United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 8

SEQ ID NO: 286448 - RNA, 22 nt, Human
ugugaagaauuaaugugaauca

SEQ ID NO: 286449 - RNA, 22 nt, Human
ggcugggagguggcgaggaggc

SEQ ID NO: 286450 - RNA, 22 nt, Human
aaauguaaacuguauuuauaaa

SEQ ID NO: 286451 - RNA, 22 nt, Human
uuuacaaggcaguuauuuuccu

SEQ ID NO: 286452 - RNA, 22 nt, Human
ggaggaugaggguggugguguu

SEQ ID NO: 286453 - RNA, 20 nt, Human
uucacagaggacucagguca

SEQ ID NO: 286454 - RNA, 22 nt, Human
aaaauaauauuauaccacugcu

SEQ ID NO: 286455 - RNA, 22 nt, Human
auguguguaugacugaaucuau

SEQ ID NO: 286456 - RNA, 22 nt, Human
ucaguggaacacacagaguggg

SEQ ID NO: 286457 - RNA, 22 nt, Human
caaaucuguuaauuucaaguug

SEQ ID NO: 286458 - RNA, 22 nt, Human
ugucccaucacagaggagacua

SEQ ID NO: 286459 - RNA, 22 nt, Human
uccuuuauuuaugggcagugua

SEQ ID NO: 286460 - RNA, 22 nt, Human
augcuuucucuucuauuucuca

SEQ ID NO: 286461 - RNA, 22 nt, Human
uuuaaucaguugguaauauuga

SEQ ID NO: 286462 - RNA, 22 nt, Human
augcugugccuggaaagcggcu

SEQ ID NO: 286463 - RNA, 22 nt, Human
cagcuccagcccaggcagcucc

SEQ ID NO: 286464 - RNA, 22 nt, Human
aggcuccucugggggccccgga

SEQ ID NO: 286465 - RNA, 22 nt, Human
ggccugcuaccagcugugaccu

SEQ ID NO: 286466 - RNA, 22 nt, Human
ugcuuucagauaucuguuucaa

SEQ ID NO: 286467 - RNA, 20 nt, Human
ucucuuuuucuucuuuucuc

SEQ ID NO: 286468 - RNA, 22 nt, Human
aucguuaugauagagaaagaga

SEQ ID NO: 286469 - RNA, 21 nt, Human
agcaucugaggcaguuuccua

SEQ ID NO: 286470 - RNA, 22 nt, Human
uuguuuucuaguguuuugaaua

SEQ ID NO: 286471 - RNA, 22 nt, Human
uuuuaaauggcuuuuacuuuuc

SEQ ID NO: 286472 - RNA, 22 nt, Human
cuguggcuaggaagcuguggga

SEQ ID NO: 286473 - RNA, 22 nt, Human
gaggccagcacccagaugcaug

SEQ ID NO: 286474 - RNA, 22 nt, Human
auucccucaagagacccacagc

SEQ ID NO: 286475 - RNA, 22 nt, Human
ccagucuuggugucuguagcac

SEQ ID NO: 286476 - RNA, 23 nt, Human
aaggugaagccaccaggugagga

SEQ ID NO: 286477 - RNA, 20 nt, Human
ucagugggaaagugagagug

SEQ ID NO: 286478 - RNA, 23 nt, Human
uaagccugugccugcuaccugcu

SEQ ID NO: 286479 - RNA, 22 nt, Human
uauauacacgcacauauacaua

SEQ ID NO: 286480 - RNA, 22 nt, Human
ggcucacuguaccugccgccgc

SEQ ID NO: 286481 - RNA, 22 nt, Human
uggcucaguaaucgagucuccu

SEQ ID NO: 286482 - RNA, 22 nt, Human
aaugaaaaucugucaguucaag

SEQ ID NO: 286483 - RNA, 20 nt, Human
gacaugagggagcaaagagc

SEQ ID NO: 286484 - RNA, 22 nt, Human
agccccaauuacagcugugcug

SEQ ID NO: 286485 - RNA, 22 nt, Human
uggggcuggccaggaggagucu

SEQ ID NO: 286486 - RNA, 22 nt, Human
cagguggauggcgagcccugca

SEQ ID NO: 286487 - RNA, 22 nt, Human
uuuucacugacuuggucuggaa

SEQ ID NO: 286488 - RNA, 22 nt, Human
uaauauaacugccaguuaaggu

SEQ ID NO: 286489 - RNA, 19 nt, Human
agagucuccacuccacuug

SEQ ID NO: 286490 - RNA, 19 nt, Human
caggucuucuuggaggacu

SEQ ID NO: 286491 - RNA, 22 nt, Human
gucugcagcacugugcacgguc

SEQ ID NO: 286492 - RNA, 22 nt, Human
uggcucaggccuacgacgccuu

SEQ ID NO: 286493 - RNA, 22 nt, Human
cuucuucaucuuuuggaggaac

SEQ ID NO: 286494 - RNA, 22 nt, Human
ccaggcuccccaggaggcccuu

SEQ ID NO: 286495 - RNA, 22 nt, Human
ugggcagggauuuggggaaacu

SEQ ID NO: 286496 - RNA, 22 nt, Human
cugucucugauaagcucgaggg

SEQ ID NO: 286497 - RNA, 22 nt, Human
ggacggggagcuggaaagggga

SEQ ID NO: 286498 - RNA, 22 nt, Human
uuucuugugauuuugaugaacu

SEQ ID NO: 286499 - RNA, 23 nt, Human
aggcugcagaagaauagggucau

SEQ ID NO: 286500 - RNA, 22 nt, Human
uuucauguuggauacuguuuca

SEQ ID NO: 286501 - RNA, 22 nt, Human
aggggaggcugggcuggggggc

SEQ ID NO: 286502 - RNA, 22 nt, Human
cuccaugagccaggagggcuac

SEQ ID NO: 286503 - RNA, 22 nt, Human
acucugcaguaaggaauuguuu

SEQ ID NO: 286504 - RNA, 22 nt, Human
aggggaggggaguaucaggauu

SEQ ID NO: 286505 - RNA, 22 nt, Human
augaagguggacagauuuuuuu

SEQ ID NO: 286506 - RNA, 22 nt, Human
aggauagacuucagaaggcaua

SEQ ID NO: 286507 - RNA, 22 nt, Human
uauauaauacacaaauauguac

SEQ ID NO: 286508 - RNA, 22 nt, Human
gcucagcuggagagggacgggu

SEQ ID NO: 286509 - RNA, 22 nt, Human
uacagaccaguaguucucagcg

SEQ ID NO: 286510 - RNA, 22 nt, Human
gagaaaaauuucuuugcugcac

SEQ ID NO: 286511 - RNA, 22 nt, Human
uguugaaacagcuauugacuuu

SEQ ID NO: 286512 - RNA, 22 nt, Human
gcuuucacugcaauagaugaau

SEQ ID NO: 286513 - RNA, 22 nt, Human
gugccugcucauucucaauauu

SEQ ID NO: 286514 - RNA, 22 nt, Human
auccugugggguauugcugcau

SEQ ID NO: 286515 - RNA, 22 nt, Human
auauuuuacagcucucguugaa

SEQ ID NO: 286516 - RNA, 22 nt, Human
uuuuccuuccugucucuuuauu

SEQ ID NO: 286517 - RNA, 22 nt, Human
cagagagcguccauccggugcc

SEQ ID NO: 286518 - RNA, 22 nt, Human
ucgagcucagcagggaggugcg

SEQ ID NO: 286519 - RNA, 22 nt, Human
ugugucuuuggcgaugucugga

SEQ ID NO: 286520 - RNA, 20 nt, Human
aggggcuguaguuagaugac

SEQ ID NO: 286521 - RNA, 22 nt, Human
gaggcuugccacuguccauggc

SEQ ID NO: 286522 - RNA, 22 nt, Human
uauuuuuuuaacauuuauugua

SEQ ID NO: 286523 - RNA, 22 nt, Human
uugguuuacucuggggauaucu

SEQ ID NO: 286524 - RNA, 22 nt, Human
aguuuccacuggagacacugug

SEQ ID NO: 286525 - RNA, 22 nt, Human
uuucuggacuaaagggagagau

SEQ ID NO: 286526 - RNA, 22 nt, Human
gccagggcucgagcaggccagc

SEQ ID NO: 286527 - RNA, 22 nt, Human
cagcuggggagagacauggcag

SEQ ID NO: 286528 - RNA, 22 nt, Human
uuuuaaaguaauugaagcuugu

SEQ ID NO: 286529 - RNA, 22 nt, Human
cacauuuuccagaagaaucaga

SEQ ID NO: 286530 - RNA, 22 nt, Human
gacuggggcauuagaguagcuu

SEQ ID NO: 286531 - RNA, 22 nt, Human
guccccugcguguucauccugg

SEQ ID NO: 286532 - RNA, 22 nt, Human
gcagggcucuggagucaggcug

SEQ ID NO: 286533 - RNA, 22 nt, Human
ucccuugacauuacuugggagg

SEQ ID NO: 286534 - RNA, 22 nt, Human
guuuauucuuuuauuugugaga

SEQ ID NO: 286535 - RNA, 23 nt, Human
caggggacaggugaccugggcuc

SEQ ID NO: 286536 - RNA, 20 nt, Human
uuguacuuaugugagaagga

SEQ ID NO: 286537 - RNA, 23 nt, Human
aaguggugacugugcuacugaga

SEQ ID NO: 286538 - RNA, 22 nt, Human
auuuuagagaaacaaacguagg

SEQ ID NO: 286539 - RNA, 22 nt, Human
ucuucaaauacagucauauuga

SEQ ID NO: 286540 - RNA, 22 nt, Human
gcagaggcugccgugggcagga

SEQ ID NO: 286541 - RNA, 22 nt, Human
ggcagagguagcuggaaccagg

SEQ ID NO: 286542 - RNA, 22 nt, Human
auuuuacuaugauaguugagaa

SEQ ID NO: 286543 - RNA, 22 nt, Human
aaaucauagccaugaacauuug

SEQ ID NO: 286544 - RNA, 17 nt, Human
ucuguguccgcucaguc

SEQ ID NO: 286545 - RNA, 22 nt, Yersinia pestis
uaaccggaucaaaaugauggaa

SEQ ID NO: 286546 - RNA, 22 nt, Yersinia pestis
auacugaagucaguuuuucgcc

SEQ ID NO: 286547 - RNA, 22 nt, Yersinia pestis
auucgggugauugcugccggua

SEQ ID NO: 286548 - RNA, 22 nt, Yersinia pestis
caccgucggcguggauaucggc

SEQ ID NO: 286549 - RNA, 22 nt, Yersinia pestis
auugaauccaugcuaaaccggu

SEQ ID NO: 286550 - RNA, 22 nt, Yersinia pestis
aagaugacgauuuugguuucug

SEQ ID NO: 286551 - RNA, 21 nt, Yersinia pestis
uccaguugguuaaugucaguu

SEQ ID NO: 286552 - RNA, 22 nt, Yersinia pestis
ucggcaccuuugaucgguaacu

SEQ ID NO: 286553 - RNA, 22 nt, Yersinia pestis
acguuguaugaacauggugugc

SEQ ID NO: 286554 - RNA, 22 nt, Yersinia pestis
ucaacaucguaccugaacgauc

SEQ ID NO: 286555 - RNA, 22 nt, Yersinia pestis
gaugucaaagcaauggaauggc

SEQ ID NO: 286556 - RNA, 22 nt, Yersinia pestis
cgggaugagaaaccgaugcuca

SEQ ID NO: 286557 - RNA, 22 nt, Yersinia pestis
ucacgguuucccguacuuuuaa

SEQ ID NO: 286558 - RNA, 22 nt, Yersinia pestis
augacuacgccguugcugaugc

SEQ ID NO: 286559 - RNA, 22 nt, Yersinia pestis
gcgguuaucugcacuguggcca

SEQ ID NO: 286560 - RNA, 22 nt, Yersinia pestis
uggcgauugccaguggugugcc

SEQ ID NO: 286561 - RNA, 22 nt, Yersinia pestis
ccagauaaguuuaaaugguuuc

SEQ ID NO: 286562 - RNA, 22 nt, Yersinia pestis
augcuggcggcuaucgauguaa

SEQ ID NO: 286563 - RNA, 22 nt, Yersinia pestis
ggcaagacgguauuuaggcgcu

SEQ ID NO: 286564 - RNA, 22 nt, Yersinia pestis
gaacauaggguggcggcuaaaa

SEQ ID NO: 286565 - RNA, 22 nt, Yersinia pestis
ggcguaauacaccauugauaag

SEQ ID NO: 286566 - RNA, 22 nt, Yersinia pestis
uuacuggcggguaguguucuuc

SEQ ID NO: 286567 - RNA, 22 nt, Yersinia pestis
aaacgcauuuauaaguucccga

SEQ ID NO: 286568 - RNA, 22 nt, Yersinia pestis
uagcuauccaguuggucaaucc

SEQ ID NO: 286569 - RNA, 22 nt, Yersinia pestis
gaauucauaagguagacuugga

SEQ ID NO: 286570 - RNA, 22 nt, Yersinia pestis
ucgauuaaucuaucauaguaag

SEQ ID NO: 286571 - RNA, 22 nt, Yersinia pestis
aaggcuaugucauuaaagaaua

SEQ ID NO: 286572 - RNA, 22 nt, Yersinia pestis
gucuucaccuccggugcgaccg

SEQ ID NO: 286573 - RNA, 22 nt, Yersinia pestis
gaauuucauagcgaugcugaug

SEQ ID NO: 286574 - RNA, 22 nt, Yersinia pestis
auuggccgaggugauuuuagcc

SEQ ID NO: 286575 - RNA, 22 nt, Yersinia pestis
aaacuuugaacaaacgcuuguu

SEQ ID NO: 286576 - RNA, 22 nt, Yersinia pestis
uaucugugguugacagacaaag

SEQ ID NO: 286577 - RNA, 22 nt, Yersinia pestis
auuguugcaggaagagggcuga

SEQ ID NO: 286578 - RNA, 22 nt, Yersinia pestis
gcgcuaucaccaagcauuauuu

SEQ ID NO: 286579 - RNA, 22 nt, Yersinia pestis
guugcugauucgucgcaauuua

SEQ ID NO: 286580 - RNA, 22 nt, Yersinia pestis
uaaccagugguuuauugcuggu

SEQ ID NO: 286581 - RNA, 19 nt, Yersinia pestis
cacgggcaagcauuuucca

SEQ ID NO: 286582 - RNA, 22 nt, Yersinia pestis
uaauacguugaucccggaugug

SEQ ID NO: 286583 - RNA, 22 nt, Yersinia pestis
aucgccauccugguguugauga

SEQ ID NO: 286584 - RNA, 22 nt, Yersinia pestis
gaccacaugggacauaugccug

SEQ ID NO: 286585 - RNA, 22 nt, Yersinia pestis
cguucauuaacggucgccaucc

SEQ ID NO: 286586 - RNA, 22 nt, Yersinia pestis
uaaugguauuaucgccgacucu

SEQ ID NO: 286587 - RNA, 22 nt, Yersinia pestis
ugggucagcaacuuuucccaga

SEQ ID NO: 286588 - RNA, 22 nt, Yersinia pestis
uacguucgcggaucaccgguuc

SEQ ID NO: 286589 - RNA, 22 nt, Yersinia pestis
uacuggauguagauuauaauga

SEQ ID NO: 286590 - RNA, 22 nt, Yersinia pestis
guggaaauuaucgaguuaccag

SEQ ID NO: 286591 - RNA, 21 nt, Yersinia pestis
aagugauucggguuauugagc

SEQ ID NO: 286592 - RNA, 22 nt, Yersinia pestis
ugcugcgugaguuuugcauuca

SEQ ID NO: 286593 - RNA, 22 nt, Yersinia pestis
cagcgcagcguccugacgcuga

SEQ ID NO: 286594 - RNA, 22 nt, Yersinia pestis
gauugcagccaguguuuccccg

SEQ ID NO: 286595 - RNA, 22 nt, Yersinia pestis
ccauggaauuacuauuuacugg

SEQ ID NO: 286596 - RNA, 22 nt, Yersinia pestis
uagaacaagguuuagcgggcaa

SEQ ID NO: 286597 - RNA, 22 nt, Yersinia pestis
gguguccggccaugaagcgauu

SEQ ID NO: 286598 - RNA, 22 nt, Yersinia pestis
guaagucgauguugcucacgua

SEQ ID NO: 286599 - RNA, 22 nt, Yersinia pestis
accaguagcaacacaaccagua

SEQ ID NO: 286600 - RNA, 22 nt, Yersinia pestis
aguuugauguuucuggguuaua

SEQ ID NO: 286601 - RNA, 22 nt, Yersinia pestis
cugugccgcagcuagccuauua

SEQ ID NO: 286602 - RNA, 22 nt, Yersinia pestis
gccauuggauaaagcacuggaa

SEQ ID NO: 286603 - RNA, 22 nt, Yersinia pestis
ccagagguuaaauauauguuaa

SEQ ID NO: 286604 - RNA, 22 nt, Yersinia pestis
acugacgauauugcguagcaua

SEQ ID NO: 286605 - RNA, 22 nt, Yersinia pestis
cucaaucauugauggcguacgg

SEQ ID NO: 286606 - RNA, 22 nt, Yersinia pestis
uucacgcuacguuauauccugc

SEQ ID NO: 286607 - RNA, 23 nt, Yersinia pestis
acucagcgucuggguuagccaau

SEQ ID NO: 286608 - RNA, 22 nt, Yersinia pestis
accggugugguguuagccacgg

SEQ ID NO: 286609 - RNA, 22 nt, Yersinia pestis
cuugccgcuucaauuugauuag

SEQ ID NO: 286610 - RNA, 22 nt, Yersinia pestis
ugacuaucaugagugcggcaac

SEQ ID NO: 286611 - RNA, 22 nt, Yersinia pestis
acguuucuuucaagaaagcacg

SEQ ID NO: 286612 - RNA, 18 nt, Yersinia pestis
cagugaucaaugccucga

SEQ ID NO: 286613 - RNA, 22 nt, Yersinia pestis
augggcauuagccaaacagaac

SEQ ID NO: 286614 - RNA, 22 nt, Yersinia pestis
gcccauuggcaguugaaguaau

SEQ ID NO: 286615 - RNA, 22 nt, Yersinia pestis
gcugacguugcccgucauacgg

SEQ ID NO: 286616 - RNA, 22 nt, Yersinia pestis
guggcaggaucugucuccucau

SEQ ID NO: 286617 - RNA, 22 nt, Yersinia pestis
gcuguagcugaggguuuguuga

SEQ ID NO: 286618 - RNA, 22 nt, Yersinia pestis
uuuccugauacauaccaucucc

SEQ ID NO: 286619 - RNA, 22 nt, Yersinia pestis
caaugucacuggaguugauggu

SEQ ID NO: 286620 - RNA, 22 nt, Yersinia pestis
auguaggagcgauguuuucugu

SEQ ID NO: 286621 - RNA, 22 nt, Yersinia pestis
guugcacugaaccccagaucuu

SEQ ID NO: 286622 - RNA, 22 nt, Yersinia pestis
uaucgguauuuaguuguauaag

SEQ ID NO: 286623 - RNA, 19 nt, Yersinia pestis
aguccugaccgguaucgcc

SEQ ID NO: 286624 - RNA, 22 nt, Yersinia pestis
ugcgagaugauuacagugccuc

SEQ ID NO: 286625 - RNA, 22 nt, Yersinia pestis
ucagcuuuaugauugugugcga

SEQ ID NO: 286626 - RNA, 22 nt, Yersinia pestis
aagugugguguugaugcagaua

SEQ ID NO: 286627 - RNA, 22 nt, Yersinia pestis
agccuuuguuuuccgucuucag

SEQ ID NO: 286628 - RNA, 22 nt, Yersinia pestis
uuugccgauaauuaacauaagc

SEQ ID NO: 286629 - RNA, 22 nt, Yersinia pestis
uuuguagacauuguuauuggua

SEQ ID NO: 286630 - RNA, 22 nt, Yersinia pestis
cugauucugguaauccauaauu

SEQ ID NO: 286631 - RNA, 22 nt, Yersinia pestis
cgcagaaauauucagagaggcg

SEQ ID NO: 286632 - RNA, 22 nt, Yersinia pestis
acaggugaaacgcuggggcuga

SEQ ID NO: 286633 - RNA, 22 nt, Yersinia pestis
ucaguuuaucgggcagguguua

SEQ ID NO: 286634 - RNA, 22 nt, Yersinia pestis
guugaugagugccugccgguag

SEQ ID NO: 286635 - RNA, 22 nt, Yersinia pestis
caagauuugcaacucagcguaa

SEQ ID NO: 286636 - RNA, 22 nt, Yersinia pestis
acgguguuccgcgaauaucugg

SEQ ID NO: 286637 - RNA, 23 nt, Yersinia pestis
ggcaaugggcacacgagcugugu

SEQ ID NO: 286638 - RNA, 22 nt, Yersinia pestis
uacuggugagauaggcucugga

SEQ ID NO: 286639 - RNA, 22 nt, Yersinia pestis
aacuuucaugcuauuacccuua

SEQ ID NO: 286640 - RNA, 20 nt, Yersinia pestis
ugcacagcuggaugugaguc

SEQ ID NO: 286641 - RNA, 22 nt, Yersinia pestis
acucugcuuguaccacaggaac

SEQ ID NO: 286642 - RNA, 22 nt, Yersinia pestis
acgaagugaaaaccuggcgcga

SEQ ID NO: 286643 - RNA, 22 nt, Yersinia pestis
gaguaguggccagacgguugag

SEQ ID NO: 286644 - RNA, 22 nt, Yersinia pestis
gcugacaguaccuugcggacgg

SEQ ID NO: 286645 - RNA, 22 nt, Yersinia pestis
uaugcccucacaucugcaacuu

SEQ ID NO: 286646 - RNA, 22 nt, Yersinia pestis
ugucaguaaauaagacccuugu

SEQ ID NO: 286647 - RNA, 22 nt, Yersinia pestis
acgcgcugcuucaacauuguag

SEQ ID NO: 286648 - RNA, 22 nt, Yersinia pestis
gcggcgaauucuaccuauaaga

SEQ ID NO: 286649 - RNA, 22 nt, Yersinia pestis
aucgccauuccguugauggaca

SEQ ID NO: 286650 - RNA, 18 nt, Yersinia pestis
gauaucauugaaauggau

SEQ ID NO: 286651 - RNA, 22 nt, Yersinia pestis
ucaucaacugcuuggcauacgg

SEQ ID NO: 286652 - RNA, 22 nt, Yersinia pestis
gguauuccaugugguugcggcu

SEQ ID NO: 286653 - RNA, 22 nt, Yersinia pestis
aaugccauggucacaucguuau

SEQ ID NO: 286654 - RNA, 22 nt, Yersinia pestis
ugaugcuaaauuuaucagcaaa

SEQ ID NO: 286655 - RNA, 22 nt, Yersinia pestis
acuaaugguuuuaugugcacua

SEQ ID NO: 286656 - RNA, 22 nt, Yersinia pestis
gaugugaucaucaaaagcguca

SEQ ID NO: 286657 - RNA, 22 nt, Yersinia pestis
uaucgauaauaugugcuguuuu

SEQ ID NO: 286658 - RNA, 22 nt, Yersinia pestis
uaacagcugcuggccacugcgu

SEQ ID NO: 286659 - RNA, 22 nt, Yersinia pestis
uccguaaucuguucgggcugau

SEQ ID NO: 286660 - RNA, 22 nt, Yersinia pestis
ggcgauugauuuauuauucuga

SEQ ID NO: 286661 - RNA, 22 nt, Yersinia pestis
cguaucaugagaaucuaaccag

SEQ ID NO: 286662 - RNA, 22 nt, Yersinia pestis
acgugguuaaguccagcgucgg

SEQ ID NO: 286663 - RNA, 22 nt, Yersinia pestis
ugaguuuauaauuucagaggcu

SEQ ID NO: 286664 - RNA, 22 nt, Yersinia pestis
cuacagggcuauagcaugcguc

SEQ ID NO: 286665 - RNA, 22 nt, Yersinia pestis
gauacguugcgauuggaaaccg

SEQ ID NO: 286666 - RNA, 19 nt, Yersinia pestis
accgcgacuugccagccaa

SEQ ID NO: 286667 - RNA, 22 nt, Yersinia pestis
uuuaaccgaugaaguguuugcc

SEQ ID NO: 286668 - RNA, 22 nt, Yersinia pestis
guugcugcucaauuuuuugcac

SEQ ID NO: 286669 - RNA, 18 nt, Yersinia pestis
acuucuuagugcgcuagc

SEQ ID NO: 286670 - RNA, 23 nt, Yersinia pestis
gaucaacacagcaggaagccgga

SEQ ID NO: 286671 - RNA, 22 nt, Yersinia pestis
ugaacaguucucugugcuggcc

SEQ ID NO: 286672 - RNA, 22 nt, Yersinia pestis
auuuccacaauuuguacugcca

SEQ ID NO: 286673 - RNA, 22 nt, Yersinia pestis
ccgcagucaaauaacaagaaua

SEQ ID NO: 286674 - RNA, 22 nt, Yersinia pestis
cuguuagccgugaaugaacucg

SEQ ID NO: 286675 - RNA, 22 nt, Yersinia pestis
caggaguucgugaaugcucugu

SEQ ID NO: 286676 - RNA, 22 nt, Yersinia pestis
ccuagccgaaacagugcucuac

SEQ ID NO: 286677 - RNA, 22 nt, Yersinia pestis
guuguagcuguuaucucgauuu

SEQ ID NO: 286678 - RNA, 22 nt, Yersinia pestis
ucguauuagagcguggcuccag

SEQ ID NO: 286679 - RNA, 22 nt, Yersinia pestis
gagagccaacagcaacggcgca

SEQ ID NO: 286680 - RNA, 22 nt, Yersinia pestis
ccgcucaucgcuuccccccugu

SEQ ID NO: 286681 - RNA, 22 nt, Yersinia pestis
cucagccgccccggagauagcg

SEQ ID NO: 286682 - RNA, 22 nt, Yersinia pestis
ugaacccaacccagcagaaagu

SEQ ID NO: 286683 - RNA, 22 nt, Yersinia pestis
uggcugccagccgcgauguguu

SEQ ID NO: 286684 - RNA, 22 nt, Yersinia pestis
uugcucgauagagauagccgga

SEQ ID NO: 286685 - RNA, 22 nt, Yersinia pestis
gccaagcuugccagaucaugaa

SEQ ID NO: 286686 - RNA, 22 nt, Yersinia pestis
acgauauuguccaugcguuaca

SEQ ID NO: 286687 - RNA, 22 nt, Yersinia pestis
uaauggcaucuucuuuagucuu

SEQ ID NO: 286688 - RNA, 22 nt, Yersinia pestis
aacggcagagcaauuuacugau

SEQ ID NO: 286689 - RNA, 22 nt, Yersinia pestis
gaacagguuaaugacaugggcc

SEQ ID NO: 286690 - RNA, 22 nt, Yersinia pestis
ccuuucagcagcgcaggaaggu

SEQ ID NO: 286691 - RNA, 22 nt, Yersinia pestis
cuggaugggagcgagagugcau

SEQ ID NO: 286692 - RNA, 22 nt, Yersinia pestis
aauggauugauacugaucugau

SEQ ID NO: 286693 - RNA, 22 nt, Yersinia pestis
ucguuaugccaacaaugauaug

SEQ ID NO: 286694 - RNA, 22 nt, Yersinia pestis
uuacuugguugaaugaaucggg

SEQ ID NO: 286695 - RNA, 22 nt, Yersinia pestis
acucgcccuuguuuuggcauuc

SEQ ID NO: 286696 - RNA, 22 nt, Yersinia pestis
gucagugcaucagaggaacagu

SEQ ID NO: 286697 - RNA, 22 nt, Yersinia pestis
auucuuugaaaacggcgaggca

SEQ ID NO: 286698 - RNA, 22 nt, Yersinia pestis
cauggguacugaaagaaccuga

SEQ ID NO: 286699 - RNA, 22 nt, Yersinia pestis
aaaccgcucaauccguugcagg

SEQ ID NO: 286700 - RNA, 22 nt, Yersinia pestis
ccgcuacuugauguacagcauu

SEQ ID NO: 286701 - RNA, 22 nt, Yersinia pestis
uguugaccacuccacggcuuau

SEQ ID NO: 286702 - RNA, 22 nt, Yersinia pestis
ucaucuuguaagaguucugccc

SEQ ID NO: 286703 - RNA, 19 nt, Yersinia pestis
aggauauuccgaugaugac

SEQ ID NO: 286704 - RNA, 22 nt, Yersinia pestis
ugagaaugccguuguguuuucu

SEQ ID NO: 286705 - RNA, 22 nt, Yersinia pestis
aguaacagcgcugcccauuggu

SEQ ID NO: 286706 - RNA, 22 nt, Yersinia pestis
uugacguuuugacgaucaaucg

SEQ ID NO: 286707 - RNA, 22 nt, Yersinia pestis
acggguaacgguggcguaaugc

SEQ ID NO: 286708 - RNA, 22 nt, Yersinia pestis
auuugucauuauuuaugagcgu

SEQ ID NO: 286709 - RNA, 21 nt, Yersinia pestis
agcaucgcuaugaaauucuug

SEQ ID NO: 286710 - RNA, 22 nt, Yersinia pestis
aagcgguaaucaguagucauug

SEQ ID NO: 286711 - RNA, 22 nt, Yersinia pestis
uggccuggguguggaugccuuu

SEQ ID NO: 286712 - RNA, 22 nt, Yersinia pestis
auuucccgaguaaccaaugaca

SEQ ID NO: 286713 - RNA, 16 nt, Yersinia pestis
uaggcaaaaacucauu

SEQ ID NO: 286714 - RNA, 22 nt, Yersinia pestis
agcgcugguuuucucgacaaau

SEQ ID NO: 286715 - RNA, 22 nt, Yersinia pestis
gaucgcugaauuacuuuccggu

SEQ ID NO: 286716 - RNA, 22 nt, Yersinia pestis
auuugcugcuugguuacggguu

SEQ ID NO: 286717 - RNA, 22 nt, Yersinia pestis
agucuuaucaaucugucauggu

SEQ ID NO: 286718 - RNA, 22 nt, Yersinia pestis
gaauugagaagacucaaagggg

SEQ ID NO: 286719 - RNA, 21 nt, Yersinia pestis
ucuggcugagcguaucagcga

SEQ ID NO: 286720 - RNA, 22 nt, Yersinia pestis
gccuuucagacugcugacaaac

SEQ ID NO: 286721 - RNA, 22 nt, Yersinia pestis
uggauccuuuagggagcgguau

SEQ ID NO: 286722 - RNA, 22 nt, Yersinia pestis
gguguucagaaugauaguugaa

SEQ ID NO: 286723 - RNA, 23 nt, Yersinia pestis
ccagcgugaacuguucuucaccc

SEQ ID NO: 286724 - RNA, 22 nt, Yersinia pestis
cuuuggauagcaaugaguuauc

SEQ ID NO: 286725 - RNA, 22 nt, Yersinia pestis
gguucacuuauuauggaauugg

SEQ ID NO: 286726 - RNA, 23 nt, Yersinia pestis
ccgaccaguggcucagccaguaa

SEQ ID NO: 286727 - RNA, 22 nt, Yersinia pestis
gcuuuccgcuucuuugucacca

SEQ ID NO: 286728 - RNA, 21 nt, Yersinia pestis
gcuaaaggugcaauccucacu

SEQ ID NO: 286729 - RNA, 23 nt, Yersinia pestis
gccuuaauuuauaucguuaaugu

SEQ ID NO: 286730 - RNA, 22 nt, Yersinia pestis
acugguugcgcaauaugggaua

SEQ ID NO: 286731 - RNA, 22 nt, Yersinia pestis
cgucugauuuacgguacccggc

SEQ ID NO: 286732 - RNA, 22 nt, Yersinia pestis
aggugagcagcaccaaacgguu

SEQ ID NO: 286733 - RNA, 22 nt, Yersinia pestis
cguccugaaggguauggcagca

SEQ ID NO: 286734 - RNA, 20 nt, Yersinia pestis
uugagugaccgggcuuuuuu

SEQ ID NO: 286735 - RNA, 22 nt, Yersinia pestis
aaugaagccaggguugcagcaa

SEQ ID NO: 286736 - RNA, 22 nt, Yersinia pestis
aucaguuucucuuuaaccucga

SEQ ID NO: 286737 - RNA, 22 nt, Yersinia pestis
guugaugcuggcauuguccaug

SEQ ID NO: 286738 - RNA, 22 nt, Yersinia pestis
uguucccgcagaugccaguacc

SEQ ID NO: 286739 - RNA, 22 nt, Yersinia pestis
auucuggcuggggaucauaucu

SEQ ID NO: 286740 - RNA, 22 nt, Yersinia pestis
auucagaugccaaucuucuugg

SEQ ID NO: 286741 - RNA, 22 nt, Yersinia pestis
gacugaaaucaugcacgguuug

SEQ ID NO: 286742 - RNA, 22 nt, Yersinia pestis
aaagcugauccggcgcaggcgg

SEQ ID NO: 286743 - RNA, 22 nt, Yersinia pestis
uggacgacguguugauucaacu

SEQ ID NO: 286744 - RNA, 22 nt, Yersinia pestis
aguaacguuagucauuaaucag

SEQ ID NO: 286745 - RNA, 22 nt, Yersinia pestis
uguaucuugcaagguuggugua

SEQ ID NO: 286746 - RNA, 22 nt, Yersinia pestis
auugcuugcaggugcugcgggu

SEQ ID NO: 286747 - RNA, 22 nt, Yersinia pestis
caguguuguuugguuuagggcu

SEQ ID NO: 286748 - RNA, 22 nt, Yersinia pestis
auggucgguucuauguuggcug

SEQ ID NO: 286749 - RNA, 22 nt, Yersinia pestis
ucacccugaauuugguguguug

SEQ ID NO: 286750 - RNA, 22 nt, Yersinia pestis
ugucguuaauucaaaguaaugc

SEQ ID NO: 286751 - RNA, 21 nt, Yersinia pestis
caugaugauguccacucucgc

SEQ ID NO: 286752 - RNA, 22 nt, Yersinia pestis
uuggcgcugaggcagugaagca

SEQ ID NO: 286753 - RNA, 21 nt, Yersinia pestis
cuguucagugcguucgauacu

SEQ ID NO: 286754 - RNA, 22 nt, Yersinia pestis
cgugaucuucacugcgcacgau

SEQ ID NO: 286755 - RNA, 22 nt, Yersinia pestis
gcaauguccgaucgagugcagg

SEQ ID NO: 286756 - RNA, 19 nt, Yersinia pestis
aaaugagucuugcagagau

SEQ ID NO: 286757 - RNA, 23 nt, Yersinia pestis
cagcggauaauggauccgauggu

SEQ ID NO: 286758 - RNA, 22 nt, Yersinia pestis
agucgccgcaaccggugauggc

SEQ ID NO: 286759 - RNA, 22 nt, Yersinia pestis
aaacucggccuuucagucaugc

SEQ ID NO: 286760 - RNA, 21 nt, Yersinia pestis
gugaacggcgaauuaccgcuu

SEQ ID NO: 286761 - RNA, 19 nt, Yersinia pestis
cgguggcauugauggucag

SEQ ID NO: 286762 - RNA, 22 nt, Yersinia pestis
uggcauugcuauugguggucgu

SEQ ID NO: 286763 - RNA, 22 nt, Yersinia pestis
aacgucagaagacaguugaucg

SEQ ID NO: 286764 - RNA, 22 nt, Yersinia pestis
acguuagcaugaugauuguugu

SEQ ID NO: 286765 - RNA, 22 nt, Yersinia pestis
auaaccugcgucacuguauucu

SEQ ID NO: 286766 - RNA, 22 nt, Yersinia pestis
ugacccuuuucgguauuggauu

SEQ ID NO: 286767 - RNA, 22 nt, Yersinia pestis
uugagcguuauccggggguguu

SEQ ID NO: 286768 - RNA, 22 nt, Yersinia pestis
agccaguucuucaucugaugga

SEQ ID NO: 286769 - RNA, 22 nt, Yersinia pestis
agguacccaauaauauuccggc

SEQ ID NO: 286770 - RNA, 22 nt, Yersinia pestis
agaaauugguauccgucgucuu

SEQ ID NO: 286771 - RNA, 22 nt, Yersinia pestis
gccgauguggguauguugggcc

SEQ ID NO: 286772 - RNA, 22 nt, Yersinia pestis
cggcaacaauacacuggguuac

SEQ ID NO: 286773 - RNA, 22 nt, Yersinia pestis
auugugcuuucugaugccugau

SEQ ID NO: 286774 - RNA, 22 nt, Yersinia pestis
agcgcuuucuggguaucugccu

SEQ ID NO: 286775 - RNA, 22 nt, Yersinia pestis
aguggcgauaccggcaguaggc

SEQ ID NO: 286776 - RNA, 23 nt, Yersinia pestis
aucacccgcuuccagaaaaucaa

SEQ ID NO: 286777 - RNA, 22 nt, Yersinia pestis
ugacuaaucgacggcugccuca

SEQ ID NO: 286778 - RNA, 22 nt, Yersinia pestis
uaccucaaucacugggcugcac

SEQ ID NO: 286779 - RNA, 22 nt, Yersinia pestis
agauuaucgccaccauucuggu

SEQ ID NO: 286780 - RNA, 22 nt, Yersinia pestis
auugccguaaaugagugagucg

SEQ ID NO: 286781 - RNA, 22 nt, Yersinia pestis
augggcugguuagcauuaucuu

SEQ ID NO: 286782 - RNA, 22 nt, Yersinia pestis
ggucauugccaucgccacuuuu

SEQ ID NO: 286783 - RNA, 22 nt, Yersinia pestis
ggcuaauagcgucaaaaguaca

SEQ ID NO: 286784 - RNA, 20 nt, Yersinia pestis
uccucugggguuacggcggc

SEQ ID NO: 286785 - RNA, 22 nt, Yersinia pestis
uccauuggucuauaucugcuuc

SEQ ID NO: 286786 - RNA, 22 nt, Yersinia pestis
ucaagcuggcgaauaugacgag

SEQ ID NO: 286787 - RNA, 22 nt, Yersinia pestis
ggaugcgguugcugcccugaaa

SEQ ID NO: 286788 - RNA, 22 nt, Yersinia pestis
gcuuaugcauuaggugcgucuu

SEQ ID NO: 286789 - RNA, 22 nt, Yersinia pestis
acaacgguaagaaagccgggcg

SEQ ID NO: 286790 - RNA, 22 nt, Yersinia pestis
auugucagcaacgaaaaaaggc

SEQ ID NO: 286791 - RNA, 22 nt, Yersinia pestis
auaaugccuugauugaaggaga

SEQ ID NO: 286792 - RNA, 22 nt, Yersinia pestis
ugacggcuuaaugagcacgcuu

SEQ ID NO: 286793 - RNA, 22 nt, Yersinia pestis
uguaacaauuuaaaugugguag

SEQ ID NO: 286794 - RNA, 22 nt, Yersinia pestis
auggauggcaaguuaacgugcu

SEQ ID NO: 286795 - RNA, 22 nt, Yersinia pestis
ccagcgagacgucacccgcgcu

SEQ ID NO: 286796 - RNA, 22 nt, Yersinia pestis
auucaacggaauagccacgagu

SEQ ID NO: 286797 - RNA, 22 nt, Yersinia pestis
caguagacggucauagaguugu

SEQ ID NO: 286798 - RNA, 22 nt, Yersinia pestis
ugugauccgcaugagugaugcg

SEQ ID NO: 286799 - RNA, 22 nt, Yersinia pestis
gccagucaaggggucuaugauu

SEQ ID NO: 286800 - RNA, 22 nt, Yersinia pestis
uuaccaccauauuuaacaucga

SEQ ID NO: 286801 - RNA, 22 nt, Yersinia pestis
auuagcgaacugaaucuacugc

SEQ ID NO: 286802 - RNA, 22 nt, Yersinia pestis
cgaucauuuuggacuuaauucg

SEQ ID NO: 286803 - RNA, 19 nt, Yersinia pestis
acugccacaggaagagggc

SEQ ID NO: 286804 - RNA, 18 nt, Yersinia pestis
ccaucaugaaacaacuga

SEQ ID NO: 286805 - RNA, 22 nt, Yersinia pestis
cuggaagguuaauugauggggu

SEQ ID NO: 286806 - RNA, 23 nt, Yersinia pestis
agcugucagggauguaguuuugc

SEQ ID NO: 286807 - RNA, 22 nt, Yersinia pestis
uugcagaucaaagugaaugaag

SEQ ID NO: 286808 - RNA, 22 nt, Yersinia pestis
gcggugcugcucgguuuuggug

SEQ ID NO: 286809 - RNA, 23 nt, Yersinia pestis
gucagcagauuaccuauuucggg

SEQ ID NO: 286810 - RNA, 22 nt, Yersinia pestis
gcgaauaaguucaucgggauuc

SEQ ID NO: 286811 - RNA, 22 nt, Yersinia pestis
cuggguuaagcucgguagcgca

SEQ ID NO: 286812 - RNA, 22 nt, Yersinia pestis
ucaagucguuggcucagugacu

SEQ ID NO: 286813 - RNA, 22 nt, Yersinia pestis
ugccaccgguauuuggacauuc

SEQ ID NO: 286814 - RNA, 22 nt, Yersinia pestis
aucuuuggaucuaaacgggccu

SEQ ID NO: 286815 - RNA, 20 nt, Yersinia pestis
uugccagagauugcgcacgu

SEQ ID NO: 286816 - RNA, 22 nt, Yersinia pestis
gucgggcugauuuguagcgguu

SEQ ID NO: 286817 - RNA, 22 nt, Yersinia pestis
uugcuaucuuugccguagugau

SEQ ID NO: 286818 - RNA, 22 nt, Yersinia pestis
agcuaaauacgaucuaaugaau

SEQ ID NO: 286819 - RNA, 22 nt, Yersinia pestis
ugaugugaucaccauggcgaaa

SEQ ID NO: 286820 - RNA, 19 nt, Yersinia pestis
ucgcugcgccguauugauc

SEQ ID NO: 286821 - RNA, 18 nt, Yersinia pestis
gugccgaucaccgggugc

SEQ ID NO: 286822 - RNA, 22 nt, Yersinia pestis
cucuugaaggugaagccauccg

SEQ ID NO: 286823 - RNA, 22 nt, Yersinia pestis
gguugcucaauugguaccucag

SEQ ID NO: 286824 - RNA, 22 nt, Yersinia pestis
aaagguauuuacugauccaaaa

SEQ ID NO: 286825 - RNA, 22 nt, Yersinia pestis
uuaccgguguucgcgguugaug

SEQ ID NO: 286826 - RNA, 23 nt, Yersinia pestis
ugauggcgagugagcugugucga

SEQ ID NO: 286827 - RNA, 22 nt, Yersinia pestis
uggcuauauuaugaucaaaccc

SEQ ID NO: 286828 - RNA, 22 nt, Yersinia pestis
cuuuaagacuuaugguugcggu

SEQ ID NO: 286829 - RNA, 21 nt, Yersinia pestis
cugcagugaaugaccgccuac

SEQ ID NO: 286830 - RNA, 21 nt, Yersinia pestis
gcgauugaaagucacaccgag

SEQ ID NO: 286831 - RNA, 22 nt, Yersinia pestis
auguuaucaaggcgcuauuuga

SEQ ID NO: 286832 - RNA, 22 nt, Yersinia pestis
acaucagagcucaauuuaacgg

SEQ ID NO: 286833 - RNA, 22 nt, Yersinia pestis
caggcuaugugcugguccagau

SEQ ID NO: 286834 - RNA, 22 nt, Yersinia pestis
gaagcaguuuccaaugagaaau

SEQ ID NO: 286835 - RNA, 22 nt, Yersinia pestis
gcgacucauugacacugagcaa

SEQ ID NO: 286836 - RNA, 21 nt, Yersinia pestis
gauaucugccggauauuuuuc

SEQ ID NO: 286837 - RNA, 21 nt, Yersinia pestis
gaugaugacgggcuuggcgcu

SEQ ID NO: 286838 - RNA, 22 nt, Yersinia pestis
gcauauccugcuucuuuauaua

SEQ ID NO: 286839 - RNA, 22 nt, Yersinia pestis
uguaaggaugcaaucaggggca

SEQ ID NO: 286840 - RNA, 22 nt, Yersinia pestis
cagcaaauugcauugauggggu

SEQ ID NO: 286841 - RNA, 22 nt, Yersinia pestis
cuggaugcauucaauaaaggcu

SEQ ID NO: 286842 - RNA, 22 nt, Yersinia pestis
cggcaacuuuauaucgaaaugc

SEQ ID NO: 286843 - RNA, 22 nt, Yersinia pestis
gguuaucgguggucuaaaaaaa

SEQ ID NO: 286844 - RNA, 23 nt, Yersinia pestis
ugcccguggcacaacuguguggc

SEQ ID NO: 286845 - RNA, 22 nt, Yersinia pestis
aaccaucugaucacgggugacc

SEQ ID NO: 286846 - RNA, 22 nt, Yersinia pestis
cagguagucagaugaaaagguc

SEQ ID NO: 286847 - RNA, 22 nt, Yersinia pestis
uacaggcucuaaucguauugug

SEQ ID NO: 286848 - RNA, 19 nt, Yersinia pestis
uguagugaugcugaauuua

SEQ ID NO: 286849 - RNA, 22 nt, Yersinia pestis
acgagcaucaauuucuggcaac

SEQ ID NO: 286850 - RNA, 22 nt, Yersinia pestis
uugcuacggucaucuuuauaau

SEQ ID NO: 286851 - RNA, 22 nt, Yersinia pestis
ugauccgcucuuuaugacgcac

SEQ ID NO: 286852 - RNA, 22 nt, Yersinia pestis
ugguauaggccugaaaauaagc

SEQ ID NO: 286853 - RNA, 22 nt, Yersinia pestis
ugccauguuuaucgccauguug

SEQ ID NO: 286854 - RNA, 22 nt, Yersinia pestis
auucaguuccugauauggggug

SEQ ID NO: 286855 - RNA, 22 nt, Yersinia pestis
agcacauuuuauucaggcgaca

SEQ ID NO: 286856 - RNA, 22 nt, Yersinia pestis
aaggacuugggaucauugucuc

SEQ ID NO: 286857 - RNA, 20 nt, Yersinia pestis
aagcguuuguaguaacguuu

SEQ ID NO: 286858 - RNA, 22 nt, Yersinia pestis
accacguggaugaaaaaacgcc

SEQ ID NO: 286859 - RNA, 22 nt, Yersinia pestis
ugaagugaugaucaacgcagcc

SEQ ID NO: 286860 - RNA, 22 nt, Yersinia pestis
agugcugcuugagaacuuacua

SEQ ID NO: 286861 - RNA, 22 nt, Yersinia pestis
ggcuggcaaacguuucacacuc

SEQ ID NO: 286862 - RNA, 22 nt, Yersinia pestis
gcgcugaauuacuccguugguu

SEQ ID NO: 286863 - RNA, 22 nt, Yersinia pestis
guccauaaaaauagcccugucu

SEQ ID NO: 286864 - RNA, 22 nt, Yersinia pestis
gaugauguucuucaaaacaaag

SEQ ID NO: 286865 - RNA, 22 nt, Yersinia pestis
uugcaaugaauguuaauggugu

SEQ ID NO: 286866 - RNA, 22 nt, Yersinia pestis
gcuggcuuaaugaucaagcggc

SEQ ID NO: 286867 - RNA, 22 nt, Yersinia pestis
aaacgcauauugcuggucggcu

SEQ ID NO: 286868 - RNA, 22 nt, Yersinia pestis
acgccgcuucaaagaugacguu

SEQ ID NO: 286869 - RNA, 22 nt, Yersinia pestis
uuaucugauaugaaugaacugc

SEQ ID NO: 286870 - RNA, 22 nt, Yersinia pestis
uacguugauuagacggagggau

SEQ ID NO: 286871 - RNA, 22 nt, Yersinia pestis
uuggauauuggcccgugggugu

SEQ ID NO: 286872 - RNA, 22 nt, Yersinia pestis
auucgcguugcaguaaggcagu

SEQ ID NO: 286873 - RNA, 22 nt, Yersinia pestis
uggacugaugagccgcuuauuu

SEQ ID NO: 286874 - RNA, 22 nt, Yersinia pestis
uauuacacaaucuggauaucaa

SEQ ID NO: 286875 - RNA, 22 nt, Yersinia pestis
gguaauggcgaaagcuccgcag

SEQ ID NO: 286876 - RNA, 22 nt, Yersinia pestis
acgucuaaauagaaaaugacgg

SEQ ID NO: 286877 - RNA, 22 nt, Yersinia pestis
cuuugucaauaaccucuaaucu

SEQ ID NO: 286878 - RNA, 22 nt, Yersinia pestis
cggcacucuugacgaggcguuu

SEQ ID NO: 286879 - RNA, 22 nt, Yersinia pestis
uacgcugaguugcaaaucuuga

SEQ ID NO: 286880 - RNA, 22 nt, Yersinia pestis
ggccgucagaguauucauuagc

SEQ ID NO: 286881 - RNA, 22 nt, Yersinia pestis
gcaguagaacuacagccuggac

SEQ ID NO: 286882 - RNA, 22 nt, Yersinia pestis
uuauuggcagucuugagcuaac

SEQ ID NO: 286883 - RNA, 22 nt, Yersinia pestis
gcggcacuuagguugagguuag

SEQ ID NO: 286884 - RNA, 22 nt, Yersinia pestis
gguaucgguauugaugaauugu

SEQ ID NO: 286885 - RNA, 22 nt, Yersinia pestis
gagcccgugauuugaaagggau

SEQ ID NO: 286886 - RNA, 16 nt, Yersinia pestis
uggcuaugguaauccu

SEQ ID NO: 286887 - RNA, 18 nt, Yersinia pestis
uggaaugccaugauaguu

SEQ ID NO: 286888 - RNA, 22 nt, Yersinia pestis
ccgcauuaugggcaggggccgc

SEQ ID NO: 286889 - RNA, 20 nt, Yersinia pestis
agaaaucgacuuuacuggcg

SEQ ID NO: 286890 - RNA, 22 nt, Yersinia pestis
auuuggcaaugaaugccgauau

SEQ ID NO: 286891 - RNA, 22 nt, Yersinia pestis
cagugccuggauauaucuguau

SEQ ID NO: 286892 - RNA, 22 nt, Yersinia pestis
cguacuuuacguaaagaaacgu

SEQ ID NO: 286893 - RNA, 23 nt, Yersinia pestis
guacacgaacgcgcaggcuuggc

SEQ ID NO: 286894 - RNA, 22 nt, Yersinia pestis
aguaugcuggcgcuguugcugg

SEQ ID NO: 286895 - RNA, 20 nt, Yersinia pestis
caguucaauuucgagggcuu

SEQ ID NO: 286896 - RNA, 22 nt, Yersinia pestis
augugcuguugaaugcuggcaa

SEQ ID NO: 286897 - RNA, 22 nt, Yersinia pestis
ugacugaugggcgguuauccaa

SEQ ID NO: 286898 - RNA, 22 nt, Yersinia pestis
uugccagcauucaacagcacau

SEQ ID NO: 286899 - RNA, 22 nt, Yersinia pestis
aagauuacguucaccgcauugg

SEQ ID NO: 286900 - RNA, 22 nt, Yersinia pestis
ccgaugaugcagcaguaucuuc

SEQ ID NO: 286901 - RNA, 22 nt, Yersinia pestis
uacuugaaucuauuaugauagu

SEQ ID NO: 286902 - RNA, 22 nt, Yersinia pestis
gacgcuuuugauccggcgcugg

SEQ ID NO: 286903 - RNA, 22 nt, Yersinia pestis
uaccuauuuugacaucauugau

SEQ ID NO: 286904 - RNA, 22 nt, Yersinia pestis
ugccaagcacuuugcggcuuua

SEQ ID NO: 286905 - RNA, 22 nt, Yersinia pestis
aaccguuuggugcugcucaccu

SEQ ID NO: 286906 - RNA, 22 nt, Yersinia pestis
ugauggcggacagugguauaac

SEQ ID NO: 286907 - RNA, 22 nt, Yersinia pestis
cacugcaauaugucuggaucgg

SEQ ID NO: 286908 - RNA, 22 nt, Yersinia pestis
ggcaacauucagcggaacggau

SEQ ID NO: 286909 - RNA, 22 nt, Yersinia pestis
cuguauugcgccaaugacugug

SEQ ID NO: 286910 - RNA, 22 nt, Yersinia pestis
caagauggcguguauaacgaug

SEQ ID NO: 286911 - RNA, 22 nt, Yersinia pestis
aacuggcagcagauaccgcuaa

SEQ ID NO: 286912 - RNA, 22 nt, Yersinia pestis
uggcgauguacauucagggcgu

SEQ ID NO: 286913 - RNA, 18 nt, Yersinia pestis
ugccacggguguuauugg

SEQ ID NO: 286914 - RNA, 22 nt, Yersinia pestis
ucucauauucccauggguugau

SEQ ID NO: 286915 - RNA, 23 nt, Yersinia pestis
aucgacgguuaaaccgcuacugg

SEQ ID NO: 286916 - RNA, 19 nt, Yersinia pestis
gcaguagguuaaauuagcc

SEQ ID NO: 286917 - RNA, 22 nt, Yersinia pestis
uagcacaucaccggguugcagu

SEQ ID NO: 286918 - RNA, 23 nt, Yersinia pestis
ggagauauuuugcguguagccgg

SEQ ID NO: 286919 - RNA, 22 nt, Yersinia pestis
uaucucgcagcaaauugguuau

SEQ ID NO: 286920 - RNA, 22 nt, Yersinia pestis
uugauaguagauaacugauagu

SEQ ID NO: 286921 - RNA, 18 nt, Yersinia pestis
cguugaugcagaugaagu

SEQ ID NO: 286922 - RNA, 22 nt, Yersinia pestis
guacgguggacaguuauuucaa

SEQ ID NO: 286923 - RNA, 22 nt, Yersinia pestis
uugagaaaacucuuauagugcu

SEQ ID NO: 286924 - RNA, 22 nt, Yersinia pestis
ccaguuggaugaucgccuggca

SEQ ID NO: 286925 - RNA, 22 nt, Yersinia pestis
gccugaucggucaacaacagua

SEQ ID NO: 286926 - RNA, 22 nt, Yersinia pestis
gcagcauacaacuuccgcauca

SEQ ID NO: 286927 - RNA, 22 nt, Yersinia pestis
uuagcucgacguuaucugccgu

SEQ ID NO: 286928 - RNA, 22 nt, Yersinia pestis
agaucagcuauccggguugaaa

SEQ ID NO: 286929 - RNA, 22 nt, Yersinia pestis
agauuaagcgccucaaacaggc

SEQ ID NO: 286930 - RNA, 22 nt, Yersinia pestis
gaguaucggugaguugaugauc

SEQ ID NO: 286931 - RNA, 22 nt, Yersinia pestis
cuggcuauggacugugcggcuu

SEQ ID NO: 286932 - RNA, 22 nt, Yersinia pestis
agauguuuuccaguugaucaug

SEQ ID NO: 286933 - RNA, 22 nt, Yersinia pestis
aaugugugcugaaauggucgcu

SEQ ID NO: 286934 - RNA, 22 nt, Yersinia pestis
ugaagagcguaucgacgcgcug

SEQ ID NO: 286935 - RNA, 20 nt, Yersinia pestis
uuggcgagcuggaacgcgcu

SEQ ID NO: 286936 - RNA, 22 nt, Yersinia pestis
gacggugagucagcccgugagu

SEQ ID NO: 286937 - RNA, 22 nt, Yersinia pestis
caaucguuguuucugauagcga

SEQ ID NO: 286938 - RNA, 19 nt, Yersinia pestis
gcaucauauaauuauuggu

SEQ ID NO: 286939 - RNA, 22 nt, Yersinia pestis
ucaucggaaggaugagacgaau

SEQ ID NO: 286940 - RNA, 22 nt, Yersinia pestis
guggugcaguuaugguugaucu

SEQ ID NO: 286941 - RNA, 22 nt, Yersinia pestis
uauaccaaccugcaaggaugcc

SEQ ID NO: 286942 - RNA, 22 nt, Yersinia pestis
caacccgucaacuauguugcaa

SEQ ID NO: 286943 - RNA, 22 nt, Yersinia pestis
uggcagcaugucguuccucggu

SEQ ID NO: 286944 - RNA, 22 nt, Yersinia pestis
ucacuugggugcauuggaugaa

SEQ ID NO: 286945 - RNA, 22 nt, Yersinia pestis
uucgggauagggaaaaguuaac

SEQ ID NO: 286946 - RNA, 21 nt, Yersinia pestis
aagccguuggugaguuuggua

SEQ ID NO: 286947 - RNA, 22 nt, Yersinia pestis
uugacaugcaguucagucagga

SEQ ID NO: 286948 - RNA, 22 nt, Yersinia pestis
gcgagugaucaccgcguugugu

SEQ ID NO: 286949 - RNA, 22 nt, Yersinia pestis
ugucagaaggucucuauguaau

SEQ ID NO: 286950 - RNA, 22 nt, Yersinia pestis
ugcugccaucaccgcauagaua

SEQ ID NO: 286951 - RNA, 23 nt, Yersinia pestis
ucgccgaugugauguuugcaaug

SEQ ID NO: 286952 - RNA, 23 nt, Yersinia pestis
cccacagguuuuuacccauccuc

SEQ ID NO: 286953 - RNA, 19 nt, Yersinia pestis
aucgggauuugugcgcugc

SEQ ID NO: 286954 - RNA, 22 nt, Yersinia pestis
ggccuucagaaugcugacaaac

SEQ ID NO: 286955 - RNA, 22 nt, Yersinia pestis
agcggcacaagauaccuuaccg

SEQ ID NO: 286956 - RNA, 22 nt, Yersinia pestis
acggcaaauauguucuggcugg

SEQ ID NO: 286957 - RNA, 22 nt, Yersinia pestis
acuguugauggcgacuucguua

SEQ ID NO: 286958 - RNA, 22 nt, Yersinia pestis
aaucuuguggcuaauaugaugg

SEQ ID NO: 286959 - RNA, 22 nt, Yersinia pestis
gaucccucguggagaggcucaa

SEQ ID NO: 286960 - RNA, 22 nt, Yersinia pestis
ccgugcuggcgagaguggucac

SEQ ID NO: 286961 - RNA, 22 nt, Yersinia pestis
guauggcgguguccaccagcag

SEQ ID NO: 286962 - RNA, 21 nt, Yersinia pestis
uuacacccauuuucgggaacu

SEQ ID NO: 286963 - RNA, 23 nt, Yersinia pestis
ggcuggucacagugagaucgcac

SEQ ID NO: 286964 - RNA, 20 nt, Yersinia pestis
ucacucacuuauucgccugu

SEQ ID NO: 286965 - RNA, 22 nt, Yersinia pestis
auaagccaccugcgugauguga

SEQ ID NO: 286966 - RNA, 23 nt, Yersinia pestis
ugaugcagagcuggauaugcguc

SEQ ID NO: 286967 - RNA, 22 nt, Yersinia pestis
gcgcuguuuuuauaaauaaccc

SEQ ID NO: 286968 - RNA, 22 nt, Yersinia pestis
cuuaaucugucugguuaucagg

SEQ ID NO: 286969 - RNA, 22 nt, Yersinia pestis
agcgacuguaccaugccgauca

SEQ ID NO: 286970 - RNA, 21 nt, Yersinia pestis
uaacagggcuaguucagcucg

SEQ ID NO: 286971 - RNA, 22 nt, Yersinia pestis
aggccacugucagcugaacuga

SEQ ID NO: 286972 - RNA, 22 nt, Yersinia pestis
cgaucguggucagcauguguug

SEQ ID NO: 286973 - RNA, 22 nt, Yersinia pestis
ucuucaguggccgugaugaaau

SEQ ID NO: 286974 - RNA, 22 nt, Yersinia pestis
agccguuaugguuuuguccaga

SEQ ID NO: 286975 - RNA, 22 nt, Yersinia pestis
auucucaaacggauugcucgcc

SEQ ID NO: 286976 - RNA, 21 nt, Yersinia pestis
uggaaugccauuggugauccu

SEQ ID NO: 286977 - RNA, 22 nt, Yersinia pestis
ccugacauaggcuagcugauaa

SEQ ID NO: 286978 - RNA, 22 nt, Yersinia pestis
gcuaucagcccuggaugaagau

SEQ ID NO: 286979 - RNA, 21 nt, Yersinia pestis
caugaucguccaugaagcggc

SEQ ID NO: 286980 - RNA, 22 nt, Yersinia pestis
accaagguuuaugguuuucaau

SEQ ID NO: 286981 - RNA, 22 nt, Yersinia pestis
ugugagucacaguauuaaaaug

SEQ ID NO: 286982 - RNA, 22 nt, Yersinia pestis
uugacgcauugaaaaguaauaa

SEQ ID NO: 286983 - RNA, 22 nt, Yersinia pestis
auccuucgcguugcaggggggg

SEQ ID NO: 286984 - RNA, 22 nt, Yersinia pestis
ugcucgcacagggucuggcgua

SEQ ID NO: 286985 - RNA, 22 nt, Yersinia pestis
gcucauuaauuccgaugagcuu

SEQ ID NO: 286986 - RNA, 19 nt, Yersinia pestis
cgccaagggccaaugccag

SEQ ID NO: 286987 - RNA, 22 nt, Yersinia pestis
cgacaucaguaggauaugcaag

SEQ ID NO: 286988 - RNA, 22 nt, Yersinia pestis
cagggcuguuuacacgcaagau

SEQ ID NO: 286989 - RNA, 22 nt, Yersinia pestis
ugccugaacaauuuuuguggcg

SEQ ID NO: 286990 - RNA, 22 nt, Yersinia pestis
ugcggccuaaauaccgcuugcc

SEQ ID NO: 286991 - RNA, 22 nt, Yersinia pestis
uugaucaacugcugacgcugua

SEQ ID NO: 286992 - RNA, 22 nt, Yersinia pestis
agcaaguacuacucagccgaug

SEQ ID NO: 286993 - RNA, 22 nt, Yersinia pestis
ugcaaugguuccgauuuucauu

SEQ ID NO: 286994 - RNA, 22 nt, Yersinia pestis
acgcaguggccagcagcuguua

SEQ ID NO: 286995 - RNA, 22 nt, Yersinia pestis
uacggcagcgaucaucagcggu

SEQ ID NO: 286996 - RNA, 22 nt, Yersinia pestis
accggugcugcguuugacagcu

SEQ ID NO: 286997 - RNA, 22 nt, Yersinia pestis
gugaacaguacuuugcccguag

SEQ ID NO: 286998 - RNA, 22 nt, Yersinia pestis
aucugauucaaaccauuaaccu

SEQ ID NO: 286999 - RNA, 22 nt, Yersinia pestis
cggcggauaaugauaucaaucc

SEQ ID NO: 287000 - RNA, 22 nt, Yersinia pestis
auugaucugauuuuacugaaag

SEQ ID NO: 287001 - RNA, 20 nt, Yersinia pestis
aacauaucuugcacggguga

SEQ ID NO: 287002 - RNA, 22 nt, Yersinia pestis
agcuugaauaccugggauaauu

SEQ ID NO: 287003 - RNA, 22 nt, Yersinia pestis
ggcaaauaucauuuauucgucg

SEQ ID NO: 287004 - RNA, 22 nt, Yersinia pestis
caggcucauugcguaugcagag

SEQ ID NO: 287005 - RNA, 22 nt, Yersinia pestis
uucgcgggcauauuuuuagucu

SEQ ID NO: 287006 - RNA, 22 nt, Yersinia pestis
guagugaucgagcuacuagcga

SEQ ID NO: 287007 - RNA, 22 nt, Yersinia pestis
cggaaugugcgaaaacacgucc

SEQ ID NO: 287008 - RNA, 22 nt, Yersinia pestis
aguugacgggguuagaucggau

SEQ ID NO: 287009 - RNA, 22 nt, Yersinia pestis
gcuuaaguaaagaugacaucug

SEQ ID NO: 287010 - RNA, 21 nt, Yersinia pestis
uaucaagguacaagacccuga

SEQ ID NO: 287011 - RNA, 22 nt, Yersinia pestis
ucgcuauacgcaaauccgggcu

SEQ ID NO: 287012 - RNA, 22 nt, Yersinia pestis
uuauagguagaauucgccgcgu

SEQ ID NO: 287013 - RNA, 22 nt, Yersinia pestis
ugcgguagcaagucuguuauaa

SEQ ID NO: 287014 - RNA, 22 nt, Yersinia pestis
ccuguucacgauaggcgguguu

SEQ ID NO: 287015 - RNA, 22 nt, Yersinia pestis
uuuggcaaaacuaucagguaaa

SEQ ID NO: 287016 - RNA, 22 nt, Yersinia pestis
gacagauggucagggagucggu

SEQ ID NO: 287017 - RNA, 16 nt, Yersinia pestis
agaacugcgccaacug

SEQ ID NO: 287018 - RNA, 22 nt, Yersinia pestis
cauggcuuucgugguuugauca

SEQ ID NO: 287019 - RNA, 22 nt, Yersinia pestis
augaucuggagguucgguucaa

SEQ ID NO: 287020 - RNA, 20 nt, Yersinia pestis
uugcugaucaauuagccggu

SEQ ID NO: 287021 - RNA, 22 nt, Yersinia pestis
ggacgaucagguuuugcucauu

SEQ ID NO: 287022 - RNA, 22 nt, Yersinia pestis
cccgguuuaucagugaaucugg

SEQ ID NO: 287023 - RNA, 22 nt, Yersinia pestis
caaagauuauugguuaguugcg

SEQ ID NO: 287024 - RNA, 19 nt, Yersinia pestis
caucauuugcaacucccau

SEQ ID NO: 287025 - RNA, 18 nt, Yersinia pestis
ggagaugcaugaauuggc

SEQ ID NO: 287026 - RNA, 22 nt, Yersinia pestis
uugcuucagccacguuugcuga

SEQ ID NO: 287027 - RNA, 22 nt, Yersinia pestis
aguagugccuuacguagcauga

SEQ ID NO: 287028 - RNA, 22 nt, Yersinia pestis
gcaggcguguugguggcuaccu

SEQ ID NO: 287029 - RNA, 22 nt, Yersinia pestis
aaucggugcgccaucaccaaua

SEQ ID NO: 287030 - RNA, 22 nt, Yersinia pestis
cgggagguuccccaacaacaaa

SEQ ID NO: 287031 - RNA, 22 nt, Yersinia pestis
aacugcuccuuuagccgugauu

SEQ ID NO: 287032 - RNA, 22 nt, Yersinia pestis
uauggcugcauuauuaucugau

SEQ ID NO: 287033 - RNA, 22 nt, Yersinia pestis
uucacuugauucaagauacccg

SEQ ID NO: 287034 - RNA, 22 nt, Yersinia pestis
agcccgauaccauaaaaccgga

SEQ ID NO: 287035 - RNA, 22 nt, Yersinia pestis
ggcgcaauuggguugagcuaua

SEQ ID NO: 287036 - RNA, 19 nt, Yersinia pestis
uacugcugcuagacaaaug

SEQ ID NO: 287037 - RNA, 22 nt, Yersinia pestis
cgcggcuaaugagagacuuuaa

SEQ ID NO: 287038 - RNA, 22 nt, Yersinia pestis
ugcugccaucuauuuagccagc

SEQ ID NO: 287039 - RNA, 22 nt, Yersinia pestis
ccuuacauccgauagccgguca

SEQ ID NO: 287040 - RNA, 22 nt, Yersinia pestis
ggcucaaugauugaauuuggcg

SEQ ID NO: 287041 - RNA, 22 nt, Yersinia pestis
ugccauuggcucacauuguuua

SEQ ID NO: 287042 - RNA, 22 nt, Yersinia pestis
gauaagccaccagaugaaauga

SEQ ID NO: 287043 - RNA, 22 nt, Yersinia pestis
uuacggugaucggaauuuguuc

SEQ ID NO: 287044 - RNA, 22 nt, Yersinia pestis
uucgaugaaagaggcauuagaa

SEQ ID NO: 287045 - RNA, 22 nt, Yersinia pestis
agcuugaacagcagguuaucca

SEQ ID NO: 287046 - RNA, 22 nt, Yersinia pestis
ccauggugcuuucgguucuggu

SEQ ID NO: 287047 - RNA, 22 nt, Yersinia pestis
ggcucacuggaagccgguuauc

SEQ ID NO: 287048 - RNA, 22 nt, Yersinia pestis
uuagcgcugaucggaucaaaag

SEQ ID NO: 287049 - RNA, 22 nt, Yersinia pestis
gccucaggcgcugauccgugag

SEQ ID NO: 287050 - RNA, 22 nt, Yersinia pestis
uaccgcauuacuaauacucauu

SEQ ID NO: 287051 - RNA, 22 nt, Yersinia pestis
uccgccaaccaaugucgcuaaa

SEQ ID NO: 287052 - RNA, 22 nt, Yersinia pestis
uaccgguuuaaauggcuugcca

SEQ ID NO: 287053 - RNA, 22 nt, Yersinia pestis
cagcggcuaacguugaauauuu

SEQ ID NO: 287054 - RNA, 22 nt, Yersinia pestis
aaugucuuuauugaucgauuca

SEQ ID NO: 287055 - RNA, 20 nt, Yersinia pestis
ugaagccuugcucaauggcc

SEQ ID NO: 287056 - RNA, 22 nt, Yersinia pestis
ucacaaaguucgucuguuguug

SEQ ID NO: 287057 - RNA, 22 nt, Yersinia pestis
agugacuauugaauggaaacau

SEQ ID NO: 287058 - RNA, 22 nt, Yersinia pestis
ucguucagugaucaccuaauca

SEQ ID NO: 287059 - RNA, 22 nt, Yersinia pestis
agcuggcuucagagauggcgug

SEQ ID NO: 287060 - RNA, 22 nt, Yersinia pestis
uuucaggagaucgaugugcugg

SEQ ID NO: 287061 - RNA, 20 nt, Yersinia pestis
ccacguuggacucuuggauc

SEQ ID NO: 287062 - RNA, 22 nt, Yersinia pestis
ucucuggaagagaacauugaaa

SEQ ID NO: 287063 - RNA, 22 nt, Yersinia pestis
aucaaugucuuuuauguuaaac

SEQ ID NO: 287064 - RNA, 22 nt, Yersinia pestis
auccgguaguaaaaaccggucu

SEQ ID NO: 287065 - RNA, 22 nt, Yersinia pestis
cggcagcaagcuguuaugcuuu

SEQ ID NO: 287066 - RNA, 22 nt, Yersinia pestis
cgcugauacgccaaauauuuuu

SEQ ID NO: 287067 - RNA, 22 nt, Yersinia pestis
accggcaaugcugaagaaaugg

SEQ ID NO: 287068 - RNA, 22 nt, Yersinia pestis
uauggcaccaagugaugagaau

SEQ ID NO: 287069 - RNA, 22 nt, Yersinia pestis
cgaagcgguaacccgcauucac

SEQ ID NO: 287070 - RNA, 22 nt, Yersinia pestis
aauaacguuagaaaucaacaua

SEQ ID NO: 287071 - RNA, 22 nt, Yersinia pestis
uagcaguuuuuggucacugcgg

SEQ ID NO: 287072 - RNA, 20 nt, Yersinia pestis
ggcaugacucauugcuucaa

SEQ ID NO: 287073 - RNA, 22 nt, Yersinia pestis
acuguggguuaaugauauucaa

SEQ ID NO: 287074 - RNA, 22 nt, Yersinia pestis
gcggcguuucuucaugauugca

SEQ ID NO: 287075 - RNA, 22 nt, Yersinia pestis
guaaggauugccgcguaauuua

SEQ ID NO: 287076 - RNA, 22 nt, Yersinia pestis
gcucauaauuguucauugccug

SEQ ID NO: 287077 - RNA, 22 nt, Yersinia pestis
uggccugcgggaugugauguca

SEQ ID NO: 287078 - RNA, 22 nt, Yersinia pestis
ggccuucaggguauugacaaag

SEQ ID NO: 287079 - RNA, 22 nt, Yersinia pestis
augcuguuaugagcaugcauua

SEQ ID NO: 287080 - RNA, 22 nt, Yersinia pestis
uuggccgccuaacaugccugcc

SEQ ID NO: 287081 - RNA, 22 nt, Yersinia pestis
gguuccuuauagugaaguugcu

SEQ ID NO: 287082 - RNA, 22 nt, Yersinia pestis
cgguggucucccuugaugguuu

SEQ ID NO: 287083 - RNA, 22 nt, Yersinia pestis
caacggcggcaccggcgacuac

SEQ ID NO: 287084 - RNA, 22 nt, Yersinia pestis
ggcguauuaacauuggcuggug

SEQ ID NO: 287085 - RNA, 23 nt, Yersinia pestis
cggcugagauagagcgccguguu

SEQ ID NO: 287086 - RNA, 22 nt, Yersinia pestis
gcuagcaagaagaauugaucau

SEQ ID NO: 287087 - RNA, 22 nt, Yersinia pestis
uuguucaauggcgauuuguuca

SEQ ID NO: 287088 - RNA, 22 nt, Yersinia pestis
cgauugguugguaccgccaggg

SEQ ID NO: 287089 - RNA, 22 nt, Yersinia pestis
agucucaguucaucaacguauc

SEQ ID NO: 287090 - RNA, 20 nt, Yersinia pestis
ugcuggcacugaugggggca

SEQ ID NO: 287091 - RNA, 22 nt, Yersinia pestis
uuucagguuaccgcguaauuuc

SEQ ID NO: 287092 - RNA, 20 nt, Yersinia pestis
ugccaaaggcccauuaagcc

SEQ ID NO: 287093 - RNA, 22 nt, Yersinia pestis
gcaggucagaccuaaguugugu

SEQ ID NO: 287094 - RNA, 22 nt, Yersinia pestis
aguugagcuucaugcacuguug

SEQ ID NO: 287095 - RNA, 22 nt, Yersinia pestis
uugcgcaggguccggugucgcu

SEQ ID NO: 287096 - RNA, 22 nt, Yersinia pestis
uuaggccggccaauuggcgcuu

SEQ ID NO: 287097 - RNA, 22 nt, Yersinia pestis
uugccaacuuugucucgggcuu

SEQ ID NO: 287098 - RNA, 22 nt, Yersinia pestis
uaggugcuuauggugaagguaa

SEQ ID NO: 287099 - RNA, 22 nt, Yersinia pestis
auucgcuguucgggaguaagag

SEQ ID NO: 287100 - RNA, 22 nt, Yersinia pestis
uaucaauguuggcuuguaaaua

SEQ ID NO: 287101 - RNA, 22 nt, Yersinia pestis
gccagcuugucggucaguguuu

SEQ ID NO: 287102 - RNA, 22 nt, Yersinia pestis
gcgauaccauaugggcgggcac

SEQ ID NO: 287103 - RNA, 21 nt, Yersinia pestis
agugcuggugcgugagcauug

SEQ ID NO: 287104 - RNA, 22 nt, Yersinia pestis
ccgagccaacgguugauggcua

SEQ ID NO: 287105 - RNA, 22 nt, Yersinia pestis
aauguauggcggugaagucggu

SEQ ID NO: 287106 - RNA, 22 nt, Yersinia pestis
uagccauuauauucagcgccau

SEQ ID NO: 287107 - RNA, 20 nt, Yersinia pestis
gccaaggugcuuuuacgcga

SEQ ID NO: 287108 - RNA, 22 nt, Yersinia pestis
cauggcguuuaaucugaagcug

SEQ ID NO: 287109 - RNA, 22 nt, Yersinia pestis
ccguagaaucagguggaaauca

SEQ ID NO: 287110 - RNA, 22 nt, Yersinia pestis
uggucgccauggcuugcuuugu

SEQ ID NO: 287111 - RNA, 22 nt, Yersinia pestis
augagccuauugcugcccgaga

SEQ ID NO: 287112 - RNA, 22 nt, Yersinia pestis
aaugacaguguuacccgagaga

SEQ ID NO: 287113 - RNA, 22 nt, Yersinia pestis
gguagcgaccuauggcgauaua

SEQ ID NO: 287114 - RNA, 22 nt, Yersinia pestis
ccguuaaguuuagucuagucua

SEQ ID NO: 287115 - RNA, 21 nt, Yersinia pestis
cucaccauuaacguuuauucu

SEQ ID NO: 287116 - RNA, 22 nt, Yersinia pestis
gaaugccauuaauacuguggca

SEQ ID NO: 287117 - RNA, 22 nt, Yersinia pestis
cgcgauggcgguaaucuauucu

SEQ ID NO: 287118 - RNA, 22 nt, Yersinia pestis
guggaucacuuuucauccgucg

SEQ ID NO: 287119 - RNA, 22 nt, Yersinia pestis
ugaugcuaaaacugugaacuag

SEQ ID NO: 287120 - RNA, 22 nt, Yersinia pestis
ucaguacggaucgcauccguga

SEQ ID NO: 287121 - RNA, 22 nt, Yersinia pestis
cugaggucagugcugcaucacc

SEQ ID NO: 287122 - RNA, 22 nt, Yersinia pestis
aucgaaaugguagucaaacaau

SEQ ID NO: 287123 - RNA, 22 nt, Yersinia pestis
aaggauguaugcuugaaggcuu

SEQ ID NO: 287124 - RNA, 22 nt, Yersinia pestis
gcgauugagcggggugagucua

SEQ ID NO: 287125 - RNA, 22 nt, Yersinia pestis
uacugauaucauguggcggugu

SEQ ID NO: 287126 - RNA, 20 nt, Yersinia pestis
ugguuuaaccaguuccgucu

SEQ ID NO: 287127 - RNA, 22 nt, Yersinia pestis
gugacagcggcucaccucugcu

SEQ ID NO: 287128 - RNA, 22 nt, Yersinia pestis
aguguaauacuggaaugugcgu

SEQ ID NO: 287129 - RNA, 19 nt, Yersinia pestis
gggauuuauuuagccugcu

SEQ ID NO: 287130 - RNA, 22 nt, Yersinia pestis
cauuccgugccggugcugaaga

SEQ ID NO: 287131 - RNA, 19 nt, Yersinia pestis
cauuuggcgcaagggccgg

SEQ ID NO: 287132 - RNA, 22 nt, Yersinia pestis
ucgcuuguggugcuaucucugg

SEQ ID NO: 287133 - RNA, 18 nt, Yersinia pestis
uuggcggcauccauccac

SEQ ID NO: 287134 - RNA, 22 nt, Yersinia pestis
ucgcaaagcgaugaucacggca

SEQ ID NO: 287135 - RNA, 21 nt, Yersinia pestis
uaaagcuuuauucaauggcgu

SEQ ID NO: 287136 - RNA, 22 nt, Yersinia pestis
cuugauaccgaugguggauuuc

SEQ ID NO: 287137 - RNA, 22 nt, Yersinia pestis
uuaccacguuuaccguaaccca

SEQ ID NO: 287138 - RNA, 21 nt, Yersinia pestis
acaccgcuaagguaucaaacc

SEQ ID NO: 287139 - RNA, 22 nt, Yersinia pestis
ugcggcgauuuucuggugaacc

SEQ ID NO: 287140 - RNA, 22 nt, Yersinia pestis
guggugcaucuacugcgcaccc

SEQ ID NO: 287141 - RNA, 22 nt, Yersinia pestis
gcaugacugaaaggccgaguuu

SEQ ID NO: 287142 - RNA, 22 nt, Yersinia pestis
ggccauuggcagcuuuauauau

SEQ ID NO: 287143 - RNA, 22 nt, Yersinia pestis
acccugacgggcaauuugccgc

SEQ ID NO: 287144 - RNA, 22 nt, Yersinia pestis
cggugagcgaugauaaucaccg

SEQ ID NO: 287145 - RNA, 22 nt, Yersinia pestis
aaaguuggcacuacucuuaauu

SEQ ID NO: 287146 - RNA, 22 nt, Yersinia pestis
uugaugcgcuggagcgccagaa

SEQ ID NO: 287147 - RNA, 22 nt, Yersinia pestis
gcugaauaucguugaacaggau

SEQ ID NO: 287148 - RNA, 22 nt, Yersinia pestis
acgggcgauuaucucuagaucg

SEQ ID NO: 287149 - RNA, 22 nt, Yersinia pestis
acgccuuguucgcaaccgaaga

SEQ ID NO: 287150 - RNA, 22 nt, Yersinia pestis
uaccgcuuuaccccgcugcaaa

SEQ ID NO: 287151 - RNA, 22 nt, Yersinia pestis
aaugcggggguagucauacaaa

SEQ ID NO: 287152 - RNA, 21 nt, Yersinia pestis
cgucagugcgcaguaagaccu

SEQ ID NO: 287153 - RNA, 22 nt, Yersinia pestis
gaaguuaugggcgcgcauauug

SEQ ID NO: 287154 - RNA, 22 nt, Yersinia pestis
auucgauuuaucuggcuuuaau

SEQ ID NO: 287155 - RNA, 22 nt, Yersinia pestis
ugauucgggcuguuuguuuacu

SEQ ID NO: 287156 - RNA, 22 nt, Yersinia pestis
ugcagcuuggcgucugacgggu

SEQ ID NO: 287157 - RNA, 22 nt, Yersinia pestis
ugguuaaacaauacggugcccu

SEQ ID NO: 287158 - RNA, 22 nt, Yersinia pestis
gaucaucaagcacggcuguauu

SEQ ID NO: 287159 - RNA, 20 nt, Yersinia pestis
ucaauuaggagccgugccca

SEQ ID NO: 287160 - RNA, 22 nt, Yersinia pestis
uaaccucagauaggagacaggg

SEQ ID NO: 287161 - RNA, 22 nt, Yersinia pestis
uugcggauauugccaagcggga

SEQ ID NO: 287162 - RNA, 22 nt, Yersinia pestis
caaucaugauauggcgagcccc

SEQ ID NO: 287163 - RNA, 22 nt, Yersinia pestis
aucuaaugguuguuaauuaaga

SEQ ID NO: 287164 - RNA, 21 nt, Yersinia pestis
gcuaagaagucuugauacuac

SEQ ID NO: 287165 - RNA, 22 nt, Yersinia pestis
gcuggcugauacgcccacgauu

SEQ ID NO: 287166 - RNA, 22 nt, Yersinia pestis
cauuugugcugaagcuggguuc

SEQ ID NO: 287167 - RNA, 22 nt, Yersinia pestis
cgccguauucaaaauagaaaag

SEQ ID NO: 287168 - RNA, 22 nt, Yersinia pestis
uaagucucaauuuauuuugucg

SEQ ID NO: 287169 - RNA, 22 nt, Yersinia pestis
uucaugaguggcuuuccgcugu

SEQ ID NO: 287170 - RNA, 22 nt, Yersinia pestis
ggugcaacuaaacgcccggacu

SEQ ID NO: 287171 - RNA, 22 nt, Yersinia pestis
uccauugaacccgugucauuaa

SEQ ID NO: 287172 - RNA, 18 nt, Yersinia pestis
cagugccacaauaaacag

SEQ ID NO: 287173 - RNA, 22 nt, Yersinia pestis
ucgaaaguaucgaagaauuagc

SEQ ID NO: 287174 - RNA, 19 nt, Yersinia pestis
uagauaacauaggguucgc

SEQ ID NO: 287175 - RNA, 22 nt, Yersinia pestis
gguuaagcgguugacugagaug

SEQ ID NO: 287176 - RNA, 17 nt, Yersinia pestis
ggccgguaagcuaccaa

SEQ ID NO: 287177 - RNA, 22 nt, Yersinia pestis
uaccgccgucagguucaggugu

SEQ ID NO: 287178 - RNA, 22 nt, Yersinia pestis
ucgcagaugaugcaagggcaca

SEQ ID NO: 287179 - RNA, 22 nt, Yersinia pestis
uucaucacgauaaagucagguu

SEQ ID NO: 287180 - RNA, 20 nt, Yersinia pestis
uaagcugagucagucauaca

SEQ ID NO: 287181 - RNA, 19 nt, Yersinia pestis
ugucgcgcucgcaggccgu

SEQ ID NO: 287182 - RNA, 22 nt, Yersinia pestis
aucuacaccacgccauggauaa

SEQ ID NO: 287183 - RNA, 18 nt, Yersinia pestis
uggucaguaaagcggcuu

SEQ ID NO: 287184 - RNA, 22 nt, Yersinia pestis
augcggugggugugauugguuu

SEQ ID NO: 287185 - RNA, 22 nt, Yersinia pestis
auuucaucacugagcugguggg

SEQ ID NO: 287186 - RNA, 22 nt, Yersinia pestis
ggucgcaagaugcuaccgaugg

SEQ ID NO: 287187 - RNA, 22 nt, Yersinia pestis
auggaaauaacaagcgagacaa

SEQ ID NO: 287188 - RNA, 21 nt, Yersinia pestis
agaugguaucccugcuguggu

SEQ ID NO: 287189 - RNA, 22 nt, Yersinia pestis
caucaagaugcacgucauacuc

SEQ ID NO: 287190 - RNA, 22 nt, Yersinia pestis
uuuaucagcaacaguggcuuuu

SEQ ID NO: 287191 - RNA, 22 nt, Yersinia pestis
gaauugaacucaucaaucauug

SEQ ID NO: 287192 - RNA, 22 nt, Yersinia pestis
gcucuggcacaguaucgugagc

SEQ ID NO: 287193 - RNA, 22 nt, Yersinia pestis
gccaagguaucgccuugcuaaa

SEQ ID NO: 287194 - RNA, 22 nt, Yersinia pestis
ugagacuuuccgcgccaaagcc

SEQ ID NO: 287195 - RNA, 22 nt, Yersinia pestis
gcauucagcaacaagaggguau

SEQ ID NO: 287196 - RNA, 22 nt, Yersinia pestis
uggaaguuauggggaauguuuu

SEQ ID NO: 287197 - RNA, 22 nt, Yersinia pestis
ucauguaugccuugguggcggg

SEQ ID NO: 287198 - RNA, 22 nt, Yersinia pestis
guugacguguuguaugccguua

SEQ ID NO: 287199 - RNA, 22 nt, Yersinia pestis
ugacaaaucucugggcgcaggg

SEQ ID NO: 287200 - RNA, 22 nt, Yersinia pestis
agagauucuagucgcccacgau

SEQ ID NO: 287201 - RNA, 20 nt, Yersinia pestis
caaugcagaagaguucagcc

SEQ ID NO: 287202 - RNA, 22 nt, Yersinia pestis
ggugccuuaucuggucgcgcca

SEQ ID NO: 287203 - RNA, 22 nt, Yersinia pestis
aaccauugacgggggcuuccag

SEQ ID NO: 287204 - RNA, 22 nt, Yersinia pestis
ggaugccguagauuuuuuugcc

SEQ ID NO: 287205 - RNA, 22 nt, Yersinia pestis
caucacuggcguuaugaccacc

SEQ ID NO: 287206 - RNA, 22 nt, Yersinia pestis
agugcguucagugccguugacc

SEQ ID NO: 287207 - RNA, 21 nt, Yersinia pestis
uaucgcuuucgcuacgccacc

SEQ ID NO: 287208 - RNA, 22 nt, Yersinia pestis
cgcuguacgccgauccgcauuu

SEQ ID NO: 287209 - RNA, 22 nt, Yersinia pestis
ggauaagugcuguagucuuugu

SEQ ID NO: 287210 - RNA, 22 nt, Yersinia pestis
uucauuggaaaaauagauguca

SEQ ID NO: 287211 - RNA, 22 nt, Yersinia pestis
auuggaaaacccuggaucuggg

SEQ ID NO: 287212 - RNA, 22 nt, Yersinia pestis
accaauuguaaauaauaacuag

SEQ ID NO: 287213 - RNA, 22 nt, Yersinia pestis
uugauagcguugaagcgcaagc

SEQ ID NO: 287214 - RNA, 22 nt, Yersinia pestis
ucagauccugucaccuucuuca

SEQ ID NO: 287215 - RNA, 22 nt, Yersinia pestis
ggugaacgcuuugguuuggcug

SEQ ID NO: 287216 - RNA, 22 nt, Yersinia pestis
cagacauuguugcauaugguca

SEQ ID NO: 287217 - RNA, 22 nt, Yersinia pestis
accacgaguacggcugcggcga

SEQ ID NO: 287218 - RNA, 22 nt, Yersinia pestis
gagcguuagcgggcggcuuagu

SEQ ID NO: 287219 - RNA, 22 nt, Yersinia pestis
acggcucugccaacgugaucgc

SEQ ID NO: 287220 - RNA, 22 nt, Yersinia pestis
gaacuugggaucagacagauau

SEQ ID NO: 287221 - RNA, 22 nt, Yersinia pestis
ugguuaucuaugaaggcgagcu

SEQ ID NO: 287222 - RNA, 22 nt, Yersinia pestis
gauccgccgguggucagcggaa

SEQ ID NO: 287223 - RNA, 22 nt, Yersinia pestis
ucugguuaguggcagugauauc

SEQ ID NO: 287224 - RNA, 22 nt, Yersinia pestis
caccgcuaauaucuuggcuuca

SEQ ID NO: 287225 - RNA, 22 nt, Yersinia pestis
uguaaaguggcucaugucagua

SEQ ID NO: 287226 - RNA, 22 nt, Yersinia pestis
ugcuacaccugcacagcgugaa

SEQ ID NO: 287227 - RNA, 22 nt, Yersinia pestis
gugacugaggaugauuguggua

SEQ ID NO: 287228 - RNA, 20 nt, Yersinia pestis
caguuaauggaaaaagcguu

SEQ ID NO: 287229 - RNA, 22 nt, Yersinia pestis
uggcucuuuacgaucaagugga

SEQ ID NO: 287230 - RNA, 22 nt, Yersinia pestis
aggugcagccacuaucagcuac

SEQ ID NO: 287231 - RNA, 22 nt, Yersinia pestis
ggcugcuaauaccaauaauaga

SEQ ID NO: 287232 - RNA, 22 nt, Yersinia pestis
cacuggcggugucucauuaaua

SEQ ID NO: 287233 - RNA, 19 nt, Yersinia pestis
accaauaugaaguuacugg

SEQ ID NO: 287234 - RNA, 22 nt, Yersinia pestis
aaaguggccagagaucuguuua

SEQ ID NO: 287235 - RNA, 22 nt, Yersinia pestis
ucgguauuaaucaguacuggug

SEQ ID NO: 287236 - RNA, 22 nt, Yersinia pestis
uaaagcaacggugguagcgaug

SEQ ID NO: 287237 - RNA, 22 nt, Yersinia pestis
uauucugcuggaagaguugcug

SEQ ID NO: 287238 - RNA, 22 nt, Yersinia pestis
aaaggccgcccguucuuugaug

SEQ ID NO: 287239 - RNA, 22 nt, Yersinia pestis
caucaauauagcguauugaauc

SEQ ID NO: 287240 - RNA, 22 nt, Yersinia pestis
aauaacgaacguguggaugcgc

SEQ ID NO: 287241 - RNA, 22 nt, Yersinia pestis
agucaaagaauccaugucuggc

SEQ ID NO: 287242 - RNA, 22 nt, Yersinia pestis
uugcaguuuagccagcaacuga

SEQ ID NO: 287243 - RNA, 22 nt, Yersinia pestis
aaugaccaucaaagaguuacug

SEQ ID NO: 287244 - RNA, 22 nt, Yersinia pestis
uuucgauacgaugcauauuaug

SEQ ID NO: 287245 - RNA, 22 nt, Yersinia pestis
ugucauugcaauggugccgguu

SEQ ID NO: 287246 - RNA, 22 nt, Yersinia pestis
guuaaugucacuuuaccagguu

SEQ ID NO: 287247 - RNA, 22 nt, Yersinia pestis
cuguagcgugaguggugcuaug

SEQ ID NO: 287248 - RNA, 22 nt, Yersinia pestis
cagggauaacagcgacaguaug

SEQ ID NO: 287249 - RNA, 22 nt, Yersinia pestis
guuagguauugagagaguuuaa

SEQ ID NO: 287250 - RNA, 19 nt, Yersinia pestis
ucaaacaucugaugagacg

SEQ ID NO: 287251 - RNA, 22 nt, Yersinia pestis
aucagcaaugaaacccugcaaa

SEQ ID NO: 287252 - RNA, 22 nt, Yersinia pestis
aucagauaggcagucagccuua

SEQ ID NO: 287253 - RNA, 17 nt, Yersinia pestis
aaugguugguuucugac

SEQ ID NO: 287254 - RNA, 20 nt, Yersinia pestis
uugaguaaccgggcuuuuuu

SEQ ID NO: 287255 - RNA, 22 nt, Yersinia pestis
ucaguguggugucauucgcugu

SEQ ID NO: 287256 - RNA, 22 nt, Yersinia pestis
cgccauauuuugccuuccaguu

SEQ ID NO: 287257 - RNA, 22 nt, Yersinia pestis
cguauugacccuaaaaccggua

SEQ ID NO: 287258 - RNA, 23 nt, Yersinia pestis
ugcugucaccgaccuucauccgg

SEQ ID NO: 287259 - RNA, 22 nt, Yersinia pestis
ugaggcaggaaaucggcucuuu

SEQ ID NO: 287260 - RNA, 19 nt, Yersinia pestis
cgguuaugacccucuggcc

SEQ ID NO: 287261 - RNA, 19 nt, Yersinia pestis
ugggcaauaaagagguugu

SEQ ID NO: 287262 - RNA, 22 nt, Yersinia pestis
caucgguaaucaguuugcucca

SEQ ID NO: 287263 - RNA, 22 nt, Yersinia pestis
aggaguuugaaggccauugucu

SEQ ID NO: 287264 - RNA, 22 nt, Yersinia pestis
uuaacgguaauuuugguguuuc

SEQ ID NO: 287265 - RNA, 22 nt, Yersinia pestis
cuguuccaccgacuuuacugcg

SEQ ID NO: 287266 - RNA, 22 nt, Yersinia pestis
cagucuggcuuuucgcaaaauu

SEQ ID NO: 287267 - RNA, 22 nt, Yersinia pestis
ccggcaucaagcauuuggucaa

SEQ ID NO: 287268 - RNA, 22 nt, Yersinia pestis
acuucaucugaucauuggcuga

SEQ ID NO: 287269 - RNA, 22 nt, Yersinia pestis
uaucagagugcgcugauuuaac

SEQ ID NO: 287270 - RNA, 22 nt, Yersinia pestis
auugcguagaaauggauguuaa

SEQ ID NO: 287271 - RNA, 20 nt, Yersinia pestis
ugcauuggcaaucaggcugg

SEQ ID NO: 287272 - RNA, 19 nt, Yersinia pestis
uuaccggcaaauuaucuga

SEQ ID NO: 287273 - RNA, 22 nt, Yersinia pestis
aaccggauaugucacauguuca

SEQ ID NO: 287274 - RNA, 22 nt, Yersinia pestis
ugagugacuuccauuugaaucg

SEQ ID NO: 287275 - RNA, 22 nt, Yersinia pestis
aaguggcuaucggcggcaagcg

SEQ ID NO: 287276 - RNA, 22 nt, Yersinia pestis
ccgguauuaaagcggcaucacc

SEQ ID NO: 287277 - RNA, 22 nt, Yersinia pestis
uuggagaguaaagucgacacgu

SEQ ID NO: 287278 - RNA, 22 nt, Yersinia pestis
uaggcgaugaucaggucacggu

SEQ ID NO: 287279 - RNA, 22 nt, Yersinia pestis
auuauccccagcgguaucagcc

SEQ ID NO: 287280 - RNA, 22 nt, Yersinia pestis
cuggauuguuacgcggaucagc

SEQ ID NO: 287281 - RNA, 20 nt, Yersinia pestis
ugcuguaacaugacuuauag

SEQ ID NO: 287282 - RNA, 22 nt, Yersinia pestis
aauggcgauggaaagacccacu

SEQ ID NO: 287283 - RNA, 20 nt, Yersinia pestis
uuuggcauggugacugcggu

SEQ ID NO: 287284 - RNA, 22 nt, Yersinia pestis
ccaacagugcugaauccgggau

SEQ ID NO: 287285 - RNA, 22 nt, Yersinia pestis
uaaacguguggccgugaucggg

SEQ ID NO: 287286 - RNA, 22 nt, Yersinia pestis
ccuguuauuccuguaucucggc

SEQ ID NO: 287287 - RNA, 22 nt, Yersinia pestis
ugucugaacuugcuuuagugga

SEQ ID NO: 287288 - RNA, 22 nt, Yersinia pestis
uguaucgucguuuacgcaaagg

SEQ ID NO: 287289 - RNA, 22 nt, Yersinia pestis
uggugcgacaggcucggcguua

SEQ ID NO: 287290 - RNA, 22 nt, Yersinia pestis
caguggcgaucuauucauagag

SEQ ID NO: 287291 - RNA, 22 nt, Yersinia pestis
ugacuaggacguugacggauga

SEQ ID NO: 287292 - RNA, 22 nt, Yersinia pestis
uauucugaacuggaagaagagu

SEQ ID NO: 287293 - RNA, 22 nt, Yersinia pestis
cauuacugucaacguuguggca

SEQ ID NO: 287294 - RNA, 22 nt, Yersinia pestis
guggcggaaugcgcggcaucac

SEQ ID NO: 287295 - RNA, 22 nt, Yersinia pestis
acgaaguuguagaacuuaauug

SEQ ID NO: 287296 - RNA, 22 nt, Yersinia pestis
augcugaugcugauguuaauac

SEQ ID NO: 287297 - RNA, 22 nt, Yersinia pestis
gcucguuuaucucggcaauuac

SEQ ID NO: 287298 - RNA, 22 nt, Yersinia pestis
augcaguuaagguuagcuaugc

SEQ ID NO: 287299 - RNA, 21 nt, Yersinia pestis
auggaccgguaucagucaugc

SEQ ID NO: 287300 - RNA, 22 nt, Yersinia pestis
guuacaugguuuguugggcagc

SEQ ID NO: 287301 - RNA, 22 nt, Yersinia pestis
gcuauguaaacgacuuuaucga

SEQ ID NO: 287302 - RNA, 22 nt, Yersinia pestis
aucgccuugucgguugguuuug

SEQ ID NO: 287303 - RNA, 22 nt, Yersinia pestis
gcgcguuaguacuggguagcua

SEQ ID NO: 287304 - RNA, 22 nt, Yersinia pestis
ccaauugagcaccguagcuuug

SEQ ID NO: 287305 - RNA, 22 nt, Yersinia pestis
agccaguacuuuuguucaaacg

SEQ ID NO: 287306 - RNA, 20 nt, Yersinia pestis
gcucugucauaucauuguug

SEQ ID NO: 287307 - RNA, 22 nt, Yersinia pestis
agcuaucgucgucgauuucaau

SEQ ID NO: 287308 - RNA, 22 nt, Yersinia pestis
acggaaaccaacuaaaugggua

SEQ ID NO: 287309 - RNA, 22 nt, Yersinia pestis
ucucggguaauuaacucuuuua

SEQ ID NO: 287310 - RNA, 22 nt, Yersinia pestis
gcuggcugagaucggcaaucug

SEQ ID NO: 287311 - RNA, 22 nt, Yersinia pestis
uugcguaauaaugcggcuuggu

SEQ ID NO: 287312 - RNA, 19 nt, Yersinia pestis
uuugaucaccaguuucggu

SEQ ID NO: 287313 - RNA, 22 nt, Yersinia pestis
auggccuucgcggucccuacgu

SEQ ID NO: 287314 - RNA, 22 nt, Yersinia pestis
gucccagcuacugcuacucagc

SEQ ID NO: 287315 - RNA, 22 nt, Yersinia pestis
gauggugcucuuuagcguuuug

SEQ ID NO: 287316 - RNA, 22 nt, Yersinia pestis
cauaucgugaaagcauucgaca

SEQ ID NO: 287317 - RNA, 22 nt, Yersinia pestis
ugaagcugcccauaaauuggau

SEQ ID NO: 287318 - RNA, 22 nt, Yersinia pestis
caggcuguguauuccgcacccg

SEQ ID NO: 287319 - RNA, 22 nt, Yersinia pestis
accaaugggcagcgcuguuacu

SEQ ID NO: 287320 - RNA, 22 nt, Yersinia pestis
aauggccgauaauaauggcuug

SEQ ID NO: 287321 - RNA, 22 nt, Yersinia pestis
ccagcugauuuauuccaacuga

SEQ ID NO: 287322 - RNA, 22 nt, Yersinia pestis
uagcuaucggugaugagccgac

SEQ ID NO: 287323 - RNA, 22 nt, Yersinia pestis
aaaggcucacaccaccgaguuc

SEQ ID NO: 287324 - RNA, 22 nt, Yersinia pestis
uggagcaauaucuuggaacuuc

SEQ ID NO: 287325 - RNA, 22 nt, Yersinia pestis
uuugucagcagucugaaaggcc

SEQ ID NO: 287326 - RNA, 18 nt, Yersinia pestis
ucucauugccauuuaaau

SEQ ID NO: 287327 - RNA, 22 nt, Yersinia pestis
cggugcuguucuucgucucugu

SEQ ID NO: 287328 - RNA, 22 nt, Yersinia pestis
uaucagcgaagcuacgcauauu

SEQ ID NO: 287329 - RNA, 22 nt, Yersinia pestis
uaaaugagguuuuuacuugagg

SEQ ID NO: 287330 - RNA, 22 nt, Yersinia pestis
ugaaacagcgcuggcagcagca

SEQ ID NO: 287331 - RNA, 22 nt, Yersinia pestis
acucaauggggugauugguuuu

SEQ ID NO: 287332 - RNA, 22 nt, Yersinia pestis
auaaacgcgguauuagugguga

SEQ ID NO: 287333 - RNA, 22 nt, Yersinia pestis
accacgcucauguugcugaaau

SEQ ID NO: 287334 - RNA, 22 nt, Yersinia pestis
augagcuuauuccugucaguga

SEQ ID NO: 287335 - RNA, 22 nt, Yersinia pestis
gccagguaaaacgaauggauuc

SEQ ID NO: 287336 - RNA, 22 nt, Yersinia pestis
cgggcgaaaucgaacuguauca

SEQ ID NO: 287337 - RNA, 22 nt, Yersinia pestis
ucaaccagauuauguuguucug

SEQ ID NO: 287338 - RNA, 22 nt, Yersinia pestis
uuuccagcggaauuucaagcug

SEQ ID NO: 287339 - RNA, 22 nt, Yersinia pestis
uuucuugagccagucagccaga

SEQ ID NO: 287340 - RNA, 22 nt, Yersinia pestis
uggccuuuuaauauauugaagc

SEQ ID NO: 287341 - RNA, 22 nt, Yersinia pestis
auugucaugcagaaucgaaacu

SEQ ID NO: 287342 - RNA, 22 nt, Yersinia pestis
uuggcgcagguaauaugcgguu

SEQ ID NO: 287343 - RNA, 22 nt, Yersinia pestis
aaacgucuugauagcgaccaga

SEQ ID NO: 287344 - RNA, 22 nt, Yersinia pestis
ugucagugagaugguucugcgu

SEQ ID NO: 287345 - RNA, 22 nt, Yersinia pestis
uccuuggguggaauggguuuau

SEQ ID NO: 287346 - RNA, 22 nt, Yersinia pestis
accuguuugaaagccugaaucu

SEQ ID NO: 287347 - RNA, 22 nt, Yersinia pestis
uagcugauagucuuuaguagcu

SEQ ID NO: 287348 - RNA, 22 nt, Yersinia pestis
uauccgauauucaucuuggauu

SEQ ID NO: 287349 - RNA, 22 nt, Yersinia pestis
uuggauucaacggcccaguuag

SEQ ID NO: 287350 - RNA, 22 nt, Yersinia pestis
uggcuuauuucaguuaccugaa

SEQ ID NO: 287351 - RNA, 22 nt, Yersinia pestis
gacgcuaucuugaugaugccug

SEQ ID NO: 287352 - RNA, 22 nt, Yersinia pestis
ggguuuacuuugcuuaaaguca

SEQ ID NO: 287353 - RNA, 22 nt, Yersinia pestis
cgucagccguacccgcucucuc

SEQ ID NO: 287354 - RNA, 22 nt, Yersinia pestis
uuugaaucaggcauuaaucaaa

SEQ ID NO: 287355 - RNA, 22 nt, Yersinia pestis
aguuugagaaaugaagacuuua

SEQ ID NO: 287356 - RNA, 22 nt, Yersinia pestis
uacaccauuccugaaaucaguu

SEQ ID NO: 287357 - RNA, 22 nt, Yersinia pestis
uugcuuuaucuguucacgcgaa

SEQ ID NO: 287358 - RNA, 22 nt, Yersinia pestis
aacuugaaguaugggggguaua

SEQ ID NO: 287359 - RNA, 22 nt, Yersinia pestis
agccgcguuggcaucacucacc

SEQ ID NO: 287360 - RNA, 22 nt, Yersinia pestis
agcgcguuguucaccguauuac

SEQ ID NO: 287361 - RNA, 22 nt, Yersinia pestis
uuuaaggucauggaaggugaaa

SEQ ID NO: 287362 - RNA, 22 nt, Yersinia pestis
uguugccaaaggagcucagcau

SEQ ID NO: 287363 - RNA, 22 nt, Yersinia pestis
gugaaccaauuguuagcuaagg

SEQ ID NO: 287364 - RNA, 22 nt, Yersinia pestis
acgaaggugauaguaacgaagg

SEQ ID NO: 287365 - RNA, 23 nt, Yersinia pestis
ugaaggcgucgaucauccgcagg

SEQ ID NO: 287366 - RNA, 22 nt, Yersinia pestis
cuggccagacuguacgcuuugg

SEQ ID NO: 287367 - RNA, 22 nt, Yersinia pestis
ucauccaucugucgcccgguca

SEQ ID NO: 287368 - RNA, 22 nt, Yersinia pestis
gacgugacauuaauuuaugacg

SEQ ID NO: 287369 - RNA, 22 nt, Yersinia pestis
ccgcauagcuugcaacccaucg

SEQ ID NO: 287370 - RNA, 22 nt, Yersinia pestis
ugggcauuguucucaauugaga

SEQ ID NO: 287371 - RNA, 22 nt, Yersinia pestis
ccaccgaugugcuucaccaguu

SEQ ID NO: 287372 - RNA, 22 nt, Yersinia pestis
ugguagccuuccauuugauccc

SEQ ID NO: 287373 - RNA, 22 nt, Yersinia pestis
cguuucaguacuguugcgccuu

SEQ ID NO: 287374 - RNA, 22 nt, Yersinia pestis
acgcaggaaagaacugcauugg

SEQ ID NO: 287375 - RNA, 21 nt, Yersinia pestis
agucggccaaccaucgccauu

SEQ ID NO: 287376 - RNA, 22 nt, Yersinia pestis
uucgcuaaacgcuugcuggcag

SEQ ID NO: 287377 - RNA, 22 nt, Yersinia pestis
ugccugucguuccgguacauga

SEQ ID NO: 287378 - RNA, 22 nt, Yersinia pestis
caaguugugccaacguaccgau

SEQ ID NO: 287379 - RNA, 22 nt, Yersinia pestis
gcgucguuuauaucucguugua

SEQ ID NO: 287380 - RNA, 19 nt, Yersinia pestis
aaaguaccggucgugaaua

SEQ ID NO: 287381 - RNA, 22 nt, Yersinia pestis
cagccguaguccaacccaguag

SEQ ID NO: 287382 - RNA, 22 nt, Yersinia pestis
augccguugaauugaucagacc

SEQ ID NO: 287383 - RNA, 22 nt, Yersinia pestis
cccgauguuggguggugguaca

SEQ ID NO: 287384 - RNA, 19 nt, Yersinia pestis
gcuaaagcaaacgccguua

SEQ ID NO: 287385 - RNA, 20 nt, Yersinia pestis
ugaaauccuauuuuugcgca

SEQ ID NO: 287386 - RNA, 22 nt, Yersinia pestis
uucgccagaucguucaggaagc

SEQ ID NO: 287387 - RNA, 22 nt, Yersinia pestis
gccacugagggugaucgccagc

SEQ ID NO: 287388 - RNA, 22 nt, Yersinia pestis
uacuggaagccagagcagggau

SEQ ID NO: 287389 - RNA, 22 nt, Yersinia pestis
guuugucagcauucugaaggcc

SEQ ID NO: 287390 - RNA, 22 nt, Yersinia pestis
ccgcuugguuaacugcgucauu

SEQ ID NO: 287391 - RNA, 22 nt, Yersinia pestis
gcugcuuaaacccgguaugauu

SEQ ID NO: 287392 - RNA, 22 nt, Yersinia pestis
uggcaggagguucucguucagg

SEQ ID NO: 287393 - RNA, 22 nt, Yersinia pestis
uugcugaaauuaggcuucaccg

SEQ ID NO: 287394 - RNA, 22 nt, Yersinia pestis
ugauacaucaguaacaggugua

SEQ ID NO: 287395 - RNA, 22 nt, Yersinia pestis
agccugacagaaaaugucaaug

SEQ ID NO: 287396 - RNA, 22 nt, Yersinia pestis
uaacggguaauuaugccgcaug

SEQ ID NO: 287397 - RNA, 22 nt, Yersinia pestis
cgccgcauuggugggugcagac

SEQ ID NO: 287398 - RNA, 20 nt, Yersinia pestis
ucuauuguuacuuuuaauac

SEQ ID NO: 287399 - RNA, 22 nt, Yersinia pestis
auuauggccgauaagacauuag

SEQ ID NO: 287400 - RNA, 22 nt, Yersinia pestis
gagugaugauugaaacacaggu

SEQ ID NO: 287401 - RNA, 22 nt, Yersinia pestis
uuucagacaaguuagugccuaa

SEQ ID NO: 287402 - RNA, 22 nt, Yersinia pestis
gacgucugacaugguacguguu

SEQ ID NO: 287403 - RNA, 22 nt, Yersinia pestis
uuaccguucugagcaaagggcc

SEQ ID NO: 287404 - RNA, 22 nt, Yersinia pestis
augaaagcaaaaguucugucau

SEQ ID NO: 287405 - RNA, 22 nt, Yersinia pestis
uaugucacacaguggguuauug

SEQ ID NO: 287406 - RNA, 22 nt, Yersinia pestis
cacuggauuauaauuucaaacg

SEQ ID NO: 287407 - RNA, 22 nt, Yersinia pestis
gaugaguuuugcguuuaaugaa

SEQ ID NO: 287408 - RNA, 22 nt, Yersinia pestis
acgcuguuggagaagauguuga

SEQ ID NO: 287409 - RNA, 22 nt, Yersinia pestis
uuagcgguguaguuaagguuag

SEQ ID NO: 287410 - RNA, 21 nt, Yersinia pestis
cugauucaauucaucggucuc

SEQ ID NO: 287411 - RNA, 22 nt, Yersinia pestis
gccaguuugagucuuuugucag

SEQ ID NO: 287412 - RNA, 22 nt, Yersinia pestis
auauugucguugauauugucgc

SEQ ID NO: 287413 - RNA, 22 nt, Yersinia pestis
gcugcacugaaccccagaucuu

SEQ ID NO: 287414 - RNA, 22 nt, Yersinia pestis
acggcauuagggcauggcugga

SEQ ID NO: 287415 - RNA, 22 nt, Yersinia pestis
gccauuuaugccgaucauccgu

SEQ ID NO: 287416 - RNA, 22 nt, Yersinia pestis
uuugugcaggaguaaaaccggg

SEQ ID NO: 287417 - RNA, 21 nt, Yersinia pestis
cagcgucaagaagugcaaaug

SEQ ID NO: 287418 - RNA, 22 nt, Yersinia pestis
uaaacuggcuaauacauucgcu

SEQ ID NO: 287419 - RNA, 22 nt, Yersinia pestis
aggcaucucugucauccaguaa

SEQ ID NO: 287420 - RNA, 22 nt, Yersinia pestis
cagugaacuucauggcaaugcu

SEQ ID NO: 287421 - RNA, 22 nt, Yersinia pestis
agcugacagggugaguaagaac

SEQ ID NO: 287422 - RNA, 22 nt, Yersinia pestis
gcgcugaaaucuaugguggucg

SEQ ID NO: 287423 - RNA, 22 nt, Yersinia pestis
gucauugcuuugauacggcugg

SEQ ID NO: 287424 - RNA, 22 nt, Yersinia pestis
uggcugccagcacuguuuaucc

SEQ ID NO: 287425 - RNA, 22 nt, Yersinia pestis
gcauccggcuggccugucgcca

SEQ ID NO: 287426 - RNA, 22 nt, Yersinia pestis
uuacucaucuggaaggcuaccg

SEQ ID NO: 287427 - RNA, 22 nt, Yersinia pestis
acgccugacaaauguacucaaa

SEQ ID NO: 287428 - RNA, 22 nt, Yersinia pestis
uacagcaaucucuguuggugca

SEQ ID NO: 287429 - RNA, 22 nt, Yersinia pestis
cacgcgcuaacguuucucaggu

SEQ ID NO: 287430 - RNA, 22 nt, Yersinia pestis
uaaccggccaaucuugucguag

SEQ ID NO: 287431 - RNA, 22 nt, Yersinia pestis
cggcgagauccuuauugagggu

SEQ ID NO: 287432 - RNA, 22 nt, Yersinia pestis
uuacugacgcguccagccguug

SEQ ID NO: 287433 - RNA, 22 nt, Yersinia pestis
gaaauacuccuguucuaucgaa

SEQ ID NO: 287434 - RNA, 22 nt, Yersinia pestis
ucaguugaucaacuuuagcguu

SEQ ID NO: 287435 - RNA, 22 nt, Yersinia pestis
cugacacgacguuugaauucag

SEQ ID NO: 287436 - RNA, 22 nt, Yersinia pestis
augccauauuuacauucgcgau

SEQ ID NO: 287437 - RNA, 22 nt, Yersinia pestis
agcuggcacuuaguacguagcg

SEQ ID NO: 287438 - RNA, 23 nt, Yersinia pestis
gccuggugauagcuuagcugugc

SEQ ID NO: 287439 - RNA, 22 nt, Yersinia pestis
cguuugaaaucaacgucacggg

SEQ ID NO: 287440 - RNA, 22 nt, Yersinia pestis
cgacgauaaacugguaagcgcc

SEQ ID NO: 287441 - RNA, 22 nt, Yersinia pestis
cgugcuuucuugaaagaaacgu

SEQ ID NO: 287442 - RNA, 22 nt, Yersinia pestis
uugcaggcgguuagccgugaga

SEQ ID NO: 287443 - RNA, 22 nt, Yersinia pestis
agacugaugcaagauggcggua

SEQ ID NO: 287444 - RNA, 22 nt, Yersinia pestis
aaucaaugaccaauaccaaaac

SEQ ID NO: 287445 - RNA, 22 nt, Yersinia pestis
ucacauugccgguaacgcguua

SEQ ID NO: 287446 - RNA, 22 nt, Yersinia pestis
augaccgccuuguuugcuggug

SEQ ID NO: 287447 - RNA, 22 nt, Yersinia pestis
aaaucgacugauauucagcgau

SEQ ID NO: 287448 - RNA, 22 nt, Yersinia pestis
ggaacgccaaguaugcaggccc

SEQ ID NO: 287449 - RNA, 22 nt, Yersinia pestis
acuucaucgcacuuaaucaacg

SEQ ID NO: 287450 - RNA, 22 nt, Yersinia pestis
guuagcuguucucgugcuauuc

SEQ ID NO: 287451 - RNA, 18 nt, Yersinia pestis
cgccacugugaugccccc

SEQ ID NO: 287452 - RNA, 22 nt, Yersinia pestis
ugucgaugaacugcguuuauau

SEQ ID NO: 287453 - RNA, 18 nt, Yersinia pestis
uguuuaaccacacgggug

SEQ ID NO: 287454 - RNA, 22 nt, Yersinia pestis
uggcuagcguauuaaugccagu

SEQ ID NO: 287455 - RNA, 22 nt, Yersinia pestis
aggauuauucauggugaauggu

SEQ ID NO: 287456 - RNA, 22 nt, Yersinia pestis
cauuugauuuuggugacgucug

SEQ ID NO: 287457 - RNA, 22 nt, Yersinia pestis
gugcaguaucgaucugagcuug

SEQ ID NO: 287458 - RNA, 22 nt, Yersinia pestis
aagggugccuggcuaacgcucc

SEQ ID NO: 287459 - RNA, 20 nt, Yersinia pestis
gcucuucggcaauaacagcu

SEQ ID NO: 287460 - RNA, 22 nt, Yersinia pestis
gaucaugaaaaaacuguccggu

SEQ ID NO: 287461 - RNA, 22 nt, Yersinia pestis
ggccgucagggucaggauauca

SEQ ID NO: 287462 - RNA, 22 nt, Yersinia pestis
cacuuugucaguaaccgcagua

SEQ ID NO: 287463 - RNA, 22 nt, Yersinia pestis
gagggauuuuugcaguaguccu

SEQ ID NO: 287464 - RNA, 22 nt, Yersinia pestis
aggugcaauuacagaagcuuga

SEQ ID NO: 287465 - RNA, 22 nt, Yersinia pestis
guuaggcuggagucacgguagc

SEQ ID NO: 287466 - RNA, 22 nt, Yersinia pestis
cugguauuccgcauugucaauu

SEQ ID NO: 287467 - RNA, 22 nt, Yersinia pestis
uggcguuagcccaacgggcaca

SEQ ID NO: 287468 - RNA, 22 nt, Yersinia pestis
accugaaggcugggcaagaggu

SEQ ID NO: 287469 - RNA, 22 nt, Yersinia pestis
agguaacgguuccuucaaaguc

SEQ ID NO: 287470 - RNA, 22 nt, Yersinia pestis
guguucauauucaugguuucaa

SEQ ID NO: 287471 - RNA, 22 nt, Yersinia pestis
agugccugcaucuguuuaccgg

SEQ ID NO: 287472 - RNA, 22 nt, Yersinia pestis
ugccagauccccagccuucacu

SEQ ID NO: 287473 - RNA, 22 nt, Yersinia pestis
aguaacgaauuacgcugaauug

SEQ ID NO: 287474 - RNA, 22 nt, Yersinia pestis
cgugcggaacaggugaugcagg

SEQ ID NO: 287475 - RNA, 22 nt, Yersinia pestis
uauccauauagcuguucagggu

SEQ ID NO: 287476 - RNA, 21 nt, Yersinia pestis
cggcuuagcccuggaauaucc

SEQ ID NO: 287477 - RNA, 22 nt, Yersinia pestis
uggcggaguguuucauccgugg

SEQ ID NO: 287478 - RNA, 22 nt, Yersinia pestis
cagcaacuggcguuucggaucc

SEQ ID NO: 287479 - RNA, 22 nt, Yersinia pestis
gcuaugacgaucaguggcacac

SEQ ID NO: 287480 - RNA, 22 nt, Yersinia pestis
gcggcugaauaugaaagacgau

SEQ ID NO: 287481 - RNA, 22 nt, Yersinia pestis
caucaaagaaauggauaaaggg

SEQ ID NO: 287482 - RNA, 22 nt, Yersinia pestis
uagcgucauaaauuaaugucac

SEQ ID NO: 287483 - RNA, 22 nt, Yersinia pestis
ucgugugaagaaaguuuaugua

SEQ ID NO: 287484 - RNA, 22 nt, Yersinia pestis
agucuaucguuaucugauggca

SEQ ID NO: 287485 - RNA, 22 nt, Yersinia pestis
ucgauucuuguucugcaacggu

SEQ ID NO: 287486 - RNA, 22 nt, Yersinia pestis
cgagagacgcugaauucauuga

SEQ ID NO: 287487 - RNA, 23 nt, Yersinia pestis
aaugccaggcaguguauucauac

SEQ ID NO: 287488 - RNA, 22 nt, Yersinia pestis
uacuguaucuuaauuuuaugcu

SEQ ID NO: 287489 - RNA, 22 nt, Yersinia pestis
uuggcagucaggccaggaugcu

SEQ ID NO: 287490 - RNA, 22 nt, Yersinia pestis
caucaacuccagugacauugac

SEQ ID NO: 287491 - RNA, 22 nt, Yersinia pestis
uucaaugauggucgaagggcgu

SEQ ID NO: 287492 - RNA, 22 nt, Yersinia pestis
uaacggcucuguuucagugggu

SEQ ID NO: 287493 - RNA, 22 nt, Yersinia pestis
gguguagacauuuuugcgcuua

SEQ ID NO: 287494 - RNA, 22 nt, Yersinia pestis
guauugauguauuacggcaagu

SEQ ID NO: 287495 - RNA, 22 nt, Yersinia pestis
uccugagagguuuuguaggcgu

SEQ ID NO: 287496 - RNA, 22 nt, Yersinia pestis
ggucggauguuuugaccggugu

SEQ ID NO: 287497 - RNA, 22 nt, Yersinia pestis
gauucagccugugacaccauca

SEQ ID NO: 287498 - RNA, 18 nt, Yersinia pestis
agccgcuauuuacggaug

SEQ ID NO: 287499 - RNA, 22 nt, Yersinia pestis
acaguauugggacaguauuugu

SEQ ID NO: 287500 - RNA, 22 nt, Yersinia pestis
uaacugauauauaaauuaaggc

SEQ ID NO: 287501 - RNA, 22 nt, Yersinia pestis
ggcuuccugcauucguucagcc

SEQ ID NO: 287502 - RNA, 20 nt, Yersinia pestis
gcggugauggaugaucacac

SEQ ID NO: 287503 - RNA, 22 nt, Yersinia pestis
cucguuauguugaaaaggccgc

SEQ ID NO: 287504 - RNA, 22 nt, Yersinia pestis
agucaccgggcguaccuuaguc

SEQ ID NO: 287505 - RNA, 22 nt, Yersinia pestis
uuugacuucugauucagcgagu

SEQ ID NO: 287506 - RNA, 18 nt, Yersinia pestis
gcucacugauuaacgcac

SEQ ID NO: 287507 - RNA, 20 nt, Yersinia pestis
cacuggguggacaucgcucu

SEQ ID NO: 287508 - RNA, 23 nt, Yersinia pestis
auggauaaacucgaugagugccg

SEQ ID NO: 287509 - RNA, 22 nt, Yersinia pestis
ugcgaacaugagcaauggcaga

SEQ ID NO: 287510 - RNA, 22 nt, Yersinia pestis
aagcggaucgucgauagguugg

SEQ ID NO: 287511 - RNA, 18 nt, Yersinia pestis
uguugcagcguaagccac

SEQ ID NO: 287512 - RNA, 22 nt, Yersinia pestis
ucuaugauuugaaaggugauuu

SEQ ID NO: 287513 - RNA, 22 nt, Yersinia pestis
gccgguauuggcguuugauaug

SEQ ID NO: 287514 - RNA, 22 nt, Yersinia pestis
acaaggucugaaugccgauaug

SEQ ID NO: 287515 - RNA, 22 nt, Yersinia pestis
uagaucguuaccuuggcaccca

SEQ ID NO: 287516 - RNA, 22 nt, Yersinia pestis
gucagggagagauaacggcacc

SEQ ID NO: 287517 - RNA, 22 nt, Yersinia pestis
gcaguaagaauaggcugcucau

SEQ ID NO: 287518 - RNA, 22 nt, Yersinia pestis
gauugccauucuggggcuggua

SEQ ID NO: 287519 - RNA, 22 nt, Yersinia pestis
ugucacugauuuuuaucguugc

SEQ ID NO: 287520 - RNA, 22 nt, Yersinia pestis
accucugauuaucucugaacaa

SEQ ID NO: 287521 - RNA, 22 nt, Yersinia pestis
ucggcgauaaccgucaggggca

SEQ ID NO: 287522 - RNA, 22 nt, Yersinia pestis
aucaaucagcuauuaagcguuu

SEQ ID NO: 287523 - RNA, 22 nt, Yersinia pestis
ucacaucacgcagguggcuuau

SEQ ID NO: 287524 - RNA, 22 nt, Yersinia pestis
cagcgcgaugguguauguuauc

SEQ ID NO: 287525 - RNA, 22 nt, Yersinia pestis
gcuggcgaguugagggagucug

SEQ ID NO: 287526 - RNA, 22 nt, Yersinia pestis
ugccaaguuuuaguuuaucucu

SEQ ID NO: 287527 - RNA, 22 nt, Yersinia pestis
uaucacuuugaucaauaccaug

SEQ ID NO: 287528 - RNA, 22 nt, Yersinia pestis
ggcgcagaaauugauugaugau

SEQ ID NO: 287529 - RNA, 22 nt, Yersinia pestis
acccgucguacuuuaagcugca

SEQ ID NO: 287530 - RNA, 22 nt, Yersinia pestis
uuggugaacgaucacauggcaa

SEQ ID NO: 287531 - RNA, 22 nt, Yersinia pestis
gcaccugguaguuggcaccacu

SEQ ID NO: 287532 - RNA, 22 nt, Yersinia pestis
ugcucaaguaucagugcucgca

SEQ ID NO: 287533 - RNA, 22 nt, Yersinia pestis
aauguaguguuguuaauguucu

SEQ ID NO: 287534 - RNA, 20 nt, Yersinia pestis
acuguaugugcguuggcuac

SEQ ID NO: 287535 - RNA, 22 nt, Yersinia pestis
uggcgaugguuggccgacuaga

SEQ ID NO: 287536 - RNA, 22 nt, Yersinia pestis
ugccaagcgcuuuggcaauuuc

SEQ ID NO: 287537 - RNA, 22 nt, Yersinia pestis
ucgcuacagcuuuaagcccgaa

SEQ ID NO: 287538 - RNA, 22 nt, Yersinia pestis
acaggcugacgaauugaugauu

SEQ ID NO: 287539 - RNA, 22 nt, Yersinia pestis
uggcaucaagcacguuauugcu

SEQ ID NO: 287540 - RNA, 22 nt, Yersinia pestis
agcuuugugggauaccguauca

SEQ ID NO: 287541 - RNA, 22 nt, Yersinia pestis
acgguguacgggauuaccgugg

SEQ ID NO: 287542 - RNA, 22 nt, Yersinia pestis
aacgacuggcgucacuggauaa

SEQ ID NO: 287543 - RNA, 22 nt, Yersinia pestis
gccacaagcaacauuaucgucu

SEQ ID NO: 287544 - RNA, 22 nt, Yersinia pestis
uccuggcuaaugcugccgccgg

SEQ ID NO: 287545 - RNA, 22 nt, Yersinia pestis
uugcuggcccacguguuauuga

SEQ ID NO: 287546 - RNA, 22 nt, Yersinia pestis
agcgcauuuaaaaauaaugauc

SEQ ID NO: 287547 - RNA, 22 nt, Yersinia pestis
agugaguuugugcagacauucc

SEQ ID NO: 287548 - RNA, 22 nt, Yersinia pestis
cggucgucgccgaugcguguua

SEQ ID NO: 287549 - RNA, 22 nt, Yersinia pestis
acacauauuucaggcuguugcg

SEQ ID NO: 287550 - RNA, 22 nt, Yersinia pestis
gguaccagaagcagaggugccc

SEQ ID NO: 287551 - RNA, 22 nt, Yersinia pestis
ugugaaguugcaggauacgucc

SEQ ID NO: 287552 - RNA, 22 nt, Yersinia pestis
aacgcaguggagguuacguucg

SEQ ID NO: 287553 - RNA, 22 nt, Yersinia pestis
cauugaaauagaauaaugucuc

SEQ ID NO: 287554 - RNA, 22 nt, Yersinia pestis
aaugagucaauagcauucaagc

SEQ ID NO: 287555 - RNA, 22 nt, Yersinia pestis
ccgguaucugauauugcugcuu

SEQ ID NO: 287556 - RNA, 22 nt, Yersinia pestis
agcaggccaucacgaccuugcu

SEQ ID NO: 287557 - RNA, 22 nt, Yersinia pestis
aacgucgagcaacaagagcgug

SEQ ID NO: 287558 - RNA, 22 nt, Yersinia pestis
cuuggauauuauccgccgcuau

SEQ ID NO: 287559 - RNA, 21 nt, Yersinia pestis
ugccauugagaacggcgugga

SEQ ID NO: 287560 - RNA, 22 nt, Yersinia pestis
aucgcgauccagaccugacucu

SEQ ID NO: 287561 - RNA, 22 nt, Yersinia pestis
gguuuaccagaaugacacauua

SEQ ID NO: 287562 - RNA, 22 nt, Yersinia pestis
auacuccugccggcugacaggu

SEQ ID NO: 287563 - RNA, 22 nt, Yersinia pestis
gaagauccgcuggggauggaag

SEQ ID NO: 287564 - RNA, 22 nt, Yersinia pestis
gagucuaaaaauaacauaagcu

SEQ ID NO: 287565 - RNA, 22 nt, Yersinia pestis
gucuuagugugaguacaucuau

SEQ ID NO: 287566 - RNA, 22 nt, Yersinia pestis
auggucagcaaagugccgaguu

SEQ ID NO: 287567 - RNA, 22 nt, Yersinia pestis
ucaacguaucuuuaauuuuaua

SEQ ID NO: 287568 - RNA, 22 nt, Yersinia pestis
uugcgaccaucacccugacugc

SEQ ID NO: 287569 - RNA, 22 nt, Yersinia pestis
cugauaccgauuaucuucggua

SEQ ID NO: 287570 - RNA, 19 nt, Yersinia pestis
caguggcaaaaucagcgcc

SEQ ID NO: 287571 - RNA, 22 nt, Yersinia pestis
ucagugaacucgaugauaauca

SEQ ID NO: 287572 - RNA, 22 nt, Yersinia pestis
gccuugagugcuuacuggggau

SEQ ID NO: 287573 - RNA, 20 nt, Yersinia pestis
uggcgcagcgcagaugccgc

SEQ ID NO: 287574 - RNA, 19 nt, Yersinia pestis
ggagucuuuucuuuaguca

SEQ ID NO: 287575 - RNA, 22 nt, Yersinia pestis
aaacccuguccgguggcgaagc

SEQ ID NO: 287576 - RNA, 22 nt, Yersinia pestis
ugaucaaauuuuuguuacgacg

SEQ ID NO: 287577 - RNA, 22 nt, Yersinia pestis
cgauagcugccauguggacggc

SEQ ID NO: 287578 - RNA, 19 nt, Yersinia pestis
ggccuguacggauuggcga

SEQ ID NO: 287579 - RNA, 22 nt, Yersinia pestis
aauggugcggcgaugaagucgc

SEQ ID NO: 287580 - RNA, 22 nt, Yersinia pestis
cuacaugaaacguaaaucaguc

SEQ ID NO: 287581 - RNA, 22 nt, Yersinia pestis
guuugccgaucauuauguuaac

SEQ ID NO: 287582 - RNA, 22 nt, Yersinia pestis
cuguucuauugucuuauugucu

SEQ ID NO: 287583 - RNA, 22 nt, Yersinia pestis
agccgccaauauugucaaaauu

SEQ ID NO: 287584 - RNA, 22 nt, Yersinia pestis
uauuaggaugguuagaguggga

SEQ ID NO: 287585 - RNA, 22 nt, Yersinia pestis
cauguugacgaauaauuucauu

SEQ ID NO: 287586 - RNA, 22 nt, Yersinia pestis
augcuguugccaagggaacuaa

SEQ ID NO: 287587 - RNA, 22 nt, Yersinia pestis
cagugcauuuuucggcucuuua

SEQ ID NO: 287588 - RNA, 22 nt, Yersinia pestis
cuggacaucucuuacuccguug

SEQ ID NO: 287589 - RNA, 22 nt, Yersinia pestis
ccugacuuucuguuguguuggu

SEQ ID NO: 287590 - RNA, 22 nt, Yersinia pestis
gguauugauguugguuggaagg

SEQ ID NO: 287591 - RNA, 22 nt, Yersinia pestis
gcaagucaaaaaauaucacuga

SEQ ID NO: 287592 - RNA, 22 nt, Yersinia pestis
ggagugcuuccgccaaccagac

SEQ ID NO: 287593 - RNA, 19 nt, Yersinia pestis
acagcguuucggugucuuc

SEQ ID NO: 287594 - RNA, 22 nt, Yersinia pestis
gccagagacaaugucgacgacg

SEQ ID NO: 287595 - RNA, 22 nt, Yersinia pestis
ugaucacuauuuuucaccgauu

SEQ ID NO: 287596 - RNA, 18 nt, Yersinia pestis
agcccgcuuauuggucag

SEQ ID NO: 287597 - RNA, 22 nt, Yersinia pestis
uugaggauaaccagcaugucug

SEQ ID NO: 287598 - RNA, 22 nt, Yersinia pestis
ugaauuucacaucacgacauuu

SEQ ID NO: 287599 - RNA, 22 nt, Yersinia pestis
gauauucgcgcagcacagauug

SEQ ID NO: 287600 - RNA, 22 nt, Yersinia pestis
agcauaacagcuugcugccgag

SEQ ID NO: 287601 - RNA, 22 nt, Yersinia pestis
agcuaauuguguuuuuaggcug

SEQ ID NO: 287602 - RNA, 21 nt, Yersinia pestis
aggcaacuucaauuaugcggc

SEQ ID NO: 287603 - RNA, 22 nt, Yersinia pestis
uuggcugaaguuaaucucaaug

SEQ ID NO: 287604 - RNA, 22 nt, Yersinia pestis
uaaguugucuguuugcuguaua

SEQ ID NO: 287605 - RNA, 22 nt, Yersinia pestis
aaacucguaauaucuuuaaagc

SEQ ID NO: 287606 - RNA, 22 nt, Yersinia pestis
auguuucuccauuuugccauug

SEQ ID NO: 287607 - RNA, 22 nt, Yersinia pestis
augaguugcucacauugcugcc

SEQ ID NO: 287608 - RNA, 22 nt, Yersinia pestis
ugaugcagggcaccguaucgug

SEQ ID NO: 287609 - RNA, 22 nt, Yersinia pestis
ugcugcgaguuucgauaucacu

SEQ ID NO: 287610 - RNA, 22 nt, Yersinia pestis
cuuugucaauacccugaaggcc

SEQ ID NO: 287611 - RNA, 21 nt, Yersinia pestis
uacuaucuaaaaguuuaaggu

SEQ ID NO: 287612 - RNA, 22 nt, Yersinia pestis
guggcgaugcuggcaaugcugg

SEQ ID NO: 287613 - RNA, 22 nt, Yersinia pestis
agcgcuguuaucgccagccacu

SEQ ID NO: 287614 - RNA, 22 nt, Yersinia pestis
gucgucauucacacccaaugua

SEQ ID NO: 287615 - RNA, 22 nt, Yersinia pestis
uguugcauugccugaaguaauu

SEQ ID NO: 287616 - RNA, 22 nt, Yersinia pestis
gauaccaauuuagcguucagaa

SEQ ID NO: 287617 - RNA, 22 nt, Yersinia pestis
aagccguauuaacugaauacca

SEQ ID NO: 287618 - RNA, 22 nt, Yersinia pestis
auuggcuagccaugcuguccuu

SEQ ID NO: 287619 - RNA, 22 nt, Yersinia pestis
aauaagcgaauuugguugucau

SEQ ID NO: 287620 - RNA, 22 nt, Yersinia pestis
cucugcgacgggaagcggugcu

SEQ ID NO: 287621 - RNA, 22 nt, Yersinia pestis
guugucauccaauuggucgcca

SEQ ID NO: 287622 - RNA, 22 nt, Yersinia pestis
auggagaccuccucaggggaua

SEQ ID NO: 287623 - RNA, 22 nt, Yersinia pestis
uaucgcuuugggcuugcucccu

SEQ ID NO: 287624 - RNA, 22 nt, Yersinia pestis
cagagcagucauuaaauuuuau

SEQ ID NO: 287625 - RNA, 22 nt, Yersinia pestis
cggcguagugggcgaccugacc

SEQ ID NO: 287626 - RNA, 21 nt, Yersinia pestis
ucauuucaucugguggcuuau

SEQ ID NO: 287627 - RNA, 22 nt, Yersinia pestis
ugcacugaaccccagaucuugg

SEQ ID NO: 287628 - RNA, 22 nt, Yersinia pestis
gcaaagcgaaaugaauaauguc

SEQ ID NO: 287629 - RNA, 22 nt, Yersinia pestis
accgcgcacgauaaagguaaua

SEQ ID NO: 287630 - RNA, 21 nt, Yersinia pestis
cugugucagggugauauuggc

SEQ ID NO: 287631 - RNA, 22 nt, Yersinia pestis
uuaagguuagcuaugcaguuaa

SEQ ID NO: 287632 - RNA, 22 nt, Yersinia pestis
guuaugaacauccaguuuagcu

SEQ ID NO: 287633 - RNA, 22 nt, Yersinia pestis
guauugaagucgcauucgcggg

SEQ ID NO: 287634 - RNA, 22 nt, Yersinia pestis
gagguuuccugauuauaguauu

SEQ ID NO: 287635 - RNA, 22 nt, Yersinia pestis
ccaaugaugccauguggcacau

SEQ ID NO: 287636 - RNA, 22 nt, Yersinia pestis
acagaguauuaccgcaaaauga

SEQ ID NO: 287637 - RNA, 22 nt, Yersinia pestis
ugcgugaauuaaucccaggugc

SEQ ID NO: 287638 - RNA, 22 nt, Yersinia pestis
uaccgcucucugucacucgccg

SEQ ID NO: 287639 - RNA, 22 nt, Yersinia pestis
cgccgguuucaagcgucaggua

SEQ ID NO: 287640 - RNA, 19 nt, Yersinia pestis
gcauugguaggcccuaucc

SEQ ID NO: 287641 - RNA, 21 nt, Yersinia pestis
uuaccgucaccggaauagcua

SEQ ID NO: 287642 - RNA, 22 nt, Yersinia pestis
ugcacagcuggaugugagucug

SEQ ID NO: 287643 - RNA, 22 nt, Yersinia pestis
agcaggcuaaacagcaugcauu

SEQ ID NO: 287644 - RNA, 22 nt, Yersinia pestis
auaaccugauuuaucagccuac

SEQ ID NO: 287645 - RNA, 22 nt, Yersinia pestis
aggauaccauuugucagggucu

SEQ ID NO: 287646 - RNA, 22 nt, Yersinia pestis
cggcgugaugggucuccgcaga

SEQ ID NO: 287647 - RNA, 22 nt, Yersinia pestis
guccagcuaagggguauuccca

SEQ ID NO: 287648 - RNA, 21 nt, Yersinia pestis
acucaccgggacucagaauau

SEQ ID NO: 287649 - RNA, 22 nt, Yersinia pestis
cguaauggcagaagccgguggu

SEQ ID NO: 287650 - RNA, 22 nt, Yersinia pestis
ggguauucgccuuuggucagug

SEQ ID NO: 287651 - RNA, 22 nt, Yersinia pestis
acuggauguugauauuccucau

SEQ ID NO: 287652 - RNA, 22 nt, Yersinia pestis
cugaugaauuacgugaugcggu

SEQ ID NO: 287653 - RNA, 22 nt, Yersinia pestis
agacauauagagcagguuaucg

SEQ ID NO: 287654 - RNA, 22 nt, Yersinia pestis
gcccaugaccguuuugguggcu

SEQ ID NO: 287655 - RNA, 22 nt, Yersinia pestis
acgauuaacaugaucguguugc

SEQ ID NO: 287656 - RNA, 22 nt, Yersinia pestis
auuacgacagucucauuuuagc

SEQ ID NO: 287657 - RNA, 22 nt, Yersinia pestis
cgguugaugagaaagaugcgcu

SEQ ID NO: 287658 - RNA, 22 nt, Yersinia pestis
agauuucagacugcugacaacc

SEQ ID NO: 287659 - RNA, 22 nt, Yersinia pestis
uuuggcaugugggcuaucagga

SEQ ID NO: 287660 - RNA, 22 nt, Yersinia pestis
aaucggugcugacaccacagga

SEQ ID NO: 287661 - RNA, 22 nt, Yersinia pestis
uacugcaucauguuugcugauu

SEQ ID NO: 287662 - RNA, 22 nt, Yersinia pestis
ugugcugauaauaggugugaug

SEQ ID NO: 287663 - RNA, 22 nt, Yersinia pestis
auggaucuuguccugagugcgg

SEQ ID NO: 287664 - RNA, 22 nt, Yersinia pestis
uggcaagaacuggcagcagaua

SEQ ID NO: 287665 - RNA, 18 nt, Yersinia pestis
cggcguaacuggccguua

SEQ ID NO: 287666 - RNA, 21 nt, Yersinia pestis
uauucgcucccaguuugaugc

SEQ ID NO: 287667 - RNA, 22 nt, Yersinia pestis
ccgugauaaauaacccgaauca

SEQ ID NO: 287668 - RNA, 22 nt, Yersinia pestis
ucaguuaaucugagugcgcuau

SEQ ID NO: 287669 - RNA, 22 nt, Yersinia pestis
gcggauauacccaaguugcuga

SEQ ID NO: 287670 - RNA, 22 nt, Yersinia pestis
agcggcguugaacugccaaaag

SEQ ID NO: 287671 - RNA, 22 nt, Yersinia pestis
uuugccauggaauauuaucccg

SEQ ID NO: 287672 - RNA, 22 nt, Yersinia pestis
aagccuuuauugaaugcaucca

SEQ ID NO: 287673 - RNA, 22 nt, Yersinia pestis
gucuaucuguuacaaacacgca

SEQ ID NO: 287674 - RNA, 22 nt, Yersinia pestis
uggugaucagguccggugacuc

SEQ ID NO: 287675 - RNA, 22 nt, Yersinia pestis
augaccugauauggugcgacgg

SEQ ID NO: 287676 - RNA, 22 nt, Yersinia pestis
ggauuauguuauagucguuaaa

SEQ ID NO: 287677 - RNA, 22 nt, Yersinia pestis
aaugucaccgaauugaaugggc

SEQ ID NO: 287678 - RNA, 22 nt, Yersinia pestis
aagcagcgacaggagaaggguu

SEQ ID NO: 287679 - RNA, 22 nt, Yersinia pestis
aucaggucagcagugaugaagu

SEQ ID NO: 287680 - RNA, 22 nt, Yersinia pestis
ggcgauauugcgucaggcacug

SEQ ID NO: 287681 - RNA, 22 nt, Yersinia pestis
auucaugucagugcuaucacuc

SEQ ID NO: 287682 - RNA, 22 nt, Yersinia pestis
gaagauacuuauguuguuaauu

SEQ ID NO: 287683 - RNA, 22 nt, Yersinia pestis
ugcuggcgucuucagugacuuu

SEQ ID NO: 287684 - RNA, 22 nt, Yersinia pestis
uggcugcagguaacagccugga

SEQ ID NO: 287685 - RNA, 22 nt, Yersinia pestis
ucaguaagaggggacaggguau

SEQ ID NO: 287686 - RNA, 22 nt, Yersinia pestis
uugaucauggcugagguguguc

SEQ ID NO: 287687 - RNA, 19 nt, Yersinia pestis
gccaaugccgcucggcucc

SEQ ID NO: 287688 - RNA, 22 nt, Yersinia pestis
uaucgugaugaccccgguuauc

SEQ ID NO: 287689 - RNA, 22 nt, Yersinia pestis
ucgaagaacuggcauugcguuu

SEQ ID NO: 287690 - RNA, 19 nt, Yersinia pestis
cagcaaagccagcaguuuu

SEQ ID NO: 287691 - RNA, 22 nt, Yersinia pestis
agcugggugccuugcagaucag

SEQ ID NO: 287692 - RNA, 22 nt, Yersinia pestis
uaucgcguuacuggcgggcgug

SEQ ID NO: 287693 - RNA, 22 nt, Yersinia pestis
cacagaugcuggagaaggucgg

SEQ ID NO: 287694 - RNA, 22 nt, Yersinia pestis
auuagcagugaugguuauuuau

SEQ ID NO: 287695 - RNA, 22 nt, Yersinia pestis
guaauggucgauguugaucgcg

SEQ ID NO: 287696 - RNA, 22 nt, Yersinia pestis
uucgguaugaguuuauugcuuu

SEQ ID NO: 287697 - RNA, 22 nt, Yersinia pestis
ccgccuaugccacccguauugc

SEQ ID NO: 287698 - RNA, 21 nt, Yersinia pestis
gugcaguuuuuuauugaugua

SEQ ID NO: 287699 - RNA, 22 nt, Yersinia pestis
gccguggugagcggguauggcu

SEQ ID NO: 287700 - RNA, 22 nt, Yersinia pestis
augcaauugcugaggugcgcug

SEQ ID NO: 287701 - RNA, 21 nt, Yersinia pestis
auuguugcucguaaggcagcc

SEQ ID NO: 287702 - RNA, 22 nt, Yersinia pestis
auuacccugggacucaagguua

SEQ ID NO: 287703 - RNA, 22 nt, Yersinia pestis
agcaucgucuccaguuugauga

SEQ ID NO: 287704 - RNA, 22 nt, Yersinia pestis
ucgauuauuacccggcgaaucu

SEQ ID NO: 287705 - RNA, 22 nt, Yersinia pestis
aaccgcagauggcggcggaucu

SEQ ID NO: 287706 - RNA, 22 nt, Yersinia pestis
ugucgguaaccguuacggggca

SEQ ID NO: 287707 - RNA, 22 nt, Yersinia pestis
gauucaucgacaacaucaucgu

SEQ ID NO: 287708 - RNA, 22 nt, Yersinia pestis
ugacgcguguugcuauuccaau

SEQ ID NO: 287709 - RNA, 22 nt, Yersinia pestis
cauugguuugguacgcaagcca

SEQ ID NO: 287710 - RNA, 22 nt, Yersinia pestis
aaugacugagauuauuaacagu

SEQ ID NO: 287711 - RNA, 22 nt, Yersinia pestis
augaggcacguguacaugacua

SEQ ID NO: 287712 - RNA, 22 nt, Yersinia pestis
cgcccugaacacccugccgacg

SEQ ID NO: 287713 - RNA, 22 nt, Yersinia pestis
gagcagcaugaucaacaguuga

SEQ ID NO: 287714 - RNA, 22 nt, Yersinia pestis
uauggcuuuacggcucaccugg

SEQ ID NO: 287715 - RNA, 22 nt, Yersinia pestis
uaaugguaaauucauaauccac

SEQ ID NO: 287716 - RNA, 22 nt, Yersinia pestis
gcuggauaucuugcugugcaac

SEQ ID NO: 287717 - RNA, 20 nt, Yersinia pestis
ucaaggcagaagccacauuc

SEQ ID NO: 287718 - RNA, 22 nt, Yersinia pestis
uggcacaguauuugauuuuggg

SEQ ID NO: 287719 - RNA, 22 nt, Yersinia pestis
uugccagugucaauugguuacc

SEQ ID NO: 287720 - RNA, 22 nt, Yersinia pestis
agucuucgcuggcagugccuau

SEQ ID NO: 287721 - RNA, 22 nt, Yersinia pestis
auugaugugccaggggauaaua

SEQ ID NO: 287722 - RNA, 22 nt, Yersinia pestis
gaucucccgcaauaccguuaaa

SEQ ID NO: 287723 - RNA, 22 nt, Yersinia pestis
aaucauguuguagagaaacgaa

SEQ ID NO: 287724 - RNA, 21 nt, Yersinia pestis
ugaucggccagugccagcgcu

SEQ ID NO: 287725 - RNA, 22 nt, Yersinia pestis
uuaaggauugucauuagucgcg

SEQ ID NO: 287726 - RNA, 22 nt, Yersinia pestis
aacugcacuggcggucgagagg

SEQ ID NO: 287727 - RNA, 22 nt, Yersinia pestis
uauugcgcuuuuguuagcgggu

SEQ ID NO: 287728 - RNA, 22 nt, Yersinia pestis
acguuucuuuacguaaaguacg

SEQ ID NO: 287729 - RNA, 22 nt, Yersinia pestis
ugcucgccguaauaaucugagu

SEQ ID NO: 287730 - RNA, 20 nt, Yersinia pestis
ggugacgguagcgacggugg

SEQ ID NO: 287731 - RNA, 22 nt, Yersinia pestis
gucaguuuccugcucuguucca

SEQ ID NO: 287732 - RNA, 20 nt, Yersinia pestis
ccagcuugcaauucggcgau

SEQ ID NO: 287733 - RNA, 22 nt, Yersinia pestis
acguuggcaauagugccgucca

SEQ ID NO: 287734 - RNA, 22 nt, Yersinia pestis
uggccaauaugucccaugagcu

SEQ ID NO: 287735 - RNA, 22 nt, Yersinia pestis
acguucagacagugugccguug

SEQ ID NO: 287736 - RNA, 23 nt, Yersinia pestis
ucaguguuggaucuuguguuggc

SEQ ID NO: 287737 - RNA, 22 nt, Yersinia pestis
gcugauccaaacgcuggcgcag

SEQ ID NO: 287738 - RNA, 17 nt, Yersinia pestis
uccagugcacucaauac

SEQ ID NO: 287739 - RNA, 22 nt, Yersinia pestis
gugcucuugccgcagguuuacu

SEQ ID NO: 287740 - RNA, 22 nt, Yersinia pestis
ucagucguauacugauauuauc

SEQ ID NO: 287741 - RNA, 22 nt, Yersinia pestis
auccugaucgccuccggcguuc

SEQ ID NO: 287742 - RNA, 22 nt, Yersinia pestis
guauugacacauuuauugccaa

SEQ ID NO: 287743 - RNA, 20 nt, Yersinia pestis
uugaacagaacgcggaagcc

SEQ ID NO: 287744 - RNA, 20 nt, Yersinia pestis
aucggcgcgguggucgccgc

SEQ ID NO: 287745 - RNA, 22 nt, Yersinia pestis
ugguugcaccgggcgcugaaag

SEQ ID NO: 287746 - RNA, 22 nt, Yersinia pestis
ggccgaugcugauauuuuugua

SEQ ID NO: 287747 - RNA, 22 nt, Yersinia pestis
agcgauaaaccgguaugcagga

SEQ ID NO: 287748 - RNA, 19 nt, Yersinia pestis
aaaugagucuugcagagau

SEQ ID NO: 287749 - RNA, 22 nt, Yersinia pestis
acaggcugacgaauugaugauu

SEQ ID NO: 287750 - RNA, 22 nt, Yersinia pestis
aaugucuuuauugaucgauuca

SEQ ID NO: 287751 - RNA, 22 nt, Yersinia pestis
acaguauugggacaguauuugu

SEQ ID NO: 287752 - RNA, 19 nt, Yersinia pestis
accaauaugaaguuacugg

SEQ ID NO: 287753 - RNA, 22 nt, Yersinia pestis
accacgaguacggcugcggcga

SEQ ID NO: 287754 - RNA, 22 nt, Yersinia pestis
auuuccacaauuuguacugcca

SEQ ID NO: 287755 - RNA, 22 nt, Yersinia pestis
auugucaugcagaaucgaaacu

SEQ ID NO: 287756 - RNA, 22 nt, Yersinia pestis
auggagaccuccucaggggaua

SEQ ID NO: 287757 - RNA, 22 nt, Yersinia pestis
cacgcgcuaacguuucucaggu

SEQ ID NO: 287758 - RNA, 20 nt, Yersinia pestis
cagcauggaucccagcggcu

SEQ ID NO: 287759 - RNA, 22 nt, Yersinia pestis
cagcgcagcguccugacgcuga

SEQ ID NO: 287760 - RNA, 22 nt, Yersinia pestis
aguucuauguucgugaacgccg

SEQ ID NO: 287761 - RNA, 22 nt, Yersinia pestis
agugaguuugugcagacauucc

SEQ ID NO: 287762 - RNA, 20 nt, Yersinia pestis
agugggucuuuccaucgcca

SEQ ID NO: 287763 - RNA, 22 nt, Yersinia pestis
acuucaucugaucauuggcuga

SEQ ID NO: 287764 - RNA, 17 nt, Yersinia pestis
aguaggguuauguguga

SEQ ID NO: 287765 - RNA, 22 nt, Yersinia pestis
aucaaucagcuauuaagcguuu

SEQ ID NO: 287766 - RNA, 22 nt, Yersinia pestis
augaggcacguguacaugacua

SEQ ID NO: 287767 - RNA, 22 nt, Yersinia pestis
gaacauaggguggcggcuaaaa

SEQ ID NO: 287768 - RNA, 22 nt, Yersinia pestis
cuguucuauugucuuauugucu

SEQ ID NO: 287769 - RNA, 21 nt, Yersinia pestis
cugugucagggugauauuggc

SEQ ID NO: 287770 - RNA, 22 nt, Yersinia pestis
cucaaucauugauggcguacgg

SEQ ID NO: 287771 - RNA, 22 nt, Yersinia pestis
cucguuauguugaaaaggccgc

SEQ ID NO: 287772 - RNA, 22 nt, Yersinia pestis
cucugcgacgggaagcggugcu

SEQ ID NO: 287773 - RNA, 19 nt, Yersinia pestis
caucauuugcaacucccau

SEQ ID NO: 287774 - RNA, 22 nt, Yersinia pestis
caggcucauugcguaugcagag

SEQ ID NO: 287775 - RNA, 22 nt, Yersinia pestis
cagggcuguuuacacgcaagau

SEQ ID NO: 287776 - RNA, 22 nt, Yersinia pestis
gcuggcugagaucggcaaucug

SEQ ID NO: 287777 - RNA, 22 nt, Yersinia pestis
gaauugaacucaucaaucauug

SEQ ID NO: 287778 - RNA, 22 nt, Yersinia pestis
gaauucauaagguagacuugga

SEQ ID NO: 287779 - RNA, 22 nt, Yersinia pestis
gccagagacaaugucgacgacg

SEQ ID NO: 287780 - RNA, 20 nt, Yersinia pestis
ucuauuguuacuuuuaauac

SEQ ID NO: 287781 - RNA, 22 nt, Yersinia pestis
ucuucaguggccgugaugaaau

SEQ ID NO: 287782 - RNA, 22 nt, Yersinia pestis
ucaguguggugucauucgcugu

SEQ ID NO: 287783 - RNA, 22 nt, Yersinia pestis
ucagugaacucgaugauaauca

SEQ ID NO: 287784 - RNA, 21 nt, Yersinia pestis
ucauuucaucugguggcuuau

SEQ ID NO: 287785 - RNA, 22 nt, Yersinia pestis
uggccugcgggaugugauguca

SEQ ID NO: 287786 - RNA, 22 nt, Yersinia pestis
uggcugcagguaacagccugga

SEQ ID NO: 287787 - RNA, 22 nt, Yersinia pestis
ugucgcauuacugaaugccacg

SEQ ID NO: 287788 - RNA, 22 nt, Yersinia pestis
ugugacuucaacaugccgcugc

SEQ ID NO: 287789 - RNA, 22 nt, Yersinia pestis
uguaucuugcaagguuggugua

SEQ ID NO: 287790 - RNA, 22 nt, Yersinia pestis
ugucacugauuuuuaucguugc

SEQ ID NO: 287791 - RNA, 22 nt, Yersinia pestis
uaucgauaauaugugcuguuuu

SEQ ID NO: 287792 - RNA, 21 nt, Yersinia pestis
uaaagcuuuauucaauggcgu

SEQ ID NO: 287793 - RNA, 22 nt, Yersinia pestis
ugugccacuacauggcaauuga

SEQ ID NO: 287794 - RNA, 22 nt, Yersinia pestis
ugucugaacuugcuuuagugga

SEQ ID NO: 287795 - RNA, 22 nt, Yersinia pestis
uuacucaucuggaaggcuaccg

SEQ ID NO: 287796 - RNA, 22 nt, Yersinia pestis
accucaguaaagggaggagauc

SEQ ID NO: 287797 - RNA, 22 nt, Yersinia pestis
aaugaguauaggcuggccuggg

SEQ ID NO: 287798 - RNA, 22 nt, Yersinia pestis
agauuucagacugcugacaacc

SEQ ID NO: 287799 - RNA, 22 nt, Yersinia pestis
agaggcucuguuagcgguaaag

SEQ ID NO: 287800 - RNA, 22 nt, Yersinia pestis
agacauauagagcagguuaucg

SEQ ID NO: 287801 - RNA, 22 nt, Yersinia pestis
aggauuauucauggugaauggu

SEQ ID NO: 287802 - RNA, 22 nt, Yersinia pestis
aggcaucucugucauccaguaa

SEQ ID NO: 287803 - RNA, 22 nt, Yersinia pestis
agcuggcuucagagauggcgug

SEQ ID NO: 287804 - RNA, 22 nt, Yersinia pestis
uuuccagugccgccuuugccau

SEQ ID NO: 287805 - RNA, 22 nt, Yersinia pestis
uugaggauaaccagcaugucug

SEQ ID NO: 287806 - RNA, 22 nt, Yersinia pestis
uugccagugucaauugguuacc

SEQ ID NO: 287807 - RNA, 22 nt, Yersinia pestis
uugcuucagccacguuugcuga

SEQ ID NO: 287808 - RNA, 23 nt, Yersinia pestis
uuggccaugcucguuuuacauag

SEQ ID NO: 287809 - RNA, 22 nt, Yersinia pestis
gauugccauucuggggcuggua

SEQ ID NO: 287810 - RNA, 22 nt, Yersinia pestis
gccucaggcgcugauccgugag

SEQ ID NO: 287811 - RNA, 22 nt, Yersinia pestis
cuggaugggagcgagagugcau

SEQ ID NO: 287812 - RNA, 22 nt, Yersinia pestis
ccuugucacgguuagcuguuau

SEQ ID NO: 287813 - RNA, 22 nt, Yersinia pestis
cauguugacgaauaauuucauu

SEQ ID NO: 287814 - RNA, 23 nt, Yersinia pestis
cccacagguuuuuacccauccuc

SEQ ID NO: 287815 - RNA, 22 nt, Yersinia pestis
cccgugucgucaacggcgcuuu

SEQ ID NO: 287816 - RNA, 22 nt, Yersinia pestis
gguguagacauuuuugcgcuua

SEQ ID NO: 287817 - RNA, 18 nt, Yersinia pestis
gcucacugauuaacgcac

SEQ ID NO: 287818 - RNA, 22 nt, Yersinia pestis
ggagugcuuccgccaaccagac

SEQ ID NO: 287819 - RNA, 22 nt, Yersinia pestis
guucacugucgguaaagucuuc

SEQ ID NO: 287820 - RNA, 22 nt, Yersinia pestis
uacugcaucauguuugcugauu

SEQ ID NO: 287821 - RNA, 22 nt, Yersinia pestis
guuguagcuguuaucucgauuu

SEQ ID NO: 287822 - RNA, 22 nt, Yersinia pestis
uggaaguuauggggaauguuuu

SEQ ID NO: 287823 - RNA, 22 nt, Yersinia pestis
ugccaagcacuuugcggcuuua

SEQ ID NO: 287824 - RNA, 22 nt, Yersinia pestis
ugccaagcgcuuuggcaauuuc

SEQ ID NO: 287825 - RNA, 19 nt, Yersinia pestis
ucaaacaucugaugagacg

SEQ ID NO: 287826 - RNA, 22 nt, Human
aaaaaauugcuggcagagcugu

SEQ ID NO: 287827 - RNA, 22 nt, Human
aaaaaggagaaagagagggaga

SEQ ID NO: 287828 - RNA, 22 nt, Human
aaaagauguaaacauauauuaa

SEQ ID NO: 287829 - RNA, 22 nt, Human
aaaaggacaguagccuugaggu

SEQ ID NO: 287830 - RNA, 22 nt, Human
aaaacuuucagggauacagaaa

SEQ ID NO: 287831 - RNA, 22 nt, Human
aaaaaguaccacuuggacacuu

SEQ ID NO: 287832 - RNA, 22 nt, Human
aaaacauuuaggguuuuuuuua

SEQ ID NO: 287833 - RNA, 20 nt, Human
aaaaacaguaaugcugaaga

SEQ ID NO: 287834 - RNA, 22 nt, Human
aaaaaaacuaauuuuaaaugug

SEQ ID NO: 287835 - RNA, 22 nt, Human
aaaaacuuaccccagggcaagg

SEQ ID NO: 287836 - RNA, 22 nt, Human
aaagacagccuguuggcuuucu

SEQ ID NO: 287837 - RNA, 22 nt, Human
aaacugugcagucacauaagga

SEQ ID NO: 287838 - RNA, 22 nt, Human
aaagagccaacuaccgcaaauu

SEQ ID NO: 287839 - RNA, 22 nt, Human
aaagagacaacaacaacuucua

SEQ ID NO: 287840 - RNA, 22 nt, Human
aaagaagugucuuacucccucu

SEQ ID NO: 287841 - RNA, 21 nt, Human
aaagaagagcucagagguaga

SEQ ID NO: 287842 - RNA, 22 nt, Human
aaacucuaagacuaaaauugaa

SEQ ID NO: 287843 - RNA, 22 nt, Human
aaagaauuucaagauucccaca

SEQ ID NO: 287844 - RNA, 21 nt, Human
aaagaaguuaguucagugguu

SEQ ID NO: 287845 - RNA, 20 nt, Human
aaacucucugaucuuacagu

SEQ ID NO: 287846 - RNA, 22 nt, Human
aaaccagaguucauaguauuca

SEQ ID NO: 287847 - RNA, 22 nt, Human
aaacugcuuucucugccuuucc

SEQ ID NO: 287848 - RNA, 20 nt, Human
aaacucuuuucuuacauuuu

SEQ ID NO: 287849 - RNA, 22 nt, Human
aaacugacugaugugaucuuau

SEQ ID NO: 287850 - RNA, 22 nt, Human
aaacuagaacagagagagaagc

SEQ ID NO: 287851 - RNA, 22 nt, Human
aaacucaucaguuuagaaaccu

SEQ ID NO: 287852 - RNA, 22 nt, Human
aaaaguuguaauauuuccuuua

SEQ ID NO: 287853 - RNA, 22 nt, Human
aaaagcgaagagaacugaaguu

SEQ ID NO: 287854 - RNA, 22 nt, Human
aaacaauaauaauuaggaagga

SEQ ID NO: 287855 - RNA, 22 nt, Human
aaacaagagcuuacauggcugc

SEQ ID NO: 287856 - RNA, 22 nt, Human
aaaauaauauuauaccacugcu

SEQ ID NO: 287857 - RNA, 22 nt, Human
aaaauauaaaggauguggguuu

SEQ ID NO: 287858 - RNA, 22 nt, Human
aaaauauguugagauacugaaa

SEQ ID NO: 287859 - RNA, 22 nt, Human
aaacccauauaccagcugugcu

SEQ ID NO: 287860 - RNA, 22 nt, Human
aaacauguagugcaugaggauc

SEQ ID NO: 287861 - RNA, 21 nt, Human
aaacaugcagccugccaauuc

SEQ ID NO: 287862 - RNA, 22 nt, Human
aaacccaggguuuugucuuccc

SEQ ID NO: 287863 - RNA, 22 nt, Human
aaacauaugccuucuuuuguaa

SEQ ID NO: 287864 - RNA, 22 nt, Human
aaaauacuaggaaaauaaauca

SEQ ID NO: 287865 - RNA, 22 nt, Human
aauguuuaagcuuuuauuuaca

SEQ ID NO: 287866 - RNA, 22 nt, Human
aauuaacuggguucucagaugc

SEQ ID NO: 287867 - RNA, 22 nt, Human
aauguuuaacuguggucagcag

SEQ ID NO: 287868 - RNA, 22 nt, Human
aauguuguaaauauucuuugag

SEQ ID NO: 287869 - RNA, 23 nt, Human
aauguugaggguggguuuuuaac

SEQ ID NO: 287870 - RNA, 22 nt, Human
aauguucauauggguagcagau

SEQ ID NO: 287871 - RNA, 22 nt, Human
aauguugaaccuuuuuggccug

SEQ ID NO: 287872 - RNA, 22 nt, Human
aauguugacguuggccagggcc

SEQ ID NO: 287873 - RNA, 22 nt, Human
aauucaacagucaguuaucuca

SEQ ID NO: 287874 - RNA, 22 nt, Human
aauucaggacaaauguuuucaa

SEQ ID NO: 287875 - RNA, 21 nt, Human
aauuauuugcauuuuucuugu

SEQ ID NO: 287876 - RNA, 22 nt, Human
aauuauucuugccuagguuuaa

SEQ ID NO: 287877 - RNA, 22 nt, Human
aauuauucaugucugggcagcc

SEQ ID NO: 287878 - RNA, 22 nt, Human
aauuauucucucaacugagaug

SEQ ID NO: 287879 - RNA, 22 nt, Human
aauuaaggccuuuaaaugucuu

SEQ ID NO: 287880 - RNA, 22 nt, Human
aauggugaggagugcauugaga

SEQ ID NO: 287881 - RNA, 22 nt, Human
aauguaaauaauuguaaaauuu

SEQ ID NO: 287882 - RNA, 22 nt, Human
aaugguggaugucuguucugac

SEQ ID NO: 287883 - RNA, 22 nt, Human
aaugguuacuacccugggucuu

SEQ ID NO: 287884 - RNA, 22 nt, Human
aauggaaaaauccacagggaac

SEQ ID NO: 287885 - RNA, 22 nt, Human
aaugcagaugugucuuuaauuu

SEQ ID NO: 287886 - RNA, 22 nt, Human
aaugcgcagaguggugugugca

SEQ ID NO: 287887 - RNA, 22 nt, Human
aauggcaauagugcauuaugua

SEQ ID NO: 287888 - RNA, 22 nt, Human
aauggcaagccacaugcuuuuc

SEQ ID NO: 287889 - RNA, 22 nt, Human
aauggagaaaagacaauguuga

SEQ ID NO: 287890 - RNA, 22 nt, Human
aauggacuucucugagccuguu

SEQ ID NO: 287891 - RNA, 22 nt, Human
aaucuguugucaggaauccaca

SEQ ID NO: 287892 - RNA, 22 nt, Human
aaucugugugugagaaauggca

SEQ ID NO: 287893 - RNA, 22 nt, Human
aaugaacuuucaguucagagag

SEQ ID NO: 287894 - RNA, 22 nt, Human
aaugaaacuaguagaaucuuug

SEQ ID NO: 287895 - RNA, 22 nt, Human
aaugaauaaauuuuaaagacag

SEQ ID NO: 287896 - RNA, 22 nt, Human
aaucugugaggaauaaugaguu

SEQ ID NO: 287897 - RNA, 22 nt, Human
aaucugacaaaauauuuccagu

SEQ ID NO: 287898 - RNA, 22 nt, Human
aaucugaccguggagaucucca

SEQ ID NO: 287899 - RNA, 22 nt, Human
aaucuuguucaacauuaucugu

SEQ ID NO: 287900 - RNA, 22 nt, Human
aaucucuugggaagagugagug

SEQ ID NO: 287901 - RNA, 22 nt, Human
aaucuacaaugaaaaaauguuu

SEQ ID NO: 287902 - RNA, 22 nt, Human
aaucucguuaugaagaugguug

SEQ ID NO: 287903 - RNA, 22 nt, Human
aaucauguguaaugggcagacc

SEQ ID NO: 287904 - RNA, 22 nt, Human
aaucccaguugacagaacuguu

SEQ ID NO: 287905 - RNA, 22 nt, Human
aaucaugguacaaguaagcacg

SEQ ID NO: 287906 - RNA, 22 nt, Human
aaucaauuauccauuuguuagu

SEQ ID NO: 287907 - RNA, 22 nt, Human
aaucaaauuucuugugguuguu

SEQ ID NO: 287908 - RNA, 22 nt, Human
aauauuuugggacugaggaauu

SEQ ID NO: 287909 - RNA, 22 nt, Human
aaugcauaaugguuugugacaa

SEQ ID NO: 287910 - RNA, 22 nt, Human
aaugccuucauuggcgaagugc

SEQ ID NO: 287911 - RNA, 22 nt, Human
aaugcauacguguuuguggcaa

SEQ ID NO: 287912 - RNA, 22 nt, Human
aaugauuuucugcaaacaguga

SEQ ID NO: 287913 - RNA, 22 nt, Human
aaugaguuuguucuauuauuug

SEQ ID NO: 287914 - RNA, 22 nt, Human
aaugaguucaucugaauucugg

SEQ ID NO: 287915 - RNA, 22 nt, Human
aaugacaguggcacagucacuu

SEQ ID NO: 287916 - RNA, 22 nt, Human
aaugagaauguaagugaagaga

SEQ ID NO: 287917 - RNA, 23 nt, Human
aaugaguugggcagcauacaggc

SEQ ID NO: 287918 - RNA, 22 nt, Human
aaugaaaaucugucaguucaag

SEQ ID NO: 287919 - RNA, 22 nt, Human
aaugaguccuuuagugccauug

SEQ ID NO: 287920 - RNA, 22 nt, Human
aaugacagccuauacugucugc

SEQ ID NO: 287921 - RNA, 22 nt, Human
aaugaaugaaugaaugauuaug

SEQ ID NO: 287922 - RNA, 22 nt, Human
aaucuuuuugaaggaggagaga

SEQ ID NO: 287923 - RNA, 22 nt, Human
aaguugaaugucuugcugaaug

SEQ ID NO: 287924 - RNA, 20 nt, Human
aaguugaaguuacuucaugg

SEQ ID NO: 287925 - RNA, 22 nt, Human
aaguguggguaagcauuucuug

SEQ ID NO: 287926 - RNA, 22 nt, Human
aaguggugagacccugcugaaa

SEQ ID NO: 287927 - RNA, 22 nt, Human
aagugguuuauuguaugguuuu

SEQ ID NO: 287928 - RNA, 22 nt, Human
aaguguucucuguuuuaucuac

SEQ ID NO: 287929 - RNA, 22 nt, Human
aaguuaaaaaagcuggguaaaa

SEQ ID NO: 287930 - RNA, 20 nt, Human
aaguagguuucaguugcugu

SEQ ID NO: 287931 - RNA, 22 nt, Human
aaguagaaaaccgcacuggacu

SEQ ID NO: 287932 - RNA, 22 nt, Human
aaguccaaaacauuucucugcu

SEQ ID NO: 287933 - RNA, 22 nt, Human
aagucauuaucucuucuaaucu

SEQ ID NO: 287934 - RNA, 22 nt, Human
aaguggcccuaauugggccaaa

SEQ ID NO: 287935 - RNA, 17 nt, Human
aagugggcaaagugaga

SEQ ID NO: 287936 - RNA, 23 nt, Human
aaguggugacugugcuacugaga

SEQ ID NO: 287937 - RNA, 22 nt, Human
aaguggcaggggaaggguugga

SEQ ID NO: 287938 - RNA, 22 nt, Human
aauaacaguuuauuugagggcu

SEQ ID NO: 287939 - RNA, 22 nt, Human
aaguuuaagguagugaugauga

SEQ ID NO: 287940 - RNA, 23 nt, Human
aaguugucauguaaaaugggcua

SEQ ID NO: 287941 - RNA, 20 nt, Human
aauaaauauaacccauaauu

SEQ ID NO: 287942 - RNA, 22 nt, Human
aauaaugguuugauucucacau

SEQ ID NO: 287943 - RNA, 22 nt, Human
aauaagaguuaagaaguauauu

SEQ ID NO: 287944 - RNA, 22 nt, Human
aauacagcacucacaccucccu

SEQ ID NO: 287945 - RNA, 22 nt, Human
aauacaaucagauuaugguagu

SEQ ID NO: 287946 - RNA, 20 nt, Human
aauagcacagcucaaacauu

SEQ ID NO: 287947 - RNA, 22 nt, Human
aauagcacauguugguugagua

SEQ ID NO: 287948 - RNA, 22 nt, Human
aauagguaaaugaguaagaaau

SEQ ID NO: 287949 - RNA, 22 nt, Human
aauaggguccuuuguguuauau

SEQ ID NO: 287950 - RNA, 22 nt, Human
aauaggaaggaaauguuuaccu

SEQ ID NO: 287951 - RNA, 22 nt, Human
aauauagagcagaucuggcucu

SEQ ID NO: 287952 - RNA, 22 nt, Human
aauaguggcuuggacuaaauau

SEQ ID NO: 287953 - RNA, 22 nt, Human
aauauauaugggugcaugucug

SEQ ID NO: 287954 - RNA, 22 nt, Human
aagguuuuguaugaaaucucug

SEQ ID NO: 287955 - RNA, 22 nt, Human
aagguggugaucaucuugaagg

SEQ ID NO: 287956 - RNA, 22 nt, Human
aaguaaaucuuaugucagggag

SEQ ID NO: 287957 - RNA, 22 nt, Human
aagguuuuguuuucgguuuuuu

SEQ ID NO: 287958 - RNA, 22 nt, Human
aagguguaaguagcugguucau

SEQ ID NO: 287959 - RNA, 22 nt, Human
aaggugcugaggguccuggcuu

SEQ ID NO: 287960 - RNA, 22 nt, Human
aagggccacaugccauuuaaaa

SEQ ID NO: 287961 - RNA, 22 nt, Human
aagggagaguauccagaaacag

SEQ ID NO: 287962 - RNA, 22 nt, Human
aagggaaguuugacacuuuuua

SEQ ID NO: 287963 - RNA, 22 nt, Human
aagggaaaagcugaaugagaug

SEQ ID NO: 287964 - RNA, 22 nt, Human
aagggccuccuggggagccugg

SEQ ID NO: 287965 - RNA, 22 nt, Human
aagggaaggaugggcauuuaca

SEQ ID NO: 287966 - RNA, 22 nt, Human
aagggaaacagccaggcccugu

SEQ ID NO: 287967 - RNA, 22 nt, Human
aagguauaucuuuaaaagugaa

SEQ ID NO: 287968 - RNA, 22 nt, Human
aagguauaaauaacucgggagg

SEQ ID NO: 287969 - RNA, 22 nt, Human
aaggggggcaccugcaugcccg

SEQ ID NO: 287970 - RNA, 22 nt, Human
aagccucaugccagauccaggu

SEQ ID NO: 287971 - RNA, 22 nt, Human
aagccugguuauuugaggaugu

SEQ ID NO: 287972 - RNA, 22 nt, Human
aagcagugacucucagaggcag

SEQ ID NO: 287973 - RNA, 22 nt, Human
aagcauaucaaguuuuaugugc

SEQ ID NO: 287974 - RNA, 22 nt, Human
aagcaguuuagucaucgggauu

SEQ ID NO: 287975 - RNA, 22 nt, Human
aaggaugguaacaguuucauuu

SEQ ID NO: 287976 - RNA, 19 nt, Human
aaggcuuucugagugaaaa

SEQ ID NO: 287977 - RNA, 22 nt, Human
aaggcgccacagugauugcaaa

SEQ ID NO: 287978 - RNA, 22 nt, Human
aaggcgaggggcacagcugaga

SEQ ID NO: 287979 - RNA, 22 nt, Human
aaggccuaggaguugacauggg

SEQ ID NO: 287980 - RNA, 22 nt, Human
aaggccacacuugcuggccagc

SEQ ID NO: 287981 - RNA, 22 nt, Human
aaggauuuccaggccugcgccu

SEQ ID NO: 287982 - RNA, 22 nt, Human
aaggaguacagggagggucccu

SEQ ID NO: 287983 - RNA, 22 nt, Human
aaggauguuuaaacuacuuucc

SEQ ID NO: 287984 - RNA, 22 nt, Human
aacucugacgcugucaaauaca

SEQ ID NO: 287985 - RNA, 23 nt, Human
aacucuggcuagcauagaauaga

SEQ ID NO: 287986 - RNA, 22 nt, Human
aacgcagagaguaaugcugaac

SEQ ID NO: 287987 - RNA, 22 nt, Human
aacgcaacaacuggagcuguag

SEQ ID NO: 287988 - RNA, 22 nt, Human
aacucgaugcaauucacuuugu

SEQ ID NO: 287989 - RNA, 22 nt, Human
aacgggguugauuauuggaaga

SEQ ID NO: 287990 - RNA, 22 nt, Human
aacgcugugcacuggguccagg

SEQ ID NO: 287991 - RNA, 22 nt, Human
aacucugcaaugaaaucauguu

SEQ ID NO: 287992 - RNA, 22 nt, Human
aacugggugauucaggcuguuu

SEQ ID NO: 287993 - RNA, 22 nt, Human
aacugcauaagcuucgggaccu

SEQ ID NO: 287994 - RNA, 22 nt, Human
aacguaauuuguggaaggggua

SEQ ID NO: 287995 - RNA, 22 nt, Human
aacuaaggccacaagaggcaaa

SEQ ID NO: 287996 - RNA, 22 nt, Human
aacucugagaaacuugcaguug

SEQ ID NO: 287997 - RNA, 22 nt, Human
aacucaggagagaguaacaggg

SEQ ID NO: 287998 - RNA, 19 nt, Human
aacuacagcgcacuguccu

SEQ ID NO: 287999 - RNA, 21 nt, Human
aacuauuaauaccauuagcaa

SEQ ID NO: 288000 - RNA, 22 nt, Human
aacuggguuuaucuaaugugua

SEQ ID NO: 288001 - RNA, 22 nt, Human
aacugaaguuuucagauuuugc

SEQ ID NO: 288002 - RNA, 22 nt, Human
aacuuuuaugaaggaaaucaua

SEQ ID NO: 288003 - RNA, 21 nt, Human
aacuuucccaauccagauuug

SEQ ID NO: 288004 - RNA, 22 nt, Human
aacuuucagaauccuaugcauu

SEQ ID NO: 288005 - RNA, 22 nt, Human
aacugagugcuacauugugauu

SEQ ID NO: 288006 - RNA, 22 nt, Human
aacugguaauuuaguauuacug

SEQ ID NO: 288007 - RNA, 22 nt, Human
aacuuaaacaagcucccaaguu

SEQ ID NO: 288008 - RNA, 22 nt, Human
aacuguugucacgaauguggcu

SEQ ID NO: 288009 - RNA, 22 nt, Human
aagaaaagcaucuuuguaguag

SEQ ID NO: 288010 - RNA, 22 nt, Human
aacuuagagcucuccuaaauga

SEQ ID NO: 288011 - RNA, 22 nt, Human
aagaaaagaaacauggguaugc

SEQ ID NO: 288012 - RNA, 22 nt, Human
aagaaauagauagaggaauacu

SEQ ID NO: 288013 - RNA, 22 nt, Human
aagaacaacugcuuuaaaagca

SEQ ID NO: 288014 - RNA, 19 nt, Human
aagaacaguucuaauuuca

SEQ ID NO: 288015 - RNA, 22 nt, Human
aacuuucuuugcaucuaaguuu

SEQ ID NO: 288016 - RNA, 22 nt, Human
aacuuucugaaaagcuugauca

SEQ ID NO: 288017 - RNA, 22 nt, Human
aacuugaagacaccccacauuc

SEQ ID NO: 288018 - RNA, 22 nt, Human
aacuucuggaaacuuccaugug

SEQ ID NO: 288019 - RNA, 22 nt, Human
aagaaagaucugaaagaagcga

SEQ ID NO: 288020 - RNA, 22 nt, Human
aagaaaccauauuaguuccugg

SEQ ID NO: 288021 - RNA, 22 nt, Human
aagcagcauaugacagcaucca

SEQ ID NO: 288022 - RNA, 22 nt, Human
aagcagaaaaacugagcuccaa

SEQ ID NO: 288023 - RNA, 22 nt, Human
aagccagccaguuccagcagcu

SEQ ID NO: 288024 - RNA, 22 nt, Human
aagcaugagguggugagugaca

SEQ ID NO: 288025 - RNA, 22 nt, Human
aagauucaguugguuuuggaaa

SEQ ID NO: 288026 - RNA, 22 nt, Human
aagcaaaagguuacacuucugg

SEQ ID NO: 288027 - RNA, 22 nt, Human
aagauuugaaaguggugcauuu

SEQ ID NO: 288028 - RNA, 22 nt, Human
aagaugcaagcauuuugaacug

SEQ ID NO: 288029 - RNA, 22 nt, Human
aagcacuaauauuuuggcaccu

SEQ ID NO: 288030 - RNA, 22 nt, Human
aagcacagggacucaggaccgg

SEQ ID NO: 288031 - RNA, 22 nt, Human
aagaggaggacgguucccagaa

SEQ ID NO: 288032 - RNA, 22 nt, Human
aagaggaggcuggaauccuaaa

SEQ ID NO: 288033 - RNA, 22 nt, Human
aagagcuuguuaugcugcucuu

SEQ ID NO: 288034 - RNA, 22 nt, Human
aagaggaauaauaaaaauugca

SEQ ID NO: 288035 - RNA, 22 nt, Human
aagaggacagucaaauggccgg

SEQ ID NO: 288036 - RNA, 22 nt, Human
aagaccacaggaaucaaacagg

SEQ ID NO: 288037 - RNA, 22 nt, Human
aagacagugacagucacaauug

SEQ ID NO: 288038 - RNA, 22 nt, Human
aagaggcuacagcccugugucu

SEQ ID NO: 288039 - RNA, 22 nt, Human
aagaggauuuuaguuugccaga

SEQ ID NO: 288040 - RNA, 22 nt, Human
aagagaaaaaucuuaaucuagu

SEQ ID NO: 288041 - RNA, 22 nt, Human
aagagugugagguugugcuuuu

SEQ ID NO: 288042 - RNA, 22 nt, Human
aagauguuguagauuagugaga

SEQ ID NO: 288043 - RNA, 22 nt, Human
aagaugcuucaugagaguuggg

SEQ ID NO: 288044 - RNA, 22 nt, Human
aagagugaguagcuugguuggu

SEQ ID NO: 288045 - RNA, 22 nt, Human
aagaaugaaaugaaagaacuaa

SEQ ID NO: 288046 - RNA, 22 nt, Human
aagaagguugaaugacuacuuu

SEQ ID NO: 288047 - RNA, 22 nt, Human
aagaaggcggaccagaagggag

SEQ ID NO: 288048 - RNA, 22 nt, Human
aagaagagaauauauuuacguc

SEQ ID NO: 288049 - RNA, 22 nt, Human
aagaacaugggugugggcauuc

SEQ ID NO: 288050 - RNA, 22 nt, Human
aagagaggaaagggugugaggu

SEQ ID NO: 288051 - RNA, 22 nt, Human
aagagaggcccaaguggcuggc

SEQ ID NO: 288052 - RNA, 22 nt, Human
aagagaaagggaaaaugguaaa

SEQ ID NO: 288053 - RNA, 22 nt, Human
aagagaaaugcuuuaacuuuau

SEQ ID NO: 288054 - RNA, 22 nt, Human
aaccaaaguugguauuuaauaa

SEQ ID NO: 288055 - RNA, 22 nt, Human
aacauuuauguuuugaccaagu

SEQ ID NO: 288056 - RNA, 22 nt, Human
aacauuguuuaaguuaaauugu

SEQ ID NO: 288057 - RNA, 20 nt, Human
aaccuauuguaauauucuaa

SEQ ID NO: 288058 - RNA, 22 nt, Human
aaccaaguaaagagguuucauu

SEQ ID NO: 288059 - RNA, 22 nt, Human
aaccaaucaaauuggaauugaa

SEQ ID NO: 288060 - RNA, 22 nt, Human
aaccuggguguacauuaugguc

SEQ ID NO: 288061 - RNA, 22 nt, Human
aaccuaagaacagcaggcuccu

SEQ ID NO: 288062 - RNA, 22 nt, Human
aaccucuuugugaaugucauga

SEQ ID NO: 288063 - RNA, 22 nt, Human
aaccagaagucaucagagcuga

SEQ ID NO: 288064 - RNA, 22 nt, Human
aaccaggcgagagagcggucag

SEQ ID NO: 288065 - RNA, 22 nt, Human
aacaucaaaggaagaaugauau

SEQ ID NO: 288066 - RNA, 22 nt, Human
aaccggauugauccuucuuuga

SEQ ID NO: 288067 - RNA, 22 nt, Human
aacccaagacaagcacuggcca

SEQ ID NO: 288068 - RNA, 22 nt, Human
aacccacuaugauuguccucau

SEQ ID NO: 288069 - RNA, 22 nt, Human
aaccaguacuucucuauucagu

SEQ ID NO: 288070 - RNA, 22 nt, Human
aacagguucaucuuggaagcag

SEQ ID NO: 288071 - RNA, 22 nt, Human
aacaguacaucaugaggucauc

SEQ ID NO: 288072 - RNA, 22 nt, Human
aacaguaugugagauuuacaca

SEQ ID NO: 288073 - RNA, 22 nt, Human
aacaguuaagaggaggcagaga

SEQ ID NO: 288074 - RNA, 22 nt, Human
aacgaugauaaauuguucucug

SEQ ID NO: 288075 - RNA, 22 nt, Human
aacgauuugaguuaguuuuuag

SEQ ID NO: 288076 - RNA, 22 nt, Human
aaccuuucucccugcacacugg

SEQ ID NO: 288077 - RNA, 22 nt, Human
aaccauggauuucaguucaccu

SEQ ID NO: 288078 - RNA, 22 nt, Human
aacccguagaucaguucuaggu

SEQ ID NO: 288079 - RNA, 22 nt, Human
aacccugaacuuaguucuagga

SEQ ID NO: 288080 - RNA, 22 nt, Human
aacgccgggacucgcagggagc

SEQ ID NO: 288081 - RNA, 22 nt, Human
aaccuuauuguguaucaccaua

SEQ ID NO: 288082 - RNA, 22 nt, Human
aacgagcugggggggccggggg

SEQ ID NO: 288083 - RNA, 22 nt, Human
aacucccucaacuuccuucucu

SEQ ID NO: 288084 - RNA, 22 nt, Human
aacuagugucuguaugauaagg

SEQ ID NO: 288085 - RNA, 22 nt, Human
aacgucugagaccccuccucuc

SEQ ID NO: 288086 - RNA, 22 nt, Human
aacgugcuuuacaaaugaccuu

SEQ ID NO: 288087 - RNA, 22 nt, Human
aaccuggaggaccuuaugcuaa

SEQ ID NO: 288088 - RNA, 22 nt, Human
aaauuagucacaccagugucuu

SEQ ID NO: 288089 - RNA, 22 nt, Human
aaauucagauggcuuucuuuuc

SEQ ID NO: 288090 - RNA, 22 nt, Human
aaauucagcagguuucaaaagc

SEQ ID NO: 288091 - RNA, 22 nt, Human
aaaugucugagacuucugaacu

SEQ ID NO: 288092 - RNA, 22 nt, Human
aaauguauuagccuaugugaga

SEQ ID NO: 288093 - RNA, 22 nt, Human
aaauggaaguuuguucucagcc

SEQ ID NO: 288094 - RNA, 22 nt, Human
aaauguuugguggauaaaagga

SEQ ID NO: 288095 - RNA, 22 nt, Human
aaauguguagaggggagagccg

SEQ ID NO: 288096 - RNA, 22 nt, Human
aaauguuucauucuauuuuuag

SEQ ID NO: 288097 - RNA, 22 nt, Human
aaagaguuguauucuuuuugag

SEQ ID NO: 288098 - RNA, 22 nt, Human
aaagagggaaggaaggagugaa

SEQ ID NO: 288099 - RNA, 22 nt, Human
aaaugguguucuuuagaugaaa

SEQ ID NO: 288100 - RNA, 22 nt, Human
aaagaucaguuaacgccaucaa

SEQ ID NO: 288101 - RNA, 21 nt, Human
aacagguuuccuaccacuugc

SEQ ID NO: 288102 - RNA, 22 nt, Human
aacagguucaagccuugcagca

SEQ ID NO: 288103 - RNA, 22 nt, Human
aacagaaaucauuuagggcucu

SEQ ID NO: 288104 - RNA, 20 nt, Human
aacagcucucgacuuaucuu

SEQ ID NO: 288105 - RNA, 22 nt, Human
aaccaauaagaggaugccauuu

SEQ ID NO: 288106 - RNA, 22 nt, Human
aacacugaaaugucuuaagauu

SEQ ID NO: 288107 - RNA, 22 nt, Human
aaauucuuccaggaggaaauac

SEQ ID NO: 288108 - RNA, 22 nt, Human
aacacaguuucucuaugagagu

SEQ ID NO: 288109 - RNA, 22 nt, Human
aaauuuauaacuuaaagugaau

SEQ ID NO: 288110 - RNA, 22 nt, Human
aaauucggggaguuuugaggau

SEQ ID NO: 288111 - RNA, 22 nt, Human
aacaaaacauuuuacgaauaua

SEQ ID NO: 288112 - RNA, 22 nt, Human
aacacuguaucagucuucaaua

SEQ ID NO: 288113 - RNA, 21 nt, Human
aaauuucauauggccaaccua

SEQ ID NO: 288114 - RNA, 22 nt, Human
aaauugcauuuuaaagguagau

SEQ ID NO: 288115 - RNA, 20 nt, Human
agucuuaucugcauuuagaa

SEQ ID NO: 288116 - RNA, 19 nt, Human
agucugugacaaggagugg

SEQ ID NO: 288117 - RNA, 22 nt, Human
agucggguugcagacacauccu

SEQ ID NO: 288118 - RNA, 22 nt, Human
aguccucagauauggagaucug

SEQ ID NO: 288119 - RNA, 22 nt, Human
agucugaguaucucugagccag

SEQ ID NO: 288120 - RNA, 22 nt, Human
agucugaaccagauggcaaggu

SEQ ID NO: 288121 - RNA, 22 nt, Human
agucucuagagucugucccucu

SEQ ID NO: 288122 - RNA, 18 nt, Human
agucugagugaaauguag

SEQ ID NO: 288123 - RNA, 22 nt, Human
agucauuguguucaguaaaauc

SEQ ID NO: 288124 - RNA, 22 nt, Human
agucggggagcgugaccagaga

SEQ ID NO: 288125 - RNA, 22 nt, Human
agucaggggaucuagacuugaa

SEQ ID NO: 288126 - RNA, 22 nt, Human
agucccugauggacuggaugag

SEQ ID NO: 288127 - RNA, 22 nt, Human
agucaguguagaaagcccaggc

SEQ ID NO: 288128 - RNA, 22 nt, Human
agucauaaagccagugggaggc

SEQ ID NO: 288129 - RNA, 22 nt, Human
aguccagggcuuagucagcggg

SEQ ID NO: 288130 - RNA, 18 nt, Human
agucauguuuuagucacu

SEQ ID NO: 288131 - RNA, 22 nt, Human
agucauuugucauuuuuuugag

SEQ ID NO: 288132 - RNA, 22 nt, Human
agucauuugaggcaugauuaug

SEQ ID NO: 288133 - RNA, 20 nt, Human
agucacagacccucagguag

SEQ ID NO: 288134 - RNA, 22 nt, Human
agucacuguucugucaugucaa

SEQ ID NO: 288135 - RNA, 22 nt, Human
agucaacauuugagaugcaaug

SEQ ID NO: 288136 - RNA, 22 nt, Human
agucagaaggugucagaucuug

SEQ ID NO: 288137 - RNA, 22 nt, Human
agucagcuugucucuaggguug

SEQ ID NO: 288138 - RNA, 22 nt, Human
agucacuguuuaaucuagcuaa

SEQ ID NO: 288139 - RNA, 22 nt, Human
aguauuuaguauucuauauuag

SEQ ID NO: 288140 - RNA, 23 nt, Human
aguauuguucaucuucaagacag

SEQ ID NO: 288141 - RNA, 22 nt, Human
aguauuuuaaaauacauuaucc

SEQ ID NO: 288142 - RNA, 22 nt, Human
aguauugguaaguguagcaaau

SEQ ID NO: 288143 - RNA, 22 nt, Human
aguauuggauauaaucuaggaa

SEQ ID NO: 288144 - RNA, 22 nt, Human
aguauucaguuagugagcuaag

SEQ ID NO: 288145 - RNA, 22 nt, Human
agucaaaaaaccuagaaacacc

SEQ ID NO: 288146 - RNA, 22 nt, Human
aguauuuucuuuaguuuguuag

SEQ ID NO: 288147 - RNA, 19 nt, Human
aguauauaucuuuaccuca

SEQ ID NO: 288148 - RNA, 22 nt, Human
aguaucuuccucaugaacacgu

SEQ ID NO: 288149 - RNA, 19 nt, Human
aguauuggcagguccugua

SEQ ID NO: 288150 - RNA, 22 nt, Human
aguaugcuggcaccuuugagug

SEQ ID NO: 288151 - RNA, 23 nt, Human
aguaucuugguguggugcagaga

SEQ ID NO: 288152 - RNA, 22 nt, Human
aguauaucugcuucuggguccc

SEQ ID NO: 288153 - RNA, 22 nt, Human
aguaucuauaucaaaaauggcu

SEQ ID NO: 288154 - RNA, 22 nt, Human
aguaucgcuuuguaucaugagg

SEQ ID NO: 288155 - RNA, 22 nt, Human
aguauggaauuuuuaaugacag

SEQ ID NO: 288156 - RNA, 22 nt, Human
aguagcaguuccauuugaugug

SEQ ID NO: 288157 - RNA, 22 nt, Human
aguacuuuuuguucaauugugc

SEQ ID NO: 288158 - RNA, 22 nt, Human
aguaggagugacaagcagguca

SEQ ID NO: 288159 - RNA, 22 nt, Human
aguaggaauucaaagagacaaa

SEQ ID NO: 288160 - RNA, 22 nt, Human
aguagucacuucacccauccca

SEQ ID NO: 288161 - RNA, 22 nt, Human
aguaacagguguacagacuauc

SEQ ID NO: 288162 - RNA, 18 nt, Human
aguaaauguuaaauauug

SEQ ID NO: 288163 - RNA, 22 nt, Human
aguauagacaucaaacugaaga

SEQ ID NO: 288164 - RNA, 22 nt, Human
agguggugacgaugcuccguac

SEQ ID NO: 288165 - RNA, 22 nt, Human
aggugggaauaauaaucaaagc

SEQ ID NO: 288166 - RNA, 22 nt, Human
aggugcuuaaagaauguguggu

SEQ ID NO: 288167 - RNA, 22 nt, Human
aggucuugcggaagauauggcu

SEQ ID NO: 288168 - RNA, 22 nt, Human
aggugcagcugguggagucugg

SEQ ID NO: 288169 - RNA, 22 nt, Human
aggugagaaggacuguugcauu

SEQ ID NO: 288170 - RNA, 21 nt, Human
aggugcccaggauuauuuuuu

SEQ ID NO: 288171 - RNA, 22 nt, Human
aggugcccaaaucuucuguuuu

SEQ ID NO: 288172 - RNA, 22 nt, Human
agguuagcuguaugucuguaaa

SEQ ID NO: 288173 - RNA, 22 nt, Human
agguguaauuacucuugcaguu

SEQ ID NO: 288174 - RNA, 22 nt, Human
aggugucauuauagaccagaua

SEQ ID NO: 288175 - RNA, 22 nt, Human
agguuuuagaagcugaagccaa

SEQ ID NO: 288176 - RNA, 22 nt, Human
agguuuuagagagccaggaugu

SEQ ID NO: 288177 - RNA, 22 nt, Human
aguaaaggaaggaagggacagc

SEQ ID NO: 288178 - RNA, 19 nt, Human
aguaaagugguggcauuuu

SEQ ID NO: 288179 - RNA, 22 nt, Human
aguaaaugaaagcaauuuuaga

SEQ ID NO: 288180 - RNA, 22 nt, Human
aggcgguuggcuuugucugggu

SEQ ID NO: 288181 - RNA, 22 nt, Human
aggccugcccuuggggagccuu

SEQ ID NO: 288182 - RNA, 22 nt, Human
aggccugaggaccagauaaaug

SEQ ID NO: 288183 - RNA, 22 nt, Human
aggccgguggaggagguggagg

SEQ ID NO: 288184 - RNA, 22 nt, Human
aggccgcgguggcgaaggcguu

SEQ ID NO: 288185 - RNA, 22 nt, Human
aggaugagugaagagguaaauu

SEQ ID NO: 288186 - RNA, 22 nt, Human
aggagcacugggcaugucaccc

SEQ ID NO: 288187 - RNA, 22 nt, Human
aggccgagaugacagagccacu

SEQ ID NO: 288188 - RNA, 20 nt, Human
aggccgcccgcugccgcuuc

SEQ ID NO: 288189 - RNA, 22 nt, Human
aggccccacaaacucgccuuug

SEQ ID NO: 288190 - RNA, 22 nt, Human
aggccauuucacagguuuugga

SEQ ID NO: 288191 - RNA, 18 nt, Human
aggcuggggaucacaggg

SEQ ID NO: 288192 - RNA, 22 nt, Human
aggcuuaaaugcucauaucagu

SEQ ID NO: 288193 - RNA, 22 nt, Human
aggcuuuugcucuggcuccucu

SEQ ID NO: 288194 - RNA, 22 nt, Human
aggcuuagaugaguucccacau

SEQ ID NO: 288195 - RNA, 22 nt, Human
aggcuuaacuacaauuuuugcc

SEQ ID NO: 288196 - RNA, 22 nt, Human
agggaguuccgaucugugcacc

SEQ ID NO: 288197 - RNA, 22 nt, Human
agggagcagcuagagggggucc

SEQ ID NO: 288198 - RNA, 22 nt, Human
agggaccacauccccucugugg

SEQ ID NO: 288199 - RNA, 17 nt, Human
agggaaguagggugggc

SEQ ID NO: 288200 - RNA, 22 nt, Human
aggcugaagcacacucaugcag

SEQ ID NO: 288201 - RNA, 22 nt, Human
aggcggguuuaggacaaugcuu

SEQ ID NO: 288202 - RNA, 22 nt, Human
aggcugggaaguguguccugag

SEQ ID NO: 288203 - RNA, 23 nt, Human
aggcugcagaagaauagggucau

SEQ ID NO: 288204 - RNA, 22 nt, Human
aggccgcuggggcagcgcccga

SEQ ID NO: 288205 - RNA, 22 nt, Human
aggcgaagggaccagacgguag

SEQ ID NO: 288206 - RNA, 22 nt, Human
agggggaauccugcuuauggau

SEQ ID NO: 288207 - RNA, 22 nt, Human
aggggcagaggaugauggaaga

SEQ ID NO: 288208 - RNA, 22 nt, Human
aggggcuuguggaguugcuggu

SEQ ID NO: 288209 - RNA, 22 nt, Human
aggggcagccucacaauccucu

SEQ ID NO: 288210 - RNA, 20 nt, Human
aggggcuguaguuagaugac

SEQ ID NO: 288211 - RNA, 22 nt, Human
aggggagaguuaaugugaaugu

SEQ ID NO: 288212 - RNA, 22 nt, Human
aggggaagagugagguuuuggu

SEQ ID NO: 288213 - RNA, 22 nt, Human
aggggauggagcuggaaggcag

SEQ ID NO: 288214 - RNA, 22 nt, Human
agggcuugggggccuugaaggc

SEQ ID NO: 288215 - RNA, 22 nt, Human
agggcgugguggugcuggagca

SEQ ID NO: 288216 - RNA, 22 nt, Human
agggcaguguggugggacugac

SEQ ID NO: 288217 - RNA, 22 nt, Human
agggcggucccugagacucucc

SEQ ID NO: 288218 - RNA, 22 nt, Human
agggcucagccuccuccucagc

SEQ ID NO: 288219 - RNA, 22 nt, Human
agggaagcaggaaguaugggaa

SEQ ID NO: 288220 - RNA, 22 nt, Human
agggacuugugucuguguuuuu

SEQ ID NO: 288221 - RNA, 22 nt, Human
agggaaguucuagggagucugg

SEQ ID NO: 288222 - RNA, 22 nt, Human
agggaagaggaccagagucucu

SEQ ID NO: 288223 - RNA, 22 nt, Human
agggaaauuaaugugagcaaug

SEQ ID NO: 288224 - RNA, 22 nt, Human
agggagucuggccgucggcugg

SEQ ID NO: 288225 - RNA, 22 nt, Human
aggguggcacucugggggcucc

SEQ ID NO: 288226 - RNA, 22 nt, Human
aggguggaggacaggccaguga

SEQ ID NO: 288227 - RNA, 22 nt, Human
agggggccggggcucaggagcc

SEQ ID NO: 288228 - RNA, 22 nt, Human
aggggaguuauuagacagggag

SEQ ID NO: 288229 - RNA, 19 nt, Human
aggucuaaucauaagacaa

SEQ ID NO: 288230 - RNA, 22 nt, Human
aggucagacagggugucuuucu

SEQ ID NO: 288231 - RNA, 22 nt, Human
agguauuuuaugucgugugaug

SEQ ID NO: 288232 - RNA, 22 nt, Human
aggguuugugaagacuuggcca

SEQ ID NO: 288233 - RNA, 22 nt, Human
aggguuugaauccucuuucuua

SEQ ID NO: 288234 - RNA, 22 nt, Human
aggguuucucuccaguguggac

SEQ ID NO: 288235 - RNA, 21 nt, Human
agguagauagccccaggaagg

SEQ ID NO: 288236 - RNA, 22 nt, Human
agguagaaggaccagaauuuau

SEQ ID NO: 288237 - RNA, 22 nt, Human
aggguuuucauauauuauuagu

SEQ ID NO: 288238 - RNA, 22 nt, Human
aggacccacccugugaaaguuc

SEQ ID NO: 288239 - RNA, 22 nt, Human
aggacucagcgucugucucccg

SEQ ID NO: 288240 - RNA, 20 nt, Human
aggaaggagaaucugagcaa

SEQ ID NO: 288241 - RNA, 22 nt, Human
aggaaaaugaaggaagugggaa

SEQ ID NO: 288242 - RNA, 22 nt, Human
aggaaagacgcauuucuguagg

SEQ ID NO: 288243 - RNA, 22 nt, Human
aggaagccuggaguccugccca

SEQ ID NO: 288244 - RNA, 22 nt, Human
aggaagucucucaaaacuggaa

SEQ ID NO: 288245 - RNA, 22 nt, Human
aggauaaaugggucauuaggca

SEQ ID NO: 288246 - RNA, 22 nt, Human
aggagacaguuuggacguguag

SEQ ID NO: 288247 - RNA, 22 nt, Human
aggagaaagaccagccugccga

SEQ ID NO: 288248 - RNA, 19 nt, Human
aggaaggggauaaguaaca

SEQ ID NO: 288249 - RNA, 20 nt, Human
agcuggcccccgguggccug

SEQ ID NO: 288250 - RNA, 22 nt, Human
agcugugaccaguuacgaaauu

SEQ ID NO: 288251 - RNA, 19 nt, Human
agcuuauuuacugcaggac

SEQ ID NO: 288252 - RNA, 22 nt, Human
agcuucuucugccuugucccug

SEQ ID NO: 288253 - RNA, 22 nt, Human
aggaaaguugagcugucuguag

SEQ ID NO: 288254 - RNA, 22 nt, Human
aggaaauaggaccagacaaagc

SEQ ID NO: 288255 - RNA, 22 nt, Human
aggaaauaguuuagucccaaaa

SEQ ID NO: 288256 - RNA, 20 nt, Human
aggaagauccuuucuuuuaa

SEQ ID NO: 288257 - RNA, 22 nt, Human
aggaaaaagaagaaaagaauca

SEQ ID NO: 288258 - RNA, 22 nt, Human
agcuuucaagaaauugucacaa

SEQ ID NO: 288259 - RNA, 20 nt, Human
agcuuucaccaguacuucca

SEQ ID NO: 288260 - RNA, 22 nt, Human
agcuugcccuuguaccagccag

SEQ ID NO: 288261 - RNA, 22 nt, Human
agcuugaaccuaaaacaauaau

SEQ ID NO: 288262 - RNA, 22 nt, Human
agcuugaugaaagugggugcuc

SEQ ID NO: 288263 - RNA, 22 nt, Human
agcuguugaccuucccuuucag

SEQ ID NO: 288264 - RNA, 22 nt, Human
agcuugauggauugcugaggca

SEQ ID NO: 288265 - RNA, 22 nt, Human
agcuugagauaauucaagcuga

SEQ ID NO: 288266 - RNA, 22 nt, Human
agcuggauuaaucacagugacu

SEQ ID NO: 288267 - RNA, 22 nt, Human
agcugcuuuacuggucggcugg

SEQ ID NO: 288268 - RNA, 22 nt, Human
agcuggaaucucggcaaagcgu

SEQ ID NO: 288269 - RNA, 22 nt, Human
agcugugccuauucguggcaag

SEQ ID NO: 288270 - RNA, 20 nt, Human
agcugucccugacacuagga

SEQ ID NO: 288271 - RNA, 22 nt, Human
agcugcuaagcugcauaacuua

SEQ ID NO: 288272 - RNA, 22 nt, Human
agcugauugucuuuuuaaaagu

SEQ ID NO: 288273 - RNA, 22 nt, Human
agcugaugucucaccuguuaga

SEQ ID NO: 288274 - RNA, 22 nt, Human
agcuuggcaagcacuguuugag

SEQ ID NO: 288275 - RNA, 22 nt, Human
agcuuugcccaaugaguuaugu

SEQ ID NO: 288276 - RNA, 22 nt, Human
agcuuucuauauaugaguugcu

SEQ ID NO: 288277 - RNA, 22 nt, Human
aggaaaauggaccagaguuguu

SEQ ID NO: 288278 - RNA, 22 nt, Human
agcuaguucacugaagccuaug

SEQ ID NO: 288279 - RNA, 22 nt, Human
agcucucaccauagugcuuaaa

SEQ ID NO: 288280 - RNA, 22 nt, Human
agcugagccagacagguaagca

SEQ ID NO: 288281 - RNA, 22 nt, Human
agcugaccugauugcuuuucag

SEQ ID NO: 288282 - RNA, 22 nt, Human
agcugacagugcauggagggac

SEQ ID NO: 288283 - RNA, 22 nt, Human
agcucuuccuccauucuggcca

SEQ ID NO: 288284 - RNA, 22 nt, Human
agcucuucugacucuaggcuca

SEQ ID NO: 288285 - RNA, 19 nt, Human
agcugcugauugguggagg

SEQ ID NO: 288286 - RNA, 22 nt, Human
agcugcuggcggauguuggacu

SEQ ID NO: 288287 - RNA, 22 nt, Human
agcugcugcaaguggugcuaac

SEQ ID NO: 288288 - RNA, 22 nt, Human
agcugcauguauauucuuaaca

SEQ ID NO: 288289 - RNA, 22 nt, Human
agcucuuuggacuuuguuuuau

SEQ ID NO: 288290 - RNA, 20 nt, Human
agcugaauaguuuugugaaa

SEQ ID NO: 288291 - RNA, 22 nt, Human
agcugaggccccgcagcagggu

SEQ ID NO: 288292 - RNA, 19 nt, Human
agcucaggcccaucguccc

SEQ ID NO: 288293 - RNA, 22 nt, Human
agcucacucaaguaccuggggu

SEQ ID NO: 288294 - RNA, 22 nt, Human
agcucccaauugacuugaacua

SEQ ID NO: 288295 - RNA, 22 nt, Human
agcguucuguuccaugcuaaca

SEQ ID NO: 288296 - RNA, 22 nt, Human
agcuagugcaguucucaaaugg

SEQ ID NO: 288297 - RNA, 22 nt, Human
agcuaaaaugagguuuuuggau

SEQ ID NO: 288298 - RNA, 22 nt, Human
agcuaaauauuuuuccugacac

SEQ ID NO: 288299 - RNA, 22 nt, Human
agcuaauguauguugaaagcac

SEQ ID NO: 288300 - RNA, 22 nt, Human
agcgucaugugaccagcgcgcc

SEQ ID NO: 288301 - RNA, 22 nt, Human
agcggugacauccuucugugcu

SEQ ID NO: 288302 - RNA, 22 nt, Human
agcggaggaggcggagcaggga

SEQ ID NO: 288303 - RNA, 22 nt, Human
agcgcggccuuacacccagggg

SEQ ID NO: 288304 - RNA, 22 nt, Human
agcggcaggaagcgcgcaagcg

SEQ ID NO: 288305 - RNA, 22 nt, Human
agcggcaggacgucuucuucga

SEQ ID NO: 288306 - RNA, 22 nt, Human
agcggcgcgucuccgagcugga

SEQ ID NO: 288307 - RNA, 22 nt, Human
agcggcucaggccccgugggcu

SEQ ID NO: 288308 - RNA, 22 nt, Human
agcgcccguugagucgcgcggu

SEQ ID NO: 288309 - RNA, 22 nt, Human
agcgagccugugcacuucuaac

SEQ ID NO: 288310 - RNA, 22 nt, Human
agccuuucugcgcacucuuccg

SEQ ID NO: 288311 - RNA, 22 nt, Human
agcgaaaagaauggaguggagu

SEQ ID NO: 288312 - RNA, 22 nt, Human
agccuucccuuucaacaauuug

SEQ ID NO: 288313 - RNA, 22 nt, Human
agccuguuacuguccugugcca

SEQ ID NO: 288314 - RNA, 22 nt, Human
agcauucuguggucuucuaugg

SEQ ID NO: 288315 - RNA, 22 nt, Human
agcauucagacaucugauggau

SEQ ID NO: 288316 - RNA, 22 nt, Human
agcaucuaucuucaaugugugu

SEQ ID NO: 288317 - RNA, 22 nt, Human
agcauuagguguguuucagagg

SEQ ID NO: 288318 - RNA, 22 nt, Human
agcaugucuaacucuucagggu

SEQ ID NO: 288319 - RNA, 22 nt, Human
agccauggaggaugugcagcau

SEQ ID NO: 288320 - RNA, 22 nt, Human
agccuggacagcuacggagaac

SEQ ID NO: 288321 - RNA, 22 nt, Human
agcccuauacuuagauuuauuc

SEQ ID NO: 288322 - RNA, 22 nt, Human
agcauuugcuguucuagaaagu

SEQ ID NO: 288323 - RNA, 22 nt, Human
agcauuuuaaaacuaguuacca

SEQ ID NO: 288324 - RNA, 22 nt, Human
agcaucggacggagcaccugcu

SEQ ID NO: 288325 - RNA, 22 nt, Human
agccagcauauauauaguugaa

SEQ ID NO: 288326 - RNA, 22 nt, Human
agcaguuagauccugguuagcg

SEQ ID NO: 288327 - RNA, 18 nt, Human
agcaguugucucucucca

SEQ ID NO: 288328 - RNA, 18 nt, Human
agcagugcggaucauuuu

SEQ ID NO: 288329 - RNA, 22 nt, Human
agcaguugcuuuguauauuaaa

SEQ ID NO: 288330 - RNA, 22 nt, Human
agcauugguggcauuugcagcu

SEQ ID NO: 288331 - RNA, 21 nt, Human
agcagucugcggccggugcgg

SEQ ID NO: 288332 - RNA, 22 nt, Human
agcagucagaucguggggaaaa

SEQ ID NO: 288333 - RNA, 22 nt, Human
agcagggugugggugugagugu

SEQ ID NO: 288334 - RNA, 22 nt, Human
agcaggucagugguaaucaaaa

SEQ ID NO: 288335 - RNA, 22 nt, Human
agcauuucuacugugucagaaa

SEQ ID NO: 288336 - RNA, 21 nt, Human
agcaucugaggcaguuuccua

SEQ ID NO: 288337 - RNA, 19 nt, Human
agcaucuccacagaaaaag

SEQ ID NO: 288338 - RNA, 19 nt, Human
agcagugaaaucuggugag

SEQ ID NO: 288339 - RNA, 22 nt, Human
agcaggaggguuuuguagaguc

SEQ ID NO: 288340 - RNA, 22 nt, Human
agcagggagacagugcagcauu

SEQ ID NO: 288341 - RNA, 22 nt, Human
agcaggccuuucaccucugucc

SEQ ID NO: 288342 - RNA, 22 nt, Human
agcagguucaagggcaaagcug

SEQ ID NO: 288343 - RNA, 22 nt, Human
agcaggguggcaagucuuucug

SEQ ID NO: 288344 - RNA, 22 nt, Human
agauaagaacauuaguaagccg

SEQ ID NO: 288345 - RNA, 22 nt, Human
agcagcaggugaccucgaugcc

SEQ ID NO: 288346 - RNA, 22 nt, Human
agcagcaggcugggaugagucu

SEQ ID NO: 288347 - RNA, 22 nt, Human
agcaggagaaagaguaugggcu

SEQ ID NO: 288348 - RNA, 22 nt, Human
agcaggaggagagccuggcggu

SEQ ID NO: 288349 - RNA, 22 nt, Human
agcaggagagacuggcccaaaa

SEQ ID NO: 288350 - RNA, 17 nt, Human
agcagcuggguugaucu

SEQ ID NO: 288351 - RNA, 22 nt, Human
accgauguggaaaauuucauuu

SEQ ID NO: 288352 - RNA, 22 nt, Human
accgcuggcacuggggacgggg

SEQ ID NO: 288353 - RNA, 19 nt, Human
acccaugcucuguggacuu

SEQ ID NO: 288354 - RNA, 20 nt, Human
acccagaguccuccccgcgc

SEQ ID NO: 288355 - RNA, 22 nt, Human
acccagauauccaggccucugc

SEQ ID NO: 288356 - RNA, 22 nt, Human
acccugcacagagggcuuuaua

SEQ ID NO: 288357 - RNA, 22 nt, Human
acccugacggugggcagcuuga

SEQ ID NO: 288358 - RNA, 22 nt, Human
accauuauagaggacauuaugu

SEQ ID NO: 288359 - RNA, 22 nt, Human
accccacucccuuucuuuugcu

SEQ ID NO: 288360 - RNA, 22 nt, Human
acccccuuucuugaccucaugu

SEQ ID NO: 288361 - RNA, 18 nt, Human
acccauuauauuuguagc

SEQ ID NO: 288362 - RNA, 22 nt, Human
acccaucauuagucuuucagga

SEQ ID NO: 288363 - RNA, 22 nt, Human
acccauggcucucugggaugcu

SEQ ID NO: 288364 - RNA, 22 nt, Human
accccuauugcuugugauuaug

SEQ ID NO: 288365 - RNA, 22 nt, Human
accgguucccaucuggagaguu

SEQ ID NO: 288366 - RNA, 22 nt, Human
acccuucugugaccugccuguc

SEQ ID NO: 288367 - RNA, 22 nt, Human
acccuauuaacuacuacguugg

SEQ ID NO: 288368 - RNA, 22 nt, Human
accuaucugcuggauuuguugu

SEQ ID NO: 288369 - RNA, 22 nt, Human
accuauuguccagagccaggcc

SEQ ID NO: 288370 - RNA, 22 nt, Human
accgugcccauucauuuacaaa

SEQ ID NO: 288371 - RNA, 21 nt, Human
accgucaguacuaguauugac

SEQ ID NO: 288372 - RNA, 22 nt, Human
accugagauuuuuacucaguaa

SEQ ID NO: 288373 - RNA, 22 nt, Human
accugcucucccucucgcaguc

SEQ ID NO: 288374 - RNA, 23 nt, Human
accuccuuguugaguggggguga

SEQ ID NO: 288375 - RNA, 22 nt, Human
accucagauuguggcuccgcug

SEQ ID NO: 288376 - RNA, 22 nt, Human
accucaguacugcaguuugguu

SEQ ID NO: 288377 - RNA, 22 nt, Human
accuauuuauacaacugcacca

SEQ ID NO: 288378 - RNA, 22 nt, Human
accgucagguuagaaugagcac

SEQ ID NO: 288379 - RNA, 23 nt, Human
accgccgcugccgccgcccccgc

SEQ ID NO: 288380 - RNA, 22 nt, Human
accugauuuuauggauuuugag

SEQ ID NO: 288381 - RNA, 22 nt, Human
accgauuucaaauggugcuaga

SEQ ID NO: 288382 - RNA, 22 nt, Human
accugaucugagaaguggaggg

SEQ ID NO: 288383 - RNA, 22 nt, Human
accgagcaggguguuugcgcac

SEQ ID NO: 288384 - RNA, 22 nt, Human
accucauucugcauagaacuuu

SEQ ID NO: 288385 - RNA, 22 nt, Human
accgaauucuauucccaauacc

SEQ ID NO: 288386 - RNA, 22 nt, Human
acggggagcgucggccucuccc

SEQ ID NO: 288387 - RNA, 22 nt, Human
acggguuccuugagggcaggau

SEQ ID NO: 288388 - RNA, 22 nt, Human
acgggugugauuccuuuugugu

SEQ ID NO: 288389 - RNA, 22 nt, Human
acguaaacagcaaagacaugau

SEQ ID NO: 288390 - RNA, 22 nt, Human
acguuuuagccauguaguuucu

SEQ ID NO: 288391 - RNA, 22 nt, Human
acuaaacauaucacugcuuuac

SEQ ID NO: 288392 - RNA, 22 nt, Human
acuaaagcagcucagacgagaa

SEQ ID NO: 288393 - RNA, 22 nt, Human
acgugaccuuauuugaaaaaug

SEQ ID NO: 288394 - RNA, 22 nt, Human
acuaagucugcaaaaguacuga

SEQ ID NO: 288395 - RNA, 22 nt, Human
acgucuacaugcaauucuuaua

SEQ ID NO: 288396 - RNA, 22 nt, Human
acuaaccacuuuacaccuggug

SEQ ID NO: 288397 - RNA, 23 nt, Human
acgggaggcggggcagggcugag

SEQ ID NO: 288398 - RNA, 22 nt, Human
acgauuugguucagugaagaca

SEQ ID NO: 288399 - RNA, 22 nt, Human
acgcaacacugcuauuuuuuuc

SEQ ID NO: 288400 - RNA, 22 nt, Human
acgcuucacaggugcgcauugu

SEQ ID NO: 288401 - RNA, 22 nt, Human
acgcugagcucauggagaugca

SEQ ID NO: 288402 - RNA, 23 nt, Human
acgaccuugcccucauuccaaag

SEQ ID NO: 288403 - RNA, 22 nt, Human
acgaaugacaugugauuugaaa

SEQ ID NO: 288404 - RNA, 22 nt, Human
accuuuuauuuucaugcuugcu

SEQ ID NO: 288405 - RNA, 20 nt, Human
acgaacauauugcaggguuu

SEQ ID NO: 288406 - RNA, 22 nt, Human
accuuuggaggacuagggucau

SEQ ID NO: 288407 - RNA, 22 nt, Human
accuuggauauucuuacucggu

SEQ ID NO: 288408 - RNA, 22 nt, Human
accuggcccugggucuccugac

SEQ ID NO: 288409 - RNA, 22 nt, Human
accuggauauuuucaguugcau

SEQ ID NO: 288410 - RNA, 19 nt, Human
accuguucaaccucgugcu

SEQ ID NO: 288411 - RNA, 22 nt, Human
accuuaaacagauggcggcugg

SEQ ID NO: 288412 - RNA, 22 nt, Human
accuugauggagugaugaauga

SEQ ID NO: 288413 - RNA, 20 nt, Human
accuucuuugguagacggaa

SEQ ID NO: 288414 - RNA, 22 nt, Human
acgaaauaaaauuaaagcccua

SEQ ID NO: 288415 - RNA, 22 nt, Human
accuugggcccagaccggcacg

SEQ ID NO: 288416 - RNA, 22 nt, Human
acgaagggggcauggugagagu

SEQ ID NO: 288417 - RNA, 22 nt, Human
acgaggauuuccuuagaugaaa

SEQ ID NO: 288418 - RNA, 22 nt, Human
acgauacaaucauauaguaccu

SEQ ID NO: 288419 - RNA, 22 nt, Human
acgauaacaauaguagcaugua

SEQ ID NO: 288420 - RNA, 22 nt, Human
accuguagcccaaucauggcag

SEQ ID NO: 288421 - RNA, 22 nt, Human
accuuaagugauuaugacauau

SEQ ID NO: 288422 - RNA, 22 nt, Human
acaguuuuccuugguauagaac

SEQ ID NO: 288423 - RNA, 22 nt, Human
acaguuuucugagaaucacagg

SEQ ID NO: 288424 - RNA, 19 nt, Human
acaguucuguggccuguuc

SEQ ID NO: 288425 - RNA, 16 nt, Human
acauggcacacaguuu

SEQ ID NO: 288426 - RNA, 22 nt, Human
acauggggaaaaaggccugcuc

SEQ ID NO: 288427 - RNA, 22 nt, Human
acauggcaugaauaauguguac

SEQ ID NO: 288428 - RNA, 22 nt, Human
acauauaugugcauacaacuau

SEQ ID NO: 288429 - RNA, 22 nt, Human
acaucacuugguuaaugugguc

SEQ ID NO: 288430 - RNA, 22 nt, Human
aauucagguuauauuugcaacu

SEQ ID NO: 288431 - RNA, 22 nt, Human
aauucgcugcauuccaucuagg

SEQ ID NO: 288432 - RNA, 22 nt, Human
aauucugcagucguacuauaau

SEQ ID NO: 288433 - RNA, 22 nt, Human
aauucuaaugaguucuuaucua

SEQ ID NO: 288434 - RNA, 22 nt, Human
acaguuagguccuaaaauucug

SEQ ID NO: 288435 - RNA, 22 nt, Human
acaguguuacuugauaguguau

SEQ ID NO: 288436 - RNA, 22 nt, Human
acagugugcaagaaauggggga

SEQ ID NO: 288437 - RNA, 22 nt, Human
acaugaguuacuuccgauuccc

SEQ ID NO: 288438 - RNA, 22 nt, Human
acaugcacagcaagggugagag

SEQ ID NO: 288439 - RNA, 22 nt, Human
acaugcuuucuagguccuucug

SEQ ID NO: 288440 - RNA, 22 nt, Human
acaugaggaacucaggagucac

SEQ ID NO: 288441 - RNA, 22 nt, Human
aauugauauuagauuugucuca

SEQ ID NO: 288442 - RNA, 22 nt, Human
acaugugugucugugugugugu

SEQ ID NO: 288443 - RNA, 22 nt, Human
acaugacagugacuuuauaaga

SEQ ID NO: 288444 - RNA, 22 nt, Human
acaucucacuucuuugaaggcu

SEQ ID NO: 288445 - RNA, 22 nt, Human
acauccagcagauuguccagag

SEQ ID NO: 288446 - RNA, 22 nt, Human
acauccaguaucagaagcauca

SEQ ID NO: 288447 - RNA, 22 nt, Human
acaucccccuacuuguguccug

SEQ ID NO: 288448 - RNA, 22 nt, Human
acaugucagaaaauucagaggg

SEQ ID NO: 288449 - RNA, 22 nt, Human
acauguuuacaaaccucaagcc

SEQ ID NO: 288450 - RNA, 23 nt, Human
acauuacacgcaguaauugcccc

SEQ ID NO: 288451 - RNA, 22 nt, Human
acaugggggugggacggcagag

SEQ ID NO: 288452 - RNA, 22 nt, Human
acauuuuaaaaacaguaccugg

SEQ ID NO: 288453 - RNA, 22 nt, Human
acauggaauuucagaagagcau

SEQ ID NO: 288454 - RNA, 22 nt, Human
accaauguuuuauagaaaugcc

SEQ ID NO: 288455 - RNA, 22 nt, Human
acauugguauuaguguggcuga

SEQ ID NO: 288456 - RNA, 22 nt, Human
acauuguuauuccucaggaguu

SEQ ID NO: 288457 - RNA, 22 nt, Human
accagcgcguuuucaguuucau

SEQ ID NO: 288458 - RNA, 22 nt, Human
accagccacacacauuagucac

SEQ ID NO: 288459 - RNA, 22 nt, Human
acauuuccaaagaugccaguca

SEQ ID NO: 288460 - RNA, 22 nt, Human
accagccacccugccgcguccg

SEQ ID NO: 288461 - RNA, 22 nt, Human
acauuuguuucucuagaguagg

SEQ ID NO: 288462 - RNA, 22 nt, Human
accaauaaaagcaauucacagu

SEQ ID NO: 288463 - RNA, 22 nt, Human
acauuauuguguagugugggca

SEQ ID NO: 288464 - RNA, 22 nt, Human
acauuagaugacucuuucuuuc

SEQ ID NO: 288465 - RNA, 22 nt, Human
acauugcagcuccuaccuuguc

SEQ ID NO: 288466 - RNA, 22 nt, Human
acauucucuuuuagaaagcugu

SEQ ID NO: 288467 - RNA, 22 nt, Human
acauggguuaaagaagauggaa

SEQ ID NO: 288468 - RNA, 22 nt, Human
acaugguguggcacuaggggcu

SEQ ID NO: 288469 - RNA, 21 nt, Human
acauguacacauguaugcaca

SEQ ID NO: 288470 - RNA, 22 nt, Human
acauuuugggagaaaguuguua

SEQ ID NO: 288471 - RNA, 22 nt, Human
acauuuuguuuauggaaaagau

SEQ ID NO: 288472 - RNA, 22 nt, Human
acauuuuuggguugaugucuga

SEQ ID NO: 288473 - RNA, 22 nt, Human
accaugacugucacauuauuau

SEQ ID NO: 288474 - RNA, 22 nt, Human
accauccaaaagcuuuucauca

SEQ ID NO: 288475 - RNA, 22 nt, Human
accauuuaucagaagagacacc

SEQ ID NO: 288476 - RNA, 22 nt, Human
accauccaggugagggagaccu

SEQ ID NO: 288477 - RNA, 21 nt, Human
acccagaauggagccaagccu

SEQ ID NO: 288478 - RNA, 22 nt, Human
accaaucugguauauuccagaa

SEQ ID NO: 288479 - RNA, 22 nt, Human
accaacacgucugaguauuucc

SEQ ID NO: 288480 - RNA, 19 nt, Human
accaaacaguggacggagc

SEQ ID NO: 288481 - RNA, 22 nt, Human
accacguccugguggcuguugg

SEQ ID NO: 288482 - RNA, 22 nt, Human
accagguugagacuucggcuuu

SEQ ID NO: 288483 - RNA, 22 nt, Human
accaguuaaagaauaugaggcc

SEQ ID NO: 288484 - RNA, 22 nt, Human
accaggcagcaccaaagccggu

SEQ ID NO: 288485 - RNA, 22 nt, Human
acccccacuccgcaguagaacu

SEQ ID NO: 288486 - RNA, 22 nt, Human
accccuuaaauuuguuguuuaa

SEQ ID NO: 288487 - RNA, 22 nt, Human
acccggccuacucagugcccag

SEQ ID NO: 288488 - RNA, 22 nt, Human
acccgguuuucccagcaccucc

SEQ ID NO: 288489 - RNA, 22 nt, Human
agaggcuuuccuaagauugguu

SEQ ID NO: 288490 - RNA, 22 nt, Human
agaggcaugaacucccguagcc

SEQ ID NO: 288491 - RNA, 22 nt, Human
agagggcugugcuaaauuucag

SEQ ID NO: 288492 - RNA, 22 nt, Human
agaguaauguggaguuugugcu

SEQ ID NO: 288493 - RNA, 22 nt, Human
agauaaucacaaucuagacuuu

SEQ ID NO: 288494 - RNA, 22 nt, Human
agauaacauguugcagauucug

SEQ ID NO: 288495 - RNA, 21 nt, Human
agagugugugcaucauauuug

SEQ ID NO: 288496 - RNA, 22 nt, Human
agaguguagugaaaagagauua

SEQ ID NO: 288497 - RNA, 22 nt, Human
agagugagauaugugguuggua

SEQ ID NO: 288498 - RNA, 22 nt, Human
agagcuuagaggaccuucgugc

SEQ ID NO: 288499 - RNA, 22 nt, Human
agagauacugcaggccauaaau

SEQ ID NO: 288500 - RNA, 22 nt, Human
agaggaauuauugaguuagauu

SEQ ID NO: 288501 - RNA, 22 nt, Human
agagcagcaaucuuugaaauua

SEQ ID NO: 288502 - RNA, 22 nt, Human
agaggaguagcugagcucugca

SEQ ID NO: 288503 - RNA, 22 nt, Human
agaggcagagcugggguuugac

SEQ ID NO: 288504 - RNA, 22 nt, Human
agagacuguaaugagagguaca

SEQ ID NO: 288505 - RNA, 22 nt, Human
agagcagaggcauggccguggg

SEQ ID NO: 288506 - RNA, 22 nt, Human
agagaauuugggaauauaaauc

SEQ ID NO: 288507 - RNA, 22 nt, Human
agagacaggguuuugucguguu

SEQ ID NO: 288508 - RNA, 22 nt, Human
agagaguacuuucaucagggaa

SEQ ID NO: 288509 - RNA, 22 nt, Human
agagaguagaagggacaguauu

SEQ ID NO: 288510 - RNA, 22 nt, Human
agagccggagucuucuuguuug

SEQ ID NO: 288511 - RNA, 22 nt, Human
agagccaugcuugugcauauau

SEQ ID NO: 288512 - RNA, 22 nt, Human
agagcagauggagcuggaagag

SEQ ID NO: 288513 - RNA, 19 nt, Human
agagauuuucuguuuuagu

SEQ ID NO: 288514 - RNA, 22 nt, Human
agagaacauuuucaggguuuca

SEQ ID NO: 288515 - RNA, 22 nt, Human
agagcaauggugcuuuaauucu

SEQ ID NO: 288516 - RNA, 22 nt, Human
agagaacaggcagcuggugccg

SEQ ID NO: 288517 - RNA, 22 nt, Human
agagauggugaugaggaaaaau

SEQ ID NO: 288518 - RNA, 22 nt, Human
agagauuagagaagaugauaaa

SEQ ID NO: 288519 - RNA, 21 nt, Human
agacuucuacuaucuuaugac

SEQ ID NO: 288520 - RNA, 22 nt, Human
agacuugguaacuagugaagaa

SEQ ID NO: 288521 - RNA, 20 nt, Human
agagaacaguuuggucacag

SEQ ID NO: 288522 - RNA, 19 nt, Human
agacugaagggcccgaguc

SEQ ID NO: 288523 - RNA, 21 nt, Human
agacugaugggaagacucugu

SEQ ID NO: 288524 - RNA, 22 nt, Human
agacuguuccgucagacucagu

SEQ ID NO: 288525 - RNA, 22 nt, Human
agagacauagcacaguuuuucg

SEQ ID NO: 288526 - RNA, 22 nt, Human
agaccccuggggaggauuauag

SEQ ID NO: 288527 - RNA, 22 nt, Human
agacccugauucugcuggcggu

SEQ ID NO: 288528 - RNA, 22 nt, Human
agacuucucuuggcuauauuau

SEQ ID NO: 288529 - RNA, 22 nt, Human
agacugugagaagauggcugcg

SEQ ID NO: 288530 - RNA, 22 nt, Human
agagaaacauuaauugaugagg

SEQ ID NO: 288531 - RNA, 22 nt, Human
agagaaauguacuagucuaacu

SEQ ID NO: 288532 - RNA, 22 nt, Human
agacauuuggugugaagggagg

SEQ ID NO: 288533 - RNA, 22 nt, Human
agacauauuggcuugcuuuaau

SEQ ID NO: 288534 - RNA, 22 nt, Human
agaccagugaguaggccuuaga

SEQ ID NO: 288535 - RNA, 22 nt, Human
agacucuaguggaggugcuagg

SEQ ID NO: 288536 - RNA, 22 nt, Human
agacagaacauaauuaguacug

SEQ ID NO: 288537 - RNA, 20 nt, Human
agacauugaggagagagcau

SEQ ID NO: 288538 - RNA, 22 nt, Human
acuuuggugcgaagucacuuua

SEQ ID NO: 288539 - RNA, 22 nt, Human
agaaccaauacuacagcaagua

SEQ ID NO: 288540 - RNA, 22 nt, Human
agaacaggaggaagccagcucc

SEQ ID NO: 288541 - RNA, 22 nt, Human
agaacauaucuguuuucuaacu

SEQ ID NO: 288542 - RNA, 22 nt, Human
agaaauggggugaagcaaaugg

SEQ ID NO: 288543 - RNA, 22 nt, Human
agaaauuguaauaaaucugguc

SEQ ID NO: 288544 - RNA, 22 nt, Human
agacacugacaggguccaugga

SEQ ID NO: 288545 - RNA, 22 nt, Human
agacagaaaaguugucaaucau

SEQ ID NO: 288546 - RNA, 22 nt, Human
agaauauaguaaauauuuucua

SEQ ID NO: 288547 - RNA, 22 nt, Human
agaaucaggaagacagccuggc

SEQ ID NO: 288548 - RNA, 22 nt, Human
agaauccucuagggauggcagg

SEQ ID NO: 288549 - RNA, 22 nt, Human
agaacaagaaacccgaaaagug

SEQ ID NO: 288550 - RNA, 22 nt, Human
agaaaagagacaauguuuuugg

SEQ ID NO: 288551 - RNA, 22 nt, Human
acuuugagaauuuuacuugugu

SEQ ID NO: 288552 - RNA, 22 nt, Human
acuuugaauuagaauuuugcug

SEQ ID NO: 288553 - RNA, 22 nt, Human
acuuuugaguuacauaccugaa

SEQ ID NO: 288554 - RNA, 23 nt, Human
acuuugaggagaagaaugucagu

SEQ ID NO: 288555 - RNA, 22 nt, Human
agaaacaagcccuagaaguccu

SEQ ID NO: 288556 - RNA, 22 nt, Human
agaaagcacccugcacuuucug

SEQ ID NO: 288557 - RNA, 22 nt, Human
agaagaagacccuaaggaaagg

SEQ ID NO: 288558 - RNA, 22 nt, Human
agaagauucagcaguagggugg

SEQ ID NO: 288559 - RNA, 22 nt, Human
agaagcaauuggaaaguacagg

SEQ ID NO: 288560 - RNA, 21 nt, Human
agaagcggucgaaucgcagac

SEQ ID NO: 288561 - RNA, 22 nt, Human
acuguuauugguguauguggca

SEQ ID NO: 288562 - RNA, 22 nt, Human
acuguugugaauaaugaaaugc

SEQ ID NO: 288563 - RNA, 22 nt, Human
acuuacuuucuauucuuguagg

SEQ ID NO: 288564 - RNA, 17 nt, Human
acuuaagacaguggaaa

SEQ ID NO: 288565 - RNA, 22 nt, Human
acuuauaaauuuaguacacugu

SEQ ID NO: 288566 - RNA, 22 nt, Human
acuuccuuccagcaaauggcau

SEQ ID NO: 288567 - RNA, 22 nt, Human
acuuagaacagccuaugggaag

SEQ ID NO: 288568 - RNA, 22 nt, Human
acuuccuuuuuuggggauagca

SEQ ID NO: 288569 - RNA, 22 nt, Human
acugugauuuguuuuuguguuu

SEQ ID NO: 288570 - RNA, 22 nt, Human
acugugauguaaagaaauaggc

SEQ ID NO: 288571 - RNA, 22 nt, Human
acugugaagagcauucuggcug

SEQ ID NO: 288572 - RNA, 22 nt, Human
acugucuuguuguaugugagcu

SEQ ID NO: 288573 - RNA, 22 nt, Human
acuguccucgaaguaccugugc

SEQ ID NO: 288574 - RNA, 22 nt, Human
acuugcaucuuagagacucacc

SEQ ID NO: 288575 - RNA, 22 nt, Human
acuuggcuaggguuuuuaucuu

SEQ ID NO: 288576 - RNA, 22 nt, Human
acuugaugcauauggaagagca

SEQ ID NO: 288577 - RNA, 22 nt, Human
acuugauggaguuucacuguau

SEQ ID NO: 288578 - RNA, 22 nt, Human
acuuuuagccuucccacaacag

SEQ ID NO: 288579 - RNA, 22 nt, Human
acuugguccacaguaagugcuu

SEQ ID NO: 288580 - RNA, 22 nt, Human
acuuugucuugaucaaaggugu

SEQ ID NO: 288581 - RNA, 19 nt, Human
acuugcuuucauuuaagau

SEQ ID NO: 288582 - RNA, 22 nt, Human
acuuuuaaggggccuugauuua

SEQ ID NO: 288583 - RNA, 22 nt, Human
acuggcgucugucuccccugcc

SEQ ID NO: 288584 - RNA, 22 nt, Human
acuggcuuggaaauggguauuu

SEQ ID NO: 288585 - RNA, 22 nt, Human
acuggcuuauuguuguggagcu

SEQ ID NO: 288586 - RNA, 22 nt, Human
acugggcaaggauaugaugggu

SEQ ID NO: 288587 - RNA, 22 nt, Human
acugggacuguaugugcuggac

SEQ ID NO: 288588 - RNA, 22 nt, Human
acuggagcccguggaggcgcag

SEQ ID NO: 288589 - RNA, 22 nt, Human
acuggauucucuuacacagaug

SEQ ID NO: 288590 - RNA, 22 nt, Human
acugcacuccagcccgagcaac

SEQ ID NO: 288591 - RNA, 22 nt, Human
acugcauuucauaaauuacaau

SEQ ID NO: 288592 - RNA, 20 nt, Human
acugcaagagacagaugaaa

SEQ ID NO: 288593 - RNA, 22 nt, Human
acuacucagcaaacauuugcug

SEQ ID NO: 288594 - RNA, 20 nt, Human
acuaccaugcaauuccgcuu

SEQ ID NO: 288595 - RNA, 22 nt, Human
acuaauuuacagaaauuucuua

SEQ ID NO: 288596 - RNA, 22 nt, Human
acguugaaaugggcauuuuccg

SEQ ID NO: 288597 - RNA, 22 nt, Human
acuaaguagaggagugaugauu

SEQ ID NO: 288598 - RNA, 22 nt, Human
acugagcaaaacugauccuguu

SEQ ID NO: 288599 - RNA, 18 nt, Human
acugagcccaggacacac

SEQ ID NO: 288600 - RNA, 22 nt, Human
acugacucacauuuugguuugc

SEQ ID NO: 288601 - RNA, 21 nt, Human
acugccaugcaggagccucca

SEQ ID NO: 288602 - RNA, 22 nt, Human
acuggcauuccuaggggagggg

SEQ ID NO: 288603 - RNA, 19 nt, Human
acugggaugggcagugcca

SEQ ID NO: 288604 - RNA, 22 nt, Human
acuggugcucuggccaccgcug

SEQ ID NO: 288605 - RNA, 22 nt, Human
acugguuucaaguuggacugaa

SEQ ID NO: 288606 - RNA, 22 nt, Human
acugucauuaaugaauguaaua

SEQ ID NO: 288607 - RNA, 22 nt, Human
acugauuuuauauauuaccccg

SEQ ID NO: 288608 - RNA, 21 nt, Human
acugggcuagccugacuucug

SEQ ID NO: 288609 - RNA, 22 nt, Human
acuggguuguuugucucaugag

SEQ ID NO: 288610 - RNA, 22 nt, Human
acuguucacccagcacuagcag

SEQ ID NO: 288611 - RNA, 22 nt, Human
acuguugagggaagcagaugaa

SEQ ID NO: 288612 - RNA, 18 nt, Human
acuguggcucagaguugc

SEQ ID NO: 288613 - RNA, 22 nt, Human
acuguggcugcuacccuggcuc

SEQ ID NO: 288614 - RNA, 22 nt, Human
acugguagcugauuaaguauag

SEQ ID NO: 288615 - RNA, 22 nt, Human
acugucaggauugagucucugg

SEQ ID NO: 288616 - RNA, 19 nt, Human
acuggggcaggcugggcuu

SEQ ID NO: 288617 - RNA, 22 nt, Human
acuggggcaggaaaguaugcug

SEQ ID NO: 288618 - RNA, 22 nt, Human
cgccaaccaggcuguccuccca

SEQ ID NO: 288619 - RNA, 22 nt, Human
cgcauugcaauucaggggauaa

SEQ ID NO: 288620 - RNA, 22 nt, Human
cgcagcuucagggccaggaggg

SEQ ID NO: 288621 - RNA, 22 nt, Human
ccucuaugcccuucuggggguc

SEQ ID NO: 288622 - RNA, 22 nt, Human
ccucucccugcagggcccaggg

SEQ ID NO: 288623 - RNA, 22 nt, Human
ccgccccaggcccugagccaag

SEQ ID NO: 288624 - RNA, 22 nt, Human
cgacagauuauuuugugacugc

SEQ ID NO: 288625 - RNA, 22 nt, Human
ccgauuuaugucucugacuuga

SEQ ID NO: 288626 - RNA, 22 nt, Human
ccucaauucgugccucacauug

SEQ ID NO: 288627 - RNA, 22 nt, Human
ccucagcuguuucucucaucag

SEQ ID NO: 288628 - RNA, 22 nt, Human
ccucacuucuuucucuucacuu

SEQ ID NO: 288629 - RNA, 22 nt, Human
ccgcagucugcaaucucccugg

SEQ ID NO: 288630 - RNA, 22 nt, Human
ccgcagggcccggcgggcucag

SEQ ID NO: 288631 - RNA, 22 nt, Human
ccugcugcugaugcuguuucac

SEQ ID NO: 288632 - RNA, 21 nt, Human
ccgaggagugcggggagcccc

SEQ ID NO: 288633 - RNA, 22 nt, Human
cgcucggugagccaguggcgga

SEQ ID NO: 288634 - RNA, 22 nt, Human
cgcgcuuugggcaguguggcug

SEQ ID NO: 288635 - RNA, 22 nt, Human
cgccugucugcauggccacugg

SEQ ID NO: 288636 - RNA, 22 nt, Human
ccugaguucuuauuuccaguca

SEQ ID NO: 288637 - RNA, 22 nt, Human
ccugauauggugucauuuaaac

SEQ ID NO: 288638 - RNA, 22 nt, Human
ccugcaguagagguugguaggg

SEQ ID NO: 288639 - RNA, 22 nt, Human
ccugaauuuaucugaauggugg

SEQ ID NO: 288640 - RNA, 22 nt, Human
cgccuggccccgcagcgcuugu

SEQ ID NO: 288641 - RNA, 22 nt, Human
ccugacagcgugucccuggccc

SEQ ID NO: 288642 - RNA, 22 nt, Human
ccugccuuccagcucuggggag

SEQ ID NO: 288643 - RNA, 22 nt, Human
ccugcaguuuuuccaugauaca

SEQ ID NO: 288644 - RNA, 22 nt, Human
ccugcccaucccaccccagcau

SEQ ID NO: 288645 - RNA, 18 nt, Human
ccugcguggauguccucu

SEQ ID NO: 288646 - RNA, 22 nt, Human
ccugcuggagucuaguuggucu

SEQ ID NO: 288647 - RNA, 19 nt, Human
ccugcugaagugaugcagc

SEQ ID NO: 288648 - RNA, 22 nt, Human
cggcggcgaaccgaccugggug

SEQ ID NO: 288649 - RNA, 22 nt, Human
cggccgcgggauggcgggcagc

SEQ ID NO: 288650 - RNA, 22 nt, Human
cgggucgagugcuguaguucga

SEQ ID NO: 288651 - RNA, 19 nt, Human
cggugaagagaguuuagau

SEQ ID NO: 288652 - RNA, 22 nt, Human
cgguugcaggaugugcgggcag

SEQ ID NO: 288653 - RNA, 22 nt, Human
cgguggcccauuguacgcagcu

SEQ ID NO: 288654 - RNA, 22 nt, Human
cguauauaaauguauauacaca

SEQ ID NO: 288655 - RNA, 22 nt, Human
cgugugugugcgugugcgugug

SEQ ID NO: 288656 - RNA, 22 nt, Human
cgugaucuguuauauagugagc

SEQ ID NO: 288657 - RNA, 22 nt, Human
cuaaaaauguucuaguaguuca

SEQ ID NO: 288658 - RNA, 20 nt, Human
ccugggcuccaggagccccg

SEQ ID NO: 288659 - RNA, 22 nt, Human
ccuggcccugcugcuugccagc

SEQ ID NO: 288660 - RNA, 22 nt, Human
cggcuacccaugucauauucgu

SEQ ID NO: 288661 - RNA, 22 nt, Human
cggcgccccgcgcgggcggcuc

SEQ ID NO: 288662 - RNA, 22 nt, Human
cggggcaaggggggcuggugga

SEQ ID NO: 288663 - RNA, 22 nt, Human
ccugugucaucagcuguggcua

SEQ ID NO: 288664 - RNA, 22 nt, Human
cggggaggagccagcggaggau

SEQ ID NO: 288665 - RNA, 22 nt, Human
ccugugcaugccaggguacacc

SEQ ID NO: 288666 - RNA, 22 nt, Human
ccuguuccaacccucccuggcu

SEQ ID NO: 288667 - RNA, 22 nt, Human
ccuguuuguucauguacuguga

SEQ ID NO: 288668 - RNA, 22 nt, Human
ccuguguucguccucaccuugc

SEQ ID NO: 288669 - RNA, 20 nt, Human
ccuguucacugcgcaguuuc

SEQ ID NO: 288670 - RNA, 22 nt, Human
cggggcuggcguuagggaggca

SEQ ID NO: 288671 - RNA, 22 nt, Human
cgggguguggggcgguagugug

SEQ ID NO: 288672 - RNA, 19 nt, Human
cgguaugaauguacuaugg

SEQ ID NO: 288673 - RNA, 22 nt, Human
ccuuaauaguguucuaauguuu

SEQ ID NO: 288674 - RNA, 18 nt, Human
ccuucaucucugcuucuu

SEQ ID NO: 288675 - RNA, 22 nt, Human
cggggugugacggugcgggccu

SEQ ID NO: 288676 - RNA, 22 nt, Human
cuccuuuuuuuaaagauggauu

SEQ ID NO: 288677 - RNA, 22 nt, Human
cuccuuuuugggaccgugcagc

SEQ ID NO: 288678 - RNA, 22 nt, Human
cucccucacaaagcauucucuu

SEQ ID NO: 288679 - RNA, 22 nt, Human
cuccuuuuccuacucauacuau

SEQ ID NO: 288680 - RNA, 22 nt, Human
cucggggcguggcaguagcaug

SEQ ID NO: 288681 - RNA, 22 nt, Human
cggccuuugcccgucauucugg

SEQ ID NO: 288682 - RNA, 22 nt, Human
cggccuuuggcuucuccugugu

SEQ ID NO: 288683 - RNA, 22 nt, Human
cggaagcacuagacacugacac

SEQ ID NO: 288684 - RNA, 22 nt, Human
cgcuuugguaauagggcagccu

SEQ ID NO: 288685 - RNA, 22 nt, Human
cuccagucccuccuugcccagc

SEQ ID NO: 288686 - RNA, 22 nt, Human
cuccaugagccaggagggcuac

SEQ ID NO: 288687 - RNA, 22 nt, Human
cucacauacaagagauggugga

SEQ ID NO: 288688 - RNA, 22 nt, Human
cucagaauugucaccucaaaaa

SEQ ID NO: 288689 - RNA, 22 nt, Human
cgcucggcuuucccuccgccgg

SEQ ID NO: 288690 - RNA, 22 nt, Human
cucagcgggagucuggccgaac

SEQ ID NO: 288691 - RNA, 22 nt, Human
cgcucugccugcccuaacuucc

SEQ ID NO: 288692 - RNA, 19 nt, Human
cgcugcucccgcuguggcu

SEQ ID NO: 288693 - RNA, 22 nt, Human
cucagcugcuuuguuuugcuuu

SEQ ID NO: 288694 - RNA, 22 nt, Human
cuauuauuauugucguuuuaca

SEQ ID NO: 288695 - RNA, 22 nt, Human
cucaccugccuccccgcccucc

SEQ ID NO: 288696 - RNA, 22 nt, Human
cucacugugggcuaugaauggg

SEQ ID NO: 288697 - RNA, 22 nt, Human
cuaguuuucacaaaggaagggc

SEQ ID NO: 288698 - RNA, 22 nt, Human
cuaaugaaaugauggcuccuac

SEQ ID NO: 288699 - RNA, 22 nt, Human
cuaauaauuuacugagugcuac

SEQ ID NO: 288700 - RNA, 22 nt, Human
cgaaaaagaagugcaccauguu

SEQ ID NO: 288701 - RNA, 22 nt, Human
cuauguuuugcuagugaugggu

SEQ ID NO: 288702 - RNA, 22 nt, Human
cgggagaugaggagagcuucgg

SEQ ID NO: 288703 - RNA, 20 nt, Human
cgggacacucaagcucuggg

SEQ ID NO: 288704 - RNA, 22 nt, Human
cucuugggggcaggagggacag

SEQ ID NO: 288705 - RNA, 22 nt, Human
cggcuucucgggucggauuccg

SEQ ID NO: 288706 - RNA, 22 nt, Human
cggggcgggcgugggaggugga

SEQ ID NO: 288707 - RNA, 22 nt, Human
cugaaagacagccaggcaaagc

SEQ ID NO: 288708 - RNA, 22 nt, Human
cugaaagcaaaguaauucuuaa

SEQ ID NO: 288709 - RNA, 22 nt, Human
cugaagaaagaaaauggccauc

SEQ ID NO: 288710 - RNA, 22 nt, Human
cggucuauuguguaucauuuca

SEQ ID NO: 288711 - RNA, 22 nt, Human
cugaaucugccuccgaggguuu

SEQ ID NO: 288712 - RNA, 22 nt, Human
cugaccgugccgcgguacugcu

SEQ ID NO: 288713 - RNA, 22 nt, Human
cugaaucaaaugacuuagccau

SEQ ID NO: 288714 - RNA, 22 nt, Human
cugaaggcuuugaauggaauga

SEQ ID NO: 288715 - RNA, 22 nt, Human
cucugcuuguaucacauuugcu

SEQ ID NO: 288716 - RNA, 22 nt, Human
cucuucauguuggugcagaagc

SEQ ID NO: 288717 - RNA, 22 nt, Human
cucugugggcauauuuguaaaa

SEQ ID NO: 288718 - RNA, 22 nt, Human
cucuguggucugaagccuguga

SEQ ID NO: 288719 - RNA, 22 nt, Human
cucuugacagcuuuaguaucau

SEQ ID NO: 288720 - RNA, 22 nt, Human
cucuuucauucuguccuuguuu

SEQ ID NO: 288721 - RNA, 22 nt, Human
cucuuucauucuuagguugccg

SEQ ID NO: 288722 - RNA, 22 nt, Human
cggcgcugguacaguggaagag

SEQ ID NO: 288723 - RNA, 19 nt, Human
cugaaacacagagagggcu

SEQ ID NO: 288724 - RNA, 22 nt, Human
cucuuuucaaaccuguuuaugg

SEQ ID NO: 288725 - RNA, 22 nt, Human
ccggcggaaacauggcggcgcc

SEQ ID NO: 288726 - RNA, 22 nt, Human
ccggauuugggagccaccaggg

SEQ ID NO: 288727 - RNA, 22 nt, Human
ccggcggguggagcaugcgcgg

SEQ ID NO: 288728 - RNA, 19 nt, Human
ccggucaugcauuccuuug

SEQ ID NO: 288729 - RNA, 22 nt, Human
ccggguucuuguucuaggaugu

SEQ ID NO: 288730 - RNA, 22 nt, Human
cccagcuuugcggacccgggag

SEQ ID NO: 288731 - RNA, 22 nt, Human
cccagagacuuuguccgacgac

SEQ ID NO: 288732 - RNA, 19 nt, Human
cccagaggaaugccuggaa

SEQ ID NO: 288733 - RNA, 22 nt, Human
cccagaccagagugccuggacg

SEQ ID NO: 288734 - RNA, 22 nt, Human
cccacgccuucuuucuucaaau

SEQ ID NO: 288735 - RNA, 22 nt, Human
ccgcggcugcgcggugccccuc

SEQ ID NO: 288736 - RNA, 22 nt, Human
ccgcggcuguaguggaggugga

SEQ ID NO: 288737 - RNA, 22 nt, Human
ccgcggcagaggcgggggcgcc

SEQ ID NO: 288738 - RNA, 22 nt, Human
ccgcucgggugcagagggcaga

SEQ ID NO: 288739 - RNA, 22 nt, Human
ccgcgggcagggcuucaccuuu

SEQ ID NO: 288740 - RNA, 22 nt, Human
cccagaagaguauguguuugcu

SEQ ID NO: 288741 - RNA, 22 nt, Human
ccguccgcuccuccagccgcug

SEQ ID NO: 288742 - RNA, 22 nt, Human
cccaggucgucagcaguguggu

SEQ ID NO: 288743 - RNA, 22 nt, Human
ccgugcaguuucucacacacau

SEQ ID NO: 288744 - RNA, 22 nt, Human
cccaugacucucauucacaguc

SEQ ID NO: 288745 - RNA, 22 nt, Human
cccauggaaggguuggcccaga

SEQ ID NO: 288746 - RNA, 22 nt, Human
ccgugccuuuaguuucuucugu

SEQ ID NO: 288747 - RNA, 22 nt, Human
cccauauacuuuuucuggucca

SEQ ID NO: 288748 - RNA, 22 nt, Human
cccaguuguuccuauucuucuu

SEQ ID NO: 288749 - RNA, 22 nt, Human
ccccaaauuugugcuuucauag

SEQ ID NO: 288750 - RNA, 22 nt, Human
ccccacaugaauacaguguagu

SEQ ID NO: 288751 - RNA, 22 nt, Human
cccauuuuuuggauguguggau

SEQ ID NO: 288752 - RNA, 22 nt, Human
cccccucuuccccucauugcuu

SEQ ID NO: 288753 - RNA, 22 nt, Human
ccccguggcugggggacagagc

SEQ ID NO: 288754 - RNA, 22 nt, Human
ccccaguuccugucaaggguaa

SEQ ID NO: 288755 - RNA, 22 nt, Human
ccgugggugggguacgggcugg

SEQ ID NO: 288756 - RNA, 22 nt, Human
ccuauuuucaaaauuguuuauc

SEQ ID NO: 288757 - RNA, 22 nt, Human
ccuagcauagcuuuugccuccc

SEQ ID NO: 288758 - RNA, 22 nt, Human
ccuauauaaaugacauauagga

SEQ ID NO: 288759 - RNA, 22 nt, Human
ccucaguguguggauguuagag

SEQ ID NO: 288760 - RNA, 22 nt, Human
cccuagccuuguuuuccuuaga

SEQ ID NO: 288761 - RNA, 22 nt, Human
ccucuggacuugggacagugag

SEQ ID NO: 288762 - RNA, 22 nt, Human
ccugaaaugaguucugcucacu

SEQ ID NO: 288763 - RNA, 22 nt, Human
ccugaagaugguugauccccuu

SEQ ID NO: 288764 - RNA, 22 nt, Human
ccucuuuugaaccaguucuuca

SEQ ID NO: 288765 - RNA, 22 nt, Human
ccuccuuucaggaaguaggugg

SEQ ID NO: 288766 - RNA, 22 nt, Human
ccuccuuuccuguuuuccugag

SEQ ID NO: 288767 - RNA, 19 nt, Human
cccgauggagacuuagcag

SEQ ID NO: 288768 - RNA, 22 nt, Human
cccgaaaauuguuguacugcag

SEQ ID NO: 288769 - RNA, 22 nt, Human
ccuccccugccugugcuguugg

SEQ ID NO: 288770 - RNA, 22 nt, Human
ccucccaccguaucucaguggc

SEQ ID NO: 288771 - RNA, 22 nt, Human
cccuucauguagcugugugucc

SEQ ID NO: 288772 - RNA, 22 nt, Human
ccugagccgagcgcucuuucuc

SEQ ID NO: 288773 - RNA, 20 nt, Human
ccucuuuaguugauggguuu

SEQ ID NO: 288774 - RNA, 21 nt, Human
ccugagucccccagacccugg

SEQ ID NO: 288775 - RNA, 22 nt, Human
ccugaggcccuggcugugcuga

SEQ ID NO: 288776 - RNA, 22 nt, Human
cccuggcucaggcagcuuuguu

SEQ ID NO: 288777 - RNA, 22 nt, Human
cccugcacuguguggacucugg

SEQ ID NO: 288778 - RNA, 20 nt, Human
cccuggaaugagaugcauau

SEQ ID NO: 288779 - RNA, 22 nt, Human
ccugcugagccuggugggcagc

SEQ ID NO: 288780 - RNA, 22 nt, Human
ccugcucccccugcaagccuug

SEQ ID NO: 288781 - RNA, 22 nt, Human
ccugccagaaaagagggaguuc

SEQ ID NO: 288782 - RNA, 22 nt, Human
ccugccagccugccaucccaca

SEQ ID NO: 288783 - RNA, 22 nt, Human
ccugccugggcucacuugccag

SEQ ID NO: 288784 - RNA, 22 nt, Human
ccugcaugacuuugucagaccu

SEQ ID NO: 288785 - RNA, 22 nt, Human
cccuuuuccugaggcccccugc

SEQ ID NO: 288786 - RNA, 22 nt, Human
ccagucagccuaguucuucuuu

SEQ ID NO: 288787 - RNA, 23 nt, Human
ccagucgagucccaaccuucacc

SEQ ID NO: 288788 - RNA, 22 nt, Human
cccugauaaaucagcaccucag

SEQ ID NO: 288789 - RNA, 17 nt, Human
cccugcacccuacucuc

SEQ ID NO: 288790 - RNA, 22 nt, Human
ccagggcugcugccugggcugg

SEQ ID NO: 288791 - RNA, 22 nt, Human
cccguggugggaugacaccaug

SEQ ID NO: 288792 - RNA, 22 nt, Human
cccgguugggguuccagggcgc

SEQ ID NO: 288793 - RNA, 22 nt, Human
cccugggccccgaacugcugag

SEQ ID NO: 288794 - RNA, 20 nt, Human
cccuggcuggcaucuggacu

SEQ ID NO: 288795 - RNA, 22 nt, Human
cccuggacuccauuuucccgua

SEQ ID NO: 288796 - RNA, 17 nt, Human
cccugcauugauccuca

SEQ ID NO: 288797 - RNA, 22 nt, Human
ccagugacaaagucggaagucc

SEQ ID NO: 288798 - RNA, 22 nt, Human
ccagugcuuccaggaauacggu

SEQ ID NO: 288799 - RNA, 22 nt, Human
cccuguccuucccuccaucuga

SEQ ID NO: 288800 - RNA, 22 nt, Human
ccaguggugcauguuugagcaa

SEQ ID NO: 288801 - RNA, 22 nt, Human
ccaguuguggagaauuguuuga

SEQ ID NO: 288802 - RNA, 19 nt, Human
ccaguuuuuuaauauucaa

SEQ ID NO: 288803 - RNA, 22 nt, Human
ccgaggaguagggugucuacgg

SEQ ID NO: 288804 - RNA, 22 nt, Human
ccgcaccgucugccauacacgc

SEQ ID NO: 288805 - RNA, 22 nt, Human
ccgauuuauucugacaguuuau

SEQ ID NO: 288806 - RNA, 22 nt, Human
cccacccuacugcuacccagga

SEQ ID NO: 288807 - RNA, 22 nt, Human
ccgccacggggcaugggaggca

SEQ ID NO: 288808 - RNA, 22 nt, Human
cccaaccagaaauugacagaga

SEQ ID NO: 288809 - RNA, 22 nt, Human
ccauuucacaucccugacaugu

SEQ ID NO: 288810 - RNA, 22 nt, Human
ccauuuggccauucaguuguuc

SEQ ID NO: 288811 - RNA, 23 nt, Human
ccaugugcaggguucagcacuua

SEQ ID NO: 288812 - RNA, 22 nt, Human
ccaugugaccugugucaguugc

SEQ ID NO: 288813 - RNA, 22 nt, Human
cccuuggaaaugguucuuaacu

SEQ ID NO: 288814 - RNA, 22 nt, Human
ccgaaaaacagaaucuuggaac

SEQ ID NO: 288815 - RNA, 22 nt, Human
ccauggaugcucagauguuagc

SEQ ID NO: 288816 - RNA, 21 nt, Human
ccaucuugaaccaugcccacu

SEQ ID NO: 288817 - RNA, 22 nt, Human
ccaugauguugccuacacugcu

SEQ ID NO: 288818 - RNA, 22 nt, Human
ccauaaaguaggaaacacuaca

SEQ ID NO: 288819 - RNA, 22 nt, Human
ccagggagggccacagggccau

SEQ ID NO: 288820 - RNA, 22 nt, Human
cccgcucaccccacuccaccag

SEQ ID NO: 288821 - RNA, 22 nt, Human
cccgcuaaaucaguucugaguc

SEQ ID NO: 288822 - RNA, 22 nt, Human
cccgccggccacaccggccgcc

SEQ ID NO: 288823 - RNA, 18 nt, Human
ccccucuuccagacagag

SEQ ID NO: 288824 - RNA, 23 nt, Human
ccccugcauggcaccacauuccc

SEQ ID NO: 288825 - RNA, 22 nt, Human
ccccugggcccugagccgcgau

SEQ ID NO: 288826 - RNA, 22 nt, Human
ccagcuuuucagaaucugccug

SEQ ID NO: 288827 - RNA, 22 nt, Human
cccccauccccugaaggagcug

SEQ ID NO: 288828 - RNA, 22 nt, Human
ccccaguuucaccuaccccgcc

SEQ ID NO: 288829 - RNA, 22 nt, Human
ccagccugagcuugcugcccuc

SEQ ID NO: 288830 - RNA, 22 nt, Human
cccagcuggcaaaggcguccuu

SEQ ID NO: 288831 - RNA, 22 nt, Human
cccagcugaacuugcauuccaa

SEQ ID NO: 288832 - RNA, 22 nt, Human
cccagggguugaggccguaggg

SEQ ID NO: 288833 - RNA, 22 nt, Human
cauuagggucuuuagacagcuc

SEQ ID NO: 288834 - RNA, 22 nt, Human
cccaggaaugagcaggcagggg

SEQ ID NO: 288835 - RNA, 22 nt, Human
ccagccacagcuuccagcuccu

SEQ ID NO: 288836 - RNA, 22 nt, Human
ccagcagaagcucccgcugggu

SEQ ID NO: 288837 - RNA, 22 nt, Human
ccagcaaguaagucagugucag

SEQ ID NO: 288838 - RNA, 23 nt, Human
cauguacacacagcuguacagug

SEQ ID NO: 288839 - RNA, 22 nt, Human
cauauuaugcauguuguucuuu

SEQ ID NO: 288840 - RNA, 20 nt, Human
caucaacaccuugucagccu

SEQ ID NO: 288841 - RNA, 22 nt, Human
cauuacaagaaauagcauaaug

SEQ ID NO: 288842 - RNA, 22 nt, Human
ccagagcaccgaaacgagcuuu

SEQ ID NO: 288843 - RNA, 22 nt, Human
cuguuucuuugcugucagagag

SEQ ID NO: 288844 - RNA, 20 nt, Human
cuguuugcuaucaugagcug

SEQ ID NO: 288845 - RNA, 22 nt, Human
gaacauauuuagcaccuaauau

SEQ ID NO: 288846 - RNA, 22 nt, Human
gaacugggguagggguagcuuu

SEQ ID NO: 288847 - RNA, 22 nt, Human
cuguuuggaugccauggucaag

SEQ ID NO: 288848 - RNA, 22 nt, Human
cuguucagugcauauguauuga

SEQ ID NO: 288849 - RNA, 22 nt, Human
cuguucuccacuccugacuucu

SEQ ID NO: 288850 - RNA, 22 nt, Human
cuguuguauuuauuucccuuuc

SEQ ID NO: 288851 - RNA, 22 nt, Human
cuuauuagaaagaaaagacaug

SEQ ID NO: 288852 - RNA, 22 nt, Human
cuuauaucaacuggaaaaauua

SEQ ID NO: 288853 - RNA, 23 nt, Human
cuuauauaaucauuagaaaccau

SEQ ID NO: 288854 - RNA, 22 nt, Human
gaagcagguucuucaggaugaa

SEQ ID NO: 288855 - RNA, 22 nt, Human
cuuauuugcccauguuucuuua

SEQ ID NO: 288856 - RNA, 20 nt, Human
cuuauuuuggagaacuuuuc

SEQ ID NO: 288857 - RNA, 22 nt, Human
cuucaacuucuguuuuaaggaa

SEQ ID NO: 288858 - RNA, 22 nt, Human
cugugccagucagggggcaagu

SEQ ID NO: 288859 - RNA, 22 nt, Human
cugugcuguuagcgauuuuuaa

SEQ ID NO: 288860 - RNA, 22 nt, Human
cuguggaguccuggggaaugga

SEQ ID NO: 288861 - RNA, 22 nt, Human
cuguguguauaauguuugauaa

SEQ ID NO: 288862 - RNA, 22 nt, Human
cugugugcagggcacaauggaa

SEQ ID NO: 288863 - RNA, 22 nt, Human
cuguguggccuaaguggagaca

SEQ ID NO: 288864 - RNA, 22 nt, Human
gaaaugucaagauauguuugga

SEQ ID NO: 288865 - RNA, 22 nt, Human
cugugucucccaaggaggguca

SEQ ID NO: 288866 - RNA, 22 nt, Human
gaaauagagacaguaagugucu

SEQ ID NO: 288867 - RNA, 22 nt, Human
gaaagugaauguaacauguuau

SEQ ID NO: 288868 - RNA, 22 nt, Human
cugugaaugguggccacgcguu

SEQ ID NO: 288869 - RNA, 21 nt, Human
cuuugccuccagcagccgcag

SEQ ID NO: 288870 - RNA, 22 nt, Human
cuuuggacaacugagugacguu

SEQ ID NO: 288871 - RNA, 22 nt, Human
cuuuguaaucaauaagucuuuu

SEQ ID NO: 288872 - RNA, 22 nt, Human
cuuugugcagcagaaaugugug

SEQ ID NO: 288873 - RNA, 22 nt, Human
cuuggagauacagaggacauuu

SEQ ID NO: 288874 - RNA, 21 nt, Human
cuuggagacucuuggccacau

SEQ ID NO: 288875 - RNA, 22 nt, Human
gaaugcacacgugugugcaugc

SEQ ID NO: 288876 - RNA, 22 nt, Human
gaaugacuugcucauucugugu

SEQ ID NO: 288877 - RNA, 22 nt, Human
cuuggcacauuuuguucuucug

SEQ ID NO: 288878 - RNA, 22 nt, Human
cuuggcaaaguggcaaaauuag

SEQ ID NO: 288879 - RNA, 20 nt, Human
gaauucugaagauaauuugg

SEQ ID NO: 288880 - RNA, 22 nt, Human
cuugggguuugggggcuugacc

SEQ ID NO: 288881 - RNA, 22 nt, Human
gaauggaacauagcaacaucuu

SEQ ID NO: 288882 - RNA, 22 nt, Human
gaaguaaaacaguaacuuuguu

SEQ ID NO: 288883 - RNA, 22 nt, Human
gaauaagaauccacuucuggca

SEQ ID NO: 288884 - RNA, 22 nt, Human
cuucuuucuuuucuucuucucu

SEQ ID NO: 288885 - RNA, 22 nt, Human
cuucuugggaggggcggagcuc

SEQ ID NO: 288886 - RNA, 22 nt, Human
cuugcucugggaauaugaguuu

SEQ ID NO: 288887 - RNA, 20 nt, Human
gaaucuggucaaaugucuau

SEQ ID NO: 288888 - RNA, 22 nt, Human
cuucagcgucgucaguguugcu

SEQ ID NO: 288889 - RNA, 22 nt, Human
gaagcggguucacuggauggcu

SEQ ID NO: 288890 - RNA, 22 nt, Human
gaagcccuggaggggcuggagg

SEQ ID NO: 288891 - RNA, 22 nt, Human
cuucaugucacugucuuaggua

SEQ ID NO: 288892 - RNA, 22 nt, Human
cuucaguuaguuucaugugagc

SEQ ID NO: 288893 - RNA, 22 nt, Human
cuucauguucaugcuaacauuu

SEQ ID NO: 288894 - RNA, 22 nt, Human
cuucauuacagcaaccauuuga

SEQ ID NO: 288895 - RNA, 22 nt, Human
cuucauuucaggcugaagaaua

SEQ ID NO: 288896 - RNA, 22 nt, Human
cuucuggaggcugcagaaaaga

SEQ ID NO: 288897 - RNA, 22 nt, Human
cuucucuugugauguuagcgga

SEQ ID NO: 288898 - RNA, 22 nt, Human
cuucucuuugacaguugggugu

SEQ ID NO: 288899 - RNA, 22 nt, Human
cuucugaugugugcucuuaguu

SEQ ID NO: 288900 - RNA, 22 nt, Human
cuucuuaaaguugucacagcug

SEQ ID NO: 288901 - RNA, 22 nt, Human
cuucuguggaauagguuugaca

SEQ ID NO: 288902 - RNA, 22 nt, Human
cuuccacucaguuuuucauugc

SEQ ID NO: 288903 - RNA, 22 nt, Human
gaaggaagcugucuggaugugu

SEQ ID NO: 288904 - RNA, 22 nt, Human
cuucccuacuucagugcucccu

SEQ ID NO: 288905 - RNA, 22 nt, Human
cuucucuuggguguggugucuu

SEQ ID NO: 288906 - RNA, 22 nt, Human
gaaggcagucuggggagcagcc

SEQ ID NO: 288907 - RNA, 22 nt, Human
cuuccagugcauagguagauca

SEQ ID NO: 288908 - RNA, 22 nt, Human
gaccagaacuucuagucuaagu

SEQ ID NO: 288909 - RNA, 22 nt, Human
gacaucuguccauggcacugga

SEQ ID NO: 288910 - RNA, 22 nt, Human
cuuuaaaaauguauuuuugugg

SEQ ID NO: 288911 - RNA, 22 nt, Human
cuuguuuuaaacuguuguggcu

SEQ ID NO: 288912 - RNA, 20 nt, Human
cuuguuaaauaugcagguag

SEQ ID NO: 288913 - RNA, 22 nt, Human
cuuguuaacaauugguaucuuu

SEQ ID NO: 288914 - RNA, 18 nt, Human
gacaaaaguacagacaga

SEQ ID NO: 288915 - RNA, 22 nt, Human
gacggggcagccagcugguggc

SEQ ID NO: 288916 - RNA, 22 nt, Human
gacuacauuugguauugacgag

SEQ ID NO: 288917 - RNA, 22 nt, Human
gacucuucucucccaaaugccc

SEQ ID NO: 288918 - RNA, 22 nt, Human
cuuuuucuuaucuuuuucuaug

SEQ ID NO: 288919 - RNA, 21 nt, Human
cuuuucuagucccagccccgc

SEQ ID NO: 288920 - RNA, 22 nt, Human
cuuuucauuucauggaauacaa

SEQ ID NO: 288921 - RNA, 22 nt, Human
gagaagugaauaacgaagcagg

SEQ ID NO: 288922 - RNA, 22 nt, Human
gaaaacccuguauguagcguuu

SEQ ID NO: 288923 - RNA, 22 nt, Human
gagaaguaggaauaucaggagu

SEQ ID NO: 288924 - RNA, 22 nt, Human
gagaauuauacaugagcuauuu

SEQ ID NO: 288925 - RNA, 22 nt, Human
gaaagcuuggaaacgacuuuau

SEQ ID NO: 288926 - RNA, 22 nt, Human
gaaagcauucuggaggggcaga

SEQ ID NO: 288927 - RNA, 22 nt, Human
gaaagaggcugucagggaaugg

SEQ ID NO: 288928 - RNA, 22 nt, Human
gacuggguaaagcuuauccaaa

SEQ ID NO: 288929 - RNA, 22 nt, Human
gaaaaacucagugggggucuuu

SEQ ID NO: 288930 - RNA, 22 nt, Human
gacugggacucaacccaccauu

SEQ ID NO: 288931 - RNA, 22 nt, Human
gaaaagaaggcaggagcccaag

SEQ ID NO: 288932 - RNA, 22 nt, Human
gaaaagaaaggaugguaugugu

SEQ ID NO: 288933 - RNA, 22 nt, Human
gaaaaggaggggaggcagaugg

SEQ ID NO: 288934 - RNA, 22 nt, Human
gagcagcucgagaaggaagcag

SEQ ID NO: 288935 - RNA, 22 nt, Human
gaaccuggcagcccuauaucug

SEQ ID NO: 288936 - RNA, 19 nt, Human
gaacuaaggggagcucugg

SEQ ID NO: 288937 - RNA, 22 nt, Human
gagcacugagcuggaauuggag

SEQ ID NO: 288938 - RNA, 22 nt, Human
gagcacuucagcauaaaucaca

SEQ ID NO: 288939 - RNA, 22 nt, Human
gagcaacacauugaaugaggau

SEQ ID NO: 288940 - RNA, 22 nt, Human
gaacauuucugcagaugucuga

SEQ ID NO: 288941 - RNA, 22 nt, Human
gagcagggagaggcagagaggc

SEQ ID NO: 288942 - RNA, 22 nt, Human
gagcaggcuggcagggccaggg

SEQ ID NO: 288943 - RNA, 22 nt, Human
gagcagcugagcuggaaugaga

SEQ ID NO: 288944 - RNA, 22 nt, Human
gaacuugagugugcuauuucuu

SEQ ID NO: 288945 - RNA, 22 nt, Human
gaagaggaagaggagccagagc

SEQ ID NO: 288946 - RNA, 22 nt, Human
gaagaugacaucggaucugucu

SEQ ID NO: 288947 - RNA, 22 nt, Human
gagcagucuuugaaaggcacca

SEQ ID NO: 288948 - RNA, 22 nt, Human
gagcaggucuuugguaaugcuu

SEQ ID NO: 288949 - RNA, 22 nt, Human
gaacuuaauauacaaucaguuc

SEQ ID NO: 288950 - RNA, 22 nt, Human
gaacagauucaucuaguggcua

SEQ ID NO: 288951 - RNA, 22 nt, Human
gaacaaggauucccaaagaaga

SEQ ID NO: 288952 - RNA, 20 nt, Human
gaacauaaauaacucuuuac

SEQ ID NO: 288953 - RNA, 22 nt, Human
gagagugggagauuuccagcag

SEQ ID NO: 288954 - RNA, 22 nt, Human
gagaugugguucaaggguguuu

SEQ ID NO: 288955 - RNA, 22 nt, Human
gagaucuguguuugcugaagcu

SEQ ID NO: 288956 - RNA, 22 nt, Human
gagaguuggaggguauguuagu

SEQ ID NO: 288957 - RNA, 22 nt, Human
gaaauuucuuuguuaucuuggu

SEQ ID NO: 288958 - RNA, 22 nt, Human
gagauuguggcagcagcuguuu

SEQ ID NO: 288959 - RNA, 22 nt, Human
gagaggcugagcaguccggguu

SEQ ID NO: 288960 - RNA, 22 nt, Human
gagaggcagcucaggaggucag

SEQ ID NO: 288961 - RNA, 22 nt, Human
gaaauaggcccuuacauggaaa

SEQ ID NO: 288962 - RNA, 22 nt, Human
gaaaugaaacacacaugcagcu

SEQ ID NO: 288963 - RNA, 22 nt, Human
cuugccagggacucagucaggg

SEQ ID NO: 288964 - RNA, 22 nt, Human
cuugccaguguugcagaagcuc

SEQ ID NO: 288965 - RNA, 22 nt, Human
cuugccuuugaaagcauuucuc

SEQ ID NO: 288966 - RNA, 22 nt, Human
cugccuuggcccuaguucaugg

SEQ ID NO: 288967 - RNA, 22 nt, Human
cuugcagagcccauggauguca

SEQ ID NO: 288968 - RNA, 20 nt, Human
cuugaguucagagcugucau

SEQ ID NO: 288969 - RNA, 22 nt, Human
cuugcaaugaaggcacacuuau

SEQ ID NO: 288970 - RNA, 22 nt, Human
cugccgaugcgcaguggcgccu

SEQ ID NO: 288971 - RNA, 22 nt, Human
cugcccugcagcuccacggacu

SEQ ID NO: 288972 - RNA, 22 nt, Human
cugcccgcaugcaggaaugcug

SEQ ID NO: 288973 - RNA, 22 nt, Human
cugccggcugcugcagagaggu

SEQ ID NO: 288974 - RNA, 22 nt, Human
cuucuuuuggggaugaaaaugg

SEQ ID NO: 288975 - RNA, 22 nt, Human
cugccaguaucuuuggggcugu

SEQ ID NO: 288976 - RNA, 22 nt, Human
cuucuuagugauuuaacaugua

SEQ ID NO: 288977 - RNA, 22 nt, Human
cugauuucaaauggugcuagau

SEQ ID NO: 288978 - RNA, 22 nt, Human
cuuccauucugauggcuaauua

SEQ ID NO: 288979 - RNA, 22 nt, Human
cuucccugucuacaacccugcc

SEQ ID NO: 288980 - RNA, 22 nt, Human
cuucccuaagggacuggcauag

SEQ ID NO: 288981 - RNA, 22 nt, Human
cuucaggaccugaagcccaucu

SEQ ID NO: 288982 - RNA, 22 nt, Human
cuucauccguaccacggccaca

SEQ ID NO: 288983 - RNA, 22 nt, Human
cugauguuuaucucaagaguuc

SEQ ID NO: 288984 - RNA, 19 nt, Human
cuucaguguucaccuggcc

SEQ ID NO: 288985 - RNA, 22 nt, Human
cuucuaauucuuauguaagcuu

SEQ ID NO: 288986 - RNA, 21 nt, Human
cuucgcuguuccagcucuugg

SEQ ID NO: 288987 - RNA, 22 nt, Human
cuucucuuccuucucauccuca

SEQ ID NO: 288988 - RNA, 22 nt, Human
cuuccugcaacaccuguguugc

SEQ ID NO: 288989 - RNA, 22 nt, Human
cuuccguuacugacaaaauguu

SEQ ID NO: 288990 - RNA, 22 nt, Human
cugcagauaaguguuuugaaaa

SEQ ID NO: 288991 - RNA, 21 nt, Human
cugcacugugauuuaaaaugu

SEQ ID NO: 288992 - RNA, 22 nt, Human
cugcaguguccgcuugcucagc

SEQ ID NO: 288993 - RNA, 22 nt, Human
cugcaucacagcaggaggcaca

SEQ ID NO: 288994 - RNA, 22 nt, Human
cugcaguaacuauuuucaauaa

SEQ ID NO: 288995 - RNA, 22 nt, Human
cugcuuguguugcucagaguca

SEQ ID NO: 288996 - RNA, 22 nt, Human
cugcuuuggaucucucucugcc

SEQ ID NO: 288997 - RNA, 19 nt, Human
cuuguggcuaugcagauac

SEQ ID NO: 288998 - RNA, 22 nt, Human
cuugugagaagaccuuccgcau

SEQ ID NO: 288999 - RNA, 22 nt, Human
cuggaagcgucggaggaagggc

SEQ ID NO: 289000 - RNA, 22 nt, Human
cuuguuuggccauaggugcugg

SEQ ID NO: 289001 - RNA, 22 nt, Human
cuggaaauggcagaguugcauu

SEQ ID NO: 289002 - RNA, 22 nt, Human
cuggaugagcuucgugcgcacg

SEQ ID NO: 289003 - RNA, 22 nt, Human
cuuucuuucaaguucugcuuua

SEQ ID NO: 289004 - RNA, 18 nt, Human
cuuucugcccccauuagc

SEQ ID NO: 289005 - RNA, 22 nt, Human
cuggagaagagguaguauguag

SEQ ID NO: 289006 - RNA, 22 nt, Human
cuuuacauuaauuucuacugau

SEQ ID NO: 289007 - RNA, 18 nt, Human
cuuuagcugucaucuuug

SEQ ID NO: 289008 - RNA, 22 nt, Human
cuuuaagugaaaggggauuaaa

SEQ ID NO: 289009 - RNA, 22 nt, Human
cugcggcaccaaccccuucaug

SEQ ID NO: 289010 - RNA, 22 nt, Human
cugcgcgagcacugccggcggg

SEQ ID NO: 289011 - RNA, 22 nt, Human
cugcuacgguguccgguggggc

SEQ ID NO: 289012 - RNA, 22 nt, Human
cugcucugagaggcucuuccua

SEQ ID NO: 289013 - RNA, 22 nt, Human
cuugcuguccgaugggucugua

SEQ ID NO: 289014 - RNA, 22 nt, Human
cugccuucaaaguaauauuuua

SEQ ID NO: 289015 - RNA, 22 nt, Human
cuugcugggagagcuuuagaga

SEQ ID NO: 289016 - RNA, 22 nt, Human
cuugcuuuaucugguuucucau

SEQ ID NO: 289017 - RNA, 22 nt, Human
cuuggcacccaucuuuccaccu

SEQ ID NO: 289018 - RNA, 21 nt, Human
cugcugaaggaaccccaugga

SEQ ID NO: 289019 - RNA, 22 nt, Human
cugcucuucccaucccuuaaau

SEQ ID NO: 289020 - RNA, 22 nt, Human
cuuggcauguucaucugcuugg

SEQ ID NO: 289021 - RNA, 22 nt, Human
cugcuguugagguuccaggcca

SEQ ID NO: 289022 - RNA, 22 nt, Human
cuuggggauuuuaaagaccucu

SEQ ID NO: 289023 - RNA, 22 nt, Human
cugcugugcagacagacucucu

SEQ ID NO: 289024 - RNA, 22 nt, Human
cugcugucuuuauuucacugcu

SEQ ID NO: 289025 - RNA, 22 nt, Human
cugcuggugcugcccacacggu

SEQ ID NO: 289026 - RNA, 22 nt, Human
cuuggugagcuccuggcgcagc

SEQ ID NO: 289027 - RNA, 22 nt, Human
cuuggugcgaagagucagggga

SEQ ID NO: 289028 - RNA, 22 nt, Human
cuuguaccuuuguguuuauuuu

SEQ ID NO: 289029 - RNA, 22 nt, Human
cuccugauuucuaggccuuauc

SEQ ID NO: 289030 - RNA, 22 nt, Human
cuggcuguguguuugugcaucu

SEQ ID NO: 289031 - RNA, 22 nt, Human
cuccagcagaaagggcgagugg

SEQ ID NO: 289032 - RNA, 22 nt, Human
cucccaucacaauucagggccu

SEQ ID NO: 289033 - RNA, 22 nt, Human
cuccccuuauuccucaacauga

SEQ ID NO: 289034 - RNA, 22 nt, Human
cuggccuuaucacaaagcuaga

SEQ ID NO: 289035 - RNA, 22 nt, Human
cuggggccccagcucggccccu

SEQ ID NO: 289036 - RNA, 22 nt, Human
cucggagggcaaguacuggcug

SEQ ID NO: 289037 - RNA, 22 nt, Human
cucuaccugcacaugccugacu

SEQ ID NO: 289038 - RNA, 22 nt, Human
cucuauucuaauggauucuggg

SEQ ID NO: 289039 - RNA, 22 nt, Human
cucuauuuuuucaucuuucagg

SEQ ID NO: 289040 - RNA, 22 nt, Human
cuccuuugagcaaaucuuugau

SEQ ID NO: 289041 - RNA, 22 nt, Human
cuccuggagcagcaggcgcagg

SEQ ID NO: 289042 - RNA, 22 nt, Human
cuccuuaaagggagcagcagcu

SEQ ID NO: 289043 - RNA, 22 nt, Human
cuccuuuuuauaucuuucucug

SEQ ID NO: 289044 - RNA, 22 nt, Human
cucgccugacucggaugggcug

SEQ ID NO: 289045 - RNA, 22 nt, Human
cuggaaagauuuacacggggaa

SEQ ID NO: 289046 - RNA, 22 nt, Human
cugacugauuuugcuuuuuaau

SEQ ID NO: 289047 - RNA, 22 nt, Human
cugaccugugagcuaugccggc

SEQ ID NO: 289048 - RNA, 22 nt, Human
cucaagugacucagccugguug

SEQ ID NO: 289049 - RNA, 22 nt, Human
cuggagaacagagcuguuuaga

SEQ ID NO: 289050 - RNA, 22 nt, Human
cuggagaacucugugcuucacu

SEQ ID NO: 289051 - RNA, 22 nt, Human
cuggagcucugggcaucucagg

SEQ ID NO: 289052 - RNA, 22 nt, Human
cuggaugucugggaggcuuccc

SEQ ID NO: 289053 - RNA, 22 nt, Human
cuggauagaggaugguaggcac

SEQ ID NO: 289054 - RNA, 22 nt, Human
cuggcccugucagcacagaauc

SEQ ID NO: 289055 - RNA, 22 nt, Human
cuggccugugggcugucuccgg

SEQ ID NO: 289056 - RNA, 22 nt, Human
cuggccagccucccagguaccc

SEQ ID NO: 289057 - RNA, 22 nt, Human
cuggccaggugggggguagugg

SEQ ID NO: 289058 - RNA, 22 nt, Human
cuggcaguguccagcucgugau

SEQ ID NO: 289059 - RNA, 22 nt, Human
cuggauuaaacaguuugauacu

SEQ ID NO: 289060 - RNA, 22 nt, Human
cugagguccucagagggaaagg

SEQ ID NO: 289061 - RNA, 22 nt, Human
cugauagagcauuagugugaga

SEQ ID NO: 289062 - RNA, 22 nt, Human
cuucacuccuggagugaguuuc

SEQ ID NO: 289063 - RNA, 22 nt, Human
cuucacuaccuacacugccgcu

SEQ ID NO: 289064 - RNA, 22 nt, Human
cugagcuauauauuaugcauag

SEQ ID NO: 289065 - RNA, 22 nt, Human
cugagcggugagggcauacagc

SEQ ID NO: 289066 - RNA, 22 nt, Human
cugacugaggaucaguucauca

SEQ ID NO: 289067 - RNA, 22 nt, Human
cugagaaauacccaagucuggu

SEQ ID NO: 289068 - RNA, 22 nt, Human
cuuaggcgugugcgggugaggc

SEQ ID NO: 289069 - RNA, 22 nt, Human
cuguguuaggaucuugcuggca

SEQ ID NO: 289070 - RNA, 22 nt, Human
cugaaggacacgugaggagcca

SEQ ID NO: 289071 - RNA, 22 nt, Human
cugacacagccauuguccuugu

SEQ ID NO: 289072 - RNA, 20 nt, Human
cugaauaccacagagccauc

SEQ ID NO: 289073 - RNA, 22 nt, Human
cugaauucuuguugucggagca

SEQ ID NO: 289074 - RNA, 22 nt, Human
cugaccucuaaguaacagagaa

SEQ ID NO: 289075 - RNA, 22 nt, Human
cucuucugugggugcuauguca

SEQ ID NO: 289076 - RNA, 19 nt, Human
cucuucauuggaggguuga

SEQ ID NO: 289077 - RNA, 22 nt, Human
cucuguauauugagugcuuacu

SEQ ID NO: 289078 - RNA, 22 nt, Human
cugugguuuuauuuauuugaag

SEQ ID NO: 289079 - RNA, 22 nt, Human
cuguggcuaggaagcuguggga

SEQ ID NO: 289080 - RNA, 22 nt, Human
cuguggcugcgcccugggggag

SEQ ID NO: 289081 - RNA, 22 nt, Human
cuguggaaugcaguugcgagca

SEQ ID NO: 289082 - RNA, 22 nt, Human
cucugagcucgugcaguacuuc

SEQ ID NO: 289083 - RNA, 22 nt, Human
cucugauuuuucuaauacuuca

SEQ ID NO: 289084 - RNA, 22 nt, Human
cucucuccuuuuugauauuuag

SEQ ID NO: 289085 - RNA, 22 nt, Human
cucuccaguuauagcugauuug

SEQ ID NO: 289086 - RNA, 22 nt, Human
cucuggggaagugcacucgcug

SEQ ID NO: 289087 - RNA, 19 nt, Human
cucuggcuccugggcugcc

SEQ ID NO: 289088 - RNA, 22 nt, Human
cucugguuucgcaggaaauaga

SEQ ID NO: 289089 - RNA, 22 nt, Human
cucuggcaacgauggugcuuau

SEQ ID NO: 289090 - RNA, 22 nt, Human
cuguagaugucagguuaaugag

SEQ ID NO: 289091 - RNA, 22 nt, Human
cagcuuauggcuucuccaguag

SEQ ID NO: 289092 - RNA, 22 nt, Human
caggggcuccaggugagccugg

SEQ ID NO: 289093 - RNA, 22 nt, Human
caggggaagccagcugccaugu

SEQ ID NO: 289094 - RNA, 22 nt, Human
cagggccagggcuauggugaag

SEQ ID NO: 289095 - RNA, 22 nt, Human
cagguaguuagaaugaccagga

SEQ ID NO: 289096 - RNA, 22 nt, Human
caggggcuuuccuguuuaugga

SEQ ID NO: 289097 - RNA, 22 nt, Human
caggguaguaauuuaauacaag

SEQ ID NO: 289098 - RNA, 22 nt, Human
caggguaagagagagugacauu

SEQ ID NO: 289099 - RNA, 22 nt, Human
cagggguaccuggguuaccugu

SEQ ID NO: 289100 - RNA, 22 nt, Human
caggcagggagcuggaaaggau

SEQ ID NO: 289101 - RNA, 22 nt, Human
caggcagagagggcagugugga

SEQ ID NO: 289102 - RNA, 21 nt, Human
caggccaaaagguucaacauu

SEQ ID NO: 289103 - RNA, 22 nt, Human
caggcagggcugccuucugcuu

SEQ ID NO: 289104 - RNA, 22 nt, Human
cagcucuccacccuccugguuc

SEQ ID NO: 289105 - RNA, 22 nt, Human
caggagaaauucacauuaguga

SEQ ID NO: 289106 - RNA, 22 nt, Human
cagcuauuguucuguauaauga

SEQ ID NO: 289107 - RNA, 22 nt, Human
cagcacugcccuaccccuccac

SEQ ID NO: 289108 - RNA, 22 nt, Human
cagauuuagcacugauaggacu

SEQ ID NO: 289109 - RNA, 22 nt, Human
cagaugccauagguauaguaua

SEQ ID NO: 289110 - RNA, 22 nt, Human
cagauggagaaagagugaaugg

SEQ ID NO: 289111 - RNA, 22 nt, Human
cagcuggggagagacauggcag

SEQ ID NO: 289112 - RNA, 21 nt, Human
cagcagaugccagggucucug

SEQ ID NO: 289113 - RNA, 21 nt, Human
cagcagaaaugagaggagaaa

SEQ ID NO: 289114 - RNA, 22 nt, Human
cagcagaggagguggcagcacc

SEQ ID NO: 289115 - RNA, 22 nt, Human
cagcuucaugacaaacaguuuu

SEQ ID NO: 289116 - RNA, 22 nt, Human
cagcauugagcacagaaggaaa

SEQ ID NO: 289117 - RNA, 22 nt, Human
cagccauucuaacacugccagu

SEQ ID NO: 289118 - RNA, 22 nt, Human
cagccagaucgccuuccgccuc

SEQ ID NO: 289119 - RNA, 22 nt, Human
cagcuuaccucccacagcucuc

SEQ ID NO: 289120 - RNA, 22 nt, Human
cagcccuguugcgcuuccggcg

SEQ ID NO: 289121 - RNA, 22 nt, Human
cagcccuggccucuucgcuuuc

SEQ ID NO: 289122 - RNA, 22 nt, Human
cagccuacaucagaauaccaau

SEQ ID NO: 289123 - RNA, 22 nt, Human
caggaagagaacugcucagccu

SEQ ID NO: 289124 - RNA, 22 nt, Human
cagacugagaaagugccacagg

SEQ ID NO: 289125 - RNA, 22 nt, Human
cagcccaggcucagauguuggg

SEQ ID NO: 289126 - RNA, 19 nt, Human
cagagacuguaacacuuuu

SEQ ID NO: 289127 - RNA, 20 nt, Human
cagagacaagagggaaggga

SEQ ID NO: 289128 - RNA, 22 nt, Human
cagagaagaggucuugaccccu

SEQ ID NO: 289129 - RNA, 22 nt, Human
cagacagagucuucccaucagu

SEQ ID NO: 289130 - RNA, 20 nt, Human
cagcagucagcucuccaaug

SEQ ID NO: 289131 - RNA, 22 nt, Human
cagaguaaugugauuuccaugu

SEQ ID NO: 289132 - RNA, 22 nt, Human
cagagguagaaguagauguuug

SEQ ID NO: 289133 - RNA, 22 nt, Human
cagcccaucaaggggauccuga

SEQ ID NO: 289134 - RNA, 22 nt, Human
cagaggauggaaaugagaacaa

SEQ ID NO: 289135 - RNA, 22 nt, Human
cagaggcugggugggguggggg

SEQ ID NO: 289136 - RNA, 22 nt, Human
cagaggcugagcugcgggauga

SEQ ID NO: 289137 - RNA, 22 nt, Human
cagcucuggcuauugaggacca

SEQ ID NO: 289138 - RNA, 22 nt, Human
cagcucugcugggaggaugcag

SEQ ID NO: 289139 - RNA, 22 nt, Human
cagaucacauccauccgucacc

SEQ ID NO: 289140 - RNA, 22 nt, Human
cagagcagaaaccugggugauu

SEQ ID NO: 289141 - RNA, 22 nt, Human
cagagaugaggcuggcgugguu

SEQ ID NO: 289142 - RNA, 22 nt, Human
cagagcugagucuucaagguug

SEQ ID NO: 289143 - RNA, 22 nt, Human
cacaauuuccauugagcagcag

SEQ ID NO: 289144 - RNA, 22 nt, Human
cacacacacacacacucucaca

SEQ ID NO: 289145 - RNA, 22 nt, Human
caauuaccaguaauugagguuu

SEQ ID NO: 289146 - RNA, 22 nt, Human
cagauaagcuauaaguaguacc

SEQ ID NO: 289147 - RNA, 22 nt, Human
cagauagccugguccuaacaug

SEQ ID NO: 289148 - RNA, 22 nt, Human
cacuugauugucagaaaaaugg

SEQ ID NO: 289149 - RNA, 22 nt, Human
cagagggagcuaaccagcagcc

SEQ ID NO: 289150 - RNA, 22 nt, Human
cagaggaugucuacaccuugag

SEQ ID NO: 289151 - RNA, 22 nt, Human
cagaggagcgaguuggacgcca

SEQ ID NO: 289152 - RNA, 22 nt, Human
cagauuuaauaaaaaaugcauc

SEQ ID NO: 289153 - RNA, 22 nt, Human
cacuuguuaaaugccaauggca

SEQ ID NO: 289154 - RNA, 22 nt, Human
cagggcagaguuaagaugcugg

SEQ ID NO: 289155 - RNA, 22 nt, Human
cagggagguuggauuggggccu

SEQ ID NO: 289156 - RNA, 22 nt, Human
cagggccaggccucaggggcgc

SEQ ID NO: 289157 - RNA, 22 nt, Human
cagggcaucucugaaucuucac

SEQ ID NO: 289158 - RNA, 22 nt, Human
cagggagcggggagaucucggg

SEQ ID NO: 289159 - RNA, 22 nt, Human
caggccgccacugcagcagcug

SEQ ID NO: 289160 - RNA, 22 nt, Human
cagugcuggaggggugcuugca

SEQ ID NO: 289161 - RNA, 22 nt, Human
caggcaggagaaaaggcgcggg

SEQ ID NO: 289162 - RNA, 22 nt, Human
caggccagcuggaggggcagcu

SEQ ID NO: 289163 - RNA, 22 nt, Human
cagucaaauuugaaaacuuuga

SEQ ID NO: 289164 - RNA, 22 nt, Human
caguauguuuauuagaacugca

SEQ ID NO: 289165 - RNA, 22 nt, Human
caggcacagcuaagacuggcca

SEQ ID NO: 289166 - RNA, 22 nt, Human
caguacugucuuccugauggca

SEQ ID NO: 289167 - RNA, 22 nt, Human
caguaguucucauaacucauga

SEQ ID NO: 289168 - RNA, 22 nt, Human
cagguuuuuauuacaacuuuga

SEQ ID NO: 289169 - RNA, 22 nt, Human
cagguauuugaaggcaguggga

SEQ ID NO: 289170 - RNA, 22 nt, Human
caggucauaacuaugcaugaac

SEQ ID NO: 289171 - RNA, 22 nt, Human
cagguugaagagguuaacgaua

SEQ ID NO: 289172 - RNA, 22 nt, Human
caggucagcacuuggaggugca

SEQ ID NO: 289173 - RNA, 22 nt, Human
cagguugucuaauuccaagggg

SEQ ID NO: 289174 - RNA, 22 nt, Human
cagggggcagcguagaaaauga

SEQ ID NO: 289175 - RNA, 22 nt, Human
cagggggacuuguuagguuuua

SEQ ID NO: 289176 - RNA, 22 nt, Human
cagggugaagaugcgccuccug

SEQ ID NO: 289177 - RNA, 22 nt, Human
caucgagaauuggcagcuaaag

SEQ ID NO: 289178 - RNA, 22 nt, Human
cauccagggguacccuggagcc

SEQ ID NO: 289179 - RNA, 22 nt, Human
caguaucucuaaaauuacucuu

SEQ ID NO: 289180 - RNA, 22 nt, Human
caguaugagcacagugccugga

SEQ ID NO: 289181 - RNA, 22 nt, Human
caguaucucccauucacagugu

SEQ ID NO: 289182 - RNA, 22 nt, Human
caucauuuggcuuuagggccug

SEQ ID NO: 289183 - RNA, 22 nt, Human
caucaaaugcaagagcguucuu

SEQ ID NO: 289184 - RNA, 23 nt, Human
cauauucagaaacaccuaguggu

SEQ ID NO: 289185 - RNA, 22 nt, Human
cagguuguugacugcauauagg

SEQ ID NO: 289186 - RNA, 20 nt, Human
cagguugcugcccccgccuc

SEQ ID NO: 289187 - RNA, 22 nt, Human
caguagcuuuuugcagacaaga

SEQ ID NO: 289188 - RNA, 22 nt, Human
cauacauguuagcaguagccuu

SEQ ID NO: 289189 - RNA, 22 nt, Human
cauaccuugguaagagugauca

SEQ ID NO: 289190 - RNA, 22 nt, Human
cauaauuggugcuuauuaaaug

SEQ ID NO: 289191 - RNA, 22 nt, Human
cauaggcucuucagagaacuga

SEQ ID NO: 289192 - RNA, 22 nt, Human
caugguaaucggggccaucugu

SEQ ID NO: 289193 - RNA, 22 nt, Human
caugguacugccacagaagagu

SEQ ID NO: 289194 - RNA, 22 nt, Human
cauguauguuaguggcugcuuu

SEQ ID NO: 289195 - RNA, 21 nt, Human
caugguaaguacaaagaugac

SEQ ID NO: 289196 - RNA, 22 nt, Human
caguuuuggaagaaacaaggaa

SEQ ID NO: 289197 - RNA, 22 nt, Human
caguuuuauacacugcagcucc

SEQ ID NO: 289198 - RNA, 22 nt, Human
caugcagcagaauaaugacuau

SEQ ID NO: 289199 - RNA, 21 nt, Human
caguucuaagugucaucuuuu

SEQ ID NO: 289200 - RNA, 22 nt, Human
caguguugcuaaugaauucauu

SEQ ID NO: 289201 - RNA, 22 nt, Human
caguugcagagugauguguuug

SEQ ID NO: 289202 - RNA, 21 nt, Human
caguuugcuauuuuaguauga

SEQ ID NO: 289203 - RNA, 22 nt, Human
caugcagauugccaggcucccu

SEQ ID NO: 289204 - RNA, 22 nt, Human
cauaaauuuuaccuuguaagug

SEQ ID NO: 289205 - RNA, 22 nt, Human
cauaagaauauuuaguggcagc

SEQ ID NO: 289206 - RNA, 22 nt, Human
cauggcacuuuugugucuaaau

SEQ ID NO: 289207 - RNA, 22 nt, Human
caugaugacagcauuccuuuua

SEQ ID NO: 289208 - RNA, 22 nt, Human
caugaugaacugugcuguuagg

SEQ ID NO: 289209 - RNA, 22 nt, Human
caguucaagauuguugcuuucu

SEQ ID NO: 289210 - RNA, 22 nt, Human
caugaccauuuggguuugugcg

SEQ ID NO: 289211 - RNA, 17 nt, Human
cagugcuguuuuagaaa

SEQ ID NO: 289212 - RNA, 22 nt, Human
caguggaugucucauaguguga

SEQ ID NO: 289213 - RNA, 22 nt, Human
cagucugcuggcuuuuucagca

SEQ ID NO: 289214 - RNA, 20 nt, Human
cagugcccguggaaaagaug

SEQ ID NO: 289215 - RNA, 22 nt, Human
cagugcaacguugugcauucaa

SEQ ID NO: 289216 - RNA, 22 nt, Human
caucagucugaaagccagggag

SEQ ID NO: 289217 - RNA, 22 nt, Human
caguccaugaugacuuuugcuc

SEQ ID NO: 289218 - RNA, 22 nt, Human
cauccuauuacugaggcucccc

SEQ ID NO: 289219 - RNA, 22 nt, Human
caucuaaaauaagccuuauaau

SEQ ID NO: 289220 - RNA, 22 nt, Human
caugagaguaaccuagagaaga

SEQ ID NO: 289221 - RNA, 22 nt, Human
caugaacucucggguuuggaau

SEQ ID NO: 289222 - RNA, 22 nt, Human
caucugcagccucugcauuccc

SEQ ID NO: 289223 - RNA, 22 nt, Human
caucucagguuuguucugagac

SEQ ID NO: 289224 - RNA, 22 nt, Human
auuucauaaaaacuuuaccuga

SEQ ID NO: 289225 - RNA, 22 nt, Human
auuuccacaaauuaagauugca

SEQ ID NO: 289226 - RNA, 22 nt, Human
auuucccugcagugcuuaggaa

SEQ ID NO: 289227 - RNA, 19 nt, Human
auuuccuggcauauaucac

SEQ ID NO: 289228 - RNA, 22 nt, Human
auuuauuuucccucaaguaccu

SEQ ID NO: 289229 - RNA, 22 nt, Human
auuuggaaggcguuucucugua

SEQ ID NO: 289230 - RNA, 22 nt, Human
auuuaaaaacugguacaacagg

SEQ ID NO: 289231 - RNA, 22 nt, Human
auuucuguaauucugaggagug

SEQ ID NO: 289232 - RNA, 22 nt, Human
auuugcuuguucaccaguacuu

SEQ ID NO: 289233 - RNA, 22 nt, Human
auuuggaaacaugcugaccaug

SEQ ID NO: 289234 - RNA, 22 nt, Human
auuuauuugaagagccauugca

SEQ ID NO: 289235 - RNA, 22 nt, Human
auuuaaagaguaauacaaucca

SEQ ID NO: 289236 - RNA, 22 nt, Human
auuuaaaggaagugggugauaa

SEQ ID NO: 289237 - RNA, 22 nt, Human
auuucaacagaguuugaaggca

SEQ ID NO: 289238 - RNA, 22 nt, Human
auuucagaaugaaaggaaaaau

SEQ ID NO: 289239 - RNA, 22 nt, Human
auuucacucuuaauugcuuccu

SEQ ID NO: 289240 - RNA, 22 nt, Human
auuuaagugagucuuuaaaaua

SEQ ID NO: 289241 - RNA, 22 nt, Human
auuuauccuugggguagagcca

SEQ ID NO: 289242 - RNA, 22 nt, Human
auugaguacuugcugggcucuc

SEQ ID NO: 289243 - RNA, 22 nt, Human
auugagcuguugaagucccaca

SEQ ID NO: 289244 - RNA, 22 nt, Human
auuuauauauuuuguucuggua

SEQ ID NO: 289245 - RNA, 22 nt, Human
auugacuucccaucaggugagu

SEQ ID NO: 289246 - RNA, 17 nt, Human
auuguuuuuaauuugca

SEQ ID NO: 289247 - RNA, 22 nt, Human
auuguuuugugaaacauaguga

SEQ ID NO: 289248 - RNA, 22 nt, Human
auugaaauuaauuucugcuuuc

SEQ ID NO: 289249 - RNA, 22 nt, Human
auucuuuauuuucuguacuugc

SEQ ID NO: 289250 - RNA, 19 nt, Human
auugguuugcucgggaaug

SEQ ID NO: 289251 - RNA, 22 nt, Human
auuagguaguauaaucuuuguu

SEQ ID NO: 289252 - RNA, 22 nt, Human
auuagcaccccuggauguggga

SEQ ID NO: 289253 - RNA, 22 nt, Human
auuagaagagcuuuuuacucuu

SEQ ID NO: 289254 - RNA, 22 nt, Human
auuacagauuauaaauuugagc

SEQ ID NO: 289255 - RNA, 22 nt, Human
auuagaaaugacaugugggaau

SEQ ID NO: 289256 - RNA, 20 nt, Human
auuaauuuuuagggcucacc

SEQ ID NO: 289257 - RNA, 18 nt, Human
auuuguggggguuauaga

SEQ ID NO: 289258 - RNA, 22 nt, Human
auuuggucuguaauuacaugga

SEQ ID NO: 289259 - RNA, 21 nt, Human
auuuguggugcaauuguggua

SEQ ID NO: 289260 - RNA, 22 nt, Human
auuuuaccauuaguuuguaaua

SEQ ID NO: 289261 - RNA, 22 nt, Human
auuucauuuuagaaauaagugu

SEQ ID NO: 289262 - RNA, 22 nt, Human
auuuuacuaugauaguugagaa

SEQ ID NO: 289263 - RNA, 22 nt, Human
auuugacuugguaagacuuaag

SEQ ID NO: 289264 - RNA, 22 nt, Human
auuugcaucagugagcgaugug

SEQ ID NO: 289265 - RNA, 23 nt, Human
auuugcugaucguagaugacuag

SEQ ID NO: 289266 - RNA, 22 nt, Human
auuuggggacagagugggggua

SEQ ID NO: 289267 - RNA, 22 nt, Human
auuuuuuuaggcugucagccgc

SEQ ID NO: 289268 - RNA, 22 nt, Human
auuuucauauggguuauuugua

SEQ ID NO: 289269 - RNA, 22 nt, Human
auuuucuucauuuugauuguau

SEQ ID NO: 289270 - RNA, 22 nt, Human
auuuuugguuauaaaauaguuu

SEQ ID NO: 289271 - RNA, 22 nt, Human
auuuuugguuucaccugcacgc

SEQ ID NO: 289272 - RNA, 22 nt, Human
auuuucuugucucuguuguagg

SEQ ID NO: 289273 - RNA, 22 nt, Human
caaagaugccaaaaggaagaca

SEQ ID NO: 289274 - RNA, 22 nt, Human
caaagagaugcaccauauuucu

SEQ ID NO: 289275 - RNA, 22 nt, Human
auuuugcaguuuauugccaauc

SEQ ID NO: 289276 - RNA, 22 nt, Human
caacuucuauucagucugcagu

SEQ ID NO: 289277 - RNA, 20 nt, Human
caacacugcccauuguuugc

SEQ ID NO: 289278 - RNA, 21 nt, Human
auuuuucagaaggaugugaua

SEQ ID NO: 289279 - RNA, 23 nt, Human
auuuuuccacacacagacucagu

SEQ ID NO: 289280 - RNA, 22 nt, Human
auuuuucacauuuugggggaca

SEQ ID NO: 289281 - RNA, 22 nt, Human
auuuuuauuugccuaugauaua

SEQ ID NO: 289282 - RNA, 22 nt, Human
auuuuucucucaugugcaacua

SEQ ID NO: 289283 - RNA, 22 nt, Human
caacaagcgcucagagcaaagc

SEQ ID NO: 289284 - RNA, 22 nt, Human
caaccaguagcugaguucaaaa

SEQ ID NO: 289285 - RNA, 22 nt, Human
caacguggauucuuccaggggc

SEQ ID NO: 289286 - RNA, 22 nt, Human
caaccucuaucggucaggaagc

SEQ ID NO: 289287 - RNA, 17 nt, Human
caaccaggaaaggaggg

SEQ ID NO: 289288 - RNA, 22 nt, Human
caacacaucaguucagucuuga

SEQ ID NO: 289289 - RNA, 22 nt, Human
caacaaguugauuucacgcugc

SEQ ID NO: 289290 - RNA, 22 nt, Human
caauugcuuccuucuguaagua

SEQ ID NO: 289291 - RNA, 22 nt, Human
caauguuuuuccuuccuuaaua

SEQ ID NO: 289292 - RNA, 22 nt, Human
cacaacaaaaaauaaguaugag

SEQ ID NO: 289293 - RNA, 22 nt, Human
caauagcuauguaaccugaaga

SEQ ID NO: 289294 - RNA, 22 nt, Human
caaauacguuuggcuggagcac

SEQ ID NO: 289295 - RNA, 22 nt, Human
caaaguauuuagcugacucgcu

SEQ ID NO: 289296 - RNA, 22 nt, Human
caaugaaaauuuaaguugcagc

SEQ ID NO: 289297 - RNA, 22 nt, Human
caaauuuuuauuuaccaucugc

SEQ ID NO: 289298 - RNA, 22 nt, Human
caaauggggaauagaugauggg

SEQ ID NO: 289299 - RNA, 22 nt, Human
caaaucuguuaauuucaaguug

SEQ ID NO: 289300 - RNA, 22 nt, Human
caaugggagaugcagaacagcu

SEQ ID NO: 289301 - RNA, 22 nt, Human
caauggaguccucuuccucuuu

SEQ ID NO: 289302 - RNA, 22 nt, Human
caaggucagacagccaggacag

SEQ ID NO: 289303 - RNA, 22 nt, Human
caagguuucgaguucccaacca

SEQ ID NO: 289304 - RNA, 22 nt, Human
caaguauuuauugaggcccugu

SEQ ID NO: 289305 - RNA, 22 nt, Human
caaguaugagaaagcuauuacc

SEQ ID NO: 289306 - RNA, 22 nt, Human
caaggguguacagauaugagag

SEQ ID NO: 289307 - RNA, 22 nt, Human
caaggcuaagcuuuggcuuucu

SEQ ID NO: 289308 - RNA, 22 nt, Human
caaggaguuuggggaccaagga

SEQ ID NO: 289309 - RNA, 22 nt, Human
caaggaagguugguugaaggua

SEQ ID NO: 289310 - RNA, 22 nt, Human
caaagccuggggagaguaagga

SEQ ID NO: 289311 - RNA, 22 nt, Human
caauaccucuuggugauugggc

SEQ ID NO: 289312 - RNA, 22 nt, Human
caagugaguauguauuguguag

SEQ ID NO: 289313 - RNA, 22 nt, Human
caagagcgugugcagggcaagu

SEQ ID NO: 289314 - RNA, 22 nt, Human
caaguugcaugugcuugaaaua

SEQ ID NO: 289315 - RNA, 22 nt, Human
caaaguaggcuaagaccuucca

SEQ ID NO: 289316 - RNA, 22 nt, Human
caaaggagcccuuugccggguu

SEQ ID NO: 289317 - RNA, 22 nt, Human
caaagcuucaucuguuguuuug

SEQ ID NO: 289318 - RNA, 22 nt, Human
caaagaaccuucgagacagggc

SEQ ID NO: 289319 - RNA, 22 nt, Human
caagaugcaagaccagucaggc

SEQ ID NO: 289320 - RNA, 22 nt, Human
caaagaagagauuuacagagcu

SEQ ID NO: 289321 - RNA, 22 nt, Human
caaggaaaugucagaaaggcaa

SEQ ID NO: 289322 - RNA, 22 nt, Human
caagauauguccuguuacuaag

SEQ ID NO: 289323 - RNA, 22 nt, Human
caaaacauucagagagcucacu

SEQ ID NO: 289324 - RNA, 22 nt, Human
caccacauguccgaaauucagc

SEQ ID NO: 289325 - RNA, 22 nt, Human
caagguugugacccaaugacca

SEQ ID NO: 289326 - RNA, 22 nt, Human
caccagcgacugugaccagcaa

SEQ ID NO: 289327 - RNA, 22 nt, Human
caccaccaguaccaucacacgc

SEQ ID NO: 289328 - RNA, 22 nt, Human
caaggaaaacagaugaucaaca

SEQ ID NO: 289329 - RNA, 22 nt, Human
cacauugguagaauuuagaaga

SEQ ID NO: 289330 - RNA, 23 nt, Human
caccaugacaugccuauagggga

SEQ ID NO: 289331 - RNA, 22 nt, Human
caauaguaaucaaugcaguuag

SEQ ID NO: 289332 - RNA, 22 nt, Human
caauaauugcuuuccagaguua

SEQ ID NO: 289333 - RNA, 22 nt, Human
caccuggaggcagcaccgggcu

SEQ ID NO: 289334 - RNA, 22 nt, Human
caccucagagcuccuucuucuc

SEQ ID NO: 289335 - RNA, 22 nt, Human
cacccugacuggcccugcagga

SEQ ID NO: 289336 - RNA, 22 nt, Human
cacccgacugaggacgccgccc

SEQ ID NO: 289337 - RNA, 22 nt, Human
caccgagagccacuuccggaac

SEQ ID NO: 289338 - RNA, 22 nt, Human
caagagguaugagccgggauga

SEQ ID NO: 289339 - RNA, 22 nt, Human
caagagcuuuagaaaugcucau

SEQ ID NO: 289340 - RNA, 17 nt, Human
cacauggagcuuguugc

SEQ ID NO: 289341 - RNA, 22 nt, Human
caagccacugggagcugcacac

SEQ ID NO: 289342 - RNA, 22 nt, Human
caagcgcgccgcuuccuuccgc

SEQ ID NO: 289343 - RNA, 22 nt, Human
cacacguuuagcuucuggcggc

SEQ ID NO: 289344 - RNA, 22 nt, Human
cacagaauuaagggagaaauau

SEQ ID NO: 289345 - RNA, 22 nt, Human
cacacguuucuacugcugccaa

SEQ ID NO: 289346 - RNA, 22 nt, Human
cacacagguaagccucuuucaa

SEQ ID NO: 289347 - RNA, 18 nt, Human
cacagcauccaaguuaug

SEQ ID NO: 289348 - RNA, 22 nt, Human
caacuucugcuuucuuccuugc

SEQ ID NO: 289349 - RNA, 22 nt, Human
cacagccaagacuuggccccau

SEQ ID NO: 289350 - RNA, 22 nt, Human
cacagauaaggcuuugucccca

SEQ ID NO: 289351 - RNA, 19 nt, Human
cacagcccucacuuuuagc

SEQ ID NO: 289352 - RNA, 19 nt, Human
caagagcaaagucuuauga

SEQ ID NO: 289353 - RNA, 22 nt, Human
caagaaguugacagccagguga

SEQ ID NO: 289354 - RNA, 22 nt, Human
caagaaaaaacaugaugagugu

SEQ ID NO: 289355 - RNA, 22 nt, Human
augcagagacugugggaaagca

SEQ ID NO: 289356 - RNA, 22 nt, Human
augccugggcuuuaggguucuc

SEQ ID NO: 289357 - RNA, 22 nt, Human
augcgcugugcacacucuuaac

SEQ ID NO: 289358 - RNA, 22 nt, Human
augcugacaacaaagaaggaag

SEQ ID NO: 289359 - RNA, 22 nt, Human
augcuaaucaaacuuucugcag

SEQ ID NO: 289360 - RNA, 22 nt, Human
augaugauuauucauuuucugu

SEQ ID NO: 289361 - RNA, 22 nt, Human
augaucacagugucagucauua

SEQ ID NO: 289362 - RNA, 22 nt, Human
augcagauguagauucugaaau

SEQ ID NO: 289363 - RNA, 22 nt, Human
augcagcggucagaggaacuca

SEQ ID NO: 289364 - RNA, 22 nt, Human
augccgggguggcuccagcacc

SEQ ID NO: 289365 - RNA, 22 nt, Human
augccugcugucaggaacucuu

SEQ ID NO: 289366 - RNA, 19 nt, Human
augcaauguuaucaauaac

SEQ ID NO: 289367 - RNA, 22 nt, Human
augcccagaacccccuggaugg

SEQ ID NO: 289368 - RNA, 23 nt, Human
augcaacauugccaguaugggca

SEQ ID NO: 289369 - RNA, 22 nt, Human
augcuacauuuugguuuauaaa

SEQ ID NO: 289370 - RNA, 22 nt, Human
augcucggcuuucuuucuuucu

SEQ ID NO: 289371 - RNA, 22 nt, Human
augcucuuaauugcuagauaag

SEQ ID NO: 289372 - RNA, 18 nt, Human
augcugacacaaugugga

SEQ ID NO: 289373 - RNA, 22 nt, Human
augcugcuuguccauuuauuug

SEQ ID NO: 289374 - RNA, 22 nt, Human
auggccuguuuccucugaaaga

SEQ ID NO: 289375 - RNA, 22 nt, Human
augcuugaaaguuauuucauuu

SEQ ID NO: 289376 - RNA, 22 nt, Human
augcugugccuggaaagcggcu

SEQ ID NO: 289377 - RNA, 22 nt, Human
augcuugcccauguuucugaag

SEQ ID NO: 289378 - RNA, 22 nt, Human
augcggcugugggggaauggga

SEQ ID NO: 289379 - RNA, 21 nt, Human
augcgcgguggagugagcgaa

SEQ ID NO: 289380 - RNA, 22 nt, Human
augccucuugagagccagugcu

SEQ ID NO: 289381 - RNA, 22 nt, Human
augcaggcuaagaguaaagacg

SEQ ID NO: 289382 - RNA, 22 nt, Human
augcaguuagguaauagucuca

SEQ ID NO: 289383 - RNA, 22 nt, Human
augcugcuccuuuucaggcauu

SEQ ID NO: 289384 - RNA, 22 nt, Human
augaagugcccugggggccaga

SEQ ID NO: 289385 - RNA, 22 nt, Human
augaagguggacagauuuuuuu

SEQ ID NO: 289386 - RNA, 22 nt, Human
augaaggauagggcaaaauuuu

SEQ ID NO: 289387 - RNA, 22 nt, Human
augaucaagaauuuuguauucc

SEQ ID NO: 289388 - RNA, 22 nt, Human
augauaucuuguuuuucaugca

SEQ ID NO: 289389 - RNA, 22 nt, Human
augaugaugguuuaacuucagg

SEQ ID NO: 289390 - RNA, 22 nt, Human
augaauuugaacaccagguugg

SEQ ID NO: 289391 - RNA, 22 nt, Human
augauggagaacaaagaaaauc

SEQ ID NO: 289392 - RNA, 22 nt, Human
augauguuggaauuuuaacuua

SEQ ID NO: 289393 - RNA, 22 nt, Human
augauuaagguacgucauuucu

SEQ ID NO: 289394 - RNA, 22 nt, Human
augcacuugacucuauuccaca

SEQ ID NO: 289395 - RNA, 22 nt, Human
augcagaaucucuuuccugagg

SEQ ID NO: 289396 - RNA, 19 nt, Human
augcacgugaaaugcauuu

SEQ ID NO: 289397 - RNA, 22 nt, Human
augauaccacucaauagggcau

SEQ ID NO: 289398 - RNA, 22 nt, Human
augcacuacuagaugcaaaagu

SEQ ID NO: 289399 - RNA, 22 nt, Human
augagcuaagcagaaagcacac

SEQ ID NO: 289400 - RNA, 22 nt, Human
augacugaugcugacucauggg

SEQ ID NO: 289401 - RNA, 22 nt, Human
augacuauaaauaggagauugu

SEQ ID NO: 289402 - RNA, 22 nt, Human
aucuucaggggcaauggagaua

SEQ ID NO: 289403 - RNA, 22 nt, Human
aucuucaaagcacaucguuugu

SEQ ID NO: 289404 - RNA, 22 nt, Human
aucugggaaggggaaaaugcug

SEQ ID NO: 289405 - RNA, 20 nt, Human
aucugguggggaauaacuuc

SEQ ID NO: 289406 - RNA, 22 nt, Human
aucugucagaccuuggucacag

SEQ ID NO: 289407 - RNA, 22 nt, Human
augagcucuaaguacaugccca

SEQ ID NO: 289408 - RNA, 22 nt, Human
aucuucucucucaucaggauca

SEQ ID NO: 289409 - RNA, 22 nt, Human
augagaaauaauuguguacuga

SEQ ID NO: 289410 - RNA, 22 nt, Human
augaaacucuagcuuucagcac

SEQ ID NO: 289411 - RNA, 22 nt, Human
aucucaaagauaugcugguaaa

SEQ ID NO: 289412 - RNA, 22 nt, Human
aucuagucccugcccuugaaga

SEQ ID NO: 289413 - RNA, 22 nt, Human
aucuagguuuggaagauagagu

SEQ ID NO: 289414 - RNA, 22 nt, Human
aucuacuaagugccaagcacag

SEQ ID NO: 289415 - RNA, 22 nt, Human
aucuauguaucucagaagcuag

SEQ ID NO: 289416 - RNA, 22 nt, Human
aucugcugcuccuucuucuugc

SEQ ID NO: 289417 - RNA, 22 nt, Human
aucugcugccuaggguuugucu

SEQ ID NO: 289418 - RNA, 22 nt, Human
aucuggaacuucucugcauuga

SEQ ID NO: 289419 - RNA, 22 nt, Human
aucugcuguaguuggugccagu

SEQ ID NO: 289420 - RNA, 22 nt, Human
augaaaacgugugugugugugu

SEQ ID NO: 289421 - RNA, 23 nt, Human
augaaaugauacuuuauucacug

SEQ ID NO: 289422 - RNA, 19 nt, Human
augaaauagcauuuucuga

SEQ ID NO: 289423 - RNA, 22 nt, Human
auuauucaaggugaggguaaaa

SEQ ID NO: 289424 - RNA, 22 nt, Human
auuaugugagggacuuaaucau

SEQ ID NO: 289425 - RNA, 22 nt, Human
auuauggacuuucuuguuuggg

SEQ ID NO: 289426 - RNA, 22 nt, Human
auuauugcaagcagugaaggga

SEQ ID NO: 289427 - RNA, 21 nt, Human
auuaagacaauggcaaugggu

SEQ ID NO: 289428 - RNA, 22 nt, Human
auuaacaggcucuguucuaguu

SEQ ID NO: 289429 - RNA, 22 nt, Human
auuaagacugcccauguuuuua

SEQ ID NO: 289430 - RNA, 22 nt, Human
auuaaagcuaguugagauuuaa

SEQ ID NO: 289431 - RNA, 22 nt, Human
auuaaaaaugagaguagggauu

SEQ ID NO: 289432 - RNA, 22 nt, Human
auucaggacucuuccuugaaga

SEQ ID NO: 289433 - RNA, 22 nt, Human
auucaccaucuugauccccucu

SEQ ID NO: 289434 - RNA, 22 nt, Human
auucaguucuaaggucagugcc

SEQ ID NO: 289435 - RNA, 22 nt, Human
auucauauagcgcuuacagccu

SEQ ID NO: 289436 - RNA, 22 nt, Human
auucaagauaagggucugggag

SEQ ID NO: 289437 - RNA, 22 nt, Human
auucaagauagaaggauuuuca

SEQ ID NO: 289438 - RNA, 22 nt, Human
auuaagucugacuggauuguau

SEQ ID NO: 289439 - RNA, 22 nt, Human
auuccauccuggcuuuuuccug

SEQ ID NO: 289440 - RNA, 17 nt, Human
auucaugaacauguccu

SEQ ID NO: 289441 - RNA, 18 nt, Human
auucauuugcguuuggcu

SEQ ID NO: 289442 - RNA, 22 nt, Human
auguuuuauacacauguaucac

SEQ ID NO: 289443 - RNA, 22 nt, Human
auguuuucauuuagaagcuaau

SEQ ID NO: 289444 - RNA, 22 nt, Human
auguuuugaguuuuuuuacacc

SEQ ID NO: 289445 - RNA, 22 nt, Human
auuagugguguauuuggcacua

SEQ ID NO: 289446 - RNA, 22 nt, Human
auuaguagcacacagagaucag

SEQ ID NO: 289447 - RNA, 22 nt, Human
auuauaauucauuaggcuuagu

SEQ ID NO: 289448 - RNA, 22 nt, Human
auuaucuauccgccaacaguaa

SEQ ID NO: 289449 - RNA, 22 nt, Human
auuaucugacugaguagucugu

SEQ ID NO: 289450 - RNA, 23 nt, Human
auuaugaagaagacucgccuguu

SEQ ID NO: 289451 - RNA, 21 nt, Human
auuauagugacuaaauugaua

SEQ ID NO: 289452 - RNA, 22 nt, Human
auuauacauuaggagauugauu

SEQ ID NO: 289453 - RNA, 22 nt, Human
auuaauaucaauauauuauaug

SEQ ID NO: 289454 - RNA, 22 nt, Human
auuaaguuauuaagcuaaauau

SEQ ID NO: 289455 - RNA, 22 nt, Human
auuacagaagauaugcucaaca

SEQ ID NO: 289456 - RNA, 22 nt, Human
auuaauguguaugauauaaauu

SEQ ID NO: 289457 - RNA, 22 nt, Human
auuacugaggcaaaguaguuuu

SEQ ID NO: 289458 - RNA, 18 nt, Human
auguuccugcaguuauuu

SEQ ID NO: 289459 - RNA, 22 nt, Human
auguuuaauuugaaauuuuauu

SEQ ID NO: 289460 - RNA, 22 nt, Human
augugaaagagguguucagugg

SEQ ID NO: 289461 - RNA, 22 nt, Human
augugaaauuugggcucuggga

SEQ ID NO: 289462 - RNA, 22 nt, Human
augugaaccuggguccugggcc

SEQ ID NO: 289463 - RNA, 22 nt, Human
auguuccuuuaaaauauagauu

SEQ ID NO: 289464 - RNA, 22 nt, Human
auguugagaaucucucuucuaa

SEQ ID NO: 289465 - RNA, 22 nt, Human
auguuccuuaaugugcuuguag

SEQ ID NO: 289466 - RNA, 22 nt, Human
auguguuuccaacagagaggga

SEQ ID NO: 289467 - RNA, 22 nt, Human
augugugugcgagcgugugugu

SEQ ID NO: 289468 - RNA, 21 nt, Human
auguguucugauagugcuugc

SEQ ID NO: 289469 - RNA, 22 nt, Human
auguguguaugacugaaucuau

SEQ ID NO: 289470 - RNA, 22 nt, Human
auguguuuugaccccugcuaaa

SEQ ID NO: 289471 - RNA, 22 nt, Human
auguccugguccacagaaggga

SEQ ID NO: 289472 - RNA, 22 nt, Human
auguucccaaaaucccuguaga

SEQ ID NO: 289473 - RNA, 22 nt, Human
auguuccaugacuaugcaugaa

SEQ ID NO: 289474 - RNA, 22 nt, Human
auguuagcaucuggcacuaugg

SEQ ID NO: 289475 - RNA, 22 nt, Human
auguccccagacugcugugcag

SEQ ID NO: 289476 - RNA, 22 nt, Human
auguauguauguauauacacac

SEQ ID NO: 289477 - RNA, 20 nt, Human
augucaggaagggagucagg

SEQ ID NO: 289478 - RNA, 22 nt, Human
augugauacuccuucuagugga

SEQ ID NO: 289479 - RNA, 22 nt, Human
augguugggggaugucagcagg

SEQ ID NO: 289480 - RNA, 22 nt, Human
augguuuuguccucuuugguuc

SEQ ID NO: 289481 - RNA, 22 nt, Human
auguauauauacauguauugua

SEQ ID NO: 289482 - RNA, 22 nt, Human
auguaugagagauucuuuuauu

SEQ ID NO: 289483 - RNA, 22 nt, Human
augguuuugugaaaaugcuuug

SEQ ID NO: 289484 - RNA, 22 nt, Human
augugagcuggaugaauuuaua

SEQ ID NO: 289485 - RNA, 22 nt, Human
augguuagauggaugagaugug

SEQ ID NO: 289486 - RNA, 22 nt, Human
auguauuuauguauguguuaua

SEQ ID NO: 289487 - RNA, 22 nt, Human
auggccuuucucaguggugcuu

SEQ ID NO: 289488 - RNA, 18 nt, Human
auggcuccagugucuucc

SEQ ID NO: 289489 - RNA, 22 nt, Human
augcuucuguugcuuaggaggu

SEQ ID NO: 289490 - RNA, 22 nt, Human
auggcucugcugggcaaagcaa

SEQ ID NO: 289491 - RNA, 22 nt, Human
auggccugaagcuaaccccccu

SEQ ID NO: 289492 - RNA, 22 nt, Human
augguugccugagauaagacug

SEQ ID NO: 289493 - RNA, 22 nt, Human
augguugugaaagagcaaagac

SEQ ID NO: 289494 - RNA, 22 nt, Human
augguuacgcccucacccuacc

SEQ ID NO: 289495 - RNA, 22 nt, Human
auggugugugugugugugugug

SEQ ID NO: 289496 - RNA, 22 nt, Human
auggcuguguuguuccucugaa

SEQ ID NO: 289497 - RNA, 22 nt, Human
auauugagagagugagguguag

SEQ ID NO: 289498 - RNA, 21 nt, Human
auauugguaucuuuuuaaauc

SEQ ID NO: 289499 - RNA, 22 nt, Human
auauuauuaaaauagauggaua

SEQ ID NO: 289500 - RNA, 22 nt, Human
aucaaaauuuucagauacuaca

SEQ ID NO: 289501 - RNA, 20 nt, Human
aucaagugucuugccaggca

SEQ ID NO: 289502 - RNA, 22 nt, Human
aucaacucacagugugcuggca

SEQ ID NO: 289503 - RNA, 22 nt, Human
auauuugucuguuuuaguggca

SEQ ID NO: 289504 - RNA, 22 nt, Human
aucaauaaccauagugguuaca

SEQ ID NO: 289505 - RNA, 22 nt, Human
aucagaagaaauggaugugacu

SEQ ID NO: 289506 - RNA, 22 nt, Human
aucacauggauuuuaucuuuug

SEQ ID NO: 289507 - RNA, 22 nt, Human
aucacuagaguuacauugccag

SEQ ID NO: 289508 - RNA, 21 nt, Human
aucagaaucucuagauuugga

SEQ ID NO: 289509 - RNA, 22 nt, Human
auauuuuacagcucucguugaa

SEQ ID NO: 289510 - RNA, 22 nt, Human
aucaaaauguguagucuugauc

SEQ ID NO: 289511 - RNA, 22 nt, Human
auauuuuugcagaauuuuucgu

SEQ ID NO: 289512 - RNA, 22 nt, Human
auauuuguuuggcagaguucag

SEQ ID NO: 289513 - RNA, 22 nt, Human
auauuuguuagcugcuuuggag

SEQ ID NO: 289514 - RNA, 22 nt, Human
auauuugcccccaugcccuggc

SEQ ID NO: 289515 - RNA, 22 nt, Human
aucaucccuuucucccagugaa

SEQ ID NO: 289516 - RNA, 22 nt, Human
aucaaguuauuaaguagcuuuc

SEQ ID NO: 289517 - RNA, 22 nt, Human
aucacaaauggaaucaccuccc

SEQ ID NO: 289518 - RNA, 22 nt, Human
aucaaugggucaaagagaaggu

SEQ ID NO: 289519 - RNA, 20 nt, Human
aucaggagucgcggggagag

SEQ ID NO: 289520 - RNA, 22 nt, Human
aucagcucuugaugccuuucuu

SEQ ID NO: 289521 - RNA, 22 nt, Human
aucagagcuaguacuugcaggu

SEQ ID NO: 289522 - RNA, 22 nt, Human
aucaaacuaugguccaugggca

SEQ ID NO: 289523 - RNA, 22 nt, Human
aucacugcaggcauauaggggu

SEQ ID NO: 289524 - RNA, 22 nt, Human
aucaacacuguuggcggggacc

SEQ ID NO: 289525 - RNA, 22 nt, Human
aucaagacaaaggaaaggcuaa

SEQ ID NO: 289526 - RNA, 19 nt, Human
aucagcaguuuugccugga

SEQ ID NO: 289527 - RNA, 22 nt, Human
aucauguuauguacaaauauga

SEQ ID NO: 289528 - RNA, 17 nt, Human
aucagaggauaggacaa

SEQ ID NO: 289529 - RNA, 22 nt, Human
aucaugggauagugggacgagc

SEQ ID NO: 289530 - RNA, 22 nt, Human
aucaugcugacacaguuuaucu

SEQ ID NO: 289531 - RNA, 22 nt, Human
aucacacaccuguuaaauugug

SEQ ID NO: 289532 - RNA, 22 nt, Human
aucauuuuuauuagcugggguu

SEQ ID NO: 289533 - RNA, 22 nt, Human
auccaggguuggggucacgagu

SEQ ID NO: 289534 - RNA, 22 nt, Human
auccagaaguauuuuggguacu

SEQ ID NO: 289535 - RNA, 22 nt, Human
auccaggggucugaauggauau

SEQ ID NO: 289536 - RNA, 22 nt, Human
auccucugcucaugagaaaugu

SEQ ID NO: 289537 - RNA, 20 nt, Human
auccuggucuuuggaagcuu

SEQ ID NO: 289538 - RNA, 19 nt, Human
auccuugcucacucacuga

SEQ ID NO: 289539 - RNA, 18 nt, Human
auccuuugaucaucuguc

SEQ ID NO: 289540 - RNA, 22 nt, Human
aucguuaugauagagaaagaga

SEQ ID NO: 289541 - RNA, 22 nt, Human
aucggucuccuauaauucaaac

SEQ ID NO: 289542 - RNA, 22 nt, Human
aucguggcacgucgccgcagcg

SEQ ID NO: 289543 - RNA, 22 nt, Human
aucggggaaugaccuuuucauu

SEQ ID NO: 289544 - RNA, 23 nt, Human
aucgcccggguccagucccggcu

SEQ ID NO: 289545 - RNA, 22 nt, Human
aucccuggccacgaagcugccc

SEQ ID NO: 289546 - RNA, 22 nt, Human
aucuaaaacuacgaauacuacc

SEQ ID NO: 289547 - RNA, 22 nt, Human
aucuaaucugccuuccuaaucu

SEQ ID NO: 289548 - RNA, 22 nt, Human
auccucaaggaauuaaauaggg

SEQ ID NO: 289549 - RNA, 22 nt, Human
auccugauggaaacugguauga

SEQ ID NO: 289550 - RNA, 22 nt, Human
aucuacuuugggaguuucucuu

SEQ ID NO: 289551 - RNA, 22 nt, Human
aucauuaacagugcagggguag

SEQ ID NO: 289552 - RNA, 22 nt, Human
aucauuugaacagaauuuguuu

SEQ ID NO: 289553 - RNA, 22 nt, Human
aucauugcuaguaaggaucuug

SEQ ID NO: 289554 - RNA, 22 nt, Human
aucauugaaaauuuaugcauuu

SEQ ID NO: 289555 - RNA, 22 nt, Human
auccgugagcgagcgagcaccc

SEQ ID NO: 289556 - RNA, 22 nt, Human
aucccacaccccuacaacauau

SEQ ID NO: 289557 - RNA, 22 nt, Human
aucauguauauuuuugcuauua

SEQ ID NO: 289558 - RNA, 22 nt, Human
auccacggucaauuccccaucc

SEQ ID NO: 289559 - RNA, 22 nt, Human
aucagugcacgcgaugggcaga

SEQ ID NO: 289560 - RNA, 22 nt, Human
aucauaugugauaccauaauga

SEQ ID NO: 289561 - RNA, 22 nt, Human
aucauuuggaaauuuggccuaa

SEQ ID NO: 289562 - RNA, 21 nt, Human
auauggauauuauuuuguguc

SEQ ID NO: 289563 - RNA, 22 nt, Human
auauggugauuuuaugcaggaa

SEQ ID NO: 289564 - RNA, 22 nt, Human
auaugagaggaggagcaucagu

SEQ ID NO: 289565 - RNA, 22 nt, Human
auauuuguacagcuugugaguu

SEQ ID NO: 289566 - RNA, 21 nt, Human
auauuguugggguuuucuuuu

SEQ ID NO: 289567 - RNA, 22 nt, Human
auauuucuacaggcugauuuua

SEQ ID NO: 289568 - RNA, 22 nt, Human
auauaaugcaguaggugauuaa

SEQ ID NO: 289569 - RNA, 22 nt, Human
auauaugcaacaagaaagcaua

SEQ ID NO: 289570 - RNA, 22 nt, Human
auauauguauauacacauauau

SEQ ID NO: 289571 - RNA, 22 nt, Human
auauauguauauaugugugugu

SEQ ID NO: 289572 - RNA, 22 nt, Human
auauauacuuugacacauucug

SEQ ID NO: 289573 - RNA, 22 nt, Human
auauugcuuuauucuugaauau

SEQ ID NO: 289574 - RNA, 22 nt, Human
auauucaaugaggucauauaag

SEQ ID NO: 289575 - RNA, 22 nt, Human
auaucuaggcugaauguaaaau

SEQ ID NO: 289576 - RNA, 22 nt, Human
auauguaguuucagaaguggaa

SEQ ID NO: 289577 - RNA, 22 nt, Human
auauguuaugccauuuucaagg

SEQ ID NO: 289578 - RNA, 22 nt, Human
auauguuuuaguagaaucccaa

SEQ ID NO: 289579 - RNA, 22 nt, Human
auauaguacauguauauauaua

SEQ ID NO: 289580 - RNA, 22 nt, Human
auauaguuggguuucauucuac

SEQ ID NO: 289581 - RNA, 22 nt, Human
auagcaacucugcuuccuugcc

SEQ ID NO: 289582 - RNA, 22 nt, Human
auagaugaggaaauucaggugc

SEQ ID NO: 289583 - RNA, 22 nt, Human
auagauguauucauuguuuggc

SEQ ID NO: 289584 - RNA, 22 nt, Human
auauccugguucuaucaaaagg

SEQ ID NO: 289585 - RNA, 19 nt, Human
auagcagaagucauuuuca

SEQ ID NO: 289586 - RNA, 22 nt, Human
auaugcacauguacauguauau

SEQ ID NO: 289587 - RNA, 22 nt, Human
auaugcagaaaauaaaggaauu

SEQ ID NO: 289588 - RNA, 22 nt, Human
auaugaagaaugaucugaagua

SEQ ID NO: 289589 - RNA, 22 nt, Human
auaucuuguuuuugauuucuug

SEQ ID NO: 289590 - RNA, 22 nt, Human
auaucugaugacgugacuaugu

SEQ ID NO: 289591 - RNA, 22 nt, Human
auaggcggagccauaucaucca

SEQ ID NO: 289592 - RNA, 22 nt, Human
auagggaggcggagggagcugg

SEQ ID NO: 289593 - RNA, 22 nt, Human
auaggagcaagauuauagcagg

SEQ ID NO: 289594 - RNA, 22 nt, Human
auaggacuuuguaucaggauga

SEQ ID NO: 289595 - RNA, 22 nt, Human
auaggcauaacacugauguccu

SEQ ID NO: 289596 - RNA, 23 nt, Human
auagucaggaacuguuggugugu

SEQ ID NO: 289597 - RNA, 23 nt, Human
auagucuuaaaccagacuucacc

SEQ ID NO: 289598 - RNA, 22 nt, Human
auaguuaagguguacugaagau

SEQ ID NO: 289599 - RNA, 22 nt, Human
auaguuuuagauacugagaaaa

SEQ ID NO: 289600 - RNA, 22 nt, Human
auaguugcugucauuauuugag

SEQ ID NO: 289601 - RNA, 22 nt, Human
auauaagauaauaacuuuuuua

SEQ ID NO: 289602 - RNA, 22 nt, Human
auauaagucacauuaaggaggu

SEQ ID NO: 289603 - RNA, 22 nt, Human
auagaguucucuuuggaggagu

SEQ ID NO: 289604 - RNA, 18 nt, Human
auagacaggaaaaaugga

SEQ ID NO: 289605 - RNA, 22 nt, Human
auaguaaauguuaacagcaaca

SEQ ID NO: 289606 - RNA, 22 nt, Human
auagagaggaacagcaagaacu

SEQ ID NO: 289607 - RNA, 23 nt, Human
auacuuuuuuucuacguuaucuc

SEQ ID NO: 289608 - RNA, 22 nt, Human
auaccaguagaggacugcccaa

SEQ ID NO: 289609 - RNA, 22 nt, Human
auaccuauagcagacugagacu

SEQ ID NO: 289610 - RNA, 22 nt, Human
auaggaguuauggaaugagccc

SEQ ID NO: 289611 - RNA, 22 nt, Human
auaggggagcagccagagaaga

SEQ ID NO: 289612 - RNA, 22 nt, Human
auagaaauagacaaugcaaaga

SEQ ID NO: 289613 - RNA, 22 nt, Human
auagcaguauuaugagauaacu

SEQ ID NO: 289614 - RNA, 22 nt, Human
auagcuauuauuauuucuguua

SEQ ID NO: 289615 - RNA, 22 nt, Human
auacaggcaguaagauucucag

SEQ ID NO: 289616 - RNA, 22 nt, Human
auacaucuuaacgcgcucuugg

SEQ ID NO: 289617 - RNA, 22 nt, Human
auacagccuaguuugaguccca

SEQ ID NO: 289618 - RNA, 22 nt, Human
auagauugcucauauauuacuu

SEQ ID NO: 289619 - RNA, 22 nt, Human
auagauuuuaucagauuuuauc

SEQ ID NO: 289620 - RNA, 22 nt, Human
auagaugacaguuaggaagcug

SEQ ID NO: 289621 - RNA, 22 nt, Human
auacaugugugugcauacaugu

SEQ ID NO: 289622 - RNA, 22 nt, Human
auacaugacucacacauucugc

SEQ ID NO: 289623 - RNA, 22 nt, Human
auagaguguguguuauguguga

SEQ ID NO: 289624 - RNA, 22 nt, Human
agugacauuauuuuguguacua

SEQ ID NO: 289625 - RNA, 22 nt, Human
agugaauuagccuauuuguaaa

SEQ ID NO: 289626 - RNA, 22 nt, Human
auagacauuuauagagaaugac

SEQ ID NO: 289627 - RNA, 22 nt, Human
auagacacagcuaugauuugag

SEQ ID NO: 289628 - RNA, 22 nt, Human
auagaauggcaccagcaucuac

SEQ ID NO: 289629 - RNA, 22 nt, Human
auagaagugaaaagggaugacu

SEQ ID NO: 289630 - RNA, 22 nt, Human
uuuuuuuccaguuauucauuuu

SEQ ID NO: 289631 - RNA, 20 nt, Human
uuuuuuaaauagagcuguug

SEQ ID NO: 289632 - RNA, 22 nt, Human
uuuuuuccugguuacagauugu

SEQ ID NO: 289633 - RNA, 22 nt, Human
uuuuuuccagcuucuagaggcc

SEQ ID NO: 289634 - RNA, 22 nt, Human
uuuuuuccuguuugucuuuggg

SEQ ID NO: 289635 - RNA, 18 nt, Human
uuuuuuguucuguuuugu

SEQ ID NO: 289636 - RNA, 22 nt, Human
uuuuuuuaaguuuugauuuuag

SEQ ID NO: 289637 - RNA, 22 nt, Human
uuuuuuguuccuugguuuuugu

SEQ ID NO: 289638 - RNA, 22 nt, Human
uuuuuugguuuggggauuauuu

SEQ ID NO: 289639 - RNA, 22 nt, Human
uuuuugcuuuuuugucaucuaa

SEQ ID NO: 289640 - RNA, 22 nt, Human
uuuuuggacccaucuucuuuuu

SEQ ID NO: 289641 - RNA, 22 nt, Human
uuuuuguaaaugaaguuuuauu

SEQ ID NO: 289642 - RNA, 22 nt, Human
uuuuuguauaugcuucgaggau

SEQ ID NO: 289643 - RNA, 22 nt, Human
uuuuugggaagaauucugauau

SEQ ID NO: 289644 - RNA, 22 nt, Human
uuuuucugacugcuaacaaaaa

SEQ ID NO: 289645 - RNA, 19 nt, Human
uuuuucccccucuccucag

SEQ ID NO: 289646 - RNA, 22 nt, Human
uuuuuaaaauuaggacggcacg

SEQ ID NO: 289647 - RNA, 22 nt, Human
uuuuguuacugauuauuaaaau

SEQ ID NO: 289648 - RNA, 22 nt, Human
uuuuguuuacauuaaauuuuga

SEQ ID NO: 289649 - RNA, 22 nt, Human
uuuuuaccugguguccagcuuc

SEQ ID NO: 289650 - RNA, 22 nt, Human
uuuuuagcauaugucaaaucag

SEQ ID NO: 289651 - RNA, 22 nt, Human
uuuuuaagguuuguuuauauau

SEQ ID NO: 289652 - RNA, 22 nt, Human
uuuuuagcuguuauuguggaag

SEQ ID NO: 289653 - RNA, 22 nt, Human
uuuuuauaagagcagcagaguu

SEQ ID NO: 289654 - RNA, 22 nt, Human
uuuuucacacuccuuuccaguu

SEQ ID NO: 289655 - RNA, 22 nt, Human
uuuuguagauuggaaaaucugg

SEQ ID NO: 289656 - RNA, 22 nt, Human
uuuuucagacuaauagggcaua

SEQ ID NO: 289657 - RNA, 22 nt, Human
uuuugggugcaaauuguuuguu

SEQ ID NO: 289658 - RNA, 22 nt, Human
uuuuggauugcuaacucagggu

SEQ ID NO: 289659 - RNA, 22 nt, Human
uuuuguggacugugagggugca

SEQ ID NO: 289660 - RNA, 21 nt, Human
uuuuguguugcgcacuuugag

SEQ ID NO: 289661 - RNA, 20 nt, Human
uuuuguccaccugcaggaag

SEQ ID NO: 289662 - RNA, 22 nt, Human
uuuugucagggcaggaggaaga

SEQ ID NO: 289663 - RNA, 22 nt, Human
uuuucauagccagaaacugaaa

SEQ ID NO: 289664 - RNA, 22 nt, Human
uuuucauuguuaguuucuccuu

SEQ ID NO: 289665 - RNA, 22 nt, Human
uuuuccuucugauacuccauuu

SEQ ID NO: 289666 - RNA, 22 nt, Human
uuuucggggcgacuuagguucu

SEQ ID NO: 289667 - RNA, 22 nt, Human
uuuuccuugagucggggcacag

SEQ ID NO: 289668 - RNA, 22 nt, Human
uuuucggagaauguuaaugugu

SEQ ID NO: 289669 - RNA, 22 nt, Human
uuuucucaguuuuuuucaaaag

SEQ ID NO: 289670 - RNA, 22 nt, Human
uuuugauacaaguuguaaaaaa

SEQ ID NO: 289671 - RNA, 22 nt, Human
uuuucuuggaguggcuguccuu

SEQ ID NO: 289672 - RNA, 22 nt, Human
uuuugcaaauuacuaaauuucu

SEQ ID NO: 289673 - RNA, 22 nt, Human
uuuugcuagaaaucaccaauac

SEQ ID NO: 289674 - RNA, 22 nt, Human
uuuugccuauuguaucaucgua

SEQ ID NO: 289675 - RNA, 22 nt, Human
uuuucucuuugcuucucuaaaa

SEQ ID NO: 289676 - RNA, 22 nt, Human
uuuucuguuuaugaaauugugu

SEQ ID NO: 289677 - RNA, 22 nt, Human
uuuucaguuccaucucugcucu

SEQ ID NO: 289678 - RNA, 22 nt, Human
uuuucaauuuucauuugcaaga

SEQ ID NO: 289679 - RNA, 22 nt, Human
uuuucaaucaaguuuauuuaua

SEQ ID NO: 289680 - RNA, 22 nt, Human
uuuuauguuccugaagcuaucu

SEQ ID NO: 289681 - RNA, 22 nt, Human
uuuuaucuuacauggaaucucc

SEQ ID NO: 289682 - RNA, 22 nt, Human
uuuucaacuuuauuuuccccca

SEQ ID NO: 289683 - RNA, 22 nt, Human
uuuuagaagcauuuaugagauu

SEQ ID NO: 289684 - RNA, 22 nt, Human
uuuguuguauuaacccagggua

SEQ ID NO: 289685 - RNA, 22 nt, Human
uuuuagccagaguuuaucacag

SEQ ID NO: 289686 - RNA, 22 nt, Human
uuuuaucagagcuugcagugug

SEQ ID NO: 289687 - RNA, 22 nt, Human
uuuuauaaaaccuguuugaccu

SEQ ID NO: 289688 - RNA, 22 nt, Human
uuuuacuuuucccacuuacagc

SEQ ID NO: 289689 - RNA, 22 nt, Human
uuuuacaaugcaaauucuugcu

SEQ ID NO: 289690 - RNA, 23 nt, Human
uuuuacaagagugcauuugucuc

SEQ ID NO: 289691 - RNA, 22 nt, Human
uuuuaauccucuugguaucuua

SEQ ID NO: 289692 - RNA, 22 nt, Human
uuuuaaucagguauuugaguau

SEQ ID NO: 289693 - RNA, 23 nt, Human
uuuuaauaguaugacaugagcug

SEQ ID NO: 289694 - RNA, 22 nt, Human
uuuuaauaguauaucuagacac

SEQ ID NO: 289695 - RNA, 22 nt, Human
uuuuaaguauuuucuuuuuuua

SEQ ID NO: 289696 - RNA, 22 nt, Human
uuuuaacuuuaccauuucuuca

SEQ ID NO: 289697 - RNA, 22 nt, Human
uuuuaaaguaauugaagcuugu

SEQ ID NO: 289698 - RNA, 22 nt, Human
uuuuaaaagguugcuguuauaa

SEQ ID NO: 289699 - RNA, 19 nt, Human
uuuacuuaggccacagaau

SEQ ID NO: 289700 - RNA, 22 nt, Human
uuuacuuguuuugcucuuuucc

SEQ ID NO: 289701 - RNA, 22 nt, Human
uuuacuauuaguauuucauuuu

SEQ ID NO: 289702 - RNA, 22 nt, Human
uuuaaugucuuuggccuuuaau

SEQ ID NO: 289703 - RNA, 22 nt, Human
uuuguguuggaagaaaugcuac

SEQ ID NO: 289704 - RNA, 22 nt, Human
uuuagagauaaaugcucuccca

SEQ ID NO: 289705 - RNA, 22 nt, Human
uuuguuaugguuggaagcagga

SEQ ID NO: 289706 - RNA, 22 nt, Human
uuuguuaggguuucagcuagcc

SEQ ID NO: 289707 - RNA, 22 nt, Human
uuuguguuacaguccuagaacu

SEQ ID NO: 289708 - RNA, 22 nt, Human
uuuguuugcugagugaauucaa

SEQ ID NO: 289709 - RNA, 22 nt, Human
uuuguuuccagccuuuugucuu

SEQ ID NO: 289710 - RNA, 22 nt, Human
uugaaaaaugcccagcagacaa

SEQ ID NO: 289711 - RNA, 21 nt, Human
uuuuucuccagaguuuccacu

SEQ ID NO: 289712 - RNA, 22 nt, Human
uuuuuauaagauuuaaaaugua

SEQ ID NO: 289713 - RNA, 22 nt, Human
uuuuuauguaaaauauuaaaag

SEQ ID NO: 289714 - RNA, 22 nt, Human
uuuuuagggauuaguguuugag

SEQ ID NO: 289715 - RNA, 22 nt, Human
uuuuuaauuuuaagcuauuugu

SEQ ID NO: 289716 - RNA, 18 nt, Human
uuuuguguuuauucugca

SEQ ID NO: 289717 - RNA, 22 nt, Human
uucuggagucuauuuugaaaag

SEQ ID NO: 289718 - RNA, 22 nt, Human
uuuuuaaaagaugauuuaauga

SEQ ID NO: 289719 - RNA, 22 nt, Human
uucuguucugcuuucuccaucc

SEQ ID NO: 289720 - RNA, 22 nt, Human
uuuugguuugaguauuuuuuuu

SEQ ID NO: 289721 - RNA, 22 nt, Human
uugacguccucgauggggaacu

SEQ ID NO: 289722 - RNA, 22 nt, Human
uugaauggaauuggaaucuuau

SEQ ID NO: 289723 - RNA, 22 nt, Human
uuuuuuguggcuggaagaaaaa

SEQ ID NO: 289724 - RNA, 22 nt, Human
uugaggcugaucacuccuauaa

SEQ ID NO: 289725 - RNA, 20 nt, Human
uugaggagauauugaauacu

SEQ ID NO: 289726 - RNA, 22 nt, Human
uugaguaaugcaagccuuugua

SEQ ID NO: 289727 - RNA, 22 nt, Human
uuuuuuuguagguguaugaaaa

SEQ ID NO: 289728 - RNA, 22 nt, Human
uuuuuuuuacuccggacagcuc

SEQ ID NO: 289729 - RNA, 22 nt, Human
uuuuuucuucucuaucuuaaua

SEQ ID NO: 289730 - RNA, 22 nt, Human
uuuuuucuggaguuugggguuu

SEQ ID NO: 289731 - RNA, 22 nt, Human
uugaacguguaggaagcugguu

SEQ ID NO: 289732 - RNA, 22 nt, Human
uugaacauuagaauaaguaauu

SEQ ID NO: 289733 - RNA, 22 nt, Human
uugaaccaggauaaacauagaa

SEQ ID NO: 289734 - RNA, 22 nt, Human
uugaagccaccacuguaaguca

SEQ ID NO: 289735 - RNA, 22 nt, Human
uugaaaaguuuguuacucacau

SEQ ID NO: 289736 - RNA, 22 nt, Human
uuuuacgucuuugcugccucgu

SEQ ID NO: 289737 - RNA, 22 nt, Human
uucgucauuguuguugguuuuc

SEQ ID NO: 289738 - RNA, 22 nt, Human
uuuguucuucucaugcacacaa

SEQ ID NO: 289739 - RNA, 22 nt, Human
uuuuacauuuuauucguuuauu

SEQ ID NO: 289740 - RNA, 22 nt, Human
uuuguucuagauaacugguaau

SEQ ID NO: 289741 - RNA, 22 nt, Human
uuuuagccagcaucugggucga

SEQ ID NO: 289742 - RNA, 18 nt, Human
uucuaaauucuguuuuua

SEQ ID NO: 289743 - RNA, 22 nt, Human
uucucucacucuuagaucccgc

SEQ ID NO: 289744 - RNA, 22 nt, Human
uucucuauuugcugcaccucuc

SEQ ID NO: 289745 - RNA, 22 nt, Human
uuuuauuuguauguugaaugua

SEQ ID NO: 289746 - RNA, 22 nt, Human
uucucuuguaaaauuccuuuuu

SEQ ID NO: 289747 - RNA, 22 nt, Human
uuuuccuguccuugggucugca

SEQ ID NO: 289748 - RNA, 22 nt, Human
uucugaaccauugagcacugcc

SEQ ID NO: 289749 - RNA, 22 nt, Human
uucucuggggacugucucuauu

SEQ ID NO: 289750 - RNA, 20 nt, Human
uucucugcagcaggcggccc

SEQ ID NO: 289751 - RNA, 22 nt, Human
uucucugcgcuccggcccaguu

SEQ ID NO: 289752 - RNA, 18 nt, Human
uucugcggugacagauau

SEQ ID NO: 289753 - RNA, 22 nt, Human
uucugauacagucccaacacaa

SEQ ID NO: 289754 - RNA, 22 nt, Human
uuuuccgaccuuaggaaggaac

SEQ ID NO: 289755 - RNA, 22 nt, Human
uucugaugccuggguugcuucu

SEQ ID NO: 289756 - RNA, 22 nt, Human
uucugggguaagcacugaggau

SEQ ID NO: 289757 - RNA, 22 nt, Human
uucuggugauuugccucuuuag

SEQ ID NO: 289758 - RNA, 22 nt, Human
uucuguacuagaucuuaucagu

SEQ ID NO: 289759 - RNA, 20 nt, Human
uucuguggcccguuuaagug

SEQ ID NO: 289760 - RNA, 22 nt, Human
uuuuggaaaaaccaguauggaa

SEQ ID NO: 289761 - RNA, 22 nt, Human
uuuuggagaaaugggacuuaau

SEQ ID NO: 289762 - RNA, 22 nt, Human
uucuggggccgugacgaggggc

SEQ ID NO: 289763 - RNA, 21 nt, Human
uucugcuguucaccaccaccc

SEQ ID NO: 289764 - RNA, 22 nt, Human
uucuggacuuccaaauggcuuc

SEQ ID NO: 289765 - RNA, 22 nt, Human
uucugcuuuaaagcucauguuu

SEQ ID NO: 289766 - RNA, 22 nt, Human
uuggcacagagcugcagccugg

SEQ ID NO: 289767 - RNA, 22 nt, Human
uuggccaaaaaagucauuagaa

SEQ ID NO: 289768 - RNA, 22 nt, Human
uuggcagagaacagaaugauuu

SEQ ID NO: 289769 - RNA, 22 nt, Human
uugguaaccaaucaaaugugag

SEQ ID NO: 289770 - RNA, 22 nt, Human
uugguaccaagcaaacuuucug

SEQ ID NO: 289771 - RNA, 22 nt, Human
uugguauuuguuuaaauuacac

SEQ ID NO: 289772 - RNA, 22 nt, Human
uugggugcugcacccuucaaca

SEQ ID NO: 289773 - RNA, 22 nt, Human
uuggggcugcguguuuccaugu

SEQ ID NO: 289774 - RNA, 22 nt, Human
uuggguagguccuucacggaua

SEQ ID NO: 289775 - RNA, 20 nt, Human
uuguacuuaugugagaagga

SEQ ID NO: 289776 - RNA, 22 nt, Human
uugucauuuucuuaauguuccu

SEQ ID NO: 289777 - RNA, 22 nt, Human
uugucucuacagagaguaguag

SEQ ID NO: 289778 - RNA, 22 nt, Human
uugucccuaugagugguaauca

SEQ ID NO: 289779 - RNA, 22 nt, Human
uuguuugguugacugauuuacc

SEQ ID NO: 289780 - RNA, 22 nt, Human
uuguuuguaaggcucuuagaau

SEQ ID NO: 289781 - RNA, 22 nt, Human
uuguuuggcaaaugugugugug

SEQ ID NO: 289782 - RNA, 22 nt, Human
uuguuugcacuuuagagacugu

SEQ ID NO: 289783 - RNA, 21 nt, Human
uugugaaaguccaggaacaac

SEQ ID NO: 289784 - RNA, 22 nt, Human
uuguuucauggggacgacuggc

SEQ ID NO: 289785 - RNA, 22 nt, Human
uuguuuuucucuagggaaggcu

SEQ ID NO: 289786 - RNA, 22 nt, Human
uuguuuuaaaaagaauaacuac

SEQ ID NO: 289787 - RNA, 22 nt, Human
uuuaaaacagcauuuaaaaggu

SEQ ID NO: 289788 - RNA, 23 nt, Human
uuuaaacaauguggucguggugg

SEQ ID NO: 289789 - RNA, 21 nt, Human
uuuaaggccagcaggagguga

SEQ ID NO: 289790 - RNA, 22 nt, Human
uuuaaaccuaucuaagaaauag

SEQ ID NO: 289791 - RNA, 22 nt, Human
uuuaaagucaggcuguaguggu

SEQ ID NO: 289792 - RNA, 22 nt, Human
uuuaauauucucuuugaaggaa

SEQ ID NO: 289793 - RNA, 18 nt, Human
uuuaauaagccuguuaug

SEQ ID NO: 289794 - RNA, 22 nt, Human
uuuaaguuaguauggguuaggu

SEQ ID NO: 289795 - RNA, 22 nt, Human
uuggaagagagauggggagaga

SEQ ID NO: 289796 - RNA, 22 nt, Human
uuggaaguggcaaaggcuaaag

SEQ ID NO: 289797 - RNA, 22 nt, Human
uuggaauuugagaccaagaaaa

SEQ ID NO: 289798 - RNA, 22 nt, Human
uuggaagugucuaauacaggua

SEQ ID NO: 289799 - RNA, 22 nt, Human
uuggaaaugcauuuguuauuau

SEQ ID NO: 289800 - RNA, 22 nt, Human
uuggaaauguagaaaagcagau

SEQ ID NO: 289801 - RNA, 22 nt, Human
uuggaagacagccgucuuuauu

SEQ ID NO: 289802 - RNA, 22 nt, Human
uugcuuugcuucuuuaugguca

SEQ ID NO: 289803 - RNA, 22 nt, Human
uugcugaggcuggggagaggug

SEQ ID NO: 289804 - RNA, 22 nt, Human
uugcugcgcugaccuccaguga

SEQ ID NO: 289805 - RNA, 22 nt, Human
uugcugccagcgcccugcaggg

SEQ ID NO: 289806 - RNA, 22 nt, Human
uugcugagcugaaccagccacc

SEQ ID NO: 289807 - RNA, 22 nt, Human
uugcuggaguagaaaacuuaac

SEQ ID NO: 289808 - RNA, 22 nt, Human
uugcugggauucauugaagggu

SEQ ID NO: 289809 - RNA, 22 nt, Human
uugcuugaacccaggaagugga

SEQ ID NO: 289810 - RNA, 22 nt, Human
uugcuuaggccaaauggcgcau

SEQ ID NO: 289811 - RNA, 22 nt, Human
uugcuuaaaucgcuuaaacugg

SEQ ID NO: 289812 - RNA, 22 nt, Human
uugcaugauuuaagaauaucug

SEQ ID NO: 289813 - RNA, 22 nt, Human
uugcaucaaauauguaccacag

SEQ ID NO: 289814 - RNA, 22 nt, Human
uugcauauguccagccaugcau

SEQ ID NO: 289815 - RNA, 22 nt, Human
uugcagagaacuaaagggagua

SEQ ID NO: 289816 - RNA, 22 nt, Human
uugcagauuucuuguccccauu

SEQ ID NO: 289817 - RNA, 22 nt, Human
uugauuuggaauuuuuagagcu

SEQ ID NO: 289818 - RNA, 22 nt, Human
uugcacuccagcccgagcaaca

SEQ ID NO: 289819 - RNA, 22 nt, Human
uugauuuggcguuuuccuccug

SEQ ID NO: 289820 - RNA, 22 nt, Human
uugcccuaccccaggccuuuuu

SEQ ID NO: 289821 - RNA, 22 nt, Human
uugcggaucuucauggccucag

SEQ ID NO: 289822 - RNA, 22 nt, Human
uugccgacuggccaaggaguaa

SEQ ID NO: 289823 - RNA, 22 nt, Human
uugcguaauuugagauuguaaa

SEQ ID NO: 289824 - RNA, 22 nt, Human
uugcuaagguuuaacuauugga

SEQ ID NO: 289825 - RNA, 20 nt, Human
uugcucucuuguguugaugu

SEQ ID NO: 289826 - RNA, 22 nt, Human
uugcucaccugagaagaauaga

SEQ ID NO: 289827 - RNA, 22 nt, Human
uuauuucauguaaaauuuaugu

SEQ ID NO: 289828 - RNA, 22 nt, Human
uuucucuuuuugggguggggug

SEQ ID NO: 289829 - RNA, 22 nt, Human
uuucucugggugaugagguggc

SEQ ID NO: 289830 - RNA, 22 nt, Human
uuucuguugugaccugacucuu

SEQ ID NO: 289831 - RNA, 22 nt, Human
uuucuguucuguuggauucuuu

SEQ ID NO: 289832 - RNA, 22 nt, Human
uuucuuaaaagcuuuuaaaguu

SEQ ID NO: 289833 - RNA, 20 nt, Human
uuugauugccccucugacuu

SEQ ID NO: 289834 - RNA, 23 nt, Human
uuugaaucauuguggggcuuuug

SEQ ID NO: 289835 - RNA, 22 nt, Human
uucaacaacuugguucaaaugg

SEQ ID NO: 289836 - RNA, 22 nt, Human
uucaaaccuaucuaagaaauag

SEQ ID NO: 289837 - RNA, 22 nt, Human
uucaaacaguguagaauauaug

SEQ ID NO: 289838 - RNA, 22 nt, Human
uucaaacacugugcaauugggu

SEQ ID NO: 289839 - RNA, 22 nt, Human
uuauuuuuguaacacuguauag

SEQ ID NO: 289840 - RNA, 22 nt, Human
uuugaaaggagcuuuauccaga

SEQ ID NO: 289841 - RNA, 22 nt, Human
uuugaagaaacagucuuaagag

SEQ ID NO: 289842 - RNA, 22 nt, Human
uuauuuucgugugugugugugu

SEQ ID NO: 289843 - RNA, 22 nt, Human
uuauuuuuaggaauguagaggu

SEQ ID NO: 289844 - RNA, 22 nt, Human
uuucuuugggcccuggcagucu

SEQ ID NO: 289845 - RNA, 22 nt, Human
uuucuuuuucuacaccuuagcu

SEQ ID NO: 289846 - RNA, 18 nt, Human
uuucuuuuauuccagguc

SEQ ID NO: 289847 - RNA, 22 nt, Human
uuugggaaguaauuaauugcag

SEQ ID NO: 289848 - RNA, 22 nt, Human
uucaguuugaauucuguagaac

SEQ ID NO: 289849 - RNA, 19 nt, Human
uucaggcuuuucauuuuuc

SEQ ID NO: 289850 - RNA, 22 nt, Human
uucaguguuagaauuccaagaa

SEQ ID NO: 289851 - RNA, 22 nt, Human
uuuggguuaguuuuccaaucuu

SEQ ID NO: 289852 - RNA, 22 nt, Human
uuugggguuuuuuggugaaauc

SEQ ID NO: 289853 - RNA, 22 nt, Human
uuuggugacuguaggaaaggau

SEQ ID NO: 289854 - RNA, 22 nt, Human
uuuggggcucauuugcuuuugu

SEQ ID NO: 289855 - RNA, 22 nt, Human
uucaggggcaaauacauuuuga

SEQ ID NO: 289856 - RNA, 22 nt, Human
uucaggaucuaggaguauuuuu

SEQ ID NO: 289857 - RNA, 22 nt, Human
uucagguuuuuaaguucugccu

SEQ ID NO: 289858 - RNA, 22 nt, Human
uuuggaugcugucauaugcugc

SEQ ID NO: 289859 - RNA, 22 nt, Human
uucagaccucaaauccacaugc

SEQ ID NO: 289860 - RNA, 22 nt, Human
uuugauuuuguuuauagugccg

SEQ ID NO: 289861 - RNA, 22 nt, Human
uuugcaggaaauguacugaaug

SEQ ID NO: 289862 - RNA, 22 nt, Human
uuugcauuaguuuagauuucaa

SEQ ID NO: 289863 - RNA, 22 nt, Human
uuugcaaaguccauugaaguua

SEQ ID NO: 289864 - RNA, 23 nt, Human
uuugcaaauuggacacaaccaca

SEQ ID NO: 289865 - RNA, 22 nt, Human
uuuguguuuugaggucuugcaa

SEQ ID NO: 289866 - RNA, 22 nt, Human
uuuguguuuucaggcacauggc

SEQ ID NO: 289867 - RNA, 22 nt, Human
uuccccagaaaaguaaacaagg

SEQ ID NO: 289868 - RNA, 22 nt, Human
uuccccaugugaugcuauugcu

SEQ ID NO: 289869 - RNA, 22 nt, Human
uucccuauaauauggcucuucu

SEQ ID NO: 289870 - RNA, 22 nt, Human
uuugugauaaguggauucaagg

SEQ ID NO: 289871 - RNA, 22 nt, Human
uuccaugccccucuuuggguac

SEQ ID NO: 289872 - RNA, 22 nt, Human
uuugucauuuagcccauggugg

SEQ ID NO: 289873 - RNA, 23 nt, Human
uuugucaucccucucacuuucug

SEQ ID NO: 289874 - RNA, 22 nt, Human
uuccaagcaccaugaaggccuc

SEQ ID NO: 289875 - RNA, 22 nt, Human
uuuguauuucaaggcacucuca

SEQ ID NO: 289876 - RNA, 22 nt, Human
uucauuuuauauuagagcuguu

SEQ ID NO: 289877 - RNA, 22 nt, Human
uucauuuccauuuuauagauaa

SEQ ID NO: 289878 - RNA, 22 nt, Human
uuuguaaguuuguucuccuggg

SEQ ID NO: 289879 - RNA, 22 nt, Human
uucauugauuuccuuggaauaa

SEQ ID NO: 289880 - RNA, 22 nt, Human
uuuggugauuuuuaaucccccu

SEQ ID NO: 289881 - RNA, 20 nt, Human
uuugguuggcuaggggaagc

SEQ ID NO: 289882 - RNA, 22 nt, Human
uuuguacuuucuaauguauuua

SEQ ID NO: 289883 - RNA, 21 nt, Human
uuucauuaguacaucaauuug

SEQ ID NO: 289884 - RNA, 22 nt, Human
uuuccagacaugguuuuucaaa

SEQ ID NO: 289885 - RNA, 22 nt, Human
uuaucagggaguuguguguucu

SEQ ID NO: 289886 - RNA, 19 nt, Human
uuauccacagggaauuuau

SEQ ID NO: 289887 - RNA, 20 nt, Human
uuauccccauucuuguucuc

SEQ ID NO: 289888 - RNA, 22 nt, Human
uuaucuuuuaaaaacacuugug

SEQ ID NO: 289889 - RNA, 22 nt, Human
uuaugccuguuaggcagcaucu

SEQ ID NO: 289890 - RNA, 22 nt, Human
uuaugggcgaugcaaaccugau

SEQ ID NO: 289891 - RNA, 22 nt, Human
uuauggauuagaguuugauucu

SEQ ID NO: 289892 - RNA, 22 nt, Human
uuucacugaguaggagagcacu

SEQ ID NO: 289893 - RNA, 22 nt, Human
uuauaucagaaggugagauuga

SEQ ID NO: 289894 - RNA, 22 nt, Human
uuauaggugauuaauuuuaacc

SEQ ID NO: 289895 - RNA, 22 nt, Human
uuaguuagucuaugccugacca

SEQ ID NO: 289896 - RNA, 22 nt, Human
uuauaagugccucuuuauuuuc

SEQ ID NO: 289897 - RNA, 22 nt, Human
uuucaucccugucagugaaggc

SEQ ID NO: 289898 - RNA, 22 nt, Human
uuauauuaaaaaucgcuaacag

SEQ ID NO: 289899 - RNA, 22 nt, Human
uuucagcaugacuguuaucuuu

SEQ ID NO: 289900 - RNA, 22 nt, Human
uuucagaaauggcacugaaauc

SEQ ID NO: 289901 - RNA, 22 nt, Human
uuaugugcuuuuugagcucuaa

SEQ ID NO: 289902 - RNA, 22 nt, Human
uuuccuguccugguacuuggca

SEQ ID NO: 289903 - RNA, 22 nt, Human
uuauguugauaggaaucugauu

SEQ ID NO: 289904 - RNA, 18 nt, Human
uuuccucauuugcagacu

SEQ ID NO: 289905 - RNA, 22 nt, Human
uuuccugacuucaccuuuuacc

SEQ ID NO: 289906 - RNA, 21 nt, Human
uuuccagaggcagccggacuc

SEQ ID NO: 289907 - RNA, 22 nt, Human
uuucuaaguuugaggcgaagca

SEQ ID NO: 289908 - RNA, 22 nt, Human
uuucucagccuccuugcuggag

SEQ ID NO: 289909 - RNA, 22 nt, Human
uuucuaaaauuacugcagucgg

SEQ ID NO: 289910 - RNA, 22 nt, Human
uuucuaaaaccagaguuuauaa

SEQ ID NO: 289911 - RNA, 22 nt, Human
uuauuguagcacuuuggcagug

SEQ ID NO: 289912 - RNA, 22 nt, Human
uuuccuuuguuuugguauaugu

SEQ ID NO: 289913 - RNA, 22 nt, Human
uuuagguccguguugcaguugg

SEQ ID NO: 289914 - RNA, 22 nt, Human
uuuaggaauuugcugggcauga

SEQ ID NO: 289915 - RNA, 22 nt, Human
uuuagcauggacacugagggcu

SEQ ID NO: 289916 - RNA, 19 nt, Human
uuuagcuacugugguauua

SEQ ID NO: 289917 - RNA, 22 nt, Human
uuacucucugaggcacucaaaa

SEQ ID NO: 289918 - RNA, 22 nt, Human
uuagaaauguccuacuaauaug

SEQ ID NO: 289919 - RNA, 21 nt, Human
uuacuggcagcagaaaccuga

SEQ ID NO: 289920 - RNA, 22 nt, Human
uuagaauggaaucauuugcauu

SEQ ID NO: 289921 - RNA, 22 nt, Human
uuuacucagucugagcaggugu

SEQ ID NO: 289922 - RNA, 22 nt, Human
uuuacuguuuacagcuaaugca

SEQ ID NO: 289923 - RNA, 19 nt, Human
uuacaugacauaugaagga

SEQ ID NO: 289924 - RNA, 22 nt, Human
uguuugaugugcacgugugugu

SEQ ID NO: 289925 - RNA, 21 nt, Human
uguuugcuuuuggagcaacug

SEQ ID NO: 289926 - RNA, 22 nt, Human
uuguauaaagauggcuagaucc

SEQ ID NO: 289927 - RNA, 22 nt, Human
uuuauauauauguaggagcaca

SEQ ID NO: 289928 - RNA, 22 nt, Human
uuaggacucuauuuggguaucu

SEQ ID NO: 289929 - RNA, 22 nt, Human
uuuaucaggccaucuuaugucu

SEQ ID NO: 289930 - RNA, 22 nt, Human
uuuauaagccagacacugcguu

SEQ ID NO: 289931 - RNA, 22 nt, Human
uuagccuccaguuuucucauuu

SEQ ID NO: 289932 - RNA, 22 nt, Human
uuagcacugucugguuaucuug

SEQ ID NO: 289933 - RNA, 22 nt, Human
uuagagauuuuauguuaaugua

SEQ ID NO: 289934 - RNA, 22 nt, Human
uuuaggauaacuccaguuuucc

SEQ ID NO: 289935 - RNA, 22 nt, Human
uuuauuuagguaaacaugaguu

SEQ ID NO: 289936 - RNA, 22 nt, Human
uuaguuauaggugaaucagaga

SEQ ID NO: 289937 - RNA, 22 nt, Human
uuuauugcuaugucuugauugu

SEQ ID NO: 289938 - RNA, 22 nt, Human
uuuauugaccugaguaucagca

SEQ ID NO: 289939 - RNA, 22 nt, Human
uuuauucuuugcuagguuccau

SEQ ID NO: 289940 - RNA, 22 nt, Human
uuucaaguagagggaucgcuag

SEQ ID NO: 289941 - RNA, 22 nt, Human
uuauaaaccgcuaacagcacuu

SEQ ID NO: 289942 - RNA, 22 nt, Human
uuucacagcgucuuucucuugc

SEQ ID NO: 289943 - RNA, 22 nt, Human
uuucacauacaguguauaguag

SEQ ID NO: 289944 - RNA, 22 nt, Human
uuuauuugugguaguguaaucu

SEQ ID NO: 289945 - RNA, 22 nt, Human
uuuauuuuccaugucucuaggu

SEQ ID NO: 289946 - RNA, 22 nt, Human
ugggucaguagccuugcagaac

SEQ ID NO: 289947 - RNA, 22 nt, Human
ugggucagauugagccccuggu

SEQ ID NO: 289948 - RNA, 22 nt, Human
uucuagcucauggugacagauc

SEQ ID NO: 289949 - RNA, 22 nt, Human
ugggguguuacacaacauugag

SEQ ID NO: 289950 - RNA, 22 nt, Human
uggggugccccccucgguuugc

SEQ ID NO: 289951 - RNA, 22 nt, Human
uucuagccauagaaauuagauu

SEQ ID NO: 289952 - RNA, 22 nt, Human
uucucagagaaagcuccucaug

SEQ ID NO: 289953 - RNA, 22 nt, Human
uucucucaguuaaacuuuguga

SEQ ID NO: 289954 - RNA, 22 nt, Human
uucucaauggcaacuuguugcu

SEQ ID NO: 289955 - RNA, 22 nt, Human
uggguccaggauucuguguuuc

SEQ ID NO: 289956 - RNA, 22 nt, Human
uucucugaagagccagcccuua

SEQ ID NO: 289957 - RNA, 18 nt, Human
uucucucuggauaguagu

SEQ ID NO: 289958 - RNA, 22 nt, Human
uucucuugccuucucuuuuauc

SEQ ID NO: 289959 - RNA, 22 nt, Human
ugggggguuuagaaucugcccu

SEQ ID NO: 289960 - RNA, 22 nt, Human
ugggggauucaucucagagcgu

SEQ ID NO: 289961 - RNA, 22 nt, Human
ugggggaugacuugcucuuuca

SEQ ID NO: 289962 - RNA, 22 nt, Human
ugggggaggaggagacagacug

SEQ ID NO: 289963 - RNA, 22 nt, Human
uggggcuuucgcggagcgucgg

SEQ ID NO: 289964 - RNA, 22 nt, Human
uucgucauuaugcagccuguga

SEQ ID NO: 289965 - RNA, 22 nt, Human
uucguucagcgcuugcgcaugc

SEQ ID NO: 289966 - RNA, 22 nt, Human
uucuaauauuaugauuucuaag

SEQ ID NO: 289967 - RNA, 20 nt, Human
uucguuucaguguuggauca

SEQ ID NO: 289968 - RNA, 22 nt, Human
ugggcaaaugcuuuuuagucaa

SEQ ID NO: 289969 - RNA, 22 nt, Human
ugggcagggauuuggggaaacu

SEQ ID NO: 289970 - RNA, 22 nt, Human
ugggcaguccagcuggaaacgg

SEQ ID NO: 289971 - RNA, 22 nt, Human
ugggcccaucauugcugugggc

SEQ ID NO: 289972 - RNA, 22 nt, Human
ugggcuguuucuuaaggauaug

SEQ ID NO: 289973 - RNA, 22 nt, Human
uggggaauguaauucuuuggcu

SEQ ID NO: 289974 - RNA, 22 nt, Human
uggggagcucagcaccaucagu

SEQ ID NO: 289975 - RNA, 22 nt, Human
uggggagucccaacgguggaag

SEQ ID NO: 289976 - RNA, 22 nt, Human
uggggcugguaccguaauauau

SEQ ID NO: 289977 - RNA, 22 nt, Human
uucccauuccagcucgaucaau

SEQ ID NO: 289978 - RNA, 22 nt, Human
uggcuugacaucaauacuuauu

SEQ ID NO: 289979 - RNA, 22 nt, Human
uggcuugagcugggcccaccug

SEQ ID NO: 289980 - RNA, 22 nt, Human
uggcggcuggacuggggggcca

SEQ ID NO: 289981 - RNA, 22 nt, Human
uggcgcgcagccugcuggugcu

SEQ ID NO: 289982 - RNA, 22 nt, Human
uucauuagcguaggauguguac

SEQ ID NO: 289983 - RNA, 22 nt, Human
uucauuagcacauuuccuuggu

SEQ ID NO: 289984 - RNA, 21 nt, Human
uucauucauggcauaauauag

SEQ ID NO: 289985 - RNA, 22 nt, Human
uucauugcuacuuaaaauacca

SEQ ID NO: 289986 - RNA, 22 nt, Human
uucauugcagaauuuggccuca

SEQ ID NO: 289987 - RNA, 22 nt, Human
uuccagcaaagguaguguguua

SEQ ID NO: 289988 - RNA, 22 nt, Human
uggcuucagacuucugcuacgu

SEQ ID NO: 289989 - RNA, 22 nt, Human
uggcuacauuuauacucucauu

SEQ ID NO: 289990 - RNA, 22 nt, Human
uggccgaugagcaugcgcugau

SEQ ID NO: 289991 - RNA, 21 nt, Human
uggcccgagccgggguuggcu

SEQ ID NO: 289992 - RNA, 22 nt, Human
uggccccauuuuucuggagccu

SEQ ID NO: 289993 - RNA, 22 nt, Human
uucauauuguggucuugcauuc

SEQ ID NO: 289994 - RNA, 22 nt, Human
uggccucuuucuucccuuugac

SEQ ID NO: 289995 - RNA, 20 nt, Human
uggcccgcgcuccuccugcu

SEQ ID NO: 289996 - RNA, 22 nt, Human
uucauccucuaguacugaagug

SEQ ID NO: 289997 - RNA, 22 nt, Human
uucaucauuuuccauuccucuu

SEQ ID NO: 289998 - RNA, 22 nt, Human
uucaugcgcuuuucaggagugu

SEQ ID NO: 289999 - RNA, 22 nt, Human
uucaguaugcugaaugauuuuu

SEQ ID NO: 290000 - RNA, 22 nt, Human
uucaguuccucuuuugggcucu

SEQ ID NO: 290001 - RNA, 22 nt, Human
uucaguuuugcuuuuaaucaug

SEQ ID NO: 290002 - RNA, 22 nt, Human
uucagugggggcuuuccuucug

SEQ ID NO: 290003 - RNA, 22 nt, Human
uggcccagaucucugaccuuga

SEQ ID NO: 290004 - RNA, 22 nt, Human
uggccaaauuggccugauguau

SEQ ID NO: 290005 - RNA, 22 nt, Human
uucagguuuuaugguaaugcuu

SEQ ID NO: 290006 - RNA, 22 nt, Human
uucagguuauugaagagcuuuc

SEQ ID NO: 290007 - RNA, 22 nt, Human
uucaguagagguggaaauaaca

SEQ ID NO: 290008 - RNA, 22 nt, Human
uggcacugcccugucucggugg

SEQ ID NO: 290009 - RNA, 22 nt, Human
uggcacugaagcuggaaagccu

SEQ ID NO: 290010 - RNA, 22 nt, Human
uggcacguuggauugggaguuc

SEQ ID NO: 290011 - RNA, 22 nt, Human
uggcacaguuaaaguuguagaa

SEQ ID NO: 290012 - RNA, 22 nt, Human
uggcagcauuuuuuccagaaca

SEQ ID NO: 290013 - RNA, 22 nt, Human
uucacuuuuucucugcuugaga

SEQ ID NO: 290014 - RNA, 22 nt, Human
uucagaaagugaaucuuguuau

SEQ ID NO: 290015 - RNA, 22 nt, Human
uucacuguucuuagagaagacc

SEQ ID NO: 290016 - RNA, 22 nt, Human
uucacugacaguauugaggagg

SEQ ID NO: 290017 - RNA, 22 nt, Human
uucacugugauguuuaagagaa

SEQ ID NO: 290018 - RNA, 22 nt, Human
uggauuguauugauugguuggc

SEQ ID NO: 290019 - RNA, 22 nt, Human
uggauucucuguagccugguuc

SEQ ID NO: 290020 - RNA, 22 nt, Human
uggauuuuggaauguuucagua

SEQ ID NO: 290021 - RNA, 22 nt, Human
uggaugccuugggggaggagga

SEQ ID NO: 290022 - RNA, 22 nt, Human
uggaugccauuugauuaaggcu

SEQ ID NO: 290023 - RNA, 22 nt, Human
uggcaaggccacaggugcaguu

SEQ ID NO: 290024 - RNA, 22 nt, Human
uucacccaaaucaagcuggccu

SEQ ID NO: 290025 - RNA, 22 nt, Human
uggcaaacacaauauggguaca

SEQ ID NO: 290026 - RNA, 22 nt, Human
uggcaaaaccugcaauuacuuu

SEQ ID NO: 290027 - RNA, 22 nt, Human
uggcaagcuguuggcagauagc

SEQ ID NO: 290028 - RNA, 23 nt, Human
uggcaaacgggaauaaaggaauu

SEQ ID NO: 290029 - RNA, 18 nt, Human
uucaggcucuugcaugaa

SEQ ID NO: 290030 - RNA, 22 nt, Human
uucaggugguuuaagaauugga

SEQ ID NO: 290031 - RNA, 22 nt, Human
uucaggacuauccaguggucuc

SEQ ID NO: 290032 - RNA, 20 nt, Human
uucaggaccuuccaguccau

SEQ ID NO: 290033 - RNA, 22 nt, Human
uucagcugcuugccugaaguca

SEQ ID NO: 290034 - RNA, 22 nt, Human
uggcaugugaauuguuacauug

SEQ ID NO: 290035 - RNA, 18 nt, Human
uggcaugcuuugauacau

SEQ ID NO: 290036 - RNA, 21 nt, Human
uggcauacugcuaaaaagugu

SEQ ID NO: 290037 - RNA, 22 nt, Human
uucagcaagugucucuacuguc

SEQ ID NO: 290038 - RNA, 22 nt, Human
uggcauuugagcuggaaggaug

SEQ ID NO: 290039 - RNA, 22 nt, Human
uucagcacuggacagcgagucu

SEQ ID NO: 290040 - RNA, 22 nt, Human
uggcagugagauuucucuucug

SEQ ID NO: 290041 - RNA, 22 nt, Human
uggcaguaaagcuggaaaagug

SEQ ID NO: 290042 - RNA, 22 nt, Human
uggcaucacagacaaggcagca

SEQ ID NO: 290043 - RNA, 22 nt, Human
uggcaguugcaguaacuuguau

SEQ ID NO: 290044 - RNA, 22 nt, Human
uggcaucucggugcugguucuu

SEQ ID NO: 290045 - RNA, 22 nt, Human
uggcaucuggugauauggacua

SEQ ID NO: 290046 - RNA, 21 nt, Human
uggcaggcagcuggaagcuug

SEQ ID NO: 290047 - RNA, 22 nt, Human
uucagacugcccauguuugcca

SEQ ID NO: 290048 - RNA, 20 nt, Human
uucacagaggacucagguca

SEQ ID NO: 290049 - RNA, 22 nt, Human
uucaauuacaucagaaucuaaa

SEQ ID NO: 290050 - RNA, 22 nt, Human
uucaauggaauucuuagguuuc

SEQ ID NO: 290051 - RNA, 22 nt, Human
uucaaugcaagggaggucugaa

SEQ ID NO: 290052 - RNA, 22 nt, Human
uucacagugguaaggguuguga

SEQ ID NO: 290053 - RNA, 22 nt, Human
uggaucuugaugcuccaagagu

SEQ ID NO: 290054 - RNA, 20 nt, Human
uggaucaccauccuguugcu

SEQ ID NO: 290055 - RNA, 21 nt, Human
uggauauugaguaguuucuga

SEQ ID NO: 290056 - RNA, 22 nt, Human
uggaguuuuaaucuguacagaa

SEQ ID NO: 290057 - RNA, 22 nt, Human
uuauuuuuguuuguuaagccua

SEQ ID NO: 290058 - RNA, 21 nt, Human
uucaaccagcaauuggcagaa

SEQ ID NO: 290059 - RNA, 22 nt, Human
uggaguaauggguguuuuugaa

SEQ ID NO: 290060 - RNA, 22 nt, Human
uucaaaaugcagaauaguuugg

SEQ ID NO: 290061 - RNA, 22 nt, Human
uggaggauggaaggaaagcugg

SEQ ID NO: 290062 - RNA, 22 nt, Human
uggaggaugacagagaugggcu

SEQ ID NO: 290063 - RNA, 22 nt, Human
uggaggauaacacaagaaguga

SEQ ID NO: 290064 - RNA, 22 nt, Human
uggaggcccagcugggggccgg

SEQ ID NO: 290065 - RNA, 22 nt, Human
uuauuuaagaucuuaauauaua

SEQ ID NO: 290066 - RNA, 22 nt, Human
uuauuuaaguauuuauugaagu

SEQ ID NO: 290067 - RNA, 22 nt, Human
uuauuuuauaaagagaagacuu

SEQ ID NO: 290068 - RNA, 22 nt, Human
uuauuugguuuuggcuuuagcu

SEQ ID NO: 290069 - RNA, 22 nt, Human
uuauuuuguagcucugaucuuu

SEQ ID NO: 290070 - RNA, 22 nt, Human
uuauuucuucucgaagcuuggg

SEQ ID NO: 290071 - RNA, 22 nt, Human
uuauuugcccauguuuagcaga

SEQ ID NO: 290072 - RNA, 22 nt, Human
uuauuucaggcauuuguaaaug

SEQ ID NO: 290073 - RNA, 22 nt, Human
uguugaagcaccucugucuuuc

SEQ ID NO: 290074 - RNA, 22 nt, Human
ugcuauuaagagaaagugaaca

SEQ ID NO: 290075 - RNA, 22 nt, Human
uuaugugcuacacauaauuugu

SEQ ID NO: 290076 - RNA, 22 nt, Human
uuauuguuuggguauaauuuga

SEQ ID NO: 290077 - RNA, 22 nt, Human
uuauuuaaaauguagguuggga

SEQ ID NO: 290078 - RNA, 22 nt, Human
uggagcugguucuggggaagcu

SEQ ID NO: 290079 - RNA, 22 nt, Human
uuauuggcagcuccugcacaug

SEQ ID NO: 290080 - RNA, 22 nt, Human
uuauucuuagccucgguauuuc

SEQ ID NO: 290081 - RNA, 22 nt, Human
uuauuaauacaugcaccugcau

SEQ ID NO: 290082 - RNA, 22 nt, Human
uucuuaaugcauccuguguuca

SEQ ID NO: 290083 - RNA, 22 nt, Human
uucugcauaggcuauauuuguu

SEQ ID NO: 290084 - RNA, 22 nt, Human
uggugcagacaggagccccgcu

SEQ ID NO: 290085 - RNA, 22 nt, Human
uucugcccuugccagacaagua

SEQ ID NO: 290086 - RNA, 22 nt, Human
uucuguuuaaccuggaaagugu

SEQ ID NO: 290087 - RNA, 22 nt, Human
uucuguguauggaagaaugucc

SEQ ID NO: 290088 - RNA, 20 nt, Human
uucugcagcagguguugaag

SEQ ID NO: 290089 - RNA, 22 nt, Human
uucugaaggcaggggcuaucuu

SEQ ID NO: 290090 - RNA, 22 nt, Human
ugguggccucaguggcuucugu

SEQ ID NO: 290091 - RNA, 22 nt, Human
uggugguaggggugguuucuga

SEQ ID NO: 290092 - RNA, 20 nt, Human
ugguguacauuuccauaguu

SEQ ID NO: 290093 - RNA, 22 nt, Human
uucuuccagugaaacgugcauc

SEQ ID NO: 290094 - RNA, 22 nt, Human
ugguggcaauuuuuggggucaa

SEQ ID NO: 290095 - RNA, 22 nt, Human
uucuucgacuguauaaaaguau

SEQ ID NO: 290096 - RNA, 22 nt, Human
uucuuacuaaguagaguacuca

SEQ ID NO: 290097 - RNA, 22 nt, Human
ugguuuguauauguuugugaga

SEQ ID NO: 290098 - RNA, 21 nt, Human
ugguuuuaucuugguggcugc

SEQ ID NO: 290099 - RNA, 22 nt, Human
uguaaagaaagacgcagaguua

SEQ ID NO: 290100 - RNA, 22 nt, Human
uguaaagguuuuagagcagaga

SEQ ID NO: 290101 - RNA, 22 nt, Human
ugguuuuuuguaggauaaacau

SEQ ID NO: 290102 - RNA, 23 nt, Human
uguaaaacaccguuauugcaccu

SEQ ID NO: 290103 - RNA, 15 nt, Human
ugguuucagaugaug

SEQ ID NO: 290104 - RNA, 22 nt, Human
ugguuuacucuguaaaccagga

SEQ ID NO: 290105 - RNA, 22 nt, Human
uucuuugcccauguuuccuaag

SEQ ID NO: 290106 - RNA, 22 nt, Human
uugaaaacugucaccuuuauuc

SEQ ID NO: 290107 - RNA, 22 nt, Human
uugaaaauuaauagguguacaa

SEQ ID NO: 290108 - RNA, 22 nt, Human
uguauaugucugugagcuauua

SEQ ID NO: 290109 - RNA, 22 nt, Human
uugaacaguuuugucagguuca

SEQ ID NO: 290110 - RNA, 19 nt, Human
ugugaagaccucagugcgg

SEQ ID NO: 290111 - RNA, 22 nt, Human
ugucugcauucgaguucaugga

SEQ ID NO: 290112 - RNA, 22 nt, Human
uugcaagcccugaagggcugga

SEQ ID NO: 290113 - RNA, 22 nt, Human
uugcacagaugcacaugguugc

SEQ ID NO: 290114 - RNA, 22 nt, Human
uugcaagauaguguauuuuuca

SEQ ID NO: 290115 - RNA, 23 nt, Human
ugucugccuaucaugugaaggac

SEQ ID NO: 290116 - RNA, 22 nt, Human
uugcagaauucuucccacucag

SEQ ID NO: 290117 - RNA, 22 nt, Human
ugugaaugacuuuguucuuugc

SEQ ID NO: 290118 - RNA, 22 nt, Human
uugccuagugguagugacuguu

SEQ ID NO: 290119 - RNA, 22 nt, Human
uugccuacaaacgaaucuaucu

SEQ ID NO: 290120 - RNA, 22 nt, Human
ugugaugagaugaacuguagac

SEQ ID NO: 290121 - RNA, 22 nt, Human
ugugagcugccacuucuaaucu

SEQ ID NO: 290122 - RNA, 22 nt, Human
ugucacggccggguggcaccga

SEQ ID NO: 290123 - RNA, 22 nt, Human
ugucaguuugucaaauacccca

SEQ ID NO: 290124 - RNA, 22 nt, Human
uugauggaggaaaaguuggaau

SEQ ID NO: 290125 - RNA, 22 nt, Human
uugaugagucacuuucuguaaa

SEQ ID NO: 290126 - RNA, 21 nt, Human
ugucaucucuaaaaagauugu

SEQ ID NO: 290127 - RNA, 22 nt, Human
uugauuuccauuguccagcauu

SEQ ID NO: 290128 - RNA, 22 nt, Human
ugucaucuuggugcugugagag

SEQ ID NO: 290129 - RNA, 22 nt, Human
ugucauggacuggauuucugcu

SEQ ID NO: 290130 - RNA, 21 nt, Human
uugauuuagcagaucuagcug

SEQ ID NO: 290131 - RNA, 22 nt, Human
uguauauuccagggguagggcc

SEQ ID NO: 290132 - RNA, 22 nt, Human
uguaucucugacacagucucac

SEQ ID NO: 290133 - RNA, 22 nt, Human
uguaucuguguguauguguuua

SEQ ID NO: 290134 - RNA, 22 nt, Human
uguauauguguguagcauguua

SEQ ID NO: 290135 - RNA, 22 nt, Human
uguauuuuuucccugaaauaaa

SEQ ID NO: 290136 - RNA, 22 nt, Human
uguugguuucaagcaggagccu

SEQ ID NO: 290137 - RNA, 22 nt, Human
uguugucaugcagucaguggua

SEQ ID NO: 290138 - RNA, 22 nt, Human
uugguguaauacaagcaauuug

SEQ ID NO: 290139 - RNA, 22 nt, Human
uugguuaccuucagaaaugagu

SEQ ID NO: 290140 - RNA, 22 nt, Human
uugguguuucacuuccuugucg

SEQ ID NO: 290141 - RNA, 22 nt, Human
uguuucaguaugauuuucccuc

SEQ ID NO: 290142 - RNA, 22 nt, Human
uuguagccaugucacaagcaca

SEQ ID NO: 290143 - RNA, 22 nt, Human
uuguacccaccuuggggccuca

SEQ ID NO: 290144 - RNA, 22 nt, Human
uugguuccauuuuaccagcucu

SEQ ID NO: 290145 - RNA, 22 nt, Human
uuguacaaauaggaaccucuga

SEQ ID NO: 290146 - RNA, 19 nt, Human
uuggugaagguucacugac

SEQ ID NO: 290147 - RNA, 22 nt, Human
uguugagaacaucucggggaca

SEQ ID NO: 290148 - RNA, 19 nt, Human
uguugcagcuugaucggua

SEQ ID NO: 290149 - RNA, 22 nt, Human
uguugcauguggcuguuugcca

SEQ ID NO: 290150 - RNA, 22 nt, Human
uuggugaugaaagugcugcgcu

SEQ ID NO: 290151 - RNA, 22 nt, Human
uuggugaugcuaggaauguagu

SEQ ID NO: 290152 - RNA, 22 nt, Human
uuggugaugcccaccuuuucau

SEQ ID NO: 290153 - RNA, 21 nt, Human
uguuggccuucauucucuguc

SEQ ID NO: 290154 - RNA, 23 nt, Human
uguuggcucccagucucccccuc

SEQ ID NO: 290155 - RNA, 22 nt, Human
uguuggcagugcuacagucagu

SEQ ID NO: 290156 - RNA, 22 nt, Human
uuggugauguagcagcaauugu

SEQ ID NO: 290157 - RNA, 22 nt, Human
uuggcuucuugcuaggaagcug

SEQ ID NO: 290158 - RNA, 22 nt, Human
uuggccaaggaccuuuuuggag

SEQ ID NO: 290159 - RNA, 22 nt, Human
uuggcuguguugaaaacgugga

SEQ ID NO: 290160 - RNA, 22 nt, Human
uuggccguuucacugggcaguu

SEQ ID NO: 290161 - RNA, 22 nt, Human
uuggccugcuccagaacaaggg

SEQ ID NO: 290162 - RNA, 22 nt, Human
uguuaacugccaggacagaucg

SEQ ID NO: 290163 - RNA, 22 nt, Human
uugggauucugucagugugugu

SEQ ID NO: 290164 - RNA, 22 nt, Human
uugggagaaauaguugauccgc

SEQ ID NO: 290165 - RNA, 22 nt, Human
uguuccacgcguaguuccugcu

SEQ ID NO: 290166 - RNA, 22 nt, Human
uugggcauuucuuauguauuuu

SEQ ID NO: 290167 - RNA, 22 nt, Human
uugggauuggugggguggguuu

SEQ ID NO: 290168 - RNA, 22 nt, Human
uugggcuagaaacaacgugggu

SEQ ID NO: 290169 - RNA, 22 nt, Human
uguugauuaauuuucccaaaca

SEQ ID NO: 290170 - RNA, 22 nt, Human
uguugaaacagcuauugacuuu

SEQ ID NO: 290171 - RNA, 22 nt, Human
uuggucaagacugauaucaaga

SEQ ID NO: 290172 - RNA, 22 nt, Human
uguucuuaacuuuuguguauau

SEQ ID NO: 290173 - RNA, 22 nt, Human
uguucuucaaacucaguuccac

SEQ ID NO: 290174 - RNA, 22 nt, Human
uugcuugcggccuuugugccuu

SEQ ID NO: 290175 - RNA, 23 nt, Human
uugcuugagcccaggaaguggag

SEQ ID NO: 290176 - RNA, 22 nt, Human
uugcuuuuugggguuuacuggg

SEQ ID NO: 290177 - RNA, 23 nt, Human
uugcuuuugccccaaaagaguua

SEQ ID NO: 290178 - RNA, 22 nt, Human
ugugggcugcuguuuccuugua

SEQ ID NO: 290179 - RNA, 22 nt, Human
uguggucuccucucugucuucc

SEQ ID NO: 290180 - RNA, 22 nt, Human
uguggugacuugagcuuccuaa

SEQ ID NO: 290181 - RNA, 22 nt, Human
uuggaaaagaaauacucauaua

SEQ ID NO: 290182 - RNA, 22 nt, Human
uugcuuuuuuggguuuacuggg

SEQ ID NO: 290183 - RNA, 22 nt, Human
ugugguuuguaagcaaagcaaa

SEQ ID NO: 290184 - RNA, 22 nt, Human
ugugguuggggucagauaggga

SEQ ID NO: 290185 - RNA, 20 nt, Human
uuggagaucacguguccagg

SEQ ID NO: 290186 - RNA, 22 nt, Human
uguguggaaaugcuguauaugu

SEQ ID NO: 290187 - RNA, 22 nt, Human
uguguggccuccauaggguacu

SEQ ID NO: 290188 - RNA, 22 nt, Human
ugugugguaaugagagauccaa

SEQ ID NO: 290189 - RNA, 22 nt, Human
uuggaggaagcucaugggggau

SEQ ID NO: 290190 - RNA, 22 nt, Human
uuggagagggugggcuuugaag

SEQ ID NO: 290191 - RNA, 21 nt, Human
uugcuggagcaauguaaauca

SEQ ID NO: 290192 - RNA, 22 nt, Human
ugugcuugucuguuuugauugu

SEQ ID NO: 290193 - RNA, 22 nt, Human
uguggacaccuauuaccaguga

SEQ ID NO: 290194 - RNA, 22 nt, Human
uguggccaccagagcugcuauu

SEQ ID NO: 290195 - RNA, 22 nt, Human
uguggcucugaugucauaaagg

SEQ ID NO: 290196 - RNA, 22 nt, Human
uugcugugucauuuguuuaauc

SEQ ID NO: 290197 - RNA, 22 nt, Human
uugcugguggcucugauuucau

SEQ ID NO: 290198 - RNA, 18 nt, Human
uugcucucucugggggca

SEQ ID NO: 290199 - RNA, 22 nt, Human
ugugcagugcguggguguugaa

SEQ ID NO: 290200 - RNA, 22 nt, Human
ugugcaguauugaaauauaugu

SEQ ID NO: 290201 - RNA, 22 nt, Human
ugugcuaauguuaggauugaau

SEQ ID NO: 290202 - RNA, 22 nt, Human
uugcucuuaccauuauguguga

SEQ ID NO: 290203 - RNA, 22 nt, Human
ugugcuugucguggagccaggc

SEQ ID NO: 290204 - RNA, 22 nt, Human
ugugcuggcuucugugagcuga

SEQ ID NO: 290205 - RNA, 22 nt, Human
ugcauucugaacguaaauguga

SEQ ID NO: 290206 - RNA, 22 nt, Human
ugccauagaaguccaacccaau

SEQ ID NO: 290207 - RNA, 22 nt, Human
ugccagugugccuuccgcucac

SEQ ID NO: 290208 - RNA, 22 nt, Human
ugccaaagauagagguuugagu

SEQ ID NO: 290209 - RNA, 22 nt, Human
ugcccacuucaaaaucuucauu

SEQ ID NO: 290210 - RNA, 22 nt, Human
ugcccacaggaagacaccagcg

SEQ ID NO: 290211 - RNA, 22 nt, Human
ugugggaucauggaucagggcc

SEQ ID NO: 290212 - RNA, 22 nt, Human
ugugggcguggguuggggaggg

SEQ ID NO: 290213 - RNA, 22 nt, Human
ugccauuggucuuaaggcuagc

SEQ ID NO: 290214 - RNA, 22 nt, Human
uguguauaugugugugugugug

SEQ ID NO: 290215 - RNA, 22 nt, Human
ugugugggcgaagacagccuuu

SEQ ID NO: 290216 - RNA, 21 nt, Human
uguguaccuucuuccgagcuc

SEQ ID NO: 290217 - RNA, 22 nt, Human
uguguaacaacauaaugguuau

SEQ ID NO: 290218 - RNA, 22 nt, Human
uguggugcagcgggaacagcuu

SEQ ID NO: 290219 - RNA, 22 nt, Human
ugccucuccaagcuuccuaagg

SEQ ID NO: 290220 - RNA, 22 nt, Human
ugccuacuuuaguacuuuaaag

SEQ ID NO: 290221 - RNA, 22 nt, Human
uguguguauauauuuuuauaug

SEQ ID NO: 290222 - RNA, 22 nt, Human
uguguguauauauauguaucau

SEQ ID NO: 290223 - RNA, 22 nt, Human
uguggugcucagggaggauggg

SEQ ID NO: 290224 - RNA, 22 nt, Human
ugccgggcugagcaagugcugc

SEQ ID NO: 290225 - RNA, 22 nt, Human
ugccuaaaccauuccccuuccu

SEQ ID NO: 290226 - RNA, 22 nt, Human
uguggguggucagcgugugaug

SEQ ID NO: 290227 - RNA, 22 nt, Human
ugugguagagcuuaaaugaggu

SEQ ID NO: 290228 - RNA, 22 nt, Human
ugcacugccuuucuuggcauga

SEQ ID NO: 290229 - RNA, 20 nt, Human
ugcacggcugugugugugca

SEQ ID NO: 290230 - RNA, 22 nt, Human
ugucuuaaaauuuuagggcuau

SEQ ID NO: 290231 - RNA, 22 nt, Human
ugcaggagcccaggaauacuau

SEQ ID NO: 290232 - RNA, 22 nt, Human
ugugcaucuggaggcaauguuu

SEQ ID NO: 290233 - RNA, 22 nt, Human
ugugccuuucacuaugucauuc

SEQ ID NO: 290234 - RNA, 22 nt, Human
ugugggaggauuuaggugaauc

SEQ ID NO: 290235 - RNA, 22 nt, Human
uguggcuuaggugagcauguga

SEQ ID NO: 290236 - RNA, 18 nt, Human
ugcaggggaggggugaua

SEQ ID NO: 290237 - RNA, 22 nt, Human
ugcauuauaacaauaaggcuua

SEQ ID NO: 290238 - RNA, 22 nt, Human
ugcauaaauauuguugggagua

SEQ ID NO: 290239 - RNA, 22 nt, Human
ugcagugcagcuggaauaucuu

SEQ ID NO: 290240 - RNA, 22 nt, Human
ugcauugccauagcagggggau

SEQ ID NO: 290241 - RNA, 22 nt, Human
ugcauugccucuauucauuaua

SEQ ID NO: 290242 - RNA, 19 nt, Human
ugcgggcugcggucagggc

SEQ ID NO: 290243 - RNA, 23 nt, Human
uguuccugaugccucguccuguc

SEQ ID NO: 290244 - RNA, 22 nt, Human
ugcgccuccugcugccugcccu

SEQ ID NO: 290245 - RNA, 22 nt, Human
uguucugaggaggguuucaagg

SEQ ID NO: 290246 - RNA, 22 nt, Human
ugcggugcgcccgggcgagugc

SEQ ID NO: 290247 - RNA, 22 nt, Human
uguucuuacuaaguaccugaaa

SEQ ID NO: 290248 - RNA, 22 nt, Human
ugcguggauuuaggagugaggg

SEQ ID NO: 290249 - RNA, 22 nt, Human
ugcguugaggaccgcgagggcg

SEQ ID NO: 290250 - RNA, 22 nt, Human
ugcuaaugagugcugugugaag

SEQ ID NO: 290251 - RNA, 22 nt, Human
ugcuaaugaauggaggaucuga

SEQ ID NO: 290252 - RNA, 22 nt, Human
ugcguuuaguuucaagacacgu

SEQ ID NO: 290253 - RNA, 22 nt, Human
uguugaucucuuuccaaauucu

SEQ ID NO: 290254 - RNA, 22 nt, Human
uguugccaucuaaaauguuacu

SEQ ID NO: 290255 - RNA, 22 nt, Human
uguguguuguuuugccagaaua

SEQ ID NO: 290256 - RNA, 22 nt, Human
ugccuggacgacaucacaguga

SEQ ID NO: 290257 - RNA, 23 nt, Human
ugugugugugugugugugugugu

SEQ ID NO: 290258 - RNA, 22 nt, Human
uguguuuaaacuauaugccugc

SEQ ID NO: 290259 - RNA, 22 nt, Human
uguguuguuuggggauguccau

SEQ ID NO: 290260 - RNA, 17 nt, Human
ugccuucgucuucaguu

SEQ ID NO: 290261 - RNA, 22 nt, Human
uguguuucggauagcagauucu

SEQ ID NO: 290262 - RNA, 23 nt, Human
uguuaucacauguuccuuuaaau

SEQ ID NO: 290263 - RNA, 22 nt, Human
uguucaguuugcuaucauaauc

SEQ ID NO: 290264 - RNA, 22 nt, Human
uguucccgaugacaggaccagg

SEQ ID NO: 290265 - RNA, 22 nt, Human
uguuaacuuagcugaccuuaaa

SEQ ID NO: 290266 - RNA, 22 nt, Human
uguguuucucugaggggucccu

SEQ ID NO: 290267 - RNA, 22 nt, Human
uguguuuuucauuuuaaguccu

SEQ ID NO: 290268 - RNA, 22 nt, Human
uguuaaaaagucccuguuuugu

SEQ ID NO: 290269 - RNA, 22 nt, Human
ugccuuuggcuguucugugacc

SEQ ID NO: 290270 - RNA, 22 nt, Human
ugcgccaggacacccguggcgg

SEQ ID NO: 290271 - RNA, 22 nt, Human
ugcgccccgcgggccuucgggc

SEQ ID NO: 290272 - RNA, 22 nt, Human
uggggguuggaguccccaaggu

SEQ ID NO: 290273 - RNA, 20 nt, Human
ugggggugcccaucuccccu

SEQ ID NO: 290274 - RNA, 22 nt, Human
ugggguuuuagagcaggcagag

SEQ ID NO: 290275 - RNA, 22 nt, Human
ugggggcacccagccgaugagg

SEQ ID NO: 290276 - RNA, 22 nt, Human
ugggggauauggcuccauacuu

SEQ ID NO: 290277 - RNA, 22 nt, Human
ugagccauguucaugagguuca

SEQ ID NO: 290278 - RNA, 22 nt, Human
ugagccugaguguguauugaac

SEQ ID NO: 290279 - RNA, 22 nt, Human
ugaccgucagcugucuuccauu

SEQ ID NO: 290280 - RNA, 22 nt, Human
ugacauuugagagagauauaca

SEQ ID NO: 290281 - RNA, 22 nt, Human
ugacaucuagauaaaugggaca

SEQ ID NO: 290282 - RNA, 22 nt, Human
ugacaucagacugugagaagag

SEQ ID NO: 290283 - RNA, 19 nt, Human
ugaggauugagguccagua

SEQ ID NO: 290284 - RNA, 22 nt, Human
uggugcuuuuguggaugcuaac

SEQ ID NO: 290285 - RNA, 22 nt, Human
ugguggaggugggggguauuuu

SEQ ID NO: 290286 - RNA, 19 nt, Human
ugguggaggugcaccugac

SEQ ID NO: 290287 - RNA, 22 nt, Human
uggugcaggauuuauuuaacua

SEQ ID NO: 290288 - RNA, 23 nt, Human
uggugcagcgcaggccggguggc

SEQ ID NO: 290289 - RNA, 22 nt, Human
ugagccauguucaugaguucau

SEQ ID NO: 290290 - RNA, 22 nt, Human
ugaggaagugguuguaugguuu

SEQ ID NO: 290291 - RNA, 22 nt, Human
uguaaauucuauacacuuaaaa

SEQ ID NO: 290292 - RNA, 22 nt, Human
ugaugaugaagaaauauuauca

SEQ ID NO: 290293 - RNA, 22 nt, Human
ugaugaucaugcagguugguuu

SEQ ID NO: 290294 - RNA, 22 nt, Human
uguacauacauagauauacaca

SEQ ID NO: 290295 - RNA, 22 nt, Human
uguacagauaucaggagugagg

SEQ ID NO: 290296 - RNA, 22 nt, Human
ugaugaugauacauuucuucag

SEQ ID NO: 290297 - RNA, 22 nt, Human
uguaauuugguuagauuucuuu

SEQ ID NO: 290298 - RNA, 22 nt, Human
uguaaacuuuugcauacugcuu

SEQ ID NO: 290299 - RNA, 22 nt, Human
ugaguuucuuacucaggagcug

SEQ ID NO: 290300 - RNA, 22 nt, Human
ugaucaacagggcuggaaagag

SEQ ID NO: 290301 - RNA, 22 nt, Human
ugguugugcucuguuugaaagu

SEQ ID NO: 290302 - RNA, 22 nt, Human
ugguugguuaaugugcccauuu

SEQ ID NO: 290303 - RNA, 18 nt, Human
ugguuggugggggugaag

SEQ ID NO: 290304 - RNA, 22 nt, Human
ugguugcaguggugcuuauaca

SEQ ID NO: 290305 - RNA, 22 nt, Human
ugguugugcuucuuugccucag

SEQ ID NO: 290306 - RNA, 22 nt, Human
ugagugugugucuuggguaccg

SEQ ID NO: 290307 - RNA, 22 nt, Human
ugagugugugcugcuuacauuc

SEQ ID NO: 290308 - RNA, 22 nt, Human
ugaguguuguaaccauaugauu

SEQ ID NO: 290309 - RNA, 22 nt, Human
ugagguuacauuaggaauaacc

SEQ ID NO: 290310 - RNA, 22 nt, Human
uggugugggauccugggaagga

SEQ ID NO: 290311 - RNA, 22 nt, Human
ugaggggucuccuaccaugaug

SEQ ID NO: 290312 - RNA, 22 nt, Human
ugcaagagcccaaacuauauac

SEQ ID NO: 290313 - RNA, 21 nt, Human
ugcaacugaaaggaauauggu

SEQ ID NO: 290314 - RNA, 22 nt, Human
ugcaagauccagucuugagaag

SEQ ID NO: 290315 - RNA, 22 nt, Human
ugcaaauucuuuacucugugau

SEQ ID NO: 290316 - RNA, 22 nt, Human
ugucauuuauucucuuauucua

SEQ ID NO: 290317 - RNA, 22 nt, Human
uguccagcuauauguguaugug

SEQ ID NO: 290318 - RNA, 22 nt, Human
ugcacagagggaggcauaaaau

SEQ ID NO: 290319 - RNA, 22 nt, Human
ugcacccacuuagcugaaguuc

SEQ ID NO: 290320 - RNA, 20 nt, Human
ugucugguaagacgcccauc

SEQ ID NO: 290321 - RNA, 22 nt, Human
ugcaaaaagagcgaggagcccu

SEQ ID NO: 290322 - RNA, 22 nt, Human
ugauuuguuuaaauugcucguu

SEQ ID NO: 290323 - RNA, 22 nt, Human
uguauuugaagaaagagcuucu

SEQ ID NO: 290324 - RNA, 22 nt, Human
uguauuuauuuuucaacuacca

SEQ ID NO: 290325 - RNA, 19 nt, Human
uguauuuauauuucugugc

SEQ ID NO: 290326 - RNA, 22 nt, Human
uguauugugggugucagagugc

SEQ ID NO: 290327 - RNA, 22 nt, Human
ugauucuuugaccaaaaaauug

SEQ ID NO: 290328 - RNA, 22 nt, Human
ugauugaauaauguuaugugaa

SEQ ID NO: 290329 - RNA, 22 nt, Human
ugaucaguacuguaugagggau

SEQ ID NO: 290330 - RNA, 22 nt, Human
ugauggaucuguuggcggguuu

SEQ ID NO: 290331 - RNA, 22 nt, Human
ugauggugagaugucccguguu

SEQ ID NO: 290332 - RNA, 22 nt, Human
uguagcaauauaucagugcaca

SEQ ID NO: 290333 - RNA, 22 nt, Human
uguaggcacauguauauauccc

SEQ ID NO: 290334 - RNA, 22 nt, Human
uguagcucaaggaauuguucuc

SEQ ID NO: 290335 - RNA, 22 nt, Human
uguagugaaauuaaaccaaagc

SEQ ID NO: 290336 - RNA, 21 nt, Human
uguauacacacauuguaccaa

SEQ ID NO: 290337 - RNA, 22 nt, Human
ugauuagccguccuuuuauuaa

SEQ ID NO: 290338 - RNA, 20 nt, Human
ugauuauuccaacaagaaug

SEQ ID NO: 290339 - RNA, 22 nt, Human
ugauuagauacuucagaugaca

SEQ ID NO: 290340 - RNA, 22 nt, Human
ugaugugugaauucuuaaaugu

SEQ ID NO: 290341 - RNA, 22 nt, Human
ugauguggaucuauaacuguaa

SEQ ID NO: 290342 - RNA, 22 nt, Human
uguauauuuucuguauaaaaua

SEQ ID NO: 290343 - RNA, 22 nt, Human
uguauggguaggaaacagcugg

SEQ ID NO: 290344 - RNA, 22 nt, Human
uguauguguuuuauguguguuu

SEQ ID NO: 290345 - RNA, 22 nt, Human
uguauugaggauucauuuuugu

SEQ ID NO: 290346 - RNA, 22 nt, Human
ugaaauugaguaccucuuuaua

SEQ ID NO: 290347 - RNA, 22 nt, Human
ugaacagacuauucucccaugu

SEQ ID NO: 290348 - RNA, 22 nt, Human
uggcuuuugaaaaggugaugua

SEQ ID NO: 290349 - RNA, 22 nt, Human
ugaaaggaauuuaaauguuguu

SEQ ID NO: 290350 - RNA, 22 nt, Human
uggcuuauggguccucccucuu

SEQ ID NO: 290351 - RNA, 22 nt, Human
ugaaagcuggcucugcagagug

SEQ ID NO: 290352 - RNA, 22 nt, Human
uggcuucuggccaggcacagga

SEQ ID NO: 290353 - RNA, 22 nt, Human
uggcugagcugcagcguggcuu

SEQ ID NO: 290354 - RNA, 22 nt, Human
uggcucuucucaagcauuggcu

SEQ ID NO: 290355 - RNA, 23 nt, Human
uggcucugagcuuccugguggcc

SEQ ID NO: 290356 - RNA, 22 nt, Human
uggcucaguaaucgagucuccu

SEQ ID NO: 290357 - RNA, 19 nt, Human
ucuuugcuuuucuaagagg

SEQ ID NO: 290358 - RNA, 22 nt, Human
ucuuuguuagucagaauugauc

SEQ ID NO: 290359 - RNA, 22 nt, Human
ucuuugcugacacuuacacugu

SEQ ID NO: 290360 - RNA, 22 nt, Human
ucuuuuaucuguuguguaacaa

SEQ ID NO: 290361 - RNA, 22 nt, Human
ucuuuucagccagcugguagga

SEQ ID NO: 290362 - RNA, 22 nt, Human
ugaaagccuacagcucacuguu

SEQ ID NO: 290363 - RNA, 22 nt, Human
uggcuuuuuauuccuaugugau

SEQ ID NO: 290364 - RNA, 22 nt, Human
ugggaaaauagcuauuuugaaa

SEQ ID NO: 290365 - RNA, 22 nt, Human
ugaacagugugagggugugacc

SEQ ID NO: 290366 - RNA, 22 nt, Human
ugaaccgcuucauggugccugu

SEQ ID NO: 290367 - RNA, 22 nt, Human
ugaacauuuuugcuugcagcuu

SEQ ID NO: 290368 - RNA, 22 nt, Human
ugaacuaauguuguguccuaau

SEQ ID NO: 290369 - RNA, 22 nt, Human
ugaacuguccuuguugucuaga

SEQ ID NO: 290370 - RNA, 22 nt, Human
ugggaagcugagccucgaugug

SEQ ID NO: 290371 - RNA, 22 nt, Human
ugggagccuuccacugggggaa

SEQ ID NO: 290372 - RNA, 22 nt, Human
ugaacuuacauugaggaauucu

SEQ ID NO: 290373 - RNA, 22 nt, Human
ugggagagaaauuuaaguuuuu

SEQ ID NO: 290374 - RNA, 18 nt, Human
ugggacucugacuugguu

SEQ ID NO: 290375 - RNA, 22 nt, Human
ugggaauuuaugagaaaauaua

SEQ ID NO: 290376 - RNA, 22 nt, Human
ugaagccaugcuaaauguuaca

SEQ ID NO: 290377 - RNA, 23 nt, Human
ugggagcuauguuuggaaugggg

SEQ ID NO: 290378 - RNA, 22 nt, Human
ugggauauagaauuggcagagu

SEQ ID NO: 290379 - RNA, 22 nt, Human
ugggaugagcuauauagaaagu

SEQ ID NO: 290380 - RNA, 22 nt, Human
ugaagccacacuagcuuguccu

SEQ ID NO: 290381 - RNA, 22 nt, Human
ugaagacuucuuuuggucacca

SEQ ID NO: 290382 - RNA, 22 nt, Human
ugaagacaguuuuacucaugag

SEQ ID NO: 290383 - RNA, 22 nt, Human
ugggauggacuuuagagaaucg

SEQ ID NO: 290384 - RNA, 22 nt, Human
ugggauucugaaaauggauuac

SEQ ID NO: 290385 - RNA, 22 nt, Human
ugaaggccagggauuugcagcc

SEQ ID NO: 290386 - RNA, 22 nt, Human
ugggccacguggagucuguagg

SEQ ID NO: 290387 - RNA, 22 nt, Human
ugggcagagggugaggaaggcg

SEQ ID NO: 290388 - RNA, 22 nt, Human
ugggcagggagcuggaaccaca

SEQ ID NO: 290389 - RNA, 22 nt, Human
ugaagguggcuugcagcuaguc

SEQ ID NO: 290390 - RNA, 22 nt, Human
ugggcacacugaaucugcuauu

SEQ ID NO: 290391 - RNA, 21 nt, Human
ugaagggugagauauaaguga

SEQ ID NO: 290392 - RNA, 23 nt, Human
ugaagugaaauuucacaagggac

SEQ ID NO: 290393 - RNA, 22 nt, Human
uggggaagaacuugccauuuca

SEQ ID NO: 290394 - RNA, 22 nt, Human
ugggccccucuucuucaguugg

SEQ ID NO: 290395 - RNA, 23 nt, Human
ugggccucuccacccuuuucugu

SEQ ID NO: 290396 - RNA, 22 nt, Human
ugggccaaaugucugcauaagu

SEQ ID NO: 290397 - RNA, 22 nt, Human
ugaauaaauaaacuuuuacuac

SEQ ID NO: 290398 - RNA, 22 nt, Human
ugaauagucaaagcacaagagg

SEQ ID NO: 290399 - RNA, 22 nt, Human
ugacacacagggggauggaguu

SEQ ID NO: 290400 - RNA, 22 nt, Human
ugacacagaccaaguggugcug

SEQ ID NO: 290401 - RNA, 22 nt, Human
ugacaguuugacugcaaccuuu

SEQ ID NO: 290402 - RNA, 22 nt, Human
ugaauguggucaggaaauuguu

SEQ ID NO: 290403 - RNA, 22 nt, Human
ugaauguguacacgauuguuug

SEQ ID NO: 290404 - RNA, 22 nt, Human
ugaauuacacugggaucagggc

SEQ ID NO: 290405 - RNA, 22 nt, Human
ugaauucaaacuuuuuaacaag

SEQ ID NO: 290406 - RNA, 22 nt, Human
ugaauuucuuuuuaaaauauua

SEQ ID NO: 290407 - RNA, 22 nt, Human
ugaauuuguaggaauucuccau

SEQ ID NO: 290408 - RNA, 22 nt, Human
uggggcuuggcucacagaagcu

SEQ ID NO: 290409 - RNA, 22 nt, Human
uggggcuccaguagagaaggca

SEQ ID NO: 290410 - RNA, 22 nt, Human
uggggcuggccaggaggagucu

SEQ ID NO: 290411 - RNA, 22 nt, Human
uggggcgccuggcugaggcugc

SEQ ID NO: 290412 - RNA, 22 nt, Human
uggggcgcaggcccagcgggcu

SEQ ID NO: 290413 - RNA, 22 nt, Human
ugaaucuuguuuacugauuccu

SEQ ID NO: 290414 - RNA, 22 nt, Human
ugaaucugagccugcgcaaagu

SEQ ID NO: 290415 - RNA, 22 nt, Human
ugaauggugcccuagagggaug

SEQ ID NO: 290416 - RNA, 22 nt, Human
ugaaugcuacccugcuggcucu

SEQ ID NO: 290417 - RNA, 22 nt, Human
uggccucauggccuuaucuggg

SEQ ID NO: 290418 - RNA, 22 nt, Human
ucuuucucauccaaacuaguug

SEQ ID NO: 290419 - RNA, 23 nt, Human
ucuuuccuuucauacagucagcu

SEQ ID NO: 290420 - RNA, 22 nt, Human
ucuuuccagaccagccccagcu

SEQ ID NO: 290421 - RNA, 22 nt, Human
ucuuuaucugugagcagucucc

SEQ ID NO: 290422 - RNA, 19 nt, Human
ucuuucauuucuagcucug

SEQ ID NO: 290423 - RNA, 22 nt, Human
ucuuuauuucccuaacuugcua

SEQ ID NO: 290424 - RNA, 22 nt, Human
ucuuggcaguucuugugcuuuu

SEQ ID NO: 290425 - RNA, 22 nt, Human
ucuugggcaguccucuacuggu

SEQ ID NO: 290426 - RNA, 22 nt, Human
ucuuggucccugagcucuuuca

SEQ ID NO: 290427 - RNA, 20 nt, Human
ucuugucuggcagccuggag

SEQ ID NO: 290428 - RNA, 22 nt, Human
ucuucuuauuuuaugaucgcuu

SEQ ID NO: 290429 - RNA, 22 nt, Human
ucuugcuguagcuguuucuucu

SEQ ID NO: 290430 - RNA, 22 nt, Human
ucuugcuguggcagaucuggag

SEQ ID NO: 290431 - RNA, 22 nt, Human
uggccauuuacucuguaagagu

SEQ ID NO: 290432 - RNA, 22 nt, Human
uggccaaucagcugugaccugc

SEQ ID NO: 290433 - RNA, 22 nt, Human
uggccagucuuagcugugccug

SEQ ID NO: 290434 - RNA, 22 nt, Human
uggccaugagaaucuuugcugu

SEQ ID NO: 290435 - RNA, 22 nt, Human
uggcagcucauuuggaaaugga

SEQ ID NO: 290436 - RNA, 22 nt, Human
uggcagccugcgugaaggagcu

SEQ ID NO: 290437 - RNA, 22 nt, Human
uggcagccucugguccuuaguu

SEQ ID NO: 290438 - RNA, 22 nt, Human
ucuucuuuccuuuugugcauuu

SEQ ID NO: 290439 - RNA, 22 nt, Human
ucuguucaugucuuuuuaagug

SEQ ID NO: 290440 - RNA, 21 nt, Human
uggaggcguaaucacuguuga

SEQ ID NO: 290441 - RNA, 22 nt, Human
ucuguucagaagaggugaaagu

SEQ ID NO: 290442 - RNA, 22 nt, Human
ucuguucucuuguucugacggu

SEQ ID NO: 290443 - RNA, 20 nt, Human
uggaugacuucaggcagccu

SEQ ID NO: 290444 - RNA, 22 nt, Human
uggaugagugaauggauaaauc

SEQ ID NO: 290445 - RNA, 22 nt, Human
uggaugcuccaaguagaccuua

SEQ ID NO: 290446 - RNA, 22 nt, Human
ucuguuuuucagaccuuuuugg

SEQ ID NO: 290447 - RNA, 18 nt, Human
uggcaaugccaaaggcuu

SEQ ID NO: 290448 - RNA, 22 nt, Human
uggauuagugcugaaaugaugg

SEQ ID NO: 290449 - RNA, 22 nt, Human
ucuuauugguaaugauggcauu

SEQ ID NO: 290450 - RNA, 22 nt, Human
uggcagaaugaagacuggggcc

SEQ ID NO: 290451 - RNA, 22 nt, Human
uggcacagcuugucauaaacuc

SEQ ID NO: 290452 - RNA, 22 nt, Human
uggcacaggcagaaggugccgc

SEQ ID NO: 290453 - RNA, 20 nt, Human
ucugugugccaucaccuaac

SEQ ID NO: 290454 - RNA, 19 nt, Human
uggaggcacuaacaaacuc

SEQ ID NO: 290455 - RNA, 22 nt, Human
uggagcuggcuuguggaaguug

SEQ ID NO: 290456 - RNA, 22 nt, Human
uggagccagcaggacucagagg

SEQ ID NO: 290457 - RNA, 22 nt, Human
uggaggaggagaacuuggcacu

SEQ ID NO: 290458 - RNA, 21 nt, Human
uggagcagggaggauuugggg

SEQ ID NO: 290459 - RNA, 17 nt, Human
ucuguguccgcucaguc

SEQ ID NO: 290460 - RNA, 22 nt, Human
uggagccugauggauaggaacg

SEQ ID NO: 290461 - RNA, 22 nt, Human
uggaagaucugguguagcuccu

SEQ ID NO: 290462 - RNA, 22 nt, Human
ucugggguucuuaauuuggaag

SEQ ID NO: 290463 - RNA, 22 nt, Human
ucugguuuggguugcuauggcu

SEQ ID NO: 290464 - RNA, 22 nt, Human
uggacuguaauguguguggacc

SEQ ID NO: 290465 - RNA, 22 nt, Human
uggagagaaguucuauaaauca

SEQ ID NO: 290466 - RNA, 22 nt, Human
uggaauuaucugaagugauuug

SEQ ID NO: 290467 - RNA, 21 nt, Human
uggaauuggaaaccauucuau

SEQ ID NO: 290468 - RNA, 22 nt, Human
uggaaugccgggccaggcuccg

SEQ ID NO: 290469 - RNA, 22 nt, Human
ucugcuuuucuuaaggggauca

SEQ ID NO: 290470 - RNA, 22 nt, Human
uggaacugguuugcuucagacu

SEQ ID NO: 290471 - RNA, 22 nt, Human
uggaagaaaugguugagccaug

SEQ ID NO: 290472 - RNA, 22 nt, Human
ucuggaaauggaaguaacuaug

SEQ ID NO: 290473 - RNA, 17 nt, Human
ucugccaguuuuagaau

SEQ ID NO: 290474 - RNA, 23 nt, Human
ucugccuccuaauuguugguguc

SEQ ID NO: 290475 - RNA, 22 nt, Human
ucugccuucaggagcagacucu

SEQ ID NO: 290476 - RNA, 22 nt, Human
ucugcggccggaauucccuuca

SEQ ID NO: 290477 - RNA, 22 nt, Human
uggaacugauuaaaagggcaga

SEQ ID NO: 290478 - RNA, 22 nt, Human
ucuaaucacccgccgccccccg

SEQ ID NO: 290479 - RNA, 22 nt, Human
ugcugccgccgccaccgccgcc

SEQ ID NO: 290480 - RNA, 22 nt, Human
ugcugccucugaauggagcagu

SEQ ID NO: 290481 - RNA, 21 nt, Human
ucugccaguuucucuuacuuu

SEQ ID NO: 290482 - RNA, 22 nt, Human
uggaaaguuggaagucucagga

SEQ ID NO: 290483 - RNA, 22 nt, Human
uggaaauacaagaaguauguca

SEQ ID NO: 290484 - RNA, 22 nt, Human
uggaaaggaguucuguuuauuu

SEQ ID NO: 290485 - RNA, 19 nt, Human
ugccggccgcgggguuccu

SEQ ID NO: 290486 - RNA, 22 nt, Human
ugccuggugcggagugaguggc

SEQ ID NO: 290487 - RNA, 21 nt, Human
ugccuggccuuugcuuuuccu

SEQ ID NO: 290488 - RNA, 20 nt, Human
uccugaaauuacgugauuca

SEQ ID NO: 290489 - RNA, 22 nt, Human
ugccaugguuguacaguagcag

SEQ ID NO: 290490 - RNA, 22 nt, Human
ugccauauuuugaggauguaca

SEQ ID NO: 290491 - RNA, 22 nt, Human
ugccaucuuugccccuauuuua

SEQ ID NO: 290492 - RNA, 22 nt, Human
ugccaucaugucagauuuggga

SEQ ID NO: 290493 - RNA, 22 nt, Human
uccugaaggccugaguuccacc

SEQ ID NO: 290494 - RNA, 22 nt, Human
ugcaugacugaucuguuuguca

SEQ ID NO: 290495 - RNA, 22 nt, Human
ugcaugacaauugccgucaagu

SEQ ID NO: 290496 - RNA, 22 nt, Human
ugcaugaucucacuuacaggug

SEQ ID NO: 290497 - RNA, 22 nt, Human
ugcauguuucuguauguuaaug

SEQ ID NO: 290498 - RNA, 22 nt, Human
uccguugaggcugccaggcgag

SEQ ID NO: 290499 - RNA, 21 nt, Human
uccuaaaggaaauacucaauu

SEQ ID NO: 290500 - RNA, 22 nt, Human
uccuaaauuuguacuagcauuu

SEQ ID NO: 290501 - RNA, 22 nt, Human
ucccuucccaccccugccuuuu

SEQ ID NO: 290502 - RNA, 22 nt, Human
ucccagaacggguucuucccag

SEQ ID NO: 290503 - RNA, 20 nt, Human
ugccagagagcucauacccu

SEQ ID NO: 290504 - RNA, 22 nt, Human
uccucagcaaacacuucacucu

SEQ ID NO: 290505 - RNA, 22 nt, Human
ugcauuaguaaagagaggaggg

SEQ ID NO: 290506 - RNA, 16 nt, Human
ugccaagggguuaaug

SEQ ID NO: 290507 - RNA, 22 nt, Human
ugcauguuuuaagugaagcuga

SEQ ID NO: 290508 - RNA, 22 nt, Human
ugcauucugggucgcagagugg

SEQ ID NO: 290509 - RNA, 22 nt, Human
ugccaacaggcuugccugaugu

SEQ ID NO: 290510 - RNA, 22 nt, Human
ucgauccaggaaggcugguuua

SEQ ID NO: 290511 - RNA, 22 nt, Human
ugccuuuuguguuuggcuaauc

SEQ ID NO: 290512 - RNA, 22 nt, Human
ugcggcucaaagggaaggccuu

SEQ ID NO: 290513 - RNA, 22 nt, Human
ugcggugcagcccugcccucuc

SEQ ID NO: 290514 - RNA, 21 nt, Human
ugcguaugucuuguauuacuc

SEQ ID NO: 290515 - RNA, 23 nt, Human
ugcuaaaggcagaauauucaccu

SEQ ID NO: 290516 - RNA, 22 nt, Human
ucggccggagggggcgggcgca

SEQ ID NO: 290517 - RNA, 22 nt, Human
ugcuauuuuguuuucaguccau

SEQ ID NO: 290518 - RNA, 22 nt, Human
ugcucagaagacuuacugguua

SEQ ID NO: 290519 - RNA, 22 nt, Human
ugcucacugcuuguguucaguu

SEQ ID NO: 290520 - RNA, 20 nt, Human
ugcuaucugcucucccuucu

SEQ ID NO: 290521 - RNA, 22 nt, Human
ugcuauucuuggagcugaugga

SEQ ID NO: 290522 - RNA, 22 nt, Human
ugcuacaucuacugguaagggu

SEQ ID NO: 290523 - RNA, 22 nt, Human
ugcuauccagacacauaugauc

SEQ ID NO: 290524 - RNA, 22 nt, Human
ugcuaguuuuugauacuuuugc

SEQ ID NO: 290525 - RNA, 22 nt, Human
ucuaaucuacaaaaggaaauuc

SEQ ID NO: 290526 - RNA, 22 nt, Human
ucuaaucuuugaaaucaggguc

SEQ ID NO: 290527 - RNA, 22 nt, Human
ucuaauagauuuggaguggaaa

SEQ ID NO: 290528 - RNA, 20 nt, Human
ucuaaugaagugagcuuagc

SEQ ID NO: 290529 - RNA, 22 nt, Human
ugcugacuauacauuuagcauu

SEQ ID NO: 290530 - RNA, 22 nt, Human
ugcugcacuuauggcucugagg

SEQ ID NO: 290531 - RNA, 22 nt, Human
ucguggaugaagaauagaggcc

SEQ ID NO: 290532 - RNA, 22 nt, Human
ucgugaagaaauguggacuuca

SEQ ID NO: 290533 - RNA, 22 nt, Human
ucgugacuggacaaacuugggu

SEQ ID NO: 290534 - RNA, 22 nt, Human
ucguuucuuuuucuucccugga

SEQ ID NO: 290535 - RNA, 22 nt, Human
ucuaaaaauuagaaauuagguc

SEQ ID NO: 290536 - RNA, 22 nt, Human
ugcugaccggccuccccccagc

SEQ ID NO: 290537 - RNA, 22 nt, Human
ucggguguguguguuggguaug

SEQ ID NO: 290538 - RNA, 23 nt, Human
ucgucgucagccacuaccucccc

SEQ ID NO: 290539 - RNA, 22 nt, Human
ugcucugguccucccucggcgc

SEQ ID NO: 290540 - RNA, 22 nt, Human
ugcucuguuuuaacucuuucaa

SEQ ID NO: 290541 - RNA, 22 nt, Human
ugcucuguucaguguaucuugu

SEQ ID NO: 290542 - RNA, 22 nt, Human
ugcucuuuguagcugcuuugcu

SEQ ID NO: 290543 - RNA, 22 nt, Human
ugcuagccacuauuguaaguau

SEQ ID NO: 290544 - RNA, 22 nt, Human
ugcucgggcuccuuugagugag

SEQ ID NO: 290545 - RNA, 21 nt, Human
ucgggcggcggcugaggcggc

SEQ ID NO: 290546 - RNA, 23 nt, Human
ugcucgccuucaggacuugggcu

SEQ ID NO: 290547 - RNA, 22 nt, Human
uccccgcugcgcccgcugcugc

SEQ ID NO: 290548 - RNA, 22 nt, Human
ugcagcgugaggacagcugagc

SEQ ID NO: 290549 - RNA, 18 nt, Human
ugcagcuuugugauuggc

SEQ ID NO: 290550 - RNA, 22 nt, Human
ucccagaaauccaggcuuaaau

SEQ ID NO: 290551 - RNA, 22 nt, Human
ucccagaaccuuuuagcuucac

SEQ ID NO: 290552 - RNA, 22 nt, Human
ugcacgcacuugcucuccagcg

SEQ ID NO: 290553 - RNA, 22 nt, Human
ugcacgcgcccuucgauggccc

SEQ ID NO: 290554 - RNA, 22 nt, Human
ugcagaggagcuggaaggcugg

SEQ ID NO: 290555 - RNA, 19 nt, Human
ugcaagcuuuuucuuguua

SEQ ID NO: 290556 - RNA, 22 nt, Human
ugcaagugccauggauucaggu

SEQ ID NO: 290557 - RNA, 22 nt, Human
uccauucccugacagccucuuu

SEQ ID NO: 290558 - RNA, 22 nt, Human
uccauuuacuauucucauaucg

SEQ ID NO: 290559 - RNA, 22 nt, Human
uccauugucaauaguauugauu

SEQ ID NO: 290560 - RNA, 22 nt, Human
ugcacauuucucacaauguaca

SEQ ID NO: 290561 - RNA, 22 nt, Human
uccacagggaugccugcggcuu

SEQ ID NO: 290562 - RNA, 22 nt, Human
ugauguauaaaaagagugaaau

SEQ ID NO: 290563 - RNA, 22 nt, Human
uccaccaccaucacagucagac

SEQ ID NO: 290564 - RNA, 20 nt, Human
uccacugagcgucacggcag

SEQ ID NO: 290565 - RNA, 22 nt, Human
uccagguaggagaccaggcugu

SEQ ID NO: 290566 - RNA, 22 nt, Human
uccagggaggggcggcaggggu

SEQ ID NO: 290567 - RNA, 22 nt, Human
uccaggcagcugcuugaugaua

SEQ ID NO: 290568 - RNA, 22 nt, Human
uccagacucaaaaaccagaugg

SEQ ID NO: 290569 - RNA, 22 nt, Human
uccacuguguagucucccaagu

SEQ ID NO: 290570 - RNA, 22 nt, Human
uccacuuaauagguauggagcc

SEQ ID NO: 290571 - RNA, 22 nt, Human
uccauaugaucuguuguauggu

SEQ ID NO: 290572 - RNA, 22 nt, Human
uccaugauauauaugugcacau

SEQ ID NO: 290573 - RNA, 22 nt, Human
ugcaaaaguuuuauacacagau

SEQ ID NO: 290574 - RNA, 23 nt, Human
ugcaaaauuugcagaguucgaug

SEQ ID NO: 290575 - RNA, 22 nt, Human
uccagguucaguucaucaucua

SEQ ID NO: 290576 - RNA, 22 nt, Human
uccagguuuggcuuuauaacuu

SEQ ID NO: 290577 - RNA, 22 nt, Human
ugauuuggcaucaguguauccu

SEQ ID NO: 290578 - RNA, 22 nt, Human
ugauuugguauccaggauuuaa

SEQ ID NO: 290579 - RNA, 22 nt, Human
ugaguuagcucuauucuuuugg

SEQ ID NO: 290580 - RNA, 22 nt, Human
ugagucuguugcuagggggaau

SEQ ID NO: 290581 - RNA, 22 nt, Human
ugaguugucacaacgucacaag

SEQ ID NO: 290582 - RNA, 22 nt, Human
ugaguuuaggccaggauauggu

SEQ ID NO: 290583 - RNA, 22 nt, Human
ugaguucugacugagcaugggg

SEQ ID NO: 290584 - RNA, 22 nt, Human
ugaguugcagucaauauugcaa

SEQ ID NO: 290585 - RNA, 22 nt, Human
ugagaaaacaguuuguaauaau

SEQ ID NO: 290586 - RNA, 22 nt, Human
ugacuuuucuccucugaaguuu

SEQ ID NO: 290587 - RNA, 22 nt, Human
ugagggauuucuggccuuaacu

SEQ ID NO: 290588 - RNA, 22 nt, Human
ugagggaggggaaugugugcag

SEQ ID NO: 290589 - RNA, 19 nt, Human
ugaguacuaaugagauuga

SEQ ID NO: 290590 - RNA, 20 nt, Human
ugagucagcugcaugggugg

SEQ ID NO: 290591 - RNA, 22 nt, Human
ugagucaccucucagaagccac

SEQ ID NO: 290592 - RNA, 22 nt, Human
ugaggucaggcagggguuuggc

SEQ ID NO: 290593 - RNA, 22 nt, Human
ugagguauuuggauuuauauuu

SEQ ID NO: 290594 - RNA, 20 nt, Human
ugauccacucucauugcucu

SEQ ID NO: 290595 - RNA, 22 nt, Human
ucauuagucuuuaauacauaau

SEQ ID NO: 290596 - RNA, 22 nt, Human
ucauuauuuugauguauuuccu

SEQ ID NO: 290597 - RNA, 22 nt, Human
ucauuguuucugcuuuucauga

SEQ ID NO: 290598 - RNA, 22 nt, Human
uccacaaagucuaugagaguug

SEQ ID NO: 290599 - RNA, 22 nt, Human
uccaaauagcuggaugauggug

SEQ ID NO: 290600 - RNA, 17 nt, Human
ucauuuauccucuuugg

SEQ ID NO: 290601 - RNA, 22 nt, Human
ucauuuaauuuggaacucagag

SEQ ID NO: 290602 - RNA, 21 nt, Human
ucuagaugggaugaaaggugc

SEQ ID NO: 290603 - RNA, 21 nt, Human
ucuagaccuugggcagucacu

SEQ ID NO: 290604 - RNA, 21 nt, Human
ucuucccaggccuuaaagggc

SEQ ID NO: 290605 - RNA, 19 nt, Human
ucuuccaucuauccuccuc

SEQ ID NO: 290606 - RNA, 22 nt, Human
ucuuccuuacucuggauguuau

SEQ ID NO: 290607 - RNA, 22 nt, Human
ucuuccuuguaagggcuuuaga

SEQ ID NO: 290608 - RNA, 22 nt, Human
uagugggauuuugaacaaaacc

SEQ ID NO: 290609 - RNA, 22 nt, Human
uaguggaaccuucuaaaugacg

SEQ ID NO: 290610 - RNA, 22 nt, Human
uaguggaaacagacugagcccg

SEQ ID NO: 290611 - RNA, 22 nt, Human
ucuaaugcuuccucucauccca

SEQ ID NO: 290612 - RNA, 22 nt, Human
ucuacugagugcugagauuuug

SEQ ID NO: 290613 - RNA, 22 nt, Human
ucuacgugacagaacagacuga

SEQ ID NO: 290614 - RNA, 22 nt, Human
uauuguauuagcucuuggagau

SEQ ID NO: 290615 - RNA, 22 nt, Human
uauugauuuuguugcuaccugg

SEQ ID NO: 290616 - RNA, 22 nt, Human
uauucuucaacuuuucuccucu

SEQ ID NO: 290617 - RNA, 22 nt, Human
uauucuucagcauaaaaauucu

SEQ ID NO: 290618 - RNA, 22 nt, Human
uauugaucuuugaaaccuuggu

SEQ ID NO: 290619 - RNA, 22 nt, Human
ucuugauggugauguuguguca

SEQ ID NO: 290620 - RNA, 22 nt, Human
ucuugcucuguucuaaaggauu

SEQ ID NO: 290621 - RNA, 22 nt, Human
ucuuggggagacuaguguuugg

SEQ ID NO: 290622 - RNA, 22 nt, Human
uauugucuuuuucuuccaccug

SEQ ID NO: 290623 - RNA, 22 nt, Human
ucuuuaaauucuuaugagugaa

SEQ ID NO: 290624 - RNA, 22 nt, Human
uauuuacgcaaacaauugugca

SEQ ID NO: 290625 - RNA, 22 nt, Human
uauugugaaggccaugugcuaa

SEQ ID NO: 290626 - RNA, 22 nt, Human
ucuuucugaugggaagggucaa

SEQ ID NO: 290627 - RNA, 22 nt, Human
uauuuacuguguucaucccucu

SEQ ID NO: 290628 - RNA, 18 nt, Human
uauuuacuguguguuacc

SEQ ID NO: 290629 - RNA, 22 nt, Human
ucuuugcauggacauguguuuu

SEQ ID NO: 290630 - RNA, 20 nt, Human
uauuucaaugugccaaguuu

SEQ ID NO: 290631 - RNA, 22 nt, Human
uauuuaugcaucacuuuuuucc

SEQ ID NO: 290632 - RNA, 17 nt, Human
ucuuuuacuuucucucc

SEQ ID NO: 290633 - RNA, 21 nt, Human
ucaaccagguguugaaggcac

SEQ ID NO: 290634 - RNA, 22 nt, Human
ucaaccagcuuaucugcaggau

SEQ ID NO: 290635 - RNA, 22 nt, Human
ucaacagaagugauagcuauua

SEQ ID NO: 290636 - RNA, 21 nt, Human
ugaagcccugugaggugcuua

SEQ ID NO: 290637 - RNA, 21 nt, Human
ugaagccuagagaauugggga

SEQ ID NO: 290638 - RNA, 22 nt, Human
ucaaaucuuuuuuccuucccug

SEQ ID NO: 290639 - RNA, 22 nt, Human
ugaaauuuuuuggagauaauuu

SEQ ID NO: 290640 - RNA, 21 nt, Human
ugaacaccaggagaaaucggu

SEQ ID NO: 290641 - RNA, 22 nt, Human
ugaaccugagggcaaagggaca

SEQ ID NO: 290642 - RNA, 22 nt, Human
uauuggguagguccuuuggagu

SEQ ID NO: 290643 - RNA, 22 nt, Human
ugaaccgacaggggaagauugu

SEQ ID NO: 290644 - RNA, 22 nt, Human
ugaagaauuccauggcuuccau

SEQ ID NO: 290645 - RNA, 22 nt, Human
uauuuuuacuguuugaugauuc

SEQ ID NO: 290646 - RNA, 22 nt, Human
ugaacuggauuugugagcuccu

SEQ ID NO: 290647 - RNA, 22 nt, Human
ugaaaaauauuuuuagaaauaa

SEQ ID NO: 290648 - RNA, 22 nt, Human
ugaaaaaugcuuuaaugcaugu

SEQ ID NO: 290649 - RNA, 22 nt, Human
ugaaaugccucuuugguucuaa

SEQ ID NO: 290650 - RNA, 22 nt, Human
ugaaauguggagaugguaagua

SEQ ID NO: 290651 - RNA, 22 nt, Human
uauuuuggaugcauugagaugc

SEQ ID NO: 290652 - RNA, 22 nt, Human
uauuuugaggugaaagaguuug

SEQ ID NO: 290653 - RNA, 22 nt, Human
uauuuuagccaacagaaugaug

SEQ ID NO: 290654 - RNA, 23 nt, Human
uauuuuccccuguaauauguauu

SEQ ID NO: 290655 - RNA, 22 nt, Human
uauuuacuuugaggaaguuguu

SEQ ID NO: 290656 - RNA, 22 nt, Human
uauuuguuucuaguggcagcaa

SEQ ID NO: 290657 - RNA, 22 nt, Human
uauuuguuuuuaaugcugggug

SEQ ID NO: 290658 - RNA, 22 nt, Human
ucuuuuuaugucaaaaucgaug

SEQ ID NO: 290659 - RNA, 22 nt, Human
ugacugguauuuguaaaccaua

SEQ ID NO: 290660 - RNA, 22 nt, Human
ugacucugaugcaguguguuua

SEQ ID NO: 290661 - RNA, 22 nt, Human
ugacugagacugcaaugaccga

SEQ ID NO: 290662 - RNA, 22 nt, Human
ucaggcaggaucccagggaagg

SEQ ID NO: 290663 - RNA, 19 nt, Human
ucaggaggucgaccuggca

SEQ ID NO: 290664 - RNA, 22 nt, Human
ucagcugggagaaaguuuuagg

SEQ ID NO: 290665 - RNA, 22 nt, Human
ucagcgucuccaaaagagcccg

SEQ ID NO: 290666 - RNA, 22 nt, Human
ucagcguuaguuuuucaucuaa

SEQ ID NO: 290667 - RNA, 22 nt, Human
ugaccuacauuuauagcuguca

SEQ ID NO: 290668 - RNA, 23 nt, Human
ugaccauauauccaucagauaua

SEQ ID NO: 290669 - RNA, 23 nt, Human
ucagccgcuggcgaguccacugg

SEQ ID NO: 290670 - RNA, 22 nt, Human
ucagcaguuaagcuucccugcc

SEQ ID NO: 290671 - RNA, 22 nt, Human
ugaccuccuaagugacagaauu

SEQ ID NO: 290672 - RNA, 22 nt, Human
ugaccucaagcaugcggagggc

SEQ ID NO: 290673 - RNA, 22 nt, Human
ugaccuuuuuaaauuauuuuua

SEQ ID NO: 290674 - RNA, 22 nt, Human
ugaauuuuggcaauuuucugug

SEQ ID NO: 290675 - RNA, 22 nt, Human
ugaauuuuaacauucugcugga

SEQ ID NO: 290676 - RNA, 22 nt, Human
ucacuguuucaccgucugaagg

SEQ ID NO: 290677 - RNA, 22 nt, Human
ucagaacuaacuuugcugaacc

SEQ ID NO: 290678 - RNA, 22 nt, Human
ugacagaggagcuggaaugauu

SEQ ID NO: 290679 - RNA, 22 nt, Human
ugacagaaaccaccccccaggu

SEQ ID NO: 290680 - RNA, 22 nt, Human
ucacuuccuugcagcuguagaa

SEQ ID NO: 290681 - RNA, 22 nt, Human
ucagagaaguaggcuaauggug

SEQ ID NO: 290682 - RNA, 20 nt, Human
ucagaaugugacccccaugg

SEQ ID NO: 290683 - RNA, 22 nt, Human
ucagaaugaaauuucuuucaga

SEQ ID NO: 290684 - RNA, 22 nt, Human
ucagagacaucagguuguagca

SEQ ID NO: 290685 - RNA, 22 nt, Human
ucagaagguacugaagacaugg

SEQ ID NO: 290686 - RNA, 22 nt, Human
ugacauccuacaccccuggguc

SEQ ID NO: 290687 - RNA, 22 nt, Human
ugacagugugcccggagguuag

SEQ ID NO: 290688 - RNA, 23 nt, Human
ugacagguucuaugguuuccaac

SEQ ID NO: 290689 - RNA, 22 nt, Human
ugacagucacagcagaaacucg

SEQ ID NO: 290690 - RNA, 22 nt, Human
ucacuagcaucugaauauuguu

SEQ ID NO: 290691 - RNA, 22 nt, Human
ucacucagucugagcaauugcu

SEQ ID NO: 290692 - RNA, 22 nt, Human
ucaccccagccuuaugacucag

SEQ ID NO: 290693 - RNA, 22 nt, Human
ucaccuguucaacagcaauaau

SEQ ID NO: 290694 - RNA, 22 nt, Human
ucacuggaaaacaaauguuuua

SEQ ID NO: 290695 - RNA, 22 nt, Human
ucacuggauucauguuucuuua

SEQ ID NO: 290696 - RNA, 22 nt, Human
ugaauuauaugguauugaacau

SEQ ID NO: 290697 - RNA, 23 nt, Human
ucacugccaagaaaaguuacaga

SEQ ID NO: 290698 - RNA, 22 nt, Human
ucacugccuagggcuacugugc

SEQ ID NO: 290699 - RNA, 22 nt, Human
ucacugaauuucaagcuagugg

SEQ ID NO: 290700 - RNA, 22 nt, Human
ucacugaacucucauagagaaa

SEQ ID NO: 290701 - RNA, 22 nt, Human
ucacucuuuaucuuuuaugucu

SEQ ID NO: 290702 - RNA, 22 nt, Human
ugaaugaagcacuguaauucuc

SEQ ID NO: 290703 - RNA, 22 nt, Human
ugaaugaguucaccgcucaguu

SEQ ID NO: 290704 - RNA, 22 nt, Human
ucacccuguggcuauaaggcaa

SEQ ID NO: 290705 - RNA, 22 nt, Human
ugaauuagagugaaggaaagcu

SEQ ID NO: 290706 - RNA, 22 nt, Human
ucacaucugugugauugucauu

SEQ ID NO: 290707 - RNA, 22 nt, Human
ugaaucagaccuucauugggua

SEQ ID NO: 290708 - RNA, 22 nt, Human
ucacagauguuauccugaggau

SEQ ID NO: 290709 - RNA, 22 nt, Human
ugaauagcaccuugaguaauga

SEQ ID NO: 290710 - RNA, 22 nt, Human
ucacauggauuaacucauuuau

SEQ ID NO: 290711 - RNA, 22 nt, Human
ugaaugaacugaugaacuuaac

SEQ ID NO: 290712 - RNA, 22 nt, Human
ugaaucaaugaauugcacuuca

SEQ ID NO: 290713 - RNA, 22 nt, Human
ugaauaaucuuggguauuaaua

SEQ ID NO: 290714 - RNA, 21 nt, Human
ucaaguccuggcuuugcucuu

SEQ ID NO: 290715 - RNA, 21 nt, Human
ucaagugcccaagguuuguuu

SEQ ID NO: 290716 - RNA, 22 nt, Human
ugaaggggaaagucuugcuaua

SEQ ID NO: 290717 - RNA, 22 nt, Human
ugaaguuuagaaaaagugccuu

SEQ ID NO: 290718 - RNA, 22 nt, Human
ucaagcaaggaauccuuuugua

SEQ ID NO: 290719 - RNA, 22 nt, Human
ucaagcacugugcaaugagcuu

SEQ ID NO: 290720 - RNA, 22 nt, Human
ucaagaagauaaugucuagggu

SEQ ID NO: 290721 - RNA, 22 nt, Human
ugaagcuaguauuaacucagau

SEQ ID NO: 290722 - RNA, 22 nt, Human
ugaagcuagguucaugaggucg

SEQ ID NO: 290723 - RNA, 21 nt, Human
uauucgcauuucugucuuuac

SEQ ID NO: 290724 - RNA, 22 nt, Human
guuccgcggccucgcgcugagc

SEQ ID NO: 290725 - RNA, 22 nt, Human
uauucauuuuuauuugugacug

SEQ ID NO: 290726 - RNA, 22 nt, Human
guucauuucaagucuaauccau

SEQ ID NO: 290727 - RNA, 22 nt, Human
guucaaucucucaugcauuuuc

SEQ ID NO: 290728 - RNA, 22 nt, Human
uaugugugugcguguguuuugc

SEQ ID NO: 290729 - RNA, 23 nt, Human
guuauugcuggugcuggccagcc

SEQ ID NO: 290730 - RNA, 23 nt, Human
guuaccgaccugauucggcagcc

SEQ ID NO: 290731 - RNA, 22 nt, Human
guuacagagcugcuaugugugc

SEQ ID NO: 290732 - RNA, 22 nt, Human
uauguguaauuaaauacuauag

SEQ ID NO: 290733 - RNA, 22 nt, Human
uaugugugaguauauaugcaca

SEQ ID NO: 290734 - RNA, 22 nt, Human
uauggcuaguguguuuguaaca

SEQ ID NO: 290735 - RNA, 22 nt, Human
guguguggacgucugagcccag

SEQ ID NO: 290736 - RNA, 22 nt, Human
guguuagcauggaacagaacgc

SEQ ID NO: 290737 - RNA, 22 nt, Human
uauggacagcuuucuuuguguu

SEQ ID NO: 290738 - RNA, 22 nt, Human
guguuaggugcauuaaacgugg

SEQ ID NO: 290739 - RNA, 22 nt, Human
uauugguagauggagagagaca

SEQ ID NO: 290740 - RNA, 22 nt, Human
guuccucucacaggcuggagcu

SEQ ID NO: 290741 - RNA, 22 nt, Human
uauuguuuuaagguguauuaau

SEQ ID NO: 290742 - RNA, 22 nt, Human
guuccgcugcaaggccaggaaa

SEQ ID NO: 290743 - RNA, 22 nt, Human
uauuggcucagucagaaguuuu

SEQ ID NO: 290744 - RNA, 22 nt, Human
uauuuaggcagaaagugauauu

SEQ ID NO: 290745 - RNA, 22 nt, Human
uauuucaguuaagaugagguca

SEQ ID NO: 290746 - RNA, 22 nt, Human
uauuuaaagucagcaacuuuuc

SEQ ID NO: 290747 - RNA, 22 nt, Human
guucuacaacuucgcuugcaga

SEQ ID NO: 290748 - RNA, 22 nt, Human
guugagaaucucuagcuuagga

SEQ ID NO: 290749 - RNA, 22 nt, Human
guugaacagucacccugggagu

SEQ ID NO: 290750 - RNA, 22 nt, Human
guugauaauuaauagcuuuuga

SEQ ID NO: 290751 - RNA, 22 nt, Human
guugauuuaaccucaccuuuga

SEQ ID NO: 290752 - RNA, 18 nt, Human
uauuugugugugugugug

SEQ ID NO: 290753 - RNA, 22 nt, Human
uauuuucucugccacacuucca

SEQ ID NO: 290754 - RNA, 22 nt, Human
uauuuguauugucuuaucacuu

SEQ ID NO: 290755 - RNA, 22 nt, Human
uauuugauggaacucuugcuuu

SEQ ID NO: 290756 - RNA, 22 nt, Human
uauuucaucugaacuucccaac

SEQ ID NO: 290757 - RNA, 22 nt, Human
uauuucaugagugaauaucuag

SEQ ID NO: 290758 - RNA, 22 nt, Human
uauuucuagggcaugaaaauaa

SEQ ID NO: 290759 - RNA, 22 nt, Human
uauaugcagauuuucaucaucg

SEQ ID NO: 290760 - RNA, 22 nt, Human
uauauuaaagugcuuugcagug

SEQ ID NO: 290761 - RNA, 23 nt, Human
uaucccauacagagagugguaca

SEQ ID NO: 290762 - RNA, 19 nt, Human
uaucccccauagcagugcg

SEQ ID NO: 290763 - RNA, 22 nt, Human
uaucugaugcaggcucccagga

SEQ ID NO: 290764 - RNA, 22 nt, Human
uaucuccauucuagccccuugu

SEQ ID NO: 290765 - RNA, 22 nt, Human
uaucuguauuguagaacuguug

SEQ ID NO: 290766 - RNA, 22 nt, Human
gugucacuuucaggagcucuaa

SEQ ID NO: 290767 - RNA, 22 nt, Human
guguauuucuagaagaaaugaa

SEQ ID NO: 290768 - RNA, 22 nt, Human
uaucuguagucucaugguuccu

SEQ ID NO: 290769 - RNA, 22 nt, Human
uaugaucuuaggauggaacuuc

SEQ ID NO: 290770 - RNA, 22 nt, Human
gugugguguuaagcaaauuaau

SEQ ID NO: 290771 - RNA, 22 nt, Human
uaugauuuucaugguagaguua

SEQ ID NO: 290772 - RNA, 22 nt, Human
uaugcacacguguccaugugca

SEQ ID NO: 290773 - RNA, 22 nt, Human
uaugagugccaaguuaccuggg

SEQ ID NO: 290774 - RNA, 22 nt, Human
gugugaguggcuaagugugccu

SEQ ID NO: 290775 - RNA, 22 nt, Human
guguccaugugggugcucuccu

SEQ ID NO: 290776 - RNA, 22 nt, Human
gugucauuggcuucccaagucc

SEQ ID NO: 290777 - RNA, 22 nt, Human
uaugacugcucagugaauggaa

SEQ ID NO: 290778 - RNA, 22 nt, Human
uaguugguggagcgauuugucu

SEQ ID NO: 290779 - RNA, 22 nt, Human
uaguuucuucaacugucccagc

SEQ ID NO: 290780 - RNA, 22 nt, Human
uaguuuuaagcugacauuguuc

SEQ ID NO: 290781 - RNA, 22 nt, Human
gugcuaugugcugaacucaggu

SEQ ID NO: 290782 - RNA, 22 nt, Human
uagcauacagauauuuaacucu

SEQ ID NO: 290783 - RNA, 22 nt, Human
uaguuacuuuugcucuucauua

SEQ ID NO: 290784 - RNA, 22 nt, Human
uaguuauuucugcacuuaauga

SEQ ID NO: 290785 - RNA, 22 nt, Human
uauauacacugauuaggauuuu

SEQ ID NO: 290786 - RNA, 22 nt, Human
uauauauaauguguacagguga

SEQ ID NO: 290787 - RNA, 22 nt, Human
uauauauacauauagaauaugu

SEQ ID NO: 290788 - RNA, 22 nt, Human
uauagcccaaucuggaugcagu

SEQ ID NO: 290789 - RNA, 22 nt, Human
uauauaauacacaaauauguac

SEQ ID NO: 290790 - RNA, 18 nt, Human
uauaaacacacuuagguu

SEQ ID NO: 290791 - RNA, 22 nt, Human
uauaagaaaagucauuaucaaa

SEQ ID NO: 290792 - RNA, 22 nt, Human
uauaaugucuuuguugaaaucu

SEQ ID NO: 290793 - RNA, 22 nt, Human
ucaaggaagggguaggaauaau

SEQ ID NO: 290794 - RNA, 22 nt, Human
ucaagggaccaagcauucauua

SEQ ID NO: 290795 - RNA, 22 nt, Human
ucaagguauuauuuuuguggug

SEQ ID NO: 290796 - RNA, 22 nt, Human
guuguugcuauguuauuguuau

SEQ ID NO: 290797 - RNA, 22 nt, Human
guuguugucauuagcuguuuaa

SEQ ID NO: 290798 - RNA, 19 nt, Human
guuguguuugguucuuuug

SEQ ID NO: 290799 - RNA, 22 nt, Human
uauuuuuaccuaauuuaugaga

SEQ ID NO: 290800 - RNA, 22 nt, Human
uauuuuggcuccugagcucuga

SEQ ID NO: 290801 - RNA, 22 nt, Human
guugauuuaggguuuugguuuu

SEQ ID NO: 290802 - RNA, 22 nt, Human
ucaaguccuuggcauaggauaa

SEQ ID NO: 290803 - RNA, 22 nt, Human
ucaauuggcuacaaauaaugua

SEQ ID NO: 290804 - RNA, 22 nt, Human
ucaauuuauguggcuauucauu

SEQ ID NO: 290805 - RNA, 22 nt, Human
ucacaagaagaaauuaaacugu

SEQ ID NO: 290806 - RNA, 22 nt, Human
ucacaguucaacuaguucagau

SEQ ID NO: 290807 - RNA, 22 nt, Human
ucacaggagucaaggaauagua

SEQ ID NO: 290808 - RNA, 23 nt, Human
ucacaaggcuauguuauauguac

SEQ ID NO: 290809 - RNA, 22 nt, Human
ucacauugcauuuucucauuug

SEQ ID NO: 290810 - RNA, 22 nt, Human
ucacuguugccacggugauaau

SEQ ID NO: 290811 - RNA, 19 nt, Human
ucacggucaaccagagccu

SEQ ID NO: 290812 - RNA, 22 nt, Human
ucaccuuuugaauugcuguugu

SEQ ID NO: 290813 - RNA, 22 nt, Human
ucaccuguuggauguauacugu

SEQ ID NO: 290814 - RNA, 22 nt, Human
ucacccagacugucugacucuu

SEQ ID NO: 290815 - RNA, 22 nt, Human
ucaccgucucaguacggaggga

SEQ ID NO: 290816 - RNA, 22 nt, Human
guuuacaacaucuuguccuuca

SEQ ID NO: 290817 - RNA, 22 nt, Human
guuuauucuuuuauuugugaga

SEQ ID NO: 290818 - RNA, 22 nt, Human
ucaccaugcccuucucugcucu

SEQ ID NO: 290819 - RNA, 22 nt, Human
guuucuguguugauugugcccu

SEQ ID NO: 290820 - RNA, 22 nt, Human
guuugagcaaucccucuauccc

SEQ ID NO: 290821 - RNA, 22 nt, Human
guuugaacagaaggguugauca

SEQ ID NO: 290822 - RNA, 22 nt, Human
ucaccuggagagcuugcuaaua

SEQ ID NO: 290823 - RNA, 22 nt, Human
guuuauuucuuaucaucacuau

SEQ ID NO: 290824 - RNA, 22 nt, Human
ucaccugccuggguggucaccu

SEQ ID NO: 290825 - RNA, 21 nt, Human
ucagccuguccaguguuaacc

SEQ ID NO: 290826 - RNA, 22 nt, Human
uaaacgaagcuucaugcuugaa

SEQ ID NO: 290827 - RNA, 22 nt, Human
uaaaccuuauuugaauaccaac

SEQ ID NO: 290828 - RNA, 22 nt, Human
uaaaauaccacauauggugcuc

SEQ ID NO: 290829 - RNA, 22 nt, Human
uaaaaugcucagauaaauauau

SEQ ID NO: 290830 - RNA, 22 nt, Human
ucagcguuggccuccuccaggg

SEQ ID NO: 290831 - RNA, 22 nt, Human
ucagcucacaauguugagaaag

SEQ ID NO: 290832 - RNA, 22 nt, Human
ucagcuauccauucuccuauga

SEQ ID NO: 290833 - RNA, 22 nt, Human
ucagcucaggggauguggggga

SEQ ID NO: 290834 - RNA, 22 nt, Human
ucagcucucucuuggugaucuc

SEQ ID NO: 290835 - RNA, 21 nt, Human
ucaggaagagccaguucaugc

SEQ ID NO: 290836 - RNA, 23 nt, Human
guuuuugcugcagcugaagaagg

SEQ ID NO: 290837 - RNA, 22 nt, Human
uaaaaaccuuguauuuaacucu

SEQ ID NO: 290838 - RNA, 22 nt, Human
guuuuucuuugauuuagaacca

SEQ ID NO: 290839 - RNA, 22 nt, Human
uaaaaccauucauugaccuaug

SEQ ID NO: 290840 - RNA, 22 nt, Human
uaaaaauuagauauguauuuag

SEQ ID NO: 290841 - RNA, 22 nt, Human
ucagcaggugcuuuguuuacuc

SEQ ID NO: 290842 - RNA, 22 nt, Human
ucagccuugguuuugguguugg

SEQ ID NO: 290843 - RNA, 19 nt, Human
ucagcagauuuugcaaaca

SEQ ID NO: 290844 - RNA, 22 nt, Human
ucagauggucauucacuagggu

SEQ ID NO: 290845 - RNA, 22 nt, Human
ucagcacagcugcuuuuacuuc

SEQ ID NO: 290846 - RNA, 22 nt, Human
ucagauagcaagggauaccugu

SEQ ID NO: 290847 - RNA, 22 nt, Human
ucagcaaugggauucaggcuuu

SEQ ID NO: 290848 - RNA, 22 nt, Human
guuuucuccugcuauacagugc

SEQ ID NO: 290849 - RNA, 22 nt, Human
guuuuauguuuuauagacacaa

SEQ ID NO: 290850 - RNA, 23 nt, Human
ucagaccaaccucuugcuggaac

SEQ ID NO: 290851 - RNA, 18 nt, Human
ucagaaugauuuggugga

SEQ ID NO: 290852 - RNA, 22 nt, Human
ucacuguaggaaucucuaaauu

SEQ ID NO: 290853 - RNA, 21 nt, Human
ucagaaucguuccagguagau

SEQ ID NO: 290854 - RNA, 22 nt, Human
ucagaacugcggggaagguggg

SEQ ID NO: 290855 - RNA, 22 nt, Human
ucagaacucuagucucagccug

SEQ ID NO: 290856 - RNA, 22 nt, Human
guuuuauaacuauagugagaau

SEQ ID NO: 290857 - RNA, 22 nt, Human
ucagaaacuaaauguggauuug

SEQ ID NO: 290858 - RNA, 22 nt, Human
guuuuaucuauguaauuauaaa

SEQ ID NO: 290859 - RNA, 22 nt, Human
guuuguuugccagcuuaguaaa

SEQ ID NO: 290860 - RNA, 22 nt, Human
guuuuaaucuccuuauuccuaa

SEQ ID NO: 290861 - RNA, 22 nt, Human
ucagagagagagaggcggaaga

SEQ ID NO: 290862 - RNA, 22 nt, Human
ucagauaauccaauagagagga

SEQ ID NO: 290863 - RNA, 18 nt, Human
ucagaggagauaccuaaa

SEQ ID NO: 290864 - RNA, 21 nt, Human
ucagaccaacucuuguauccu

SEQ ID NO: 290865 - RNA, 22 nt, Human
ucagacucaguuuugucuccug

SEQ ID NO: 290866 - RNA, 22 nt, Human
guuuuuaguuuaaguuuuugca

SEQ ID NO: 290867 - RNA, 22 nt, Human
guuuuucuagaaaucuccuccu

SEQ ID NO: 290868 - RNA, 22 nt, Human
guuuugauggaguguguuaaau

SEQ ID NO: 290869 - RNA, 22 nt, Human
guuuucuuguuaauuuugaacg

SEQ ID NO: 290870 - RNA, 22 nt, Human
guuuuguucaugaacauugggu

SEQ ID NO: 290871 - RNA, 22 nt, Human
uagccaaguuuucuuugaaagu

SEQ ID NO: 290872 - RNA, 22 nt, Human
uccugcaugcuagugagugcuu

SEQ ID NO: 290873 - RNA, 22 nt, Human
uccugcccuguccuugccucug

SEQ ID NO: 290874 - RNA, 22 nt, Human
uagccaguuuauaaaguggaag

SEQ ID NO: 290875 - RNA, 22 nt, Human
uagccucuggaauccuuucucu

SEQ ID NO: 290876 - RNA, 22 nt, Human
uagcccgugaggaggggcugug

SEQ ID NO: 290877 - RNA, 22 nt, Human
uagccucaagagauucagggac

SEQ ID NO: 290878 - RNA, 23 nt, Human
uagcggccaugacgggggucaca

SEQ ID NO: 290879 - RNA, 22 nt, Human
uccuuuauuuaugggcagugua

SEQ ID NO: 290880 - RNA, 22 nt, Human
uccuuuucuuugaggaaggugu

SEQ ID NO: 290881 - RNA, 22 nt, Human
uccuuuggaaacuggaugucuu

SEQ ID NO: 290882 - RNA, 22 nt, Human
uagcaggagagaaguuuuaagu

SEQ ID NO: 290883 - RNA, 22 nt, Human
uagcauuuauugggcuagcaaa

SEQ ID NO: 290884 - RNA, 22 nt, Human
uagcauuuagaacaccuugaga

SEQ ID NO: 290885 - RNA, 22 nt, Human
uagccaaguguuuuucaugacc

SEQ ID NO: 290886 - RNA, 21 nt, Human
uccugcagggcagcagagugg

SEQ ID NO: 290887 - RNA, 23 nt, Human
uccugcagauaagcugguugaca

SEQ ID NO: 290888 - RNA, 22 nt, Human
uccugagaagcacuuaauacac

SEQ ID NO: 290889 - RNA, 22 nt, Human
uccugaaugguguaauagguuu

SEQ ID NO: 290890 - RNA, 22 nt, Human
uccucuucucuagagccggaau

SEQ ID NO: 290891 - RNA, 23 nt, Human
uagacugcaggcuccuugagggc

SEQ ID NO: 290892 - RNA, 22 nt, Human
uagagaaauuacagcuuucuuu

SEQ ID NO: 290893 - RNA, 22 nt, Human
uagacugugagcuccuugaggg

SEQ ID NO: 290894 - RNA, 22 nt, Human
uagagagaaaccaggguuuggg

SEQ ID NO: 290895 - RNA, 19 nt, Human
uagagcagcuucagauucc

SEQ ID NO: 290896 - RNA, 22 nt, Human
uccucgccgucacgcagccucu

SEQ ID NO: 290897 - RNA, 22 nt, Human
uccucaaauccuagccucaucg

SEQ ID NO: 290898 - RNA, 22 nt, Human
uccucuucaaaauagcucugaa

SEQ ID NO: 290899 - RNA, 22 nt, Human
uacuuaucuuagggaugcuugc

SEQ ID NO: 290900 - RNA, 22 nt, Human
uacuucaguuacaugaagguau

SEQ ID NO: 290901 - RNA, 22 nt, Human
uacuuaauuuuaaaagcuagau

SEQ ID NO: 290902 - RNA, 22 nt, Human
ucccaugaguuugguguagucu

SEQ ID NO: 290903 - RNA, 22 nt, Human
uacuucauucaaguucgcuaua

SEQ ID NO: 290904 - RNA, 22 nt, Human
uagaagagcaugucaaacuaua

SEQ ID NO: 290905 - RNA, 22 nt, Human
uagaagagcuuccaccuggggc

SEQ ID NO: 290906 - RNA, 21 nt, Human
uagaagagggaauuugucuuu

SEQ ID NO: 290907 - RNA, 22 nt, Human
uagaaguuaaaggaauacagaa

SEQ ID NO: 290908 - RNA, 19 nt, Human
uagacagauuuguguuacu

SEQ ID NO: 290909 - RNA, 22 nt, Human
uagaaugggaggggaaucaucc

SEQ ID NO: 290910 - RNA, 20 nt, Human
uagugaccaagagggcugcu

SEQ ID NO: 290911 - RNA, 22 nt, Human
ucuaacuaagcuuuaaaagguc

SEQ ID NO: 290912 - RNA, 22 nt, Human
ucuaaagcuccuuccacuaaaa

SEQ ID NO: 290913 - RNA, 22 nt, Human
uaguauuguguuguuugacagu

SEQ ID NO: 290914 - RNA, 22 nt, Human
ucguguuggaacugcuuuguaa

SEQ ID NO: 290915 - RNA, 22 nt, Human
uagucaauuagaaagaggccuu

SEQ ID NO: 290916 - RNA, 22 nt, Human
uaguccacagagggcaggguca

SEQ ID NO: 290917 - RNA, 22 nt, Human
ucgggcgaauguuguuuuucuc

SEQ ID NO: 290918 - RNA, 22 nt, Human
ucgggccacauccacacaucca

SEQ ID NO: 290919 - RNA, 22 nt, Human
ucgucaaaguaaugucauagca

SEQ ID NO: 290920 - RNA, 22 nt, Human
uaguacguuccaaaucacugga

SEQ ID NO: 290921 - RNA, 22 nt, Human
uaguaauauuccuacauuaugu

SEQ ID NO: 290922 - RNA, 22 nt, Human
uaguaauagcuguaaagugugu

SEQ ID NO: 290923 - RNA, 22 nt, Human
uagguuguaagaggucuuuugu

SEQ ID NO: 290924 - RNA, 23 nt, Human
uaggucacacauugggugguugc

SEQ ID NO: 290925 - RNA, 22 nt, Human
uagggucucccuuuaaucuaac

SEQ ID NO: 290926 - RNA, 22 nt, Human
uagguauguuaacugugcaauu

SEQ ID NO: 290927 - RNA, 22 nt, Human
ucggauuggggaugggugggag

SEQ ID NO: 290928 - RNA, 22 nt, Human
ucgcuucugaguuggugacccc

SEQ ID NO: 290929 - RNA, 22 nt, Human
ucgcuuuaauggucuucacagc

SEQ ID NO: 290930 - RNA, 22 nt, Human
ucgcuugaacccaggaagugga

SEQ ID NO: 290931 - RNA, 22 nt, Human
uaggggcccgugggauggacag

SEQ ID NO: 290932 - RNA, 20 nt, Human
ucgcugcaagggaaauggag

SEQ ID NO: 290933 - RNA, 22 nt, Human
uaggcuuuguuacuuucccuuu

SEQ ID NO: 290934 - RNA, 22 nt, Human
uaggggaagcauagguuuagaa

SEQ ID NO: 290935 - RNA, 19 nt, Human
uaggcccugcgaauggcuu

SEQ ID NO: 290936 - RNA, 22 nt, Human
uaggcauguaaaagugaguucg

SEQ ID NO: 290937 - RNA, 22 nt, Human
uaggcaguagcuuuggauguca

SEQ ID NO: 290938 - RNA, 22 nt, Human
ucgcuauuauuuuagguucuca

SEQ ID NO: 290939 - RNA, 22 nt, Human
ucgcggccgcuccacaugcaca

SEQ ID NO: 290940 - RNA, 22 nt, Human
ucgccauguacaugaagggcgg

SEQ ID NO: 290941 - RNA, 22 nt, Human
ucgaugcuggcgcagguuucac

SEQ ID NO: 290942 - RNA, 22 nt, Human
uaggauugguguauguagguuu

SEQ ID NO: 290943 - RNA, 22 nt, Human
uaggauauuuuagaaugguaca

SEQ ID NO: 290944 - RNA, 22 nt, Human
ucgagcacaccagacuugcaga

SEQ ID NO: 290945 - RNA, 22 nt, Human
uccuuuuuagguuauuguacau

SEQ ID NO: 290946 - RNA, 22 nt, Human
ucgaaugccaacaccgaaguuu

SEQ ID NO: 290947 - RNA, 22 nt, Human
ucgacguuguuuuuucucuguc

SEQ ID NO: 290948 - RNA, 17 nt, Human
uccauugagacaagaag

SEQ ID NO: 290949 - RNA, 22 nt, Human
uacuggaugcaacaaagcccag

SEQ ID NO: 290950 - RNA, 22 nt, Human
uacuggguguucugagaaaaua

SEQ ID NO: 290951 - RNA, 16 nt, Human
uccaguguuccuggau

SEQ ID NO: 290952 - RNA, 22 nt, Human
uacugccauuauccugcugaaa

SEQ ID NO: 290953 - RNA, 22 nt, Human
uacucucuuccauacaaucugu

SEQ ID NO: 290954 - RNA, 22 nt, Human
uacugguguauuucuucuuauu

SEQ ID NO: 290955 - RNA, 21 nt, Human
uacugugccagggcagcucug

SEQ ID NO: 290956 - RNA, 22 nt, Human
uccauguugauaaucuugugaa

SEQ ID NO: 290957 - RNA, 22 nt, Human
uccagugaacaucauggcucca

SEQ ID NO: 290958 - RNA, 20 nt, Human
uccaguuuuggagacauucu

SEQ ID NO: 290959 - RNA, 22 nt, Human
uccagugccagcuguuaaaguu

SEQ ID NO: 290960 - RNA, 22 nt, Human
uaccuaacauugugcagagguu

SEQ ID NO: 290961 - RNA, 22 nt, Human
uacuagacugagaaucagcuga

SEQ ID NO: 290962 - RNA, 19 nt, Human
uaccagguuggagaggccc

SEQ ID NO: 290963 - RNA, 22 nt, Human
uaccauaaagcaggcaaaugag

SEQ ID NO: 290964 - RNA, 22 nt, Human
uccagaaagccguugacuuauu

SEQ ID NO: 290965 - RNA, 22 nt, Human
uccagaaaucucuguugauugu

SEQ ID NO: 290966 - RNA, 22 nt, Human
uccagagcuguccuacugugag

SEQ ID NO: 290967 - RNA, 22 nt, Human
uacaugggcguguucaguuagu

SEQ ID NO: 290968 - RNA, 21 nt, Human
uaccacugaaauugaucguuc

SEQ ID NO: 290969 - RNA, 22 nt, Human
uccacuaucugagcuuaguugc

SEQ ID NO: 290970 - RNA, 19 nt, Human
uccaccgcgugcaccucua

SEQ ID NO: 290971 - RNA, 22 nt, Human
uccaccacgaaacugcagcugc

SEQ ID NO: 290972 - RNA, 22 nt, Human
uccaccuaagucuccgggagcu

SEQ ID NO: 290973 - RNA, 22 nt, Human
uccacgcucuuucuacuuuuca

SEQ ID NO: 290974 - RNA, 22 nt, Human
uccacuaucagaccuguagucu

SEQ ID NO: 290975 - RNA, 22 nt, Human
uacaauguucgcauucucucug

SEQ ID NO: 290976 - RNA, 22 nt, Human
ucaucagccaaagaguccuuca

SEQ ID NO: 290977 - RNA, 22 nt, Human
uaagaauguuuguugaguaaau

SEQ ID NO: 290978 - RNA, 22 nt, Human
uaacuuuucuguucaauuuucc

SEQ ID NO: 290979 - RNA, 22 nt, Human
uaagauuuuuacaaauagagug

SEQ ID NO: 290980 - RNA, 22 nt, Human
uaagauauugagugguaauuug

SEQ ID NO: 290981 - RNA, 22 nt, Human
uaagagcagacacaaccugaga

SEQ ID NO: 290982 - RNA, 22 nt, Human
ucagagugagcuggggcugcuu

SEQ ID NO: 290983 - RNA, 23 nt, Human
uaaagauaguuuaaaggugaguu

SEQ ID NO: 290984 - RNA, 22 nt, Human
uaaagacaauuucgagcuguag

SEQ ID NO: 290985 - RNA, 22 nt, Human
uaagaaaggggaaguuccucuu

SEQ ID NO: 290986 - RNA, 22 nt, Human
ucaucauccuuuuuugaagagu

SEQ ID NO: 290987 - RNA, 22 nt, Human
uaagauggaagaaaaggcggau

SEQ ID NO: 290988 - RNA, 21 nt, Human
uaagccaccaugugaaaccag

SEQ ID NO: 290989 - RNA, 22 nt, Human
ucauccucguccucuggugccc

SEQ ID NO: 290990 - RNA, 22 nt, Human
uaagggagcagaagcugugaaa

SEQ ID NO: 290991 - RNA, 22 nt, Human
ucaucuauaaguagcaucuggg

SEQ ID NO: 290992 - RNA, 22 nt, Human
ucaucuuuauaaugcaaguuuu

SEQ ID NO: 290993 - RNA, 22 nt, Human
uaagggaagucuucaggagaca

SEQ ID NO: 290994 - RNA, 22 nt, Human
ucauccugucucuguucggaau

SEQ ID NO: 290995 - RNA, 22 nt, Human
ucauuguguaguagagguggca

SEQ ID NO: 290996 - RNA, 22 nt, Human
uaauucuacagggaacucugga

SEQ ID NO: 290997 - RNA, 22 nt, Human
ucauuugggauuuuuuauaauu

SEQ ID NO: 290998 - RNA, 22 nt, Human
uaauucuagauugacauuuuga

SEQ ID NO: 290999 - RNA, 22 nt, Human
uacaaaugaucaucucuuugaa

SEQ ID NO: 291000 - RNA, 22 nt, Human
uacaacuuacuugaauggcuuu

SEQ ID NO: 291001 - RNA, 22 nt, Human
uccaaauucccaugacagaagu

SEQ ID NO: 291002 - RNA, 22 nt, Human
uaaugcucauuuggcucugcaa

SEQ ID NO: 291003 - RNA, 22 nt, Human
ucauugguugcguaauuugauu

SEQ ID NO: 291004 - RNA, 22 nt, Human
ucauuggagcauaugaugguua

SEQ ID NO: 291005 - RNA, 20 nt, Human
ucauucagaaucaguaugca

SEQ ID NO: 291006 - RNA, 22 nt, Human
ucauugguugcauaauuugauc

SEQ ID NO: 291007 - RNA, 23 nt, Human
ucauugcucaagauaaugguuga

SEQ ID NO: 291008 - RNA, 22 nt, Human
ucauucucucguauucgcgaau

SEQ ID NO: 291009 - RNA, 21 nt, Human
uaauaauugggggcagggugg

SEQ ID NO: 291010 - RNA, 22 nt, Human
uaauaauuaacagugauggguc

SEQ ID NO: 291011 - RNA, 22 nt, Human
uaaguuguagaacguuuucuua

SEQ ID NO: 291012 - RNA, 22 nt, Human
uaauaaaaauuuaauucacauu

SEQ ID NO: 291013 - RNA, 22 nt, Human
uacugacguaguagaguugcuu

SEQ ID NO: 291014 - RNA, 22 nt, Human
uacucuggaguugagaugcgag

SEQ ID NO: 291015 - RNA, 22 nt, Human
uacuaucauuuuuuguugccaa

SEQ ID NO: 291016 - RNA, 22 nt, Human
uacucauuggagaauuacgagg

SEQ ID NO: 291017 - RNA, 22 nt, Human
uacuuacacugaagcaaagaua

SEQ ID NO: 291018 - RNA, 22 nt, Human
gugaagaugccucaggugaccc

SEQ ID NO: 291019 - RNA, 22 nt, Human
uacugcaguuccugcugucucc

SEQ ID NO: 291020 - RNA, 20 nt, Human
uacccgcagcugggucuggc

SEQ ID NO: 291021 - RNA, 22 nt, Human
uacccauuuugguucuugaugc

SEQ ID NO: 291022 - RNA, 20 nt, Human
uaccaucauuggcaaaccuc

SEQ ID NO: 291023 - RNA, 22 nt, Human
uaccaugggucaguuggguuug

SEQ ID NO: 291024 - RNA, 23 nt, Human
uaccauugauuuuaugguuuucu

SEQ ID NO: 291025 - RNA, 22 nt, Human
uacuauuuugacaugaaauuga

SEQ ID NO: 291026 - RNA, 22 nt, Human
uacuaaacugcauuucuaucua

SEQ ID NO: 291027 - RNA, 22 nt, Human
uaccaauuaaauagccaaucua

SEQ ID NO: 291028 - RNA, 22 nt, Human
uacagugaggcgagauucacca

SEQ ID NO: 291029 - RNA, 22 nt, Human
uacaguauuuuuuaagaaaaaa

SEQ ID NO: 291030 - RNA, 21 nt, Human
uacagcucaucaauuacugcu

SEQ ID NO: 291031 - RNA, 22 nt, Human
uaagugugcauguguauuauau

SEQ ID NO: 291032 - RNA, 23 nt, Human
gucagcuugaccaguggagaguc

SEQ ID NO: 291033 - RNA, 22 nt, Human
uaauaagugcuggcuguacauc

SEQ ID NO: 291034 - RNA, 22 nt, Human
uaauaacuacacucagaggacc

SEQ ID NO: 291035 - RNA, 22 nt, Human
uacaaauuguuuugccacaaag

SEQ ID NO: 291036 - RNA, 22 nt, Human
gucuauucaucauucaucaaac

SEQ ID NO: 291037 - RNA, 22 nt, Human
uacaaagugauuuuggaauuga

SEQ ID NO: 291038 - RNA, 22 nt, Human
uacaaauguuucuucuccuuuu

SEQ ID NO: 291039 - RNA, 22 nt, Human
uacaaauugccugacggcaggu

SEQ ID NO: 291040 - RNA, 23 nt, Human
gucucacaaccaccugagaaaau

SEQ ID NO: 291041 - RNA, 22 nt, Human
gucucuuuugauuuuucacuca

SEQ ID NO: 291042 - RNA, 22 nt, Human
gucugcagcacugugcacgguc

SEQ ID NO: 291043 - RNA, 18 nt, Human
uacagauguaugucuaca

SEQ ID NO: 291044 - RNA, 22 nt, Human
uagagaaauauuuguagugcug

SEQ ID NO: 291045 - RNA, 22 nt, Human
gugauggggagagcgcagcuuu

SEQ ID NO: 291046 - RNA, 19 nt, Human
gugaugaugccacuccaac

SEQ ID NO: 291047 - RNA, 22 nt, Human
gugaugugugaaggucugcagg

SEQ ID NO: 291048 - RNA, 22 nt, Human
uagaggauucuaaaggaagcug

SEQ ID NO: 291049 - RNA, 22 nt, Human
gugauuucaaauauagagugag

SEQ ID NO: 291050 - RNA, 22 nt, Human
uagagcucaagaagcaaaagcu

SEQ ID NO: 291051 - RNA, 22 nt, Human
uagagauagccaaguccuucaa

SEQ ID NO: 291052 - RNA, 22 nt, Human
uagaaauaaacacugcuaccuu

SEQ ID NO: 291053 - RNA, 22 nt, Human
gugaguuuucgugacacuauuu

SEQ ID NO: 291054 - RNA, 22 nt, Human
gugaggugauugcugguguuug

SEQ ID NO: 291055 - RNA, 22 nt, Human
uagauuccaaaauaguuugguu

SEQ ID NO: 291056 - RNA, 22 nt, Human
gugccuaaugacccauuuaucc

SEQ ID NO: 291057 - RNA, 22 nt, Human
gugccgcuggagcuggaauuga

SEQ ID NO: 291058 - RNA, 22 nt, Human
gugccuggaaucuuuucuucac

SEQ ID NO: 291059 - RNA, 22 nt, Human
uagcaaugugggugggcuccaa

SEQ ID NO: 291060 - RNA, 22 nt, Human
gugcgaaagaagcgacuccagu

SEQ ID NO: 291061 - RNA, 22 nt, Human
gugccuggugcaggauaaucac

SEQ ID NO: 291062 - RNA, 20 nt, Human
gugcggcucuaccacucggu

SEQ ID NO: 291063 - RNA, 22 nt, Human
gugcuacacaaauguuaguugu

SEQ ID NO: 291064 - RNA, 22 nt, Human
gugccgaugaggccuggcauuc

SEQ ID NO: 291065 - RNA, 22 nt, Human
gugcaucuguaauuacaauggu

SEQ ID NO: 291066 - RNA, 22 nt, Human
gugccaaauagcuugauuaaga

SEQ ID NO: 291067 - RNA, 22 nt, Human
uagaugaacagaaagccacugu

SEQ ID NO: 291068 - RNA, 22 nt, Human
uagaugcugagcuuaagagaau

SEQ ID NO: 291069 - RNA, 22 nt, Human
uagaucucugccuuguucagag

SEQ ID NO: 291070 - RNA, 22 nt, Human
uagauccaagguuggauugggg

SEQ ID NO: 291071 - RNA, 19 nt, Human
gugcacugucacuuugcuc

SEQ ID NO: 291072 - RNA, 22 nt, Human
gugcaaugaguguggcaaagcc

SEQ ID NO: 291073 - RNA, 22 nt, Human
gugcacagaaacauacaaugug

SEQ ID NO: 291074 - RNA, 22 nt, Human
gugcagcugguggagucugggg

SEQ ID NO: 291075 - RNA, 22 nt, Human
gugcagcugggcgcugaccuuc

SEQ ID NO: 291076 - RNA, 22 nt, Human
uagaguaagugugugcugagcu

SEQ ID NO: 291077 - RNA, 22 nt, Human
gguuaacaccacagcugggaca

SEQ ID NO: 291078 - RNA, 22 nt, Human
guuuuuacuuccaaugcuauga

SEQ ID NO: 291079 - RNA, 22 nt, Human
gguugauuuuuaugaagccaug

SEQ ID NO: 291080 - RNA, 22 nt, Human
uaaacugacagugagggagagu

SEQ ID NO: 291081 - RNA, 22 nt, Human
gguucaaagccugaugggguug

SEQ ID NO: 291082 - RNA, 22 nt, Human
gguuauuucugauuauaugaua

SEQ ID NO: 291083 - RNA, 22 nt, Human
uaaagaagaaaaggcuucaggc

SEQ ID NO: 291084 - RNA, 23 nt, Human
gguuggcuguacccaggcucccu

SEQ ID NO: 291085 - RNA, 22 nt, Human
uaaagcacucaaaauuguagcu

SEQ ID NO: 291086 - RNA, 22 nt, Human
uaaagaggagaauuaagucagc

SEQ ID NO: 291087 - RNA, 22 nt, Human
gguugggauuauccaaggcaga

SEQ ID NO: 291088 - RNA, 22 nt, Human
guaaauacuaugagauaaugaa

SEQ ID NO: 291089 - RNA, 22 nt, Human
guuuuggagauguccauuuucc

SEQ ID NO: 291090 - RNA, 22 nt, Human
gguggcuugcugguaggugugc

SEQ ID NO: 291091 - RNA, 22 nt, Human
guuuugaagagaagcaagucug

SEQ ID NO: 291092 - RNA, 22 nt, Human
gguggcauguaccucacagacu

SEQ ID NO: 291093 - RNA, 22 nt, Human
gguggcauucaguaaguauaua

SEQ ID NO: 291094 - RNA, 22 nt, Human
ggugcuuuucacaagcauggga

SEQ ID NO: 291095 - RNA, 22 nt, Human
guuuucuaaaacacauauaagu

SEQ ID NO: 291096 - RNA, 23 nt, Human
gguagguggggagauuaaagucu

SEQ ID NO: 291097 - RNA, 22 nt, Human
guuuuagugauaagaacaccaa

SEQ ID NO: 291098 - RNA, 22 nt, Human
ggugcuggggaaauuaggguag

SEQ ID NO: 291099 - RNA, 22 nt, Human
gguggagacucagauuuguugc

SEQ ID NO: 291100 - RNA, 22 nt, Human
guaggugggcuuccaagguccu

SEQ ID NO: 291101 - RNA, 22 nt, Human
guaguggaauuuagaguauaau

SEQ ID NO: 291102 - RNA, 22 nt, Human
guaguuagaguugugcuggaga

SEQ ID NO: 291103 - RNA, 22 nt, Human
guagugauuguuccucaggggu

SEQ ID NO: 291104 - RNA, 22 nt, Human
guaguucuuucucaauguucaa

SEQ ID NO: 291105 - RNA, 22 nt, Human
guaguuuuucuugcaagaguag

SEQ ID NO: 291106 - RNA, 22 nt, Human
guauauccaauaggugaugaaa

SEQ ID NO: 291107 - RNA, 22 nt, Human
guauaaagaugccauacuuacu

SEQ ID NO: 291108 - RNA, 22 nt, Human
guaguuuucaugguuagaaaua

SEQ ID NO: 291109 - RNA, 22 nt, Human
uaacucuagggacucgcccaga

SEQ ID NO: 291110 - RNA, 22 nt, Human
uaacgcaucuggaaacaggaca

SEQ ID NO: 291111 - RNA, 18 nt, Human
uaacugguuucuucccau

SEQ ID NO: 291112 - RNA, 22 nt, Human
uaacucugcuguggaaauggga

SEQ ID NO: 291113 - RNA, 22 nt, Human
uaacuugaauacauucuuuuca

SEQ ID NO: 291114 - RNA, 22 nt, Human
uaaauuggaauaaugagaagug

SEQ ID NO: 291115 - RNA, 22 nt, Human
uaaauuugugaauuagcuauca

SEQ ID NO: 291116 - RNA, 23 nt, Human
uaaauuuuauucugauaacacag

SEQ ID NO: 291117 - RNA, 22 nt, Human
uaacaguauacuacaucauauu

SEQ ID NO: 291118 - RNA, 23 nt, Human
uaacacaguccuggucuuuggcc

SEQ ID NO: 291119 - RNA, 22 nt, Human
guaagguuggaugcaaucaacu

SEQ ID NO: 291120 - RNA, 22 nt, Human
uaacaguggucugugguaucug

SEQ ID NO: 291121 - RNA, 22 nt, Human
uaacauuagcuuugcucaugca

SEQ ID NO: 291122 - RNA, 22 nt, Human
gucacuguuucacuguucauua

SEQ ID NO: 291123 - RNA, 22 nt, Human
gucagacucuggggccccaggc

SEQ ID NO: 291124 - RNA, 22 nt, Human
gucagacugaguuccuggguac

SEQ ID NO: 291125 - RNA, 22 nt, Human
gucacucuuuuucagcuagcuc

SEQ ID NO: 291126 - RNA, 22 nt, Human
gucacuuugcuugcgaugcucc

SEQ ID NO: 291127 - RNA, 22 nt, Human
gucaagaugcuacauaauggga

SEQ ID NO: 291128 - RNA, 22 nt, Human
gucacaaaugauuuagcaauca

SEQ ID NO: 291129 - RNA, 22 nt, Human
gucaccgguuuuuagguaaaca

SEQ ID NO: 291130 - RNA, 22 nt, Human
gucaaugcuuaguuugccugaa

SEQ ID NO: 291131 - RNA, 21 nt, Human
uaagcuaaacauucaguuaac

SEQ ID NO: 291132 - RNA, 23 nt, Human
uaagccacgugacccuuuauuug

SEQ ID NO: 291133 - RNA, 23 nt, Human
uaagccugugccugcuaccugcu

SEQ ID NO: 291134 - RNA, 22 nt, Human
guaugugugcauacauguacga

SEQ ID NO: 291135 - RNA, 22 nt, Human
guagucauugggucugugguca

SEQ ID NO: 291136 - RNA, 22 nt, Human
uaagagauuuauugaggacuuc

SEQ ID NO: 291137 - RNA, 22 nt, Human
guaugugguaccaugcaacggg

SEQ ID NO: 291138 - RNA, 22 nt, Human
uaagaggucugaaacgguggga

SEQ ID NO: 291139 - RNA, 22 nt, Human
guaucugaaaaagaauucugac

SEQ ID NO: 291140 - RNA, 22 nt, Human
uaacuuuuuauccuguuaaaug

SEQ ID NO: 291141 - RNA, 22 nt, Human
guauauuuaugagcauuagccu

SEQ ID NO: 291142 - RNA, 22 nt, Human
guaucaggugugagcauuuuaa

SEQ ID NO: 291143 - RNA, 22 nt, Human
gggcaggggcagugguggcauu

SEQ ID NO: 291144 - RNA, 22 nt, Human
gggcaggcuggguggugguccc

SEQ ID NO: 291145 - RNA, 22 nt, Human
gggcagaaaggaaggcuggggg

SEQ ID NO: 291146 - RNA, 22 nt, Human
gggcacggaaggcgccaggggu

SEQ ID NO: 291147 - RNA, 22 nt, Human
gggcagagggcgagcugggaga

SEQ ID NO: 291148 - RNA, 22 nt, Human
gggcagagagcuggaacuccuu

SEQ ID NO: 291149 - RNA, 22 nt, Human
ggccuugguggcuuugcugaug

SEQ ID NO: 291150 - RNA, 22 nt, Human
ggccuugggauguggcugcagc

SEQ ID NO: 291151 - RNA, 22 nt, Human
guggagaagggaccgggaagga

SEQ ID NO: 291152 - RNA, 22 nt, Human
guggagauauuugugauagggg

SEQ ID NO: 291153 - RNA, 22 nt, Human
guggagaucuggugcccccugg

SEQ ID NO: 291154 - RNA, 22 nt, Human
guggagaaauauguucagcuuc

SEQ ID NO: 291155 - RNA, 20 nt, Human
gggccagguggaccaggggc

SEQ ID NO: 291156 - RNA, 22 nt, Human
gggccccugagauggguuuucu

SEQ ID NO: 291157 - RNA, 22 nt, Human
gugggcuuuuuugaaaccugaa

SEQ ID NO: 291158 - RNA, 22 nt, Human
gugggggcagaagcgagugcag

SEQ ID NO: 291159 - RNA, 22 nt, Human
gugggauaaccugagauaacau

SEQ ID NO: 291160 - RNA, 22 nt, Human
gugggaggaguguugaguaagu

SEQ ID NO: 291161 - RNA, 22 nt, Human
gggccuguccccccaggagaac

SEQ ID NO: 291162 - RNA, 21 nt, Human
gggccugggccagggccgggu

SEQ ID NO: 291163 - RNA, 22 nt, Human
gugggggugaggaauguucuau

SEQ ID NO: 291164 - RNA, 22 nt, Human
guggguauauauaugugugcug

SEQ ID NO: 291165 - RNA, 22 nt, Human
guggggguaggggguuuucugg

SEQ ID NO: 291166 - RNA, 22 nt, Human
guggggguaggggguuuccugg

SEQ ID NO: 291167 - RNA, 22 nt, Human
guggcagagccuugcggcuuug

SEQ ID NO: 291168 - RNA, 20 nt, Human
guggcagugguggcagcagu

SEQ ID NO: 291169 - RNA, 22 nt, Human
guggcuggguggaacugagucu

SEQ ID NO: 291170 - RNA, 22 nt, Human
guggcuuauguccagcagauau

SEQ ID NO: 291171 - RNA, 22 nt, Human
guggcuuucuaccauuaaauug

SEQ ID NO: 291172 - RNA, 22 nt, Human
guggcuuaauauuuauagcaga

SEQ ID NO: 291173 - RNA, 22 nt, Human
guggcgucgaugauggugucau

SEQ ID NO: 291174 - RNA, 22 nt, Human
guggcauggggagcagcuagaa

SEQ ID NO: 291175 - RNA, 22 nt, Human
gugucuuauugauguuggcacu

SEQ ID NO: 291176 - RNA, 22 nt, Human
gggcugagagcuggaaucugag

SEQ ID NO: 291177 - RNA, 22 nt, Human
gggcugaugcuuauacauacug

SEQ ID NO: 291178 - RNA, 22 nt, Human
gggcucuuaauuuuuuucucua

SEQ ID NO: 291179 - RNA, 22 nt, Human
gggcuguaggagcuggaauggg

SEQ ID NO: 291180 - RNA, 22 nt, Human
gggcuggggcucuggggcuagg

SEQ ID NO: 291181 - RNA, 22 nt, Human
guguggcgacucagagcugccu

SEQ ID NO: 291182 - RNA, 22 nt, Human
gugugcacaaucuggcaugugc

SEQ ID NO: 291183 - RNA, 22 nt, Human
guguguauguagguauauaugu

SEQ ID NO: 291184 - RNA, 22 nt, Human
guguuaaucauuuuugauuuug

SEQ ID NO: 291185 - RNA, 22 nt, Human
gugugugucuacuuucaucucu

SEQ ID NO: 291186 - RNA, 22 nt, Human
guguuagagucuugugcucauu

SEQ ID NO: 291187 - RNA, 22 nt, Human
gggcuuaaccuggguaugaggg

SEQ ID NO: 291188 - RNA, 20 nt, Human
gggcuuugagcucagggcuu

SEQ ID NO: 291189 - RNA, 22 nt, Human
gggcuuuuccaacacucuggag

SEQ ID NO: 291190 - RNA, 18 nt, Human
gggcuuugggguucuauc

SEQ ID NO: 291191 - RNA, 22 nt, Human
guguucuucacuguuagaaggu

SEQ ID NO: 291192 - RNA, 22 nt, Human
gggcgcaagcaugugucugggu

SEQ ID NO: 291193 - RNA, 22 nt, Human
gggcgagcgucucagccgggcg

SEQ ID NO: 291194 - RNA, 22 nt, Human
gggccucccggagcugcuccca

SEQ ID NO: 291195 - RNA, 22 nt, Human
guggguuggguuuuugaaggga

SEQ ID NO: 291196 - RNA, 22 nt, Human
gugguaccaguaggucagccau

SEQ ID NO: 291197 - RNA, 22 nt, Human
gggcggggcuuccguccuccac

SEQ ID NO: 291198 - RNA, 22 nt, Human
gggcggccugcucuguggggag

SEQ ID NO: 291199 - RNA, 22 nt, Human
guggucaagaccgggaauagga

SEQ ID NO: 291200 - RNA, 23 nt, Human
gugguguaaaugccaaaaugaaa

SEQ ID NO: 291201 - RNA, 17 nt, Human
gugguguacauuuccau

SEQ ID NO: 291202 - RNA, 22 nt, Human
gggcggugccugucuccgaagc

SEQ ID NO: 291203 - RNA, 22 nt, Human
gggcuagggucagggggccacu

SEQ ID NO: 291204 - RNA, 22 nt, Human
gugguggugaggcaaggggugu

SEQ ID NO: 291205 - RNA, 22 nt, Human
ggguuuuaccagauguguggug

SEQ ID NO: 291206 - RNA, 22 nt, Human
ggguuguuuguauuucucugaa

SEQ ID NO: 291207 - RNA, 22 nt, Human
ggguuccuuggaacacuguuug

SEQ ID NO: 291208 - RNA, 22 nt, Human
ggguucugggaggacuagggga

SEQ ID NO: 291209 - RNA, 22 nt, Human
ggguguuuuuggugacagggag

SEQ ID NO: 291210 - RNA, 22 nt, Human
ggguuaaauggauggcauuugc

SEQ ID NO: 291211 - RNA, 22 nt, Human
ggguuacgaugauuucaugugu

SEQ ID NO: 291212 - RNA, 22 nt, Human
ggguucauuugccggguaguuu

SEQ ID NO: 291213 - RNA, 22 nt, Human
guucuuuacuucgcaucugcua

SEQ ID NO: 291214 - RNA, 22 nt, Human
ggguuuguuccuacuucuacuc

SEQ ID NO: 291215 - RNA, 22 nt, Human
guucuucagcccucagguccua

SEQ ID NO: 291216 - RNA, 22 nt, Human
ggguuuugugauugccucugaa

SEQ ID NO: 291217 - RNA, 22 nt, Human
gguagagagugaggaggggcuc

SEQ ID NO: 291218 - RNA, 22 nt, Human
gguaccuggcccuggggcugcu

SEQ ID NO: 291219 - RNA, 22 nt, Human
gguaagcugcuguagggucaga

SEQ ID NO: 291220 - RNA, 22 nt, Human
gguaauguucugaugaauuugu

SEQ ID NO: 291221 - RNA, 22 nt, Human
guugcaaaugggaagaugguua

SEQ ID NO: 291222 - RNA, 23 nt, Human
guugccuuugcaucuucauccau

SEQ ID NO: 291223 - RNA, 22 nt, Human
guugccugguuucaaaaggaau

SEQ ID NO: 291224 - RNA, 22 nt, Human
guugauauggaaacucuagguu

SEQ ID NO: 291225 - RNA, 17 nt, Human
guucucaaacugacuga

SEQ ID NO: 291226 - RNA, 22 nt, Human
gggucggcacucuggcagcacc

SEQ ID NO: 291227 - RNA, 21 nt, Human
gggugcacagcaaauuugaga

SEQ ID NO: 291228 - RNA, 22 nt, Human
gggugcucagugccaaggagug

SEQ ID NO: 291229 - RNA, 22 nt, Human
guucaccaguagcugggcuguu

SEQ ID NO: 291230 - RNA, 22 nt, Human
guucuguauauauccuagcaaa

SEQ ID NO: 291231 - RNA, 22 nt, Human
guucucauugugaugcuuaguu

SEQ ID NO: 291232 - RNA, 22 nt, Human
ggguggcaagucuuucugcaac

SEQ ID NO: 291233 - RNA, 22 nt, Human
gggugcucauggauaaggcgaa

SEQ ID NO: 291234 - RNA, 22 nt, Human
gggugcuucauaggugaugcug

SEQ ID NO: 291235 - RNA, 22 nt, Human
ggguggugauacugcuucugcc

SEQ ID NO: 291236 - RNA, 22 nt, Human
ggguggugagagaacuuugcag

SEQ ID NO: 291237 - RNA, 21 nt, Human
guucuuaguuauauucucaau

SEQ ID NO: 291238 - RNA, 22 nt, Human
guucuguucuucacagguuugu

SEQ ID NO: 291239 - RNA, 22 nt, Human
ggguguuaugccucugagucag

SEQ ID NO: 291240 - RNA, 22 nt, Human
gggugguuccuggaucugacug

SEQ ID NO: 291241 - RNA, 22 nt, Human
gggugguggagguuugacagac

SEQ ID NO: 291242 - RNA, 22 nt, Human
gggggggcagguuggaugucag

SEQ ID NO: 291243 - RNA, 22 nt, Human
guuauacuuaugugcaaaaaua

SEQ ID NO: 291244 - RNA, 22 nt, Human
guuaggcagugugguauagcag

SEQ ID NO: 291245 - RNA, 22 nt, Human
guuagacuugcguggaucauga

SEQ ID NO: 291246 - RNA, 22 nt, Human
guuacuacccacccuucucccc

SEQ ID NO: 291247 - RNA, 22 nt, Human
ggggcugggaggccggcgcgca

SEQ ID NO: 291248 - RNA, 22 nt, Human
gggggacagugugccuggugug

SEQ ID NO: 291249 - RNA, 22 nt, Human
ggggcuccuguggcuauaugua

SEQ ID NO: 291250 - RNA, 22 nt, Human
ggggcuuggguagagcagaaac

SEQ ID NO: 291251 - RNA, 22 nt, Human
ggggcuuggguaagaaugcaaa

SEQ ID NO: 291252 - RNA, 22 nt, Human
ggggugugcugggagaagggau

SEQ ID NO: 291253 - RNA, 22 nt, Human
guuauuguuauugcguugucga

SEQ ID NO: 291254 - RNA, 22 nt, Human
guuaguucccaccccuguaaga

SEQ ID NO: 291255 - RNA, 22 nt, Human
guuauugggagagggaauggga

SEQ ID NO: 291256 - RNA, 22 nt, Human
ggguacaccaauggaugccagg

SEQ ID NO: 291257 - RNA, 22 nt, Human
gggguugauaauuagagaaaug

SEQ ID NO: 291258 - RNA, 21 nt, Human
gggguuuuguucuuauaaugu

SEQ ID NO: 291259 - RNA, 22 nt, Human
ggguauuugacaaacugacacu

SEQ ID NO: 291260 - RNA, 22 nt, Human
guucacauccuugugaggauuu

SEQ ID NO: 291261 - RNA, 22 nt, Human
guucaaggagcagcuugcuaca

SEQ ID NO: 291262 - RNA, 22 nt, Human
guuauuuugucuuguucaugaa

SEQ ID NO: 291263 - RNA, 22 nt, Human
guucaaccaugauuaggaacug

SEQ ID NO: 291264 - RNA, 22 nt, Human
guguugaugugucuguauucua

SEQ ID NO: 291265 - RNA, 22 nt, Human
ggggaagagagaagaaugaucu

SEQ ID NO: 291266 - RNA, 22 nt, Human
ggggaggaagcuggaacacggg

SEQ ID NO: 291267 - RNA, 22 nt, Human
ggggaauuaaaugagaagccuu

SEQ ID NO: 291268 - RNA, 22 nt, Human
guguuuguauccuccauauaac

SEQ ID NO: 291269 - RNA, 23 nt, Human
guguuguugauuuucgaaucuuu

SEQ ID NO: 291270 - RNA, 22 nt, Human
guguuuauguuuuugcuaggga

SEQ ID NO: 291271 - RNA, 22 nt, Human
ggggagggcugagcacgguuga

SEQ ID NO: 291272 - RNA, 22 nt, Human
ggggaggguuuggaugagaguc

SEQ ID NO: 291273 - RNA, 22 nt, Human
guguuggugagcucauuuccac

SEQ ID NO: 291274 - RNA, 22 nt, Human
guguugcaggaagauauagcug

SEQ ID NO: 291275 - RNA, 21 nt, Human
guuaccacugaugcaacagga

SEQ ID NO: 291276 - RNA, 22 nt, Human
guuaauaugcaaaacggaugcg

SEQ ID NO: 291277 - RNA, 22 nt, Human
guuaaaugcagauucugacuca

SEQ ID NO: 291278 - RNA, 22 nt, Human
guuaaaggaagccauauguucg

SEQ ID NO: 291279 - RNA, 22 nt, Human
guuagaauggacaaagcugaaa

SEQ ID NO: 291280 - RNA, 22 nt, Human
ggggauuuuucuuacucuuagg

SEQ ID NO: 291281 - RNA, 22 nt, Human
ggggauuucccaaugcgaagca

SEQ ID NO: 291282 - RNA, 22 nt, Human
ggggcgaguguggaccgcagcc

SEQ ID NO: 291283 - RNA, 22 nt, Human
ggggccaugauggacgagguga

SEQ ID NO: 291284 - RNA, 22 nt, Human
gccuuuauauuacauuuggaag

SEQ ID NO: 291285 - RNA, 22 nt, Human
ggaccagagcuaaugcgcgccc

SEQ ID NO: 291286 - RNA, 22 nt, Human
ggacagacuuuacagccccggg

SEQ ID NO: 291287 - RNA, 22 nt, Human
ggacccagggcuuauucauguu

SEQ ID NO: 291288 - RNA, 23 nt, Human
ggaauuucagaugugaaauaaaa

SEQ ID NO: 291289 - RNA, 22 nt, Human
ggacggggagcuggaaagggga

SEQ ID NO: 291290 - RNA, 22 nt, Human
ggagaugaaugugguaaaacug

SEQ ID NO: 291291 - RNA, 22 nt, Human
ggagaucugggcuguuucuggc

SEQ ID NO: 291292 - RNA, 22 nt, Human
ggagaaacuaguuagauccaau

SEQ ID NO: 291293 - RNA, 22 nt, Human
gcgcgccugccucccgcggugc

SEQ ID NO: 291294 - RNA, 22 nt, Human
gccaucuucggcagccgccugg

SEQ ID NO: 291295 - RNA, 19 nt, Human
gcugggauaggauguauuu

SEQ ID NO: 291296 - RNA, 22 nt, Human
gcugggagucgcgucuguggcc

SEQ ID NO: 291297 - RNA, 22 nt, Human
ggaagccugggcgcaggcaggg

SEQ ID NO: 291298 - RNA, 22 nt, Human
ggaagcugucugcccggcgcuc

SEQ ID NO: 291299 - RNA, 22 nt, Human
gccugcuugaaagcacuuucug

SEQ ID NO: 291300 - RNA, 22 nt, Human
gccugcugggcucuuccugcug

SEQ ID NO: 291301 - RNA, 22 nt, Human
ggaauaauauuacagauacagu

SEQ ID NO: 291302 - RNA, 22 nt, Human
ggaagguauuucuccuugagug

SEQ ID NO: 291303 - RNA, 22 nt, Human
ggaagaggaagaugaggcagca

SEQ ID NO: 291304 - RNA, 22 nt, Human
ggaaggggagcuggaaagggua

SEQ ID NO: 291305 - RNA, 18 nt, Human
ggaaggugcuggagugca

SEQ ID NO: 291306 - RNA, 22 nt, Human
gcgggcgcuguggccccggccu

SEQ ID NO: 291307 - RNA, 22 nt, Human
gcggcuggcuguccaaacuggg

SEQ ID NO: 291308 - RNA, 22 nt, Human
gcggcgucccagcuccgacggc

SEQ ID NO: 291309 - RNA, 22 nt, Human
ggcagaaaacaauaaccauuuc

SEQ ID NO: 291310 - RNA, 22 nt, Human
ggcaaagaguacaucguccugg

SEQ ID NO: 291311 - RNA, 23 nt, Human
ggauccugacauauaccaucacc

SEQ ID NO: 291312 - RNA, 22 nt, Human
ggaucccaucgagcuggcuguc

SEQ ID NO: 291313 - RNA, 22 nt, Human
ggagccaguuuagaccucaguu

SEQ ID NO: 291314 - RNA, 22 nt, Human
ggauaauugaugauuuauaaga

SEQ ID NO: 291315 - RNA, 22 nt, Human
ggagccucuaaacaguuaucaa

SEQ ID NO: 291316 - RNA, 22 nt, Human
ggauggaugugaucugccuccu

SEQ ID NO: 291317 - RNA, 22 nt, Human
ggaugcguuugaauguguuugu

SEQ ID NO: 291318 - RNA, 22 nt, Human
ggaugcagcagagaccuggagu

SEQ ID NO: 291319 - RNA, 22 nt, Human
ggaucuaaagccagaauauaug

SEQ ID NO: 291320 - RNA, 22 nt, Human
ggaugcugcuccacaucccaca

SEQ ID NO: 291321 - RNA, 22 nt, Human
ggaugaguuguauauaggauuc

SEQ ID NO: 291322 - RNA, 22 nt, Human
ggauccuucagcacugaggugu

SEQ ID NO: 291323 - RNA, 22 nt, Human
ggaugauuuucaguuguguggg

SEQ ID NO: 291324 - RNA, 22 nt, Human
gcgguggcuacuaaaguucgaa

SEQ ID NO: 291325 - RNA, 22 nt, Human
gcgguguuuuaacacucccucg

SEQ ID NO: 291326 - RNA, 22 nt, Human
gcguguauuccagaccuuaacg

SEQ ID NO: 291327 - RNA, 21 nt, Human
ggcagagaagcuggaaguugg

SEQ ID NO: 291328 - RNA, 22 nt, Human
ggcagaggaagcuggaaguggg

SEQ ID NO: 291329 - RNA, 22 nt, Human
ggcagaggagcuggaaacaugg

SEQ ID NO: 291330 - RNA, 22 nt, Human
ggcagagguagcuggaaccagg

SEQ ID NO: 291331 - RNA, 22 nt, Human
ggcaggaaguaaggaugcuaca

SEQ ID NO: 291332 - RNA, 22 nt, Human
gcucaugggcccagagcagccc

SEQ ID NO: 291333 - RNA, 23 nt, Human
gcucauguugcuucuguucuguc

SEQ ID NO: 291334 - RNA, 22 nt, Human
gcuccacugccccugggcaccg

SEQ ID NO: 291335 - RNA, 22 nt, Human
ggcggcaagggaauggagaaga

SEQ ID NO: 291336 - RNA, 22 nt, Human
ggcgcccucccuguccgucuuc

SEQ ID NO: 291337 - RNA, 22 nt, Human
ggcgaguacagacggggccugg

SEQ ID NO: 291338 - RNA, 22 nt, Human
ggcgccuuguggaaugagagcu

SEQ ID NO: 291339 - RNA, 22 nt, Human
ggcggcugcuccuugcccucgg

SEQ ID NO: 291340 - RNA, 22 nt, Human
ggcgggucuagggcccuggagu

SEQ ID NO: 291341 - RNA, 22 nt, Human
ggcuaaucaagaaggcccagug

SEQ ID NO: 291342 - RNA, 23 nt, Human
ggcgugcugggcugacccuuggc

SEQ ID NO: 291343 - RNA, 22 nt, Human
ggcuauuguuuuaaaaaaugag

SEQ ID NO: 291344 - RNA, 22 nt, Human
ggcgaugaggucuuagaaucua

SEQ ID NO: 291345 - RNA, 22 nt, Human
gcugcuggcggagcuggcgcug

SEQ ID NO: 291346 - RNA, 22 nt, Human
gcugcuacagagcuggaggggg

SEQ ID NO: 291347 - RNA, 22 nt, Human
gcugcucaaaaaaacacuagcu

SEQ ID NO: 291348 - RNA, 22 nt, Human
gcugcgcgcagccggcgccgag

SEQ ID NO: 291349 - RNA, 22 nt, Human
gcugcgccgggagccggggccg

SEQ ID NO: 291350 - RNA, 23 nt, Human
ggccuuuuuaaccgcgagcgaca

SEQ ID NO: 291351 - RNA, 22 nt, Human
ggccuugauuccggucauugaa

SEQ ID NO: 291352 - RNA, 23 nt, Human
gcugccguuucccaucgugguga

SEQ ID NO: 291353 - RNA, 22 nt, Human
gcugccuugaacuuggccuggg

SEQ ID NO: 291354 - RNA, 22 nt, Human
gcugccgcugcggggcgcgggc

SEQ ID NO: 291355 - RNA, 22 nt, Human
ggccagcgugggggaguagcgg

SEQ ID NO: 291356 - RNA, 22 nt, Human
gcugcccucccagggcaagcuu

SEQ ID NO: 291357 - RNA, 22 nt, Human
gcucugcuccaucuguuuccuc

SEQ ID NO: 291358 - RNA, 22 nt, Human
gcucuggcuacuguggcuaccg

SEQ ID NO: 291359 - RNA, 22 nt, Human
gcucuggcugccuuaguuuugu

SEQ ID NO: 291360 - RNA, 20 nt, Human
gcucuucuccgggucugccu

SEQ ID NO: 291361 - RNA, 18 nt, Human
gcugaaauucuaaacaaa

SEQ ID NO: 291362 - RNA, 22 nt, Human
gcucuugcuuuuucuagaaaga

SEQ ID NO: 291363 - RNA, 22 nt, Human
ggcccuggggcaggagcagagg

SEQ ID NO: 291364 - RNA, 22 nt, Human
ggccgccacacagauucccccg

SEQ ID NO: 291365 - RNA, 22 nt, Human
ggccagucaaggggauccugaa

SEQ ID NO: 291366 - RNA, 22 nt, Human
ggccgccgcuuagcugagcccc

SEQ ID NO: 291367 - RNA, 22 nt, Human
ggccagcuuugagcugcaggaa

SEQ ID NO: 291368 - RNA, 22 nt, Human
ggccaguauacaaacuuccggu

SEQ ID NO: 291369 - RNA, 22 nt, Human
ggcccgcgcugcuggcgcgcca

SEQ ID NO: 291370 - RNA, 22 nt, Human
ggccugagaagcaaggacacaa

SEQ ID NO: 291371 - RNA, 22 nt, Human
ggccgggcaugcgagcugagcg

SEQ ID NO: 291372 - RNA, 22 nt, Human
ggccuggccuccugcuuuucca

SEQ ID NO: 291373 - RNA, 22 nt, Human
ggccuggcacauaguaggcagu

SEQ ID NO: 291374 - RNA, 22 nt, Human
ggcucuggcgagcuuuaguaca

SEQ ID NO: 291375 - RNA, 22 nt, Human
gcuggaugucugugccaggcac

SEQ ID NO: 291376 - RNA, 22 nt, Human
ggcucguaaaggccucacaggu

SEQ ID NO: 291377 - RNA, 22 nt, Human
gcugcuggcuuccugcuguuuu

SEQ ID NO: 291378 - RNA, 22 nt, Human
gcugcuuagaaccauauuuaaa

SEQ ID NO: 291379 - RNA, 22 nt, Human
gcuggaaauaacuuguguagaa

SEQ ID NO: 291380 - RNA, 22 nt, Human
ggcuccaggguaccccuggaug

SEQ ID NO: 291381 - RNA, 22 nt, Human
ggcuccagauguccccuggcaa

SEQ ID NO: 291382 - RNA, 22 nt, Human
ggcucagaggagcuggaacggu

SEQ ID NO: 291383 - RNA, 22 nt, Human
ggcucacuguaccugccgccgc

SEQ ID NO: 291384 - RNA, 17 nt, Human
ggcugccaggcaacaua

SEQ ID NO: 291385 - RNA, 22 nt, Human
ggcugcagugcaacucuuucua

SEQ ID NO: 291386 - RNA, 22 nt, Human
ggcugcugcccaccccugcaug

SEQ ID NO: 291387 - RNA, 22 nt, Human
ggcugcuauuggucuggcuugg

SEQ ID NO: 291388 - RNA, 22 nt, Human
gcuggccugcgagggcaggcug

SEQ ID NO: 291389 - RNA, 22 nt, Human
gcuggcgauggccgagucuccg

SEQ ID NO: 291390 - RNA, 22 nt, Human
gcuggcggguuggggaggcgga

SEQ ID NO: 291391 - RNA, 22 nt, Human
gcugguuucucucauugucagu

SEQ ID NO: 291392 - RNA, 22 nt, Human
gcuguacugucugccaagccag

SEQ ID NO: 291393 - RNA, 22 nt, Human
gcugucaggaacaugccuuggu

SEQ ID NO: 291394 - RNA, 22 nt, Human
gcuguauaucuuuugaagugau

SEQ ID NO: 291395 - RNA, 22 nt, Human
ggcuguggcagcuggaaguggu

SEQ ID NO: 291396 - RNA, 20 nt, Human
gcugugccaugacccucgag

SEQ ID NO: 291397 - RNA, 21 nt, Human
ggcuguuaauagugauuagaa

SEQ ID NO: 291398 - RNA, 22 nt, Human
ggcuuaguagggacagaugcac

SEQ ID NO: 291399 - RNA, 22 nt, Human
ggcuuacgcgcuaacagugaau

SEQ ID NO: 291400 - RNA, 22 nt, Human
ggcugggaggcggaggcugaga

SEQ ID NO: 291401 - RNA, 18 nt, Human
ggcugggcugugccccuu

SEQ ID NO: 291402 - RNA, 22 nt, Human
ggcuggagcaggcugcacagug

SEQ ID NO: 291403 - RNA, 22 nt, Human
gcuggguaguucuuguuuggga

SEQ ID NO: 291404 - RNA, 22 nt, Human
gcuggggaucgaaggcagagcc

SEQ ID NO: 291405 - RNA, 22 nt, Human
gcugggccucuuacuucuuacg

SEQ ID NO: 291406 - RNA, 22 nt, Human
gcuggugugagauucucgaggg

SEQ ID NO: 291407 - RNA, 22 nt, Human
gcugggucucucccugguccug

SEQ ID NO: 291408 - RNA, 22 nt, Human
gcuggguuguucuccuggucca

SEQ ID NO: 291409 - RNA, 22 nt, Human
gguguacgaagaggcgggaguc

SEQ ID NO: 291410 - RNA, 22 nt, Human
gguguaaggaagauggaagaug

SEQ ID NO: 291411 - RNA, 22 nt, Human
ggugguucagugguuagggcca

SEQ ID NO: 291412 - RNA, 22 nt, Human
ggcagugguaggagcccaggag

SEQ ID NO: 291413 - RNA, 22 nt, Human
ggcagucuuucccuugagcucu

SEQ ID NO: 291414 - RNA, 22 nt, Human
ggcagucaucacuuauucauca

SEQ ID NO: 291415 - RNA, 22 nt, Human
ggugggaauccaggccuucauc

SEQ ID NO: 291416 - RNA, 22 nt, Human
gguggcuucuguuugcaagagg

SEQ ID NO: 291417 - RNA, 22 nt, Human
ggugcugcugcugaacccagcu

SEQ ID NO: 291418 - RNA, 22 nt, Human
gguggccuaacaaugguggcaa

SEQ ID NO: 291419 - RNA, 22 nt, Human
ggugaucucuggcucugcuugu

SEQ ID NO: 291420 - RNA, 22 nt, Human
ggugcagucuggggcacauuau

SEQ ID NO: 291421 - RNA, 22 nt, Human
ggugcaauaaaguuguagaacc

SEQ ID NO: 291422 - RNA, 22 nt, Human
ggcagcagaacuggcccuguau

SEQ ID NO: 291423 - RNA, 22 nt, Human
ggugccugggcacggaaagcau

SEQ ID NO: 291424 - RNA, 22 nt, Human
ggcagggacugggauauggaga

SEQ ID NO: 291425 - RNA, 22 nt, Human
ggcagggagagcaugcugauaa

SEQ ID NO: 291426 - RNA, 18 nt, Human
ggcagggcucagcugcuc

SEQ ID NO: 291427 - RNA, 22 nt, Human
ggcagcuuucaauaggguuaug

SEQ ID NO: 291428 - RNA, 22 nt, Human
ggcaggauggagcagggcuaaa

SEQ ID NO: 291429 - RNA, 22 nt, Human
ggcagggaauucagagggaagg

SEQ ID NO: 291430 - RNA, 22 nt, Human
ggucgguuggagagaucaugaa

SEQ ID NO: 291431 - RNA, 22 nt, Human
ggucggggcuggccggcguggu

SEQ ID NO: 291432 - RNA, 22 nt, Human
ggcacgagccaguguguguguu

SEQ ID NO: 291433 - RNA, 22 nt, Human
ggcaccuuucaucccaucuaga

SEQ ID NO: 291434 - RNA, 22 nt, Human
ggcaagauccagcacaaacaca

SEQ ID NO: 291435 - RNA, 22 nt, Human
ggucucugggacguuggaucgc

SEQ ID NO: 291436 - RNA, 22 nt, Human
ggucuuauaauuaauuuaggcu

SEQ ID NO: 291437 - RNA, 22 nt, Human
ggucuucauaugccacagaguc

SEQ ID NO: 291438 - RNA, 22 nt, Human
ggucuucauucuaccagacuuu

SEQ ID NO: 291439 - RNA, 22 nt, Human
gguaauugaaaguuuguugaug

SEQ ID NO: 291440 - RNA, 22 nt, Human
gggugugcuaaaccuacgcaca

SEQ ID NO: 291441 - RNA, 22 nt, Human
ggauaauguauuuuaaaauggg

SEQ ID NO: 291442 - RNA, 22 nt, Human
ggauuucuucucauaacugaga

SEQ ID NO: 291443 - RNA, 22 nt, Human
ggauggugauguacccagucau

SEQ ID NO: 291444 - RNA, 22 nt, Human
guaagaauauacccaggaguca

SEQ ID NO: 291445 - RNA, 22 nt, Human
guaaaucuuggcaucugcuuuc

SEQ ID NO: 291446 - RNA, 22 nt, Human
guaaacugaauuggauacugug

SEQ ID NO: 291447 - RNA, 22 nt, Human
gguuuuuggcucaauauuuugg

SEQ ID NO: 291448 - RNA, 22 nt, Human
guaauugcucauauggcaccug

SEQ ID NO: 291449 - RNA, 22 nt, Human
guacauauggcacaugcuauuu

SEQ ID NO: 291450 - RNA, 22 nt, Human
guacaaagucaaggugaaaaua

SEQ ID NO: 291451 - RNA, 22 nt, Human
guacauauccuuuacguuuugu

SEQ ID NO: 291452 - RNA, 22 nt, Human
guaacugguuuucuucccucuc

SEQ ID NO: 291453 - RNA, 22 nt, Human
guaaccacuaugguuauugauu

SEQ ID NO: 291454 - RNA, 22 nt, Human
guaaggcaggagucuuaaaccu

SEQ ID NO: 291455 - RNA, 22 nt, Human
guaauucugugugaaucuauua

SEQ ID NO: 291456 - RNA, 22 nt, Human
ggcccugcuuccccaguguaca

SEQ ID NO: 291457 - RNA, 22 nt, Human
gguugccuuugcaguuggauca

SEQ ID NO: 291458 - RNA, 22 nt, Human
gguugccuguggcucccuguua

SEQ ID NO: 291459 - RNA, 22 nt, Human
gguuuucagaaugcaguccugu

SEQ ID NO: 291460 - RNA, 22 nt, Human
ggcccucucuacauguuagacg

SEQ ID NO: 291461 - RNA, 22 nt, Human
gguucuggaaaagaaagcaaag

SEQ ID NO: 291462 - RNA, 21 nt, Human
ggccagauucucccauagcug

SEQ ID NO: 291463 - RNA, 22 nt, Human
gguguagggaaacuugacuaau

SEQ ID NO: 291464 - RNA, 20 nt, Human
ggccugagcauggcuggcag

SEQ ID NO: 291465 - RNA, 18 nt, Human
ggccucagccuggccgga

SEQ ID NO: 291466 - RNA, 22 nt, Human
ggccugcuaccagcugugaccu

SEQ ID NO: 291467 - RNA, 22 nt, Human
ggccugcucuggcuguggucag

SEQ ID NO: 291468 - RNA, 22 nt, Human
ggccuucuuuucaugucuuucg

SEQ ID NO: 291469 - RNA, 22 nt, Human
ggccgccacuuuccagugcugc

SEQ ID NO: 291470 - RNA, 22 nt, Human
ggccgcuuucuggggagugagg

SEQ ID NO: 291471 - RNA, 22 nt, Human
guaguucuccaggggcuguuca

SEQ ID NO: 291472 - RNA, 22 nt, Human
guagaucaugaaaauucacugc

SEQ ID NO: 291473 - RNA, 22 nt, Human
guagccauuuucuagagaguua

SEQ ID NO: 291474 - RNA, 22 nt, Human
guaggggccagaaagacuuaga

SEQ ID NO: 291475 - RNA, 22 nt, Human
guagucuuaggaaugauuuugu

SEQ ID NO: 291476 - RNA, 22 nt, Human
guacuugauucauuauugcauu

SEQ ID NO: 291477 - RNA, 22 nt, Human
guacugguuuucuuacucuggc

SEQ ID NO: 291478 - RNA, 22 nt, Human
gggauguuuugcaggcaaagaa

SEQ ID NO: 291479 - RNA, 22 nt, Human
gggauguauguuuguguggaga

SEQ ID NO: 291480 - RNA, 22 nt, Human
gggaggucgaggcugggccgca

SEQ ID NO: 291481 - RNA, 22 nt, Human
ggaaaagaauuguuaguuagug

SEQ ID NO: 291482 - RNA, 22 nt, Human
gggauuuaaugggaaaaauaug

SEQ ID NO: 291483 - RNA, 22 nt, Human
gggcaagagaggaagagauggc

SEQ ID NO: 291484 - RNA, 22 nt, Human
ggaaaaucaaaccauuuacagu

SEQ ID NO: 291485 - RNA, 22 nt, Human
ggaaaaugcugaagcaucugaa

SEQ ID NO: 291486 - RNA, 22 nt, Human
gcuguggacacagcucucuuca

SEQ ID NO: 291487 - RNA, 22 nt, Human
ggcuuccuggugcagaguuaua

SEQ ID NO: 291488 - RNA, 22 nt, Human
gggaggcagacgcuggagccca

SEQ ID NO: 291489 - RNA, 22 nt, Human
gcuuuuaaauuaucugacaaug

SEQ ID NO: 291490 - RNA, 22 nt, Human
gcuuuguugauggugagucugu

SEQ ID NO: 291491 - RNA, 22 nt, Human
gcuuuucaaguuacaauuagcu

SEQ ID NO: 291492 - RNA, 22 nt, Human
gggcgcuguguuaggugcugua

SEQ ID NO: 291493 - RNA, 22 nt, Human
gggcgcuuucugggucagggcu

SEQ ID NO: 291494 - RNA, 22 nt, Human
gggcggcguccucagucgggug

SEQ ID NO: 291495 - RNA, 22 nt, Human
gggcggggcucacggugcggca

SEQ ID NO: 291496 - RNA, 20 nt, Human
gggcucugcauccaucagcc

SEQ ID NO: 291497 - RNA, 18 nt, Human
ggacaguuguagaggacu

SEQ ID NO: 291498 - RNA, 22 nt, Human
gggcuacugagcuggaacuggg

SEQ ID NO: 291499 - RNA, 22 nt, Human
gggcaugcagcaauucuguggu

SEQ ID NO: 291500 - RNA, 22 nt, Human
gggcaguuucaugugguucaac

SEQ ID NO: 291501 - RNA, 22 nt, Human
gggcaugugauggacgugugcc

SEQ ID NO: 291502 - RNA, 19 nt, Human
ggaacgcugggcuccccuc

SEQ ID NO: 291503 - RNA, 22 nt, Human
ggaagcuguugugagugcagca

SEQ ID NO: 291504 - RNA, 22 nt, Human
gggcgccgggagugagagugag

SEQ ID NO: 291505 - RNA, 22 nt, Human
gggccuuggaggagaaggacuu

SEQ ID NO: 291506 - RNA, 22 nt, Human
ggaagugagcucauuacuuuag

SEQ ID NO: 291507 - RNA, 22 nt, Human
ggaaggugagugcugugugauu

SEQ ID NO: 291508 - RNA, 22 nt, Human
ggaacuaagcacauuaucugau

SEQ ID NO: 291509 - RNA, 22 nt, Human
gggcuggcaguuuucugaguuc

SEQ ID NO: 291510 - RNA, 22 nt, Human
gggcuguggggccugcagaagg

SEQ ID NO: 291511 - RNA, 22 nt, Human
ggacauugaagcuggaaaggga

SEQ ID NO: 291512 - RNA, 18 nt, Human
ggagaagaacagaugugg

SEQ ID NO: 291513 - RNA, 22 nt, Human
ggacuuucuccugcacaaagug

SEQ ID NO: 291514 - RNA, 22 nt, Human
ggacuugaaguaguuauggccu

SEQ ID NO: 291515 - RNA, 22 nt, Human
ggggaaauauuucugaccugug

SEQ ID NO: 291516 - RNA, 22 nt, Human
ggggaagugguggggcuccgag

SEQ ID NO: 291517 - RNA, 22 nt, Human
ggggaagaaauagaacauuuug

SEQ ID NO: 291518 - RNA, 22 nt, Human
ggggagaugauaagugcauuug

SEQ ID NO: 291519 - RNA, 22 nt, Human
ggagacagauggcgucucaguu

SEQ ID NO: 291520 - RNA, 22 nt, Human
ggggaauaaacacuuugucacu

SEQ ID NO: 291521 - RNA, 22 nt, Human
ggagagaacguaaucuaguauu

SEQ ID NO: 291522 - RNA, 22 nt, Human
ggagaggaggugagaggaagua

SEQ ID NO: 291523 - RNA, 22 nt, Human
ggagauaugugaaaaagacagc

SEQ ID NO: 291524 - RNA, 22 nt, Human
ggagaggaaguuuaaagaauug

SEQ ID NO: 291525 - RNA, 22 nt, Human
ggggcaucguugauugcauggu

SEQ ID NO: 291526 - RNA, 22 nt, Human
ggagagcguggaugggcuucca

SEQ ID NO: 291527 - RNA, 22 nt, Human
ggggucugaucccuucuggcuu

SEQ ID NO: 291528 - RNA, 22 nt, Human
gggguauuugguagacauuuug

SEQ ID NO: 291529 - RNA, 22 nt, Human
ggggucccucucugugucaguu

SEQ ID NO: 291530 - RNA, 22 nt, Human
ggggugagaguguuuuaaagca

SEQ ID NO: 291531 - RNA, 22 nt, Human
gggggcugugugcccgcucccc

SEQ ID NO: 291532 - RNA, 22 nt, Human
ggggcggggagcaugagcuggg

SEQ ID NO: 291533 - RNA, 22 nt, Human
ggggcguugccacggggacggg

SEQ ID NO: 291534 - RNA, 22 nt, Human
ggggccuuugaguugggucccu

SEQ ID NO: 291535 - RNA, 22 nt, Human
ggagaucucauugauacugaua

SEQ ID NO: 291536 - RNA, 22 nt, Human
ggggccaaggcaaacuugaggg

SEQ ID NO: 291537 - RNA, 22 nt, Human
ggggccgggccggcagacuggg

SEQ ID NO: 291538 - RNA, 20 nt, Human
gggucuggcaucucucucug

SEQ ID NO: 291539 - RNA, 22 nt, Human
gggguguuuugaagagguucag

SEQ ID NO: 291540 - RNA, 22 nt, Human
ggaguucacagcaauggaacag

SEQ ID NO: 291541 - RNA, 22 nt, Human
gggugucugcugaauuucccuu

SEQ ID NO: 291542 - RNA, 22 nt, Human
gggucucucuucuuucugugaa

SEQ ID NO: 291543 - RNA, 22 nt, Human
gcugagcaaugcacugccgcau

SEQ ID NO: 291544 - RNA, 22 nt, Human
gcucugaacugucaugaauugg

SEQ ID NO: 291545 - RNA, 22 nt, Human
gcugagcagcgaaggcacaugc

SEQ ID NO: 291546 - RNA, 23 nt, Human
gcugagcaccagccauaucuuuu

SEQ ID NO: 291547 - RNA, 22 nt, Human
gcauuucauaaccagccaugcu

SEQ ID NO: 291548 - RNA, 22 nt, Human
gcugcacgguccuggcaccacg

SEQ ID NO: 291549 - RNA, 22 nt, Human
gcauuuuaauuggggcaguuag

SEQ ID NO: 291550 - RNA, 23 nt, Human
gcauuugcaggaaacuggaaaag

SEQ ID NO: 291551 - RNA, 22 nt, Human
gcugcccauugcucucccacuc

SEQ ID NO: 291552 - RNA, 23 nt, Human
gcugcagugaauguuguuguugu

SEQ ID NO: 291553 - RNA, 20 nt, Human
gccaaggaggagaaacaggc

SEQ ID NO: 291554 - RNA, 22 nt, Human
gcauuucuguuuuuuuaaauga

SEQ ID NO: 291555 - RNA, 19 nt, Human
gccacccaucauauggagg

SEQ ID NO: 291556 - RNA, 22 nt, Human
gccaaucaggaggcuguacauc

SEQ ID NO: 291557 - RNA, 21 nt, Human
gccacugcugcucauucucug

SEQ ID NO: 291558 - RNA, 22 nt, Human
gccagccggugaguggaagcgg

SEQ ID NO: 291559 - RNA, 22 nt, Human
gccagcuuagaucccccagccc

SEQ ID NO: 291560 - RNA, 22 nt, Human
gcugcgcugggacgccaccaac

SEQ ID NO: 291561 - RNA, 22 nt, Human
gccaggagaaaaggcgaaugau

SEQ ID NO: 291562 - RNA, 22 nt, Human
gccaggcggcccaggagauggc

SEQ ID NO: 291563 - RNA, 22 nt, Human
gcugcuuacuauaggguuaacu

SEQ ID NO: 291564 - RNA, 22 nt, Human
gcugcuucgcugcacacccgag

SEQ ID NO: 291565 - RNA, 22 nt, Human
gcugccucacuagauagguaug

SEQ ID NO: 291566 - RNA, 22 nt, Human
gccaguuuguuuacugaugguu

SEQ ID NO: 291567 - RNA, 22 nt, Human
gcuggauaaggaucaguuucuu

SEQ ID NO: 291568 - RNA, 22 nt, Human
gccaucugcuuagauugcuggg

SEQ ID NO: 291569 - RNA, 22 nt, Human
gcuggaagggccagcuuucagg

SEQ ID NO: 291570 - RNA, 22 nt, Human
gccauguuuugguaaauaccau

SEQ ID NO: 291571 - RNA, 22 nt, Human
gcccaauuugaacaaagauacu

SEQ ID NO: 291572 - RNA, 22 nt, Human
gcccagaagguagcgaguaguc

SEQ ID NO: 291573 - RNA, 22 nt, Human
gccauguucuugaaucuggguc

SEQ ID NO: 291574 - RNA, 21 nt, Human
gcuggcugucucuuacacggu

SEQ ID NO: 291575 - RNA, 22 nt, Human
gcguggccugcugaaggacuuc

SEQ ID NO: 291576 - RNA, 22 nt, Human
gcgugcauggccguguguaugc

SEQ ID NO: 291577 - RNA, 22 nt, Human
gcaguugguccagccucggcug

SEQ ID NO: 291578 - RNA, 22 nt, Human
gcagugucacuaguaauagucu

SEQ ID NO: 291579 - RNA, 22 nt, Human
gcuacaacugugucuguggggc

SEQ ID NO: 291580 - RNA, 22 nt, Human
gcuacaaaaccagggcaaagga

SEQ ID NO: 291581 - RNA, 22 nt, Human
gcaucuguuagagugugcaugc

SEQ ID NO: 291582 - RNA, 22 nt, Human
gcucccaguucccaaagugacc

SEQ ID NO: 291583 - RNA, 22 nt, Human
gcauaacaacagacucuguguu

SEQ ID NO: 291584 - RNA, 22 nt, Human
gcaguuugugauguggcaguca

SEQ ID NO: 291585 - RNA, 22 nt, Human
gcuauuuagaaaggcuuggaga

SEQ ID NO: 291586 - RNA, 22 nt, Human
gcuauuggcuaauuguugcaac

SEQ ID NO: 291587 - RNA, 22 nt, Human
gcagcguguggcuaauggcucu

SEQ ID NO: 291588 - RNA, 22 nt, Human
gcggggcucuacuuggccugga

SEQ ID NO: 291589 - RNA, 22 nt, Human
gcgggugagauucgagagaugg

SEQ ID NO: 291590 - RNA, 22 nt, Human
gcggucuaggaccucagugugu

SEQ ID NO: 291591 - RNA, 22 nt, Human
gcguagaagaaagcugcugcua

SEQ ID NO: 291592 - RNA, 22 nt, Human
gcgguuguucugugugcaugga

SEQ ID NO: 291593 - RNA, 22 nt, Human
gcggccucuuugcugccucagg

SEQ ID NO: 291594 - RNA, 22 nt, Human
gcggaucuccuugagugggcaa

SEQ ID NO: 291595 - RNA, 22 nt, Human
gcagccuccggccuggcccccu

SEQ ID NO: 291596 - RNA, 22 nt, Human
gcagccauggcuggccgggcau

SEQ ID NO: 291597 - RNA, 22 nt, Human
gcggagcuaaagauuggcuccu

SEQ ID NO: 291598 - RNA, 22 nt, Human
gccuuuugcaaugguguuggug

SEQ ID NO: 291599 - RNA, 22 nt, Human
gccuuggacuaccacucccaca

SEQ ID NO: 291600 - RNA, 22 nt, Human
gcagccaugcacgucauuauga

SEQ ID NO: 291601 - RNA, 22 nt, Human
gcagccagggaccuuugacuau

SEQ ID NO: 291602 - RNA, 22 nt, Human
gcggagaggcagagacuccgcg

SEQ ID NO: 291603 - RNA, 23 nt, Human
gcagccaacccacgugagagaag

SEQ ID NO: 291604 - RNA, 22 nt, Human
gaugauaacagcauuucaacug

SEQ ID NO: 291605 - RNA, 22 nt, Human
gaugaaguaguccacuggaagg

SEQ ID NO: 291606 - RNA, 22 nt, Human
gccaguaaaguaucuccuuuug

SEQ ID NO: 291607 - RNA, 22 nt, Human
gccaggugauuucaaaguccuu

SEQ ID NO: 291608 - RNA, 22 nt, Human
gauauuuugugaaaaaacaacu

SEQ ID NO: 291609 - RNA, 22 nt, Human
gaucacuuugauuagauguccu

SEQ ID NO: 291610 - RNA, 22 nt, Human
gauauucauaggcagguauuua

SEQ ID NO: 291611 - RNA, 22 nt, Human
gcccgccaacuugccagcggug

SEQ ID NO: 291612 - RNA, 23 nt, Human
gcccagaggccccuggccugagc

SEQ ID NO: 291613 - RNA, 22 nt, Human
gauggcauucacaaacuuaacu

SEQ ID NO: 291614 - RNA, 22 nt, Human
gauggacgguuuuaccagacag

SEQ ID NO: 291615 - RNA, 22 nt, Human
gaugccuccaggaaagaggacg

SEQ ID NO: 291616 - RNA, 22 nt, Human
gccauggugagccaccuggugg

SEQ ID NO: 291617 - RNA, 22 nt, Human
gcauuggaaacugcuuuaugcu

SEQ ID NO: 291618 - RNA, 22 nt, Human
gcauucuugucaguggggucag

SEQ ID NO: 291619 - RNA, 20 nt, Human
gauagcacaaagagaauggg

SEQ ID NO: 291620 - RNA, 22 nt, Human
gauagguacuguaagguccucu

SEQ ID NO: 291621 - RNA, 22 nt, Human
gauaauuauaggcuaagccacu

SEQ ID NO: 291622 - RNA, 22 nt, Human
gcauguucaaguuaguauauuu

SEQ ID NO: 291623 - RNA, 22 nt, Human
gauacuuuguggaauccuggau

SEQ ID NO: 291624 - RNA, 22 nt, Human
gauaccugccaagcugcacuca

SEQ ID NO: 291625 - RNA, 22 nt, Human
gauacuugaggagaucaccaca

SEQ ID NO: 291626 - RNA, 22 nt, Human
gagguuggagggcuggccugca

SEQ ID NO: 291627 - RNA, 22 nt, Human
gcaggccgauuuguuagaaguc

SEQ ID NO: 291628 - RNA, 22 nt, Human
gaggugcaggggcccgggcugg

SEQ ID NO: 291629 - RNA, 22 nt, Human
gaggugggaggcgggccugcau

SEQ ID NO: 291630 - RNA, 22 nt, Human
gagguuauucuucuaucaguau

SEQ ID NO: 291631 - RNA, 22 nt, Human
gagguucgauacagcguauuua

SEQ ID NO: 291632 - RNA, 20 nt, Human
gcauggcuggcugcugucug

SEQ ID NO: 291633 - RNA, 22 nt, Human
gcauggaaaagggaugcuaacu

SEQ ID NO: 291634 - RNA, 22 nt, Human
gcaugcgugcgugcgugcaugu

SEQ ID NO: 291635 - RNA, 22 nt, Human
gcaugcuguuuggaaacgauaa

SEQ ID NO: 291636 - RNA, 22 nt, Human
gaguuucacguagaucaggguc

SEQ ID NO: 291637 - RNA, 22 nt, Human
gcacacuguaugcugguauuug

SEQ ID NO: 291638 - RNA, 22 nt, Human
gcaaaugacuuagucacuccag

SEQ ID NO: 291639 - RNA, 22 nt, Human
gccuccagaggggacaaaaauu

SEQ ID NO: 291640 - RNA, 22 nt, Human
gauugcugccagcguguccgug

SEQ ID NO: 291641 - RNA, 22 nt, Human
gccuggccaaucgccgucuagg

SEQ ID NO: 291642 - RNA, 22 nt, Human
gccuggaaugcaaugugacgaa

SEQ ID NO: 291643 - RNA, 21 nt, Human
gccugcuguucacccugccac

SEQ ID NO: 291644 - RNA, 22 nt, Human
gcacagauaaucugccuuacca

SEQ ID NO: 291645 - RNA, 22 nt, Human
gccuggcagggagauuguaaga

SEQ ID NO: 291646 - RNA, 20 nt, Human
gccugggagaagaucaggga

SEQ ID NO: 291647 - RNA, 22 nt, Human
gccugggccgggcgcggccccc

SEQ ID NO: 291648 - RNA, 22 nt, Human
gcacucuguggagacaagauag

SEQ ID NO: 291649 - RNA, 23 nt, Human
gcacuguuugaggagcacugugc

SEQ ID NO: 291650 - RNA, 22 nt, Human
gcacuguauuuaaauauuuaaa

SEQ ID NO: 291651 - RNA, 22 nt, Human
gccuucauuggaaucuagcuuc

SEQ ID NO: 291652 - RNA, 22 nt, Human
gccugggguuugcggggcugca

SEQ ID NO: 291653 - RNA, 22 nt, Human
gccgcguggcagucuuggugac

SEQ ID NO: 291654 - RNA, 20 nt, Human
gccggggcauaggggccguc

SEQ ID NO: 291655 - RNA, 22 nt, Human
gccguuccuacucucucugugu

SEQ ID NO: 291656 - RNA, 22 nt, Human
gccuaagguucuucagcuauaa

SEQ ID NO: 291657 - RNA, 22 nt, Human
gauugggagugugacauuguau

SEQ ID NO: 291658 - RNA, 22 nt, Human
gauuggucacacaauaguauau

SEQ ID NO: 291659 - RNA, 20 nt, Human
gauuuaacgcugcgucuguc

SEQ ID NO: 291660 - RNA, 22 nt, Human
gauuucauaaaacgagaaacuc

SEQ ID NO: 291661 - RNA, 22 nt, Human
gccgccgccgccuuuguugcgg

SEQ ID NO: 291662 - RNA, 22 nt, Human
gccgccgcucaccugggcgccg

SEQ ID NO: 291663 - RNA, 22 nt, Human
gauucugaaauuaacagacugg

SEQ ID NO: 291664 - RNA, 22 nt, Human
gauucuaucauucuguauauua

SEQ ID NO: 291665 - RNA, 22 nt, Human
gccgcaacggacccugggaguc

SEQ ID NO: 291666 - RNA, 21 nt, Human
gccgaugugacucuacguagu

SEQ ID NO: 291667 - RNA, 22 nt, Human
gcccucugccacaggacgccag

SEQ ID NO: 291668 - RNA, 22 nt, Human
gaugguggggggcagcugggag

SEQ ID NO: 291669 - RNA, 22 nt, Human
gaugguuuuacauuuuaauguu

SEQ ID NO: 291670 - RNA, 22 nt, Human
gagagcaaaccuguguuuggag

SEQ ID NO: 291671 - RNA, 22 nt, Human
gagagcugucagcguagcaccg

SEQ ID NO: 291672 - RNA, 22 nt, Human
gaugcuaauuaaugaagaggag

SEQ ID NO: 291673 - RNA, 22 nt, Human
gaugcucuugauuggaccaggg

SEQ ID NO: 291674 - RNA, 22 nt, Human
gauggauuuuuuauuaaaucag

SEQ ID NO: 291675 - RNA, 22 nt, Human
gaugccggggucguagccgugg

SEQ ID NO: 291676 - RNA, 22 nt, Human
gauggcaaugcuagaaauuuag

SEQ ID NO: 291677 - RNA, 23 nt, Human
gaugauggcaacuacauccggug

SEQ ID NO: 291678 - RNA, 22 nt, Human
gaugauuccuuuguucauugug

SEQ ID NO: 291679 - RNA, 22 nt, Human
gaugauugaauaaauaugguca

SEQ ID NO: 291680 - RNA, 22 nt, Human
gaugauuuuguaacuggggaca

SEQ ID NO: 291681 - RNA, 22 nt, Human
gagcaugacgcaacaccaagug

SEQ ID NO: 291682 - RNA, 22 nt, Human
gagcccgugugugugugugugu

SEQ ID NO: 291683 - RNA, 22 nt, Human
gagaccuuaagagaugucagcu

SEQ ID NO: 291684 - RNA, 22 nt, Human
gaugucccuggaggggacagga

SEQ ID NO: 291685 - RNA, 22 nt, Human
gaugucauguuggcagacaguu

SEQ ID NO: 291686 - RNA, 22 nt, Human
gauguaucugagcugcuuaggu

SEQ ID NO: 291687 - RNA, 22 nt, Human
gaugugugugcccugggccugc

SEQ ID NO: 291688 - RNA, 22 nt, Human
gagcagcaggccagguugcagg

SEQ ID NO: 291689 - RNA, 22 nt, Human
gagcagccugaggauucugcuc

SEQ ID NO: 291690 - RNA, 22 nt, Human
gagauuugaguuccuacugagu

SEQ ID NO: 291691 - RNA, 22 nt, Human
gaugguggaggaaucgcugaag

SEQ ID NO: 291692 - RNA, 22 nt, Human
gagcagcacagaccaaacagaa

SEQ ID NO: 291693 - RNA, 22 nt, Human
gauggugcaauuaucgugcaug

SEQ ID NO: 291694 - RNA, 22 nt, Human
gagauuucauuugugaggcuca

SEQ ID NO: 291695 - RNA, 22 nt, Human
gaugguaucugcuggcuuucag

SEQ ID NO: 291696 - RNA, 22 nt, Human
gagauuuccauauuuuguaaca

SEQ ID NO: 291697 - RNA, 22 nt, Human
gauggguuugagauguuugggu

SEQ ID NO: 291698 - RNA, 22 nt, Human
gaugggaggaugaauuggaccu

SEQ ID NO: 291699 - RNA, 22 nt, Human
gaugggaaggugguaaaguuua

SEQ ID NO: 291700 - RNA, 22 nt, Human
gagauuaauuaaaaccuuuaug

SEQ ID NO: 291701 - RNA, 22 nt, Human
gagauggauuuuuuugccaguc

SEQ ID NO: 291702 - RNA, 22 nt, Human
gauuuuuaaaaguaguuuugaa

SEQ ID NO: 291703 - RNA, 22 nt, Human
gcaaaaacaguguagucuucug

SEQ ID NO: 291704 - RNA, 22 nt, Human
gcaaagaauugauucauuuugc

SEQ ID NO: 291705 - RNA, 21 nt, Human
gcaaccagaccacagggcagu

SEQ ID NO: 291706 - RNA, 22 nt, Human
gaggaaaauggaguguaauuaa

SEQ ID NO: 291707 - RNA, 22 nt, Human
gauuuugcuuuagugaaggaag

SEQ ID NO: 291708 - RNA, 22 nt, Human
gagcuggagaaacacauaagaa

SEQ ID NO: 291709 - RNA, 22 nt, Human
gagcggcggugagaaguguggg

SEQ ID NO: 291710 - RNA, 22 nt, Human
gagcguuucccugggggucugc

SEQ ID NO: 291711 - RNA, 22 nt, Human
gagccuuucuggagggcacuug

SEQ ID NO: 291712 - RNA, 22 nt, Human
gagccucaggguuuuguugaca

SEQ ID NO: 291713 - RNA, 22 nt, Human
gauuuugaaccuuauuuggaaa

SEQ ID NO: 291714 - RNA, 22 nt, Human
gauuuuaaaagauguauaaggu

SEQ ID NO: 291715 - RNA, 22 nt, Human
gauuucuucauuuaaaaauauu

SEQ ID NO: 291716 - RNA, 21 nt, Human
gauuuuagggcagccaaacac

SEQ ID NO: 291717 - RNA, 22 nt, Human
gauugauguaggugauaaaucu

SEQ ID NO: 291718 - RNA, 22 nt, Human
gagcagguuauuagaaauggaa

SEQ ID NO: 291719 - RNA, 22 nt, Human
gagccauggaggaugugcagca

SEQ ID NO: 291720 - RNA, 22 nt, Human
gauucagagcugcaacaaagaa

SEQ ID NO: 291721 - RNA, 22 nt, Human
gauugcauaugcauucugauac

SEQ ID NO: 291722 - RNA, 22 nt, Human
gauugauuuaauaugagaggau

SEQ ID NO: 291723 - RNA, 22 nt, Human
gauugcaucaauauuuagagua

SEQ ID NO: 291724 - RNA, 22 nt, Human
gauuaaaggucuugauuauaag

SEQ ID NO: 291725 - RNA, 22 nt, Human
gauguuggugcauucacuucug

SEQ ID NO: 291726 - RNA, 22 nt, Human
gagcaggucucaguucugccuc

SEQ ID NO: 291727 - RNA, 22 nt, Human
gauuaagaaagauagaugugga

SEQ ID NO: 291728 - RNA, 22 nt, Human
gagcaguuagggaccgcaggcu

SEQ ID NO: 291729 - RNA, 19 nt, Human
gagcaugacuggccuugca

SEQ ID NO: 291730 - RNA, 22 nt, Human
gagccaugagauaagagcaccu

SEQ ID NO: 291731 - RNA, 22 nt, Human
gcaauuguauugucaagacaug

SEQ ID NO: 291732 - RNA, 22 nt, Human
gcaaggaggguaaccacauuuc

SEQ ID NO: 291733 - RNA, 22 nt, Human
gcaauagccuacaugcgucaga

SEQ ID NO: 291734 - RNA, 22 nt, Human
gaggacccuuaggucagacaga

SEQ ID NO: 291735 - RNA, 22 nt, Human
gaggaagucuuaucuggaugca

SEQ ID NO: 291736 - RNA, 22 nt, Human
gcaagagaagaaagaauaguuu

SEQ ID NO: 291737 - RNA, 22 nt, Human
gcaaggacagaagcccacacag

SEQ ID NO: 291738 - RNA, 22 nt, Human
gcacagaguguaaaaguuucau

SEQ ID NO: 291739 - RNA, 22 nt, Human
gaggauaaugaaucugaaucau

SEQ ID NO: 291740 - RNA, 22 nt, Human
gaggaggcuggagaggccagga

SEQ ID NO: 291741 - RNA, 22 nt, Human
gcacagcuaugagcugaauugu

SEQ ID NO: 291742 - RNA, 22 nt, Human
gaggaggagaagcggcggcgga

SEQ ID NO: 291743 - RNA, 22 nt, Human
gcacaaguccuccgacagcacg

SEQ ID NO: 291744 - RNA, 23 nt, Human
gcacuccgagggcacgugucucu

SEQ ID NO: 291745 - RNA, 22 nt, Human
gcacucugggucaucugcugcc

SEQ ID NO: 291746 - RNA, 22 nt, Human
gcacugagacuuuagauuggag

SEQ ID NO: 291747 - RNA, 22 nt, Human
gagggaaauauggguuugguua

SEQ ID NO: 291748 - RNA, 22 nt, Human
gagggaaaggggccaugauugg

SEQ ID NO: 291749 - RNA, 22 nt, Human
gaggcuccgccggggcgggccg

SEQ ID NO: 291750 - RNA, 21 nt, Human
gcagaaagugauuugcuauuc

SEQ ID NO: 291751 - RNA, 21 nt, Human
gcagaacuaggacuugaacau

SEQ ID NO: 291752 - RNA, 22 nt, Human
gaggaucuuuagcgggacugcu

SEQ ID NO: 291753 - RNA, 22 nt, Human
gcaccacccaaaggcggggcuc

SEQ ID NO: 291754 - RNA, 22 nt, Human
gaggcagaggaaacagcucauu

SEQ ID NO: 291755 - RNA, 22 nt, Human
gaggcagaggaugggacuguau

SEQ ID NO: 291756 - RNA, 22 nt, Human
gcacggucagggugggggagug

SEQ ID NO: 291757 - RNA, 22 nt, Human
gaggccauguggcccgggcugc

SEQ ID NO: 291758 - RNA, 22 nt, Human
gaggcauaaguagaagagauug

SEQ ID NO: 291759 - RNA, 22 nt, Human
gaggccuucauuucuccgucug

SEQ ID NO: 291760 - RNA, 22 nt, Human
gcaggcaggauucagagauaca

SEQ ID NO: 291761 - RNA, 22 nt, Human
gaggugauuccucccauguaau

SEQ ID NO: 291762 - RNA, 22 nt, Human
gcaggaaugguacauaccuguu

SEQ ID NO: 291763 - RNA, 22 nt, Human
gcagcgcugagaugauuuguug

SEQ ID NO: 291764 - RNA, 22 nt, Human
gcagccucugcaguucaggagg

SEQ ID NO: 291765 - RNA, 22 nt, Human
gcagcguuaacauuuuuccugu

SEQ ID NO: 291766 - RNA, 22 nt, Human
gcagcucagcacgcacagguaa

SEQ ID NO: 291767 - RNA, 21 nt, Human
gcagcucaggauauagacuug

SEQ ID NO: 291768 - RNA, 22 nt, Human
gaggguuucagugggacggguu

SEQ ID NO: 291769 - RNA, 22 nt, Human
gaggucagcaagccaugcuugu

SEQ ID NO: 291770 - RNA, 22 nt, Human
gaggugaacccaggugcuucac

SEQ ID NO: 291771 - RNA, 22 nt, Human
gaggucauuaaagaaaagaguc

SEQ ID NO: 291772 - RNA, 22 nt, Human
gcagccauuugcaucuaauuaa

SEQ ID NO: 291773 - RNA, 22 nt, Human
gaggguuagauuuuaagaaaga

SEQ ID NO: 291774 - RNA, 22 nt, Human
gagggcugccacguugggcgag

SEQ ID NO: 291775 - RNA, 22 nt, Human
gcagagcacccugcagugguau

SEQ ID NO: 291776 - RNA, 22 nt, Human
gcagaggcaaagucuggaugac

SEQ ID NO: 291777 - RNA, 22 nt, Human
gagggauuuuagugcagcaacu

SEQ ID NO: 291778 - RNA, 22 nt, Human
gagggagugggcccgugggcac

SEQ ID NO: 291779 - RNA, 22 nt, Human
gaggggcuccagguguugagga

SEQ ID NO: 291780 - RNA, 22 nt, Human
gcagcaaucuucacagugucau

SEQ ID NO: 291781 - RNA, 22 nt, Human
gaggggcucuugggcaugaagg

SEQ ID NO: 291782 - RNA, 22 nt, Human
gagggggcggccccugugggca

SEQ ID NO: 291783 - RNA, 22 nt, Human
gagggugguggcggccggcacc

SEQ ID NO: 291784 - RNA, 22 nt, Human
gaggguggggaauagacugcua

SEQ ID NO: 291785 - RNA, 22 nt, Human
gaggguggagccuccuggaagu

SEQ ID NO: 291786 - RNA, 22 nt, Human
gagggguuguuaacaaagaaua

SEQ ID NO: 291787 - RNA, 22 nt, Human
aaaacauuuuacugccaucuca

SEQ ID NO: 291788 - RNA, 22 nt, Human
aaaaccugcaagaugaaaucag

SEQ ID NO: 291789 - RNA, 22 nt, Human
aaaagacaaggaucuggaguga

SEQ ID NO: 291790 - RNA, 22 nt, Human
aaaaauuucuggugaaaugccu

SEQ ID NO: 291791 - RNA, 20 nt, Human
aaaaauguguuuauggagau

SEQ ID NO: 291792 - RNA, 22 nt, Human
aaaagggucugacacugcuuga

SEQ ID NO: 291793 - RNA, 22 nt, Human
aaaauaaccuucauuugcauug

SEQ ID NO: 291794 - RNA, 22 nt, Human
aaaagguuauagcuuugccuug

SEQ ID NO: 291795 - RNA, 22 nt, Human
aaaaggucacuguaaaaugacg

SEQ ID NO: 291796 - RNA, 22 nt, Human
aaaagcauuauuagucugggug

SEQ ID NO: 291797 - RNA, 22 nt, Human
aaaaggaacaauaugguauuuu

SEQ ID NO: 291798 - RNA, 22 nt, Human
aaaaggaagaguuuucagagac

SEQ ID NO: 291799 - RNA, 22 nt, Human
aaaaggauauuuggugcaaagc

SEQ ID NO: 291800 - RNA, 22 nt, Human
aaaaugggaaaauuuuagauua

SEQ ID NO: 291801 - RNA, 22 nt, Human
aaacagguuugaacuucuuaac

SEQ ID NO: 291802 - RNA, 18 nt, Human
aaacccacguauucaggc

SEQ ID NO: 291803 - RNA, 22 nt, Human
aaacaccaagagcuagcuauua

SEQ ID NO: 291804 - RNA, 22 nt, Human
aaacacacaacauauuuuggaa

SEQ ID NO: 291805 - RNA, 22 nt, Human
aaaauuuccuuggaccauuuuu

SEQ ID NO: 291806 - RNA, 22 nt, Human
aaacaaauccaauaauaaaauu

SEQ ID NO: 291807 - RNA, 22 nt, Human
aaaauauucuauaucaaagaua

SEQ ID NO: 291808 - RNA, 22 nt, Human
aaaaguauaagugucuccugau

SEQ ID NO: 291809 - RNA, 22 nt, Human
aaaauauuuaucuagcucuuaa

SEQ ID NO: 291810 - RNA, 17 nt, Human
aaaaucaaaggaggugc

SEQ ID NO: 291811 - RNA, 22 nt, Human
aaacagcugcaguacacggccu

SEQ ID NO: 291812 - RNA, 22 nt, Human
aaagcaaagaucuguagcccaa

SEQ ID NO: 291813 - RNA, 22 nt, Human
aaagcugaaacgaaaugacaac

SEQ ID NO: 291814 - RNA, 17 nt, Human
aaagccgaucagauguu

SEQ ID NO: 291815 - RNA, 22 nt, Human
aaagcauuuguuucuccuggaa

SEQ ID NO: 291816 - RNA, 22 nt, Human
aaagaugaaguucagcgaagaa

SEQ ID NO: 291817 - RNA, 22 nt, Human
aaagguguagacucaguuaugc

SEQ ID NO: 291818 - RNA, 22 nt, Human
aaaggucagaugugucgaggag

SEQ ID NO: 291819 - RNA, 22 nt, Human
aaagggaugauuucugaagaua

SEQ ID NO: 291820 - RNA, 22 nt, Human
aaaggcaugugcaacuacaaau

SEQ ID NO: 291821 - RNA, 22 nt, Human
aaagccaagucugauuuuguug

SEQ ID NO: 291822 - RNA, 22 nt, Human
aaaggagugaaaugagaggaaa

SEQ ID NO: 291823 - RNA, 22 nt, Human
aaagccagggacagugugcaug

SEQ ID NO: 291824 - RNA, 22 nt, Human
aaagccauaucuauucuauucu

SEQ ID NO: 291825 - RNA, 22 nt, Human
aaagccaagguccauguacuuu

SEQ ID NO: 291826 - RNA, 22 nt, Human
aaaggaaacuaugaaucucugg

SEQ ID NO: 291827 - RNA, 22 nt, Human
aaagcagguugcaauuacagug

SEQ ID NO: 291828 - RNA, 22 nt, Human
aaagagugugcauguaccugug

SEQ ID NO: 291829 - RNA, 22 nt, Human
aaagacaauaauucucucuagc

SEQ ID NO: 291830 - RNA, 22 nt, Human
aaacuuuaucaaguacucuuca

SEQ ID NO: 291831 - RNA, 18 nt, Human
aaacgguuucaugcugua

SEQ ID NO: 291832 - RNA, 22 nt, Human
aaacuuuaggcacauggaucua

SEQ ID NO: 291833 - RNA, 22 nt, Human
aaacgcauucuuacaugcuucc

SEQ ID NO: 291834 - RNA, 22 nt, Human
aaacgcaauuucuugcauguca

SEQ ID NO: 291835 - RNA, 22 nt, Human
aaacccacauuccugcuuaggc

SEQ ID NO: 291836 - RNA, 22 nt, Human
aaaccgguacccuccugccugc

SEQ ID NO: 291837 - RNA, 22 nt, Human
aaacccuagcguuguuuauuga

SEQ ID NO: 291838 - RNA, 22 nt, Human
aaagaugucauacacauuaaga

SEQ ID NO: 291839 - RNA, 22 nt, Human
aaagcaaauaguugcuuaauau

SEQ ID NO: 291840 - RNA, 22 nt, Human
aaagaguuaagagucuuaagcu

SEQ ID NO: 291841 - RNA, 22 nt, Human
aaagcauucuaaccgaucgacg

SEQ ID NO: 291842 - RNA, 22 nt, Human
aaagcagucuguuuuaaccuga

SEQ ID NO: 291843 - RNA, 23 nt, Human
aaagaggugaauccaggacaagc

SEQ ID NO: 291844 - RNA, 22 nt, Human
aaaugcucgccagguuuuauua

SEQ ID NO: 291845 - RNA, 22 nt, Human
aaauuaaaguuuuauuuagagc

SEQ ID NO: 291846 - RNA, 22 nt, Human
aaaugcuuuaauugaguucaug

SEQ ID NO: 291847 - RNA, 22 nt, Human
aaaugcacaauaaaguaaaggc

SEQ ID NO: 291848 - RNA, 22 nt, Human
aaaugggagucacacagguuua

SEQ ID NO: 291849 - RNA, 22 nt, Human
aaauggauaaucaagauaauca

SEQ ID NO: 291850 - RNA, 22 nt, Human
aaaucuuccugaaauuuguuca

SEQ ID NO: 291851 - RNA, 22 nt, Human
aaaucuuucacauauuuuuuau

SEQ ID NO: 291852 - RNA, 22 nt, Human
aaaucugaaggaaacagcuuca

SEQ ID NO: 291853 - RNA, 22 nt, Human
aaaucugaauuaaaaucugguu

SEQ ID NO: 291854 - RNA, 22 nt, Human
aaauguaaacuguauuuauaaa

SEQ ID NO: 291855 - RNA, 22 nt, Human
aaauccaucaaaucuucuagaa

SEQ ID NO: 291856 - RNA, 21 nt, Human
aaauccagugaucuccucuaa

SEQ ID NO: 291857 - RNA, 22 nt, Human
aaauauuaaugaugaagguagu

SEQ ID NO: 291858 - RNA, 22 nt, Human
aaauauuagacauaccuggaga

SEQ ID NO: 291859 - RNA, 22 nt, Human
aaaucaagucagcugaauucca

SEQ ID NO: 291860 - RNA, 22 nt, Human
aaaucauguuaaagagggaguu

SEQ ID NO: 291861 - RNA, 22 nt, Human
aaaucauagccaugaacauuug

SEQ ID NO: 291862 - RNA, 22 nt, Human
aaauauauauaauauauauauu

SEQ ID NO: 291863 - RNA, 22 nt, Human
aaauugucuuuaaucaggucau

SEQ ID NO: 291864 - RNA, 22 nt, Human
aaauuaacuaucacuuuuguga

SEQ ID NO: 291865 - RNA, 22 nt, Human
aaauuaggcccugauuuuaugu

SEQ ID NO: 291866 - RNA, 20 nt, Human
aaauugaacaagccaggcug

SEQ ID NO: 291867 - RNA, 22 nt, Human
aacaaagaaaagcuugagguuu

SEQ ID NO: 291868 - RNA, 21 nt, Human
aacaaaagggaagaacagcug

SEQ ID NO: 291869 - RNA, 22 nt, Human
aacagaauaucaaaagauuaug

SEQ ID NO: 291870 - RNA, 22 nt, Human
aacacaucagcacacuaacgga

SEQ ID NO: 291871 - RNA, 22 nt, Human
aacaggaagaauccagauggug

SEQ ID NO: 291872 - RNA, 22 nt, Human
aacagggcgugaauaaugaaga

SEQ ID NO: 291873 - RNA, 22 nt, Human
aacaggcuaaauuguccauuuc

SEQ ID NO: 291874 - RNA, 22 nt, Human
aacaaagaacuuucuuccuuug

SEQ ID NO: 291875 - RNA, 22 nt, Human
aacagggcaguuccuuauagug

SEQ ID NO: 291876 - RNA, 19 nt, Human
aacaaaauaguucuaguua

SEQ ID NO: 291877 - RNA, 22 nt, Human
aaauauauccuucuguccugcc

SEQ ID NO: 291878 - RNA, 22 nt, Human
aaaguuaauucuuguuuuuuau

SEQ ID NO: 291879 - RNA, 22 nt, Human
aaauaugguaucugccaaacua

SEQ ID NO: 291880 - RNA, 22 nt, Human
aaauauugaauuugaggaugua

SEQ ID NO: 291881 - RNA, 22 nt, Human
aaaguguuuaacaaauugcuuu

SEQ ID NO: 291882 - RNA, 22 nt, Human
aaaguuacacgacuauuuaugu

SEQ ID NO: 291883 - RNA, 22 nt, Human
aaauauagugacacuuauaguc

SEQ ID NO: 291884 - RNA, 22 nt, Human
aaaguguaagucccugguuguc

SEQ ID NO: 291885 - RNA, 21 nt, Human
aaagugguaaggauuauuuug

SEQ ID NO: 291886 - RNA, 22 nt, Human
aaaggggugguauuucuuuugg

SEQ ID NO: 291887 - RNA, 22 nt, Human
aaaucgcuugaacccaggaagu

SEQ ID NO: 291888 - RNA, 22 nt, Human
aaaucccacucacgaguuuugc

SEQ ID NO: 291889 - RNA, 22 nt, Human
aaauauuugaaugguguaagau

SEQ ID NO: 291890 - RNA, 23 nt, Human
aaauaauaauuucucuguuggga

SEQ ID NO: 291891 - RNA, 22 nt, Human
aaaguuguccuuugugccuuua

SEQ ID NO: 291892 - RNA, 22 nt, Human
aaauaggaguagugauguauua

SEQ ID NO: 291893 - RNA, 22 nt, Human
aaauagauuugacuacuuggug

SEQ ID NO: 291894 - RNA, 22 nt, Human
aaaucaaaagugguuauuuuau

SEQ ID NO: 291895 - RNA, 22 nt, Human
aaauaggucaaucagacuauga

SEQ ID NO: 291896 - RNA, 23 nt, Human
aaaguacuuaaucugcaaaccac

SEQ ID NO: 291897 - RNA, 22 nt, Human
aaaguaaagccuauuuaauaau

SEQ ID NO: 291898 - RNA, 22 nt, Human
aaagggcugaaguagucucugu

SEQ ID NO: 291899 - RNA, 22 nt, Human
aaaggugccucuuacaaggcuu

SEQ ID NO: 291900 - RNA, 22 nt, Human
aaauagucagaaaucaacgugc

SEQ ID NO: 291901 - RNA, 22 nt, Human
aaaguuacccaaucucuaugaa

SEQ ID NO: 291902 - RNA, 22 nt, Human
aaaguugcauccuaugaccuca

SEQ ID NO: 291903 - RNA, 22 nt, Human
aaaguuuguacugggaguuacu

SEQ ID NO: 291904 - RNA, 22 nt, Human
aaagcgagccggcuuggaggga

SEQ ID NO: 291905 - RNA, 22 nt, Human
aaagcuccaaauggguggaagu

SEQ ID NO: 291906 - RNA, 22 nt, Human
aaagccuacagucaugguuaga

SEQ ID NO: 291907 - RNA, 22 nt, Human
aaagcccuccaggguauacauu

SEQ ID NO: 291908 - RNA, 22 nt, Human
aaaguagaugagaauuuuguug

SEQ ID NO: 291909 - RNA, 22 nt, Human
aaaguagaauaauaaacccuug

SEQ ID NO: 291910 - RNA, 22 nt, Human
aaaguguuaacacuggcuacuu

SEQ ID NO: 291911 - RNA, 22 nt, Human
aauugcauucauuuguauauuu

SEQ ID NO: 291912 - RNA, 22 nt, Human
aauugccaagaauuagugauac

SEQ ID NO: 291913 - RNA, 21 nt, Human
aauugccuaauauaugggaag

SEQ ID NO: 291914 - RNA, 22 nt, Human
aauugcuuucacaaguguuaua

SEQ ID NO: 291915 - RNA, 22 nt, Human
aauucugaggccauuuauuucc

SEQ ID NO: 291916 - RNA, 22 nt, Human
aauuauugucuuuuuuaaaagc

SEQ ID NO: 291917 - RNA, 22 nt, Human
aauugugagaguuagagagcau

SEQ ID NO: 291918 - RNA, 22 nt, Human
aauuguuagaaaugacuguuuu

SEQ ID NO: 291919 - RNA, 22 nt, Human
aauuuaaguuauugcuaaugug

SEQ ID NO: 291920 - RNA, 22 nt, Human
aauuggagaguugugaaaggau

SEQ ID NO: 291921 - RNA, 22 nt, Human
aauugguuugaauaaauaaaga

SEQ ID NO: 291922 - RNA, 20 nt, Human
aauuuagaguuuuaccaagg

SEQ ID NO: 291923 - RNA, 22 nt, Human
aauuucaucugagacugggagc

SEQ ID NO: 291924 - RNA, 22 nt, Human
aauuucagaccaacgagucagg

SEQ ID NO: 291925 - RNA, 22 nt, Human
aauuuaauugguuuuuacuugu

SEQ ID NO: 291926 - RNA, 22 nt, Human
aauuuauccuuuugcuaaagca

SEQ ID NO: 291927 - RNA, 22 nt, Human
aauuuuauuagacaggcauaau

SEQ ID NO: 291928 - RNA, 22 nt, Human
aauuucuuucagcugcuuuaag

SEQ ID NO: 291929 - RNA, 22 nt, Human
acaaaaauauuguagaagugcu

SEQ ID NO: 291930 - RNA, 22 nt, Human
aauuuuauuuuuuccccuagau

SEQ ID NO: 291931 - RNA, 18 nt, Human
acaaaaauagugcuuugg

SEQ ID NO: 291932 - RNA, 22 nt, Human
aauuugcuccaaugucaguucu

SEQ ID NO: 291933 - RNA, 22 nt, Human
aauuucuuuagagguacugauc

SEQ ID NO: 291934 - RNA, 22 nt, Human
aauuucuccuuuucaguuagau

SEQ ID NO: 291935 - RNA, 21 nt, Human
acaaaaccuaacuuggcugcu

SEQ ID NO: 291936 - RNA, 22 nt, Human
acaaccaugucaguucaaacca

SEQ ID NO: 291937 - RNA, 20 nt, Human
acaaccacugcucacaguuu

SEQ ID NO: 291938 - RNA, 22 nt, Human
acaaauuuaaauguugucuguu

SEQ ID NO: 291939 - RNA, 22 nt, Human
aauuauuauguggaagacgacg

SEQ ID NO: 291940 - RNA, 22 nt, Human
aauuauuaucauuaucuuccug

SEQ ID NO: 291941 - RNA, 22 nt, Human
aauuauuaagcuuucuccagug

SEQ ID NO: 291942 - RNA, 22 nt, Human
aauuagaagcuguuagcaaaau

SEQ ID NO: 291943 - RNA, 22 nt, Human
aauuauguugaaauaugagaac

SEQ ID NO: 291944 - RNA, 22 nt, Human
aauuauguuugcuuuagaugga

SEQ ID NO: 291945 - RNA, 22 nt, Human
aauguuuaguuuuauuuuagua

SEQ ID NO: 291946 - RNA, 22 nt, Human
aauguuugaacuuugcauauuu

SEQ ID NO: 291947 - RNA, 22 nt, Human
aauuaaauguuugguuugagcu

SEQ ID NO: 291948 - RNA, 22 nt, Human
aauguuuuucaaguguggagca

SEQ ID NO: 291949 - RNA, 22 nt, Human
aauggcagauaauuuuccagau

SEQ ID NO: 291950 - RNA, 22 nt, Human
aaugguaauauuucauaguugu

SEQ ID NO: 291951 - RNA, 22 nt, Human
aauggcuagcauguaaaauauc

SEQ ID NO: 291952 - RNA, 22 nt, Human
aaugggauaggucuucaggaau

SEQ ID NO: 291953 - RNA, 23 nt, Human
aaugggcggaaguguuaaguugc

SEQ ID NO: 291954 - RNA, 22 nt, Human
aauguauuuuuaggcagaauau

SEQ ID NO: 291955 - RNA, 22 nt, Human
aauguuaguauuuaagagcuug

SEQ ID NO: 291956 - RNA, 22 nt, Human
aaugugugggagaacagucuuu

SEQ ID NO: 291957 - RNA, 22 nt, Human
aaugugguauuuuggcauucuu

SEQ ID NO: 291958 - RNA, 22 nt, Human
aauguguauguguauauauaug

SEQ ID NO: 291959 - RNA, 22 nt, Human
aaugugcugguaacugcuuugc

SEQ ID NO: 291960 - RNA, 22 nt, Human
aauguggaguugguuuccuucc

SEQ ID NO: 291961 - RNA, 22 nt, Human
aaugugcauaacuuuauaaauu

SEQ ID NO: 291962 - RNA, 22 nt, Human
aaucauaacaaaagcaauuaua

SEQ ID NO: 291963 - RNA, 22 nt, Human
aaucacuuagaacccaggaagu

SEQ ID NO: 291964 - RNA, 22 nt, Human
aauccaaacaggauuaccuauc

SEQ ID NO: 291965 - RNA, 22 nt, Human
aaucgguugaacccaggaagug

SEQ ID NO: 291966 - RNA, 22 nt, Human
aaugcugaaugcauguuuccau

SEQ ID NO: 291967 - RNA, 22 nt, Human
aaugcuaaagaagaaggaguag

SEQ ID NO: 291968 - RNA, 22 nt, Human
aaugggauuaagaaagaucuug

SEQ ID NO: 291969 - RNA, 22 nt, Human
aauggaugauuaaauggaugaa

SEQ ID NO: 291970 - RNA, 22 nt, Human
aaugcuuuuugcgaaaugugca

SEQ ID NO: 291971 - RNA, 22 nt, Human
aaugcugugggauagggcuccu

SEQ ID NO: 291972 - RNA, 22 nt, Human
aaugcugugauuuauuaaguau

SEQ ID NO: 291973 - RNA, 22 nt, Human
aauggaaaggagccugacuaua

SEQ ID NO: 291974 - RNA, 22 nt, Human
acagucucucaagcauauccug

SEQ ID NO: 291975 - RNA, 22 nt, Human
acauaaauagcacugugaauuu

SEQ ID NO: 291976 - RNA, 22 nt, Human
acauaaacaugcagccugccaa

SEQ ID NO: 291977 - RNA, 20 nt, Human
acauccacugagugggauga

SEQ ID NO: 291978 - RNA, 22 nt, Human
acagguuucuccccugguuauu

SEQ ID NO: 291979 - RNA, 22 nt, Human
acagguaucccuuucuaccuga

SEQ ID NO: 291980 - RNA, 22 nt, Human
acagguauuaugaagccuauuu

SEQ ID NO: 291981 - RNA, 22 nt, Human
acaggguaagggagggugagug

SEQ ID NO: 291982 - RNA, 22 nt, Human
acaggcgucgccugcucuugcc

SEQ ID NO: 291983 - RNA, 22 nt, Human
acagguuggagguguggaguca

SEQ ID NO: 291984 - RNA, 22 nt, Human
acaggccuggguucaaauuugg

SEQ ID NO: 291985 - RNA, 22 nt, Human
acaggacgugugugcgcaugug

SEQ ID NO: 291986 - RNA, 22 nt, Human
acaggacaaaaaucuggauggc

SEQ ID NO: 291987 - RNA, 21 nt, Human
acaguacuugagaucuuuuga

SEQ ID NO: 291988 - RNA, 22 nt, Human
acagucuuggauuccaggaguc

SEQ ID NO: 291989 - RNA, 22 nt, Human
acaggaaugaagaugagagagu

SEQ ID NO: 291990 - RNA, 19 nt, Human
acaggaaggaaaauuucaa

SEQ ID NO: 291991 - RNA, 22 nt, Human
acaggaaaugaaaugguaucua

SEQ ID NO: 291992 - RNA, 22 nt, Human
acagcucaggcccaucaacccc

SEQ ID NO: 291993 - RNA, 20 nt, Human
acagccguaaugguccuugg

SEQ ID NO: 291994 - RNA, 22 nt, Human
acagccaacgucuuucuuacuu

SEQ ID NO: 291995 - RNA, 22 nt, Human
acagcugagaugcuacuugugg

SEQ ID NO: 291996 - RNA, 22 nt, Human
acagcuggaggucugugagcac

SEQ ID NO: 291997 - RNA, 22 nt, Human
acagcuauuuaaaggcuuuagg

SEQ ID NO: 291998 - RNA, 22 nt, Human
acagccacccuggaacgguugu

SEQ ID NO: 291999 - RNA, 22 nt, Human
acagccacuaugacagauuuag

SEQ ID NO: 292000 - RNA, 22 nt, Human
acagcagguuauuguuauggca

SEQ ID NO: 292001 - RNA, 23 nt, Human
acagaggcaucagagcagcaggc

SEQ ID NO: 292002 - RNA, 22 nt, Human
acagcaauccuggcagaggguu

SEQ ID NO: 292003 - RNA, 23 nt, Human
acagcaagaggaccagaugugag

SEQ ID NO: 292004 - RNA, 22 nt, Human
acagaucugcacagugaacaau

SEQ ID NO: 292005 - RNA, 22 nt, Human
acacuagcgcaaauacgcccau

SEQ ID NO: 292006 - RNA, 22 nt, Human
acacucaugcucagcuggugcu

SEQ ID NO: 292007 - RNA, 22 nt, Human
acagacaucaucaacaucuucc

SEQ ID NO: 292008 - RNA, 22 nt, Human
acacgugcaggagaauguagug

SEQ ID NO: 292009 - RNA, 22 nt, Human
acacgcacaccugugcacucgu

SEQ ID NO: 292010 - RNA, 22 nt, Human
acacgguggccagcaguaggug

SEQ ID NO: 292011 - RNA, 22 nt, Human
acagacuugaccuuggagaggc

SEQ ID NO: 292012 - RNA, 22 nt, Human
acagacuuaguauccugcugcu

SEQ ID NO: 292013 - RNA, 22 nt, Human
acacugguucucuuaacccuau

SEQ ID NO: 292014 - RNA, 22 nt, Human
acacuuacugcauuuuucuaua

SEQ ID NO: 292015 - RNA, 22 nt, Human
acacuuuugcgagagcaugcag

SEQ ID NO: 292016 - RNA, 22 nt, Human
acagaucuauauuauauauaca

SEQ ID NO: 292017 - RNA, 22 nt, Human
acacucagaaaggcagagguuc

SEQ ID NO: 292018 - RNA, 20 nt, Human
acagagauccucucuuuauc

SEQ ID NO: 292019 - RNA, 22 nt, Human
acaaucuuauuaguaguauaga

SEQ ID NO: 292020 - RNA, 22 nt, Human
acaaucagcacugaguuuaucu

SEQ ID NO: 292021 - RNA, 17 nt, Human
acaaugggcaacaauau

SEQ ID NO: 292022 - RNA, 22 nt, Human
acacaacuuuauuaauuuauac

SEQ ID NO: 292023 - RNA, 20 nt, Human
acacagccuagaguuuggcu

SEQ ID NO: 292024 - RNA, 22 nt, Human
acacacaugccuuuccuaagua

SEQ ID NO: 292025 - RNA, 22 nt, Human
acaaggaagaaaacauuacuuu

SEQ ID NO: 292026 - RNA, 20 nt, Human
acaacuuaguugagagacua

SEQ ID NO: 292027 - RNA, 21 nt, Human
acaaugaguuugaggcaucag

SEQ ID NO: 292028 - RNA, 22 nt, Human
acaauaauguuuuuagguuauu

SEQ ID NO: 292029 - RNA, 22 nt, Human
acaagguugauucuggcaucug

SEQ ID NO: 292030 - RNA, 23 nt, Human
acaaguguuuccaauauggcugg

SEQ ID NO: 292031 - RNA, 22 nt, Human
aaguucuuauguucugaugugc

SEQ ID NO: 292032 - RNA, 22 nt, Human
aaguuaugauuggcguggacaa

SEQ ID NO: 292033 - RNA, 22 nt, Human
aaguuaauugcuucuaguuaau

SEQ ID NO: 292034 - RNA, 22 nt, Human
aagugauuuuccuacuugcuaa

SEQ ID NO: 292035 - RNA, 22 nt, Human
aagugcuggccuacucaaucga

SEQ ID NO: 292036 - RNA, 23 nt, Human
aagugcucaguggacagcauugc

SEQ ID NO: 292037 - RNA, 20 nt, Human
aagugcuguuagcugccuga

SEQ ID NO: 292038 - RNA, 22 nt, Human
aauaauacaauuggugucaugu

SEQ ID NO: 292039 - RNA, 22 nt, Human
aauaagagaauaaaaucuguua

SEQ ID NO: 292040 - RNA, 22 nt, Human
aauaacuuaaugacuguguaca

SEQ ID NO: 292041 - RNA, 22 nt, Human
aauaauacaugugaugagaauu

SEQ ID NO: 292042 - RNA, 22 nt, Human
aauaacuuacucuaugcuuagu

SEQ ID NO: 292043 - RNA, 21 nt, Human
aaguuuuggcuguacaguugu

SEQ ID NO: 292044 - RNA, 16 nt, Human
aaguuuuaucuucuca

SEQ ID NO: 292045 - RNA, 22 nt, Human
aauaaagcuugaaagcagggaa

SEQ ID NO: 292046 - RNA, 21 nt, Human
aaguuucucccuaauuguugc

SEQ ID NO: 292047 - RNA, 22 nt, Human
aaucaucuguuguucccuugga

SEQ ID NO: 292048 - RNA, 22 nt, Human
aauauuuaaauagaauuacauc

SEQ ID NO: 292049 - RNA, 22 nt, Human
aauaugucacacuccuuaauag

SEQ ID NO: 292050 - RNA, 22 nt, Human
aaucacuucuuugucuucuuca

SEQ ID NO: 292051 - RNA, 22 nt, Human
aaucacuggcuccucacggcaa

SEQ ID NO: 292052 - RNA, 23 nt, Human
aaucacuggauuugagcaugagg

SEQ ID NO: 292053 - RNA, 19 nt, Human
aaucacaagcaauaggggu

SEQ ID NO: 292054 - RNA, 22 nt, Human
aauauuuaccuaccugucaucu

SEQ ID NO: 292055 - RNA, 22 nt, Human
aaucaaagccugcaaguugacu

SEQ ID NO: 292056 - RNA, 22 nt, Human
aauacagauggcaugugaagau

SEQ ID NO: 292057 - RNA, 22 nt, Human
aauagaguccuguacugaauga

SEQ ID NO: 292058 - RNA, 22 nt, Human
aauagagacaguuuaacaauau

SEQ ID NO: 292059 - RNA, 22 nt, Human
aauaagacugucauggaguaaa

SEQ ID NO: 292060 - RNA, 22 nt, Human
aauagcaauuacccuucaacuc

SEQ ID NO: 292061 - RNA, 22 nt, Human
aauaauuuuuuugugauuaugu

SEQ ID NO: 292062 - RNA, 22 nt, Human
aauaugcaaagcguguuaucug

SEQ ID NO: 292063 - RNA, 22 nt, Human
aauaugccaaauccugucacau

SEQ ID NO: 292064 - RNA, 22 nt, Human
aauaugaugccaaauugcuaca

SEQ ID NO: 292065 - RNA, 22 nt, Human
aauaucuugaguuauaaauuca

SEQ ID NO: 292066 - RNA, 22 nt, Human
aagugauuuucccaccaucuac

SEQ ID NO: 292067 - RNA, 22 nt, Human
aagugagaugggagucagagga

SEQ ID NO: 292068 - RNA, 22 nt, Human
aagugauauaaaucgagaggga

SEQ ID NO: 292069 - RNA, 22 nt, Human
aagugauuuagagagcucuuag

SEQ ID NO: 292070 - RNA, 22 nt, Human
aagugaggagaccucuucuuca

SEQ ID NO: 292071 - RNA, 22 nt, Human
aagugaaaaaagucaguacuga

SEQ ID NO: 292072 - RNA, 22 nt, Human
aagugaagccaauuuuuuuagg

SEQ ID NO: 292073 - RNA, 20 nt, Human
aagucuauuuagaguugcuu

SEQ ID NO: 292074 - RNA, 23 nt, Human
aaggugaagccaccaggugagga

SEQ ID NO: 292075 - RNA, 22 nt, Human
aaggugccacuucccucagacu

SEQ ID NO: 292076 - RNA, 22 nt, Human
aaggugggacugagaggggaca

SEQ ID NO: 292077 - RNA, 22 nt, Human
aaguacugauucuguuccucaa

SEQ ID NO: 292078 - RNA, 21 nt, Human
aaguaaauuuuuacuuaggcc

SEQ ID NO: 292079 - RNA, 22 nt, Human
aaguaauuugugaaggcauguu

SEQ ID NO: 292080 - RNA, 22 nt, Human
aagucgccuaaacaaaguaucu

SEQ ID NO: 292081 - RNA, 18 nt, Human
aaguaguuugagauuguu

SEQ ID NO: 292082 - RNA, 22 nt, Human
aaguauuccccaaguauucugg

SEQ ID NO: 292083 - RNA, 22 nt, Human
aagggaggguaggaagagggag

SEQ ID NO: 292084 - RNA, 22 nt, Human
aaggcggcggcggcggcugcgg

SEQ ID NO: 292085 - RNA, 22 nt, Human
aagggaccucagcaaucaggga

SEQ ID NO: 292086 - RNA, 23 nt, Human
aagggcgauuaacauucgcucga

SEQ ID NO: 292087 - RNA, 22 nt, Human
aaggggaauaguaggaccuggg

SEQ ID NO: 292088 - RNA, 22 nt, Human
aaggucuucgaaccuuauguua

SEQ ID NO: 292089 - RNA, 22 nt, Human
aaggucaggggcuuuugaaaca

SEQ ID NO: 292090 - RNA, 22 nt, Human
aaggugcauuaguuuggagggg

SEQ ID NO: 292091 - RNA, 22 nt, Human
aagguaaugcaucaggcaggga

SEQ ID NO: 292092 - RNA, 22 nt, Human
aaggggauuuaagguaagaaga

SEQ ID NO: 292093 - RNA, 22 nt, Human
aaggcuguuugagcacuggagc

SEQ ID NO: 292094 - RNA, 22 nt, Human
aaggcugaccaguuuacacuuu

SEQ ID NO: 292095 - RNA, 22 nt, Human
aagggaauagagcagcaaaaau

SEQ ID NO: 292096 - RNA, 22 nt, Human
aaggcugugaacuuuucgggaa

SEQ ID NO: 292097 - RNA, 22 nt, Human
aaggcuuguugucacgcucuug

SEQ ID NO: 292098 - RNA, 22 nt, Human
aaggcuuugugcugaguugucg

SEQ ID NO: 292099 - RNA, 22 nt, Human
aaggcgguuccgguucgcggcg

SEQ ID NO: 292100 - RNA, 18 nt, Human
aagcugcauuauuuuggc

SEQ ID NO: 292101 - RNA, 22 nt, Human
aaggaaaaaauggcuugugaua

SEQ ID NO: 292102 - RNA, 22 nt, Human
aagaugaguuacaaaggaguaa

SEQ ID NO: 292103 - RNA, 22 nt, Human
aacaucugagagcccuugugca

SEQ ID NO: 292104 - RNA, 22 nt, Human
aagauagaaugauguuggcuca

SEQ ID NO: 292105 - RNA, 22 nt, Human
aagcagacugggccauaaggaa

SEQ ID NO: 292106 - RNA, 21 nt, Human
aagcagcugcagaauuucagu

SEQ ID NO: 292107 - RNA, 22 nt, Human
aagcagaacuguuuuguuuucu

SEQ ID NO: 292108 - RNA, 23 nt, Human
aagcaacagacuucaucagauau

SEQ ID NO: 292109 - RNA, 22 nt, Human
aagauuuaccacuuuauucaag

SEQ ID NO: 292110 - RNA, 22 nt, Human
aagaugaucagagggcaagagg

SEQ ID NO: 292111 - RNA, 22 nt, Human
aagauauauaaggaaguucagu

SEQ ID NO: 292112 - RNA, 22 nt, Human
aagaucugaccgugauggcggc

SEQ ID NO: 292113 - RNA, 22 nt, Human
aagcaaaugguauugguauuau

SEQ ID NO: 292114 - RNA, 22 nt, Human
aagaguuaggagugggcuuuga

SEQ ID NO: 292115 - RNA, 22 nt, Human
aagauauauaacccuuucacuu

SEQ ID NO: 292116 - RNA, 22 nt, Human
aagagaaacauauggccagauu

SEQ ID NO: 292117 - RNA, 22 nt, Human
aagaacuagauagugguguaaa

SEQ ID NO: 292118 - RNA, 22 nt, Human
aagaagcuacugucacuaucag

SEQ ID NO: 292119 - RNA, 22 nt, Human
aagaaguccuugaggcgcaccc

SEQ ID NO: 292120 - RNA, 22 nt, Human
aagacagaaaagcagagagagg

SEQ ID NO: 292121 - RNA, 23 nt, Human
aagaaugcuucugaagagcugcc

SEQ ID NO: 292122 - RNA, 22 nt, Human
aaccaagcucaauggucugagu

SEQ ID NO: 292123 - RNA, 22 nt, Human
aagaaaagguaaccgcuuaucu

SEQ ID NO: 292124 - RNA, 22 nt, Human
aagaaauacagaaauggcagua

SEQ ID NO: 292125 - RNA, 22 nt, Human
aagaaaggagauauucuuuuag

SEQ ID NO: 292126 - RNA, 22 nt, Human
aaggcacauauuuuagagucac

SEQ ID NO: 292127 - RNA, 22 nt, Human
aaggcaguuaauuuggcuagaa

SEQ ID NO: 292128 - RNA, 22 nt, Human
aaggcacuugcccagagcugca

SEQ ID NO: 292129 - RNA, 22 nt, Human
aaggcagagggaaaacgggaau

SEQ ID NO: 292130 - RNA, 20 nt, Human
aaggaggcuuaaaguuagaa

SEQ ID NO: 292131 - RNA, 18 nt, Human
aaggaggaaugaauagca

SEQ ID NO: 292132 - RNA, 22 nt, Human
aaggaggaugaauugucugcaa

SEQ ID NO: 292133 - RNA, 22 nt, Human
aaggagaggagucauugggaua

SEQ ID NO: 292134 - RNA, 22 nt, Human
aagccuuagauuggcgaugucg

SEQ ID NO: 292135 - RNA, 22 nt, Human
aaggcgauuuaaagauguuagg

SEQ ID NO: 292136 - RNA, 22 nt, Human
aagcucagcugguggugauugc

SEQ ID NO: 292137 - RNA, 22 nt, Human
aagccuguugacagcugucagu

SEQ ID NO: 292138 - RNA, 22 nt, Human
aagcgggcagcggccugcgcca

SEQ ID NO: 292139 - RNA, 22 nt, Human
aagcucuuuccacuaaaccacu

SEQ ID NO: 292140 - RNA, 22 nt, Human
aagcugcagacccccugucuca

SEQ ID NO: 292141 - RNA, 22 nt, Human
aagcuguuauuucacagguuca

SEQ ID NO: 292142 - RNA, 22 nt, Human
aaggaaaaccugacugaagaac

SEQ ID NO: 292143 - RNA, 20 nt, Human
aagcuguguucaagauggga

SEQ ID NO: 292144 - RNA, 22 nt, Human
aagcugccugggaggaagggcu

SEQ ID NO: 292145 - RNA, 22 nt, Human
aagcugaguaggaaugguaggu

SEQ ID NO: 292146 - RNA, 22 nt, Human
aagccuccgugcugcuggaucu

SEQ ID NO: 292147 - RNA, 22 nt, Human
aagcucugggacugaggcuccu

SEQ ID NO: 292148 - RNA, 22 nt, Human
aagcaaaaucgcaucuggggcc

SEQ ID NO: 292149 - RNA, 22 nt, Human
aagcaauucacaguucacuuaa

SEQ ID NO: 292150 - RNA, 22 nt, Human
aagcaaguucuaaaguaauucu

SEQ ID NO: 292151 - RNA, 22 nt, Human
aagcgcggccgccgcggucgcu

SEQ ID NO: 292152 - RNA, 22 nt, Human
aagcaugaaauaauguccuugu

SEQ ID NO: 292153 - RNA, 22 nt, Human
aagcauuuuagauaaagcauca

SEQ ID NO: 292154 - RNA, 22 nt, Human
aagccgagggaggugauggaga

SEQ ID NO: 292155 - RNA, 22 nt, Human
auaaaaucugaagcaagaauaa

SEQ ID NO: 292156 - RNA, 22 nt, Human
auaaaaauguuuuuguguggua

SEQ ID NO: 292157 - RNA, 22 nt, Human
aguuuuugagaauucuucugaa

SEQ ID NO: 292158 - RNA, 22 nt, Human
aguuuuuaacgccauguuugaa

SEQ ID NO: 292159 - RNA, 22 nt, Human
auaaauucuaugauggauuggg

SEQ ID NO: 292160 - RNA, 20 nt, Human
auaaauaggauuuucugaca

SEQ ID NO: 292161 - RNA, 22 nt, Human
auaagcuucucugcaguucagu

SEQ ID NO: 292162 - RNA, 22 nt, Human
auaaaguaaugcauauaaugug

SEQ ID NO: 292163 - RNA, 22 nt, Human
auaacgaaagcaauuauuuuca

SEQ ID NO: 292164 - RNA, 22 nt, Human
auaaguuauuuuaguaaaucag

SEQ ID NO: 292165 - RNA, 22 nt, Human
auaaucuuuccagucaguuucc

SEQ ID NO: 292166 - RNA, 22 nt, Human
auaaaacagaucaggagaauga

SEQ ID NO: 292167 - RNA, 22 nt, Human
auaaaagcacaauagaguuaug

SEQ ID NO: 292168 - RNA, 21 nt, Human
auacaguucagcuuuuacuau

SEQ ID NO: 292169 - RNA, 22 nt, Human
auacauauaugcacauuaauau

SEQ ID NO: 292170 - RNA, 22 nt, Human
auaaucuuugaguagaguugag

SEQ ID NO: 292171 - RNA, 22 nt, Human
auaaggcauagugagucaucau

SEQ ID NO: 292172 - RNA, 22 nt, Human
auaagguuuucuuuuguucccu

SEQ ID NO: 292173 - RNA, 22 nt, Human
auaagccugccuuaucuccaga

SEQ ID NO: 292174 - RNA, 23 nt, Human
auaaugauaaugcuauuuuuugu

SEQ ID NO: 292175 - RNA, 22 nt, Human
auaauugaauaagagcugcagg

SEQ ID NO: 292176 - RNA, 22 nt, Human
auacaaaaaguggugaguguau

SEQ ID NO: 292177 - RNA, 22 nt, Human
auaccaaugacaggaguuaggg

SEQ ID NO: 292178 - RNA, 21 nt, Human
auaccaaaagaacaccuuguu

SEQ ID NO: 292179 - RNA, 22 nt, Human
auaaggaaagugagugcuuaaa

SEQ ID NO: 292180 - RNA, 22 nt, Human
auaaggacuugaauuagacauu

SEQ ID NO: 292181 - RNA, 22 nt, Human
auaaccaaaaauaguuuaguac

SEQ ID NO: 292182 - RNA, 22 nt, Human
auaaauuugccagcauauguuc

SEQ ID NO: 292183 - RNA, 22 nt, Human
auaaauuugacagcucuucaug

SEQ ID NO: 292184 - RNA, 22 nt, Human
auacagacacuguagguuauuu

SEQ ID NO: 292185 - RNA, 22 nt, Human
auaaaucaagggcaguauuucc

SEQ ID NO: 292186 - RNA, 22 nt, Human
aguuucuugaagacugauguuu

SEQ ID NO: 292187 - RNA, 23 nt, Human
aguuuacguauucauucuuacuc

SEQ ID NO: 292188 - RNA, 22 nt, Human
aguuuacccacuguugaaauua

SEQ ID NO: 292189 - RNA, 22 nt, Human
aguuuaaauuguucuaucagaa

SEQ ID NO: 292190 - RNA, 22 nt, Human
aguugguggaagcuaagcuucu

SEQ ID NO: 292191 - RNA, 21 nt, Human
aguuguacuguauagcagaug

SEQ ID NO: 292192 - RNA, 22 nt, Human
aguuuggaggagaaagugcggg

SEQ ID NO: 292193 - RNA, 22 nt, Human
aguuuguagguuaggaucagca

SEQ ID NO: 292194 - RNA, 22 nt, Human
aguugguguuagaguuuuucag

SEQ ID NO: 292195 - RNA, 22 nt, Human
aguuguucucagcagaagaacu

SEQ ID NO: 292196 - RNA, 22 nt, Human
aguuguuuuucuuagauuuuag

SEQ ID NO: 292197 - RNA, 22 nt, Human
aguuuuguuuguuuguuuguua

SEQ ID NO: 292198 - RNA, 22 nt, Human
aguuuccacuggagacacugug

SEQ ID NO: 292199 - RNA, 22 nt, Human
aguuucaguuaguugggugaca

SEQ ID NO: 292200 - RNA, 22 nt, Human
aguuugauuugucuaucuucau

SEQ ID NO: 292201 - RNA, 22 nt, Human
aguuuuugccucgaauucugcg

SEQ ID NO: 292202 - RNA, 22 nt, Human
aguuuucugccucuggaugcgu

SEQ ID NO: 292203 - RNA, 22 nt, Human
auaaaaaguggcugcuauugga

SEQ ID NO: 292204 - RNA, 18 nt, Human
aguuuuuuuggcaaaagg

SEQ ID NO: 292205 - RNA, 22 nt, Human
aguugguucgucucgccuugag

SEQ ID NO: 292206 - RNA, 22 nt, Human
aguugugagaaugaacacugaa

SEQ ID NO: 292207 - RNA, 22 nt, Human
aguugguauuuacugcaguugg

SEQ ID NO: 292208 - RNA, 22 nt, Human
aguuggcauuuuauuuaaguau

SEQ ID NO: 292209 - RNA, 22 nt, Human
aguugaggguuaguaaauagcu

SEQ ID NO: 292210 - RNA, 22 nt, Human
aguuggaagacacccugaaauc

SEQ ID NO: 292211 - RNA, 22 nt, Human
aguugcuucccuauucuuagca

SEQ ID NO: 292212 - RNA, 22 nt, Human
aguugcagguucacguaucuug

SEQ ID NO: 292213 - RNA, 22 nt, Human
aguuccaaauuugcaagaaaau

SEQ ID NO: 292214 - RNA, 22 nt, Human
aguucugggaggugcacgucca

SEQ ID NO: 292215 - RNA, 22 nt, Human
aguugcugccagguccugggag

SEQ ID NO: 292216 - RNA, 22 nt, Human
aguugcuaauacaaaaaguccc

SEQ ID NO: 292217 - RNA, 22 nt, Human
aguucuguucccccaguuacau

SEQ ID NO: 292218 - RNA, 22 nt, Human
aguucugacucugaaucuggga

SEQ ID NO: 292219 - RNA, 22 nt, Human
aguucucaagguuaggaaaagu

SEQ ID NO: 292220 - RNA, 22 nt, Human
aguucccgcgggagggcgcagg

SEQ ID NO: 292221 - RNA, 22 nt, Human
aguggggcccaagaaucugcau

SEQ ID NO: 292222 - RNA, 22 nt, Human
aguggugaucuguuacagucac

SEQ ID NO: 292223 - RNA, 22 nt, Human
aguggcuagaucaugagugagc

SEQ ID NO: 292224 - RNA, 22 nt, Human
aguggggaaauaucaauauuug

SEQ ID NO: 292225 - RNA, 19 nt, Human
agugggcaaggaagaugac

SEQ ID NO: 292226 - RNA, 22 nt, Human
aguggcuguuccaggugaggac

SEQ ID NO: 292227 - RNA, 22 nt, Human
aguggcuucucuggggucaaga

SEQ ID NO: 292228 - RNA, 22 nt, Human
aguggcugugaaauacauggga

SEQ ID NO: 292229 - RNA, 22 nt, Human
aguggcuggcaggggagggucc

SEQ ID NO: 292230 - RNA, 22 nt, Human
agugcuuuauguuguugugcaa

SEQ ID NO: 292231 - RNA, 22 nt, Human
agugcucagggaaugccacuga

SEQ ID NO: 292232 - RNA, 22 nt, Human
agugaugcuuuggagaagaucc

SEQ ID NO: 292233 - RNA, 22 nt, Human
agugauguaauggugaauguga

SEQ ID NO: 292234 - RNA, 23 nt, Human
agugaucuguguuugaagaaugc

SEQ ID NO: 292235 - RNA, 22 nt, Human
agugaucugcugcagugcucug

SEQ ID NO: 292236 - RNA, 22 nt, Human
agugaugauccaaaugaauuga

SEQ ID NO: 292237 - RNA, 21 nt, Human
agugagugacagaagaagguu

SEQ ID NO: 292238 - RNA, 22 nt, Human
agugccuucuagaaucucuuaa

SEQ ID NO: 292239 - RNA, 22 nt, Human
agugccuuaaaggucuugcagc

SEQ ID NO: 292240 - RNA, 22 nt, Human
agugccaucuuuaacuguccca

SEQ ID NO: 292241 - RNA, 23 nt, Human
aguggaggucgggguggggagac

SEQ ID NO: 292242 - RNA, 23 nt, Human
aguggccgaucaucucgggcuug

SEQ ID NO: 292243 - RNA, 22 nt, Human
agugccauggcugcuagauggc

SEQ ID NO: 292244 - RNA, 22 nt, Human
agugaaagaaaacuguuagaac

SEQ ID NO: 292245 - RNA, 22 nt, Human
agugaaauaugcccauugcugu

SEQ ID NO: 292246 - RNA, 21 nt, Human
agugaagagugggcuugauca

SEQ ID NO: 292247 - RNA, 19 nt, Human
agugaacuccauaucaggu

SEQ ID NO: 292248 - RNA, 22 nt, Human
agucugugguccucuguaucuc

SEQ ID NO: 292249 - RNA, 22 nt, Human
agugaaaacugaaucaccuucc

SEQ ID NO: 292250 - RNA, 22 nt, Human
aguagagacgggguuuuaguag

SEQ ID NO: 292251 - RNA, 20 nt, Human
aguacugacaauauucugug

SEQ ID NO: 292252 - RNA, 22 nt, Human
aguacuuugacuagaggcagcu

SEQ ID NO: 292253 - RNA, 22 nt, Human
aguacuuggaaaaaugcccacu

SEQ ID NO: 292254 - RNA, 23 nt, Human
agugaagcugguuagugaugacc

SEQ ID NO: 292255 - RNA, 22 nt, Human
agugaagauagagccaggucug

SEQ ID NO: 292256 - RNA, 22 nt, Human
agugagcuuuuaaaauuuacca

SEQ ID NO: 292257 - RNA, 22 nt, Human
agugagcauuagugcuuauauu

SEQ ID NO: 292258 - RNA, 22 nt, Human
agugagaguauuaaugugaacu

SEQ ID NO: 292259 - RNA, 22 nt, Human
agugacuguccuacuuuguaga

SEQ ID NO: 292260 - RNA, 22 nt, Human
agugaggggagaaugaggugga

SEQ ID NO: 292261 - RNA, 21 nt, Human
agugaguagagcacugaguca

SEQ ID NO: 292262 - RNA, 20 nt, Human
agugaguuaucagcuacagu

SEQ ID NO: 292263 - RNA, 20 nt, Human
agugauuuguuaguacauug

SEQ ID NO: 292264 - RNA, 23 nt, Human
agugaugcaguaucugggucugu

SEQ ID NO: 292265 - RNA, 22 nt, Human
aguucaugcuuagaucucauuu

SEQ ID NO: 292266 - RNA, 22 nt, Human
aguucaugugguuuaacuuaau

SEQ ID NO: 292267 - RNA, 22 nt, Human
aguucaauuguuuuguaaaagu

SEQ ID NO: 292268 - RNA, 22 nt, Human
aguuauuaagaaaauuuugcca

SEQ ID NO: 292269 - RNA, 22 nt, Human
aguucauccucauuuacaagga

SEQ ID NO: 292270 - RNA, 22 nt, Human
aguuauuuuucacuauuaggcu

SEQ ID NO: 292271 - RNA, 22 nt, Human
aguuauggguauguauuauaau

SEQ ID NO: 292272 - RNA, 22 nt, Human
aguuaucuauaaaucccugagg

SEQ ID NO: 292273 - RNA, 22 nt, Human
aguuaugcaagcaaguaccacu

SEQ ID NO: 292274 - RNA, 22 nt, Human
aguuaauuauagugcuuaauau

SEQ ID NO: 292275 - RNA, 17 nt, Human
aguuacugcacuugcca

SEQ ID NO: 292276 - RNA, 23 nt, Human
aguuaucuaaugaaguucuucca

SEQ ID NO: 292277 - RNA, 22 nt, Human
aguuaggaaauaaguugaguuu

SEQ ID NO: 292278 - RNA, 22 nt, Human
aguuacuauuacuuauuauuau

SEQ ID NO: 292279 - RNA, 22 nt, Human
aguuaaucuuguauuaaugguu

SEQ ID NO: 292280 - RNA, 22 nt, Human
aguuaacuugugguuuggcugu

SEQ ID NO: 292281 - RNA, 22 nt, Human
aguuaaagggggcuacagugug

SEQ ID NO: 292282 - RNA, 22 nt, Human
aguguuuuaugugccaguuuaa

SEQ ID NO: 292283 - RNA, 22 nt, Human
aguguggccaaugaggaugggc

SEQ ID NO: 292284 - RNA, 22 nt, Human
aguguggcccaugaauuauugg

SEQ ID NO: 292285 - RNA, 22 nt, Human
aguguucaucacaggcuagaga

SEQ ID NO: 292286 - RNA, 22 nt, Human
agugugaguuacaaagugugaa

SEQ ID NO: 292287 - RNA, 22 nt, Human
agugugacccauggcaagggca

SEQ ID NO: 292288 - RNA, 22 nt, Human
agugucuuuagucgcugagcaa

SEQ ID NO: 292289 - RNA, 22 nt, Human
agugucagcagcuucauugucu

SEQ ID NO: 292290 - RNA, 20 nt, Human
aguguuggugcuuuucccag

SEQ ID NO: 292291 - RNA, 22 nt, Human
aguguuugggagagggugugag

SEQ ID NO: 292292 - RNA, 23 nt, Human
aguguucagcauguaguaaauac

SEQ ID NO: 292293 - RNA, 22 nt, Human
aguguuaggaauuaauguaggg

SEQ ID NO: 292294 - RNA, 22 nt, Human
aguguccaacucagcuugucaa

SEQ ID NO: 292295 - RNA, 22 nt, Human
agugucugcgggcagaggagcg

SEQ ID NO: 292296 - RNA, 22 nt, Human
aguggguaaggacaggugucug

SEQ ID NO: 292297 - RNA, 22 nt, Human
aguguucaauuugagcucaaag

SEQ ID NO: 292298 - RNA, 19 nt, Human
agugggauggcuuuuuccc

SEQ ID NO: 292299 - RNA, 22 nt, Human
aguguauuugccuauaaaaaug

SEQ ID NO: 292300 - RNA, 22 nt, Human
aguggugccuaagcgcggaggc

SEQ ID NO: 292301 - RNA, 22 nt, Human
agguugggagaggucacccuga

SEQ ID NO: 292302 - RNA, 22 nt, Human
agguggcguauguguucguguu

SEQ ID NO: 292303 - RNA, 20 nt, Human
agguuugcuguauaucaugg

SEQ ID NO: 292304 - RNA, 22 nt, Human
aggugcuugcauacugcuugac

SEQ ID NO: 292305 - RNA, 22 nt, Human
agguucaucaauaacucagaga

SEQ ID NO: 292306 - RNA, 18 nt, Human
agguugcaucugugcaga

SEQ ID NO: 292307 - RNA, 22 nt, Human
agguuuggguucauugcuggcu

SEQ ID NO: 292308 - RNA, 20 nt, Human
agguugguuuacuagucugu

SEQ ID NO: 292309 - RNA, 22 nt, Human
agguuguugagaucaucuggcu

SEQ ID NO: 292310 - RNA, 18 nt, Human
agguuguguaaaaagaag

SEQ ID NO: 292311 - RNA, 22 nt, Human
agguuguaucauaugaaacugu

SEQ ID NO: 292312 - RNA, 21 nt, Human
aguaccugugugccugugugu

SEQ ID NO: 292313 - RNA, 22 nt, Human
aguaauaaacaacucauuuugg

SEQ ID NO: 292314 - RNA, 20 nt, Human
aguacauauuugugauuuuu

SEQ ID NO: 292315 - RNA, 22 nt, Human
aguaagaaagaaugauaggccu

SEQ ID NO: 292316 - RNA, 22 nt, Human
agguuuuacuuuuuuuggaggu

SEQ ID NO: 292317 - RNA, 22 nt, Human
agguuuauggagcaccacaucu

SEQ ID NO: 292318 - RNA, 22 nt, Human
agguuuuugucauuuucuggua

SEQ ID NO: 292319 - RNA, 22 nt, Human
aggugcucaguaauugauuguu

SEQ ID NO: 292320 - RNA, 22 nt, Human
aggugauaugggcuucucugag

SEQ ID NO: 292321 - RNA, 22 nt, Human
agguggcuaugaggaugcaguc

SEQ ID NO: 292322 - RNA, 18 nt, Human
aggugagaauuuggcuuu

SEQ ID NO: 292323 - RNA, 22 nt, Human
aggucuugguaggccagagucu

SEQ ID NO: 292324 - RNA, 22 nt, Human
aggugagaacguggaggggcgg

SEQ ID NO: 292325 - RNA, 22 nt, Human
aggucuuuaguggcagagucua

SEQ ID NO: 292326 - RNA, 22 nt, Human
aggugauauuauguauuucuau

SEQ ID NO: 292327 - RNA, 19 nt, Human
aggugaugugacucuagaa

SEQ ID NO: 292328 - RNA, 21 nt, Human
aggugguuccaauaaguaggu

SEQ ID NO: 292329 - RNA, 22 nt, Human
aggugggcuuagaaaucuguau

SEQ ID NO: 292330 - RNA, 22 nt, Human
agguggucuuguggaugccgca

SEQ ID NO: 292331 - RNA, 22 nt, Human
agguuaaaagagugaguggaua

SEQ ID NO: 292332 - RNA, 22 nt, Human
agguuaauaugaacagcagaag

SEQ ID NO: 292333 - RNA, 22 nt, Human
agguuaugcacugcacaacccu

SEQ ID NO: 292334 - RNA, 22 nt, Human
agguuaggaaugggagguaaug

SEQ ID NO: 292335 - RNA, 22 nt, Human
agguuagaauauuuuuucaaga

SEQ ID NO: 292336 - RNA, 22 nt, Human
agggggcaugaaauaaaggaaa

SEQ ID NO: 292337 - RNA, 22 nt, Human
aggguuacuuauuuuggauagu

SEQ ID NO: 292338 - RNA, 22 nt, Human
aggguuaggaaggagaagagag

SEQ ID NO: 292339 - RNA, 22 nt, Human
agggggaaaauguggauuaugg

SEQ ID NO: 292340 - RNA, 22 nt, Human
aggggguugcgcaggggcuccc

SEQ ID NO: 292341 - RNA, 22 nt, Human
agggguacuagaggauugagau

SEQ ID NO: 292342 - RNA, 22 nt, Human
agggggcuccugcaggccccca

SEQ ID NO: 292343 - RNA, 22 nt, Human
agggggccuauucuuggacugc

SEQ ID NO: 292344 - RNA, 22 nt, Human
agguaugucccccgagugcagc

SEQ ID NO: 292345 - RNA, 22 nt, Human
aggguugaagucugguccucau

SEQ ID NO: 292346 - RNA, 22 nt, Human
aggguauguuuuuaucuacugu

SEQ ID NO: 292347 - RNA, 22 nt, Human
aggguuaugcuccuucaucuug

SEQ ID NO: 292348 - RNA, 22 nt, Human
aggucggcuuuuuuccuuucac

SEQ ID NO: 292349 - RNA, 22 nt, Human
aggucugcccaggaugcugcuu

SEQ ID NO: 292350 - RNA, 20 nt, Human
agggguucuguuaugaaaua

SEQ ID NO: 292351 - RNA, 22 nt, Human
agggguuugggaaggguuaggg

SEQ ID NO: 292352 - RNA, 22 nt, Human
aggggcugugucauuuguccua

SEQ ID NO: 292353 - RNA, 22 nt, Human
aggguaauaacaguauggugau

SEQ ID NO: 292354 - RNA, 22 nt, Human
aggguggcuggaguggucuggu

SEQ ID NO: 292355 - RNA, 22 nt, Human
aggguguuugggagcagaggau

SEQ ID NO: 292356 - RNA, 22 nt, Human
aggggcaagucuggccauuucu

SEQ ID NO: 292357 - RNA, 22 nt, Human
agggcugggcuuggcaggcugg

SEQ ID NO: 292358 - RNA, 22 nt, Human
agggcuuaggcacacugugacu

SEQ ID NO: 292359 - RNA, 22 nt, Human
aggggcugagaguuugaugugg

SEQ ID NO: 292360 - RNA, 19 nt, Human
aggggccugcuuggccuug

SEQ ID NO: 292361 - RNA, 22 nt, Human
aggggauucgggugccccuagu

SEQ ID NO: 292362 - RNA, 22 nt, Human
agggcauacauuuuccugagau

SEQ ID NO: 292363 - RNA, 22 nt, Human
aggggcaaacuuguucuagggu

SEQ ID NO: 292364 - RNA, 22 nt, Human
agggcccaccuuggugcugagg

SEQ ID NO: 292365 - RNA, 21 nt, Human
agggccagaucaccaaggagc

SEQ ID NO: 292366 - RNA, 22 nt, Human
agggccagcagcuuggccaacc

SEQ ID NO: 292367 - RNA, 22 nt, Human
agggcaguuuuacugaaaggug

SEQ ID NO: 292368 - RNA, 22 nt, Human
agggaugcaguaaaaacuguag

SEQ ID NO: 292369 - RNA, 22 nt, Human
agggaggcccagcagacuggcg

SEQ ID NO: 292370 - RNA, 22 nt, Human
agggaguagggagccaugggug

SEQ ID NO: 292371 - RNA, 19 nt, Human
agggaggcaagagaaaugu

SEQ ID NO: 292372 - RNA, 20 nt, Human
agggauuugguugguauugu

SEQ ID NO: 292373 - RNA, 22 nt, Human
agggcaggguuggugcuggugc

SEQ ID NO: 292374 - RNA, 22 nt, Human
agggccaagaaagaguggcuuu

SEQ ID NO: 292375 - RNA, 22 nt, Human
agggaggagggacagaaagagg

SEQ ID NO: 292376 - RNA, 22 nt, Human
agggcaugugaaguaaccuagg

SEQ ID NO: 292377 - RNA, 22 nt, Human
agggcaguuaugaaugucucca

SEQ ID NO: 292378 - RNA, 22 nt, Human
agggaaauaggagaagaaagga

SEQ ID NO: 292379 - RNA, 21 nt, Human
aggcuuggaucuagacaggcc

SEQ ID NO: 292380 - RNA, 22 nt, Human
aggcuguagaucuagacaugua

SEQ ID NO: 292381 - RNA, 22 nt, Human
aggcugcucucgccggcggugu

SEQ ID NO: 292382 - RNA, 22 nt, Human
aggcugucucagccugcuugca

SEQ ID NO: 292383 - RNA, 22 nt, Human
aggcuucaaggacagcagccac

SEQ ID NO: 292384 - RNA, 22 nt, Human
aggacacagaguauggaagugu

SEQ ID NO: 292385 - RNA, 23 nt, Human
aggaagucugacacuacagcguu

SEQ ID NO: 292386 - RNA, 22 nt, Human
aggaauugucgucauguauaau

SEQ ID NO: 292387 - RNA, 22 nt, Human
aggaauuugggguuacaugaug

SEQ ID NO: 292388 - RNA, 16 nt, Human
aggagcagaaagcagu

SEQ ID NO: 292389 - RNA, 22 nt, Human
aggagcugccggauggggcaug

SEQ ID NO: 292390 - RNA, 22 nt, Human
aggaggcucucagguccucccc

SEQ ID NO: 292391 - RNA, 22 nt, Human
aggaaauaagggcacuucagau

SEQ ID NO: 292392 - RNA, 19 nt, Human
agcggccgccgcgggcgcc

SEQ ID NO: 292393 - RNA, 22 nt, Human
agcgcuguguucccgugggcau

SEQ ID NO: 292394 - RNA, 22 nt, Human
agcggcaagguguauguggcag

SEQ ID NO: 292395 - RNA, 22 nt, Human
aggacaaaggaccagaucugga

SEQ ID NO: 292396 - RNA, 22 nt, Human
aggauucuccuguuucccaccc

SEQ ID NO: 292397 - RNA, 22 nt, Human
aggagggcggggcuaaaaggga

SEQ ID NO: 292398 - RNA, 22 nt, Human
aggauaaaggucauuauuccca

SEQ ID NO: 292399 - RNA, 22 nt, Human
aggauauguccuuuuuuucccc

SEQ ID NO: 292400 - RNA, 22 nt, Human
aggauagacuucagaaggcaua

SEQ ID NO: 292401 - RNA, 22 nt, Human
aggauuuagcaugaaaugugaa

SEQ ID NO: 292402 - RNA, 20 nt, Human
aggcagacaaggagucuguu

SEQ ID NO: 292403 - RNA, 20 nt, Human
aggauuauguacauggaugc

SEQ ID NO: 292404 - RNA, 22 nt, Human
aggauugucuccugugaugugc

SEQ ID NO: 292405 - RNA, 22 nt, Human
aggauuuaauugcauuuuucuc

SEQ ID NO: 292406 - RNA, 22 nt, Human
aggcaagauuaggaccagaaga

SEQ ID NO: 292407 - RNA, 22 nt, Human
aggcaauuuuuaggguuguugu

SEQ ID NO: 292408 - RNA, 22 nt, Human
aggcaauuauacuagguuuugg

SEQ ID NO: 292409 - RNA, 22 nt, Human
aggcaacagacaggcuugguuc

SEQ ID NO: 292410 - RNA, 22 nt, Human
aggauuuauuccagaaaugcaa

SEQ ID NO: 292411 - RNA, 22 nt, Human
aggcucagcaucugauucauau

SEQ ID NO: 292412 - RNA, 22 nt, Human
aggcuaagugauuagugacaua

SEQ ID NO: 292413 - RNA, 22 nt, Human
aggcguggcuucugcuggguug

SEQ ID NO: 292414 - RNA, 22 nt, Human
aggcugcuggcaggcguggacg

SEQ ID NO: 292415 - RNA, 22 nt, Human
aggcccagcaccagcggucuuc

SEQ ID NO: 292416 - RNA, 22 nt, Human
aggcugccuaugaaggcagaag

SEQ ID NO: 292417 - RNA, 22 nt, Human
aggcauuuucuuguuauuuuua

SEQ ID NO: 292418 - RNA, 22 nt, Human
aggcaguguggagggcuguugc

SEQ ID NO: 292419 - RNA, 22 nt, Human
aggcaguggcuuuuguuguguu

SEQ ID NO: 292420 - RNA, 22 nt, Human
aggcaguguguagcuggaagag

SEQ ID NO: 292421 - RNA, 22 nt, Human
aggcauguugcuucgggcuuug

SEQ ID NO: 292422 - RNA, 22 nt, Human
aggcauuuaaagauguaagacu

SEQ ID NO: 292423 - RNA, 22 nt, Human
aggcauuuaucaggaaauguuc

SEQ ID NO: 292424 - RNA, 21 nt, Human
aggcauuuucuuggagauucu

SEQ ID NO: 292425 - RNA, 22 nt, Human
aggcagugccuggaccccagcu

SEQ ID NO: 292426 - RNA, 22 nt, Human
aggcaguggagcuggaauaggc

SEQ ID NO: 292427 - RNA, 21 nt, Human
aggccaaguuggauuucuuca

SEQ ID NO: 292428 - RNA, 22 nt, Human
aggccacucagggggccaagau

SEQ ID NO: 292429 - RNA, 22 nt, Human
aggcaauagagggugaggagga

SEQ ID NO: 292430 - RNA, 22 nt, Human
aggcaggauuugcgaugugguu

SEQ ID NO: 292431 - RNA, 22 nt, Human
aggcagagaggucuuccuggaa

SEQ ID NO: 292432 - RNA, 22 nt, Human
aggcacagaauccagucugcug

SEQ ID NO: 292433 - RNA, 22 nt, Human
aggcagcagggagggagaaaug

SEQ ID NO: 292434 - RNA, 21 nt, Human
aggcagcgauuuucauauugc

SEQ ID NO: 292435 - RNA, 23 nt, Human
aggcagaguccuggggcacagcc

SEQ ID NO: 292436 - RNA, 19 nt, Human
aggcagccccaacuugcau

SEQ ID NO: 292437 - RNA, 23 nt, Human
aggcaagaacggguuguucaccc

SEQ ID NO: 292438 - RNA, 22 nt, Human
aggcagagauggcugcagggcc

SEQ ID NO: 292439 - RNA, 22 nt, Human
aggcagaugggagcuggaaguu

SEQ ID NO: 292440 - RNA, 22 nt, Human
aggcaucguguuuuucugcuuu

SEQ ID NO: 292441 - RNA, 22 nt, Human
aggcagugguguuugcuggugg

SEQ ID NO: 292442 - RNA, 22 nt, Human
aggcaggggagcuggaagggua

SEQ ID NO: 292443 - RNA, 22 nt, Human
aggcauauaguguuuaaaaaaa

SEQ ID NO: 292444 - RNA, 22 nt, Human
aggcaggagcugugguggugag

SEQ ID NO: 292445 - RNA, 22 nt, Human
aggcaggcucaaugcccagucu

SEQ ID NO: 292446 - RNA, 23 nt, Human
aggcagcaugcaacaggccauuu

SEQ ID NO: 292447 - RNA, 22 nt, Human
acgccuugagccuugccugaau

SEQ ID NO: 292448 - RNA, 22 nt, Human
acgccugccuguacuugugggg

SEQ ID NO: 292449 - RNA, 22 nt, Human
acgccggguaaggucauucugc

SEQ ID NO: 292450 - RNA, 22 nt, Human
acgcauguacuuguaugcaaug

SEQ ID NO: 292451 - RNA, 22 nt, Human
acgccaggagcuucuccguuca

SEQ ID NO: 292452 - RNA, 20 nt, Human
acgcauguauaugcaucacc

SEQ ID NO: 292453 - RNA, 22 nt, Human
acggccgaugacuccagcaugg

SEQ ID NO: 292454 - RNA, 22 nt, Human
acgcgcuccagcaggugcuuca

SEQ ID NO: 292455 - RNA, 22 nt, Human
acggcuugaacgcgccuguggg

SEQ ID NO: 292456 - RNA, 22 nt, Human
acggcggguuccgggccagccc

SEQ ID NO: 292457 - RNA, 22 nt, Human
acgucaucguugucaucgucau

SEQ ID NO: 292458 - RNA, 20 nt, Human
acgccgcgaggugagcuggu

SEQ ID NO: 292459 - RNA, 22 nt, Human
acaucuaugucugaggccuugg

SEQ ID NO: 292460 - RNA, 21 nt, Human
acauccaggguccucacugcc

SEQ ID NO: 292461 - RNA, 22 nt, Human
acaggguauauaggcaaagcua

SEQ ID NO: 292462 - RNA, 22 nt, Human
acagugguggagggcuguccug

SEQ ID NO: 292463 - RNA, 21 nt, Human
acaguaugaucaaaugugcca

SEQ ID NO: 292464 - RNA, 22 nt, Human
acguagggauuccucgucucau

SEQ ID NO: 292465 - RNA, 22 nt, Human
acgguuuugugagguaguacuu

SEQ ID NO: 292466 - RNA, 22 nt, Human
acggugagacuggcgaaggaaa

SEQ ID NO: 292467 - RNA, 22 nt, Human
acgguguuucucguucaggguu

SEQ ID NO: 292468 - RNA, 22 nt, Human
acuaggagcccgaugccugggu

SEQ ID NO: 292469 - RNA, 20 nt, Human
acuagaaagucacugggggg

SEQ ID NO: 292470 - RNA, 22 nt, Human
acgugcauuacucaaaucucaa

SEQ ID NO: 292471 - RNA, 22 nt, Human
acuagagguuccagugaaggua

SEQ ID NO: 292472 - RNA, 22 nt, Human
acuacuguaauuuauuguuaca

SEQ ID NO: 292473 - RNA, 22 nt, Human
acuauauaaugcacacaguaua

SEQ ID NO: 292474 - RNA, 22 nt, Human
acuaggugggugucacugacuc

SEQ ID NO: 292475 - RNA, 22 nt, Human
acuauacaguauguacgugcac

SEQ ID NO: 292476 - RNA, 22 nt, Human
acuaggaaguaaauaugucauc

SEQ ID NO: 292477 - RNA, 22 nt, Human
acuagccucauaaaguuugucu

SEQ ID NO: 292478 - RNA, 22 nt, Human
acuaucuauugucuucuucaug

SEQ ID NO: 292479 - RNA, 22 nt, Human
acuauggaguucagaucuugag

SEQ ID NO: 292480 - RNA, 22 nt, Human
acucacuguuuugaaauugaac

SEQ ID NO: 292481 - RNA, 22 nt, Human
acucagcaccuagaaagugugc

SEQ ID NO: 292482 - RNA, 22 nt, Human
acuaucaacagcaucagggugu

SEQ ID NO: 292483 - RNA, 22 nt, Human
acucaaccaucugcauuuuuga

SEQ ID NO: 292484 - RNA, 22 nt, Human
acugcaggucccaucaccugcg

SEQ ID NO: 292485 - RNA, 22 nt, Human
acugcauuaucaccaagaugua

SEQ ID NO: 292486 - RNA, 22 nt, Human
acugccauauuaggagcuucag

SEQ ID NO: 292487 - RNA, 22 nt, Human
acugcuguugugauggguauuu

SEQ ID NO: 292488 - RNA, 22 nt, Human
acugcugauuauugaaguagag

SEQ ID NO: 292489 - RNA, 22 nt, Human
acugaggaagccugucaucauc

SEQ ID NO: 292490 - RNA, 22 nt, Human
acugaucuguguaauauguuac

SEQ ID NO: 292491 - RNA, 22 nt, Human
acugauuccaagcuuguggagg

SEQ ID NO: 292492 - RNA, 22 nt, Human
acugaugacaaugugaguguuc

SEQ ID NO: 292493 - RNA, 22 nt, Human
acugcagauccucugagaaacc

SEQ ID NO: 292494 - RNA, 22 nt, Human
acugaaaguugaugagucacug

SEQ ID NO: 292495 - RNA, 18 nt, Human
acucuuccuuauguucuu

SEQ ID NO: 292496 - RNA, 22 nt, Human
acugacuucugguauuuuuagu

SEQ ID NO: 292497 - RNA, 22 nt, Human
acugaauguucucaaaggggag

SEQ ID NO: 292498 - RNA, 22 nt, Human
acugaacuaaagaaaugggcaa

SEQ ID NO: 292499 - RNA, 22 nt, Human
acugaaauggggacaguccuua

SEQ ID NO: 292500 - RNA, 22 nt, Human
acugaaauuuauauuuugggca

SEQ ID NO: 292501 - RNA, 22 nt, Human
acucuugacuaaugcuaauguc

SEQ ID NO: 292502 - RNA, 22 nt, Human
acucuuauuuugaaguaauaau

SEQ ID NO: 292503 - RNA, 22 nt, Human
acugaaggcuggaccaugcauc

SEQ ID NO: 292504 - RNA, 22 nt, Human
acucauuuggauuuuggaguuu

SEQ ID NO: 292505 - RNA, 22 nt, Human
acucauucgccuugcccaaggc

SEQ ID NO: 292506 - RNA, 21 nt, Human
acuccagccacugacugucuc

SEQ ID NO: 292507 - RNA, 22 nt, Human
acucaguuuugaucguucuuau

SEQ ID NO: 292508 - RNA, 22 nt, Human
acucaucauuuuacggagcagc

SEQ ID NO: 292509 - RNA, 22 nt, Human
acucaugugacuaaaacauuaa

SEQ ID NO: 292510 - RNA, 21 nt, Human
acucaucuuuuuggagaccag

SEQ ID NO: 292511 - RNA, 22 nt, Human
acucaguaacuguuugcugaau

SEQ ID NO: 292512 - RNA, 22 nt, Human
acucaaacuuuuuguggacauu

SEQ ID NO: 292513 - RNA, 22 nt, Human
acuccuucauauuuuaauugaa

SEQ ID NO: 292514 - RNA, 18 nt, Human
acucugaagcuaagucac

SEQ ID NO: 292515 - RNA, 22 nt, Human
acucugcaguaaggaauuguuu

SEQ ID NO: 292516 - RNA, 22 nt, Human
acuugggaaaugaaaauacaga

SEQ ID NO: 292517 - RNA, 22 nt, Human
acuucaggacggcaguggaggg

SEQ ID NO: 292518 - RNA, 22 nt, Human
acuguugcuuguuuggaauguu

SEQ ID NO: 292519 - RNA, 22 nt, Human
acuggauuuugugguguaucuu

SEQ ID NO: 292520 - RNA, 22 nt, Human
acuggcaugauagaccauaaca

SEQ ID NO: 292521 - RNA, 22 nt, Human
acugccuugcaccauggcuuuu

SEQ ID NO: 292522 - RNA, 22 nt, Human
acugcucugugguuggaagccu

SEQ ID NO: 292523 - RNA, 22 nt, Human
acuucagugugguauaaaacgu

SEQ ID NO: 292524 - RNA, 22 nt, Human
acuucauuugaaaugguugaau

SEQ ID NO: 292525 - RNA, 22 nt, Human
acuucuuuugcaugauucuuua

SEQ ID NO: 292526 - RNA, 22 nt, Human
acuugaagcaugaaaauaagcc

SEQ ID NO: 292527 - RNA, 22 nt, Human
acugcguuucuaaaguagcaua

SEQ ID NO: 292528 - RNA, 22 nt, Human
acuucccacugcagugacugag

SEQ ID NO: 292529 - RNA, 22 nt, Human
acuuuaaaucuguugcuuagcu

SEQ ID NO: 292530 - RNA, 22 nt, Human
acuuguuuacaagcaguucuga

SEQ ID NO: 292531 - RNA, 22 nt, Human
acuugagcuugaaagguaugcu

SEQ ID NO: 292532 - RNA, 22 nt, Human
acuuugccuucuuacuguguug

SEQ ID NO: 292533 - RNA, 19 nt, Human
agaaauagccuuccuuguc

SEQ ID NO: 292534 - RNA, 22 nt, Human
agaaauggccagacuugccccu

SEQ ID NO: 292535 - RNA, 22 nt, Human
agaaacacaaguaaagcuccca

SEQ ID NO: 292536 - RNA, 20 nt, Human
agaaaggaguaaagaagaga

SEQ ID NO: 292537 - RNA, 20 nt, Human
acuuucacaugaacauuuaa

SEQ ID NO: 292538 - RNA, 22 nt, Human
acuuuuaauaguagauuuuuaa

SEQ ID NO: 292539 - RNA, 22 nt, Human
agaaaagaggcuuucuaagcau

SEQ ID NO: 292540 - RNA, 22 nt, Human
agaaaaggaagcuuagacugua

SEQ ID NO: 292541 - RNA, 19 nt, Human
agaaacaacauucuggaga

SEQ ID NO: 292542 - RNA, 22 nt, Human
agacaauuccauccuacguggg

SEQ ID NO: 292543 - RNA, 22 nt, Human
agaccauuuuguagccagcaua

SEQ ID NO: 292544 - RNA, 19 nt, Human
agaauuggaaccaugaacc

SEQ ID NO: 292545 - RNA, 22 nt, Human
agacaaucaacuguugaugccu

SEQ ID NO: 292546 - RNA, 22 nt, Human
agacaaggggauuuuugauggu

SEQ ID NO: 292547 - RNA, 22 nt, Human
agacacagcaauaacuacuguu

SEQ ID NO: 292548 - RNA, 22 nt, Human
agaagguggaguagaacaagcu

SEQ ID NO: 292549 - RNA, 22 nt, Human
agaaguguacuuagagaacaua

SEQ ID NO: 292550 - RNA, 22 nt, Human
agaauaagucuaauauauuggu

SEQ ID NO: 292551 - RNA, 22 nt, Human
agaauacaauuguucaguaaua

SEQ ID NO: 292552 - RNA, 22 nt, Human
agaaucagagcagaaucuucau

SEQ ID NO: 292553 - RNA, 22 nt, Human
agaaucucuagaaaugggucuc

SEQ ID NO: 292554 - RNA, 21 nt, Human
agaaugaagaagaggucuuug

SEQ ID NO: 292555 - RNA, 22 nt, Human
agaagcagaaggaagcagggcc

SEQ ID NO: 292556 - RNA, 22 nt, Human
agaaguuuguuauguaaacaaa

SEQ ID NO: 292557 - RNA, 22 nt, Human
agaaguagacaguuggauauaa

SEQ ID NO: 292558 - RNA, 21 nt, Human
agaaguuauuccauggguguu

SEQ ID NO: 292559 - RNA, 22 nt, Human
agaagaaugguuugaaagauuu

SEQ ID NO: 292560 - RNA, 22 nt, Human
agaagaucccugugguuacgac

SEQ ID NO: 292561 - RNA, 22 nt, Human
agaagggcugcuuagaauauac

SEQ ID NO: 292562 - RNA, 22 nt, Human
agaagguagaugcaucaggagg

SEQ ID NO: 292563 - RNA, 19 nt, Human
agaacccccuuccucugcu

SEQ ID NO: 292564 - RNA, 22 nt, Human
agaacccaaggcccagggaugu

SEQ ID NO: 292565 - RNA, 22 nt, Human
agaaggcagaaaagcuuuacaa

SEQ ID NO: 292566 - RNA, 22 nt, Human
agaaaauagguaguagacgggc

SEQ ID NO: 292567 - RNA, 22 nt, Human
acuuuuuugccaucccuccagc

SEQ ID NO: 292568 - RNA, 23 nt, Human
agauaaggaagcauuugagccag

SEQ ID NO: 292569 - RNA, 22 nt, Human
agauauuauuuucuauuuauca

SEQ ID NO: 292570 - RNA, 21 nt, Human
agaguuuucuccauuucaggc

SEQ ID NO: 292571 - RNA, 22 nt, Human
agauaggcuuagccaagcuuuc

SEQ ID NO: 292572 - RNA, 22 nt, Human
agauauucugccuaacagguuu

SEQ ID NO: 292573 - RNA, 22 nt, Human
agaucugucaccauccuggagc

SEQ ID NO: 292574 - RNA, 17 nt, Human
agaucugaaggagaaca

SEQ ID NO: 292575 - RNA, 22 nt, Human
agauagaaggauugugacacau

SEQ ID NO: 292576 - RNA, 22 nt, Human
agaugacuaacauaguauugcu

SEQ ID NO: 292577 - RNA, 22 nt, Human
agaugaccaguaagugguugaa

SEQ ID NO: 292578 - RNA, 22 nt, Human
agagugucaggaggguggaugu

SEQ ID NO: 292579 - RNA, 22 nt, Human
agaguguaauuaguauuuauau

SEQ ID NO: 292580 - RNA, 22 nt, Human
agaguuaguggccucagcaggg

SEQ ID NO: 292581 - RNA, 22 nt, Human
agaguguguggggcugagguca

SEQ ID NO: 292582 - RNA, 22 nt, Human
agaguggcaccuuaccugagac

SEQ ID NO: 292583 - RNA, 21 nt, Human
agaguugaaggcaguaaagag

SEQ ID NO: 292584 - RNA, 22 nt, Human
agauaaaucauuuauuaagcgg

SEQ ID NO: 292585 - RNA, 22 nt, Human
agauaaacaacucuuagcuguu

SEQ ID NO: 292586 - RNA, 22 nt, Human
agauaucuuguuggcauaaaug

SEQ ID NO: 292587 - RNA, 23 nt, Human
agagccuaauaucuaaucuuugu

SEQ ID NO: 292588 - RNA, 22 nt, Human
agagcagcuuuucggaaccacu

SEQ ID NO: 292589 - RNA, 22 nt, Human
agagcucguggcucauugagga

SEQ ID NO: 292590 - RNA, 22 nt, Human
agagcuauuucuuaaaagcugu

SEQ ID NO: 292591 - RNA, 22 nt, Human
agagcauagggcauuaggaagg

SEQ ID NO: 292592 - RNA, 23 nt, Human
agagggaagagcuuagaugggga

SEQ ID NO: 292593 - RNA, 23 nt, Human
agaggccaacuucuugccccucc

SEQ ID NO: 292594 - RNA, 22 nt, Human
agaggcaggcagcagagaagau

SEQ ID NO: 292595 - RNA, 22 nt, Human
agagccuaguauggacucuuag

SEQ ID NO: 292596 - RNA, 22 nt, Human
agagggagccugcacagcuuuc

SEQ ID NO: 292597 - RNA, 22 nt, Human
agacuauuuugugauaacuaau

SEQ ID NO: 292598 - RNA, 22 nt, Human
agacuaauaucccauuucugac

SEQ ID NO: 292599 - RNA, 22 nt, Human
agacgcgcagaaggaagcggcc

SEQ ID NO: 292600 - RNA, 22 nt, Human
agagauugagcucagaagaccu

SEQ ID NO: 292601 - RNA, 22 nt, Human
agauguugucucuuacguuuga

SEQ ID NO: 292602 - RNA, 22 nt, Human
agauugaugugaccauuggaag

SEQ ID NO: 292603 - RNA, 22 nt, Human
agcaacauggaguuugugcgca

SEQ ID NO: 292604 - RNA, 22 nt, Human
agcaaaauuccaaaaugcuaau

SEQ ID NO: 292605 - RNA, 22 nt, Human
agauggcugggagcucuguuug

SEQ ID NO: 292606 - RNA, 22 nt, Human
agauggcuccaguguccagagg

SEQ ID NO: 292607 - RNA, 22 nt, Human
agaugguucagaauuauaaaga

SEQ ID NO: 292608 - RNA, 22 nt, Human
agauggggccugaggacacugu

SEQ ID NO: 292609 - RNA, 22 nt, Human
agauuuucuuuuccaucuuugu

SEQ ID NO: 292610 - RNA, 22 nt, Human
agauuuggaauggggguucaua

SEQ ID NO: 292611 - RNA, 22 nt, Human
agauuuuacggaguauuagggu

SEQ ID NO: 292612 - RNA, 21 nt, Human
agaugcaguuugcaggugggu

SEQ ID NO: 292613 - RNA, 22 nt, Human
agauggaggaaagcaguuagaa

SEQ ID NO: 292614 - RNA, 20 nt, Human
agaugcccaacucuguuuug

SEQ ID NO: 292615 - RNA, 22 nt, Human
agauuauuuaagacaggaacca

SEQ ID NO: 292616 - RNA, 22 nt, Human
agauugaacgagcuggcaugga

SEQ ID NO: 292617 - RNA, 22 nt, Human
agauuaagcauuauaauuauaa

SEQ ID NO: 292618 - RNA, 22 nt, Human
agaugaguaaauggagucuucc

SEQ ID NO: 292619 - RNA, 22 nt, Human
agauccuagaugugaauagcua

SEQ ID NO: 292620 - RNA, 22 nt, Human
agaugaacuuuuuuaaacugga

SEQ ID NO: 292621 - RNA, 22 nt, Human
agaugucauguguugcuccaag

SEQ ID NO: 292622 - RNA, 21 nt, Human
agaugaggauacugaggccua

SEQ ID NO: 292623 - RNA, 22 nt, Human
agaugaugugugucuucagcua

SEQ ID NO: 292624 - RNA, 22 nt, Human
agauggaguccugaagccagaa

SEQ ID NO: 292625 - RNA, 19 nt, Human
agaucaggauguauuuuug

SEQ ID NO: 292626 - RNA, 23 nt, Human
agaugaugaauaaagagugagga

SEQ ID NO: 292627 - RNA, 22 nt, Human
agauaggccauuaagaaggaua

SEQ ID NO: 292628 - RNA, 22 nt, Human
agauagccagauauaaauaguc

SEQ ID NO: 292629 - RNA, 22 nt, Human
agcgcaguuaccgcgcggggcu

SEQ ID NO: 292630 - RNA, 22 nt, Human
agcgccgcugugauuggugagg

SEQ ID NO: 292631 - RNA, 22 nt, Human
agcgcgcggggcugcggcaggg

SEQ ID NO: 292632 - RNA, 19 nt, Human
agcgccucuacugcaugga

SEQ ID NO: 292633 - RNA, 22 nt, Human
agcgcucauuuuccuccugcuc

SEQ ID NO: 292634 - RNA, 21 nt, Human
agcgcugcauccaccauggcu

SEQ ID NO: 292635 - RNA, 22 nt, Human
agccugaaccaauauagcagcc

SEQ ID NO: 292636 - RNA, 22 nt, Human
agccuggagcaggcucugcucu

SEQ ID NO: 292637 - RNA, 22 nt, Human
agccugagucugcacauagaac

SEQ ID NO: 292638 - RNA, 22 nt, Human
agccucuagcuccccaaagcca

SEQ ID NO: 292639 - RNA, 22 nt, Human
agccuauucaucugaucuugaa

SEQ ID NO: 292640 - RNA, 22 nt, Human
agccugggucgagagacgagaa

SEQ ID NO: 292641 - RNA, 22 nt, Human
agccuguacuuagagggauuaa

SEQ ID NO: 292642 - RNA, 22 nt, Human
agccugugacucugugaaacca

SEQ ID NO: 292643 - RNA, 22 nt, Human
agccuaauuuguaggucugugu

SEQ ID NO: 292644 - RNA, 22 nt, Human
agccgcugaauuugaaacaagc

SEQ ID NO: 292645 - RNA, 22 nt, Human
agccucucugaugugacagcua

SEQ ID NO: 292646 - RNA, 22 nt, Human
agccgcgcagccucauuaagga

SEQ ID NO: 292647 - RNA, 22 nt, Human
agcccuuucuuguuuaacugca

SEQ ID NO: 292648 - RNA, 22 nt, Human
agccuacauuugacuauagucu

SEQ ID NO: 292649 - RNA, 22 nt, Human
agccccaauuacagcugugcug

SEQ ID NO: 292650 - RNA, 22 nt, Human
agccgauaaauuguuuucuugg

SEQ ID NO: 292651 - RNA, 22 nt, Human
agcccuucccuuucacuggugc

SEQ ID NO: 292652 - RNA, 21 nt, Human
agccagguuuccuuugaagag

SEQ ID NO: 292653 - RNA, 22 nt, Human
agccagugcagcuggaaauuca

SEQ ID NO: 292654 - RNA, 22 nt, Human
agccacggcaaugauaggcugc

SEQ ID NO: 292655 - RNA, 22 nt, Human
agccaucuggugucaaugauuc

SEQ ID NO: 292656 - RNA, 22 nt, Human
agccagauuuuuugagaggcga

SEQ ID NO: 292657 - RNA, 22 nt, Human
agccaagucucacugagucugu

SEQ ID NO: 292658 - RNA, 22 nt, Human
agccacagucuguagccagcuu

SEQ ID NO: 292659 - RNA, 22 nt, Human
agccacacuuagucacaaagau

SEQ ID NO: 292660 - RNA, 22 nt, Human
agcauauaugcaugagugugca

SEQ ID NO: 292661 - RNA, 23 nt, Human
agcccagcagagaaccuaggucc

SEQ ID NO: 292662 - RNA, 22 nt, Human
agcccgggagggcugucuggga

SEQ ID NO: 292663 - RNA, 22 nt, Human
agcccugaccuguccuguucug

SEQ ID NO: 292664 - RNA, 22 nt, Human
agcaggggcaggguuuugugcu

SEQ ID NO: 292665 - RNA, 22 nt, Human
agccagugucgugugacaugag

SEQ ID NO: 292666 - RNA, 22 nt, Human
agccauggagaacagacuugaa

SEQ ID NO: 292667 - RNA, 22 nt, Human
agccauggagauguggguuggg

SEQ ID NO: 292668 - RNA, 22 nt, Human
agcauaacaaagggcauaauug

SEQ ID NO: 292669 - RNA, 19 nt, Human
agcaccuaucuggauaagg

SEQ ID NO: 292670 - RNA, 20 nt, Human
agcacaggcagucauucagu

SEQ ID NO: 292671 - RNA, 22 nt, Human
agauuucaauggauauugcaag

SEQ ID NO: 292672 - RNA, 22 nt, Human
agauuuguauagaugugguuga

SEQ ID NO: 292673 - RNA, 22 nt, Human
agcacgcccaccuccugcggcg

SEQ ID NO: 292674 - RNA, 22 nt, Human
agcaaaacuaaagacacagaca

SEQ ID NO: 292675 - RNA, 22 nt, Human
agcaaggagcugaaaccgggcu

SEQ ID NO: 292676 - RNA, 22 nt, Human
agcaaggguugguuuucugaca

SEQ ID NO: 292677 - RNA, 22 nt, Human
agcaauguuggccuauauaccu

SEQ ID NO: 292678 - RNA, 22 nt, Human
agcaaaguacugagcucaaagg

SEQ ID NO: 292679 - RNA, 22 nt, Human
agcaaauaauugucuuugaggg

SEQ ID NO: 292680 - RNA, 22 nt, Human
agcacggugguuaagagagugg

SEQ ID NO: 292681 - RNA, 22 nt, Human
agcacguucuucauuacuucac

SEQ ID NO: 292682 - RNA, 22 nt, Human
agcagauaaagguugcauuucu

SEQ ID NO: 292683 - RNA, 22 nt, Human
agcaaagccucuuugaaaaaaa

SEQ ID NO: 292684 - RNA, 22 nt, Human
agcagagggucaguuuuuuagu

SEQ ID NO: 292685 - RNA, 22 nt, Human
agcacuuuagaauuuagaguug

SEQ ID NO: 292686 - RNA, 22 nt, Human
agcagauuguacagugcauuag

SEQ ID NO: 292687 - RNA, 22 nt, Human
agcaauucagagcauggacuuu

SEQ ID NO: 292688 - RNA, 22 nt, Human
agcaauucugaaauuacuugac

SEQ ID NO: 292689 - RNA, 22 nt, Human
agcacagugccugacauauaug

SEQ ID NO: 292690 - RNA, 22 nt, Human
agcagcaaugacaauucaacca

SEQ ID NO: 292691 - RNA, 22 nt, Human
agcagagaacauucauucaugu

SEQ ID NO: 292692 - RNA, 22 nt, Human
agcacuugggugauaguacuuu

SEQ ID NO: 292693 - RNA, 22 nt, Human
agcaggauggaguaacgugaaa

SEQ ID NO: 292694 - RNA, 22 nt, Human
agcaggaaggcuagaagcagga

SEQ ID NO: 292695 - RNA, 22 nt, Human
agcagcugagccccagcuguga

SEQ ID NO: 292696 - RNA, 22 nt, Human
agcaguuuauccucauaaugga

SEQ ID NO: 292697 - RNA, 22 nt, Human
agcagccgccgccgccgcgcac

SEQ ID NO: 292698 - RNA, 22 nt, Human
agcagcaccuguccucgcugcu

SEQ ID NO: 292699 - RNA, 19 nt, Human
agcagccaucgaccaugga

SEQ ID NO: 292700 - RNA, 22 nt, Human
gaauuacuccaguguguggguu

SEQ ID NO: 292701 - RNA, 22 nt, Human
gaauuacagaguuguuaaguca

SEQ ID NO: 292702 - RNA, 22 nt, Human
gaaugguuauaugauguuuaaa

SEQ ID NO: 292703 - RNA, 22 nt, Human
gaggcuugccacuguccauggc

SEQ ID NO: 292704 - RNA, 22 nt, Human
gaauggcagaaugaagcagugu

SEQ ID NO: 292705 - RNA, 19 nt, Human
gaauggguucuguagggag

SEQ ID NO: 292706 - RNA, 22 nt, Human
gaggggcaagaaguuggccucu

SEQ ID NO: 292707 - RNA, 22 nt, Human
gaggggcgaggacgcugaagua

SEQ ID NO: 292708 - RNA, 22 nt, Human
gaauuagacggcaucacauggg

SEQ ID NO: 292709 - RNA, 22 nt, Human
gaauuagguaauagaacuagua

SEQ ID NO: 292710 - RNA, 19 nt, Human
gaauugcacgagcagaggc

SEQ ID NO: 292711 - RNA, 22 nt, Human
gaggauggaaaaaccccaaagg

SEQ ID NO: 292712 - RNA, 22 nt, Human
gaggaugacaaagaaggcagac

SEQ ID NO: 292713 - RNA, 22 nt, Human
gaagucaggaaggagauugaag

SEQ ID NO: 292714 - RNA, 22 nt, Human
gaaguucuuagucucauuugca

SEQ ID NO: 292715 - RNA, 22 nt, Human
gaagucugacucuuuguaagcu

SEQ ID NO: 292716 - RNA, 22 nt, Human
gaagugagcauccuaguuaacc

SEQ ID NO: 292717 - RNA, 22 nt, Human
gaauauuuaucucagcugcaga

SEQ ID NO: 292718 - RNA, 22 nt, Human
gaauacaagccugccaccugga

SEQ ID NO: 292719 - RNA, 22 nt, Human
gaggauuugagggucacuccac

SEQ ID NO: 292720 - RNA, 22 nt, Human
gaauacaaauaauaccaaggug

SEQ ID NO: 292721 - RNA, 22 nt, Human
gaauaauuuugaucagaaggga

SEQ ID NO: 292722 - RNA, 22 nt, Human
gaauagauuagaaagaguaugu

SEQ ID NO: 292723 - RNA, 22 nt, Human
gaauaccauuuacauuugaaaa

SEQ ID NO: 292724 - RNA, 22 nt, Human
gaggcggugguggcgagaguca

SEQ ID NO: 292725 - RNA, 22 nt, Human
gaggcugguucccuugaucuuu

SEQ ID NO: 292726 - RNA, 22 nt, Human
gaggcuaugucuacgcucagcg

SEQ ID NO: 292727 - RNA, 22 nt, Human
gaaugccugggguucuucgauc

SEQ ID NO: 292728 - RNA, 22 nt, Human
gaaugcauuuuuuaaaagcaua

SEQ ID NO: 292729 - RNA, 22 nt, Human
gaggcaggaagggaggguugug

SEQ ID NO: 292730 - RNA, 22 nt, Human
gaggccagcacccagaugcaug

SEQ ID NO: 292731 - RNA, 22 nt, Human
gaaucucuuugucccugaguuu

SEQ ID NO: 292732 - RNA, 22 nt, Human
gaggcggcgacgcgggcccggg

SEQ ID NO: 292733 - RNA, 22 nt, Human
gaggaaagcugguuuaaaguau

SEQ ID NO: 292734 - RNA, 22 nt, Human
gaggacuucaggccuggccagg

SEQ ID NO: 292735 - RNA, 22 nt, Human
gaggagagcuggccagguuucu

SEQ ID NO: 292736 - RNA, 22 nt, Human
gaggagaaacagccgugauagu

SEQ ID NO: 292737 - RNA, 22 nt, Human
gaaggaaaagacgugcuaagua

SEQ ID NO: 292738 - RNA, 22 nt, Human
gaaggagaggauugugaggcug

SEQ ID NO: 292739 - RNA, 22 nt, Human
gaaggauaauuuugcuggaugu

SEQ ID NO: 292740 - RNA, 22 nt, Human
gaaggcaguaaauggcuguuuu

SEQ ID NO: 292741 - RNA, 22 nt, Human
gagcuggacauacaggaaacca

SEQ ID NO: 292742 - RNA, 22 nt, Human
gaaggcuguggcuggucucagu

SEQ ID NO: 292743 - RNA, 22 nt, Human
gaagggccaggggcaggcugga

SEQ ID NO: 292744 - RNA, 22 nt, Human
gaggagcaggcaggaucugguc

SEQ ID NO: 292745 - RNA, 22 nt, Human
gaaggggacuccauggaaugau

SEQ ID NO: 292746 - RNA, 22 nt, Human
gaggaggacauuggaaagaacu

SEQ ID NO: 292747 - RNA, 22 nt, Human
gaaguaaugugauugcucaggg

SEQ ID NO: 292748 - RNA, 22 nt, Human
gaggagggagcuggaagcucuu

SEQ ID NO: 292749 - RNA, 22 nt, Human
gaagcgucaugaaagaaaggcu

SEQ ID NO: 292750 - RNA, 22 nt, Human
gaagccaugauaaccagugugg

SEQ ID NO: 292751 - RNA, 22 nt, Human
gagcggcucaguggccauguga

SEQ ID NO: 292752 - RNA, 22 nt, Human
gagcgcgcaaucucuccagcug

SEQ ID NO: 292753 - RNA, 22 nt, Human
gagcgcacagaaggaagcagcc

SEQ ID NO: 292754 - RNA, 22 nt, Human
gaagcucaguugcuuagaucuc

SEQ ID NO: 292755 - RNA, 22 nt, Human
gaagcgugcagguccguauacu

SEQ ID NO: 292756 - RNA, 22 nt, Human
gagcuaauagacagcaacauca

SEQ ID NO: 292757 - RNA, 22 nt, Human
gagcucucgggcuggggcguug

SEQ ID NO: 292758 - RNA, 22 nt, Human
gaaaaucaugaaaguguguugu

SEQ ID NO: 292759 - RNA, 22 nt, Human
gaaaaguauuaugugaggguuc

SEQ ID NO: 292760 - RNA, 22 nt, Human
gaaaauaguucaucacaaugau

SEQ ID NO: 292761 - RNA, 22 nt, Human
gagccuggagcuggaacgaagc

SEQ ID NO: 292762 - RNA, 22 nt, Human
gagccuaccugcugcucuuuca

SEQ ID NO: 292763 - RNA, 22 nt, Human
gagccggggcucccugaggucc

SEQ ID NO: 292764 - RNA, 22 nt, Human
gagccgcagcugcguagggucc

SEQ ID NO: 292765 - RNA, 22 nt, Human
gaagauuauuacucauugcagg

SEQ ID NO: 292766 - RNA, 22 nt, Human
gaagcaccuggacggugccugg

SEQ ID NO: 292767 - RNA, 22 nt, Human
gagaagugggggucugggauga

SEQ ID NO: 292768 - RNA, 22 nt, Human
gagaaugagucagagcuggcug

SEQ ID NO: 292769 - RNA, 22 nt, Human
gaucccccaucuacuaucccca

SEQ ID NO: 292770 - RNA, 22 nt, Human
gaucauauccagucaccacuau

SEQ ID NO: 292771 - RNA, 22 nt, Human
gauccagauauuugggcuggua

SEQ ID NO: 292772 - RNA, 22 nt, Human
gaucccaguccuacccucauaa

SEQ ID NO: 292773 - RNA, 19 nt, Human
gauauugagcugagaauuc

SEQ ID NO: 292774 - RNA, 22 nt, Human
gagaacaaggaagagucggcag

SEQ ID NO: 292775 - RNA, 22 nt, Human
gagaaauagauucaugguagau

SEQ ID NO: 292776 - RNA, 22 nt, Human
gagaaaaauuucuuugcugcac

SEQ ID NO: 292777 - RNA, 22 nt, Human
gauauuaguuuuggaaggaggg

SEQ ID NO: 292778 - RNA, 22 nt, Human
gagaaaacauacuuaguguccu

SEQ ID NO: 292779 - RNA, 22 nt, Human
gauauauuucaaauucuuuugc

SEQ ID NO: 292780 - RNA, 22 nt, Human
gauagaaagagaaucagaacuu

SEQ ID NO: 292781 - RNA, 22 nt, Human
gacuguuggcagauguuugagu

SEQ ID NO: 292782 - RNA, 22 nt, Human
gauaaauaguguuuggggacau

SEQ ID NO: 292783 - RNA, 22 nt, Human
gauacaugucacaaguugugca

SEQ ID NO: 292784 - RNA, 22 nt, Human
gauaagugauucugauucacau

SEQ ID NO: 292785 - RNA, 22 nt, Human
gauaaugcuuuggucagacaug

SEQ ID NO: 292786 - RNA, 22 nt, Human
gacuugcucaaaucagauuuua

SEQ ID NO: 292787 - RNA, 22 nt, Human
gauacugugggcacucauaaua

SEQ ID NO: 292788 - RNA, 22 nt, Human
gacuuaaccacggucacauggu

SEQ ID NO: 292789 - RNA, 22 nt, Human
gacuggaaucucugcuuguuaa

SEQ ID NO: 292790 - RNA, 18 nt, Human
gacugccuugaacuauug

SEQ ID NO: 292791 - RNA, 22 nt, Human
gacuggcucuaucaggauaaau

SEQ ID NO: 292792 - RNA, 22 nt, Human
gaguuggggcugcguguuucca

SEQ ID NO: 292793 - RNA, 22 nt, Human
gaguucaaagaucuaggaagag

SEQ ID NO: 292794 - RNA, 22 nt, Human
gacuccugccucucuacuucug

SEQ ID NO: 292795 - RNA, 22 nt, Human
gacuaaauaaaagccaaacuuc

SEQ ID NO: 292796 - RNA, 21 nt, Human
gacuacaauauguaaucuaau

SEQ ID NO: 292797 - RNA, 22 nt, Human
gaguuaaauagcuuaggauuca

SEQ ID NO: 292798 - RNA, 22 nt, Human
gaguguuugcuguauaauugga

SEQ ID NO: 292799 - RNA, 20 nt, Human
gagugucacacacaaccccu

SEQ ID NO: 292800 - RNA, 20 nt, Human
gacgaacuagaacaguggua

SEQ ID NO: 292801 - RNA, 22 nt, Human
gacggaggacaucagcaguguc

SEQ ID NO: 292802 - RNA, 22 nt, Human
gaguggccugccccagccaggc

SEQ ID NO: 292803 - RNA, 22 nt, Human
gagucuuuuaagaugucuuacu

SEQ ID NO: 292804 - RNA, 22 nt, Human
gaccuuucccuaucucacucuc

SEQ ID NO: 292805 - RNA, 22 nt, Human
gaguauuuaccacuaaaugguu

SEQ ID NO: 292806 - RNA, 22 nt, Human
gaccugaccucauuagcaaguu

SEQ ID NO: 292807 - RNA, 22 nt, Human
gaccaggagauuugagcuaggc

SEQ ID NO: 292808 - RNA, 22 nt, Human
gaccacugaaugcacuucuaau

SEQ ID NO: 292809 - RNA, 22 nt, Human
gaguaaaagaugaggcaguaga

SEQ ID NO: 292810 - RNA, 22 nt, Human
gaguacagaagauaaaggcaca

SEQ ID NO: 292811 - RNA, 22 nt, Human
gagguuggggugucucucccca

SEQ ID NO: 292812 - RNA, 22 nt, Human
gacauuuauuggauuuuacgag

SEQ ID NO: 292813 - RNA, 22 nt, Human
gacauugaauugaauccagauu

SEQ ID NO: 292814 - RNA, 22 nt, Human
gaccgggcucugcugacggucu

SEQ ID NO: 292815 - RNA, 22 nt, Human
gaguauuacuaaaauucgccua

SEQ ID NO: 292816 - RNA, 22 nt, Human
gaguaucagauuggaguccuca

SEQ ID NO: 292817 - RNA, 22 nt, Human
gaguagcaguucauccacaagc

SEQ ID NO: 292818 - RNA, 22 nt, Human
gaguaaggaaguguuggccaca

SEQ ID NO: 292819 - RNA, 22 nt, Human
gacagcaggaugugaggggaug

SEQ ID NO: 292820 - RNA, 22 nt, Human
gacagggacacagccagugagg

SEQ ID NO: 292821 - RNA, 22 nt, Human
gacaggcagagaggaagagaga

SEQ ID NO: 292822 - RNA, 22 nt, Human
gagguuuaguccauaguauuua

SEQ ID NO: 292823 - RNA, 22 nt, Human
gacaguggagccacguugggag

SEQ ID NO: 292824 - RNA, 20 nt, Human
gagguugcucagaguggggu

SEQ ID NO: 292825 - RNA, 22 nt, Human
gagggugugguauggauguguu

SEQ ID NO: 292826 - RNA, 22 nt, Human
gacacucauauuaagccuauuu

SEQ ID NO: 292827 - RNA, 22 nt, Human
gaggucagugugggggcaaggg

SEQ ID NO: 292828 - RNA, 22 nt, Human
gacacaacuauccaguauggga

SEQ ID NO: 292829 - RNA, 22 nt, Human
gacaaguagguuauuuuuagca

SEQ ID NO: 292830 - RNA, 22 nt, Human
gaggguaaauucagaguaggag

SEQ ID NO: 292831 - RNA, 22 nt, Human
gaggguaagcugggacuccucg

SEQ ID NO: 292832 - RNA, 22 nt, Human
cuugcagccuggagcucagccu

SEQ ID NO: 292833 - RNA, 22 nt, Human
cuugagcugaguuugcagcucu

SEQ ID NO: 292834 - RNA, 22 nt, Human
cuucuuuucuacuggccuagaa

SEQ ID NO: 292835 - RNA, 22 nt, Human
gaagguuuuguuugcaaaucau

SEQ ID NO: 292836 - RNA, 22 nt, Human
gaaggggccuggggcaaggcua

SEQ ID NO: 292837 - RNA, 21 nt, Human
gaaguagcucugagaaaagug

SEQ ID NO: 292838 - RNA, 22 nt, Human
gaagucagaucuuuugacuccc

SEQ ID NO: 292839 - RNA, 22 nt, Human
gaaguauuucugaguugcccag

SEQ ID NO: 292840 - RNA, 22 nt, Human
gaagaugcugcuuguucacggg

SEQ ID NO: 292841 - RNA, 22 nt, Human
gaagauucugacccugacucag

SEQ ID NO: 292842 - RNA, 18 nt, Human
gaagcaacaguucugagu

SEQ ID NO: 292843 - RNA, 22 nt, Human
gaaggcugaauuauuuguuccu

SEQ ID NO: 292844 - RNA, 22 nt, Human
cuuccuuucagaggaaggccug

SEQ ID NO: 292845 - RNA, 22 nt, Human
gaaggugcugaaacagaaauuu

SEQ ID NO: 292846 - RNA, 20 nt, Human
gacaagccacagcucccaga

SEQ ID NO: 292847 - RNA, 22 nt, Human
gacaauuucucaauauagaaac

SEQ ID NO: 292848 - RNA, 22 nt, Human
cuuuauguuggggugucuuagu

SEQ ID NO: 292849 - RNA, 23 nt, Human
cuugugacagcaauuauagcaag

SEQ ID NO: 292850 - RNA, 22 nt, Human
cuugucuaguuccuggugaugu

SEQ ID NO: 292851 - RNA, 22 nt, Human
cuuggggucuuacuuguacccu

SEQ ID NO: 292852 - RNA, 22 nt, Human
gacaagaugacaucauggcuuc

SEQ ID NO: 292853 - RNA, 22 nt, Human
gaauguuugagugccaugugac

SEQ ID NO: 292854 - RNA, 22 nt, Human
cuuggggcuugcuguuguagcc

SEQ ID NO: 292855 - RNA, 22 nt, Human
cuugggacucccuguagcagug

SEQ ID NO: 292856 - RNA, 22 nt, Human
cuuggcuccuucacagggagau

SEQ ID NO: 292857 - RNA, 22 nt, Human
cuugauucauuuaagguuggag

SEQ ID NO: 292858 - RNA, 22 nt, Human
gaauggaugcuggucaguuugg

SEQ ID NO: 292859 - RNA, 22 nt, Human
gaaugguuagugaacaaauuug

SEQ ID NO: 292860 - RNA, 22 nt, Human
gagacagugucagccauugaaa

SEQ ID NO: 292861 - RNA, 22 nt, Human
gaaaaauggguuguuugaagau

SEQ ID NO: 292862 - RNA, 22 nt, Human
gagacugcguggcucugacaca

SEQ ID NO: 292863 - RNA, 22 nt, Human
gagagaaggaagugaauuuccc

SEQ ID NO: 292864 - RNA, 22 nt, Human
gagagagacugggaaaucauca

SEQ ID NO: 292865 - RNA, 22 nt, Human
gagaacagauaugaugacuuca

SEQ ID NO: 292866 - RNA, 22 nt, Human
gagaaagauuguccuucagggg

SEQ ID NO: 292867 - RNA, 22 nt, Human
gagaaagggagaaaaagaucuu

SEQ ID NO: 292868 - RNA, 22 nt, Human
cuuuugcaauagugacacugau

SEQ ID NO: 292869 - RNA, 22 nt, Human
cuuuuuaaaguaaauggcuaga

SEQ ID NO: 292870 - RNA, 22 nt, Human
gacugacagugguacuguaauu

SEQ ID NO: 292871 - RNA, 22 nt, Human
cuuuuugccuugaagugaccuc

SEQ ID NO: 292872 - RNA, 22 nt, Human
gacuugauugguuugucaaguu

SEQ ID NO: 292873 - RNA, 22 nt, Human
gacccugaggauucccugcuga

SEQ ID NO: 292874 - RNA, 22 nt, Human
cuuuucuuuucuucucuuccca

SEQ ID NO: 292875 - RNA, 22 nt, Human
gaccucauggaguaagugagug

SEQ ID NO: 292876 - RNA, 22 nt, Human
gacagugucccucuggggugga

SEQ ID NO: 292877 - RNA, 22 nt, Human
gaccugcucagcccuguguguu

SEQ ID NO: 292878 - RNA, 22 nt, Human
cuuuggggcugaggaggagguu

SEQ ID NO: 292879 - RNA, 21 nt, Human
cuuuggcaagggagaagucac

SEQ ID NO: 292880 - RNA, 22 nt, Human
cuuugauuucucugguccaauc

SEQ ID NO: 292881 - RNA, 22 nt, Human
cuuugcaaagagagaaaguggg

SEQ ID NO: 292882 - RNA, 22 nt, Human
cuuuggauuuuuugcuuuugua

SEQ ID NO: 292883 - RNA, 22 nt, Human
gacaggaccgagguggggcggg

SEQ ID NO: 292884 - RNA, 22 nt, Human
gacagguagacaugaauauuaa

SEQ ID NO: 292885 - RNA, 22 nt, Human
gacagcguguuuugcaugaaca

SEQ ID NO: 292886 - RNA, 22 nt, Human
cuuucauuuuugggcaucugag

SEQ ID NO: 292887 - RNA, 22 nt, Human
cuuucugauguaaggaacuagg

SEQ ID NO: 292888 - RNA, 22 nt, Human
cuuucuccagagugaagauccu

SEQ ID NO: 292889 - RNA, 22 nt, Human
cuuuccugaaaucucuucugca

SEQ ID NO: 292890 - RNA, 22 nt, Human
cuggagaucaguuggacaacag

SEQ ID NO: 292891 - RNA, 22 nt, Human
cuggagcuucaggguucucggg

SEQ ID NO: 292892 - RNA, 22 nt, Human
cuggaucgccccgaugugcccc

SEQ ID NO: 292893 - RNA, 22 nt, Human
cuggauagaccccuuauugcau

SEQ ID NO: 292894 - RNA, 20 nt, Human
cuggaguguagcaguggcug

SEQ ID NO: 292895 - RNA, 23 nt, Human
cuucagaccucagaaggucuguu

SEQ ID NO: 292896 - RNA, 22 nt, Human
cugauccuauauugguaugagg

SEQ ID NO: 292897 - RNA, 22 nt, Human
cugaucuuaaguaacauuauuu

SEQ ID NO: 292898 - RNA, 22 nt, Human
cuucacugcagucauggcucug

SEQ ID NO: 292899 - RNA, 20 nt, Human
cuuaugcaaaauguuaggga

SEQ ID NO: 292900 - RNA, 22 nt, Human
cugggaaggaagggaaaaacag

SEQ ID NO: 292901 - RNA, 22 nt, Human
cuggcuuucauggcgcaguuga

SEQ ID NO: 292902 - RNA, 22 nt, Human
cuggcggcccgaggcagaggag

SEQ ID NO: 292903 - RNA, 22 nt, Human
cuggcgauugcgagagucgccu

SEQ ID NO: 292904 - RNA, 22 nt, Human
cuggcggugaucccgauggugu

SEQ ID NO: 292905 - RNA, 22 nt, Human
cuuuuccuccaggaagccaagc

SEQ ID NO: 292906 - RNA, 22 nt, Human
cuuuucaaacaggacagguccu

SEQ ID NO: 292907 - RNA, 22 nt, Human
cuuuuaaucuaauuuuuauauu

SEQ ID NO: 292908 - RNA, 19 nt, Human
cuuuuagagggagaggacu

SEQ ID NO: 292909 - RNA, 22 nt, Human
cugggguuggccagggcccuag

SEQ ID NO: 292910 - RNA, 22 nt, Human
cugggguggugcaggccucaug

SEQ ID NO: 292911 - RNA, 22 nt, Human
cuuuuuuucuccauauuucugg

SEQ ID NO: 292912 - RNA, 22 nt, Human
cuggguaaggaaacuccuuugu

SEQ ID NO: 292913 - RNA, 22 nt, Human
cugggugagcuggccagagggu

SEQ ID NO: 292914 - RNA, 22 nt, Human
gaaaaagucuuaaaguaaggca

SEQ ID NO: 292915 - RNA, 22 nt, Human
gaaaaagagaaggaguucagua

SEQ ID NO: 292916 - RNA, 22 nt, Human
gaaaaaccacaauugguauuuu

SEQ ID NO: 292917 - RNA, 22 nt, Human
cuuuuugcccuugggcuuccug

SEQ ID NO: 292918 - RNA, 22 nt, Human
cuuuuucuugugguuaauaucu

SEQ ID NO: 292919 - RNA, 22 nt, Human
cuuuuggcaucagccucaggaa

SEQ ID NO: 292920 - RNA, 22 nt, Human
cuuuuucaugggugaugagugg

SEQ ID NO: 292921 - RNA, 22 nt, Human
cugggacccagcccaagucuuu

SEQ ID NO: 292922 - RNA, 22 nt, Human
cugggaugagcuguuuccuggu

SEQ ID NO: 292923 - RNA, 22 nt, Human
gaaaugggggcaugcguuacau

SEQ ID NO: 292924 - RNA, 22 nt, Human
gaaagagaugucguuugucuuc

SEQ ID NO: 292925 - RNA, 22 nt, Human
gaacaaaagauagcccaaacau

SEQ ID NO: 292926 - RNA, 22 nt, Human
gaacaguuucccuguagaaaau

SEQ ID NO: 292927 - RNA, 22 nt, Human
gaaaccauggcaaccagguccu

SEQ ID NO: 292928 - RNA, 22 nt, Human
gaaacauuuguugaguacuugc

SEQ ID NO: 292929 - RNA, 22 nt, Human
gaaaaugcacacauacacaccc

SEQ ID NO: 292930 - RNA, 22 nt, Human
cugucucugucucuguuuaucc

SEQ ID NO: 292931 - RNA, 22 nt, Human
gaaacguuguggaaaauccucu

SEQ ID NO: 292932 - RNA, 22 nt, Human
gaacugaauguguaauguuggc

SEQ ID NO: 292933 - RNA, 22 nt, Human
gaaccauuuaauggagaugcuc

SEQ ID NO: 292934 - RNA, 22 nt, Human
gaacaugaguuuuaugguauuu

SEQ ID NO: 292935 - RNA, 22 nt, Human
cuguguuguuugaguagcuuga

SEQ ID NO: 292936 - RNA, 22 nt, Human
gaagaaggaagaucaugcuuga

SEQ ID NO: 292937 - RNA, 22 nt, Human
gaagaagagauaauggggagca

SEQ ID NO: 292938 - RNA, 22 nt, Human
gaaaagcucuuuagaagagguu

SEQ ID NO: 292939 - RNA, 22 nt, Human
cuggugcuguagccugauugag

SEQ ID NO: 292940 - RNA, 22 nt, Human
cugguuacuucagaucaguagu

SEQ ID NO: 292941 - RNA, 22 nt, Human
cuggucaauaaucauguaguac

SEQ ID NO: 292942 - RNA, 22 nt, Human
cugguacuggaggaguucagag

SEQ ID NO: 292943 - RNA, 22 nt, Human
cugucagcaaaucagugucugg

SEQ ID NO: 292944 - RNA, 22 nt, Human
cugucacuguuuuaaccaacaa

SEQ ID NO: 292945 - RNA, 22 nt, Human
cugucucugauaagcucgaggg

SEQ ID NO: 292946 - RNA, 22 nt, Human
cuguccuguggccugcuccggu

SEQ ID NO: 292947 - RNA, 21 nt, Human
gaaaaucuaaugugacaaugc

SEQ ID NO: 292948 - RNA, 22 nt, Human
gaaaaucaggauggaugugagg

SEQ ID NO: 292949 - RNA, 22 nt, Human
cuacuuucuucuucagaauugu

SEQ ID NO: 292950 - RNA, 22 nt, Human
cuacugaugccccgcugugccu

SEQ ID NO: 292951 - RNA, 22 nt, Human
cugccugugcgccaagugcacg

SEQ ID NO: 292952 - RNA, 22 nt, Human
cuagagaaaaagcuuagguacg

SEQ ID NO: 292953 - RNA, 22 nt, Human
cugcgcagaucugcuguucucu

SEQ ID NO: 292954 - RNA, 22 nt, Human
cuacauuuacacaguuaggcuu

SEQ ID NO: 292955 - RNA, 18 nt, Human
cuacauucauaggaaagg

SEQ ID NO: 292956 - RNA, 22 nt, Human
cuacaaggucuuuaucugcuuu

SEQ ID NO: 292957 - RNA, 22 nt, Human
cugccaggagaggccagggccc

SEQ ID NO: 292958 - RNA, 22 nt, Human
cuacugacugaccauaguuuca

SEQ ID NO: 292959 - RNA, 22 nt, Human
cugccacuaccaugcuggauga

SEQ ID NO: 292960 - RNA, 22 nt, Human
cuaauugcuggcugcuggcaga

SEQ ID NO: 292961 - RNA, 22 nt, Human
cuaagguuggcaguggaauugg

SEQ ID NO: 292962 - RNA, 22 nt, Human
cuaagaaggaggaaaagugcca

SEQ ID NO: 292963 - RNA, 22 nt, Human
cugcgguucuguuuaguggcga

SEQ ID NO: 292964 - RNA, 22 nt, Human
cugcguugaccagacuccuggg

SEQ ID NO: 292965 - RNA, 22 nt, Human
cuaggaugcuguaauggugucu

SEQ ID NO: 292966 - RNA, 22 nt, Human
cuaguauuaagugugaguaaaa

SEQ ID NO: 292967 - RNA, 22 nt, Human
cuaggucagaggacacagcuua

SEQ ID NO: 292968 - RNA, 20 nt, Human
cugcuccauggcaucuuuag

SEQ ID NO: 292969 - RNA, 22 nt, Human
cugcugccagcuuaauacucac

SEQ ID NO: 292970 - RNA, 22 nt, Human
cugcuguuuuccccaccaucuc

SEQ ID NO: 292971 - RNA, 22 nt, Human
cugcuguuuucugggcuucuua

SEQ ID NO: 292972 - RNA, 22 nt, Human
cuaugaaucaauuucugcaguu

SEQ ID NO: 292973 - RNA, 22 nt, Human
cuauauucuggaauguccauuu

SEQ ID NO: 292974 - RNA, 22 nt, Human
cuaugguaguggcacaggagga

SEQ ID NO: 292975 - RNA, 22 nt, Human
cugcugcuugauugcaggaagu

SEQ ID NO: 292976 - RNA, 21 nt, Human
cuauaaaaaugguucuuugcg

SEQ ID NO: 292977 - RNA, 22 nt, Human
cguggcaguagagcuggaacuu

SEQ ID NO: 292978 - RNA, 22 nt, Human
cguggccacaguggagcugagc

SEQ ID NO: 292979 - RNA, 22 nt, Human
cugaugucaaauuuaucaaagc

SEQ ID NO: 292980 - RNA, 22 nt, Human
cgugaagaaguaauagguggug

SEQ ID NO: 292981 - RNA, 17 nt, Human
cgugaggaccaggcagc

SEQ ID NO: 292982 - RNA, 22 nt, Human
cugauggagagugugauuuggg

SEQ ID NO: 292983 - RNA, 22 nt, Human
cugaugcucuggauguagucaa

SEQ ID NO: 292984 - RNA, 22 nt, Human
cugaucccuuuucauuugcagg

SEQ ID NO: 292985 - RNA, 22 nt, Human
cugauaauaaccauuuuaaaau

SEQ ID NO: 292986 - RNA, 22 nt, Human
cugaggcuaauagaauuuucug

SEQ ID NO: 292987 - RNA, 22 nt, Human
cugagcuuuucucugcuucuua

SEQ ID NO: 292988 - RNA, 22 nt, Human
cugaguuuuucaaaucugaauu

SEQ ID NO: 292989 - RNA, 22 nt, Human
cgucauacagaugaacaaucuc

SEQ ID NO: 292990 - RNA, 22 nt, Human
cugagcugcucccgcugcagcg

SEQ ID NO: 292991 - RNA, 22 nt, Human
cugagcaucaaaugggcaauua

SEQ ID NO: 292992 - RNA, 22 nt, Human
cucugcuuagacaggcuuuaag

SEQ ID NO: 292993 - RNA, 22 nt, Human
cggugcuuuccauaucagcagc

SEQ ID NO: 292994 - RNA, 19 nt, Human
cugagcagggaaaaacccu

SEQ ID NO: 292995 - RNA, 22 nt, Human
cgucagccacagcugccccggg

SEQ ID NO: 292996 - RNA, 19 nt, Human
cggugcugauuggugcagu

SEQ ID NO: 292997 - RNA, 22 nt, Human
cgguuuuuaaaagucucuucua

SEQ ID NO: 292998 - RNA, 22 nt, Human
cugcagauguagcugcuuuccu

SEQ ID NO: 292999 - RNA, 20 nt, Human
cuaaaacaggugucuaguga

SEQ ID NO: 293000 - RNA, 22 nt, Human
cuaaacacuauucuggaaauag

SEQ ID NO: 293001 - RNA, 22 nt, Human
cuaaaccaauauauuuucuucc

SEQ ID NO: 293002 - RNA, 22 nt, Human
cuaaauguuuuaucuuccuggc

SEQ ID NO: 293003 - RNA, 17 nt, Human
cguuccagaacaaauga

SEQ ID NO: 293004 - RNA, 20 nt, Human
cguugccagcccggcccggg

SEQ ID NO: 293005 - RNA, 22 nt, Human
cguugguggguguguggucgga

SEQ ID NO: 293006 - RNA, 22 nt, Human
cugaugugcauguggggggaug

SEQ ID NO: 293007 - RNA, 22 nt, Human
cgugucauggcggcgcaggugg

SEQ ID NO: 293008 - RNA, 22 nt, Human
cgugugcguauguguuuguaug

SEQ ID NO: 293009 - RNA, 22 nt, Human
cugcagagaccuaggucagguu

SEQ ID NO: 293010 - RNA, 22 nt, Human
cugcacuggguacauagaaaca

SEQ ID NO: 293011 - RNA, 22 nt, Human
cugauuguagccacugugauga

SEQ ID NO: 293012 - RNA, 20 nt, Human
cugauguucgugcuuccugg

SEQ ID NO: 293013 - RNA, 22 nt, Human
cuguuuggcuuccacugcuucu

SEQ ID NO: 293014 - RNA, 22 nt, Human
cuguuuuugccugugacaaaaa

SEQ ID NO: 293015 - RNA, 22 nt, Human
cugagaucaugggucagguggu

SEQ ID NO: 293016 - RNA, 22 nt, Human
cugagguagaggaaauguagcu

SEQ ID NO: 293017 - RNA, 22 nt, Human
cuuauucuucuggacuuggagu

SEQ ID NO: 293018 - RNA, 22 nt, Human
cuuacauuuguuuaguguuucc

SEQ ID NO: 293019 - RNA, 22 nt, Human
cugagggagacagugcggacua

SEQ ID NO: 293020 - RNA, 22 nt, Human
cuguuucucugccugcacacau

SEQ ID NO: 293021 - RNA, 22 nt, Human
cuguuguucacuuugcugguga

SEQ ID NO: 293022 - RNA, 20 nt, Human
cuguucucuugccacaugag

SEQ ID NO: 293023 - RNA, 22 nt, Human
cuguuguguuauuugcagugca

SEQ ID NO: 293024 - RNA, 22 nt, Human
cugacagaucuggaucugaacu

SEQ ID NO: 293025 - RNA, 22 nt, Human
cugaacuaagcccaaagacacu

SEQ ID NO: 293026 - RNA, 23 nt, Human
cugaaauucagaugcuaaagaua

SEQ ID NO: 293027 - RNA, 20 nt, Human
cugaaaggaaagaaauuuuu

SEQ ID NO: 293028 - RNA, 22 nt, Human
cuguguugggauggugcgcgca

SEQ ID NO: 293029 - RNA, 22 nt, Human
cuguuaauugugaauuuuacau

SEQ ID NO: 293030 - RNA, 22 nt, Human
cuguuaucaggaguuuucacgg

SEQ ID NO: 293031 - RNA, 22 nt, Human
cucuuuuuccuaugaaaucuau

SEQ ID NO: 293032 - RNA, 22 nt, Human
cugugcuguuaagaaauuuagu

SEQ ID NO: 293033 - RNA, 20 nt, Human
cucuuuaugagaccacuguc

SEQ ID NO: 293034 - RNA, 20 nt, Human
cucuuucugcuuuaugccuc

SEQ ID NO: 293035 - RNA, 22 nt, Human
cuggugaagccuucggagaccc

SEQ ID NO: 293036 - RNA, 22 nt, Human
cuggugagaccgacuuccacuu

SEQ ID NO: 293037 - RNA, 20 nt, Human
cuggugccuucugcgauuua

SEQ ID NO: 293038 - RNA, 22 nt, Human
cucuggagggaggcugagcugg

SEQ ID NO: 293039 - RNA, 22 nt, Human
cuggugggucacgugugggugg

SEQ ID NO: 293040 - RNA, 22 nt, Human
cugguuuauuucauaguuuguu

SEQ ID NO: 293041 - RNA, 22 nt, Human
cuguccugauggugccacuggu

SEQ ID NO: 293042 - RNA, 22 nt, Human
cuguccccauugcugucccugg

SEQ ID NO: 293043 - RNA, 22 nt, Human
cuguauggaggaggugcuagcc

SEQ ID NO: 293044 - RNA, 22 nt, Human
cucuguugucaguggaagcagc

SEQ ID NO: 293045 - RNA, 22 nt, Human
cugguuuuccaauguuuugacu

SEQ ID NO: 293046 - RNA, 22 nt, Human
cucccuucaggggaggacuagg

SEQ ID NO: 293047 - RNA, 22 nt, Human
cucccugagaugcaggagagag

SEQ ID NO: 293048 - RNA, 22 nt, Human
cuccgcagcugggguuggcgcu

SEQ ID NO: 293049 - RNA, 22 nt, Human
cuggcuaaugugcugauagcca

SEQ ID NO: 293050 - RNA, 22 nt, Human
cucccucauaugguugcuuauc

SEQ ID NO: 293051 - RNA, 20 nt, Human
cucauugcuuucauuuucuu

SEQ ID NO: 293052 - RNA, 22 nt, Human
cucauugacagagcagcucuac

SEQ ID NO: 293053 - RNA, 22 nt, Human
cugggugggcacccagccuggg

SEQ ID NO: 293054 - RNA, 22 nt, Human
cuggguaaauauguauuccuga

SEQ ID NO: 293055 - RNA, 22 nt, Human
cugggugugugugaacagagau

SEQ ID NO: 293056 - RNA, 22 nt, Human
cuggguuuggcugugcuugaau

SEQ ID NO: 293057 - RNA, 22 nt, Human
cuggucuugguauucgcagaag

SEQ ID NO: 293058 - RNA, 22 nt, Human
cugggguaucuggugucuuggu

SEQ ID NO: 293059 - RNA, 22 nt, Human
cugggcaugggaacuucaaggc

SEQ ID NO: 293060 - RNA, 22 nt, Human
cugggaguugacgaggcuugua

SEQ ID NO: 293061 - RNA, 22 nt, Human
cucaauuguuuggucucugguu

SEQ ID NO: 293062 - RNA, 22 nt, Human
cugcuugaugaggaaaggauug

SEQ ID NO: 293063 - RNA, 22 nt, Human
cucacgguuugcaucaagagug

SEQ ID NO: 293064 - RNA, 22 nt, Human
cucaauuuuuauugcuuuuuug

SEQ ID NO: 293065 - RNA, 22 nt, Human
cucaaauggguuuguagaauau

SEQ ID NO: 293066 - RNA, 22 nt, Human
cuauuuucccauaugguugaca

SEQ ID NO: 293067 - RNA, 22 nt, Human
cucaaaauccauaaaaucaggu

SEQ ID NO: 293068 - RNA, 22 nt, Human
cuauuaauggccaggagucaug

SEQ ID NO: 293069 - RNA, 22 nt, Human
cugcuucacccugccugagaac

SEQ ID NO: 293070 - RNA, 22 nt, Human
cuauugguaucacacugauuuc

SEQ ID NO: 293071 - RNA, 22 nt, Human
cucagcacauuccuaagggaug

SEQ ID NO: 293072 - RNA, 22 nt, Human
cucagaugcacacaggugaggg

SEQ ID NO: 293073 - RNA, 22 nt, Human
cucagcgagggaaagaggccgc

SEQ ID NO: 293074 - RNA, 22 nt, Human
cucagcaacccacacacggucu

SEQ ID NO: 293075 - RNA, 23 nt, Human
cuggacauucgcaaaguucaucu

SEQ ID NO: 293076 - RNA, 22 nt, Human
cuggcagcucugagucccuucu

SEQ ID NO: 293077 - RNA, 22 nt, Human
cugcuugguuuggagggcccac

SEQ ID NO: 293078 - RNA, 22 nt, Human
cucaguauugacgaaagagauu

SEQ ID NO: 293079 - RNA, 22 nt, Human
cucaugaauggcucuuugugcu

SEQ ID NO: 293080 - RNA, 22 nt, Human
cucagugacuuccugcucaauu

SEQ ID NO: 293081 - RNA, 22 nt, Human
cucaucagagcccuccucuggc

SEQ ID NO: 293082 - RNA, 22 nt, Human
cucaaugagcuauuuguuucau

SEQ ID NO: 293083 - RNA, 22 nt, Human
cucaagagaaaucggaaucaga

SEQ ID NO: 293084 - RNA, 22 nt, Human
cucaagacacccuggccucuac

SEQ ID NO: 293085 - RNA, 22 nt, Human
cucaggugagcgagcuaaauua

SEQ ID NO: 293086 - RNA, 22 nt, Human
cgcgggcuugggcaccugcgga

SEQ ID NO: 293087 - RNA, 22 nt, Human
cuaggcuuucugugugacuaga

SEQ ID NO: 293088 - RNA, 22 nt, Human
cuagguggcagcacuccgaggu

SEQ ID NO: 293089 - RNA, 22 nt, Human
cuagguuuuuuccuuuccccac

SEQ ID NO: 293090 - RNA, 22 nt, Human
cuagcagaagcuccuugagggu

SEQ ID NO: 293091 - RNA, 22 nt, Human
cgcaucggguagaggagcugga

SEQ ID NO: 293092 - RNA, 22 nt, Human
cgccgccgccugcccgcgcccc

SEQ ID NO: 293093 - RNA, 22 nt, Human
cgcccccgaucggggccgccgc

SEQ ID NO: 293094 - RNA, 18 nt, Human
cuaguuuguuuucuacau

SEQ ID NO: 293095 - RNA, 22 nt, Human
cuaguucugccauucaguguca

SEQ ID NO: 293096 - RNA, 22 nt, Human
cgccaguggcagcuggaacagg

SEQ ID NO: 293097 - RNA, 22 nt, Human
cuauguuucagauauauauaua

SEQ ID NO: 293098 - RNA, 22 nt, Human
cuccggccuucugacuccccug

SEQ ID NO: 293099 - RNA, 22 nt, Human
cuccacagccccuccaguggca

SEQ ID NO: 293100 - RNA, 22 nt, Human
cucaugagucugucagagucau

SEQ ID NO: 293101 - RNA, 22 nt, Human
cgcuggagagcaagugcgugca

SEQ ID NO: 293102 - RNA, 22 nt, Human
cggagcgagaaggggaaagccc

SEQ ID NO: 293103 - RNA, 22 nt, Human
cggagcauacugccuggagaug

SEQ ID NO: 293104 - RNA, 22 nt, Human
cucucuuuuuuucccuuguuaa

SEQ ID NO: 293105 - RNA, 22 nt, Human
cucucuccuuagcugcagacca

SEQ ID NO: 293106 - RNA, 22 nt, Human
cucucuguuaugcuuucaugaa

SEQ ID NO: 293107 - RNA, 22 nt, Human
cucucugcugucuuucgggaaa

SEQ ID NO: 293108 - RNA, 22 nt, Human
cucugcuagaaggucaaucucu

SEQ ID NO: 293109 - RNA, 22 nt, Human
ccuggccacagggcucugcauu

SEQ ID NO: 293110 - RNA, 22 nt, Human
ccuggcccagcuggaagcggga

SEQ ID NO: 293111 - RNA, 19 nt, Human
ccuggccaacgucaacauu

SEQ ID NO: 293112 - RNA, 22 nt, Human
cgggagcagcucuggggcuggg

SEQ ID NO: 293113 - RNA, 22 nt, Human
cgggcacucagggucgaggugg

SEQ ID NO: 293114 - RNA, 22 nt, Human
cgggcacagguugagguagaug

SEQ ID NO: 293115 - RNA, 22 nt, Human
ccuugguuuagcaauuuuucuu

SEQ ID NO: 293116 - RNA, 22 nt, Human
ccuugggagcgcccuguccggg

SEQ ID NO: 293117 - RNA, 22 nt, Human
ccuugauaugcuucagagaauu

SEQ ID NO: 293118 - RNA, 22 nt, Human
ccuucugcuggucaucccagug

SEQ ID NO: 293119 - RNA, 17 nt, Human
ccuuucugaucaucuga

SEQ ID NO: 293120 - RNA, 22 nt, Human
ccuuuccucuucaugacuuucu

SEQ ID NO: 293121 - RNA, 23 nt, Human
ccuuguguaucuccagccacucc

SEQ ID NO: 293122 - RNA, 22 nt, Human
cgucauuuguaaaugaucaaga

SEQ ID NO: 293123 - RNA, 22 nt, Human
cgugcuaccugagcugacagcu

SEQ ID NO: 293124 - RNA, 22 nt, Human
cgugaaaugcagaaaguugugg

SEQ ID NO: 293125 - RNA, 22 nt, Human
ccuuuuuagaugugcgaauguu

SEQ ID NO: 293126 - RNA, 22 nt, Human
cgaguagagaugugguuucuga

SEQ ID NO: 293127 - RNA, 22 nt, Human
cuacugaagcaugcuuauaugu

SEQ ID NO: 293128 - RNA, 22 nt, Human
cuacuucucccuagaucagaaa

SEQ ID NO: 293129 - RNA, 22 nt, Human
cgauuccugauaagugaauaag

SEQ ID NO: 293130 - RNA, 22 nt, Human
cgcacaggcacagacacuggga

SEQ ID NO: 293131 - RNA, 22 nt, Human
cgcacuggagcuggaacgaguc

SEQ ID NO: 293132 - RNA, 22 nt, Human
cuaccagcacgccuuccucuac

SEQ ID NO: 293133 - RNA, 22 nt, Human
cuacauaaauuuaucacagacu

SEQ ID NO: 293134 - RNA, 19 nt, Human
cuacaguguuuuucuuucc

SEQ ID NO: 293135 - RNA, 22 nt, Human
cgaggcuugcaaggacgaggag

SEQ ID NO: 293136 - RNA, 22 nt, Human
cuaaauuuuuuagugaaauagg

SEQ ID NO: 293137 - RNA, 22 nt, Human
cuaaauucuauauccuugcuuc

SEQ ID NO: 293138 - RNA, 22 nt, Human
cuaaagacagcaagacaucauc

SEQ ID NO: 293139 - RNA, 22 nt, Human
cuaaaacuuuuccaaauuaugu

SEQ ID NO: 293140 - RNA, 22 nt, Human
cgcacacaaaugcauacgccag

SEQ ID NO: 293141 - RNA, 22 nt, Human
cgcccggcugagacgcucgccc

SEQ ID NO: 293142 - RNA, 21 nt, Human
ccuccagccagagggucugga

SEQ ID NO: 293143 - RNA, 22 nt, Human
ccucccagccuggagaggagcc

SEQ ID NO: 293144 - RNA, 22 nt, Human
ccucaucagaaagcagaaagca

SEQ ID NO: 293145 - RNA, 20 nt, Human
ccucauucucgcguguguuu

SEQ ID NO: 293146 - RNA, 18 nt, Human
ccuccccuguggaggucc

SEQ ID NO: 293147 - RNA, 22 nt, Human
ccuuuuguuucccuuuauguuc

SEQ ID NO: 293148 - RNA, 22 nt, Human
ccuauauuacaggcuugcucua

SEQ ID NO: 293149 - RNA, 21 nt, Human
ccguuauucuucccaccccca

SEQ ID NO: 293150 - RNA, 22 nt, Human
ccgguguggguuucucgguagu

SEQ ID NO: 293151 - RNA, 22 nt, Human
cgggacaauagcagugcugaug

SEQ ID NO: 293152 - RNA, 22 nt, Human
cggcugcgguucaccuagggca

SEQ ID NO: 293153 - RNA, 22 nt, Human
cggaggcugcuuucuguugcua

SEQ ID NO: 293154 - RNA, 22 nt, Human
cggagagacaagucugcuuugg

SEQ ID NO: 293155 - RNA, 22 nt, Human
cggacugaccugcucggggaga

SEQ ID NO: 293156 - RNA, 22 nt, Human
cgccgugcagucagcccagaag

SEQ ID NO: 293157 - RNA, 22 nt, Human
ccucuccucugugcagacugcc

SEQ ID NO: 293158 - RNA, 22 nt, Human
cgcccguacuuugccggcauga

SEQ ID NO: 293159 - RNA, 22 nt, Human
ccucuccuugcuccccuuccuu

SEQ ID NO: 293160 - RNA, 22 nt, Human
ccugacucugauuucgcugcau

SEQ ID NO: 293161 - RNA, 22 nt, Human
ccugacgcugauauauaguuaa

SEQ ID NO: 293162 - RNA, 22 nt, Human
cgccgugucuggucuguacguc

SEQ ID NO: 293163 - RNA, 22 nt, Human
cgcugcugucaucgucuacggu

SEQ ID NO: 293164 - RNA, 22 nt, Human
cgcugggugguugauguacagc

SEQ ID NO: 293165 - RNA, 22 nt, Human
ccugagacucuccugugcagcc

SEQ ID NO: 293166 - RNA, 22 nt, Human
ccuuggaucugcauaucagcua

SEQ ID NO: 293167 - RNA, 22 nt, Human
ccuucaguguuacuagaaagcg

SEQ ID NO: 293168 - RNA, 22 nt, Human
ccuugcuucuagcauucccaug

SEQ ID NO: 293169 - RNA, 22 nt, Human
ccgcucuuugagacucucccga

SEQ ID NO: 293170 - RNA, 22 nt, Human
ccgcuggaagcgaguggugggc

SEQ ID NO: 293171 - RNA, 22 nt, Human
ccgcuggccgacuuccgagagc

SEQ ID NO: 293172 - RNA, 22 nt, Human
ccuuucuggucucugagagacu

SEQ ID NO: 293173 - RNA, 21 nt, Human
ccuuugaguguguuugaagua

SEQ ID NO: 293174 - RNA, 22 nt, Human
ccggcugagccucgccgcggcc

SEQ ID NO: 293175 - RNA, 21 nt, Human
ccuuuggagacugcagcaaug

SEQ ID NO: 293176 - RNA, 22 nt, Human
ccuuuggaugucauucuuggca

SEQ ID NO: 293177 - RNA, 22 nt, Human
ccuuugcugggccucuccaucu

SEQ ID NO: 293178 - RNA, 22 nt, Human
ccuuuuaucgcgaagaacucca

SEQ ID NO: 293179 - RNA, 22 nt, Human
ccuuuuaagggagacuagagau

SEQ ID NO: 293180 - RNA, 22 nt, Human
ccuuuuagagaagugcauccag

SEQ ID NO: 293181 - RNA, 22 nt, Human
ccgggcuuccuuagagcaagau

SEQ ID NO: 293182 - RNA, 22 nt, Human
ccgggcggcauccagccguucc

SEQ ID NO: 293183 - RNA, 23 nt, Human
ccuggcugaccugaagguguagu

SEQ ID NO: 293184 - RNA, 22 nt, Human
ccugggcucgcgcacuucaccc

SEQ ID NO: 293185 - RNA, 22 nt, Human
ccuuagaaaaucauggaauauu

SEQ ID NO: 293186 - RNA, 22 nt, Human
ccgccucucgcucccagcuugc

SEQ ID NO: 293187 - RNA, 22 nt, Human
ccgcggauggggagucaccacc

SEQ ID NO: 293188 - RNA, 22 nt, Human
ccgcgcccccggcugugccccc

SEQ ID NO: 293189 - RNA, 21 nt, Human
ccgacggcgcagaugccggcc

SEQ ID NO: 293190 - RNA, 22 nt, Human
ccagacuggggauuuugccagg

SEQ ID NO: 293191 - RNA, 18 nt, Human
cccagaggaaugccugga

SEQ ID NO: 293192 - RNA, 19 nt, Human
ccagaagggcaagcaaagg

SEQ ID NO: 293193 - RNA, 22 nt, Human
ccgaaccacacgacagugcuca

SEQ ID NO: 293194 - RNA, 22 nt, Human
caugugguauugugagauccac

SEQ ID NO: 293195 - RNA, 22 nt, Human
cauguggaaaugcaugcuuuuu

SEQ ID NO: 293196 - RNA, 22 nt, Human
ccaaucaacuguguggcuuucu

SEQ ID NO: 293197 - RNA, 22 nt, Human
ccacguguugcucagacagggu

SEQ ID NO: 293198 - RNA, 17 nt, Human
ccacuagauagguugug

SEQ ID NO: 293199 - RNA, 22 nt, Human
ccacucagaagaaacaagagag

SEQ ID NO: 293200 - RNA, 22 nt, Human
cauucauagaaucaguuuggga

SEQ ID NO: 293201 - RNA, 20 nt, Human
cauuccaugcaucuuggucc

SEQ ID NO: 293202 - RNA, 22 nt, Human
cauucauaagacuuugcucuug

SEQ ID NO: 293203 - RNA, 22 nt, Human
cauggcggcgcucucccugccu

SEQ ID NO: 293204 - RNA, 22 nt, Human
cauggcaggugcagauucugug

SEQ ID NO: 293205 - RNA, 19 nt, Human
cauggcgguaaagaggcug

SEQ ID NO: 293206 - RNA, 22 nt, Human
caugggcucuucuggacugcac

SEQ ID NO: 293207 - RNA, 22 nt, Human
cauggcacagaagaugucguuu

SEQ ID NO: 293208 - RNA, 22 nt, Human
ccaagagcuucccauagcuucu

SEQ ID NO: 293209 - RNA, 22 nt, Human
cauggccaaagaauuauauuuu

SEQ ID NO: 293210 - RNA, 22 nt, Human
ccaagcguguuuaggaaaugcu

SEQ ID NO: 293211 - RNA, 22 nt, Human
ccaaccaguuaucuccuaaggu

SEQ ID NO: 293212 - RNA, 22 nt, Human
caugcuaacacguugcucaccg

SEQ ID NO: 293213 - RNA, 22 nt, Human
ccaaaguauuaaaucuuagcaa

SEQ ID NO: 293214 - RNA, 19 nt, Human
ccaacaguacugaagcacu

SEQ ID NO: 293215 - RNA, 22 nt, Human
cauuuuuuuuccccuccuggua

SEQ ID NO: 293216 - RNA, 22 nt, Human
ccaaagaagcaaugagaauagu

SEQ ID NO: 293217 - RNA, 22 nt, Human
caugauucccacauugcgauca

SEQ ID NO: 293218 - RNA, 22 nt, Human
caugaugagaguaauaacacag

SEQ ID NO: 293219 - RNA, 22 nt, Human
caugauguuaucaagcacaaag

SEQ ID NO: 293220 - RNA, 22 nt, Human
caugccaguagccggcuugacu

SEQ ID NO: 293221 - RNA, 22 nt, Human
cauuuugguaauguucguuugc

SEQ ID NO: 293222 - RNA, 22 nt, Human
cauuuugguccucauguguagc

SEQ ID NO: 293223 - RNA, 22 nt, Human
cauuuuaucagcacacgucacu

SEQ ID NO: 293224 - RNA, 22 nt, Human
cauuugcuuaucacucuucuuu

SEQ ID NO: 293225 - RNA, 22 nt, Human
caugaagugaaaagguuaauuu

SEQ ID NO: 293226 - RNA, 22 nt, Human
caugaauaauucuuuuucuugg

SEQ ID NO: 293227 - RNA, 22 nt, Human
cauuuagagaagauuacaagga

SEQ ID NO: 293228 - RNA, 22 nt, Human
cauugucaaguggccgggucuu

SEQ ID NO: 293229 - RNA, 22 nt, Human
caugauaacacuucuguuuaau

SEQ ID NO: 293230 - RNA, 22 nt, Human
cauuuaucacuugcuaaacaua

SEQ ID NO: 293231 - RNA, 22 nt, Human
cauuucaaacaguuacagcugc

SEQ ID NO: 293232 - RNA, 22 nt, Human
cauuuacauaacaguaacgcug

SEQ ID NO: 293233 - RNA, 22 nt, Human
cauuuacguaacaguaacgcug

SEQ ID NO: 293234 - RNA, 22 nt, Human
caucccaacaggugaucuggua

SEQ ID NO: 293235 - RNA, 22 nt, Human
cauccagagcugccugaccccg

SEQ ID NO: 293236 - RNA, 22 nt, Human
cauccagcuccugggggccacc

SEQ ID NO: 293237 - RNA, 22 nt, Human
cauugcaucuuuuauggguaag

SEQ ID NO: 293238 - RNA, 22 nt, Human
cauuggaugagggccucaucga

SEQ ID NO: 293239 - RNA, 22 nt, Human
cauugcuguuaauugucucuag

SEQ ID NO: 293240 - RNA, 22 nt, Human
cauugcugugggcauuugcugc

SEQ ID NO: 293241 - RNA, 22 nt, Human
cauuccuucucagguacuggca

SEQ ID NO: 293242 - RNA, 22 nt, Human
caucaguaaaguacuuuuaugu

SEQ ID NO: 293243 - RNA, 22 nt, Human
cauuauacaugaagacucaccc

SEQ ID NO: 293244 - RNA, 21 nt, Human
caucaagaucaauggagggcu

SEQ ID NO: 293245 - RNA, 22 nt, Human
caucaacagucuacuuuuugcc

SEQ ID NO: 293246 - RNA, 22 nt, Human
caugucaagacugaagauccag

SEQ ID NO: 293247 - RNA, 22 nt, Human
caugugacuuagguuuuaucac

SEQ ID NO: 293248 - RNA, 22 nt, Human
cauuagugaggggcugccugcu

SEQ ID NO: 293249 - RNA, 22 nt, Human
cauuauucaggcuuuggaauuu

SEQ ID NO: 293250 - RNA, 22 nt, Human
cauaguuuguucuuuuuuauug

SEQ ID NO: 293251 - RNA, 22 nt, Human
cagguuuuccuuuuaaaaggaa

SEQ ID NO: 293252 - RNA, 22 nt, Human
caucaggcugggaacacagauc

SEQ ID NO: 293253 - RNA, 22 nt, Human
caucaauagguauuugagagac

SEQ ID NO: 293254 - RNA, 22 nt, Human
cagguugaaaguggaggagcua

SEQ ID NO: 293255 - RNA, 16 nt, Human
ccacccagagaauauu

SEQ ID NO: 293256 - RNA, 22 nt, Human
ccacccugguuacugugccagg

SEQ ID NO: 293257 - RNA, 22 nt, Human
ccaccacugaggcacaggagcc

SEQ ID NO: 293258 - RNA, 22 nt, Human
ccaugaggcaaagacugauaua

SEQ ID NO: 293259 - RNA, 22 nt, Human
ccaucuuugcucuuuuauugca

SEQ ID NO: 293260 - RNA, 21 nt, Human
ccacuaagccccaguaaugga

SEQ ID NO: 293261 - RNA, 22 nt, Human
ccacuacauugagugcuuucuc

SEQ ID NO: 293262 - RNA, 22 nt, Human
ccaucucaucugguugggggug

SEQ ID NO: 293263 - RNA, 22 nt, Human
ccacagugauucacuuuugaag

SEQ ID NO: 293264 - RNA, 21 nt, Human
ccacaucaugucaccuccuag

SEQ ID NO: 293265 - RNA, 22 nt, Human
ccaguuuuuccagugcuuucug

SEQ ID NO: 293266 - RNA, 22 nt, Human
ccauaaaagagaaucuaaauga

SEQ ID NO: 293267 - RNA, 22 nt, Human
ccauggauacuaagguauguga

SEQ ID NO: 293268 - RNA, 20 nt, Human
ccacuucucugcucugccca

SEQ ID NO: 293269 - RNA, 23 nt, Human
ccacuccucccaggccacccugc

SEQ ID NO: 293270 - RNA, 22 nt, Human
ccagaacguuugugcgaggcag

SEQ ID NO: 293271 - RNA, 19 nt, Human
ccacuucuuugugugugag

SEQ ID NO: 293272 - RNA, 22 nt, Human
ccauuuuccuguauggacucga

SEQ ID NO: 293273 - RNA, 22 nt, Human
ccagaacgacgggcagaggcgc

SEQ ID NO: 293274 - RNA, 20 nt, Human
ccagaagagaagaaaaggaa

SEQ ID NO: 293275 - RNA, 22 nt, Human
cccagaaugauucagcgacagu

SEQ ID NO: 293276 - RNA, 18 nt, Human
cccaccugcccagguuca

SEQ ID NO: 293277 - RNA, 22 nt, Human
ccaggcucaccuggagccccug

SEQ ID NO: 293278 - RNA, 22 nt, Human
ccaggcuccccaggaggcccuu

SEQ ID NO: 293279 - RNA, 22 nt, Human
ccagggaagaaagaugaagugc

SEQ ID NO: 293280 - RNA, 22 nt, Human
ccagggaggucauagugcuggu

SEQ ID NO: 293281 - RNA, 22 nt, Human
ccagggcggacaaggucuuuga

SEQ ID NO: 293282 - RNA, 22 nt, Human
ccagggcuggaccagugcuugg

SEQ ID NO: 293283 - RNA, 22 nt, Human
ccaaauuguuguuguuguuguu

SEQ ID NO: 293284 - RNA, 22 nt, Human
ccaaauuaccuucuuggauuca

SEQ ID NO: 293285 - RNA, 22 nt, Human
ccaaagaauuuggaaaaucuga

SEQ ID NO: 293286 - RNA, 22 nt, Human
ccaaccaaagggccuaaggucu

SEQ ID NO: 293287 - RNA, 22 nt, Human
ccagguggacggcgaguacagg

SEQ ID NO: 293288 - RNA, 22 nt, Human
ccagucugccggcccggccccu

SEQ ID NO: 293289 - RNA, 22 nt, Human
ccagguuggccaccuucacggg

SEQ ID NO: 293290 - RNA, 22 nt, Human
ccaaccaguuucuuggcuuuag

SEQ ID NO: 293291 - RNA, 22 nt, Human
ccagugcagacgcggaacuggc

SEQ ID NO: 293292 - RNA, 22 nt, Human
ccagucuuggugucuguagcac

SEQ ID NO: 293293 - RNA, 22 nt, Human
ccaaggcugcagccgugacgcg

SEQ ID NO: 293294 - RNA, 22 nt, Human
ccagugagauagugguauaugc

SEQ ID NO: 293295 - RNA, 22 nt, Human
ccaaggcuguggggcugugcag

SEQ ID NO: 293296 - RNA, 22 nt, Human
ccaaggcuggagggcuuaugua

SEQ ID NO: 293297 - RNA, 22 nt, Human
ccaauguuaggcucugguuuua

SEQ ID NO: 293298 - RNA, 22 nt, Human
ccaaggugcagcccauggugaa

SEQ ID NO: 293299 - RNA, 22 nt, Human
ccaauuuuggaauuauuaggca

SEQ ID NO: 293300 - RNA, 22 nt, Human
ccagugcaguacaaaccuuagu

SEQ ID NO: 293301 - RNA, 22 nt, Human
ccaguguguuuuucucugacuc

SEQ ID NO: 293302 - RNA, 22 nt, Human
ccagcaucagcucuuggcuggc

SEQ ID NO: 293303 - RNA, 22 nt, Human
ccagccacugacugauuuaaaa

SEQ ID NO: 293304 - RNA, 22 nt, Human
ccagccugccaagcccagcccu

SEQ ID NO: 293305 - RNA, 22 nt, Human
ccagcaggagacuagcaacaua

SEQ ID NO: 293306 - RNA, 22 nt, Human
ccagcucgaggcaggggcugca

SEQ ID NO: 293307 - RNA, 22 nt, Human
cauuuucugcaagucugcucaa

SEQ ID NO: 293308 - RNA, 23 nt, Human
cauuugauccucacaauaaaugg

SEQ ID NO: 293309 - RNA, 22 nt, Human
cauuucuggccuggggagcggg

SEQ ID NO: 293310 - RNA, 22 nt, Human
ccaggcagaggggucuggagca

SEQ ID NO: 293311 - RNA, 22 nt, Human
ccagcugcugcaccgugcaugg

SEQ ID NO: 293312 - RNA, 22 nt, Human
ccagcugggucccugcuggggc

SEQ ID NO: 293313 - RNA, 22 nt, Human
ccaggcuaggaccgauuucccu

SEQ ID NO: 293314 - RNA, 22 nt, Human
ccaaaauauuagugcuuaagua

SEQ ID NO: 293315 - RNA, 22 nt, Human
ccacuuugagaagcugaugaaa

SEQ ID NO: 293316 - RNA, 22 nt, Human
ccacuguuggcccgaagggguc

SEQ ID NO: 293317 - RNA, 20 nt, Human
cauuccugaggaauucaugu

SEQ ID NO: 293318 - RNA, 22 nt, Human
cauugcaaccauuccaaauggc

SEQ ID NO: 293319 - RNA, 22 nt, Human
cauugcugccaaggugagcugg

SEQ ID NO: 293320 - RNA, 22 nt, Human
ccagagaugcagugggugcagu

SEQ ID NO: 293321 - RNA, 22 nt, Human
ccagacucucucauuuuccugu

SEQ ID NO: 293322 - RNA, 22 nt, Human
cauuggcacauguauucugggc

SEQ ID NO: 293323 - RNA, 22 nt, Human
ccagcaagacucgcagugggau

SEQ ID NO: 293324 - RNA, 22 nt, Human
cauugggcggggaccucggcug

SEQ ID NO: 293325 - RNA, 22 nt, Human
cauugguacaaaauguacuuug

SEQ ID NO: 293326 - RNA, 22 nt, Human
ccagaggcuuaugcagcugcug

SEQ ID NO: 293327 - RNA, 22 nt, Human
ccagauaaacauuccuuggccu

SEQ ID NO: 293328 - RNA, 22 nt, Human
ccagaugggggcugugggaggg

SEQ ID NO: 293329 - RNA, 22 nt, Human
ccagacuggggcuccuugaggg

SEQ ID NO: 293330 - RNA, 22 nt, Human
cagaacugaauaaagccaggau

SEQ ID NO: 293331 - RNA, 22 nt, Human
cagaaauuggcagagaagaccu

SEQ ID NO: 293332 - RNA, 22 nt, Human
cagcagccuccccggccgaccu

SEQ ID NO: 293333 - RNA, 22 nt, Human
cagaaagugauuugcuauucca

SEQ ID NO: 293334 - RNA, 22 nt, Human
cagcagaugacuauuggagcug

SEQ ID NO: 293335 - RNA, 22 nt, Human
cacuuauuuuuccuuugugauu

SEQ ID NO: 293336 - RNA, 22 nt, Human
cacuuagugcuuuuguguuucu

SEQ ID NO: 293337 - RNA, 22 nt, Human
cacuguugagcaauguacagug

SEQ ID NO: 293338 - RNA, 22 nt, Human
cagaaagaaguggggauagagg

SEQ ID NO: 293339 - RNA, 22 nt, Human
cagcacaggugugaggccugau

SEQ ID NO: 293340 - RNA, 19 nt, Human
cagcaaacacuguaaaugg

SEQ ID NO: 293341 - RNA, 22 nt, Human
cagagagcguccauccggugcc

SEQ ID NO: 293342 - RNA, 22 nt, Human
cagcccugagagaaccaucuau

SEQ ID NO: 293343 - RNA, 22 nt, Human
cagccccagcacuuagcugagu

SEQ ID NO: 293344 - RNA, 22 nt, Human
cagccccaguuuucauaagacu

SEQ ID NO: 293345 - RNA, 22 nt, Human
cagcauucuacuuugugaacug

SEQ ID NO: 293346 - RNA, 22 nt, Human
cacgggcgacgugaucuaggac

SEQ ID NO: 293347 - RNA, 22 nt, Human
caccugcaaauuccagauuucu

SEQ ID NO: 293348 - RNA, 22 nt, Human
caccgaacuuugcaaaugcaau

SEQ ID NO: 293349 - RNA, 22 nt, Human
caccaucagacuucugggcagg

SEQ ID NO: 293350 - RNA, 20 nt, Human
cacccgguccucagcgacuc

SEQ ID NO: 293351 - RNA, 22 nt, Human
cacucuucucucauuuuccuuu

SEQ ID NO: 293352 - RNA, 23 nt, Human
cacuggugggguuuaaaagaagc

SEQ ID NO: 293353 - RNA, 22 nt, Human
cacugcugaggcccguguuacu

SEQ ID NO: 293354 - RNA, 22 nt, Human
cacugugagugcaagcaggggu

SEQ ID NO: 293355 - RNA, 22 nt, Human
cacugguugccucuuucuguuc

SEQ ID NO: 293356 - RNA, 23 nt, Human
cacucgcaggcccagcucucagg

SEQ ID NO: 293357 - RNA, 22 nt, Human
cagacugugagcuccuugaggg

SEQ ID NO: 293358 - RNA, 23 nt, Human
cagagaaaauagaauaugcugug

SEQ ID NO: 293359 - RNA, 20 nt, Human
caauguuggcaguauagagc

SEQ ID NO: 293360 - RNA, 22 nt, Human
caauggagccaagaggaggaaa

SEQ ID NO: 293361 - RNA, 22 nt, Human
cacuauguacauaauagcugcu

SEQ ID NO: 293362 - RNA, 22 nt, Human
cacugcaaccuccaccucccgg

SEQ ID NO: 293363 - RNA, 22 nt, Human
caaaacccaagugcuauugcaa

SEQ ID NO: 293364 - RNA, 22 nt, Human
caagcagauauuuuagucaaga

SEQ ID NO: 293365 - RNA, 22 nt, Human
caaaagcaaagaucuuugauug

SEQ ID NO: 293366 - RNA, 22 nt, Human
caaugccaggaaccugggggaa

SEQ ID NO: 293367 - RNA, 22 nt, Human
caaaauuguugaugcugcuuug

SEQ ID NO: 293368 - RNA, 22 nt, Human
cacagaggaugcccaagcgauc

SEQ ID NO: 293369 - RNA, 22 nt, Human
cacugcguaguggcccgaagcu

SEQ ID NO: 293370 - RNA, 22 nt, Human
cacacagcuagugacaggagaa

SEQ ID NO: 293371 - RNA, 22 nt, Human
cacuuaaaauucagggcuuaua

SEQ ID NO: 293372 - RNA, 22 nt, Human
cacuguugaagauacuuccucu

SEQ ID NO: 293373 - RNA, 21 nt, Human
cacuguauagcaggagaaaac

SEQ ID NO: 293374 - RNA, 22 nt, Human
cacagcaggcagaacgugggca

SEQ ID NO: 293375 - RNA, 22 nt, Human
cacagcagcaucauuuaucugg

SEQ ID NO: 293376 - RNA, 22 nt, Human
cacauuuuccagaagaaucaga

SEQ ID NO: 293377 - RNA, 22 nt, Human
cacaugugugugccuacaugca

SEQ ID NO: 293378 - RNA, 22 nt, Human
cacauuucagcacucagggcau

SEQ ID NO: 293379 - RNA, 22 nt, Human
cacauuaagcccaagcauagaa

SEQ ID NO: 293380 - RNA, 22 nt, Human
cacaucugaaggcggcucuagg

SEQ ID NO: 293381 - RNA, 22 nt, Human
cacaucaaacuuacuaagauuu

SEQ ID NO: 293382 - RNA, 22 nt, Human
cagaaguugcuugagagagagc

SEQ ID NO: 293383 - RNA, 22 nt, Human
cagacaaauccuuaugagacug

SEQ ID NO: 293384 - RNA, 22 nt, Human
caccaaaauaucccuuuguaca

SEQ ID NO: 293385 - RNA, 22 nt, Human
cagacagagcucacaagucuuu

SEQ ID NO: 293386 - RNA, 22 nt, Human
cagaaacacuguauuuagggaa

SEQ ID NO: 293387 - RNA, 22 nt, Human
cagaaaacauuguguguauaag

SEQ ID NO: 293388 - RNA, 22 nt, Human
cacuuuuucccccuggugucau

SEQ ID NO: 293389 - RNA, 22 nt, Human
cagaaaaaaaugcagacuagca

SEQ ID NO: 293390 - RNA, 22 nt, Human
cacuugagagcugaagaagucu

SEQ ID NO: 293391 - RNA, 22 nt, Human
cacauaaggacauuauugaaag

SEQ ID NO: 293392 - RNA, 22 nt, Human
cacuucaguacuagaggaugaa

SEQ ID NO: 293393 - RNA, 23 nt, Human
cacaggcagaaaucaagacggua

SEQ ID NO: 293394 - RNA, 22 nt, Human
cacagcuggggaagcugaggcc

SEQ ID NO: 293395 - RNA, 22 nt, Human
cacaguuuuaucuuauacugau

SEQ ID NO: 293396 - RNA, 22 nt, Human
cagcuuuugcagacuucuugcc

SEQ ID NO: 293397 - RNA, 22 nt, Human
cagcauggagacaaagugggca

SEQ ID NO: 293398 - RNA, 18 nt, Human
cagcauuagcagcuucca

SEQ ID NO: 293399 - RNA, 22 nt, Human
cagcaugcaaguccagaugugg

SEQ ID NO: 293400 - RNA, 22 nt, Human
cagcaugguggagcugcucuuu

SEQ ID NO: 293401 - RNA, 22 nt, Human
caggaacucggagcccaucucu

SEQ ID NO: 293402 - RNA, 22 nt, Human
cagccccgcuggccucgccucc

SEQ ID NO: 293403 - RNA, 22 nt, Human
caggacacagacacuaaauaua

SEQ ID NO: 293404 - RNA, 22 nt, Human
cagcgguggcaaggugacugug

SEQ ID NO: 293405 - RNA, 22 nt, Human
cagcuucaaaggcccugauggu

SEQ ID NO: 293406 - RNA, 22 nt, Human
cagcuacuaccuguagacaaag

SEQ ID NO: 293407 - RNA, 22 nt, Human
cagcuucacuuaaaacaugcaa

SEQ ID NO: 293408 - RNA, 22 nt, Human
cagccuuuucuuaaaaugcaag

SEQ ID NO: 293409 - RNA, 22 nt, Human
cagcuauggaauuggcccagau

SEQ ID NO: 293410 - RNA, 22 nt, Human
cagccuggccucuggauauuug

SEQ ID NO: 293411 - RNA, 22 nt, Human
cagccgcucaugggcccggagc

SEQ ID NO: 293412 - RNA, 21 nt, Human
cagagcuuuggagacggagga

SEQ ID NO: 293413 - RNA, 22 nt, Human
cagagcucacaaacugaaaacc

SEQ ID NO: 293414 - RNA, 20 nt, Human
cagagccaggguuuuguuuu

SEQ ID NO: 293415 - RNA, 22 nt, Human
caggaaaauaauggugauggga

SEQ ID NO: 293416 - RNA, 22 nt, Human
caggugauuuuguuuucaaaug

SEQ ID NO: 293417 - RNA, 22 nt, Human
cagcuucuccauucuucuggcu

SEQ ID NO: 293418 - RNA, 22 nt, Human
cagcugcgcagcgccgggccug

SEQ ID NO: 293419 - RNA, 22 nt, Human
cagcugcugguguaucgggucc

SEQ ID NO: 293420 - RNA, 22 nt, Human
cagcuguauuucucugguuaga

SEQ ID NO: 293421 - RNA, 22 nt, Human
cagcuguggagauggggugcau

SEQ ID NO: 293422 - RNA, 22 nt, Human
caggcgcauggugagcagauga

SEQ ID NO: 293423 - RNA, 22 nt, Human
caggccgcccucuccuguuagc

SEQ ID NO: 293424 - RNA, 22 nt, Human
caggcgcugacgggaccgggcu

SEQ ID NO: 293425 - RNA, 22 nt, Human
cagggaaguauuacauguuucc

SEQ ID NO: 293426 - RNA, 22 nt, Human
cagggacgugagccaugucagu

SEQ ID NO: 293427 - RNA, 22 nt, Human
cagggacugcaggaggacaggu

SEQ ID NO: 293428 - RNA, 22 nt, Human
caggauuuaauaagauaguguu

SEQ ID NO: 293429 - RNA, 22 nt, Human
caggauauguucaagguuuucu

SEQ ID NO: 293430 - RNA, 22 nt, Human
caggaggaaaguuccacucaac

SEQ ID NO: 293431 - RNA, 22 nt, Human
cauaggugguagaauggggaga

SEQ ID NO: 293432 - RNA, 22 nt, Human
cauauacauauacaugcauaca

SEQ ID NO: 293433 - RNA, 22 nt, Human
cauaucuuaaacaucaucucug

SEQ ID NO: 293434 - RNA, 22 nt, Human
cauaaucaagggguugugaugu

SEQ ID NO: 293435 - RNA, 22 nt, Human
caguuuuucaaaauuacaugau

SEQ ID NO: 293436 - RNA, 22 nt, Human
caguggagaccugccugcugga

SEQ ID NO: 293437 - RNA, 22 nt, Human
caguggggaggccaggauagaa

SEQ ID NO: 293438 - RNA, 22 nt, Human
caguuaaugauaggaauucggu

SEQ ID NO: 293439 - RNA, 22 nt, Human
caguguuuagcacagugcuugg

SEQ ID NO: 293440 - RNA, 22 nt, Human
cagugguaaaugucguuccugu

SEQ ID NO: 293441 - RNA, 22 nt, Human
caguugcuauugagagaacaca

SEQ ID NO: 293442 - RNA, 22 nt, Human
caguucuguaccaggagaagcu

SEQ ID NO: 293443 - RNA, 22 nt, Human
caggguuuuauuuggcuuuaaa

SEQ ID NO: 293444 - RNA, 22 nt, Human
caggguuuuaguugcagguuau

SEQ ID NO: 293445 - RNA, 22 nt, Human
caggguugaugaauugucugua

SEQ ID NO: 293446 - RNA, 22 nt, Human
cagugcucauagcuguuccucc

SEQ ID NO: 293447 - RNA, 22 nt, Human
cagugcuccugccccugcccuu

SEQ ID NO: 293448 - RNA, 22 nt, Human
caggcacaaugagcgccaucuu

SEQ ID NO: 293449 - RNA, 22 nt, Human
caguggacacuuccucuacaau

SEQ ID NO: 293450 - RNA, 22 nt, Human
cagucucuugcuucauuaguug

SEQ ID NO: 293451 - RNA, 22 nt, Human
cagguuucuggaugcagcccca

SEQ ID NO: 293452 - RNA, 22 nt, Human
caggcacaagaucggcuagaua

SEQ ID NO: 293453 - RNA, 22 nt, Human
cagguuuggaagucacgaagcu

SEQ ID NO: 293454 - RNA, 22 nt, Human
caggacuuccucuaugguggcg

SEQ ID NO: 293455 - RNA, 22 nt, Human
caggagagucucugucuguacu

SEQ ID NO: 293456 - RNA, 22 nt, Human
cagguguugcaguugaagacug

SEQ ID NO: 293457 - RNA, 22 nt, Human
cagguggccggguaggaggugg

SEQ ID NO: 293458 - RNA, 23 nt, Human
cagguuacacuuuaaaauaugca

SEQ ID NO: 293459 - RNA, 22 nt, Human
caggugggauuuugcugcuuga

SEQ ID NO: 293460 - RNA, 22 nt, Human
caggaagucugaauucugagag

SEQ ID NO: 293461 - RNA, 22 nt, Human
caggacagaaauaaggaauaua

SEQ ID NO: 293462 - RNA, 19 nt, Human
caggucuucuuggaggacu

SEQ ID NO: 293463 - RNA, 22 nt, Human
cagguggauggcgagcccugca

SEQ ID NO: 293464 - RNA, 22 nt, Human
auggagcagagcugaugggccu

SEQ ID NO: 293465 - RNA, 22 nt, Human
auggaggugagccccccauccu

SEQ ID NO: 293466 - RNA, 22 nt, Human
augcugccuaaagcuacuuaca

SEQ ID NO: 293467 - RNA, 22 nt, Human
auggagguuugucugguuuugu

SEQ ID NO: 293468 - RNA, 22 nt, Human
augcugccuccucuucagccgc

SEQ ID NO: 293469 - RNA, 22 nt, Human
augcuuuauuggagacagucau

SEQ ID NO: 293470 - RNA, 22 nt, Human
augccccuuuauauguuaaguc

SEQ ID NO: 293471 - RNA, 22 nt, Human
augccacuguuuaugucacuua

SEQ ID NO: 293472 - RNA, 22 nt, Human
augcauaugugugcaagugugu

SEQ ID NO: 293473 - RNA, 22 nt, Human
augcaugaucccgguaugugaa

SEQ ID NO: 293474 - RNA, 22 nt, Human
augccaccucuucugauuccag

SEQ ID NO: 293475 - RNA, 22 nt, Human
augauuauuugaaugaagagga

SEQ ID NO: 293476 - RNA, 22 nt, Human
augauucuaccaaugccaucuu

SEQ ID NO: 293477 - RNA, 22 nt, Human
augggagugacagggccacugg

SEQ ID NO: 293478 - RNA, 22 nt, Human
augggagggagcagugaguguu

SEQ ID NO: 293479 - RNA, 22 nt, Human
augggaauggauugagugggug

SEQ ID NO: 293480 - RNA, 22 nt, Human
auggcaucuucgguuggacugc

SEQ ID NO: 293481 - RNA, 22 nt, Human
auggaaggggagguagggagga

SEQ ID NO: 293482 - RNA, 22 nt, Human
auggaauuuaaauuuugguguc

SEQ ID NO: 293483 - RNA, 22 nt, Human
auggaagagacaaugcuaucug

SEQ ID NO: 293484 - RNA, 22 nt, Human
auggaacccgggcgucugcucu

SEQ ID NO: 293485 - RNA, 22 nt, Human
auggaacauuaaucuucaaaug

SEQ ID NO: 293486 - RNA, 22 nt, Human
auggacguuuguguauuaugua

SEQ ID NO: 293487 - RNA, 22 nt, Human
auggagcgggaggauggaggag

SEQ ID NO: 293488 - RNA, 22 nt, Human
auggggaggcggauggagugcu

SEQ ID NO: 293489 - RNA, 22 nt, Human
augggggccagggacccuggca

SEQ ID NO: 293490 - RNA, 19 nt, Human
augguauugcuggguuuuu

SEQ ID NO: 293491 - RNA, 22 nt, Human
augggugggagugaaggggcuc

SEQ ID NO: 293492 - RNA, 22 nt, Human
auggauuggguugauggcauac

SEQ ID NO: 293493 - RNA, 22 nt, Human
auggauggaagcagccugaacu

SEQ ID NO: 293494 - RNA, 22 nt, Human
auggagugggaggacaugaagg

SEQ ID NO: 293495 - RNA, 22 nt, Human
auguuuuaaaaaacaggcuacc

SEQ ID NO: 293496 - RNA, 20 nt, Human
augugcuaauauuaauaugu

SEQ ID NO: 293497 - RNA, 22 nt, Human
auguuuaaguguuuugccccaa

SEQ ID NO: 293498 - RNA, 22 nt, Human
auguuugugauugcugaaaaga

SEQ ID NO: 293499 - RNA, 22 nt, Human
auuaaagcaugaauaauaugua

SEQ ID NO: 293500 - RNA, 22 nt, Human
auuaaacuaaauuaugaauugg

SEQ ID NO: 293501 - RNA, 19 nt, Human
auguucugaauuacuguaa

SEQ ID NO: 293502 - RNA, 22 nt, Human
auuaaaaaaagauaaugaguua

SEQ ID NO: 293503 - RNA, 22 nt, Human
auguuuuuugaaaauguauuuu

SEQ ID NO: 293504 - RNA, 22 nt, Human
auguuuucuugucuggagaagu

SEQ ID NO: 293505 - RNA, 22 nt, Human
augugaacuccagcugccaacc

SEQ ID NO: 293506 - RNA, 22 nt, Human
augugacaagugugggcagggc

SEQ ID NO: 293507 - RNA, 22 nt, Human
auguuguugaacucuuugcaug

SEQ ID NO: 293508 - RNA, 22 nt, Human
augugcauguauguaucauauu

SEQ ID NO: 293509 - RNA, 22 nt, Human
augugcacuggugugugcguuc

SEQ ID NO: 293510 - RNA, 22 nt, Human
auguugcugauccuguggcugu

SEQ ID NO: 293511 - RNA, 22 nt, Human
auguguguaugugugcauguau

SEQ ID NO: 293512 - RNA, 22 nt, Human
augugggugaggaggccauugu

SEQ ID NO: 293513 - RNA, 22 nt, Human
auguacugacuguacuuuuaaa

SEQ ID NO: 293514 - RNA, 22 nt, Human
auguaguccuuauuugacauaa

SEQ ID NO: 293515 - RNA, 22 nt, Human
augguaaguuuuuaaaaagcgu

SEQ ID NO: 293516 - RNA, 22 nt, Human
auggugaugaugaugaugauaa

SEQ ID NO: 293517 - RNA, 22 nt, Human
augguguaagacuguauuucuu

SEQ ID NO: 293518 - RNA, 22 nt, Human
auggugaaaugauuugauguca

SEQ ID NO: 293519 - RNA, 22 nt, Human
auguggaaagcuugucuuagag

SEQ ID NO: 293520 - RNA, 22 nt, Human
auguaacauaugugaucgcauu

SEQ ID NO: 293521 - RNA, 22 nt, Human
auguaaugucaaucuucagugg

SEQ ID NO: 293522 - RNA, 22 nt, Human
augggcauggauggccgagucu

SEQ ID NO: 293523 - RNA, 22 nt, Human
augggauuugaaaaguggaaau

SEQ ID NO: 293524 - RNA, 22 nt, Human
augggcauacaaaugcuacccu

SEQ ID NO: 293525 - RNA, 22 nt, Human
auguaaauauuuauauaugcau

SEQ ID NO: 293526 - RNA, 22 nt, Human
auggggaauugaccguggaucu

SEQ ID NO: 293527 - RNA, 22 nt, Human
auggggaucugcaguguugauc

SEQ ID NO: 293528 - RNA, 22 nt, Human
augguguaggugaagagaacau

SEQ ID NO: 293529 - RNA, 22 nt, Human
auggcagcggagcuggaaauga

SEQ ID NO: 293530 - RNA, 21 nt, Human
augagguggcuacuaaagagu

SEQ ID NO: 293531 - RNA, 22 nt, Human
augcaccugucuuuuaaggaua

SEQ ID NO: 293532 - RNA, 22 nt, Human
augaggccacaguuauagauuu

SEQ ID NO: 293533 - RNA, 22 nt, Human
augaggauuagcaucugcaaau

SEQ ID NO: 293534 - RNA, 22 nt, Human
augaggagucaaggagucggag

SEQ ID NO: 293535 - RNA, 22 nt, Human
augcacaagguagauuauuauu

SEQ ID NO: 293536 - RNA, 22 nt, Human
augaggaacagcaagaauauuu

SEQ ID NO: 293537 - RNA, 18 nt, Human
augauaauguuugcauca

SEQ ID NO: 293538 - RNA, 22 nt, Human
augcauaucuccuaucuccuca

SEQ ID NO: 293539 - RNA, 22 nt, Human
augauuacagcaugauguuuca

SEQ ID NO: 293540 - RNA, 22 nt, Human
augaacuaagagucauuagugu

SEQ ID NO: 293541 - RNA, 22 nt, Human
augagugugugguucuaaauga

SEQ ID NO: 293542 - RNA, 22 nt, Human
augaacugcaguauaaacuugg

SEQ ID NO: 293543 - RNA, 22 nt, Human
augaguuaaguagcccuucaug

SEQ ID NO: 293544 - RNA, 22 nt, Human
augauuuguuaacagacuuaau

SEQ ID NO: 293545 - RNA, 22 nt, Human
augcaaaaucuuauuuuuucua

SEQ ID NO: 293546 - RNA, 22 nt, Human
aucuuuuuucacaauuuauuuu

SEQ ID NO: 293547 - RNA, 20 nt, Human
augaaugcuccccacguuuc

SEQ ID NO: 293548 - RNA, 22 nt, Human
augaauuaucugguguuggaaa

SEQ ID NO: 293549 - RNA, 22 nt, Human
augaaugccggucucgggggaa

SEQ ID NO: 293550 - RNA, 22 nt, Human
aucugugauuuuggcaagauuu

SEQ ID NO: 293551 - RNA, 22 nt, Human
aucuguuccccuaugcucucua

SEQ ID NO: 293552 - RNA, 22 nt, Human
aucuguggguaaggauaagcau

SEQ ID NO: 293553 - RNA, 23 nt, Human
augaacgcacugagaucauaauu

SEQ ID NO: 293554 - RNA, 22 nt, Human
augaaaacggaccagagcuauu

SEQ ID NO: 293555 - RNA, 22 nt, Human
augaguaaguucugauuagauu

SEQ ID NO: 293556 - RNA, 22 nt, Human
aucuuggccuucuccuggagug

SEQ ID NO: 293557 - RNA, 22 nt, Human
augacagcuaaggaauguguag

SEQ ID NO: 293558 - RNA, 22 nt, Human
augaccauccagaaguccagcu

SEQ ID NO: 293559 - RNA, 22 nt, Human
augacagcucuagcacacagua

SEQ ID NO: 293560 - RNA, 22 nt, Human
aucugcauguggcagguggauu

SEQ ID NO: 293561 - RNA, 22 nt, Human
aucuugaaacauauaugcauuu

SEQ ID NO: 293562 - RNA, 22 nt, Human
aucucccaaauuagccucuuga

SEQ ID NO: 293563 - RNA, 22 nt, Human
aucucuguaaaccauaaauuga

SEQ ID NO: 293564 - RNA, 22 nt, Human
aucuuggauccuuugccagcuu

SEQ ID NO: 293565 - RNA, 22 nt, Human
aucuuugccuuuaugccucuag

SEQ ID NO: 293566 - RNA, 19 nt, Human
aucuuucagcagcuccccu

SEQ ID NO: 293567 - RNA, 22 nt, Human
aucucacuucugucauguggca

SEQ ID NO: 293568 - RNA, 22 nt, Human
aucuucuuucaucagccccuca

SEQ ID NO: 293569 - RNA, 22 nt, Human
aucuuaguuauuuggagaaacc

SEQ ID NO: 293570 - RNA, 22 nt, Human
aucuucaaggacgccaagaucc

SEQ ID NO: 293571 - RNA, 22 nt, Human
aucuaauguggcaaguugcuga

SEQ ID NO: 293572 - RNA, 20 nt, Human
aucuuaucuaucuuuuguuc

SEQ ID NO: 293573 - RNA, 22 nt, Human
aucuguucuucaaaauauuaca

SEQ ID NO: 293574 - RNA, 21 nt, Human
aucugugucauuagguggcag

SEQ ID NO: 293575 - RNA, 22 nt, Human
aucgcagaguggaaauugauga

SEQ ID NO: 293576 - RNA, 22 nt, Human
aucugugguacaugacggcugc

SEQ ID NO: 293577 - RNA, 20 nt, Human
aucugugaugagaacgguuu

SEQ ID NO: 293578 - RNA, 22 nt, Human
aucugacaaccuauugacuuga

SEQ ID NO: 293579 - RNA, 22 nt, Human
auccuugacuguagugauauua

SEQ ID NO: 293580 - RNA, 22 nt, Human
auaaugccucauaggguguucc

SEQ ID NO: 293581 - RNA, 22 nt, Human
auacuagauaccucuucuaccu

SEQ ID NO: 293582 - RNA, 22 nt, Human
auacacauguuauuguggaagc

SEQ ID NO: 293583 - RNA, 22 nt, Human
auacaauugcaauggaagauga

SEQ ID NO: 293584 - RNA, 22 nt, Human
auacacuucauguuuucaucug

SEQ ID NO: 293585 - RNA, 19 nt, Human
auacacguguauacauaca

SEQ ID NO: 293586 - RNA, 22 nt, Human
auccuggcuuuccugauuuacu

SEQ ID NO: 293587 - RNA, 22 nt, Human
auccuucaaaaggaauagcagg

SEQ ID NO: 293588 - RNA, 22 nt, Human
auacuagguggauauacaaaga

SEQ ID NO: 293589 - RNA, 22 nt, Human
auacuucaccuaacccaguuuc

SEQ ID NO: 293590 - RNA, 22 nt, Human
auacugagauguuaauagggug

SEQ ID NO: 293591 - RNA, 21 nt, Human
aucucaguccugggaaugauu

SEQ ID NO: 293592 - RNA, 22 nt, Human
caaauacaaauacgggcagcuu

SEQ ID NO: 293593 - RNA, 22 nt, Human
caaaggauguguagugcaacca

SEQ ID NO: 293594 - RNA, 22 nt, Human
caaaucagaucagagacaggcu

SEQ ID NO: 293595 - RNA, 22 nt, Human
caaaugaugcauggcuagugag

SEQ ID NO: 293596 - RNA, 22 nt, Human
caaaggaauuacauguuucgga

SEQ ID NO: 293597 - RNA, 22 nt, Human
caaaccuagagaggagaggaca

SEQ ID NO: 293598 - RNA, 22 nt, Human
caaaggaaagagaaaaagucuu

SEQ ID NO: 293599 - RNA, 22 nt, Human
auuuuuagagugaaagaauuaa

SEQ ID NO: 293600 - RNA, 22 nt, Human
caagcacaauuucuacauguua

SEQ ID NO: 293601 - RNA, 22 nt, Human
caaaaauacuugccuguaucug

SEQ ID NO: 293602 - RNA, 22 nt, Human
auuuuuuuuccugucucuuuca

SEQ ID NO: 293603 - RNA, 22 nt, Human
caaaaaauccauagaaagaggu

SEQ ID NO: 293604 - RNA, 22 nt, Human
auuuuuuuggucauaugagaua

SEQ ID NO: 293605 - RNA, 22 nt, Human
auuuuucuuucacauuuucuua

SEQ ID NO: 293606 - RNA, 22 nt, Human
caaauguuugguggcauuuugu

SEQ ID NO: 293607 - RNA, 22 nt, Human
auuuuugugucacaucuaggaa

SEQ ID NO: 293608 - RNA, 22 nt, Human
auuuuugugcuuuauuggggua

SEQ ID NO: 293609 - RNA, 22 nt, Human
auuuuuucaugugugguugaga

SEQ ID NO: 293610 - RNA, 22 nt, Human
auuuuauuuugggaucuuuuua

SEQ ID NO: 293611 - RNA, 22 nt, Human
auuuugcuuuucuaguggguuu

SEQ ID NO: 293612 - RNA, 22 nt, Human
auuuuuaucuaaaauccacuuu

SEQ ID NO: 293613 - RNA, 22 nt, Human
auuuuuagucuugcugcaauca

SEQ ID NO: 293614 - RNA, 22 nt, Human
auuuuagagaaacaaacguagg

SEQ ID NO: 293615 - RNA, 22 nt, Human
auuuucgcaccucgcgaguugc

SEQ ID NO: 293616 - RNA, 17 nt, Human
auuuccgaguuucuuuc

SEQ ID NO: 293617 - RNA, 22 nt, Human
auuuuggguguuaacaaugaaa

SEQ ID NO: 293618 - RNA, 19 nt, Human
auuuugguucuuuccauuc

SEQ ID NO: 293619 - RNA, 22 nt, Human
auuuuguugaaacccuuguugu

SEQ ID NO: 293620 - RNA, 22 nt, Human
auuggccaguggacagcgccgu

SEQ ID NO: 293621 - RNA, 22 nt, Human
auuggcugucagcccggauggg

SEQ ID NO: 293622 - RNA, 22 nt, Human
auugguuucuuguggguuaucc

SEQ ID NO: 293623 - RNA, 22 nt, Human
auuguucuagaauuuuuuuucc

SEQ ID NO: 293624 - RNA, 22 nt, Human
auugaaguguacguuugaucua

SEQ ID NO: 293625 - RNA, 22 nt, Human
auugaugccugaaaaauaugua

SEQ ID NO: 293626 - RNA, 22 nt, Human
auugaugaaaauaguuauuuua

SEQ ID NO: 293627 - RNA, 22 nt, Human
auugccauaauagagccaugua

SEQ ID NO: 293628 - RNA, 22 nt, Human
auugagacugaaauuacugaag

SEQ ID NO: 293629 - RNA, 22 nt, Human
auuguuacuggguuaauuugga

SEQ ID NO: 293630 - RNA, 22 nt, Human
auugaguauuguaaauaaaaca

SEQ ID NO: 293631 - RNA, 22 nt, Human
auuugccaguuacucacaccac

SEQ ID NO: 293632 - RNA, 22 nt, Human
auuugaaaaucuaugaugugca

SEQ ID NO: 293633 - RNA, 22 nt, Human
auuugaaguauaaguaauugcu

SEQ ID NO: 293634 - RNA, 22 nt, Human
auuguuuccccggaauuauuca

SEQ ID NO: 293635 - RNA, 22 nt, Human
auuuccagcagcauauuugucu

SEQ ID NO: 293636 - RNA, 22 nt, Human
auuguauugcguuugcgaaugu

SEQ ID NO: 293637 - RNA, 21 nt, Human
auuggcagaucucuggauugu

SEQ ID NO: 293638 - RNA, 22 nt, Human
auuggagacauuaagucuaaga

SEQ ID NO: 293639 - RNA, 22 nt, Human
auuuaagacuguggugcaguuu

SEQ ID NO: 293640 - RNA, 22 nt, Human
auuuaaguuacuucucuuuccu

SEQ ID NO: 293641 - RNA, 22 nt, Human
auuuacugagguaaauaaacug

SEQ ID NO: 293642 - RNA, 22 nt, Human
auuuaucugcucuucgcguuga

SEQ ID NO: 293643 - RNA, 22 nt, Human
auuuagagaaguagcaaggucc

SEQ ID NO: 293644 - RNA, 22 nt, Human
auuucagaguagaucguuauuu

SEQ ID NO: 293645 - RNA, 22 nt, Human
auuucaguuugcaguuucucuc

SEQ ID NO: 293646 - RNA, 22 nt, Human
auuucagcagcccauguuugga

SEQ ID NO: 293647 - RNA, 21 nt, Human
auuuggucaaugucugcguga

SEQ ID NO: 293648 - RNA, 22 nt, Human
auuuggucuacauuuuccaaau

SEQ ID NO: 293649 - RNA, 22 nt, Human
auuccguuuuaaaaccuuaagc

SEQ ID NO: 293650 - RNA, 22 nt, Human
auguugaguggaugaacaaaca

SEQ ID NO: 293651 - RNA, 22 nt, Human
auucccucaagagacccacagc

SEQ ID NO: 293652 - RNA, 22 nt, Human
auucgaucacugccgaggaccu

SEQ ID NO: 293653 - RNA, 22 nt, Human
auucgcggcuugaucugcuugc

SEQ ID NO: 293654 - RNA, 22 nt, Human
auucuaauaagcguuuugucgc

SEQ ID NO: 293655 - RNA, 22 nt, Human
auguuguuuauggguuaucaag

SEQ ID NO: 293656 - RNA, 22 nt, Human
auuaaauagcagaagaaagaug

SEQ ID NO: 293657 - RNA, 22 nt, Human
auucucauguuuuaaaaaaguu

SEQ ID NO: 293658 - RNA, 22 nt, Human
auucuacucuuuaaauaugaaa

SEQ ID NO: 293659 - RNA, 22 nt, Human
auuaugaauuguguuacgaaga

SEQ ID NO: 293660 - RNA, 22 nt, Human
auuaugcagcugccuccaaggu

SEQ ID NO: 293661 - RNA, 22 nt, Human
auucuuauaaaaaguguugacu

SEQ ID NO: 293662 - RNA, 22 nt, Human
auucauuuuuacaucaccaaua

SEQ ID NO: 293663 - RNA, 17 nt, Human
auucuuauacucuguga

SEQ ID NO: 293664 - RNA, 22 nt, Human
auucuguuuuaccauuuucuuu

SEQ ID NO: 293665 - RNA, 22 nt, Human
auucuguugguuuaauagucaa

SEQ ID NO: 293666 - RNA, 22 nt, Human
auucaucuguacuucaauaucu

SEQ ID NO: 293667 - RNA, 22 nt, Human
auuauuugcuuaagcuggucuc

SEQ ID NO: 293668 - RNA, 22 nt, Human
auuauucuuugggaaaguugaa

SEQ ID NO: 293669 - RNA, 23 nt, Human
auuauuucaggguuuugacuugc

SEQ ID NO: 293670 - RNA, 20 nt, Human
auuauuucuucugcccaaag

SEQ ID NO: 293671 - RNA, 21 nt, Human
auucugauguuucuauuguuu

SEQ ID NO: 293672 - RNA, 22 nt, Human
auucaagagcccauguuuccug

SEQ ID NO: 293673 - RNA, 22 nt, Human
auucugcauuucuaaccagguc

SEQ ID NO: 293674 - RNA, 22 nt, Human
auucuguaggcuuuuguuaaaa

SEQ ID NO: 293675 - RNA, 22 nt, Human
auucuacucuccuacaggucua

SEQ ID NO: 293676 - RNA, 22 nt, Human
auucuuuucucuaaaugaugaa

SEQ ID NO: 293677 - RNA, 22 nt, Human
auucuuuagaguccuucaaaua

SEQ ID NO: 293678 - RNA, 19 nt, Human
auucuucucuuccugcugu

SEQ ID NO: 293679 - RNA, 22 nt, Human
auucuugauauagauaguuaau

SEQ ID NO: 293680 - RNA, 22 nt, Human
auucucauguuaccaaauucua

SEQ ID NO: 293681 - RNA, 20 nt, Human
auucucaccaugugacaugg

SEQ ID NO: 293682 - RNA, 22 nt, Human
auugaaauuugcuuccucacug

SEQ ID NO: 293683 - RNA, 22 nt, Human
auucuaugaaugacuguuagau

SEQ ID NO: 293684 - RNA, 22 nt, Human
auugaagcauggagaugaggca

SEQ ID NO: 293685 - RNA, 22 nt, Human
auugacagagguguaguugaga

SEQ ID NO: 293686 - RNA, 22 nt, Human
auugaauuagauguuguagucc

SEQ ID NO: 293687 - RNA, 22 nt, Human
auugaguucaccucuuucagaa

SEQ ID NO: 293688 - RNA, 18 nt, Human
auugagcaugacagaccu

SEQ ID NO: 293689 - RNA, 22 nt, Human
auugcaggucguguggaaguga

SEQ ID NO: 293690 - RNA, 19 nt, Human
auugcaguguaaaacuauu

SEQ ID NO: 293691 - RNA, 22 nt, Human
auugauuuugugcuuuccuacg

SEQ ID NO: 293692 - RNA, 22 nt, Human
auucuucauguugaagcuguca

SEQ ID NO: 293693 - RNA, 23 nt, Human
auugccuguagaucuucacuuuc

SEQ ID NO: 293694 - RNA, 22 nt, Human
auuggaagacgcuggaggcacu

SEQ ID NO: 293695 - RNA, 22 nt, Human
auugagaaaauucgagcaaguu

SEQ ID NO: 293696 - RNA, 22 nt, Human
auucuuacaaagcagagucugu

SEQ ID NO: 293697 - RNA, 22 nt, Human
auugagaugcuuaaaucuucac

SEQ ID NO: 293698 - RNA, 22 nt, Human
auucuguuuaauacacgaaagg

SEQ ID NO: 293699 - RNA, 22 nt, Human
auucugaagcagaaaaggcaga

SEQ ID NO: 293700 - RNA, 22 nt, Human
auucugagaucucuucuaggcc

SEQ ID NO: 293701 - RNA, 21 nt, Human
auucugaguugucagucuuca

SEQ ID NO: 293702 - RNA, 22 nt, Human
auucucugaugcagguggaaga

SEQ ID NO: 293703 - RNA, 22 nt, Human
auucucuguacagaagguaccg

SEQ ID NO: 293704 - RNA, 22 nt, Human
auucugcaauaaucaguccuua

SEQ ID NO: 293705 - RNA, 22 nt, Human
auucugcugccuaguuuaugaa

SEQ ID NO: 293706 - RNA, 22 nt, Human
uuuguggaaaagagcccaggag

SEQ ID NO: 293707 - RNA, 17 nt, Human
uuugugauggcagaugc

SEQ ID NO: 293708 - RNA, 22 nt, Human
uuucuguuuguaacuccagcaa

SEQ ID NO: 293709 - RNA, 22 nt, Human
uuucuuccuucuugaucauuug

SEQ ID NO: 293710 - RNA, 22 nt, Human
uuucuugggaaaugucagaagu

SEQ ID NO: 293711 - RNA, 22 nt, Human
uuucuugugauuuugaugaacu

SEQ ID NO: 293712 - RNA, 22 nt, Human
uuucuuugcugguuggcucucc

SEQ ID NO: 293713 - RNA, 22 nt, Human
uuucugaugaaguagaaagacc

SEQ ID NO: 293714 - RNA, 23 nt, Human
uuucugaguuuuuuaaaagucca

SEQ ID NO: 293715 - RNA, 17 nt, Human
uuucugcaugauuggac

SEQ ID NO: 293716 - RNA, 22 nt, Human
uuucugcauuuguauuggaaaa

SEQ ID NO: 293717 - RNA, 22 nt, Human
uuucugcuuucuaguugguguu

SEQ ID NO: 293718 - RNA, 22 nt, Human
uuucuggaaacuguaaagagga

SEQ ID NO: 293719 - RNA, 22 nt, Human
uuucucuuguauuugaaucacu

SEQ ID NO: 293720 - RNA, 22 nt, Human
uuucucuuucaaucugcaguac

SEQ ID NO: 293721 - RNA, 22 nt, Human
uuucugagccacauauaauuug

SEQ ID NO: 293722 - RNA, 22 nt, Human
uuucgggauuucaaagagcaaa

SEQ ID NO: 293723 - RNA, 22 nt, Human
uuucgcuuguucggagugcuuu

SEQ ID NO: 293724 - RNA, 22 nt, Human
uuuccugcagacaguuuaagca

SEQ ID NO: 293725 - RNA, 22 nt, Human
uuucuacauuuguaaccagauu

SEQ ID NO: 293726 - RNA, 22 nt, Human
uuucuaguauauaacuagaucu

SEQ ID NO: 293727 - RNA, 22 nt, Human
uuucuauauucaguuucauaaa

SEQ ID NO: 293728 - RNA, 22 nt, Human
uuucguugcacucauaugguug

SEQ ID NO: 293729 - RNA, 22 nt, Human
uuucagguggaaguuuuagaug

SEQ ID NO: 293730 - RNA, 22 nt, Human
uuucagauuauguucauggguu

SEQ ID NO: 293731 - RNA, 22 nt, Human
uuucaugauuaacuuagugaau

SEQ ID NO: 293732 - RNA, 16 nt, Human
uuucacucuagaggua

SEQ ID NO: 293733 - RNA, 22 nt, Human
uuuccuaggaaaugauugaagu

SEQ ID NO: 293734 - RNA, 22 nt, Human
uuuccaguuguucuagaaagcu

SEQ ID NO: 293735 - RNA, 22 nt, Human
uuucauguuggauacuguuuca

SEQ ID NO: 293736 - RNA, 22 nt, Human
uuuccacacucacugcacucau

SEQ ID NO: 293737 - RNA, 18 nt, Human
uuugggauccucuuuucu

SEQ ID NO: 293738 - RNA, 23 nt, Human
uuugggaaauagccuauaggcac

SEQ ID NO: 293739 - RNA, 22 nt, Human
uuuggcugucauuugaaaaugu

SEQ ID NO: 293740 - RNA, 22 nt, Human
uuuggcuccccaggaucugaaa

SEQ ID NO: 293741 - RNA, 22 nt, Human
uuugggcauuuuuaaggaucuu

SEQ ID NO: 293742 - RNA, 22 nt, Human
uuugggccugucugccugcuuu

SEQ ID NO: 293743 - RNA, 22 nt, Human
uuugggcuuuguuuuaagguau

SEQ ID NO: 293744 - RNA, 22 nt, Human
uuugcuuugacuuugggaguau

SEQ ID NO: 293745 - RNA, 22 nt, Human
uuuggcaagcagaugaagguag

SEQ ID NO: 293746 - RNA, 22 nt, Human
uuuggcgucucucaggagcuca

SEQ ID NO: 293747 - RNA, 22 nt, Human
uuuggcaccuccaaggacucgc

SEQ ID NO: 293748 - RNA, 22 nt, Human
uuuggccauuuguaugcaugau

SEQ ID NO: 293749 - RNA, 22 nt, Human
uuugucaggaauugaaaaguuu

SEQ ID NO: 293750 - RNA, 20 nt, Human
uuugucaacugcauccagca

SEQ ID NO: 293751 - RNA, 22 nt, Human
uuuguauuguuuauuucauuuu

SEQ ID NO: 293752 - RNA, 22 nt, Human
uuugucaucuuccauauuugca

SEQ ID NO: 293753 - RNA, 20 nt, Human
uuugugaggccagagaacag

SEQ ID NO: 293754 - RNA, 22 nt, Human
uuugguguuuucaggaauauac

SEQ ID NO: 293755 - RNA, 19 nt, Human
uuugguaggcuugagggaa

SEQ ID NO: 293756 - RNA, 22 nt, Human
uuuggucaucaaagacaaguaa

SEQ ID NO: 293757 - RNA, 22 nt, Human
uuuggucuggaaucuucagggu

SEQ ID NO: 293758 - RNA, 22 nt, Human
uuuggguauuaguuuagcuaga

SEQ ID NO: 293759 - RNA, 22 nt, Human
uuugauauaaaggcuugggcug

SEQ ID NO: 293760 - RNA, 22 nt, Human
uuugauuaccuggggcccucug

SEQ ID NO: 293761 - RNA, 22 nt, Human
uuugauuuuuugagcaguguau

SEQ ID NO: 293762 - RNA, 22 nt, Human
uuugcacuuaaauuuacaacac

SEQ ID NO: 293763 - RNA, 22 nt, Human
uuugcugaaaaaccacuugagu

SEQ ID NO: 293764 - RNA, 22 nt, Human
uuugcuccucuucauuuguauc

SEQ ID NO: 293765 - RNA, 22 nt, Human
uuugcuguaaugcaugucagag

SEQ ID NO: 293766 - RNA, 22 nt, Human
uuugccggaucugucuccagcu

SEQ ID NO: 293767 - RNA, 22 nt, Human
uuugcauuugagagaggaaaca

SEQ ID NO: 293768 - RNA, 23 nt, Human
uuugccuaaugaagacuauguca

SEQ ID NO: 293769 - RNA, 22 nt, Human
uuugaauauuaugucccacuuu

SEQ ID NO: 293770 - RNA, 22 nt, Human
uuugacaccaggagagaaaaca

SEQ ID NO: 293771 - RNA, 21 nt, Human
uuugacagaccagguauaguu

SEQ ID NO: 293772 - RNA, 22 nt, Human
uuugaagauaaauauggagaaa

SEQ ID NO: 293773 - RNA, 22 nt, Human
uuugaauauacuucaaacaaag

SEQ ID NO: 293774 - RNA, 22 nt, Human
uuugaagaccuuaucucuaaau

SEQ ID NO: 293775 - RNA, 22 nt, Human
uuugagguuuagcucacuauuu

SEQ ID NO: 293776 - RNA, 22 nt, Human
uuugaguaagauguugauacug

SEQ ID NO: 293777 - RNA, 22 nt, Human
uuugagugccucgaguguggga

SEQ ID NO: 293778 - RNA, 22 nt, Human
uuugagugcccauguuucccag

SEQ ID NO: 293779 - RNA, 22 nt, Human
uuugaugauuuucuagagugua

SEQ ID NO: 293780 - RNA, 22 nt, Human
uuugaugagaaaugacuuaagu

SEQ ID NO: 293781 - RNA, 20 nt, Human
uuguuagguucaguguuucc

SEQ ID NO: 293782 - RNA, 22 nt, Human
uuguuccuaguuguccaucaca

SEQ ID NO: 293783 - RNA, 22 nt, Human
uuguucacuaugaagagguugg

SEQ ID NO: 293784 - RNA, 22 nt, Human
uuuacaagucuguugaucccaa

SEQ ID NO: 293785 - RNA, 22 nt, Human
uuuaccugucuguagaacauaa

SEQ ID NO: 293786 - RNA, 22 nt, Human
uuuacaaggcaguuauuuuccu

SEQ ID NO: 293787 - RNA, 22 nt, Human
uuuaauuauaucugggcaguua

SEQ ID NO: 293788 - RNA, 19 nt, Human
uuuaaugugugcugcaauc

SEQ ID NO: 293789 - RNA, 22 nt, Human
uuuaguauaguaugugcucaaa

SEQ ID NO: 293790 - RNA, 22 nt, Human
uuuagguuguguucuggcaugu

SEQ ID NO: 293791 - RNA, 22 nt, Human
uuuagcugugugugucgcucca

SEQ ID NO: 293792 - RNA, 22 nt, Human
uuuacuaauuaguuuuggaaca

SEQ ID NO: 293793 - RNA, 22 nt, Human
uuuagcaaaaaagcucugcgua

SEQ ID NO: 293794 - RNA, 22 nt, Human
uuuagcaaggagaaauaauccu

SEQ ID NO: 293795 - RNA, 22 nt, Human
uuuagcaguuuauuuaaggggg

SEQ ID NO: 293796 - RNA, 22 nt, Human
uuuauaauuacguaaaauauuu

SEQ ID NO: 293797 - RNA, 22 nt, Human
uuuauaauuguuauguuaccca

SEQ ID NO: 293798 - RNA, 22 nt, Human
uuuaucucugcauagaagugau

SEQ ID NO: 293799 - RNA, 22 nt, Human
uuuauccacucauccaugccuc

SEQ ID NO: 293800 - RNA, 22 nt, Human
uuuaucaucuucugaauuugga

SEQ ID NO: 293801 - RNA, 22 nt, Human
uuuauguugagcaaaauaccac

SEQ ID NO: 293802 - RNA, 22 nt, Human
uuuauuuacuuucgguucugcu

SEQ ID NO: 293803 - RNA, 22 nt, Human
uuuauuugggauuucucaucug

SEQ ID NO: 293804 - RNA, 22 nt, Human
uuuauuuggugguguuacuguu

SEQ ID NO: 293805 - RNA, 19 nt, Human
uuuauuugagacaugccuu

SEQ ID NO: 293806 - RNA, 22 nt, Human
uuucacuucgaucagaguuuuu

SEQ ID NO: 293807 - RNA, 22 nt, Human
uugucaguggccugaggacaga

SEQ ID NO: 293808 - RNA, 22 nt, Human
uugucagcuagugaugcuguuc

SEQ ID NO: 293809 - RNA, 22 nt, Human
uugguugaaauguguucaugcu

SEQ ID NO: 293810 - RNA, 22 nt, Human
uuguauguuucugugcacauga

SEQ ID NO: 293811 - RNA, 22 nt, Human
uugugcucaguuguggucuauu

SEQ ID NO: 293812 - RNA, 22 nt, Human
uuguggagaggaagcaaggagg

SEQ ID NO: 293813 - RNA, 22 nt, Human
uugugccuuaauauaggcgcug

SEQ ID NO: 293814 - RNA, 18 nt, Human
uugugccugagaaggugg

SEQ ID NO: 293815 - RNA, 22 nt, Human
uugugacuauuuuucauugaag

SEQ ID NO: 293816 - RNA, 20 nt, Human
uuggggacaggagugugaug

SEQ ID NO: 293817 - RNA, 22 nt, Human
uuggggaaaaagaccuaaugac

SEQ ID NO: 293818 - RNA, 22 nt, Human
uuggggagaagagcuggucagg

SEQ ID NO: 293819 - RNA, 22 nt, Human
uuggggaugccccuacgggcua

SEQ ID NO: 293820 - RNA, 22 nt, Human
uuggugauugggaauggauggg

SEQ ID NO: 293821 - RNA, 22 nt, Human
uuguaauaguguuuuacguugu

SEQ ID NO: 293822 - RNA, 22 nt, Human
uuguaaguuuuagguguuucaa

SEQ ID NO: 293823 - RNA, 22 nt, Human
uugguuuacucuggggauaucu

SEQ ID NO: 293824 - RNA, 22 nt, Human
uugggagaaaguuaacuuucua

SEQ ID NO: 293825 - RNA, 22 nt, Human
uuggccuuacgcauggucggca

SEQ ID NO: 293826 - RNA, 22 nt, Human
uuggccuaggcacaggcaggug

SEQ ID NO: 293827 - RNA, 22 nt, Human
uuggcgcuauuauuaccacauu

SEQ ID NO: 293828 - RNA, 22 nt, Human
uuggcguuuccuguucugggug

SEQ ID NO: 293829 - RNA, 22 nt, Human
uuggcuuuucaguuuuaaguua

SEQ ID NO: 293830 - RNA, 22 nt, Human
uuggccauuacugagccuggag

SEQ ID NO: 293831 - RNA, 22 nt, Human
uuggauugugaaaguauucucu

SEQ ID NO: 293832 - RNA, 22 nt, Human
uuggauguccucuguggaguau

SEQ ID NO: 293833 - RNA, 22 nt, Human
uugaguuuacauuguauuagcc

SEQ ID NO: 293834 - RNA, 22 nt, Human
uuggaguucuucaugcucugua

SEQ ID NO: 293835 - RNA, 22 nt, Human
uuggaggcagagucuugcugag

SEQ ID NO: 293836 - RNA, 22 nt, Human
uugauuccagcguuccaucagc

SEQ ID NO: 293837 - RNA, 23 nt, Human
uugaucuggaaaauacuuguuug

SEQ ID NO: 293838 - RNA, 22 nt, Human
uugauuugcagaagguguagag

SEQ ID NO: 293839 - RNA, 22 nt, Human
uugaccauguggcccaggccaa

SEQ ID NO: 293840 - RNA, 22 nt, Human
uugacacauuagagcuuguaaa

SEQ ID NO: 293841 - RNA, 22 nt, Human
uuuuuugucuugaagaaauggu

SEQ ID NO: 293842 - RNA, 22 nt, Human
uugagaugacuuaaaucacugu

SEQ ID NO: 293843 - RNA, 22 nt, Human
uugacucuuucauuuauuauuu

SEQ ID NO: 293844 - RNA, 22 nt, Human
uugagauuuggagguaauuccc

SEQ ID NO: 293845 - RNA, 22 nt, Human
uugagcagccauuagcuggggu

SEQ ID NO: 293846 - RNA, 21 nt, Human
uugagcuuuuaguacagacag

SEQ ID NO: 293847 - RNA, 22 nt, Human
uugagauggccuuuuuuauacu

SEQ ID NO: 293848 - RNA, 22 nt, Human
uuuuuuuagaaagaucauaguu

SEQ ID NO: 293849 - RNA, 22 nt, Human
uugaugacauuuagcauaauug

SEQ ID NO: 293850 - RNA, 22 nt, Human
uugaaggugggaggauuuauau

SEQ ID NO: 293851 - RNA, 22 nt, Human
uuuuugggccaaauauauuuac

SEQ ID NO: 293852 - RNA, 22 nt, Human
uugaaaucuucccuccugucug

SEQ ID NO: 293853 - RNA, 22 nt, Human
uuuuuguuauuuagguguagag

SEQ ID NO: 293854 - RNA, 22 nt, Human
uugaauaguuuuggauagcaua

SEQ ID NO: 293855 - RNA, 22 nt, Human
uugaauaaggcauaaagauacu

SEQ ID NO: 293856 - RNA, 22 nt, Human
uuuuuuaaucaaguaggaaaca

SEQ ID NO: 293857 - RNA, 22 nt, Human
uucuugcuucucugucugccuc

SEQ ID NO: 293858 - RNA, 22 nt, Human
uucuuggcacagaugagauucu

SEQ ID NO: 293859 - RNA, 22 nt, Human
uucuugagaacaaauuccugga

SEQ ID NO: 293860 - RNA, 23 nt, Human
uucuuuccuuaucccauuuacuu

SEQ ID NO: 293861 - RNA, 22 nt, Human
uuuugucuguggaaagcugcua

SEQ ID NO: 293862 - RNA, 22 nt, Human
uuuugguaguccagaguuuagu

SEQ ID NO: 293863 - RNA, 22 nt, Human
uucuuugcucaccugccgcucc

SEQ ID NO: 293864 - RNA, 22 nt, Human
uucuuuguccuagcauucuaca

SEQ ID NO: 293865 - RNA, 22 nt, Human
uuuuucuuugcuuuccacuggc

SEQ ID NO: 293866 - RNA, 22 nt, Human
uuuuucuuugguaacucuuccu

SEQ ID NO: 293867 - RNA, 22 nt, Human
uuuuugaauaagugcaucauca

SEQ ID NO: 293868 - RNA, 22 nt, Human
uuuuucugccucucucccacau

SEQ ID NO: 293869 - RNA, 22 nt, Human
uucuuuuaauagagauccugug

SEQ ID NO: 293870 - RNA, 22 nt, Human
uuuuugcccuaaagaagucauu

SEQ ID NO: 293871 - RNA, 22 nt, Human
uucuuuucuucccuguuuauua

SEQ ID NO: 293872 - RNA, 22 nt, Human
uugaaaaaaucugaggaggacc

SEQ ID NO: 293873 - RNA, 22 nt, Human
uucuuuuuagcugguuguaaga

SEQ ID NO: 293874 - RNA, 22 nt, Human
uuuucuucucauucugaccuca

SEQ ID NO: 293875 - RNA, 22 nt, Human
uuuucuugagucacuccaguga

SEQ ID NO: 293876 - RNA, 22 nt, Human
uuuucuucggugcuggguugau

SEQ ID NO: 293877 - RNA, 22 nt, Human
uuuucucucacuucacauauuu

SEQ ID NO: 293878 - RNA, 22 nt, Human
uuuucugauccuucuaacuuga

SEQ ID NO: 293879 - RNA, 22 nt, Human
uuuucuacaaucacucuggaag

SEQ ID NO: 293880 - RNA, 22 nt, Human
uucugagguagccacucacugg

SEQ ID NO: 293881 - RNA, 22 nt, Human
uuuuccuucuuccugccuugcc

SEQ ID NO: 293882 - RNA, 22 nt, Human
uucuuauuuuucguaaauccug

SEQ ID NO: 293883 - RNA, 22 nt, Human
uuuugguauggcuugauagagu

SEQ ID NO: 293884 - RNA, 22 nt, Human
uucuguucuuuguccccuuggu

SEQ ID NO: 293885 - RNA, 22 nt, Human
uuuugcuucuaguauauuuuuu

SEQ ID NO: 293886 - RNA, 22 nt, Human
uucuguuuauaauuugcaguug

SEQ ID NO: 293887 - RNA, 22 nt, Human
uucugucaguguugguggaaau

SEQ ID NO: 293888 - RNA, 22 nt, Human
uuuugagucuggcaguuuuguu

SEQ ID NO: 293889 - RNA, 22 nt, Human
uucugugacgcaaagcugggaa

SEQ ID NO: 293890 - RNA, 22 nt, Human
uuuugaauaauucagaaacagc

SEQ ID NO: 293891 - RNA, 22 nt, Human
uuuugaugaccauucuucuuuu

SEQ ID NO: 293892 - RNA, 22 nt, Human
uucggugagcugcgggcgagga

SEQ ID NO: 293893 - RNA, 22 nt, Human
uuuuaauucaacauuugcuuuu

SEQ ID NO: 293894 - RNA, 22 nt, Human
uucuagaagggccuaggcauaa

SEQ ID NO: 293895 - RNA, 22 nt, Human
uucuaguuacucuuaaaugcug

SEQ ID NO: 293896 - RNA, 22 nt, Human
uuuucacugacuuggucuggaa

SEQ ID NO: 293897 - RNA, 22 nt, Human
uucuauaagagaugaauacagu

SEQ ID NO: 293898 - RNA, 22 nt, Human
uuuuauaauacccuugacuaau

SEQ ID NO: 293899 - RNA, 22 nt, Human
uuuuccuuccugucucuuuauu

SEQ ID NO: 293900 - RNA, 22 nt, Human
uuuuccuuagaaauacauugau

SEQ ID NO: 293901 - RNA, 22 nt, Human
uuccuuuucuucuaccacaugu

SEQ ID NO: 293902 - RNA, 22 nt, Human
uucgcggccaggcggggaggcc

SEQ ID NO: 293903 - RNA, 22 nt, Human
uuccuuuuuaauuaaucuaauu

SEQ ID NO: 293904 - RNA, 22 nt, Human
uuuuaaauggcuuuuacuuuuc

SEQ ID NO: 293905 - RNA, 22 nt, Human
uuuuaaauaaacuacacugauu

SEQ ID NO: 293906 - RNA, 22 nt, Human
uuuuaacuuuggguucucuuua

SEQ ID NO: 293907 - RNA, 22 nt, Human
uuuguugucuucauaauacuuu

SEQ ID NO: 293908 - RNA, 20 nt, Human
uuccucaaaagucugaugcu

SEQ ID NO: 293909 - RNA, 22 nt, Human
uuccugacacuggcaggcuucu

SEQ ID NO: 293910 - RNA, 22 nt, Human
uuccucauuuuguuaauuuuac

SEQ ID NO: 293911 - RNA, 22 nt, Human
uuccucauuuauaggaaagaga

SEQ ID NO: 293912 - RNA, 22 nt, Human
uuuguuuuggugucaugcguga

SEQ ID NO: 293913 - RNA, 22 nt, Human
uuccugcuggucaaaguugccu

SEQ ID NO: 293914 - RNA, 22 nt, Human
uuuuaaaacaugucaaaaugug

SEQ ID NO: 293915 - RNA, 22 nt, Human
uuuguuuauuuacuuugggccu

SEQ ID NO: 293916 - RNA, 22 nt, Human
uuuguuugcuaguauuuuguuu

SEQ ID NO: 293917 - RNA, 22 nt, Human
uucaugcaagagugugaggucc

SEQ ID NO: 293918 - RNA, 22 nt, Human
uucaugucuuugauucugauaa

SEQ ID NO: 293919 - RNA, 22 nt, Human
uucauuauuaauaauagcagcu

SEQ ID NO: 293920 - RNA, 19 nt, Human
uuccacugcuuagcauugc

SEQ ID NO: 293921 - RNA, 22 nt, Human
uuccauuacuaaugccugcaau

SEQ ID NO: 293922 - RNA, 22 nt, Human
uuccauuccauaucagguacag

SEQ ID NO: 293923 - RNA, 22 nt, Human
uuccaugccuaagagccugaag

SEQ ID NO: 293924 - RNA, 22 nt, Human
uuuguucaccuagcaaacuuuu

SEQ ID NO: 293925 - RNA, 21 nt, Human
uuuguucaggggcaaaguuaa

SEQ ID NO: 293926 - RNA, 22 nt, Human
uuuguucaguuuguugugggug

SEQ ID NO: 293927 - RNA, 22 nt, Human
uucccuagagagauuuuuauuc

SEQ ID NO: 293928 - RNA, 23 nt, Human
uuuguugguuuaagaguagcaga

SEQ ID NO: 293929 - RNA, 22 nt, Human
uuuguugguugcacuggugggu

SEQ ID NO: 293930 - RNA, 19 nt, Human
uuuguuguaucagagcuuu

SEQ ID NO: 293931 - RNA, 22 nt, Human
uuuguugaauggcaggauuuua

SEQ ID NO: 293932 - RNA, 22 nt, Human
uuuggcuacucuucauugguga

SEQ ID NO: 293933 - RNA, 22 nt, Human
uucaggaaacaaauuugcaguu

SEQ ID NO: 293934 - RNA, 22 nt, Human
uucauacuguuuaaguucuguu

SEQ ID NO: 293935 - RNA, 22 nt, Human
uucauauuuaauuggucaucaa

SEQ ID NO: 293936 - RNA, 22 nt, Human
uucauaugaauuggguuuuuuu

SEQ ID NO: 293937 - RNA, 22 nt, Human
uuugccccacaggcagcuuugg

SEQ ID NO: 293938 - RNA, 22 nt, Human
uucagaugcuugauuauggcaa

SEQ ID NO: 293939 - RNA, 22 nt, Human
uucagcauaggcugcucuucaa

SEQ ID NO: 293940 - RNA, 22 nt, Human
uucagcauggcuguuuucccuu

SEQ ID NO: 293941 - RNA, 23 nt, Human
uucagcucuccugaagcaucugu

SEQ ID NO: 293942 - RNA, 22 nt, Human
uuugcuguccaauauucagggu

SEQ ID NO: 293943 - RNA, 22 nt, Human
uuugcugggaagccuucacucu

SEQ ID NO: 293944 - RNA, 19 nt, Human
uuugccugugguucagaag

SEQ ID NO: 293945 - RNA, 22 nt, Human
uucacaauuuuaaaaaguggaa

SEQ ID NO: 293946 - RNA, 21 nt, Human
uucaaguucacacucaaaggu

SEQ ID NO: 293947 - RNA, 22 nt, Human
uuuauucacuuaucaggaacga

SEQ ID NO: 293948 - RNA, 22 nt, Human
uuaguccuaaauuuagauuuuc

SEQ ID NO: 293949 - RNA, 22 nt, Human
uucacauucauuucuuauguuu

SEQ ID NO: 293950 - RNA, 23 nt, Human
uucaccaaugcuguccaaguacc

SEQ ID NO: 293951 - RNA, 22 nt, Human
uucacucagagcaggacagccc

SEQ ID NO: 293952 - RNA, 22 nt, Human
uucacguuguugaagaaaauac

SEQ ID NO: 293953 - RNA, 22 nt, Human
uuugccaucagaugugguaggu

SEQ ID NO: 293954 - RNA, 22 nt, Human
uucagaauguacugauagaaca

SEQ ID NO: 293955 - RNA, 19 nt, Human
uugguuuguugcuuaggug

SEQ ID NO: 293956 - RNA, 22 nt, Human
uugguugcugaugagcuuugag

SEQ ID NO: 293957 - RNA, 22 nt, Human
uugguauucaguuggauuugga

SEQ ID NO: 293958 - RNA, 22 nt, Human
uugggucagcuuucagguagua

SEQ ID NO: 293959 - RNA, 22 nt, Human
uugggucaugggaucccagcau

SEQ ID NO: 293960 - RNA, 22 nt, Human
uguugaugaccacaauuuaugc

SEQ ID NO: 293961 - RNA, 22 nt, Human
uuggguguugguuccugggagg

SEQ ID NO: 293962 - RNA, 22 nt, Human
uuggggauugggugcaagggac

SEQ ID NO: 293963 - RNA, 22 nt, Human
uuggguaacuucccagaggguc

SEQ ID NO: 293964 - RNA, 22 nt, Human
uuggggcugcguauuuccaugu

SEQ ID NO: 293965 - RNA, 22 nt, Human
uguuuagcucugacuaugugau

SEQ ID NO: 293966 - RNA, 22 nt, Human
uugguuuuuugguguaucuuau

SEQ ID NO: 293967 - RNA, 22 nt, Human
uugguuuuauucguauuuguau

SEQ ID NO: 293968 - RNA, 22 nt, Human
uguuguuguuguuguuguuguu

SEQ ID NO: 293969 - RNA, 22 nt, Human
uguuguucuuuuucuucuuguu

SEQ ID NO: 293970 - RNA, 22 nt, Human
uguuuaaauagaacauacugca

SEQ ID NO: 293971 - RNA, 22 nt, Human
uuguauuguuugcgucuguguu

SEQ ID NO: 293972 - RNA, 22 nt, Human
uugucaagauauuuuaggaggc

SEQ ID NO: 293973 - RNA, 22 nt, Human
uugucaggaacuaugauuaugc

SEQ ID NO: 293974 - RNA, 22 nt, Human
uuguauuaauacacuccuuuuc

SEQ ID NO: 293975 - RNA, 22 nt, Human
uuguaugcugggaagcgggagg

SEQ ID NO: 293976 - RNA, 22 nt, Human
uguuuuucaagcauuuauuaau

SEQ ID NO: 293977 - RNA, 22 nt, Human
uguuuuuucccccccuucuaaa

SEQ ID NO: 293978 - RNA, 22 nt, Human
uuaaaagaauccuguuauccuc

SEQ ID NO: 293979 - RNA, 23 nt, Human
uugugguuauauuugcccauuuu

SEQ ID NO: 293980 - RNA, 22 nt, Human
uuguggcaggauggacagcaga

SEQ ID NO: 293981 - RNA, 22 nt, Human
uugugcagugccuggacccagg

SEQ ID NO: 293982 - RNA, 22 nt, Human
uugugcauuugcuaugggccau

SEQ ID NO: 293983 - RNA, 23 nt, Human
uugugcggugcuuuggguuuaca

SEQ ID NO: 293984 - RNA, 22 nt, Human
uguuuguuuuguauuuuuaauu

SEQ ID NO: 293985 - RNA, 22 nt, Human
uguuuucaucucucacccagaa

SEQ ID NO: 293986 - RNA, 22 nt, Human
uugucaugauccuucuguuagg

SEQ ID NO: 293987 - RNA, 22 nt, Human
uugucuuggcauaccguuauau

SEQ ID NO: 293988 - RNA, 22 nt, Human
uugucuguacuggcugcaucga

SEQ ID NO: 293989 - RNA, 19 nt, Human
uugucuuagcugcauaaga

SEQ ID NO: 293990 - RNA, 22 nt, Human
uguuauugccucaugagacucc

SEQ ID NO: 293991 - RNA, 21 nt, Human
uuggcuacugcuucagaggga

SEQ ID NO: 293992 - RNA, 22 nt, Human
uguuccucuuagucuuaugugu

SEQ ID NO: 293993 - RNA, 22 nt, Human
uguuacugaaugucucugcuuu

SEQ ID NO: 293994 - RNA, 22 nt, Human
uguucugauggauuacaugucu

SEQ ID NO: 293995 - RNA, 20 nt, Human
uugggaagccuacaccauuc

SEQ ID NO: 293996 - RNA, 19 nt, Human
uguucuacuugcuaguauu

SEQ ID NO: 293997 - RNA, 22 nt, Human
uuggcaaagagaugcauaagga

SEQ ID NO: 293998 - RNA, 22 nt, Human
uuggauguggggauggaguggg

SEQ ID NO: 293999 - RNA, 22 nt, Human
uuggcaaaagauuggguacuua

SEQ ID NO: 294000 - RNA, 22 nt, Human
uguguuagguuuugggauggcu

SEQ ID NO: 294001 - RNA, 22 nt, Human
uuggcaaaaauacuguaggccu

SEQ ID NO: 294002 - RNA, 22 nt, Human
uguguuacaauaauggcaagua

SEQ ID NO: 294003 - RNA, 22 nt, Human
uguguucuuugcuuaauuaaag

SEQ ID NO: 294004 - RNA, 22 nt, Human
uuggcaggcugcauguuuaugu

SEQ ID NO: 294005 - RNA, 22 nt, Human
uuggcauuccagaugcuuuucu

SEQ ID NO: 294006 - RNA, 21 nt, Human
uguguuuauauguguuuauau

SEQ ID NO: 294007 - RNA, 22 nt, Human
uguguuguuggggauguuuuca

SEQ ID NO: 294008 - RNA, 22 nt, Human
uugcggauguccacgucacacu

SEQ ID NO: 294009 - RNA, 22 nt, Human
uugccuguuugagagcuguguu

SEQ ID NO: 294010 - RNA, 22 nt, Human
uguguauguauguauguaugua

SEQ ID NO: 294011 - RNA, 19 nt, Human
uguguaccuaauguuugug

SEQ ID NO: 294012 - RNA, 22 nt, Human
uguguacggugcacacacacag

SEQ ID NO: 294013 - RNA, 22 nt, Human
uuggacugggauggccgaggcu

SEQ ID NO: 294014 - RNA, 19 nt, Human
uuggacuaugaaaaaucag

SEQ ID NO: 294015 - RNA, 22 nt, Human
uuggacugguuuacauuucaag

SEQ ID NO: 294016 - RNA, 17 nt, Human
uguguauucuccaggug

SEQ ID NO: 294017 - RNA, 22 nt, Human
uguguguguccucauuugcaga

SEQ ID NO: 294018 - RNA, 22 nt, Human
uuaaucagacauucucaaguuu

SEQ ID NO: 294019 - RNA, 22 nt, Human
uuaauaaggaccugugacaugc

SEQ ID NO: 294020 - RNA, 22 nt, Human
uuaauacugugucuuuuuuaau

SEQ ID NO: 294021 - RNA, 22 nt, Human
uuguuuucuugaugaaauuauu

SEQ ID NO: 294022 - RNA, 22 nt, Human
uuguuuucuaguguuuugaaua

SEQ ID NO: 294023 - RNA, 22 nt, Human
uuguuuuaguagaaguuacaug

SEQ ID NO: 294024 - RNA, 22 nt, Human
uuaaucuauuucauauaaggga

SEQ ID NO: 294025 - RNA, 22 nt, Human
uuaauguugacacacuagcaca

SEQ ID NO: 294026 - RNA, 22 nt, Human
uuuaaauuucugaaucuugagg

SEQ ID NO: 294027 - RNA, 22 nt, Human
uuaauucuugagcugucuuucc

SEQ ID NO: 294028 - RNA, 21 nt, Human
uuaaugcuaugcagaaaaucu

SEQ ID NO: 294029 - RNA, 22 nt, Human
uuuaaaauguuuuauuuauuua

SEQ ID NO: 294030 - RNA, 22 nt, Human
uuuaaaacaguacguuuucuua

SEQ ID NO: 294031 - RNA, 22 nt, Human
uuuaaauaguugguuuuuuugc

SEQ ID NO: 294032 - RNA, 22 nt, Human
uuguuucagcuuccuccuccau

SEQ ID NO: 294033 - RNA, 22 nt, Human
uuguuguuguuguuauuuaguu

SEQ ID NO: 294034 - RNA, 22 nt, Human
uuguugcaagccuggaaucugg

SEQ ID NO: 294035 - RNA, 22 nt, Human
uuguuuaaagaacuucugacuu

SEQ ID NO: 294036 - RNA, 22 nt, Human
uuguuuacuugagcugcacucu

SEQ ID NO: 294037 - RNA, 22 nt, Human
uuguugcuguugaacccugcug

SEQ ID NO: 294038 - RNA, 22 nt, Human
uuaaguccuugguaauuuucuu

SEQ ID NO: 294039 - RNA, 22 nt, Human
uuaaguauauccauuugacugg

SEQ ID NO: 294040 - RNA, 22 nt, Human
uuguuccagaaacccaggggaa

SEQ ID NO: 294041 - RNA, 22 nt, Human
uuguuauuauuauuuucguucu

SEQ ID NO: 294042 - RNA, 22 nt, Human
uuguguuuaaucuguuccacua

SEQ ID NO: 294043 - RNA, 22 nt, Human
uuguguugaagugguuagggcg

SEQ ID NO: 294044 - RNA, 22 nt, Human
uuguuauaggaucagugucacu

SEQ ID NO: 294045 - RNA, 22 nt, Human
uuaaagaguuuauuacuuguaa

SEQ ID NO: 294046 - RNA, 22 nt, Human
uuaaagguacuccuaagcgggg

SEQ ID NO: 294047 - RNA, 22 nt, Human
uuaacccagccauuuucaauuu

SEQ ID NO: 294048 - RNA, 22 nt, Human
uuaacauuguccuuagcagauu

SEQ ID NO: 294049 - RNA, 22 nt, Human
uuaagagaagaguaucuagaac

SEQ ID NO: 294050 - RNA, 23 nt, Human
uuaagacuggcugaacuuaguag

SEQ ID NO: 294051 - RNA, 22 nt, Human
uuaaggcuguggggauuacugc

SEQ ID NO: 294052 - RNA, 22 nt, Human
uuuaccuuauguaaauaagagu

SEQ ID NO: 294053 - RNA, 22 nt, Human
uuuaccucguuguguccuuguu

SEQ ID NO: 294054 - RNA, 22 nt, Human
uuaccuuggaccggguaucaga

SEQ ID NO: 294055 - RNA, 22 nt, Human
uuuaaugucuuggaaaaagacu

SEQ ID NO: 294056 - RNA, 22 nt, Human
uuaccuuuucuuguuuacaagu

SEQ ID NO: 294057 - RNA, 22 nt, Human
uuacuuaucugaugugauuuuu

SEQ ID NO: 294058 - RNA, 22 nt, Human
uuuacuuuugguaaggucauuu

SEQ ID NO: 294059 - RNA, 22 nt, Human
uuuagaaugaaugcaagagaau

SEQ ID NO: 294060 - RNA, 20 nt, Human
uuuaacuggccuucuggcuc

SEQ ID NO: 294061 - RNA, 22 nt, Human
uuuaacauaugaaagaauauuu

SEQ ID NO: 294062 - RNA, 22 nt, Human
uuuaagguacagcuagcagcau

SEQ ID NO: 294063 - RNA, 21 nt, Human
uuaauugagggauggggguga

SEQ ID NO: 294064 - RNA, 22 nt, Human
uuuaauauuacacuuaccuugu

SEQ ID NO: 294065 - RNA, 22 nt, Human
uuaauuguuagauagauuauag

SEQ ID NO: 294066 - RNA, 22 nt, Human
uuacaacgcacacagauuucac

SEQ ID NO: 294067 - RNA, 22 nt, Human
uuacaguuuacauaagaauugu

SEQ ID NO: 294068 - RNA, 22 nt, Human
uuacaagaucuuugaaggcaag

SEQ ID NO: 294069 - RNA, 22 nt, Human
uuuaaucaguugguaauauuga

SEQ ID NO: 294070 - RNA, 22 nt, Human
uuuaaugaugucuaugccuguu

SEQ ID NO: 294071 - RNA, 22 nt, Human
uuacaucacuuuacuuaauaau

SEQ ID NO: 294072 - RNA, 22 nt, Human
uuuaaucaauaaccuccugggu

SEQ ID NO: 294073 - RNA, 22 nt, Human
uuagauaguaaauagcacuaag

SEQ ID NO: 294074 - RNA, 22 nt, Human
uuuaggugucugcucauugaag

SEQ ID NO: 294075 - RNA, 20 nt, Human
uuuagucauuuccuaggaaa

SEQ ID NO: 294076 - RNA, 17 nt, Human
uuagagcuacauguuga

SEQ ID NO: 294077 - RNA, 22 nt, Human
uuagaaaaaggcuguggucuua

SEQ ID NO: 294078 - RNA, 22 nt, Human
uuacuuucugggauaucaaaug

SEQ ID NO: 294079 - RNA, 22 nt, Human
uuuagaugcuguauguuauuuc

SEQ ID NO: 294080 - RNA, 22 nt, Human
uuuagauguucccucuacccug

SEQ ID NO: 294081 - RNA, 22 nt, Human
uuacuuacagggggucaggcug

SEQ ID NO: 294082 - RNA, 22 nt, Human
uuuagagguacaguaggcauga

SEQ ID NO: 294083 - RNA, 22 nt, Human
uuaggcuuuauugaaaacaaua

SEQ ID NO: 294084 - RNA, 22 nt, Human
uuaggcugcuuuggaaaacugu

SEQ ID NO: 294085 - RNA, 22 nt, Human
uuuaguugcuuuaguugagcug

SEQ ID NO: 294086 - RNA, 22 nt, Human
uuuauaaacacaagaugggcuc

SEQ ID NO: 294087 - RNA, 22 nt, Human
uuuagugagugugaaucaaaug

SEQ ID NO: 294088 - RNA, 22 nt, Human
uuuagugaagcuuugcauuuca

SEQ ID NO: 294089 - RNA, 22 nt, Human
uuuaugauguagccuagagcug

SEQ ID NO: 294090 - RNA, 22 nt, Human
uuuaugguacaggaaugcuguu

SEQ ID NO: 294091 - RNA, 22 nt, Human
uuuaugucaaaaguaaaaugaa

SEQ ID NO: 294092 - RNA, 22 nt, Human
uuuauguuuguuuuugaaauaa

SEQ ID NO: 294093 - RNA, 22 nt, Human
uuaguauuuuuugaaugaugaa

SEQ ID NO: 294094 - RNA, 19 nt, Human
uuaggguccauuuuuuuau

SEQ ID NO: 294095 - RNA, 22 nt, Human
uuagguuuaugaggucugcauu

SEQ ID NO: 294096 - RNA, 22 nt, Human
uuaguauuuucaccauaugagg

SEQ ID NO: 294097 - RNA, 22 nt, Human
uugaagaagucaaaagcugcag

SEQ ID NO: 294098 - RNA, 22 nt, Human
uguaguguauagaauuccagca

SEQ ID NO: 294099 - RNA, 22 nt, Human
uguagggaucugccucuuccuc

SEQ ID NO: 294100 - RNA, 22 nt, Human
uguagggaggaaggguuggaaa

SEQ ID NO: 294101 - RNA, 20 nt, Human
uugaaagucagggcuccagu

SEQ ID NO: 294102 - RNA, 17 nt, Human
uguaccgaguguguaua

SEQ ID NO: 294103 - RNA, 22 nt, Human
ugguugagguugacucuauaua

SEQ ID NO: 294104 - RNA, 22 nt, Human
ugguugauuaauuuugccaagc

SEQ ID NO: 294105 - RNA, 23 nt, Human
ugguuuucagaagaccuuguuag

SEQ ID NO: 294106 - RNA, 21 nt, Human
uucuuugcugcuguuuuugua

SEQ ID NO: 294107 - RNA, 22 nt, Human
uugaaaaaauguguuuaaggag

SEQ ID NO: 294108 - RNA, 22 nt, Human
uguaagaagaaaaccguaugga

SEQ ID NO: 294109 - RNA, 22 nt, Human
uguaaagugguauuuaauuuua

SEQ ID NO: 294110 - RNA, 22 nt, Human
uucuuuuaauuucugucugcag

SEQ ID NO: 294111 - RNA, 22 nt, Human
uggucuccucuuaauugccuac

SEQ ID NO: 294112 - RNA, 22 nt, Human
uggucugggaagaucacaauua

SEQ ID NO: 294113 - RNA, 22 nt, Human
uggugacaucuaccuagguaaa

SEQ ID NO: 294114 - RNA, 22 nt, Human
uggucuuuccuucauuguccag

SEQ ID NO: 294115 - RNA, 22 nt, Human
uucugugcugagaaauagagag

SEQ ID NO: 294116 - RNA, 22 nt, Human
uggugaggacccagauuuuccu

SEQ ID NO: 294117 - RNA, 22 nt, Human
uggugcacgugggcagucggcc

SEQ ID NO: 294118 - RNA, 22 nt, Human
uucuguuuuuauucuaucucug

SEQ ID NO: 294119 - RNA, 22 nt, Human
uggugcucucgauauauaaggc

SEQ ID NO: 294120 - RNA, 22 nt, Human
ugguucacaagaauccagguag

SEQ ID NO: 294121 - RNA, 22 nt, Human
ugguucuagaugagaugaugag

SEQ ID NO: 294122 - RNA, 20 nt, Human
ugguguccuaugcuugugcu

SEQ ID NO: 294123 - RNA, 22 nt, Human
uucuucuguuggcagagcauac

SEQ ID NO: 294124 - RNA, 22 nt, Human
uucuucuucuuccucauccuca

SEQ ID NO: 294125 - RNA, 22 nt, Human
uugcagugucaucuagacgugg

SEQ ID NO: 294126 - RNA, 22 nt, Human
uugcagcuguugcaaagucucu

SEQ ID NO: 294127 - RNA, 22 nt, Human
ugucuucauuccccaugaaguc

SEQ ID NO: 294128 - RNA, 22 nt, Human
ugugauugucuucugaaaguca

SEQ ID NO: 294129 - RNA, 22 nt, Human
uugcaucagcaggcauaauugg

SEQ ID NO: 294130 - RNA, 22 nt, Human
ugugccuucuucauuuaauuua

SEQ ID NO: 294131 - RNA, 22 nt, Human
ugugccuagauuccaugcacuc

SEQ ID NO: 294132 - RNA, 22 nt, Human
ugugccuguugguguagacaua

SEQ ID NO: 294133 - RNA, 20 nt, Human
uugcaugcagccggaugcug

SEQ ID NO: 294134 - RNA, 22 nt, Human
uugcaugugugaaaugcacaga

SEQ ID NO: 294135 - RNA, 22 nt, Human
uugccauacuugaaaggagaaa

SEQ ID NO: 294136 - RNA, 20 nt, Human
ugucugugugugauaauagu

SEQ ID NO: 294137 - RNA, 22 nt, Human
ugucuucagguuccucaccacu

SEQ ID NO: 294138 - RNA, 20 nt, Human
uugcaaagugaauagcaauu

SEQ ID NO: 294139 - RNA, 22 nt, Human
ugucugggauguuggcagccac

SEQ ID NO: 294140 - RNA, 22 nt, Human
uugauuggguauaaugacagga

SEQ ID NO: 294141 - RNA, 22 nt, Human
uugauucauuuguucccauuuu

SEQ ID NO: 294142 - RNA, 22 nt, Human
ugucugauccuucaggagcccc

SEQ ID NO: 294143 - RNA, 21 nt, Human
ugucugcaauuccagggaacc

SEQ ID NO: 294144 - RNA, 21 nt, Human
uugaaguggguagcuggcggg

SEQ ID NO: 294145 - RNA, 19 nt, Human
uugaauguuugauagucuc

SEQ ID NO: 294146 - RNA, 22 nt, Human
uugaauuuagguuuaugugaaa

SEQ ID NO: 294147 - RNA, 22 nt, Human
uguauaaaauggaaugucagaa

SEQ ID NO: 294148 - RNA, 22 nt, Human
uugaaucauauguaauugacuu

SEQ ID NO: 294149 - RNA, 20 nt, Human
uugagccucauggauugucu

SEQ ID NO: 294150 - RNA, 22 nt, Human
uugaccagaaaaguuaguaauu

SEQ ID NO: 294151 - RNA, 22 nt, Human
uugacuauacucuggcggaaaa

SEQ ID NO: 294152 - RNA, 22 nt, Human
ugucauuggugaucugaugccu

SEQ ID NO: 294153 - RNA, 22 nt, Human
uugaugacuaaagaaagcugcu

SEQ ID NO: 294154 - RNA, 22 nt, Human
uugauuaauugaugaaccucuc

SEQ ID NO: 294155 - RNA, 22 nt, Human
uugaggguggauugucagggga

SEQ ID NO: 294156 - RNA, 22 nt, Human
uugauagauuuuagaggcaggc

SEQ ID NO: 294157 - RNA, 22 nt, Human
uugauaacuuagcugggcugcu

SEQ ID NO: 294158 - RNA, 21 nt, Human
ugucagcaacaauacuuucuc

SEQ ID NO: 294159 - RNA, 22 nt, Human
ugucagacagggcugcagucag

SEQ ID NO: 294160 - RNA, 22 nt, Human
uuccuaauguccaccuaguccu

SEQ ID NO: 294161 - RNA, 22 nt, Human
uuccuaauugccaugaaguuau

SEQ ID NO: 294162 - RNA, 22 nt, Human
uucccggccgccccccgcucgg

SEQ ID NO: 294163 - RNA, 22 nt, Human
ugggacaugaugcauuugaaag

SEQ ID NO: 294164 - RNA, 22 nt, Human
uucccgcugcuggaguuggggc

SEQ ID NO: 294165 - RNA, 22 nt, Human
uucccugggggggccgcuuucc

SEQ ID NO: 294166 - RNA, 22 nt, Human
uuccucauuuggcacaucugag

SEQ ID NO: 294167 - RNA, 22 nt, Human
uuccucauucuggggcauguug

SEQ ID NO: 294168 - RNA, 22 nt, Human
uuccugaucuuuucccagaguu

SEQ ID NO: 294169 - RNA, 22 nt, Human
uggggccaggcuguuggcuucc

SEQ ID NO: 294170 - RNA, 18 nt, Human
uucgucauggggaucgua

SEQ ID NO: 294171 - RNA, 22 nt, Human
uucgucaauaugcagccuguga

SEQ ID NO: 294172 - RNA, 22 nt, Human
uucgcucuucacacagugcuga

SEQ ID NO: 294173 - RNA, 20 nt, Human
uuccuuaucuguaaagugga

SEQ ID NO: 294174 - RNA, 21 nt, Human
uuccuggaggcagaaacguga

SEQ ID NO: 294175 - RNA, 22 nt, Human
uggggcauacgugaaauaauuu

SEQ ID NO: 294176 - RNA, 21 nt, Human
uggggaugcauugcagaggca

SEQ ID NO: 294177 - RNA, 21 nt, Human
uucgaaugggucguugcugcc

SEQ ID NO: 294178 - RNA, 22 nt, Human
ugggaaaauugugauucuuucu

SEQ ID NO: 294179 - RNA, 22 nt, Human
ugggaaacucuaaacuugagua

SEQ ID NO: 294180 - RNA, 22 nt, Human
uggcugaggcuuuucuuaaaga

SEQ ID NO: 294181 - RNA, 22 nt, Human
ugggaagccaguaucagacuaa

SEQ ID NO: 294182 - RNA, 22 nt, Human
ugggaagaguuagagacagcug

SEQ ID NO: 294183 - RNA, 22 nt, Human
uggcuguuggagcuggaagaug

SEQ ID NO: 294184 - RNA, 22 nt, Human
uggcugaugucuguucuguuau

SEQ ID NO: 294185 - RNA, 22 nt, Human
uggcugggagcuggaacugggc

SEQ ID NO: 294186 - RNA, 22 nt, Human
uuccauggggcuguugcgcaga

SEQ ID NO: 294187 - RNA, 22 nt, Human
uggcugagugaacauguccauu

SEQ ID NO: 294188 - RNA, 22 nt, Human
uggagccuugugagaccacaau

SEQ ID NO: 294189 - RNA, 22 nt, Human
uuaucuguuuuaaugaauaauu

SEQ ID NO: 294190 - RNA, 22 nt, Human
uuaugcaaaggggccucuuccu

SEQ ID NO: 294191 - RNA, 22 nt, Human
uuaugucauuugaauuaauuuu

SEQ ID NO: 294192 - RNA, 22 nt, Human
uuaugggguuaaauuucuccua

SEQ ID NO: 294193 - RNA, 22 nt, Human
uuccagucugggcucuucacug

SEQ ID NO: 294194 - RNA, 22 nt, Human
uuccacaugaucauuguaauaa

SEQ ID NO: 294195 - RNA, 22 nt, Human
uuaugguuuaauauccagcaca

SEQ ID NO: 294196 - RNA, 17 nt, Human
uucugcucaggaacaga

SEQ ID NO: 294197 - RNA, 19 nt, Human
uucugcucaguaacacccu

SEQ ID NO: 294198 - RNA, 20 nt, Human
uucugcucuagagucuagaa

SEQ ID NO: 294199 - RNA, 23 nt, Human
uucugcuucccauagcacuuugu

SEQ ID NO: 294200 - RNA, 22 nt, Human
ugguaauuuaacaaaauuguca

SEQ ID NO: 294201 - RNA, 21 nt, Human
ugguaaggggauccuguuacu

SEQ ID NO: 294202 - RNA, 22 nt, Human
ugguauaaaaauuugugaaugu

SEQ ID NO: 294203 - RNA, 22 nt, Human
ugguagcaggugcuaaaggccu

SEQ ID NO: 294204 - RNA, 22 nt, Human
ugguaaguuacaugucugccuc

SEQ ID NO: 294205 - RNA, 19 nt, Human
uucugguacauacugccug

SEQ ID NO: 294206 - RNA, 22 nt, Human
uucuggccagggaagagggguc

SEQ ID NO: 294207 - RNA, 22 nt, Human
ugguauaaaaaaaugaguauaa

SEQ ID NO: 294208 - RNA, 22 nt, Human
uucuggaguuugaagaucaggu

SEQ ID NO: 294209 - RNA, 22 nt, Human
uucuggucucucugaccuagga

SEQ ID NO: 294210 - RNA, 22 nt, Human
ugguauauuugaccauaugugu

SEQ ID NO: 294211 - RNA, 22 nt, Human
uggucacacugcauaacacgca

SEQ ID NO: 294212 - RNA, 22 nt, Human
uucuggagacccagcaacaggg

SEQ ID NO: 294213 - RNA, 21 nt, Human
ugguccaaggacucauaccug

SEQ ID NO: 294214 - RNA, 22 nt, Human
ugggugugcaccuacgaucucu

SEQ ID NO: 294215 - RNA, 22 nt, Human
ugggugugggguaggguaagag

SEQ ID NO: 294216 - RNA, 22 nt, Human
ugggugggcagagucuaagaua

SEQ ID NO: 294217 - RNA, 22 nt, Human
uggguggauucgggaacuuguu

SEQ ID NO: 294218 - RNA, 23 nt, Human
uggguuucagugccaaugcugcc

SEQ ID NO: 294219 - RNA, 22 nt, Human
uggguucaaauccugguuccac

SEQ ID NO: 294220 - RNA, 22 nt, Human
uggguuaaaaguugaaugaauu

SEQ ID NO: 294221 - RNA, 22 nt, Human
uggguguuccuggggugcaagg

SEQ ID NO: 294222 - RNA, 22 nt, Human
uggguauauauguugcuacaga

SEQ ID NO: 294223 - RNA, 22 nt, Human
uucuccacguucuucucggccu

SEQ ID NO: 294224 - RNA, 20 nt, Human
ugggguucccuuuagggcuu

SEQ ID NO: 294225 - RNA, 22 nt, Human
uggguagcucaauagagccaca

SEQ ID NO: 294226 - RNA, 22 nt, Human
uucuccucagcaaggcagcuuu

SEQ ID NO: 294227 - RNA, 22 nt, Human
uggggcggaaggaggagaggug

SEQ ID NO: 294228 - RNA, 22 nt, Human
uucuaguuacagaagccuugcu

SEQ ID NO: 294229 - RNA, 21 nt, Human
uucuauauugagaauuggcua

SEQ ID NO: 294230 - RNA, 23 nt, Human
uggaaguugagagucugcuuugu

SEQ ID NO: 294231 - RNA, 18 nt, Human
uuauacaauuuuuuuuca

SEQ ID NO: 294232 - RNA, 22 nt, Human
uuauacugaaagucuuuuaaua

SEQ ID NO: 294233 - RNA, 22 nt, Human
uuauaaguaagggucucuggca

SEQ ID NO: 294234 - RNA, 22 nt, Human
uggagcaagaagggaggcagaa

SEQ ID NO: 294235 - RNA, 22 nt, Human
uggagauauucuauauuuuaua

SEQ ID NO: 294236 - RNA, 22 nt, Human
uggagaugcacgagcaggugga

SEQ ID NO: 294237 - RNA, 22 nt, Human
uuaucugugcuuuacugacaga

SEQ ID NO: 294238 - RNA, 22 nt, Human
uuaucugcccauuguagaauug

SEQ ID NO: 294239 - RNA, 19 nt, Human
uuauccggacuuaauuuau

SEQ ID NO: 294240 - RNA, 22 nt, Human
uggagagauagucauucuagag

SEQ ID NO: 294241 - RNA, 22 nt, Human
uggagaaauaacauuuggauuc

SEQ ID NO: 294242 - RNA, 22 nt, Human
uggacuguaaauuggggacucu

SEQ ID NO: 294243 - RNA, 22 nt, Human
uuauauuuuauuuaauuaaaua

SEQ ID NO: 294244 - RNA, 22 nt, Human
uuaucaaaaaauaguacuuuga

SEQ ID NO: 294245 - RNA, 22 nt, Human
uggaagaagcuacaagcgguga

SEQ ID NO: 294246 - RNA, 23 nt, Human
uggaagaaaaugguuuggcugug

SEQ ID NO: 294247 - RNA, 22 nt, Human
uuagcgcucucuccauucuuaa

SEQ ID NO: 294248 - RNA, 21 nt, Human
uuagcaguuguugauuuccag

SEQ ID NO: 294249 - RNA, 22 nt, Human
uuagcccaggacuuuuuauagc

SEQ ID NO: 294250 - RNA, 22 nt, Human
uuagucauucccucuugauauu

SEQ ID NO: 294251 - RNA, 22 nt, Human
uuaguggguuccauuucuaugg

SEQ ID NO: 294252 - RNA, 22 nt, Human
uuagugucugacgcaggcgcca

SEQ ID NO: 294253 - RNA, 22 nt, Human
uuaguuaccacugcagaucuuu

SEQ ID NO: 294254 - RNA, 20 nt, Human
uuaguuacuuagugagaguc

SEQ ID NO: 294255 - RNA, 22 nt, Human
uuaguuaauaaauauugagugu

SEQ ID NO: 294256 - RNA, 22 nt, Human
uuaguuacuugacucaagaccc

SEQ ID NO: 294257 - RNA, 22 nt, Human
uggaaggaaauguguaucauaa

SEQ ID NO: 294258 - RNA, 20 nt, Human
uggaaggaaagguguaucuu

SEQ ID NO: 294259 - RNA, 19 nt, Human
uggaagugauaguauagua

SEQ ID NO: 294260 - RNA, 22 nt, Human
uuagcagacagauggagagaga

SEQ ID NO: 294261 - RNA, 22 nt, Human
uuagaugaaaaucggaacaugu

SEQ ID NO: 294262 - RNA, 22 nt, Human
uuagaugcugugauuuuucaaa

SEQ ID NO: 294263 - RNA, 22 nt, Human
uggaacuagugucugagauggg

SEQ ID NO: 294264 - RNA, 22 nt, Human
uggaacuuccucacuuucccuc

SEQ ID NO: 294265 - RNA, 22 nt, Human
uuagauaaaucagcccugagua

SEQ ID NO: 294266 - RNA, 22 nt, Human
uggaaauaguugugagucaggc

SEQ ID NO: 294267 - RNA, 22 nt, Human
uggaaauagauguaggaaauug

SEQ ID NO: 294268 - RNA, 22 nt, Human
uuagagguuuuuuuccucauuc

SEQ ID NO: 294269 - RNA, 20 nt, Human
uuagaggccaugucuuguuu

SEQ ID NO: 294270 - RNA, 22 nt, Human
uggaaaugcuuagaggugaucu

SEQ ID NO: 294271 - RNA, 22 nt, Human
uuacuguaggugggugaauuug

SEQ ID NO: 294272 - RNA, 22 nt, Human
uggaaaauuuagaaagauuuau

SEQ ID NO: 294273 - RNA, 22 nt, Human
uggaaagaagacugugguugag

SEQ ID NO: 294274 - RNA, 22 nt, Human
uggaaagauuuaaaauaacgag

SEQ ID NO: 294275 - RNA, 22 nt, Human
uuaccugcagagacguggaggc

SEQ ID NO: 294276 - RNA, 22 nt, Human
uuaccugagcggauuuguugca

SEQ ID NO: 294277 - RNA, 22 nt, Human
uuaccugccucaaacacgaaug

SEQ ID NO: 294278 - RNA, 20 nt, Human
uuacucaaccaggcuucuac

SEQ ID NO: 294279 - RNA, 23 nt, Human
uuacuaugaaaauuccagucacu

SEQ ID NO: 294280 - RNA, 22 nt, Human
ugcuuuuggcagcaguguuuau

SEQ ID NO: 294281 - RNA, 22 nt, Human
uuacuggaauauaaagauaaga

SEQ ID NO: 294282 - RNA, 22 nt, Human
uuacuguguguaaaauaucuuu

SEQ ID NO: 294283 - RNA, 23 nt, Human
ugcuuugauuauuauucccaccu

SEQ ID NO: 294284 - RNA, 20 nt, Human
uuacugagguauuuuuauca

SEQ ID NO: 294285 - RNA, 22 nt, Human
ugcuuuuguaucagaguauuca

SEQ ID NO: 294286 - RNA, 22 nt, Human
uuacacaugaagguccaauguu

SEQ ID NO: 294287 - RNA, 22 nt, Human
uuaccauaguacuaucaguuua

SEQ ID NO: 294288 - RNA, 22 nt, Human
uuacaugcuugugcagguuuug

SEQ ID NO: 294289 - RNA, 22 nt, Human
ugcuuucaaaacucagaggaau

SEQ ID NO: 294290 - RNA, 22 nt, Human
ugcuuuauucgacaucugguag

SEQ ID NO: 294291 - RNA, 22 nt, Human
ugcuuuaccuuccauuuaagga

SEQ ID NO: 294292 - RNA, 22 nt, Human
uuaccuaagaaacucauuucgu

SEQ ID NO: 294293 - RNA, 22 nt, Human
uuaccgagaacaugacuggaau

SEQ ID NO: 294294 - RNA, 22 nt, Human
uuacccuugaauuugugacaaa

SEQ ID NO: 294295 - RNA, 22 nt, Human
ugcuuucagauaucuguuucaa

SEQ ID NO: 294296 - RNA, 22 nt, Human
uuaaugcagguacuguuacaau

SEQ ID NO: 294297 - RNA, 22 nt, Human
uuaaugauuaauguggacccaa

SEQ ID NO: 294298 - RNA, 22 nt, Human
uuaauauuaagauauugagugg

SEQ ID NO: 294299 - RNA, 22 nt, Human
uuaauauuuauugguaaucacu

SEQ ID NO: 294300 - RNA, 22 nt, Human
uuaauaaauugugguaccagag

SEQ ID NO: 294301 - RNA, 22 nt, Human
uuaaguauggaggccuaacuga

SEQ ID NO: 294302 - RNA, 22 nt, Human
ugcuuggauuuccaaaugguuu

SEQ ID NO: 294303 - RNA, 22 nt, Human
ugcuugcuaucuaaguguuuca

SEQ ID NO: 294304 - RNA, 22 nt, Human
ugcuugaggcuugucaucuaac

SEQ ID NO: 294305 - RNA, 22 nt, Human
ugcuugaacccaggaaguggag

SEQ ID NO: 294306 - RNA, 22 nt, Human
uuaauugggugcuuuguaaaua

SEQ ID NO: 294307 - RNA, 22 nt, Human
uuaauguuuuagaaugagagug

SEQ ID NO: 294308 - RNA, 22 nt, Human
uuaauguggaagaguuuggcua

SEQ ID NO: 294309 - RNA, 22 nt, Human
uuaaugcauguaaaugugcaaa

SEQ ID NO: 294310 - RNA, 22 nt, Human
ugcuucuuuaggauguaguuau

SEQ ID NO: 294311 - RNA, 22 nt, Human
ugcugcucuucaccauggccuc

SEQ ID NO: 294312 - RNA, 22 nt, Human
ugcugcucaagcugcagcaaaa

SEQ ID NO: 294313 - RNA, 22 nt, Human
ugcugcggcgcaggcacuccag

SEQ ID NO: 294314 - RNA, 22 nt, Human
uguuuuuuagagugauacuuuu

SEQ ID NO: 294315 - RNA, 22 nt, Human
uuaaacauuuccacuugccagu

SEQ ID NO: 294316 - RNA, 22 nt, Human
uuaaaauuguuaacuuugguga

SEQ ID NO: 294317 - RNA, 22 nt, Human
ugcugccucccaucccucccga

SEQ ID NO: 294318 - RNA, 22 nt, Human
uuaaaucaggcaucauuucagu

SEQ ID NO: 294319 - RNA, 22 nt, Human
ugcuggagucucuugacccugg

SEQ ID NO: 294320 - RNA, 22 nt, Human
ugcuggaguggcacuguguggc

SEQ ID NO: 294321 - RNA, 22 nt, Human
ugcugggagcugggccucgaca

SEQ ID NO: 294322 - RNA, 22 nt, Human
ugcuggagccauguuuucucua

SEQ ID NO: 294323 - RNA, 22 nt, Human
uuaacuaguauuuuuaguccug

SEQ ID NO: 294324 - RNA, 22 nt, Human
ugcugguuucugaguaaccaca

SEQ ID NO: 294325 - RNA, 20 nt, Human
ugcugggccaucuugcaugc

SEQ ID NO: 294326 - RNA, 22 nt, Human
ugcugugagaccauuuguugag

SEQ ID NO: 294327 - RNA, 22 nt, Human
uuaaggcauagcuuguguugac

SEQ ID NO: 294328 - RNA, 22 nt, Human
uguuugaggugacucuggaaug

SEQ ID NO: 294329 - RNA, 22 nt, Human
uguuuguaugauggcacaucca

SEQ ID NO: 294330 - RNA, 22 nt, Human
uguuuucuauuaccugagauug

SEQ ID NO: 294331 - RNA, 22 nt, Human
uguuuucuuuccccuucuuuuc

SEQ ID NO: 294332 - RNA, 22 nt, Human
uguuuuuauucuuaauguuuca

SEQ ID NO: 294333 - RNA, 22 nt, Human
uguuuuuagcuguuuuuuggau

SEQ ID NO: 294334 - RNA, 21 nt, Human
uguuuuguaauagauacuaug

SEQ ID NO: 294335 - RNA, 22 nt, Human
uguuuuguuuagguuuguuuuu

SEQ ID NO: 294336 - RNA, 22 nt, Human
uguuuucccacugguuuguaca

SEQ ID NO: 294337 - RNA, 22 nt, Human
ugcugcggauauacaggaucug

SEQ ID NO: 294338 - RNA, 22 nt, Human
uguuuccuaagugucucugaag

SEQ ID NO: 294339 - RNA, 22 nt, Human
uguuggaauaagugcuugaagg

SEQ ID NO: 294340 - RNA, 22 nt, Human
ugcucuuucaggcauagaccuu

SEQ ID NO: 294341 - RNA, 20 nt, Human
uguuucccaacaccccaaag

SEQ ID NO: 294342 - RNA, 22 nt, Human
uguuuaagugguuaaaggauuc

SEQ ID NO: 294343 - RNA, 22 nt, Human
uguuuaguuuugcaccaauaaa

SEQ ID NO: 294344 - RNA, 22 nt, Human
uguuuaucaguagacucaaguu

SEQ ID NO: 294345 - RNA, 19 nt, Human
ugcugcaggaauucucaag

SEQ ID NO: 294346 - RNA, 22 nt, Human
uguuugagaauuugcugauguu

SEQ ID NO: 294347 - RNA, 22 nt, Human
ugcuccguucuucugcuucuug

SEQ ID NO: 294348 - RNA, 22 nt, Human
uguuggauuuugugaaauauga

SEQ ID NO: 294349 - RNA, 22 nt, Human
uguuggaaucuucuagucuucc

SEQ ID NO: 294350 - RNA, 18 nt, Human
uguugguguucacucacu

SEQ ID NO: 294351 - RNA, 22 nt, Human
uguuggugcacugaaaggcagg

SEQ ID NO: 294352 - RNA, 20 nt, Human
ugcuccaggaacacuggccg

SEQ ID NO: 294353 - RNA, 22 nt, Human
uguguguguguguaugugcgug

SEQ ID NO: 294354 - RNA, 22 nt, Human
ugccugucuaucuuugucaucu

SEQ ID NO: 294355 - RNA, 22 nt, Human
uguguguguauacauguauaua

SEQ ID NO: 294356 - RNA, 22 nt, Human
ugcucgauuauuucauuuugca

SEQ ID NO: 294357 - RNA, 17 nt, Human
uguuguguggauuuucc

SEQ ID NO: 294358 - RNA, 22 nt, Human
uguuguagacaguucacucgug

SEQ ID NO: 294359 - RNA, 22 nt, Human
ugguccaaaccagugcuguggu

SEQ ID NO: 294360 - RNA, 22 nt, Human
uggucacgucgggguauugcca

SEQ ID NO: 294361 - RNA, 22 nt, Human
uggucaaauccuagauccuuug

SEQ ID NO: 294362 - RNA, 22 nt, Human
ugguaugaaggaggccggcagc

SEQ ID NO: 294363 - RNA, 22 nt, Human
ugagaccuaaaccgucuguccu

SEQ ID NO: 294364 - RNA, 22 nt, Human
ugagacugaguuugguuuuguu

SEQ ID NO: 294365 - RNA, 22 nt, Human
ugagacuugaacuccagugcca

SEQ ID NO: 294366 - RNA, 22 nt, Human
ugagaauuuaacuugauuagga

SEQ ID NO: 294367 - RNA, 22 nt, Human
ugguaaaguguacugaauauga

SEQ ID NO: 294368 - RNA, 22 nt, Human
uggguuugcuuguucagguucu

SEQ ID NO: 294369 - RNA, 22 nt, Human
ugguaacgguuuccuugccauu

SEQ ID NO: 294370 - RNA, 20 nt, Human
ugagaaacaagggcuggucu

SEQ ID NO: 294371 - RNA, 22 nt, Human
ugagaacuguuuugguuugggu

SEQ ID NO: 294372 - RNA, 22 nt, Human
uggguuuaccaguguuucuucc

SEQ ID NO: 294373 - RNA, 20 nt, Human
uggguucaguuguuucuggc

SEQ ID NO: 294374 - RNA, 22 nt, Human
uggguuuauuguauuucccuua

SEQ ID NO: 294375 - RNA, 22 nt, Human
ugggugccgcaucuugcuguuc

SEQ ID NO: 294376 - RNA, 22 nt, Human
ugggugaugagguccccagccc

SEQ ID NO: 294377 - RNA, 22 nt, Human
ugacguuugcgccgcgcacgac

SEQ ID NO: 294378 - RNA, 22 nt, Human
uggguggugaaauggaugggaa

SEQ ID NO: 294379 - RNA, 22 nt, Human
ugacuaauacagaaacuacaag

SEQ ID NO: 294380 - RNA, 22 nt, Human
ugacuagggauauuuucuuucc

SEQ ID NO: 294381 - RNA, 19 nt, Human
ugacuggguucuaggcagg

SEQ ID NO: 294382 - RNA, 22 nt, Human
ugacugaggaaggugggguggg

SEQ ID NO: 294383 - RNA, 22 nt, Human
uggguuaaaguuugucacugac

SEQ ID NO: 294384 - RNA, 22 nt, Human
uggguguguccauauuuugacu

SEQ ID NO: 294385 - RNA, 22 nt, Human
ugacuuauuaaaaguuuuuauu

SEQ ID NO: 294386 - RNA, 22 nt, Human
uggguguggaagcagcgugggg

SEQ ID NO: 294387 - RNA, 22 nt, Human
ucuuuuucccugguuccuuuuu

SEQ ID NO: 294388 - RNA, 22 nt, Human
ucuuuugaacauccaggauguc

SEQ ID NO: 294389 - RNA, 22 nt, Human
ugacgcauggccagcucugucu

SEQ ID NO: 294390 - RNA, 22 nt, Human
ugggugaagaggcuaugcuacu

SEQ ID NO: 294391 - RNA, 22 nt, Human
ugggucagauacaguguuuggu

SEQ ID NO: 294392 - RNA, 22 nt, Human
ugaguuuuggaagauguuacag

SEQ ID NO: 294393 - RNA, 22 nt, Human
ugguuucagacagacucgaacu

SEQ ID NO: 294394 - RNA, 22 nt, Human
ugguuuccugauggacacuugg

SEQ ID NO: 294395 - RNA, 22 nt, Human
ugagugcuuuucgguguaccgu

SEQ ID NO: 294396 - RNA, 22 nt, Human
ugguucugccacuuuccccuug

SEQ ID NO: 294397 - RNA, 22 nt, Human
ugagugccagugcuugcucuac

SEQ ID NO: 294398 - RNA, 21 nt, Human
ugagucuuagagaacuucagg

SEQ ID NO: 294399 - RNA, 22 nt, Human
ugagguugggaggacugccuaa

SEQ ID NO: 294400 - RNA, 22 nt, Human
ugagucugaagagagaauaagg

SEQ ID NO: 294401 - RNA, 22 nt, Human
uguaauguuagaaacaauugcu

SEQ ID NO: 294402 - RNA, 22 nt, Human
uguaaucaugguagaggcaaag

SEQ ID NO: 294403 - RNA, 22 nt, Human
ugauauaaaagauucuuauuga

SEQ ID NO: 294404 - RNA, 20 nt, Human
ugauaugcgguacagagagg

SEQ ID NO: 294405 - RNA, 22 nt, Human
ugauagcaugcucucaguaaaa

SEQ ID NO: 294406 - RNA, 22 nt, Human
ugauaccugagucuuccccguu

SEQ ID NO: 294407 - RNA, 20 nt, Human
ugauaggcauugacauaagg

SEQ ID NO: 294408 - RNA, 22 nt, Human
ugaucauugaacaucgaguuaa

SEQ ID NO: 294409 - RNA, 22 nt, Human
ugaugaaguuggaaggaaaguu

SEQ ID NO: 294410 - RNA, 22 nt, Human
uguagaaguuaauugaugagua

SEQ ID NO: 294411 - RNA, 19 nt, Human
ugaucuccaguacagacau

SEQ ID NO: 294412 - RNA, 22 nt, Human
uguacuacaugauuauugacca

SEQ ID NO: 294413 - RNA, 20 nt, Human
uguacuauaaaagguugagu

SEQ ID NO: 294414 - RNA, 22 nt, Human
uggugcucuugauauauaaggc

SEQ ID NO: 294415 - RNA, 22 nt, Human
ugagcaaacacagauaggcuua

SEQ ID NO: 294416 - RNA, 19 nt, Human
ugagauuguaugaggagau

SEQ ID NO: 294417 - RNA, 22 nt, Human
ugagauguaauguaguacuuug

SEQ ID NO: 294418 - RNA, 22 nt, Human
ugaggaugaggaagaagaagaa

SEQ ID NO: 294419 - RNA, 22 nt, Human
ugaggaggugggcacacagagu

SEQ ID NO: 294420 - RNA, 21 nt, Human
ugguguacauuuccauaguuu

SEQ ID NO: 294421 - RNA, 22 nt, Human
ugguggcuuuucguagguucac

SEQ ID NO: 294422 - RNA, 22 nt, Human
ugaggcuuucacuuggcaaaga

SEQ ID NO: 294423 - RNA, 22 nt, Human
ugguuagucaugguacugcagc

SEQ ID NO: 294424 - RNA, 22 nt, Human
ugagggagggggagccguucua

SEQ ID NO: 294425 - RNA, 22 nt, Human
ugguucggcuguaaguauaucu

SEQ ID NO: 294426 - RNA, 22 nt, Human
ugguuauggaacuggcuauggc

SEQ ID NO: 294427 - RNA, 22 nt, Human
ugguuauauaaggauuaaauac

SEQ ID NO: 294428 - RNA, 22 nt, Human
ugguuacagaugaagaucggcc

SEQ ID NO: 294429 - RNA, 22 nt, Human
ugcagcaucuccuugugccaug

SEQ ID NO: 294430 - RNA, 22 nt, Human
ugcagccucacgcauccgcauu

SEQ ID NO: 294431 - RNA, 19 nt, Human
ugcagcacuaaaaacuuuc

SEQ ID NO: 294432 - RNA, 22 nt, Human
ugcagcagaauauggcugcagg

SEQ ID NO: 294433 - RNA, 22 nt, Human
ugugagauuuuauuugauaugc

SEQ ID NO: 294434 - RNA, 22 nt, Human
ugugagccuuuauuaaccucau

SEQ ID NO: 294435 - RNA, 22 nt, Human
ugugacugaaaaugauugagug

SEQ ID NO: 294436 - RNA, 22 nt, Human
ugugacaugauggcgucaugua

SEQ ID NO: 294437 - RNA, 23 nt, Human
ugugaauggccuucuuuagaggu

SEQ ID NO: 294438 - RNA, 22 nt, Human
ugugaagugaugggugaccgag

SEQ ID NO: 294439 - RNA, 22 nt, Human
ugugaaugacuguguucuuugc

SEQ ID NO: 294440 - RNA, 22 nt, Human
ugucuuuuaaaaauguguaaaa

SEQ ID NO: 294441 - RNA, 22 nt, Human
ugugaagaauuaaugugaauca

SEQ ID NO: 294442 - RNA, 22 nt, Human
ugcagaauauucuggugacaau

SEQ ID NO: 294443 - RNA, 22 nt, Human
ugcagaacacaguagacagaac

SEQ ID NO: 294444 - RNA, 22 nt, Human
ugucuucuuuucccuuagcccu

SEQ ID NO: 294445 - RNA, 22 nt, Human
ugucuuuagagugaacagaaga

SEQ ID NO: 294446 - RNA, 22 nt, Human
ugcagagagccagcucucucgg

SEQ ID NO: 294447 - RNA, 22 nt, Human
ugucuuucuuucucuugacaga

SEQ ID NO: 294448 - RNA, 22 nt, Human
ugcaauggauaucugaacgugg

SEQ ID NO: 294449 - RNA, 23 nt, Human
ugcaaugcagcuagauguaaaau

SEQ ID NO: 294450 - RNA, 21 nt, Human
ugcaaugcauugacagcagca

SEQ ID NO: 294451 - RNA, 22 nt, Human
ugucugaauuguaauguugcgu

SEQ ID NO: 294452 - RNA, 22 nt, Human
ugaugccauaguaaaauuugcu

SEQ ID NO: 294453 - RNA, 22 nt, Human
ugaugcuagaacuuccaagaua

SEQ ID NO: 294454 - RNA, 22 nt, Human
ugaugaugccaaaauuuggcau

SEQ ID NO: 294455 - RNA, 22 nt, Human
ugauggaguauaauaaaaugac

SEQ ID NO: 294456 - RNA, 22 nt, Human
ugucacagagcgugcaacagaa

SEQ ID NO: 294457 - RNA, 22 nt, Human
ugucacagugcacagcuaagaa

SEQ ID NO: 294458 - RNA, 22 nt, Human
ugucacaccuggcgauaauggg

SEQ ID NO: 294459 - RNA, 22 nt, Human
ugauuugauuuguuuaugccug

SEQ ID NO: 294460 - RNA, 22 nt, Human
uguccuuuauauguuuuuuagu

SEQ ID NO: 294461 - RNA, 22 nt, Human
ugcaaggcacccacucugcuuu

SEQ ID NO: 294462 - RNA, 22 nt, Human
ugcaaugagcuucuuugauaaa

SEQ ID NO: 294463 - RNA, 23 nt, Human
ugucacugcggaguggccugcag

SEQ ID NO: 294464 - RNA, 22 nt, Human
ugucacguaaaaacuagauuuc

SEQ ID NO: 294465 - RNA, 23 nt, Human
ugucacuuguggucacuaggcug

SEQ ID NO: 294466 - RNA, 22 nt, Human
ugcaaauuuuuuuauuuuuccu

SEQ ID NO: 294467 - RNA, 22 nt, Human
ugucagccacggugugaccggc

SEQ ID NO: 294468 - RNA, 22 nt, Human
ugucauauagaauguucuauga

SEQ ID NO: 294469 - RNA, 22 nt, Human
ugucaucuuucuaaagcugguc

SEQ ID NO: 294470 - RNA, 22 nt, Human
ugccagucggcacuuuaucugg

SEQ ID NO: 294471 - RNA, 22 nt, Human
ugccagauuaugucuccagggc

SEQ ID NO: 294472 - RNA, 22 nt, Human
ugccaguaauuguccuguagcu

SEQ ID NO: 294473 - RNA, 23 nt, Human
ugccaggaagaaugaccucugcu

SEQ ID NO: 294474 - RNA, 22 nt, Human
ugccccuggaggagagcaaugg

SEQ ID NO: 294475 - RNA, 22 nt, Human
ugcccccggcugcccaggggaa

SEQ ID NO: 294476 - RNA, 19 nt, Human
ugccccacccucuauccag

SEQ ID NO: 294477 - RNA, 22 nt, Human
ugcccagcagggagcuaccugg

SEQ ID NO: 294478 - RNA, 22 nt, Human
ugccaaugauuccacaauggaa

SEQ ID NO: 294479 - RNA, 22 nt, Human
ugccagcuccgaggagcugcag

SEQ ID NO: 294480 - RNA, 22 nt, Human
ugccgccgugggucccgacgcg

SEQ ID NO: 294481 - RNA, 23 nt, Human
ugccggaucuacuuuggguucuc

SEQ ID NO: 294482 - RNA, 22 nt, Human
ugugucauuugagaggagacga

SEQ ID NO: 294483 - RNA, 22 nt, Human
ugugucuuuggcgaugucugga

SEQ ID NO: 294484 - RNA, 22 nt, Human
ugugugcacguacauacuguau

SEQ ID NO: 294485 - RNA, 22 nt, Human
ugugugcuaguuuugucaguau

SEQ ID NO: 294486 - RNA, 22 nt, Human
uguguggaggugggugaugucu

SEQ ID NO: 294487 - RNA, 22 nt, Human
ugcccuagaucacauuacaggu

SEQ ID NO: 294488 - RNA, 22 nt, Human
ugcccugcagacccugcagugu

SEQ ID NO: 294489 - RNA, 22 nt, Human
ugcccugaagcugucaauuuug

SEQ ID NO: 294490 - RNA, 22 nt, Human
ugcccuuucuccagugaccauu

SEQ ID NO: 294491 - RNA, 22 nt, Human
ugccgcaggaggggcgauuucu

SEQ ID NO: 294492 - RNA, 22 nt, Human
ugccgccccggggcccccagcc

SEQ ID NO: 294493 - RNA, 23 nt, Human
ugcaugagcaucuccaccucagu

SEQ ID NO: 294494 - RNA, 22 nt, Human
ugcaugcagcuggucgggcgcc

SEQ ID NO: 294495 - RNA, 22 nt, Human
ugcaucccugaggcauuauccu

SEQ ID NO: 294496 - RNA, 22 nt, Human
ugcagugaugcuucuggcucag

SEQ ID NO: 294497 - RNA, 22 nt, Human
ugcagugcagcuggaaguuggc

SEQ ID NO: 294498 - RNA, 22 nt, Human
ugugcugcagcgagagcuacga

SEQ ID NO: 294499 - RNA, 22 nt, Human
ugugcuauuuuugcauaugugu

SEQ ID NO: 294500 - RNA, 22 nt, Human
uguggauauauuuuaaaaggaa

SEQ ID NO: 294501 - RNA, 22 nt, Human
uguggcaauauggaauguguuu

SEQ ID NO: 294502 - RNA, 22 nt, Human
ugugauuucaaagggugucuuu

SEQ ID NO: 294503 - RNA, 22 nt, Human
ugcagcuucucugcaacaggag

SEQ ID NO: 294504 - RNA, 22 nt, Human
ugcaggaacucgaaaacuauag

SEQ ID NO: 294505 - RNA, 22 nt, Human
ugcagcuuuugguuucuagaug

SEQ ID NO: 294506 - RNA, 22 nt, Human
ugcagccuuuguccuugggcua

SEQ ID NO: 294507 - RNA, 22 nt, Human
ugugauaaaggcccgcagaucc

SEQ ID NO: 294508 - RNA, 22 nt, Human
ugugauugcauugcagauuacu

SEQ ID NO: 294509 - RNA, 22 nt, Human
ugauucacgcuucucuuuaaac

SEQ ID NO: 294510 - RNA, 22 nt, Human
ugauucaguacuuucucuaacu

SEQ ID NO: 294511 - RNA, 22 nt, Human
ugauugauaaugaagacaguca

SEQ ID NO: 294512 - RNA, 22 nt, Human
ugauugcucagcuagccucuuu

SEQ ID NO: 294513 - RNA, 22 nt, Human
uccaaggacucuugucagcugu

SEQ ID NO: 294514 - RNA, 22 nt, Human
ugauguuucugaagggguuacu

SEQ ID NO: 294515 - RNA, 18 nt, Human
ugauggcuaagagccggg

SEQ ID NO: 294516 - RNA, 22 nt, Human
ugauguaggacauuauuauuuc

SEQ ID NO: 294517 - RNA, 22 nt, Human
ugauguaaaauaggaaguucua

SEQ ID NO: 294518 - RNA, 22 nt, Human
ugauaugguaauaagauauucu

SEQ ID NO: 294519 - RNA, 22 nt, Human
ugaucauguucuccaaaagcgu

SEQ ID NO: 294520 - RNA, 22 nt, Human
ucaguuuaucuagcugggggaa

SEQ ID NO: 294521 - RNA, 20 nt, Human
ucaguuucccuauuagguug

SEQ ID NO: 294522 - RNA, 22 nt, Human
ucauaaaaucaguguccauugu

SEQ ID NO: 294523 - RNA, 22 nt, Human
ugaggcaguucuuacuuguauu

SEQ ID NO: 294524 - RNA, 22 nt, Human
ucauaaguuguugacuagcaaa

SEQ ID NO: 294525 - RNA, 22 nt, Human
ucauauugguagagauguguaa

SEQ ID NO: 294526 - RNA, 22 nt, Human
ucauaucauuuugaaagcugag

SEQ ID NO: 294527 - RNA, 17 nt, Human
ugaggcugucucccugg

SEQ ID NO: 294528 - RNA, 21 nt, Human
ugaggccugccagucucagaa

SEQ ID NO: 294529 - RNA, 21 nt, Human
ucauccagguccugcuucuuc

SEQ ID NO: 294530 - RNA, 22 nt, Human
ucaucccuuccugcacuauuag

SEQ ID NO: 294531 - RNA, 22 nt, Human
ucauccgcaaccacuuuagccu

SEQ ID NO: 294532 - RNA, 22 nt, Human
ucauguauucugggcaggagau

SEQ ID NO: 294533 - RNA, 22 nt, Human
ucaugcagauaagaauaaguaa

SEQ ID NO: 294534 - RNA, 22 nt, Human
ucauggcucuaaagacauagau

SEQ ID NO: 294535 - RNA, 22 nt, Human
ucaugagcacaggugcagggac

SEQ ID NO: 294536 - RNA, 20 nt, Human
ucaucuuucaaauuugugac

SEQ ID NO: 294537 - RNA, 22 nt, Human
ucaucuuucuuuauggaaauac

SEQ ID NO: 294538 - RNA, 22 nt, Human
ucaucggcugucaucuucacgu

SEQ ID NO: 294539 - RNA, 22 nt, Human
ucauccugaagaaccugcuucc

SEQ ID NO: 294540 - RNA, 22 nt, Human
ugagugacuguugucaagaugg

SEQ ID NO: 294541 - RNA, 22 nt, Human
ucaguguccuucguucuuguug

SEQ ID NO: 294542 - RNA, 22 nt, Human
ucagugugacccuucuauuuuu

SEQ ID NO: 294543 - RNA, 19 nt, Human
ucagugggacauuugcuuu

SEQ ID NO: 294544 - RNA, 22 nt, Human
ucagugguuaaguucuguccac

SEQ ID NO: 294545 - RNA, 22 nt, Human
ucaguuguuggaaguagaugua

SEQ ID NO: 294546 - RNA, 17 nt, Human
ucaguugugcgagcagc

SEQ ID NO: 294547 - RNA, 22 nt, Human
ugagcuauuucaccauauagau

SEQ ID NO: 294548 - RNA, 22 nt, Human
ucaguugagguggucuauugcg

SEQ ID NO: 294549 - RNA, 22 nt, Human
ugaggagggcuagagucuccug

SEQ ID NO: 294550 - RNA, 22 nt, Human
ugaggaugagaaggaagagaag

SEQ ID NO: 294551 - RNA, 22 nt, Human
ucaguuuaauuggaucuuuuuc

SEQ ID NO: 294552 - RNA, 22 nt, Human
ucaguggaacacacagaguggg

SEQ ID NO: 294553 - RNA, 22 nt, Human
ugagauuuagaacuggauuuca

SEQ ID NO: 294554 - RNA, 22 nt, Human
ugagcagagcacuugggaacga

SEQ ID NO: 294555 - RNA, 20 nt, Human
ucaguggcauaguugcuaag

SEQ ID NO: 294556 - RNA, 22 nt, Human
ugagcagccagucauucaaaaa

SEQ ID NO: 294557 - RNA, 21 nt, Human
ugagcccaaagcuguauuggu

SEQ ID NO: 294558 - RNA, 18 nt, Human
ucaguccuccauagagcu

SEQ ID NO: 294559 - RNA, 23 nt, Human
ucagugaaggaacaacuaaauag

SEQ ID NO: 294560 - RNA, 22 nt, Human
ucagugauccagauauuugagc

SEQ ID NO: 294561 - RNA, 23 nt, Human
ucagugccaaggagaacuuggug

SEQ ID NO: 294562 - RNA, 22 nt, Human
ugagaagucagucuauugugaa

SEQ ID NO: 294563 - RNA, 22 nt, Human
ucaguagcauuuaauguucagu

SEQ ID NO: 294564 - RNA, 22 nt, Human
ucaguacaagauuuucuaaauc

SEQ ID NO: 294565 - RNA, 22 nt, Human
ucaguaagauugauauuucccc

SEQ ID NO: 294566 - RNA, 22 nt, Human
ugagagguagaacuuguagugu

SEQ ID NO: 294567 - RNA, 22 nt, Human
ucagucacugucucagacagga

SEQ ID NO: 294568 - RNA, 22 nt, Human
ucagucauguuuaccagacgua

SEQ ID NO: 294569 - RNA, 22 nt, Human
ugagaaauauacaccagacaca

SEQ ID NO: 294570 - RNA, 22 nt, Human
ucagguagugguuaaguucugu

SEQ ID NO: 294571 - RNA, 22 nt, Human
ucagguuugcaaccucgggcaa

SEQ ID NO: 294572 - RNA, 22 nt, Human
ugagaagaggucuuuugggaug

SEQ ID NO: 294573 - RNA, 22 nt, Human
ucaggcuagcccagugcuuggg

SEQ ID NO: 294574 - RNA, 22 nt, Human
ucugugugugugcauaugcaug

SEQ ID NO: 294575 - RNA, 23 nt, Human
ucagggaucgucagaaaaugaaa

SEQ ID NO: 294576 - RNA, 22 nt, Human
ucagggaggagaggcaggggga

SEQ ID NO: 294577 - RNA, 18 nt, Human
ucagggaaacuuugccug

SEQ ID NO: 294578 - RNA, 22 nt, Human
ucaggcgcucuucguggcugcc

SEQ ID NO: 294579 - RNA, 22 nt, Human
ucuucaguaaucgacauuccac

SEQ ID NO: 294580 - RNA, 22 nt, Human
ugcagguuuucagauguguguu

SEQ ID NO: 294581 - RNA, 22 nt, Human
ugcagguggcagcggggcacca

SEQ ID NO: 294582 - RNA, 22 nt, Human
ugcaguugcguuugcauuccau

SEQ ID NO: 294583 - RNA, 22 nt, Human
uccggcgaccuccagauguucc

SEQ ID NO: 294584 - RNA, 22 nt, Human
uccgggagcccccggaggagga

SEQ ID NO: 294585 - RNA, 22 nt, Human
uccguccacacuuagagaguuu

SEQ ID NO: 294586 - RNA, 22 nt, Human
ugcaggguuucaauacacagga

SEQ ID NO: 294587 - RNA, 22 nt, Human
ugcaggagcaccagcucacccu

SEQ ID NO: 294588 - RNA, 22 nt, Human
uccgagggugacuaccgcuucc

SEQ ID NO: 294589 - RNA, 18 nt, Human
uccggaggucagaguaaa

SEQ ID NO: 294590 - RNA, 22 nt, Human
ucccucuuccuacccucccuuu

SEQ ID NO: 294591 - RNA, 21 nt, Human
ucccugcagccccaggccccc

SEQ ID NO: 294592 - RNA, 22 nt, Human
ucccugccuccuggcagugcca

SEQ ID NO: 294593 - RNA, 22 nt, Human
ucccugagcuguguuuguuggu

SEQ ID NO: 294594 - RNA, 22 nt, Human
ugcagggucuccuguacuuggg

SEQ ID NO: 294595 - RNA, 22 nt, Human
ugcaggagaaaguacggagcgu

SEQ ID NO: 294596 - RNA, 22 nt, Human
ugcaggaagcucagcggggccg

SEQ ID NO: 294597 - RNA, 22 nt, Human
ucccuuuuuccugaucugugaa

SEQ ID NO: 294598 - RNA, 19 nt, Human
ugcacucauggagggucug

SEQ ID NO: 294599 - RNA, 22 nt, Human
ucccuacuccucuggucccucu

SEQ ID NO: 294600 - RNA, 22 nt, Human
uccccaugaacuuguggcugcu

SEQ ID NO: 294601 - RNA, 22 nt, Human
ucccagccugacagugcaucaa

SEQ ID NO: 294602 - RNA, 22 nt, Human
ugcacacaguucucaggaaaga

SEQ ID NO: 294603 - RNA, 22 nt, Human
uccagcuccugaguucacugcu

SEQ ID NO: 294604 - RNA, 22 nt, Human
ugauugcucgacacucugcuug

SEQ ID NO: 294605 - RNA, 22 nt, Human
ugauugggacauuuuguuuucu

SEQ ID NO: 294606 - RNA, 23 nt, Human
ucccaacuuugaaauauuccaca

SEQ ID NO: 294607 - RNA, 22 nt, Human
ucccacacucaacacacaugua

SEQ ID NO: 294608 - RNA, 22 nt, Human
ugauuugaaaccuuuggcaaga

SEQ ID NO: 294609 - RNA, 22 nt, Human
ugauuucauaugacagcuuuuu

SEQ ID NO: 294610 - RNA, 22 nt, Human
ugauugguauguauguuuguca

SEQ ID NO: 294611 - RNA, 22 nt, Human
ugauuuagguauuuucuuuugu

SEQ ID NO: 294612 - RNA, 20 nt, Human
ugccugagcgcagcuccagg

SEQ ID NO: 294613 - RNA, 22 nt, Human
ugccugaagccugccccugggu

SEQ ID NO: 294614 - RNA, 22 nt, Human
uccuuggagaaucuuguuuuac

SEQ ID NO: 294615 - RNA, 19 nt, Human
uccuugacuguauucagag

SEQ ID NO: 294616 - RNA, 22 nt, Human
uccuugaccuccugacaguaac

SEQ ID NO: 294617 - RNA, 22 nt, Human
ugccccuugccaggccucugcc

SEQ ID NO: 294618 - RNA, 22 nt, Human
ugcgccucugucacucagcauc

SEQ ID NO: 294619 - RNA, 22 nt, Human
ugcgcgcaccugcauauauaug

SEQ ID NO: 294620 - RNA, 22 nt, Human
ucgacuccauuuuucuugguuc

SEQ ID NO: 294621 - RNA, 22 nt, Human
ugccuuguagccaccgggucac

SEQ ID NO: 294622 - RNA, 22 nt, Human
ugcccagagccucuuaccucca

SEQ ID NO: 294623 - RNA, 18 nt, Human
ugcccaccagaagaggga

SEQ ID NO: 294624 - RNA, 22 nt, Human
uccuccacuuagcgccacuggg

SEQ ID NO: 294625 - RNA, 23 nt, Human
uccuccccaccuuuguccccucc

SEQ ID NO: 294626 - RNA, 22 nt, Human
uccucagcaagacgcuggcagc

SEQ ID NO: 294627 - RNA, 22 nt, Human
ugcauuugcaauggguacacaa

SEQ ID NO: 294628 - RNA, 22 nt, Human
ugcauguuauuguggcaagaau

SEQ ID NO: 294629 - RNA, 22 nt, Human
ugcaugguuauauacuacuagu

SEQ ID NO: 294630 - RNA, 22 nt, Human
ugcauuguuuauggaauaaaau

SEQ ID NO: 294631 - RNA, 22 nt, Human
ugcauuuuuaauuuggaaaaaa

SEQ ID NO: 294632 - RNA, 22 nt, Human
ugcauuuugaaggaaaaaaaug

SEQ ID NO: 294633 - RNA, 22 nt, Human
ugcauuuucuaccacacccacu

SEQ ID NO: 294634 - RNA, 22 nt, Human
ugcaucuaaguggcuaacaacc

SEQ ID NO: 294635 - RNA, 22 nt, Human
ugcauaagguuaaauuagcaga

SEQ ID NO: 294636 - RNA, 22 nt, Human
ugcaucauuaagguacaguugg

SEQ ID NO: 294637 - RNA, 22 nt, Human
ugcuggaaggguaguauuaacu

SEQ ID NO: 294638 - RNA, 22 nt, Human
ucucauugugcuuuuuguacug

SEQ ID NO: 294639 - RNA, 22 nt, Human
ucuccaggaaagacacuggacu

SEQ ID NO: 294640 - RNA, 22 nt, Human
ucucagggaugggaggccccag

SEQ ID NO: 294641 - RNA, 22 nt, Human
ucucauaauuguuucccagcua

SEQ ID NO: 294642 - RNA, 22 nt, Human
ucucauacguuuccagguguca

SEQ ID NO: 294643 - RNA, 20 nt, Human
ucucauuuugauuucgcauu

SEQ ID NO: 294644 - RNA, 22 nt, Human
ugcugcuguuuccuacaucuca

SEQ ID NO: 294645 - RNA, 21 nt, Human
ucucauuuuaacacagaguug

SEQ ID NO: 294646 - RNA, 22 nt, Human
ugcuguugacuuuguuguucuu

SEQ ID NO: 294647 - RNA, 22 nt, Human
ucuccuaauuacauacuugauu

SEQ ID NO: 294648 - RNA, 20 nt, Human
ugcugugugucuacuguggg

SEQ ID NO: 294649 - RNA, 20 nt, Human
ugcuguggguaagcuuuaua

SEQ ID NO: 294650 - RNA, 22 nt, Human
ugcugugcuggcggcagaggcc

SEQ ID NO: 294651 - RNA, 22 nt, Human
ucucccgcuuccugcuggcugc

SEQ ID NO: 294652 - RNA, 22 nt, Human
ucuccccagcucgcucucuccc

SEQ ID NO: 294653 - RNA, 23 nt, Human
ucuccccuccagcccucccuccu

SEQ ID NO: 294654 - RNA, 22 nt, Human
ucuccccucuggucugggcucu

SEQ ID NO: 294655 - RNA, 22 nt, Human
ugcuggugauuaaauccugaag

SEQ ID NO: 294656 - RNA, 16 nt, Human
ucucccuguucuccaa

SEQ ID NO: 294657 - RNA, 22 nt, Human
ugcuguacaagacccucuguuu

SEQ ID NO: 294658 - RNA, 22 nt, Human
ucgccuccucccagaucaacaa

SEQ ID NO: 294659 - RNA, 22 nt, Human
ucuagggcaguacaaauucaag

SEQ ID NO: 294660 - RNA, 20 nt, Human
ucuaggguuugguuaucauc

SEQ ID NO: 294661 - RNA, 23 nt, Human
ucucaccaggauaugacugucac

SEQ ID NO: 294662 - RNA, 23 nt, Human
ugcugcgggacccgagcgcgcgc

SEQ ID NO: 294663 - RNA, 23 nt, Human
ugcugcuggaguaucuacaaugc

SEQ ID NO: 294664 - RNA, 22 nt, Human
ugcugcuguuaucauuuuacca

SEQ ID NO: 294665 - RNA, 22 nt, Human
ucucugugaauggcgucaccug

SEQ ID NO: 294666 - RNA, 22 nt, Human
ugcuuguuuuguggcuucagcu

SEQ ID NO: 294667 - RNA, 22 nt, Human
ugcuuuccuucccuauguugag

SEQ ID NO: 294668 - RNA, 22 nt, Human
ugcuuucaaugaauuguauacu

SEQ ID NO: 294669 - RNA, 21 nt, Human
ugcuuucugugcuuuuucugc

SEQ ID NO: 294670 - RNA, 22 nt, Human
ucucuuuuuuuaaaacucuaug

SEQ ID NO: 294671 - RNA, 22 nt, Human
ucugaguaauacucuugccuug

SEQ ID NO: 294672 - RNA, 22 nt, Human
ucugagucgcucccuggaucca

SEQ ID NO: 294673 - RNA, 22 nt, Human
ucugagugggaacucucaugac

SEQ ID NO: 294674 - RNA, 22 nt, Human
ucugagugacguccugacagga

SEQ ID NO: 294675 - RNA, 22 nt, Human
ucugacugucccguagaggaac

SEQ ID NO: 294676 - RNA, 22 nt, Human
ucugacuucuuuuauuaucauu

SEQ ID NO: 294677 - RNA, 22 nt, Human
ucugaggaauaagaugucuaaa

SEQ ID NO: 294678 - RNA, 22 nt, Human
ucugagcaggaaagagcagaga

SEQ ID NO: 294679 - RNA, 22 nt, Human
uggaaaacgcaguuuaauuuuu

SEQ ID NO: 294680 - RNA, 22 nt, Human
uggaaaagaugucuuccugaau

SEQ ID NO: 294681 - RNA, 21 nt, Human
ugcuuuuguugucagcugcug

SEQ ID NO: 294682 - RNA, 22 nt, Human
ucugaccaggcucuuguagccu

SEQ ID NO: 294683 - RNA, 22 nt, Human
ugcuuuggcccaacauugaugc

SEQ ID NO: 294684 - RNA, 22 nt, Human
ugcuucuuugggggugaagaga

SEQ ID NO: 294685 - RNA, 22 nt, Human
ucuccuuugaaaguuaggacug

SEQ ID NO: 294686 - RNA, 22 nt, Human
ugcuuacauuuugcuggucucc

SEQ ID NO: 294687 - RNA, 22 nt, Human
ugcuuaucuccuuaguuuuugc

SEQ ID NO: 294688 - RNA, 22 nt, Human
ugcuuaaagcauuucucuuuaa

SEQ ID NO: 294689 - RNA, 22 nt, Human
ugcuuguuuguuuucuuccauu

SEQ ID NO: 294690 - RNA, 22 nt, Human
ugcuugugcacacacauguuau

SEQ ID NO: 294691 - RNA, 22 nt, Human
ucucugucucccguguguccgg

SEQ ID NO: 294692 - RNA, 22 nt, Human
ucucugguagcucugugcucug

SEQ ID NO: 294693 - RNA, 19 nt, Human
ucucugguggcuccaucag

SEQ ID NO: 294694 - RNA, 22 nt, Human
ugcuugggucuguuuugcaaag

SEQ ID NO: 294695 - RNA, 22 nt, Human
ucucuggcuuuuuuuccauuuu

SEQ ID NO: 294696 - RNA, 22 nt, Human
ucucugcguucaucccaucaca

SEQ ID NO: 294697 - RNA, 22 nt, Human
ucuucaaauacagucauauuga

SEQ ID NO: 294698 - RNA, 22 nt, Human
ucuuauuucuuucuuuuccugu

SEQ ID NO: 294699 - RNA, 22 nt, Human
ucuucagacuguuguucuuuug

SEQ ID NO: 294700 - RNA, 22 nt, Human
uggaugacaaccauuggaagag

SEQ ID NO: 294701 - RNA, 22 nt, Human
ucuuauugugaugaugaagaac

SEQ ID NO: 294702 - RNA, 22 nt, Human
uggcaacucaauuucuacaaga

SEQ ID NO: 294703 - RNA, 22 nt, Human
uggauuguuuacaucaugucug

SEQ ID NO: 294704 - RNA, 22 nt, Human
ucuuccucuccuggggcauuug

SEQ ID NO: 294705 - RNA, 22 nt, Human
ucuuccauuccccuccuacgcc

SEQ ID NO: 294706 - RNA, 22 nt, Human
ucuucccgggcaucucugcuca

SEQ ID NO: 294707 - RNA, 22 nt, Human
ucuucuauaucuacauaugcaa

SEQ ID NO: 294708 - RNA, 22 nt, Human
uggcagugggaagcuggaaguc

SEQ ID NO: 294709 - RNA, 22 nt, Human
ucuuccacuugaaccuucuguc

SEQ ID NO: 294710 - RNA, 22 nt, Human
uggcaguagagcuggaacuuga

SEQ ID NO: 294711 - RNA, 22 nt, Human
ucuuccagauacuuccugacuu

SEQ ID NO: 294712 - RNA, 22 nt, Human
ucuucaugaaauugauugcuua

SEQ ID NO: 294713 - RNA, 22 nt, Human
ucuucauuucuggggaauuggc

SEQ ID NO: 294714 - RNA, 22 nt, Human
ucuuucucuccagccuggaccu

SEQ ID NO: 294715 - RNA, 22 nt, Human
uggccuucagcucuggggugca

SEQ ID NO: 294716 - RNA, 22 nt, Human
uggcgugaagcuggaaggcgga

SEQ ID NO: 294717 - RNA, 22 nt, Human
uggcucacuuccguggagaggu

SEQ ID NO: 294718 - RNA, 22 nt, Human
uggcucagcgcggccuggucuu

SEQ ID NO: 294719 - RNA, 22 nt, Human
uggcucaggccuacgacgccuu

SEQ ID NO: 294720 - RNA, 22 nt, Human
uggcuacguacaauggaacuuu

SEQ ID NO: 294721 - RNA, 18 nt, Human
uggcuagaagagcucuca

SEQ ID NO: 294722 - RNA, 22 nt, Human
uggcucacaggaggcagaggug

SEQ ID NO: 294723 - RNA, 22 nt, Human
uggcggagacauggacuucaga

SEQ ID NO: 294724 - RNA, 22 nt, Human
uggcggcggggagguaggcaga

SEQ ID NO: 294725 - RNA, 22 nt, Human
uggcgcgcucgcucucgcugag

SEQ ID NO: 294726 - RNA, 22 nt, Human
uggcgacuggaauuaaucuuuu

SEQ ID NO: 294727 - RNA, 22 nt, Human
uggccugauuuugcuaagagaa

SEQ ID NO: 294728 - RNA, 22 nt, Human
uggcccugaaucaaggccagca

SEQ ID NO: 294729 - RNA, 21 nt, Human
uggccaaggaauagaagcucu

SEQ ID NO: 294730 - RNA, 22 nt, Human
uggcauuuuguagcuguguauc

SEQ ID NO: 294731 - RNA, 22 nt, Human
ucuugccuuuucuagcuucuag

SEQ ID NO: 294732 - RNA, 22 nt, Human
ucuugcuggagucaaggcuaca

SEQ ID NO: 294733 - RNA, 22 nt, Human
ucugucaguguccucguguggu

SEQ ID NO: 294734 - RNA, 22 nt, Human
uggacuguucauugauacugga

SEQ ID NO: 294735 - RNA, 22 nt, Human
ucuguaacaucaguguaauuuu

SEQ ID NO: 294736 - RNA, 22 nt, Human
ucuguagucuuggagccgcaca

SEQ ID NO: 294737 - RNA, 22 nt, Human
ucuguaauccacacagguggau

SEQ ID NO: 294738 - RNA, 22 nt, Human
uggaagugggcaucaccaucca

SEQ ID NO: 294739 - RNA, 22 nt, Human
uggaaggggccaggcgcggagu

SEQ ID NO: 294740 - RNA, 22 nt, Human
ucuguaaaugcaaguuuuccuc

SEQ ID NO: 294741 - RNA, 22 nt, Human
ucuguaccuuauguucagagug

SEQ ID NO: 294742 - RNA, 21 nt, Human
ucugugcuuuuuuggcuccua

SEQ ID NO: 294743 - RNA, 22 nt, Human
ucugugcuggacugauuucaua

SEQ ID NO: 294744 - RNA, 22 nt, Human
ucuguggcaaacacagugacca

SEQ ID NO: 294745 - RNA, 22 nt, Human
ucugugcuccuuccuugucauc

SEQ ID NO: 294746 - RNA, 21 nt, Human
ucugucuaguuaccaccgccc

SEQ ID NO: 294747 - RNA, 22 nt, Human
uggagucagaaugcgacaggcc

SEQ ID NO: 294748 - RNA, 19 nt, Human
ucuguggagcucagaguag

SEQ ID NO: 294749 - RNA, 22 nt, Human
ucuguguuccuggcaccaaacu

SEQ ID NO: 294750 - RNA, 22 nt, Human
uggauauuuuguaugugcguuu

SEQ ID NO: 294751 - RNA, 22 nt, Human
uggauaugaaacaaaacaagag

SEQ ID NO: 294752 - RNA, 22 nt, Human
ucuguucacaauuacacacacu

SEQ ID NO: 294753 - RNA, 22 nt, Human
ucuguuguauggcugucuaauu

SEQ ID NO: 294754 - RNA, 19 nt, Human
ucuguugcuuuguguccuc

SEQ ID NO: 294755 - RNA, 22 nt, Human
ucuguuuugugcuuuguuuucu

SEQ ID NO: 294756 - RNA, 22 nt, Human
uggaaggugauucucugguuaa

SEQ ID NO: 294757 - RNA, 22 nt, Human
uggaagcccagaaggaagcaga

SEQ ID NO: 294758 - RNA, 22 nt, Human
uggaagggguuacgcagcagga

SEQ ID NO: 294759 - RNA, 22 nt, Human
ucuggcuucaguaggguucacu

SEQ ID NO: 294760 - RNA, 22 nt, Human
ucuggcucuccagugcucuuag

SEQ ID NO: 294761 - RNA, 22 nt, Human
uggaaguggcaggggagacgua

SEQ ID NO: 294762 - RNA, 22 nt, Human
ucugggucuaucccaugccuuu

SEQ ID NO: 294763 - RNA, 22 nt, Human
ucuggucugccgagauccauuu

SEQ ID NO: 294764 - RNA, 22 nt, Human
ucugguuaggcuugugaggucc

SEQ ID NO: 294765 - RNA, 22 nt, Human
uggaagugucagcaggcugguu

SEQ ID NO: 294766 - RNA, 22 nt, Human
uggaagaaaacuuggaaggcau

SEQ ID NO: 294767 - RNA, 21 nt, Human
ucugaggagaaacucuuggug

SEQ ID NO: 294768 - RNA, 22 nt, Human
ucugauaaggaaggauuaaaag

SEQ ID NO: 294769 - RNA, 22 nt, Human
ucugcgggccuggcucccagcg

SEQ ID NO: 294770 - RNA, 22 nt, Human
ucugcuggugucauuuuugcua

SEQ ID NO: 294771 - RNA, 22 nt, Human
ucugcuuaguuuucuugaacag

SEQ ID NO: 294772 - RNA, 22 nt, Human
ucugcuguugaucaugacuagc

SEQ ID NO: 294773 - RNA, 22 nt, Human
uggaagcuagggguuucuguug

SEQ ID NO: 294774 - RNA, 22 nt, Human
uggaagcuggcugaucugacuu

SEQ ID NO: 294775 - RNA, 22 nt, Human
ucuauuauauuuacacgagagu

SEQ ID NO: 294776 - RNA, 22 nt, Human
ucucaaacuauauaugggguuc

SEQ ID NO: 294777 - RNA, 22 nt, Human
ucuauuguuauccuuuccauuu

SEQ ID NO: 294778 - RNA, 22 nt, Human
ucuaugcuacguuccucugaaa

SEQ ID NO: 294779 - RNA, 22 nt, Human
uaguugaauuuaucaguagcau

SEQ ID NO: 294780 - RNA, 22 nt, Human
uaguucugaauagcauugaaga

SEQ ID NO: 294781 - RNA, 22 nt, Human
ucuauauucuauguucuucuuu

SEQ ID NO: 294782 - RNA, 21 nt, Human
ucuauccuggcuuuccacuug

SEQ ID NO: 294783 - RNA, 21 nt, Human
ucucaagguaacauuuaagau

SEQ ID NO: 294784 - RNA, 22 nt, Human
ucucaggcuuccuggugcugug

SEQ ID NO: 294785 - RNA, 22 nt, Human
ucucacucuuccccaugucaga

SEQ ID NO: 294786 - RNA, 23 nt, Human
ucucacucauucuccucugucca

SEQ ID NO: 294787 - RNA, 22 nt, Human
uaggacuuguccauccaggaca

SEQ ID NO: 294788 - RNA, 22 nt, Human
uaguguuauuucuuaugugcua

SEQ ID NO: 294789 - RNA, 22 nt, Human
uaguuagagggaagcgacucgg

SEQ ID NO: 294790 - RNA, 22 nt, Human
uaguuaaugauagggagagggg

SEQ ID NO: 294791 - RNA, 22 nt, Human
uaggauaacaauuuguaguuuc

SEQ ID NO: 294792 - RNA, 22 nt, Human
uagugucuuccaggacauggua

SEQ ID NO: 294793 - RNA, 22 nt, Human
ucucauaucuguacacccuugu

SEQ ID NO: 294794 - RNA, 22 nt, Human
uauaaagaccuuauccuucaua

SEQ ID NO: 294795 - RNA, 22 nt, Human
uaguuggguagacaguucuaca

SEQ ID NO: 294796 - RNA, 22 nt, Human
uaguuucuaauguugaaauuau

SEQ ID NO: 294797 - RNA, 17 nt, Human
ucuccuggcucuaucag

SEQ ID NO: 294798 - RNA, 22 nt, Human
ucuccuuuggggccucaggguu

SEQ ID NO: 294799 - RNA, 22 nt, Human
uauaggaugaugucauguugcu

SEQ ID NO: 294800 - RNA, 22 nt, Human
ucucccuuuggauuuguuuugg

SEQ ID NO: 294801 - RNA, 22 nt, Human
ucucccuggccagcccuuuccc

SEQ ID NO: 294802 - RNA, 22 nt, Human
uauaagaaacaaggcaaauuuu

SEQ ID NO: 294803 - RNA, 22 nt, Human
uauaaucuugcccauaguauuu

SEQ ID NO: 294804 - RNA, 22 nt, Human
uauagccuuacaagauauuaua

SEQ ID NO: 294805 - RNA, 22 nt, Human
uauagcaagagaaccauuacca

SEQ ID NO: 294806 - RNA, 22 nt, Human
uauacucaauaaauauuuggag

SEQ ID NO: 294807 - RNA, 22 nt, Human
uauacauauacaaaugcacaua

SEQ ID NO: 294808 - RNA, 22 nt, Human
ucugaguagaaucauucauaaa

SEQ ID NO: 294809 - RNA, 22 nt, Human
ucugaggacagugcugugccug

SEQ ID NO: 294810 - RNA, 22 nt, Human
ucugacguugguucugcccuuu

SEQ ID NO: 294811 - RNA, 17 nt, Human
ucugaccuuuacuccug

SEQ ID NO: 294812 - RNA, 22 nt, Human
uaucugcuggagguaauuacuc

SEQ ID NO: 294813 - RNA, 22 nt, Human
ucugaccccccuugccuccacu

SEQ ID NO: 294814 - RNA, 22 nt, Human
ucugaaaggagaguagggcaga

SEQ ID NO: 294815 - RNA, 22 nt, Human
ucugaauauguuuaucaucucu

SEQ ID NO: 294816 - RNA, 18 nt, Human
ucugaaggaaugauucca

SEQ ID NO: 294817 - RNA, 20 nt, Human
ucucuuuuucuucuuuucuc

SEQ ID NO: 294818 - RNA, 22 nt, Human
ucugaaauuuuaguuauagaaa

SEQ ID NO: 294819 - RNA, 22 nt, Human
ucugaagagaacucuuaguguu

SEQ ID NO: 294820 - RNA, 22 nt, Human
uauccuaaaggguaguguggga

SEQ ID NO: 294821 - RNA, 22 nt, Human
uauccuaagguaguuuuaguuu

SEQ ID NO: 294822 - RNA, 22 nt, Human
uauccaucuucuuugagaaugg

SEQ ID NO: 294823 - RNA, 22 nt, Human
ucucuucacuuguaugcuauca

SEQ ID NO: 294824 - RNA, 22 nt, Human
ucucuugcuauugcgaacaggu

SEQ ID NO: 294825 - RNA, 22 nt, Human
ucucuguaguugggcagcugcu

SEQ ID NO: 294826 - RNA, 22 nt, Human
ucucuucggagagaccuuugga

SEQ ID NO: 294827 - RNA, 22 nt, Human
ucucugguggcuccaucaguag

SEQ ID NO: 294828 - RNA, 22 nt, Human
uauaugaggauauuuuaaagcu

SEQ ID NO: 294829 - RNA, 22 nt, Human
uauaugcacucagguguaugug

SEQ ID NO: 294830 - RNA, 22 nt, Human
ucucuguacauagugaagcccg

SEQ ID NO: 294831 - RNA, 22 nt, Human
uauauauaugcaccacaugugu

SEQ ID NO: 294832 - RNA, 22 nt, Human
uauccaaaggaacaaucacagc

SEQ ID NO: 294833 - RNA, 22 nt, Human
uaucauuaggagugcugcucgg

SEQ ID NO: 294834 - RNA, 22 nt, Human
ucucugagggugaucaugagaa

SEQ ID NO: 294835 - RNA, 22 nt, Human
uaucacauaaaugaggaauauu

SEQ ID NO: 294836 - RNA, 22 nt, Human
uaucaguagaacaauggacauu

SEQ ID NO: 294837 - RNA, 22 nt, Human
uauauuuguccuagcuccuagc

SEQ ID NO: 294838 - RNA, 22 nt, Human
uauauguagcucaaaaauuccc

SEQ ID NO: 294839 - RNA, 22 nt, Human
uauauacacgcacauauacaua

SEQ ID NO: 294840 - RNA, 22 nt, Human
uauauacuugaaaauugcugag

SEQ ID NO: 294841 - RNA, 22 nt, Human
ucucuacugcuucugugaguga

SEQ ID NO: 294842 - RNA, 22 nt, Human
ucucgcuguuccugcuucaggu

SEQ ID NO: 294843 - RNA, 22 nt, Human
ucucucguuuuuugcagauaaa

SEQ ID NO: 294844 - RNA, 22 nt, Human
ucucuagcuuccuuaggaacac

SEQ ID NO: 294845 - RNA, 22 nt, Human
ucugcccguucaaauccuuguu

SEQ ID NO: 294846 - RNA, 22 nt, Human
ucugcggccuagcgcccggcgc

SEQ ID NO: 294847 - RNA, 22 nt, Human
uaugcagauaguuugccauuca

SEQ ID NO: 294848 - RNA, 22 nt, Human
uaugccuaccuccaaaauauau

SEQ ID NO: 294849 - RNA, 22 nt, Human
ucugauucucuuguugaccuag

SEQ ID NO: 294850 - RNA, 22 nt, Human
ucugaugaccacaugugggacu

SEQ ID NO: 294851 - RNA, 22 nt, Human
uaugagguuaucuaugucguau

SEQ ID NO: 294852 - RNA, 22 nt, Human
ucugaucagaagacaaaugagg

SEQ ID NO: 294853 - RNA, 19 nt, Human
uaugacaaguacuaguucu

SEQ ID NO: 294854 - RNA, 22 nt, Human
uaugacccccugcacaugugac

SEQ ID NO: 294855 - RNA, 19 nt, Human
uaugaaguugauaaaaguu

SEQ ID NO: 294856 - RNA, 22 nt, Human
uaugaauauaccacaauuuagg

SEQ ID NO: 294857 - RNA, 21 nt, Human
ucuggccuauaaaguagucgc

SEQ ID NO: 294858 - RNA, 22 nt, Human
ucuggcucaggagcuguguuca

SEQ ID NO: 294859 - RNA, 22 nt, Human
ucuggcaguugccgcuucaguc

SEQ ID NO: 294860 - RNA, 22 nt, Human
ucuggcacuugccaguuucuau

SEQ ID NO: 294861 - RNA, 20 nt, Human
uaugugcaguuugguuuauc

SEQ ID NO: 294862 - RNA, 22 nt, Human
ucugggccacccgccuccaggg

SEQ ID NO: 294863 - RNA, 22 nt, Human
uaugugaaauggaauauagaaa

SEQ ID NO: 294864 - RNA, 22 nt, Human
uaugguuagugcuguagauuau

SEQ ID NO: 294865 - RNA, 22 nt, Human
uauguacauauauguguauaua

SEQ ID NO: 294866 - RNA, 22 nt, Human
uauguaacaccauuuacaaagu

SEQ ID NO: 294867 - RNA, 22 nt, Human
uaugguuucuccugcagauuug

SEQ ID NO: 294868 - RNA, 20 nt, Human
ucugcuugucuucagguucc

SEQ ID NO: 294869 - RNA, 22 nt, Human
ucugcguggcgugguucugugc

SEQ ID NO: 294870 - RNA, 22 nt, Human
uaugcuguauucuguauguuag

SEQ ID NO: 294871 - RNA, 22 nt, Human
uauggcuucucagucaugaaaa

SEQ ID NO: 294872 - RNA, 22 nt, Human
ucuguuuuuaucuauucuguua

SEQ ID NO: 294873 - RNA, 22 nt, Human
ucuuaaauaugaaaaggauuau

SEQ ID NO: 294874 - RNA, 21 nt, Human
ucuuauacagcaauagaucug

SEQ ID NO: 294875 - RNA, 22 nt, Human
ucuuacuguccucuguuuuucu

SEQ ID NO: 294876 - RNA, 22 nt, Human
ucuuaaucauucuucacuuccu

SEQ ID NO: 294877 - RNA, 22 nt, Human
ucuucacagaugcauauacuuc

SEQ ID NO: 294878 - RNA, 22 nt, Human
ucuucacugaagcuuugcaucu

SEQ ID NO: 294879 - RNA, 20 nt, Human
ucuucagcuccaagucuggc

SEQ ID NO: 294880 - RNA, 22 nt, Human
ucuuauucuuuuaaacaacgca

SEQ ID NO: 294881 - RNA, 22 nt, Human
ucuguuauaaaucacacugcau

SEQ ID NO: 294882 - RNA, 22 nt, Human
ucuguuuuccaggaaucucaua

SEQ ID NO: 294883 - RNA, 22 nt, Human
ucuguuuacaugucagcagcaa

SEQ ID NO: 294884 - RNA, 18 nt, Human
uauuccucuuccucuauc

SEQ ID NO: 294885 - RNA, 22 nt, Human
uauucccacuccucagcaauuu

SEQ ID NO: 294886 - RNA, 22 nt, Human
uauuaugguuguagguuaacaa

SEQ ID NO: 294887 - RNA, 22 nt, Human
uauucagugcugguucuuuuuc

SEQ ID NO: 294888 - RNA, 22 nt, Human
ucugugugugcauguguguaua

SEQ ID NO: 294889 - RNA, 22 nt, Human
uauguuuugcaaauaucaaaca

SEQ ID NO: 294890 - RNA, 22 nt, Human
uauguuugcaguucuaggucuu

SEQ ID NO: 294891 - RNA, 22 nt, Human
uauuacugccacaucauuaggu

SEQ ID NO: 294892 - RNA, 22 nt, Human
uauuaauugugguuauuguauu

SEQ ID NO: 294893 - RNA, 22 nt, Human
uauuaaaagagaaaaagccacc

SEQ ID NO: 294894 - RNA, 22 nt, Human
ucuggguaacugaggcuaauau

SEQ ID NO: 294895 - RNA, 17 nt, Human
ucuggguuucugauuua

SEQ ID NO: 294896 - RNA, 22 nt, Human
ucuggggaugagugaugucgua

SEQ ID NO: 294897 - RNA, 22 nt, Human
uauguuaaauguuugauguuua

SEQ ID NO: 294898 - RNA, 22 nt, Human
uauguuaauuaccagcacugau

SEQ ID NO: 294899 - RNA, 22 nt, Human
ucuguauuuuuuacacacaugc

SEQ ID NO: 294900 - RNA, 22 nt, Human
ucuggugcacucugauauuuga

SEQ ID NO: 294901 - RNA, 22 nt, Human
ucugguagauuauuuagaguac

SEQ ID NO: 294902 - RNA, 22 nt, Human
ucaguuacucugauguccugug

SEQ ID NO: 294903 - RNA, 22 nt, Human
ucaguugauggcaguuaauguc

SEQ ID NO: 294904 - RNA, 22 nt, Human
ucauaggaguagcagugagagg

SEQ ID NO: 294905 - RNA, 22 nt, Human
ucaucgauggggagcucuacaa

SEQ ID NO: 294906 - RNA, 22 nt, Human
ucauaaaggugccacucaguuu

SEQ ID NO: 294907 - RNA, 22 nt, Human
ucauaagucucauauaugucca

SEQ ID NO: 294908 - RNA, 21 nt, Human
ucauaauaauuacaugggggg

SEQ ID NO: 294909 - RNA, 22 nt, Human
uaagcguuugggaguuaugaac

SEQ ID NO: 294910 - RNA, 22 nt, Human
uaagcuauuccugaagaagguu

SEQ ID NO: 294911 - RNA, 22 nt, Human
ucaugagagaaaacgugcuucu

SEQ ID NO: 294912 - RNA, 22 nt, Human
ucaugcagaguagaaagggcaa

SEQ ID NO: 294913 - RNA, 22 nt, Human
uaaggagagaauuuagagguuu

SEQ ID NO: 294914 - RNA, 22 nt, Human
ucauggguauaauuuuagaugu

SEQ ID NO: 294915 - RNA, 22 nt, Human
ucauuagcuaucagaguggaac

SEQ ID NO: 294916 - RNA, 22 nt, Human
uaagucaagagcuagaaaaagc

SEQ ID NO: 294917 - RNA, 22 nt, Human
uaaguauguuagaaaaucaagu

SEQ ID NO: 294918 - RNA, 22 nt, Human
uaaguaauugugguuuuugcca

SEQ ID NO: 294919 - RNA, 22 nt, Human
uccaagacagauaccuagaaga

SEQ ID NO: 294920 - RNA, 18 nt, Human
uccaaaccuuuuacuucc

SEQ ID NO: 294921 - RNA, 19 nt, Human
uccaaaauacuuguuacug

SEQ ID NO: 294922 - RNA, 21 nt, Human
uccaaaggagacugagugugu

SEQ ID NO: 294923 - RNA, 22 nt, Human
uacaaucacccaaagagccaga

SEQ ID NO: 294924 - RNA, 22 nt, Human
ucauuuguauucuacaaagcac

SEQ ID NO: 294925 - RNA, 22 nt, Human
ucauuuuaucaggaauggaauc

SEQ ID NO: 294926 - RNA, 22 nt, Human
ucauuuaucgcugccuuuuaaa

SEQ ID NO: 294927 - RNA, 22 nt, Human
uaauauauuuuuuaagggaugu

SEQ ID NO: 294928 - RNA, 22 nt, Human
uaauauaacugccaguuaaggu

SEQ ID NO: 294929 - RNA, 22 nt, Human
uaauaguugaaggucaucacua

SEQ ID NO: 294930 - RNA, 22 nt, Human
uaauagauagggagaguugcug

SEQ ID NO: 294931 - RNA, 22 nt, Human
ucauuauuuggaauaugggacu

SEQ ID NO: 294932 - RNA, 22 nt, Human
ucauugugugugcuucuugggc

SEQ ID NO: 294933 - RNA, 22 nt, Human
ucauuguuuacugucuuuuuuc

SEQ ID NO: 294934 - RNA, 22 nt, Human
uaauuuugucacagugacaugc

SEQ ID NO: 294935 - RNA, 22 nt, Human
uaauuuagugcauuuccuagua

SEQ ID NO: 294936 - RNA, 22 nt, Human
uaauugagauuucuggcugcuu

SEQ ID NO: 294937 - RNA, 20 nt, Human
ucagugggaaagugagagug

SEQ ID NO: 294938 - RNA, 22 nt, Human
uaacuguuuugaauauuguggu

SEQ ID NO: 294939 - RNA, 22 nt, Human
uaacagugcuacaguuacuuuc

SEQ ID NO: 294940 - RNA, 22 nt, Human
uaaccaggaaaaagauaugcau

SEQ ID NO: 294941 - RNA, 22 nt, Human
uaacauuucggugacaguggga

SEQ ID NO: 294942 - RNA, 22 nt, Human
ucagucucuggggcuucuguuu

SEQ ID NO: 294943 - RNA, 22 nt, Human
uaaccuugaagacugagcugac

SEQ ID NO: 294944 - RNA, 22 nt, Human
uaaaugagcaccucuaguuuug

SEQ ID NO: 294945 - RNA, 22 nt, Human
uaaauuccuagucacaaacuuc

SEQ ID NO: 294946 - RNA, 22 nt, Human
uaaaugcucuuuaaaagugcuu

SEQ ID NO: 294947 - RNA, 22 nt, Human
uaacaacuuucugguguaacuu

SEQ ID NO: 294948 - RNA, 22 nt, Human
ucagucauacuuuaugauugaa

SEQ ID NO: 294949 - RNA, 22 nt, Human
ucagucugcuauagguauuugu

SEQ ID NO: 294950 - RNA, 22 nt, Human
ucagucugguggaugcucauug

SEQ ID NO: 294951 - RNA, 22 nt, Human
ucagugagauuuuuagcaguag

SEQ ID NO: 294952 - RNA, 22 nt, Human
ucagucuucaggacuaugaaaa

SEQ ID NO: 294953 - RNA, 22 nt, Human
uaaagcauguuucaguaagguu

SEQ ID NO: 294954 - RNA, 21 nt, Human
ucaagcggcagagcaguuauu

SEQ ID NO: 294955 - RNA, 22 nt, Human
ucaagagauauaugcugguuua

SEQ ID NO: 294956 - RNA, 22 nt, Human
ucaggguacuuguggccaaagu

SEQ ID NO: 294957 - RNA, 20 nt, Human
ucaggguuucccauucuugg

SEQ ID NO: 294958 - RNA, 22 nt, Human
ucaggagaguguucaguggagg

SEQ ID NO: 294959 - RNA, 22 nt, Human
ucaggaggucugcugcggggug

SEQ ID NO: 294960 - RNA, 22 nt, Human
uaaauaugcaugugguauucau

SEQ ID NO: 294961 - RNA, 22 nt, Human
uaaaguguacaagucauaagua

SEQ ID NO: 294962 - RNA, 22 nt, Human
uaaaguauucaaguagcuuucu

SEQ ID NO: 294963 - RNA, 22 nt, Human
uaaaggcaaacucuccaaggau

SEQ ID NO: 294964 - RNA, 22 nt, Human
uaaaugaaaugaagugaaagcu

SEQ ID NO: 294965 - RNA, 22 nt, Human
uaaaugaaaggguuuaauuuau

SEQ ID NO: 294966 - RNA, 22 nt, Human
ucaggucacugauaaaguggaa

SEQ ID NO: 294967 - RNA, 22 nt, Human
ucagguuuuuaaggagcuagga

SEQ ID NO: 294968 - RNA, 22 nt, Human
ucaguauuagugcauuaucagg

SEQ ID NO: 294969 - RNA, 22 nt, Human
uaaaugauaguauugaagguag

SEQ ID NO: 294970 - RNA, 22 nt, Human
ucagucacugugaaaugaauuu

SEQ ID NO: 294971 - RNA, 22 nt, Human
uccuccauguugugcacuugaa

SEQ ID NO: 294972 - RNA, 20 nt, Human
uagcacagacuuuugcuuac

SEQ ID NO: 294973 - RNA, 22 nt, Human
uccucuuguguguuccgguacc

SEQ ID NO: 294974 - RNA, 21 nt, Human
uccugccuggccuucugacua

SEQ ID NO: 294975 - RNA, 21 nt, Human
uccugccuuaguccagagcag

SEQ ID NO: 294976 - RNA, 22 nt, Human
uagcagaacaauagucaaugau

SEQ ID NO: 294977 - RNA, 20 nt, Human
uagcacuguauccucuucau

SEQ ID NO: 294978 - RNA, 22 nt, Human
uagcagcacuauuuguuguagu

SEQ ID NO: 294979 - RNA, 22 nt, Human
uccuggaagggaugguugagga

SEQ ID NO: 294980 - RNA, 22 nt, Human
uccuggcgugggcuggcugcag

SEQ ID NO: 294981 - RNA, 19 nt, Human
uccuuaguugcugccgcua

SEQ ID NO: 294982 - RNA, 22 nt, Human
uccuuccucuuucaaauuuguu

SEQ ID NO: 294983 - RNA, 22 nt, Human
uccuucagaggacggcagccag

SEQ ID NO: 294984 - RNA, 22 nt, Human
uagcuaccucugcaaggugaua

SEQ ID NO: 294985 - RNA, 22 nt, Human
uagcucuaaggagaaucccucu

SEQ ID NO: 294986 - RNA, 22 nt, Human
uagcuggaggggcaggaugcug

SEQ ID NO: 294987 - RNA, 22 nt, Human
uagcucuuaccagugaaguuug

SEQ ID NO: 294988 - RNA, 22 nt, Human
ucccuugagcccugaggucccu

SEQ ID NO: 294989 - RNA, 22 nt, Human
uagaacuguaaauuaucucucc

SEQ ID NO: 294990 - RNA, 20 nt, Human
uccgaaucaugacuuugcac

SEQ ID NO: 294991 - RNA, 22 nt, Human
ucccuguuuccugcgcuccuuc

SEQ ID NO: 294992 - RNA, 22 nt, Human
uacuuuuuucacuucuagcccc

SEQ ID NO: 294993 - RNA, 22 nt, Human
ucccuucagcuccagcucugcu

SEQ ID NO: 294994 - RNA, 22 nt, Human
uccgggcagcuccuggagcugu

SEQ ID NO: 294995 - RNA, 22 nt, Human
uccucagagacaaguugagagg

SEQ ID NO: 294996 - RNA, 22 nt, Human
uagagugcugucaaagacuugu

SEQ ID NO: 294997 - RNA, 22 nt, Human
uagaggcuagugguuaugaccu

SEQ ID NO: 294998 - RNA, 22 nt, Human
ucccucacacagcugggagaac

SEQ ID NO: 294999 - RNA, 22 nt, Human
ucccggcaccgggagccccugc

SEQ ID NO: 295000 - RNA, 22 nt, Human
uccccugccccccauccucugg

SEQ ID NO: 295001 - RNA, 22 nt, Human
ucccugcaggcauguacucuga

SEQ ID NO: 295002 - RNA, 22 nt, Human
ucccugagcucacauggcagga

SEQ ID NO: 295003 - RNA, 22 nt, Human
ucccugagagacuucuuuggcu

SEQ ID NO: 295004 - RNA, 22 nt, Human
ucccucguuucgaucuuuagaa

SEQ ID NO: 295005 - RNA, 22 nt, Human
ucccugcagggccauugugcag

SEQ ID NO: 295006 - RNA, 22 nt, Human
ucccugccuuauuuucauaugc

SEQ ID NO: 295007 - RNA, 22 nt, Human
uacuugaacaucacuaagagaa

SEQ ID NO: 295008 - RNA, 22 nt, Human
uacuucccacuggggucuacca

SEQ ID NO: 295009 - RNA, 22 nt, Human
uacugauggagauaggcuauca

SEQ ID NO: 295010 - RNA, 22 nt, Human
uacugaguuucacugucugugc

SEQ ID NO: 295011 - RNA, 22 nt, Human
uacugaaagagugguggacucu

SEQ ID NO: 295012 - RNA, 22 nt, Human
uacugaauuacugcugguaaau

SEQ ID NO: 295013 - RNA, 22 nt, Human
uccauggucgauggcugcuggg

SEQ ID NO: 295014 - RNA, 22 nt, Human
uccauguauugcuaacaaauag

SEQ ID NO: 295015 - RNA, 22 nt, Human
uccaucaccacagaggacagag

SEQ ID NO: 295016 - RNA, 18 nt, Human
uccauccucugcucuuca

SEQ ID NO: 295017 - RNA, 22 nt, Human
uacuaccugcaggaacaauuag

SEQ ID NO: 295018 - RNA, 22 nt, Human
uaccuggauaaauguacaaccg

SEQ ID NO: 295019 - RNA, 20 nt, Human
uaccuccccagcagucauga

SEQ ID NO: 295020 - RNA, 20 nt, Human
uacguguccgaugaucacag

SEQ ID NO: 295021 - RNA, 22 nt, Human
uacaggaggaugugcagccagg

SEQ ID NO: 295022 - RNA, 22 nt, Human
uacagcgaaaauuuagcuugau

SEQ ID NO: 295023 - RNA, 23 nt, Human
uacagccaugucgcugauuuaac

SEQ ID NO: 295024 - RNA, 22 nt, Human
uccaaugugccuuauuuugagc

SEQ ID NO: 295025 - RNA, 22 nt, Human
uccaaggacuaaauucuagauu

SEQ ID NO: 295026 - RNA, 20 nt, Human
uacaauauucccacuuugcu

SEQ ID NO: 295027 - RNA, 22 nt, Human
uccagcuucugccugcugcugc

SEQ ID NO: 295028 - RNA, 22 nt, Human
guggagaugagauauaccccuu

SEQ ID NO: 295029 - RNA, 22 nt, Human
guggauggagcuggaagccauu

SEQ ID NO: 295030 - RNA, 22 nt, Human
guggauaaguuguuugaccuac

SEQ ID NO: 295031 - RNA, 22 nt, Human
guggauuucaggcuccccucag

SEQ ID NO: 295032 - RNA, 22 nt, Human
guggauuguaccacgaaaagug

SEQ ID NO: 295033 - RNA, 22 nt, Human
uaggagccagaauugcauuagu

SEQ ID NO: 295034 - RNA, 22 nt, Human
uaggcaaguggaccagagguuu

SEQ ID NO: 295035 - RNA, 22 nt, Human
uaggcagauuccauauuuuggc

SEQ ID NO: 295036 - RNA, 22 nt, Human
guggaaauuuuaggaucaucuu

SEQ ID NO: 295037 - RNA, 22 nt, Human
guggaaauaugggcaacaaaga

SEQ ID NO: 295038 - RNA, 22 nt, Human
guggaagauauuucugguccag

SEQ ID NO: 295039 - RNA, 22 nt, Human
guggaaggaauuaacagacuag

SEQ ID NO: 295040 - RNA, 22 nt, Human
gugcuuugcuaggaccgauugu

SEQ ID NO: 295041 - RNA, 22 nt, Human
guggagaaagcuggaaucugag

SEQ ID NO: 295042 - RNA, 22 nt, Human
gugcuuuaccuuauuggucucg

SEQ ID NO: 295043 - RNA, 22 nt, Human
gugcuugaguaaaaauagucuu

SEQ ID NO: 295044 - RNA, 22 nt, Human
gugcuguuagcgguuuauaaca

SEQ ID NO: 295045 - RNA, 22 nt, Human
gugcuggcaaagagaacaucuu

SEQ ID NO: 295046 - RNA, 17 nt, Human
uagccagcuugugauuu

SEQ ID NO: 295047 - RNA, 22 nt, Human
uagccacuccgcagcaccgggu

SEQ ID NO: 295048 - RNA, 22 nt, Human
uagcauuucacugaucuucacu

SEQ ID NO: 295049 - RNA, 22 nt, Human
uagccucauuauuuacucauga

SEQ ID NO: 295050 - RNA, 22 nt, Human
uagccuguuuuuaugagaauuu

SEQ ID NO: 295051 - RNA, 22 nt, Human
uagccacagaauucugaguaga

SEQ ID NO: 295052 - RNA, 22 nt, Human
uagaagaugccuuaaaguugaa

SEQ ID NO: 295053 - RNA, 22 nt, Human
uagaagaacaugucaaacuaua

SEQ ID NO: 295054 - RNA, 22 nt, Human
uagaacugcucucauacuugcu

SEQ ID NO: 295055 - RNA, 22 nt, Human
uacugucuuuuccuaaaugggu

SEQ ID NO: 295056 - RNA, 22 nt, Human
uagaacaaacagcauguuugau

SEQ ID NO: 295057 - RNA, 22 nt, Human
uagcgggucacccugcugugaa

SEQ ID NO: 295058 - RNA, 22 nt, Human
uagcguucuugcaugcuaaccu

SEQ ID NO: 295059 - RNA, 22 nt, Human
uagcguaugcugugugaugaau

SEQ ID NO: 295060 - RNA, 19 nt, Human
uagcuguucuugaguguga

SEQ ID NO: 295061 - RNA, 22 nt, Human
gugcucuagaaauugucagugg

SEQ ID NO: 295062 - RNA, 22 nt, Human
gugcucuauguugauuccuuga

SEQ ID NO: 295063 - RNA, 22 nt, Human
uagcugucauuggaucagaagg

SEQ ID NO: 295064 - RNA, 22 nt, Human
uagcuucacuuuuguugaugcg

SEQ ID NO: 295065 - RNA, 21 nt, Human
uagcuugaucauuuuauuucc

SEQ ID NO: 295066 - RNA, 22 nt, Human
uaguaugugccuguugucucug

SEQ ID NO: 295067 - RNA, 22 nt, Human
uaguauuuguaauuaucaaagc

SEQ ID NO: 295068 - RNA, 22 nt, Human
uagugauuuaagaaaggugacu

SEQ ID NO: 295069 - RNA, 22 nt, Human
uagucggcuaggagggccuucu

SEQ ID NO: 295070 - RNA, 22 nt, Human
gugggugaguggggccgccuga

SEQ ID NO: 295071 - RNA, 22 nt, Human
uaguggccacugaagugcuaga

SEQ ID NO: 295072 - RNA, 22 nt, Human
uaguggcccagcauuucucaau

SEQ ID NO: 295073 - RNA, 22 nt, Human
guggggcgggucccccgccugg

SEQ ID NO: 295074 - RNA, 22 nt, Human
uaguaugaaaauuagcgggagg

SEQ ID NO: 295075 - RNA, 20 nt, Human
uaguaugggagaagaucucc

SEQ ID NO: 295076 - RNA, 22 nt, Human
gugggcacguccuacugucacu

SEQ ID NO: 295077 - RNA, 18 nt, Human
gugggcacacacucuguu

SEQ ID NO: 295078 - RNA, 22 nt, Human
gugggccaguuccucacaggua

SEQ ID NO: 295079 - RNA, 22 nt, Human
gugggaaacagccuugcuucua

SEQ ID NO: 295080 - RNA, 22 nt, Human
gugggaguggagcucagcaugu

SEQ ID NO: 295081 - RNA, 22 nt, Human
uagggggagugugcugaagcca

SEQ ID NO: 295082 - RNA, 22 nt, Human
uaggguagugggaaacuggacg

SEQ ID NO: 295083 - RNA, 22 nt, Human
uagguaguuuccuguuguuggg

SEQ ID NO: 295084 - RNA, 22 nt, Human
uagguaauacuuagaccugauu

SEQ ID NO: 295085 - RNA, 22 nt, Human
guggcaguaaagcuggaaaagu

SEQ ID NO: 295086 - RNA, 22 nt, Human
guggcagagagcaagugucuga

SEQ ID NO: 295087 - RNA, 22 nt, Human
uaggucaaggccacuucuugga

SEQ ID NO: 295088 - RNA, 22 nt, Human
guggcaaguuuucugacaagga

SEQ ID NO: 295089 - RNA, 18 nt, Human
guggccauugaccagcuu

SEQ ID NO: 295090 - RNA, 22 nt, Human
guggccuuccuguuccuuugaa

SEQ ID NO: 295091 - RNA, 22 nt, Human
guggccugacagaucggaacag

SEQ ID NO: 295092 - RNA, 22 nt, Human
guggcuuuguuuccaaaugaaa

SEQ ID NO: 295093 - RNA, 22 nt, Human
guggcuugguauuaaggugcca

SEQ ID NO: 295094 - RNA, 22 nt, Human
uaggucugaggcugcaucuugg

SEQ ID NO: 295095 - RNA, 22 nt, Human
uagguggaaccauaugaaauuu

SEQ ID NO: 295096 - RNA, 22 nt, Human
uagguuuugugucagaguagaa

SEQ ID NO: 295097 - RNA, 22 nt, Human
guggccaaggcagagaaagagc

SEQ ID NO: 295098 - RNA, 22 nt, Human
uauuuuucacagauuggugcuu

SEQ ID NO: 295099 - RNA, 22 nt, Human
uauuuuauuuagguuuaguugu

SEQ ID NO: 295100 - RNA, 22 nt, Human
uauuuuuuuaacauuuauugua

SEQ ID NO: 295101 - RNA, 22 nt, Human
uauuuuuguuuaccaguuaaca

SEQ ID NO: 295102 - RNA, 22 nt, Human
guugcuaugaaauuaaaauuua

SEQ ID NO: 295103 - RNA, 22 nt, Human
guuggaaauaucagucacguga

SEQ ID NO: 295104 - RNA, 22 nt, Human
ucaaaaauaagauauucuggac

SEQ ID NO: 295105 - RNA, 22 nt, Human
ucaaccucccugcucaccccuc

SEQ ID NO: 295106 - RNA, 22 nt, Human
guugggugccagaggcuucacg

SEQ ID NO: 295107 - RNA, 22 nt, Human
guuggugagaguuagggauuua

SEQ ID NO: 295108 - RNA, 22 nt, Human
guugggaauucggagagaaaua

SEQ ID NO: 295109 - RNA, 22 nt, Human
ucaacauguuuuuuaaaagaaa

SEQ ID NO: 295110 - RNA, 20 nt, Human
guugggagaagugucagcug

SEQ ID NO: 295111 - RNA, 22 nt, Human
ucaaagaucuuugcuuuugggg

SEQ ID NO: 295112 - RNA, 22 nt, Human
ucaaaucugauaggcgacaccu

SEQ ID NO: 295113 - RNA, 22 nt, Human
guucuucucuuguaauggaauc

SEQ ID NO: 295114 - RNA, 22 nt, Human
guucuucagauuccauuucagu

SEQ ID NO: 295115 - RNA, 22 nt, Human
uauuuuagaagauuuggagaaa

SEQ ID NO: 295116 - RNA, 22 nt, Human
uauuuuaaaagcauuaauucuu

SEQ ID NO: 295117 - RNA, 21 nt, Human
guucucacagcugaggugguu

SEQ ID NO: 295118 - RNA, 22 nt, Human
guucuccaggggcuguucaucu

SEQ ID NO: 295119 - RNA, 22 nt, Human
guucucuccugcuggugaugga

SEQ ID NO: 295120 - RNA, 22 nt, Human
guucuguuguugaucuuuggag

SEQ ID NO: 295121 - RNA, 22 nt, Human
uauuuccugcguuucugugagc

SEQ ID NO: 295122 - RNA, 22 nt, Human
guucggcuuccuaugucaugag

SEQ ID NO: 295123 - RNA, 22 nt, Human
guuccugugcccuguucuuucc

SEQ ID NO: 295124 - RNA, 22 nt, Human
guuccugagcaguuccuggcca

SEQ ID NO: 295125 - RNA, 22 nt, Human
guucuacaugacacucaacauu

SEQ ID NO: 295126 - RNA, 18 nt, Human
guucaagcauuuugcucu

SEQ ID NO: 295127 - RNA, 19 nt, Human
uauuagccucaucccagcc

SEQ ID NO: 295128 - RNA, 22 nt, Human
uauuagggaacugcaagacuaa

SEQ ID NO: 295129 - RNA, 22 nt, Human
uauuauggguuuuuguguaaau

SEQ ID NO: 295130 - RNA, 22 nt, Human
guuauuaaauauuuuggugauu

SEQ ID NO: 295131 - RNA, 22 nt, Human
guguugugauuggucagucacu

SEQ ID NO: 295132 - RNA, 22 nt, Human
guguuguaguguguguuucuuu

SEQ ID NO: 295133 - RNA, 21 nt, Human
guguugugagguugguguuag

SEQ ID NO: 295134 - RNA, 22 nt, Human
guguuugagagguacaagggaa

SEQ ID NO: 295135 - RNA, 22 nt, Human
uauguauaacuugauaggauga

SEQ ID NO: 295136 - RNA, 22 nt, Human
uauguauguauguauguauaug

SEQ ID NO: 295137 - RNA, 23 nt, Human
gugugccuuuaucuucuguacuc

SEQ ID NO: 295138 - RNA, 19 nt, Human
guguucuguuauacaguug

SEQ ID NO: 295139 - RNA, 22 nt, Human
guguugaaaaguagcacugcuu

SEQ ID NO: 295140 - RNA, 22 nt, Human
guguucuuuguagaggaucuug

SEQ ID NO: 295141 - RNA, 22 nt, Human
uaugucuauugacuuaggauuu

SEQ ID NO: 295142 - RNA, 22 nt, Human
guuaaaaugauuugugauuuau

SEQ ID NO: 295143 - RNA, 22 nt, Human
guguuuugagaggaugguuuua

SEQ ID NO: 295144 - RNA, 22 nt, Human
uaugugguuugucauuuaauau

SEQ ID NO: 295145 - RNA, 22 nt, Human
uauguggcaggugggagaucag

SEQ ID NO: 295146 - RNA, 22 nt, Human
guuagggcaagggguuccucug

SEQ ID NO: 295147 - RNA, 22 nt, Human
guuaucauccucagaggcaguu

SEQ ID NO: 295148 - RNA, 22 nt, Human
uauguucaauaccagguucuuu

SEQ ID NO: 295149 - RNA, 22 nt, Human
uauguugucuuguucagccaua

SEQ ID NO: 295150 - RNA, 22 nt, Human
uaugaaggauacaccucugauu

SEQ ID NO: 295151 - RNA, 22 nt, Human
guguagauuuguucaccuauua

SEQ ID NO: 295152 - RNA, 22 nt, Human
guguagugugcuguucaguguu

SEQ ID NO: 295153 - RNA, 22 nt, Human
uauccauaccuucaaguuugcu

SEQ ID NO: 295154 - RNA, 22 nt, Human
uaucuuugccuuggguuuuguu

SEQ ID NO: 295155 - RNA, 22 nt, Human
uaucuucaauagcccagaugug

SEQ ID NO: 295156 - RNA, 22 nt, Human
guguaucagaggcuguguuaua

SEQ ID NO: 295157 - RNA, 22 nt, Human
uaugcaucaguaugguuggaaa

SEQ ID NO: 295158 - RNA, 22 nt, Human
uaugcauaauuggauaaguaga

SEQ ID NO: 295159 - RNA, 22 nt, Human
uaugccaaaaauaaguuuuaug

SEQ ID NO: 295160 - RNA, 22 nt, Human
uaugccaccagucuggaacucu

SEQ ID NO: 295161 - RNA, 22 nt, Human
uaugcgguccaucaggggcacu

SEQ ID NO: 295162 - RNA, 22 nt, Human
guguucccauccacaccaagcc

SEQ ID NO: 295163 - RNA, 22 nt, Human
gugguaaagugugccugugguc

SEQ ID NO: 295164 - RNA, 22 nt, Human
gugggugauacugccgugggag

SEQ ID NO: 295165 - RNA, 22 nt, Human
guggugauuugggucuagcuuu

SEQ ID NO: 295166 - RNA, 22 nt, Human
guggugggcgugguguaugccu

SEQ ID NO: 295167 - RNA, 22 nt, Human
guggugaacauuugcaucugcu

SEQ ID NO: 295168 - RNA, 22 nt, Human
gugguaagugcuccuauuggcg

SEQ ID NO: 295169 - RNA, 22 nt, Human
guggugguguuggugacaaguu

SEQ ID NO: 295170 - RNA, 22 nt, Human
gugguuuagccuucauuaaccu

SEQ ID NO: 295171 - RNA, 22 nt, Human
gugguuugacccuucagguaaa

SEQ ID NO: 295172 - RNA, 22 nt, Human
uaucauuuuacugugacauuuu

SEQ ID NO: 295173 - RNA, 22 nt, Human
guagaaaauagauugucucuug

SEQ ID NO: 295174 - RNA, 22 nt, Human
guagaacucuuuccugcguggg

SEQ ID NO: 295175 - RNA, 22 nt, Human
guaugaguggauagauguaucu

SEQ ID NO: 295176 - RNA, 22 nt, Human
guagauaauuuuggaaagcugg

SEQ ID NO: 295177 - RNA, 22 nt, Human
guauucugugugaucaagugau

SEQ ID NO: 295178 - RNA, 21 nt, Human
uaagaacauuaucuucuuccu

SEQ ID NO: 295179 - RNA, 22 nt, Human
gucagugaaccuucaccaaacc

SEQ ID NO: 295180 - RNA, 22 nt, Human
gucagugcuuuaguucaggaug

SEQ ID NO: 295181 - RNA, 20 nt, Human
gucaucucagggacugucug

SEQ ID NO: 295182 - RNA, 22 nt, Human
gucaggaugagggaugaggagu

SEQ ID NO: 295183 - RNA, 22 nt, Human
uaaggcuuuggucaccauggag

SEQ ID NO: 295184 - RNA, 22 nt, Human
uaaggcuguuaggaggauuaaa

SEQ ID NO: 295185 - RNA, 22 nt, Human
uaagcacuuuauaugcuuuauc

SEQ ID NO: 295186 - RNA, 22 nt, Human
guauuggcaguauacauagcac

SEQ ID NO: 295187 - RNA, 22 nt, Human
guccaguaguguuugcaugugg

SEQ ID NO: 295188 - RNA, 22 nt, Human
uaauaucuuuacacauuuucaa

SEQ ID NO: 295189 - RNA, 22 nt, Human
uaauccaaaacugaaucugugg

SEQ ID NO: 295190 - RNA, 22 nt, Human
uaaugaugaacacuuggaagaa

SEQ ID NO: 295191 - RNA, 22 nt, Human
guccguaauuuuugcuugcaga

SEQ ID NO: 295192 - RNA, 22 nt, Human
gucccuggucuaccguggcuuc

SEQ ID NO: 295193 - RNA, 22 nt, Human
guccuaugggaagggauccugg

SEQ ID NO: 295194 - RNA, 22 nt, Human
guccucugggagccuugagccu

SEQ ID NO: 295195 - RNA, 22 nt, Human
guccuggugccaccugcgggau

SEQ ID NO: 295196 - RNA, 22 nt, Human
guccugauggccauuuuucacu

SEQ ID NO: 295197 - RNA, 22 nt, Human
guccuuaaauacgaugaacaug

SEQ ID NO: 295198 - RNA, 22 nt, Human
uaauucuucaauccaguguuca

SEQ ID NO: 295199 - RNA, 22 nt, Human
uaauuauuaauuuuagguugcu

SEQ ID NO: 295200 - RNA, 22 nt, Human
uaauugaacguucauuuuuaau

SEQ ID NO: 295201 - RNA, 22 nt, Human
guccuuuuuuuauacccaggcc

SEQ ID NO: 295202 - RNA, 22 nt, Human
gugaaaauaguaaccuggcuag

SEQ ID NO: 295203 - RNA, 23 nt, Human
gugaacaaugcuccaggagauac

SEQ ID NO: 295204 - RNA, 22 nt, Human
uaccugguuucuuaaacccaaa

SEQ ID NO: 295205 - RNA, 22 nt, Human
uaccgcagagucauugugagga

SEQ ID NO: 295206 - RNA, 22 nt, Human
uaccuagaagagacuuuucugg

SEQ ID NO: 295207 - RNA, 22 nt, Human
uacguaauagcuuuauuuuggg

SEQ ID NO: 295208 - RNA, 22 nt, Human
uacugggugagcugggcuggga

SEQ ID NO: 295209 - RNA, 22 nt, Human
uacguuuuauaucuuuuggaau

SEQ ID NO: 295210 - RNA, 22 nt, Human
uacuuccuucugcccccucuga

SEQ ID NO: 295211 - RNA, 22 nt, Human
gugaagcacaugggcguugggu

SEQ ID NO: 295212 - RNA, 22 nt, Human
gugacuaugguggagaucagua

SEQ ID NO: 295213 - RNA, 22 nt, Human
gugacucuacuuaagauuaagc

SEQ ID NO: 295214 - RNA, 22 nt, Human
gugacugagcuggcaaaguaug

SEQ ID NO: 295215 - RNA, 22 nt, Human
gugaaggggaagcagggagagg

SEQ ID NO: 295216 - RNA, 22 nt, Human
gugaccagacagagucuagccc

SEQ ID NO: 295217 - RNA, 22 nt, Human
uacuuuggugaaauuggaaaua

SEQ ID NO: 295218 - RNA, 22 nt, Human
uacuuugucauucuaaccuucc

SEQ ID NO: 295219 - RNA, 22 nt, Human
gugacugagugaagguugggua

SEQ ID NO: 295220 - RNA, 22 nt, Human
uacuugucuuuauuuuaaugcu

SEQ ID NO: 295221 - RNA, 22 nt, Human
uacuugaaaugggcaucaagag

SEQ ID NO: 295222 - RNA, 22 nt, Human
uacuuuaauugcaaaaauaaau

SEQ ID NO: 295223 - RNA, 22 nt, Human
uacuugcaaggcucuuggaaua

SEQ ID NO: 295224 - RNA, 22 nt, Human
gucgguacuaguacugguguug

SEQ ID NO: 295225 - RNA, 22 nt, Human
uaauuugauuucucccuggaaa

SEQ ID NO: 295226 - RNA, 22 nt, Human
uaauuucauuuugcaaugaucu

SEQ ID NO: 295227 - RNA, 22 nt, Human
uacaaaauucaaauaauguuug

SEQ ID NO: 295228 - RNA, 22 nt, Human
uacauagaauauauaaaugucg

SEQ ID NO: 295229 - RNA, 22 nt, Human
uacagauaaaaaugcuguucuu

SEQ ID NO: 295230 - RNA, 22 nt, Human
uacaccuuaagccgcggcuccc

SEQ ID NO: 295231 - RNA, 22 nt, Human
uaccgaagcugcuuuugcaugu

SEQ ID NO: 295232 - RNA, 22 nt, Human
gucuucuauuuggcaugacaga

SEQ ID NO: 295233 - RNA, 22 nt, Human
guacugggaauggagccugggc

SEQ ID NO: 295234 - RNA, 22 nt, Human
uaaauuagauucccagcgcuau

SEQ ID NO: 295235 - RNA, 22 nt, Human
guaaauaucucacgaaugauuc

SEQ ID NO: 295236 - RNA, 22 nt, Human
guaaauuaugucugggucaguu

SEQ ID NO: 295237 - RNA, 22 nt, Human
guaacuuuuuccucauuggcua

SEQ ID NO: 295238 - RNA, 22 nt, Human
uaaauguugcuugugcugcuca

SEQ ID NO: 295239 - RNA, 22 nt, Human
gguuuucuuguucauuuuuuaa

SEQ ID NO: 295240 - RNA, 22 nt, Human
gguuucuuuccucucugugccu

SEQ ID NO: 295241 - RNA, 22 nt, Human
gguuuguggagcuggaaacacu

SEQ ID NO: 295242 - RNA, 22 nt, Human
uaaagugaaguucagaauggcu

SEQ ID NO: 295243 - RNA, 22 nt, Human
gguuuuccaguagaucagaaga

SEQ ID NO: 295244 - RNA, 22 nt, Human
uaaaggaguguauaauuguagu

SEQ ID NO: 295245 - RNA, 22 nt, Human
uaaaaguuagcuaggacaaagu

SEQ ID NO: 295246 - RNA, 22 nt, Human
uaaaaucaugacagauugacau

SEQ ID NO: 295247 - RNA, 22 nt, Human
ggugcaaagauggcaguugcaa

SEQ ID NO: 295248 - RNA, 19 nt, Human
ggugaucugucccuugcuc

SEQ ID NO: 295249 - RNA, 22 nt, Human
guuugguucucauuguuuuucu

SEQ ID NO: 295250 - RNA, 22 nt, Human
guuuggguugcucauucuacau

SEQ ID NO: 295251 - RNA, 22 nt, Human
gguguacuucacucuuaccuag

SEQ ID NO: 295252 - RNA, 22 nt, Human
gguguaaucacaagcuggaauu

SEQ ID NO: 295253 - RNA, 22 nt, Human
gguggucaggagcgcccguugg

SEQ ID NO: 295254 - RNA, 22 nt, Human
gguggggacuuggggucagcgg

SEQ ID NO: 295255 - RNA, 22 nt, Human
guuuguguauauguguauuuuu

SEQ ID NO: 295256 - RNA, 22 nt, Human
ggugucguuucacaugacccag

SEQ ID NO: 295257 - RNA, 22 nt, Human
ggugucagccacuuugucggag

SEQ ID NO: 295258 - RNA, 22 nt, Human
gguguauucuccaguuuuagca

SEQ ID NO: 295259 - RNA, 22 nt, Human
guuuugaugugauuucucaugu

SEQ ID NO: 295260 - RNA, 22 nt, Human
ggugugaauagagccuggagca

SEQ ID NO: 295261 - RNA, 22 nt, Human
ggugugggcagaugcccuacuu

SEQ ID NO: 295262 - RNA, 22 nt, Human
ggugugugugugugugugugug

SEQ ID NO: 295263 - RNA, 22 nt, Human
uaaaacuaugcaaccuacuacc

SEQ ID NO: 295264 - RNA, 21 nt, Human
uaaaagaugacaagacagcuc

SEQ ID NO: 295265 - RNA, 22 nt, Human
gguugaagcuacuuucuggaug

SEQ ID NO: 295266 - RNA, 22 nt, Human
guugggguuucaguggcaguca

SEQ ID NO: 295267 - RNA, 22 nt, Human
guugggcugaagugugugcuua

SEQ ID NO: 295268 - RNA, 22 nt, Human
guuggcgaaggaccuggaggag

SEQ ID NO: 295269 - RNA, 22 nt, Human
gugcugggaggcccaggaugga

SEQ ID NO: 295270 - RNA, 22 nt, Human
gugcugucguggaacugggcug

SEQ ID NO: 295271 - RNA, 22 nt, Human
guugcuggggcugaguccccag

SEQ ID NO: 295272 - RNA, 22 nt, Human
guugcuucuuggcuuuuccaac

SEQ ID NO: 295273 - RNA, 22 nt, Human
ggucgaguuccuuguuuuuuau

SEQ ID NO: 295274 - RNA, 22 nt, Human
guuguuuucagcccagcauuag

SEQ ID NO: 295275 - RNA, 22 nt, Human
guuguuagccucacauuuagga

SEQ ID NO: 295276 - RNA, 22 nt, Human
guugucguucccccugcuuaaa

SEQ ID NO: 295277 - RNA, 22 nt, Human
guugucuggcucugaccauucu

SEQ ID NO: 295278 - RNA, 22 nt, Human
ggucgagcagcacccguucggc

SEQ ID NO: 295279 - RNA, 22 nt, Human
gugcuuccuguauugauuccau

SEQ ID NO: 295280 - RNA, 22 nt, Human
ggucaucacugagagcagaucc

SEQ ID NO: 295281 - RNA, 22 nt, Human
guuuaagcagauugcuguggug

SEQ ID NO: 295282 - RNA, 22 nt, Human
guuuagauguagauucucuggu

SEQ ID NO: 295283 - RNA, 22 nt, Human
guuuaucagagagcagaggugg

SEQ ID NO: 295284 - RNA, 22 nt, Human
ggucugcgauggcaagggucuu

SEQ ID NO: 295285 - RNA, 22 nt, Human
ggucuagcucggugcuggcgac

SEQ ID NO: 295286 - RNA, 22 nt, Human
ggucugauaccugcagguuguc

SEQ ID NO: 295287 - RNA, 22 nt, Human
guuuaaaagcaaccaacaggcu

SEQ ID NO: 295288 - RNA, 22 nt, Human
guuguuuuuguuaaaacaguga

SEQ ID NO: 295289 - RNA, 22 nt, Human
ggugaucucagucuagaugguu

SEQ ID NO: 295290 - RNA, 22 nt, Human
guuugcagacuauguaaacuuc

SEQ ID NO: 295291 - RNA, 22 nt, Human
guuucuguggacucugcuuagg

SEQ ID NO: 295292 - RNA, 22 nt, Human
guuucucuuugguggguugaga

SEQ ID NO: 295293 - RNA, 22 nt, Human
ggugaaggaucccucuuggccu

SEQ ID NO: 295294 - RNA, 22 nt, Human
ggugacucacauuaggacuucg

SEQ ID NO: 295295 - RNA, 22 nt, Human
ggugacauuggagagacaggug

SEQ ID NO: 295296 - RNA, 22 nt, Human
ggucuuccuugggggacuugaa

SEQ ID NO: 295297 - RNA, 18 nt, Human
ggugagggagcuggaagc

SEQ ID NO: 295298 - RNA, 22 nt, Human
ggugaggggauccuguuaccau

SEQ ID NO: 295299 - RNA, 22 nt, Human
guccugaaaaaaaucccugagu

SEQ ID NO: 295300 - RNA, 22 nt, Human
ggcugaggccucuggggaggga

SEQ ID NO: 295301 - RNA, 22 nt, Human
ggcucuccacuauggaugagaa

SEQ ID NO: 295302 - RNA, 22 nt, Human
ggcugagguguggggaacuaua

SEQ ID NO: 295303 - RNA, 22 nt, Human
ggcugaugacgccugagucuga

SEQ ID NO: 295304 - RNA, 22 nt, Human
ggcugcaagacguuauuagcgu

SEQ ID NO: 295305 - RNA, 22 nt, Human
guccaugugcuaacagugcuua

SEQ ID NO: 295306 - RNA, 23 nt, Human
gucauuacuguuaccuuauucuu

SEQ ID NO: 295307 - RNA, 22 nt, Human
gucaugaugauacagguggagg

SEQ ID NO: 295308 - RNA, 22 nt, Human
gucaucugagggacgagauuuc

SEQ ID NO: 295309 - RNA, 22 nt, Human
ggcugcuugggcuguuucuuuu

SEQ ID NO: 295310 - RNA, 22 nt, Human
gucguagaaccuuuuccaaaca

SEQ ID NO: 295311 - RNA, 22 nt, Human
ggcugcuugauagauaugagua

SEQ ID NO: 295312 - RNA, 22 nt, Human
gucgucgcucccaccuuccgcu

SEQ ID NO: 295313 - RNA, 22 nt, Human
ggcuggaacuucuucuggcauu

SEQ ID NO: 295314 - RNA, 22 nt, Human
gucgagaacauucauuaugcaa

SEQ ID NO: 295315 - RNA, 22 nt, Human
gucugccagauucugcuggauc

SEQ ID NO: 295316 - RNA, 22 nt, Human
gucugaaauaucuuuugucuug

SEQ ID NO: 295317 - RNA, 22 nt, Human
gucuauuuauagacagauccua

SEQ ID NO: 295318 - RNA, 22 nt, Human
gucuauaaccuuuccaauuacc

SEQ ID NO: 295319 - RNA, 22 nt, Human
ggcuggacuuucugcugggcuc

SEQ ID NO: 295320 - RNA, 22 nt, Human
ggcugggagguggcgaggaggc

SEQ ID NO: 295321 - RNA, 22 nt, Human
gucuggagccacugcugcugcu

SEQ ID NO: 295322 - RNA, 22 nt, Human
gucuggugguggguguagggca

SEQ ID NO: 295323 - RNA, 22 nt, Human
gucugguggaguuguauauacu

SEQ ID NO: 295324 - RNA, 22 nt, Human
guauuaagaaaugccugugaaa

SEQ ID NO: 295325 - RNA, 22 nt, Human
guauuauauaaccauugguucu

SEQ ID NO: 295326 - RNA, 22 nt, Human
guauuaugaaugccgaggcggc

SEQ ID NO: 295327 - RNA, 22 nt, Human
guauuugcaaucacaaacaaaa

SEQ ID NO: 295328 - RNA, 22 nt, Human
guauuugacaccagugaauggu

SEQ ID NO: 295329 - RNA, 22 nt, Human
guauugauuguuuuaaaagauu

SEQ ID NO: 295330 - RNA, 20 nt, Human
gucaauguuuucuuggcccu

SEQ ID NO: 295331 - RNA, 22 nt, Human
gucaaaguuaacuagcaggugc

SEQ ID NO: 295332 - RNA, 22 nt, Human
guauuuggacugccuguucauu

SEQ ID NO: 295333 - RNA, 22 nt, Human
gucaaaggcggugcaggaggag

SEQ ID NO: 295334 - RNA, 22 nt, Human
ggcggcccaggugcuccaggcg

SEQ ID NO: 295335 - RNA, 22 nt, Human
ggcggugcgaggaugcagggcu

SEQ ID NO: 295336 - RNA, 22 nt, Human
gucaguggugcuuaaaguuuca

SEQ ID NO: 295337 - RNA, 22 nt, Human
gucagauucuuucauuugcuga

SEQ ID NO: 295338 - RNA, 22 nt, Human
gucacuuuuaagggccuuuucu

SEQ ID NO: 295339 - RNA, 22 nt, Human
gucagaagauagaggaaguuug

SEQ ID NO: 295340 - RNA, 22 nt, Human
ggcgauuggccgggaggaggca

SEQ ID NO: 295341 - RNA, 22 nt, Human
guaucaggacuaaauuauggau

SEQ ID NO: 295342 - RNA, 22 nt, Human
guauccuccccgcuggccuuca

SEQ ID NO: 295343 - RNA, 22 nt, Human
ggcgccugguauucuuccucuc

SEQ ID NO: 295344 - RNA, 22 nt, Human
ggcgccauuuuugccuucggag

SEQ ID NO: 295345 - RNA, 22 nt, Human
guaucuuuauuuuaauuaagau

SEQ ID NO: 295346 - RNA, 22 nt, Human
guaugugucuuagaacuuggga

SEQ ID NO: 295347 - RNA, 22 nt, Human
guaugucuuaggguucaguaac

SEQ ID NO: 295348 - RNA, 21 nt, Human
guaucuuucuuuuaaaauauc

SEQ ID NO: 295349 - RNA, 22 nt, Human
gguuugccagugcuggaaugca

SEQ ID NO: 295350 - RNA, 22 nt, Human
gguuugauauguuugugauucu

SEQ ID NO: 295351 - RNA, 22 nt, Human
gguuugggaagaacuauucccu

SEQ ID NO: 295352 - RNA, 22 nt, Human
gguuuaucuuuacaaaugaaau

SEQ ID NO: 295353 - RNA, 22 nt, Human
gguuuauucccacaaaggaagu

SEQ ID NO: 295354 - RNA, 21 nt, Human
gguuucugcaaaccuuguaca

SEQ ID NO: 295355 - RNA, 22 nt, Human
ggccccagggauuaggccaacc

SEQ ID NO: 295356 - RNA, 22 nt, Human
ggcgacuacugaaugcuugaaa

SEQ ID NO: 295357 - RNA, 22 nt, Human
guauaaauaucuauauuguuac

SEQ ID NO: 295358 - RNA, 22 nt, Human
gugcauauguguguauacaaac

SEQ ID NO: 295359 - RNA, 22 nt, Human
gggagccagcagggcauggagc

SEQ ID NO: 295360 - RNA, 22 nt, Human
gggagcucaccaugcucugcau

SEQ ID NO: 295361 - RNA, 22 nt, Human
gugcacuugaucuagacagauu

SEQ ID NO: 295362 - RNA, 19 nt, Human
gggagaaaaucuuuauccu

SEQ ID NO: 295363 - RNA, 22 nt, Human
gugauucaucuggggccuuauu

SEQ ID NO: 295364 - RNA, 22 nt, Human
gggacgggcuagcugccguggc

SEQ ID NO: 295365 - RNA, 22 nt, Human
gggaauuuuaggaugacuccua

SEQ ID NO: 295366 - RNA, 22 nt, Human
gugaucagaagaaccugccgaa

SEQ ID NO: 295367 - RNA, 22 nt, Human
gugauggucgagcgcuuguugu

SEQ ID NO: 295368 - RNA, 22 nt, Human
gggaaguugguaagaggcuguu

SEQ ID NO: 295369 - RNA, 20 nt, Human
gggaauggauggauugcucc

SEQ ID NO: 295370 - RNA, 22 nt, Human
gugaugaaggccugcaccuggu

SEQ ID NO: 295371 - RNA, 22 nt, Human
gugaugaagguggagaaucaga

SEQ ID NO: 295372 - RNA, 22 nt, Human
gggcaagaagcuggaagcauuc

SEQ ID NO: 295373 - RNA, 22 nt, Human
gggauuaaaaaucaccaaagua

SEQ ID NO: 295374 - RNA, 22 nt, Human
gugcugcaugagcaucacguag

SEQ ID NO: 295375 - RNA, 22 nt, Human
gggcaagaggguuugacaugag

SEQ ID NO: 295376 - RNA, 22 nt, Human
gugcucgagcugugcgcgcugc

SEQ ID NO: 295377 - RNA, 22 nt, Human
gugcucaucuucuguaacuguu

SEQ ID NO: 295378 - RNA, 22 nt, Human
gugcucaagacauuaggaauau

SEQ ID NO: 295379 - RNA, 21 nt, Human
gggagugaguaaugauggggg

SEQ ID NO: 295380 - RNA, 22 nt, Human
gggagggggauucuggcgagaa

SEQ ID NO: 295381 - RNA, 22 nt, Human
gugccugcucauucucaauauu

SEQ ID NO: 295382 - RNA, 22 nt, Human
gugccucuaguuuucuccuaaa

SEQ ID NO: 295383 - RNA, 22 nt, Human
gugccaccagaugcuguugcua

SEQ ID NO: 295384 - RNA, 20 nt, Human
gugaaguuuucugaagacag

SEQ ID NO: 295385 - RNA, 22 nt, Human
gugaagguccugauuugugacc

SEQ ID NO: 295386 - RNA, 21 nt, Human
gugaccuguuaugcaaaggca

SEQ ID NO: 295387 - RNA, 22 nt, Human
ggcuuuuucccuaggguaagag

SEQ ID NO: 295388 - RNA, 22 nt, Human
gugaagcaagggucaccugugg

SEQ ID NO: 295389 - RNA, 22 nt, Human
gggaaaugugucuuggcauucu

SEQ ID NO: 295390 - RNA, 22 nt, Human
gggaaaaaggaaccuuauuacu

SEQ ID NO: 295391 - RNA, 22 nt, Human
gggaaaauguuucugagacaaa

SEQ ID NO: 295392 - RNA, 18 nt, Human
gggaagaugccacaguga

SEQ ID NO: 295393 - RNA, 22 nt, Human
gggaagugcaguuuucuuuugg

SEQ ID NO: 295394 - RNA, 22 nt, Human
gugaguugugugaguaagcaga

SEQ ID NO: 295395 - RNA, 19 nt, Human
gugauauuuauuauuuauu

SEQ ID NO: 295396 - RNA, 22 nt, Human
gggaagaacugauuucacacca

SEQ ID NO: 295397 - RNA, 22 nt, Human
gggaagaagaaaagagguggga

SEQ ID NO: 295398 - RNA, 22 nt, Human
gugauauaacaauuuagggaau

SEQ ID NO: 295399 - RNA, 17 nt, Human
gugagcugagucaggac

SEQ ID NO: 295400 - RNA, 22 nt, Human
gugagaggaggcagcuuuuaca

SEQ ID NO: 295401 - RNA, 22 nt, Human
gucuguuggcacagggggaggu

SEQ ID NO: 295402 - RNA, 22 nt, Human
gucugaggagaggcagcauaac

SEQ ID NO: 295403 - RNA, 22 nt, Human
gucugugguccaaaauugccuc

SEQ ID NO: 295404 - RNA, 22 nt, Human
ggcuggggccuguugaagaugc

SEQ ID NO: 295405 - RNA, 22 nt, Human
ggcugguggcgggcagcacaga

SEQ ID NO: 295406 - RNA, 22 nt, Human
ggcugugaaguacguugaaggu

SEQ ID NO: 295407 - RNA, 22 nt, Human
gugaaaaauggccaucaggaca

SEQ ID NO: 295408 - RNA, 22 nt, Human
ggcugugguggacgcgggaaac

SEQ ID NO: 295409 - RNA, 22 nt, Human
ggcugugggguccuguggugug

SEQ ID NO: 295410 - RNA, 20 nt, Human
gugaacuggagaacugaugu

SEQ ID NO: 295411 - RNA, 22 nt, Human
ggcuucucuuggccaugguccc

SEQ ID NO: 295412 - RNA, 22 nt, Human
ggcuuuuguuauaaucaggccu

SEQ ID NO: 295413 - RNA, 22 nt, Human
ggcuuugggaggaugaggcggu

SEQ ID NO: 295414 - RNA, 22 nt, Human
gugaaaugaagugacuggauau

SEQ ID NO: 295415 - RNA, 22 nt, Human
gugaaauuguacacucaguacc

SEQ ID NO: 295416 - RNA, 22 nt, Human
ggcuuauauguauucccagaga

SEQ ID NO: 295417 - RNA, 22 nt, Human
gugaaacuggaugugaaaacaa

SEQ ID NO: 295418 - RNA, 22 nt, Human
gcuuacagauaaugaggagacu

SEQ ID NO: 295419 - RNA, 22 nt, Human
gggaaaaaggaguuagagauaa

SEQ ID NO: 295420 - RNA, 22 nt, Human
gggaaauagagcuggaaccuug

SEQ ID NO: 295421 - RNA, 22 nt, Human
ggccacgggguuugcugaaacu

SEQ ID NO: 295422 - RNA, 22 nt, Human
ggccaccuaagguugugcauca

SEQ ID NO: 295423 - RNA, 22 nt, Human
gcuguguaugaugcaggcaccu

SEQ ID NO: 295424 - RNA, 22 nt, Human
ggcuucuuaacauuuggacacc

SEQ ID NO: 295425 - RNA, 22 nt, Human
gcuuguuuagcauaggucacug

SEQ ID NO: 295426 - RNA, 22 nt, Human
gcuugcuuuguaaauaucugug

SEQ ID NO: 295427 - RNA, 22 nt, Human
gcuuggagaacguuuucuagaa

SEQ ID NO: 295428 - RNA, 22 nt, Human
gggaagugagcuggaaucaagg

SEQ ID NO: 295429 - RNA, 20 nt, Human
gcuugaauuugauggccaga

SEQ ID NO: 295430 - RNA, 22 nt, Human
gcuugcaucaggggcuggggcc

SEQ ID NO: 295431 - RNA, 20 nt, Human
gcuugcgugggaggaggggg

SEQ ID NO: 295432 - RNA, 22 nt, Human
gggaagagggagcuggaaugau

SEQ ID NO: 295433 - RNA, 21 nt, Human
gggaagagaagagaaaggagg

SEQ ID NO: 295434 - RNA, 22 nt, Human
gggaagaaccucugcuaccaau

SEQ ID NO: 295435 - RNA, 22 nt, Human
gcuucucacccuuacuaucucu

SEQ ID NO: 295436 - RNA, 22 nt, Human
gggaagccugggugauccuaaa

SEQ ID NO: 295437 - RNA, 22 nt, Human
gcuuauugcuuauagauaggaa

SEQ ID NO: 295438 - RNA, 22 nt, Human
gcuucacucugagacuuggagc

SEQ ID NO: 295439 - RNA, 22 nt, Human
gcuuauuagguuauuucaagga

SEQ ID NO: 295440 - RNA, 22 nt, Human
gcuuaggcgcuccuuuucacuc

SEQ ID NO: 295441 - RNA, 22 nt, Human
gggaacuguaguuuacgcugcc

SEQ ID NO: 295442 - RNA, 22 nt, Human
gggaacuuugugagacuggaga

SEQ ID NO: 295443 - RNA, 22 nt, Human
ggaaguuaguucuuggcaaagg

SEQ ID NO: 295444 - RNA, 22 nt, Human
ggaaguggauucagggcugcua

SEQ ID NO: 295445 - RNA, 22 nt, Human
gggccggagaagguagcugaag

SEQ ID NO: 295446 - RNA, 22 nt, Human
gggccggcuggggcggggcggg

SEQ ID NO: 295447 - RNA, 18 nt, Human
ggaauagcuuguuuccca

SEQ ID NO: 295448 - RNA, 22 nt, Human
ggaaucuucagccaugccaaga

SEQ ID NO: 295449 - RNA, 22 nt, Human
ggaauauaaaucagaugcuccg

SEQ ID NO: 295450 - RNA, 22 nt, Human
ggaauacggguuuauuuagucu

SEQ ID NO: 295451 - RNA, 22 nt, Human
ggaauaaaaggagguggcgaga

SEQ ID NO: 295452 - RNA, 22 nt, Human
ggaaguuugagcaucuguuucc

SEQ ID NO: 295453 - RNA, 19 nt, Human
gggcuuguuggcaaaugac

SEQ ID NO: 295454 - RNA, 22 nt, Human
ggaauuaagaggcuggacaggg

SEQ ID NO: 295455 - RNA, 22 nt, Human
gggcuguuugcauauguuuaua

SEQ ID NO: 295456 - RNA, 22 nt, Human
ggaauuauuuuaaauagacauu

SEQ ID NO: 295457 - RNA, 22 nt, Human
gcuuucauuauguuguguuuuu

SEQ ID NO: 295458 - RNA, 22 nt, Human
gggagaaccagccagugcaagg

SEQ ID NO: 295459 - RNA, 21 nt, Human
gggagccucauuuucuucauc

SEQ ID NO: 295460 - RNA, 22 nt, Human
ggaagaagagggagcuguggga

SEQ ID NO: 295461 - RNA, 22 nt, Human
ggaagacuuagaguagcaucag

SEQ ID NO: 295462 - RNA, 22 nt, Human
ggaagauagaaguucaaaaguu

SEQ ID NO: 295463 - RNA, 22 nt, Human
gggagccucccacugggggaag

SEQ ID NO: 295464 - RNA, 22 nt, Human
ggaaaggaagggaaggagaugc

SEQ ID NO: 295465 - RNA, 22 nt, Human
ggaaauauaagcaguuugugug

SEQ ID NO: 295466 - RNA, 22 nt, Human
gggcaggacccguuagaguggc

SEQ ID NO: 295467 - RNA, 22 nt, Human
gggguuggaugccuuggaaauu

SEQ ID NO: 295468 - RNA, 23 nt, Human
gggggagcuggacuccuagaucc

SEQ ID NO: 295469 - RNA, 22 nt, Human
ggagcauggcuucuuggggcug

SEQ ID NO: 295470 - RNA, 22 nt, Human
gggggcgcguggagggccgugg

SEQ ID NO: 295471 - RNA, 22 nt, Human
gggugcauggcagcccuucugg

SEQ ID NO: 295472 - RNA, 22 nt, Human
gggggaaaguggagguucguga

SEQ ID NO: 295473 - RNA, 22 nt, Human
gggggcagguuccaggccagcu

SEQ ID NO: 295474 - RNA, 22 nt, Human
gggggagcuacaggucccuugg

SEQ ID NO: 295475 - RNA, 22 nt, Human
ggggcuggguuugcgcaggcuc

SEQ ID NO: 295476 - RNA, 19 nt, Human
ggagcagauaaacauacuu

SEQ ID NO: 295477 - RNA, 22 nt, Human
ggagcaguggaggggccagggu

SEQ ID NO: 295478 - RNA, 22 nt, Human
ggagaugucugugccacgucuc

SEQ ID NO: 295479 - RNA, 22 nt, Human
ggagcaagagugagcaagcaga

SEQ ID NO: 295480 - RNA, 22 nt, Human
ggagcagaggaaagaguagcau

SEQ ID NO: 295481 - RNA, 22 nt, Human
ggagauggucacagguaaacau

SEQ ID NO: 295482 - RNA, 22 nt, Human
ggagaugacaucccagcccggc

SEQ ID NO: 295483 - RNA, 18 nt, Human
gggcuuuacagaguggag

SEQ ID NO: 295484 - RNA, 22 nt, Human
ggguggggcaugcucucuucug

SEQ ID NO: 295485 - RNA, 22 nt, Human
ggguuggaggcauugaaacaga

SEQ ID NO: 295486 - RNA, 20 nt, Human
ggguugagcguggccccucu

SEQ ID NO: 295487 - RNA, 22 nt, Human
gggugcuuaagcuuguuuguaa

SEQ ID NO: 295488 - RNA, 22 nt, Human
ggagguggagcuggaaguucca

SEQ ID NO: 295489 - RNA, 22 nt, Human
ggaugauacuuggagaaauauu

SEQ ID NO: 295490 - RNA, 22 nt, Human
gguaagguugggugucagaggg

SEQ ID NO: 295491 - RNA, 22 nt, Human
gguaagcacuucauguacauga

SEQ ID NO: 295492 - RNA, 22 nt, Human
gguaacagaagagcacuuggca

SEQ ID NO: 295493 - RNA, 22 nt, Human
ggaucgauuccaaauguagauc

SEQ ID NO: 295494 - RNA, 22 nt, Human
ggaucagcgagaagggcugaaa

SEQ ID NO: 295495 - RNA, 23 nt, Human
ggugagccuuucuaguagucuug

SEQ ID NO: 295496 - RNA, 22 nt, Human
ggugacuucugaaccuggagug

SEQ ID NO: 295497 - RNA, 22 nt, Human
ggcacaggcugguaccaguuca

SEQ ID NO: 295498 - RNA, 22 nt, Human
ggcacacugaaguuugagaacc

SEQ ID NO: 295499 - RNA, 22 nt, Human
ggucgacuaauguuucauuuca

SEQ ID NO: 295500 - RNA, 22 nt, Human
ggcacagcgacuaccaucgaaa

SEQ ID NO: 295501 - RNA, 22 nt, Human
ggcaaggaagaaagcagaaguu

SEQ ID NO: 295502 - RNA, 22 nt, Human
ggucaauuuggucaaucguuua

SEQ ID NO: 295503 - RNA, 20 nt, Human
ggcagagcuaugucuguugc

SEQ ID NO: 295504 - RNA, 22 nt, Human
ggugaggagaaacucugccccu

SEQ ID NO: 295505 - RNA, 22 nt, Human
ggcagagcugugcgcccaccca

SEQ ID NO: 295506 - RNA, 22 nt, Human
ggcagauaaacaauguuguaua

SEQ ID NO: 295507 - RNA, 22 nt, Human
ggaugggcuuggggaggucuag

SEQ ID NO: 295508 - RNA, 22 nt, Human
ggucauagagcuggaaauuggc

SEQ ID NO: 295509 - RNA, 22 nt, Human
ggucaaauaugaguaauuuccu

SEQ ID NO: 295510 - RNA, 22 nt, Human
ggucauacaaggcacuggugau

SEQ ID NO: 295511 - RNA, 22 nt, Human
gguaugaggaugaggguggcau

SEQ ID NO: 295512 - RNA, 20 nt, Human
ggucagccaagaaguuaccu

SEQ ID NO: 295513 - RNA, 22 nt, Human
ggucaaucaugggucauugucu

SEQ ID NO: 295514 - RNA, 20 nt, Human
ggcauuuuuuaguugagcuu

SEQ ID NO: 295515 - RNA, 22 nt, Human
ggccaaagagcacaaugaauag

SEQ ID NO: 295516 - RNA, 19 nt, Human
gguuaccagugugucuggc

SEQ ID NO: 295517 - RNA, 22 nt, Human
ggugucucagauuguaaaaugu

SEQ ID NO: 295518 - RNA, 22 nt, Human
gguguggcaguggaccugugaa

SEQ ID NO: 295519 - RNA, 22 nt, Human
gguguggguguuaguuugcuua

SEQ ID NO: 295520 - RNA, 22 nt, Human
gguguuaaccagcuaaaguuug

SEQ ID NO: 295521 - RNA, 22 nt, Human
ggugaguagaaguaguuggcuu

SEQ ID NO: 295522 - RNA, 22 nt, Human
ggugaguaguggaaaugaauga

SEQ ID NO: 295523 - RNA, 22 nt, Human
ggugauaaaaagcauuuaaauu

SEQ ID NO: 295524 - RNA, 22 nt, Human
gguggcagaggaggcgggagag

SEQ ID NO: 295525 - RNA, 22 nt, Human
ggcauggugggggaggacuugg

SEQ ID NO: 295526 - RNA, 22 nt, Human
ggugagagaaaagaaacacugu

SEQ ID NO: 295527 - RNA, 22 nt, Human
gcccugucagcucucauggaca

SEQ ID NO: 295528 - RNA, 22 nt, Human
gcccuggucguggagggcaaca

SEQ ID NO: 295529 - RNA, 22 nt, Human
gcccuguuauagucugaggccu

SEQ ID NO: 295530 - RNA, 22 nt, Human
gauguuuugaaagaagaauaca

SEQ ID NO: 295531 - RNA, 22 nt, Human
gcccugaaggccuccaggacuc

SEQ ID NO: 295532 - RNA, 22 nt, Human
gccccgcgcgcguagcgccgcu

SEQ ID NO: 295533 - RNA, 22 nt, Human
gcccccgccuugcugggccagg

SEQ ID NO: 295534 - RNA, 22 nt, Human
gaugguagauauagaaagggga

SEQ ID NO: 295535 - RNA, 22 nt, Human
gauggugauggcccuaagcuga

SEQ ID NO: 295536 - RNA, 22 nt, Human
gauggggaaaaaauggaucuuu

SEQ ID NO: 295537 - RNA, 22 nt, Human
gauggguugaguucauggagcc

SEQ ID NO: 295538 - RNA, 22 nt, Human
gcccagccucagggcaucagcu

SEQ ID NO: 295539 - RNA, 22 nt, Human
gcccagcucucuggccugucuu

SEQ ID NO: 295540 - RNA, 22 nt, Human
gccccaaccccuccuuggucua

SEQ ID NO: 295541 - RNA, 22 nt, Human
gcccagcuuuuugaggcaggca

SEQ ID NO: 295542 - RNA, 22 nt, Human
gccauauucaugcaggugcuaa

SEQ ID NO: 295543 - RNA, 23 nt, Human
gccaucugcugggugccccggcc

SEQ ID NO: 295544 - RNA, 22 nt, Human
gccagggcucgagcaggccagc

SEQ ID NO: 295545 - RNA, 22 nt, Human
gccauaggggcuuacauaguua

SEQ ID NO: 295546 - RNA, 22 nt, Human
gaucugguuccaggacauugca

SEQ ID NO: 295547 - RNA, 22 nt, Human
gaugaagaaacucaaccaagaa

SEQ ID NO: 295548 - RNA, 18 nt, Human
gccagcccuccaaccucc

SEQ ID NO: 295549 - RNA, 22 nt, Human
gauccucagacccuccucuggu

SEQ ID NO: 295550 - RNA, 16 nt, Human
gccagauugaacuuug

SEQ ID NO: 295551 - RNA, 22 nt, Human
gccaggcagcagcgaggauggu

SEQ ID NO: 295552 - RNA, 22 nt, Human
gaugcauccuuucugucuucuc

SEQ ID NO: 295553 - RNA, 22 nt, Human
gaguuauuuuuccuguuuuuua

SEQ ID NO: 295554 - RNA, 22 nt, Human
gcaugcaggaagggcuugggga

SEQ ID NO: 295555 - RNA, 22 nt, Human
gcaugaauggaacccccugagu

SEQ ID NO: 295556 - RNA, 22 nt, Human
gaucauuuucauuaauguugca

SEQ ID NO: 295557 - RNA, 22 nt, Human
gauauggaaacuugauguugug

SEQ ID NO: 295558 - RNA, 19 nt, Human
gccacguuggcuaguugcc

SEQ ID NO: 295559 - RNA, 22 nt, Human
gccacucaguuuaggggcaagc

SEQ ID NO: 295560 - RNA, 22 nt, Human
gcagguuguuuaaauuaggauu

SEQ ID NO: 295561 - RNA, 22 nt, Human
gcagugacagacaacuguuuga

SEQ ID NO: 295562 - RNA, 22 nt, Human
gaguagccucagucugcaagug

SEQ ID NO: 295563 - RNA, 22 nt, Human
gaguagaacagauagucaagaa

SEQ ID NO: 295564 - RNA, 19 nt, Human
gaguaaaacuagagagaaa

SEQ ID NO: 295565 - RNA, 22 nt, Human
gcagggcucagccgcucccacc

SEQ ID NO: 295566 - RNA, 20 nt, Human
gagaaugucauuccuuuuuu

SEQ ID NO: 295567 - RNA, 22 nt, Human
gcagggcucuggagucaggcug

SEQ ID NO: 295568 - RNA, 21 nt, Human
gcaggggugugugagcugggg

SEQ ID NO: 295569 - RNA, 22 nt, Human
gaucuguccuggcaguuaacac

SEQ ID NO: 295570 - RNA, 21 nt, Human
gaucgcaaugugggaaucaug

SEQ ID NO: 295571 - RNA, 22 nt, Human
gagaagucaggaguggagaaca

SEQ ID NO: 295572 - RNA, 22 nt, Human
gagaauaauaauaggcauggug

SEQ ID NO: 295573 - RNA, 18 nt, Human
gaugaagaggaagaggag

SEQ ID NO: 295574 - RNA, 22 nt, Human
gagucaucucuagaaugaugau

SEQ ID NO: 295575 - RNA, 22 nt, Human
gagucaggucaggcuuguagau

SEQ ID NO: 295576 - RNA, 22 nt, Human
gaguaugugaggaaguaaagaa

SEQ ID NO: 295577 - RNA, 22 nt, Human
gaguccuggagagcccgagcgc

SEQ ID NO: 295578 - RNA, 22 nt, Human
gagucaaugugcagugcagccc

SEQ ID NO: 295579 - RNA, 22 nt, Human
gagucaauucaccuuggugcuu

SEQ ID NO: 295580 - RNA, 22 nt, Human
gaguauucuauguauauuauug

SEQ ID NO: 295581 - RNA, 22 nt, Human
gcagugcugcgacagucgggug

SEQ ID NO: 295582 - RNA, 23 nt, Human
gcaguggagcgagaacuuccugu

SEQ ID NO: 295583 - RNA, 22 nt, Human
gaguauuagaagaguaguuauu

SEQ ID NO: 295584 - RNA, 19 nt, Human
gcaguuccucuuaagagaa

SEQ ID NO: 295585 - RNA, 19 nt, Human
gcaguuauggcccacuucc

SEQ ID NO: 295586 - RNA, 22 nt, Human
gaguggcaaagagaacaaagau

SEQ ID NO: 295587 - RNA, 22 nt, Human
gaguggugagaauacaacggaa

SEQ ID NO: 295588 - RNA, 22 nt, Human
gagugaucuguaggcagcaugg

SEQ ID NO: 295589 - RNA, 21 nt, Human
gcauccucguacucuucaggu

SEQ ID NO: 295590 - RNA, 22 nt, Human
gagugguaaaguguacugaaua

SEQ ID NO: 295591 - RNA, 22 nt, Human
gcaucacacgcacauacacaca

SEQ ID NO: 295592 - RNA, 22 nt, Human
gcauaaaggacuauaaggauca

SEQ ID NO: 295593 - RNA, 22 nt, Human
gcauagauauguaaugcaucau

SEQ ID NO: 295594 - RNA, 22 nt, Human
gauuuucauuauagcuaguuuc

SEQ ID NO: 295595 - RNA, 22 nt, Human
gccucucuggcaaagcggugau

SEQ ID NO: 295596 - RNA, 22 nt, Human
gccucucagagcuguucaguuu

SEQ ID NO: 295597 - RNA, 20 nt, Human
gcccuucccccuccgcgagc

SEQ ID NO: 295598 - RNA, 22 nt, Human
gauuaucaccaaauggccuccu

SEQ ID NO: 295599 - RNA, 22 nt, Human
gauuaagauuacauauuuaagu

SEQ ID NO: 295600 - RNA, 22 nt, Human
gauuaagugaauuggagaaaag

SEQ ID NO: 295601 - RNA, 18 nt, Human
gccugccagccgagggac

SEQ ID NO: 295602 - RNA, 22 nt, Human
gcacauaugcuguaagcacaug

SEQ ID NO: 295603 - RNA, 22 nt, Human
gcacaggcugcacgaccccagc

SEQ ID NO: 295604 - RNA, 22 nt, Human
gcacauauuuagaucuugaugu

SEQ ID NO: 295605 - RNA, 22 nt, Human
gcacagucaacacuuauucacc

SEQ ID NO: 295606 - RNA, 22 nt, Human
gcaccgagaaggaagcaugccu

SEQ ID NO: 295607 - RNA, 22 nt, Human
gcacuaccaguaauuaaaucug

SEQ ID NO: 295608 - RNA, 22 nt, Human
gcaauaaguuuucucuucuguc

SEQ ID NO: 295609 - RNA, 22 nt, Human
gcaauuggaaugaauucuauuu

SEQ ID NO: 295610 - RNA, 22 nt, Human
gccugcagccagggaguucucu

SEQ ID NO: 295611 - RNA, 22 nt, Human
gccugcaggaaggugugccugu

SEQ ID NO: 295612 - RNA, 22 nt, Human
gcacaaaagguacuucauguag

SEQ ID NO: 295613 - RNA, 22 nt, Human
gcgccuugccuguccucuaacc

SEQ ID NO: 295614 - RNA, 21 nt, Human
gcgcgcucgugcucgacgcgc

SEQ ID NO: 295615 - RNA, 20 nt, Human
gcgcaguuccgggcgcgucu

SEQ ID NO: 295616 - RNA, 22 nt, Human
gcgccgacccucccugccggac

SEQ ID NO: 295617 - RNA, 22 nt, Human
gcagcauuaccaagacauggca

SEQ ID NO: 295618 - RNA, 22 nt, Human
gcagcagugugggcugaaccua

SEQ ID NO: 295619 - RNA, 20 nt, Human
gcagcagacagacaggggac

SEQ ID NO: 295620 - RNA, 22 nt, Human
gcagauuggguacauaaacagu

SEQ ID NO: 295621 - RNA, 22 nt, Human
gcagaugagagugugaucuggg

SEQ ID NO: 295622 - RNA, 22 nt, Human
gcagcaauaaaacugaaggugu

SEQ ID NO: 295623 - RNA, 22 nt, Human
gcagauaguaggagcuaaucuu

SEQ ID NO: 295624 - RNA, 22 nt, Human
gcagauaaaauuuuugauggga

SEQ ID NO: 295625 - RNA, 22 nt, Human
gcagaggcugccgugggcagga

SEQ ID NO: 295626 - RNA, 22 nt, Human
gcagaguauaaguguggagcug

SEQ ID NO: 295627 - RNA, 22 nt, Human
gcagagcugucuaagucacuuc

SEQ ID NO: 295628 - RNA, 22 nt, Human
gcagagaaugucagauuuuguu

SEQ ID NO: 295629 - RNA, 22 nt, Human
gcagacuaacuuuugucagccu

SEQ ID NO: 295630 - RNA, 20 nt, Human
gcucaguggagaaaugcacc

SEQ ID NO: 295631 - RNA, 22 nt, Human
gcuccagcuccauaaacauaag

SEQ ID NO: 295632 - RNA, 22 nt, Human
gcucuucuaaguuuacccuucc

SEQ ID NO: 295633 - RNA, 23 nt, Human
gcugaagcccacucccugggucu

SEQ ID NO: 295634 - RNA, 22 nt, Human
gcucuagcuggcgcugaccugg

SEQ ID NO: 295635 - RNA, 22 nt, Human
gcagugcauggaagggggugug

SEQ ID NO: 295636 - RNA, 22 nt, Human
gcuagaaacuguuuaaucucuu

SEQ ID NO: 295637 - RNA, 22 nt, Human
gcuagauugucacuugaguguc

SEQ ID NO: 295638 - RNA, 22 nt, Human
gcuagaaggaagccccugcuga

SEQ ID NO: 295639 - RNA, 22 nt, Human
gcucagagaaaacuggggcuug

SEQ ID NO: 295640 - RNA, 22 nt, Human
gcucagccuuuuguucuauuca

SEQ ID NO: 295641 - RNA, 22 nt, Human
gcucagagaugucugcugccuu

SEQ ID NO: 295642 - RNA, 22 nt, Human
gcauaauauugagaaauuauua

SEQ ID NO: 295643 - RNA, 22 nt, Human
gcauauuuuaaaguguaaccug

SEQ ID NO: 295644 - RNA, 22 nt, Human
gcauagacaccuuagagcaaua

SEQ ID NO: 295645 - RNA, 22 nt, Human
gcgcgggugagucacgggcgga

SEQ ID NO: 295646 - RNA, 21 nt, Human
gcagcaugagaaagccccaaa

SEQ ID NO: 295647 - RNA, 22 nt, Human
gcgcugagcuuuucuuauugaa

SEQ ID NO: 295648 - RNA, 20 nt, Human
gcagcugacccuagugcuug

SEQ ID NO: 295649 - RNA, 22 nt, Human
gcagcuuuggagguggaacucu

SEQ ID NO: 295650 - RNA, 22 nt, Human
gcaggccuccccugcuggagcu

SEQ ID NO: 295651 - RNA, 22 nt, Human
gcaggacuucuguuuaaccagu

SEQ ID NO: 295652 - RNA, 22 nt, Human
gcaggcagauccagaagcacua

SEQ ID NO: 295653 - RNA, 22 nt, Human
gcgggcuuggcuccagggccca

SEQ ID NO: 295654 - RNA, 22 nt, Human
gcaggaagauugcagaaggcug

SEQ ID NO: 295655 - RNA, 22 nt, Human
gcaguagauccagcagccugca

SEQ ID NO: 295656 - RNA, 22 nt, Human
gcuacaggggucaguccuuugc

SEQ ID NO: 295657 - RNA, 22 nt, Human
gcaguauuguguguggucaugg

SEQ ID NO: 295658 - RNA, 22 nt, Human
gcagucauggguagaacucaag

SEQ ID NO: 295659 - RNA, 22 nt, Human
gcagucuacuuaagaaucucag

SEQ ID NO: 295660 - RNA, 23 nt, Human
gcagugacugggauggaaguaga

SEQ ID NO: 295661 - RNA, 22 nt, Human
gcagugccauguggaggaucuc

SEQ ID NO: 295662 - RNA, 22 nt, Human
gcagguggaagcagcagacuca

SEQ ID NO: 295663 - RNA, 22 nt, Human
gcaggucacagcugauuggcca

SEQ ID NO: 295664 - RNA, 22 nt, Human
gcaguaaauugagagucauguu

SEQ ID NO: 295665 - RNA, 22 nt, Human
gcgguuauggcagagauuacag

SEQ ID NO: 295666 - RNA, 22 nt, Human
gcuuuggcuucuccuggcagga

SEQ ID NO: 295667 - RNA, 22 nt, Human
gcuuuugaauacuacaggaguu

SEQ ID NO: 295668 - RNA, 22 nt, Human
gcuuuucucccugcuuucuucc

SEQ ID NO: 295669 - RNA, 22 nt, Human
gcuuuugagaaaguguuuuccc

SEQ ID NO: 295670 - RNA, 22 nt, Human
gcuuuugcaaagcuggagaauu

SEQ ID NO: 295671 - RNA, 22 nt, Human
ggaaaaauggguggugauauga

SEQ ID NO: 295672 - RNA, 22 nt, Human
gcuuuuuaauuugcuucccugg

SEQ ID NO: 295673 - RNA, 22 nt, Human
ggaaaagccauauuauaggcaa

SEQ ID NO: 295674 - RNA, 20 nt, Human
gcuugcggacagguggcuca

SEQ ID NO: 295675 - RNA, 22 nt, Human
gcuugcugaacaggaaccuggc

SEQ ID NO: 295676 - RNA, 18 nt, Human
gccgccuugcucgugaac

SEQ ID NO: 295677 - RNA, 22 nt, Human
gcccuuuuaucaacuccuagaa

SEQ ID NO: 295678 - RNA, 22 nt, Human
gcuucuguuaggauguggcuua

SEQ ID NO: 295679 - RNA, 18 nt, Human
gcuuggguggcuauguuu

SEQ ID NO: 295680 - RNA, 22 nt, Human
gcuugggcugaaggccuggguc

SEQ ID NO: 295681 - RNA, 22 nt, Human
gcuuucagggucacugucaaca

SEQ ID NO: 295682 - RNA, 22 nt, Human
gcuuucacugcaauagaugaau

SEQ ID NO: 295683 - RNA, 22 nt, Human
gccugaaaugaaccagaggacu

SEQ ID NO: 295684 - RNA, 22 nt, Human
gccugagucaagauguggcacc

SEQ ID NO: 295685 - RNA, 22 nt, Human
ggaaagaggacaucuuacuucu

SEQ ID NO: 295686 - RNA, 22 nt, Human
ggaaagagaaacaugaacuaga

SEQ ID NO: 295687 - RNA, 22 nt, Human
ggaaauguguguaagaaaguau

SEQ ID NO: 295688 - RNA, 22 nt, Human
ggaacaguacucggaggccaga

SEQ ID NO: 295689 - RNA, 17 nt, Human
ggaagaaaaggaucauc

SEQ ID NO: 295690 - RNA, 22 nt, Human
gccugcaaagacuuccuucucu

SEQ ID NO: 295691 - RNA, 21 nt, Human
gccgugcgccuccaggcgcgc

SEQ ID NO: 295692 - RNA, 22 nt, Human
gccuagaagaaugagcgcaggg

SEQ ID NO: 295693 - RNA, 22 nt, Human
gccggguguuccugggaagaug

SEQ ID NO: 295694 - RNA, 22 nt, Human
gccggcugggggcggagggcag

SEQ ID NO: 295695 - RNA, 22 nt, Human
gccucaaaaguguuguagaggg

SEQ ID NO: 295696 - RNA, 22 nt, Human
gcuuccuuagcuuaccaaguau

SEQ ID NO: 295697 - RNA, 22 nt, Human
gccgcagauucugagacgugua

SEQ ID NO: 295698 - RNA, 22 nt, Human
gcuuagaaucagaccuggguca

SEQ ID NO: 295699 - RNA, 21 nt, Human
gcuucaauucauccaccucuc

SEQ ID NO: 295700 - RNA, 22 nt, Human
gcuuagaugcugucauucacca

SEQ ID NO: 295701 - RNA, 22 nt, Human
gcuuaugauguuuacauaaaag

SEQ ID NO: 295702 - RNA, 22 nt, Human
gcuguggagaagcugccuaugg

SEQ ID NO: 295703 - RNA, 18 nt, Human
gcuguccgguagcuggug

SEQ ID NO: 295704 - RNA, 22 nt, Human
gcuguggcuccaauggugagcc

SEQ ID NO: 295705 - RNA, 22 nt, Human
gcuuacuguuccuguuggugcu

SEQ ID NO: 295706 - RNA, 22 nt, Human
gcuguuguugcacggaaggugg

SEQ ID NO: 295707 - RNA, 22 nt, Human
gcuguuuaaguggaauuuguuu

SEQ ID NO: 295708 - RNA, 22 nt, Human
gcuguugcaaucaaggccaugg

SEQ ID NO: 295709 - RNA, 22 nt, Human
gcuguugagucagacaaguuuu

SEQ ID NO: 295710 - RNA, 22 nt, Human
gcuguugugaggaucagcauau

SEQ ID NO: 295711 - RNA, 22 nt, Human
gcuguuggaggaguucagugcu

SEQ ID NO: 295712 - RNA, 22 nt, Human
gcccuggcauuucuauucaugu

SEQ ID NO: 295713 - RNA, 22 nt, Human
gcccugccauugaucggcccag

SEQ ID NO: 295714 - RNA, 22 nt, Human
gcccugaagagguagagaauuu

SEQ ID NO: 295715 - RNA, 22 nt, Human
gcugucccccaaagaugcuccu

SEQ ID NO: 295716 - RNA, 22 nt, Human
gcccuguguguuugcacugauu

SEQ ID NO: 295717 - RNA, 22 nt, Human
gcuguaacuuuuucauuuucaa

SEQ ID NO: 295718 - RNA, 22 nt, Human
gcugucauggacaugucuguuu

SEQ ID NO: 295719 - RNA, 22 nt, Human
gcugguuacuucauuagguccu

SEQ ID NO: 295720 - RNA, 22 nt, Human
gcugguggcagagcuccgcggc

SEQ ID NO: 295721 - RNA, 22 nt, Human
gcugacuuauuagaaaaggaca

SEQ ID NO: 295722 - RNA, 22 nt, Human
gcauugcuauuucuguuagugu

SEQ ID NO: 295723 - RNA, 22 nt, Human
gccccucuccuugugcaccugc

SEQ ID NO: 295724 - RNA, 22 nt, Human
gcaugguuuccugcaacguucu

SEQ ID NO: 295725 - RNA, 22 nt, Human
gcauguagucaguguugagaac

SEQ ID NO: 295726 - RNA, 22 nt, Human
gcugacuguagcugggggaaga

SEQ ID NO: 295727 - RNA, 22 nt, Human
gcaugguuagacaucaauguga

SEQ ID NO: 295728 - RNA, 21 nt, Human
gcucccgaagugcucggcguu

SEQ ID NO: 295729 - RNA, 22 nt, Human
gcucaacuucuaggacuucagg

SEQ ID NO: 295730 - RNA, 22 nt, Human
gcucaagaccaagggagcgggg

SEQ ID NO: 295731 - RNA, 22 nt, Human
gcucuccuugcuagagguucua

SEQ ID NO: 295732 - RNA, 22 nt, Human
gcucggcuggcucaucucaugu

SEQ ID NO: 295733 - RNA, 19 nt, Human
gcuccugcagcuagagugc

SEQ ID NO: 295734 - RNA, 22 nt, Human
gcucaacucaacgucauuugaa

SEQ ID NO: 295735 - RNA, 17 nt, Human
gcuaguuguuuccagua

SEQ ID NO: 295736 - RNA, 22 nt, Human
ggcagguggcacugcugcuccc

SEQ ID NO: 295737 - RNA, 22 nt, Human
gcuagagaccagaggccuugaa

SEQ ID NO: 295738 - RNA, 22 nt, Human
gcugacucugcuuuuagccucc

SEQ ID NO: 295739 - RNA, 22 nt, Human
gcucucucuucugcaggccuua

SEQ ID NO: 295740 - RNA, 22 nt, Human
gcugagcagaacaauuagaaau

SEQ ID NO: 295741 - RNA, 21 nt, Human
ggcauguagccagcaaaggua

SEQ ID NO: 295742 - RNA, 22 nt, Human
ggcauuccucucuguucaugga

SEQ ID NO: 295743 - RNA, 22 nt, Human
ggcaugcaaaugugggugaccu

SEQ ID NO: 295744 - RNA, 20 nt, Human
ggcaucugacaacuaguugc

SEQ ID NO: 295745 - RNA, 22 nt, Human
gcgucucugggcugacccaggu

SEQ ID NO: 295746 - RNA, 22 nt, Human
gcguaccugaaauuacggcacu

SEQ ID NO: 295747 - RNA, 22 nt, Human
gcgguuggacguucgccucggg

SEQ ID NO: 295748 - RNA, 22 nt, Human
gcguggaugauuuugagucggu

SEQ ID NO: 295749 - RNA, 22 nt, Human
gcgugcauguguguaugcgugu

SEQ ID NO: 295750 - RNA, 22 nt, Human
ggcagcagaaccaacuguggcu

SEQ ID NO: 295751 - RNA, 20 nt, Human
ggcagcaaccauaugcuaca

SEQ ID NO: 295752 - RNA, 21 nt, Human
ggcagccuggcaggggcacug

SEQ ID NO: 295753 - RNA, 22 nt, Human
ggcagcgcuuggcugcucgaca

SEQ ID NO: 295754 - RNA, 22 nt, Human
ggcacuggguugcagagagaga

SEQ ID NO: 295755 - RNA, 22 nt, Human
ggcaauauuauaagggcauuua

SEQ ID NO: 295756 - RNA, 22 nt, Human
ggcaauuacguauuagucaugu

SEQ ID NO: 295757 - RNA, 19 nt, Human
ggauaagguuggagugauc

SEQ ID NO: 295758 - RNA, 22 nt, Human
ggaguguuaggaaguuguguuu

SEQ ID NO: 295759 - RNA, 22 nt, Human
ggagugauuugucuugucuggu

SEQ ID NO: 295760 - RNA, 22 nt, Human
ggagugaagacagagugaacuu

SEQ ID NO: 295761 - RNA, 22 nt, Human
ggagugaguauguucugaugca

SEQ ID NO: 295762 - RNA, 22 nt, Human
ggaguuucugucaucccguccc

SEQ ID NO: 295763 - RNA, 22 nt, Human
ggauaaaugaaggcauacagau

SEQ ID NO: 295764 - RNA, 19 nt, Human
ggaguugccaggagaagga

SEQ ID NO: 295765 - RNA, 22 nt, Human
gcggacaauggaagaugucauu

SEQ ID NO: 295766 - RNA, 20 nt, Human
gcgcuucccuacgcucugcu

SEQ ID NO: 295767 - RNA, 22 nt, Human
gcgcgcucugcgaggacacgcu

SEQ ID NO: 295768 - RNA, 22 nt, Human
gcgcggcgcggguccucggccu

SEQ ID NO: 295769 - RNA, 22 nt, Human
ggagcuaagagaauggacaagg

SEQ ID NO: 295770 - RNA, 22 nt, Human
ggaggggaguuugccucugggg

SEQ ID NO: 295771 - RNA, 19 nt, Human
ggaggguguccucaguguc

SEQ ID NO: 295772 - RNA, 22 nt, Human
ggagggcuggacguacuagggc

SEQ ID NO: 295773 - RNA, 22 nt, Human
ggagugaaugguggccguguuu

SEQ ID NO: 295774 - RNA, 22 nt, Human
ggaggccccccaugcagcucca

SEQ ID NO: 295775 - RNA, 22 nt, Human
ggagucugugucuugaagcagu

SEQ ID NO: 295776 - RNA, 22 nt, Human
ggaggucagcuggaggggaggc

SEQ ID NO: 295777 - RNA, 22 nt, Human
ggaggccagagaagagccaggc

SEQ ID NO: 295778 - RNA, 22 nt, Human
ggagcugaacccuuaacuggcu

SEQ ID NO: 295779 - RNA, 22 nt, Human
ggaggaaauccuuaguaaggca

SEQ ID NO: 295780 - RNA, 22 nt, Human
ggacauuguuguuggauccuug

SEQ ID NO: 295781 - RNA, 22 nt, Human
ggacauggaaagugugugauuu

SEQ ID NO: 295782 - RNA, 22 nt, Human
ggacauggccguaguccccacg

SEQ ID NO: 295783 - RNA, 22 nt, Human
ggacauagaucuagacuuuaaa

SEQ ID NO: 295784 - RNA, 22 nt, Human
ggagaagaggagcuggaagccu

SEQ ID NO: 295785 - RNA, 22 nt, Human
gccuuuuaaggcagagggagau

SEQ ID NO: 295786 - RNA, 22 nt, Human
gccugggauuggggauuuuuug

SEQ ID NO: 295787 - RNA, 22 nt, Human
ggaaugcuuggcaugagaaccu

SEQ ID NO: 295788 - RNA, 22 nt, Human
ggaauguuuuccagaccuagau

SEQ ID NO: 295789 - RNA, 22 nt, Human
gccugggcuuccgggacccggg

SEQ ID NO: 295790 - RNA, 22 nt, Human
uacugcaguuccugcugucucc

SEQ ID NO: 295791 - RNA, 22 nt, Human
agucugugguccucuguaucuc

SEQ ID NO: 295792 - RNA, 22 nt, Human
uuuuccuuccugucucuuuauu

SEQ ID NO: 295793 - RNA, 22 nt, Human
guuuauucuuuuauuugugaga

SEQ ID NO: 295794 - RNA, 22 nt, Human
ucagucucuggggcuucuguuu

SEQ ID NO: 295795 - RNA, 22 nt, Human
ucuucaugaaauugauugcuua

SEQ ID NO: 295796 - RNA, 22 nt, Human
gaggcaggaagggaggguugug

SEQ ID NO: 295797 - RNA, 22 nt, Human
gugucccaaagauuagaaauca

SEQ ID NO: 295798 - RNA, 22 nt, Human
uuauauuuuauuuaauuaaaua

SEQ ID NO: 295799 - RNA, 22 nt, Human
ugcuuggagaaucagucccagc

SEQ ID NO: 295800 - RNA, 22 nt, Human
uuaggggcuuaggcagaguuug

SEQ ID NO: 295801 - RNA, 22 nt, Human
gcuuucacugcaauagaugaau

SEQ ID NO: 295802 - RNA, 22 nt, Human
agggcaguuaugaaugucucca

SEQ ID NO: 295803 - RNA, 18 nt, Human
uucaggcucuugcaugaa

SEQ ID NO: 295804 - RNA, 22 nt, Human
uucucuugccuucucuuuuauc

SEQ ID NO: 295805 - RNA, 22 nt, Human
uuauuugcccauguuuagcaga

SEQ ID NO: 295806 - RNA, 22 nt, Human
uuguuuuaguagaaguuacaug

SEQ ID NO: 295807 - RNA, 22 nt, Human
guccccugcguguucauccugg

SEQ ID NO: 295808 - RNA, 22 nt, Human
auuuaaaaacugguacaacagg

SEQ ID NO: 295809 - RNA, 22 nt, Human
agcagcugagccccagcuguga

SEQ ID NO: 295810 - RNA, 22 nt, Human
agggcaguuuuacugaaaggug

SEQ ID NO: 295811 - RNA, 22 nt, Human
guggaaggaauuaacagacuag

SEQ ID NO: 295812 - RNA, 22 nt, Human
ucacaucugugugauugucauu

SEQ ID NO: 295813 - RNA, 22 nt, Human
cucugcuuguaucacauuugcu

SEQ ID NO: 295814 - RNA, 22 nt, Human
guuguuuucagcccagcauuag

SEQ ID NO: 295815 - RNA, 22 nt, Human
gcugucccccaaagaugcuccu

SEQ ID NO: 295816 - RNA, 22 nt, Human
aaggcuguuugagcacuggagc

SEQ ID NO: 295817 - RNA, 22 nt, Human
uauuuuauuuagguuuaguugu

SEQ ID NO: 295818 - RNA, 21 nt, Human
uccugcagggcagcagagugg

SEQ ID NO: 295819 - RNA, 22 nt, Human
auuagaagagcuuuuuacucuu

SEQ ID NO: 295820 - RNA, 22 nt, Human
uuauuuaaguauuuauugaagu

SEQ ID NO: 295821 - RNA, 20 nt, Human
aggggcuguaguuagaugac

SEQ ID NO: 295822 - RNA, 22 nt, Human
gcauaauauugagaaauuauua

SEQ ID NO: 295823 - RNA, 22 nt, Human
uuaucaaaaaauaguacuuuga

SEQ ID NO: 295824 - RNA, 22 nt, Human
uuuaacauaugaaagaauauuu

SEQ ID NO: 295825 - RNA, 22 nt, Human
gcccugucagcucucauggaca

SEQ ID NO: 295826 - RNA, 22 nt, Human
ucccuucccaccccugccuuuu

SEQ ID NO: 295827 - RNA, 22 nt, Human
cuucuuaaaguugucacagcug

SEQ ID NO: 295828 - RNA, 22 nt, Human
augaagguggacagauuuuuuu

SEQ ID NO: 295829 - RNA, 22 nt, Human
ccaggcucaccuggagccccug

SEQ ID NO: 295830 - RNA, 22 nt, Human
cugcugugcagacagacucucu

SEQ ID NO: 295831 - RNA, 23 nt, Human
ccagcugugccuggcccaggagc

SEQ ID NO: 295832 - RNA, 22 nt, Human
gugucacuuucaggagcucuaa

SEQ ID NO: 295833 - RNA, 20 nt, Human
ugauuauuccaacaagaaug

SEQ ID NO: 295834 - RNA, 22 nt, Human
ggagcucacuacgaaauaagcu

SEQ ID NO: 295835 - RNA, 22 nt, Human
agaguucuauccagacucaugu

SEQ ID NO: 295836 - RNA, 21 nt, Human
agaugaggauacugaggccua

SEQ ID NO: 295837 - RNA, 22 nt, Human
gaggcucagagggacuuucaag

SEQ ID NO: 295838 - RNA, 22 nt, Human
gucuuucuuuuacauauuugug

SEQ ID NO: 295839 - RNA, 22 nt, Human
ggcuguggcagcuggaaguggu

SEQ ID NO: 295840 - RNA, 22 nt, Human
cacagcuggggaagcugaggcc

SEQ ID NO: 295841 - RNA, 22 nt, Human
aaugaauaaauuuuaaagacag

SEQ ID NO: 295842 - RNA, 22 nt, Human
uuuacaaggcaguuauuuuccu

SEQ ID NO: 295843 - RNA, 22 nt, Human
guuuucuuguuaauuuugaacg

SEQ ID NO: 295844 - RNA, 22 nt, Human
auggagugggaggacaugaagg

SEQ ID NO: 295845 - RNA, 22 nt, Human
acugcauuaucaccaagaugua

SEQ ID NO: 295846 - RNA, 22 nt, Human
aggagaaagaccagccugccga

SEQ ID NO: 295847 - RNA, 22 nt, Human
uugccaggagacaucuggagcc

SEQ ID NO: 295848 - RNA, 22 nt, Human
aguaaaugaaagcaauuuuaga

SEQ ID NO: 295849 - RNA, 22 nt, Human
ucucugaccuccaccccaggag

SEQ ID NO: 295850 - RNA, 22 nt, Human
cuggagaacucugugcuucacu

SEQ ID NO: 295851 - RNA, 22 nt, Human
uuuuccuucuuccugccuugcc

SEQ ID NO: 295852 - RNA, 21 nt, Human
uuucauuaguacaucaauuug

SEQ ID NO: 295853 - RNA, 22 nt, Human
gaggaggcuggagaggccagga

SEQ ID NO: 295854 - RNA, 22 nt, Human
uauuuaaagucagcaacuuuuc

SEQ ID NO: 295855 - RNA, 22 nt, Human
aguuuccacuggagacacugug

SEQ ID NO: 295856 - RNA, 18 nt, Human
auucauuugcguuuggcu

SEQ ID NO: 295857 - RNA, 22 nt, Human
gcucagccuuuuguucuauuca

SEQ ID NO: 295858 - RNA, 22 nt, Human
gaggcuugccacuguccauggc

SEQ ID NO: 295859 - RNA, 22 nt, Human
uauuucuagggcaugaaaauaa

SEQ ID NO: 295860 - RNA, 22 nt, Human
agagacaggguuuugucguguu

SEQ ID NO: 295861 - RNA, 22 nt, Human
gcagggcucuggagucaggcug

SEQ ID NO: 295862 - RNA, 22 nt, Human
cucagcgagggaaagaggccgc

SEQ ID NO: 295863 - RNA, 22 nt, Human
uucuagcucauggugacagauc

SEQ ID NO: 295864 - RNA, 22 nt, Human
caaauguuugguggcauuuugu

SEQ ID NO: 295865 - RNA, 22 nt, Human
aaauguaaacuguauuuauaaa

SEQ ID NO: 295866 - RNA, 22 nt, Human
uucacuguucuuagagaagacc

SEQ ID NO: 295867 - RNA, 22 nt, Human
ggugugaauagagccuggagca

SEQ ID NO: 295868 - RNA, 22 nt, Human
cagcuccaucuugcuuauacca

SEQ ID NO: 295869 - RNA, 22 nt, Human
gcuguggacacagcucucuuca

SEQ ID NO: 295870 - RNA, 22 nt, Human
acauaaaccccccuuccccagg

SEQ ID NO: 295871 - RNA, 22 nt, Human
guccuguguaaguacuugcuca

SEQ ID NO: 295872 - RNA, 22 nt, Human
uggagagauagucauucuagag

SEQ ID NO: 295873 - RNA, 22 nt, Human
uuuuaaauggcuuuuacuuuuc

SEQ ID NO: 295874 - RNA, 22 nt, Human
agucacuguucugucaugucaa

SEQ ID NO: 295875 - RNA, 22 nt, Human
aucacuagaguuacauugccag

SEQ ID NO: 295876 - RNA, 22 nt, Human
ggggaaggaaggggagggcacg

SEQ ID NO: 295877 - RNA, 22 nt, Human
caggccccagggacugggcgcu

SEQ ID NO: 295878 - RNA, 22 nt, Human
gcucagcuggagagggacgggu

SEQ ID NO: 295879 - RNA, 22 nt, Human
gccugcaggaaggugugccugu

SEQ ID NO: 295880 - RNA, 22 nt, Human
uauuuucucugccacacuucca

SEQ ID NO: 295881 - RNA, 23 nt, Human
uuucugaguuuuuuaaaagucca

SEQ ID NO: 295882 - RNA, 22 nt, Human
cuucuuuuggggaugaaaaugg

SEQ ID NO: 295883 - RNA, 22 nt, Human
uuauuuaagaucuuaauauaua

SEQ ID NO: 295884 - RNA, 22 nt, Human
aucuaaaacuacgaauacuacc

SEQ ID NO: 295885 - RNA, 22 nt, Human
aggauagacuucagaaggcaua

SEQ ID NO: 295886 - RNA, 18 nt, Human
uucucucuggauaguagu

SEQ ID NO: 295887 - RNA, 22 nt, Human
ggcuggagcaggcugcacagug

SEQ ID NO: 295888 - RNA, 22 nt, Human
ggugaguagaaguaguuggcuu

SEQ ID NO: 295889 - RNA, 22 nt, Human
cugguacuggaggaguucagag

SEQ ID NO: 295890 - RNA, 22 nt, Human
uucacauucauuucuuauguuu

SEQ ID NO: 295891 - RNA, 22 nt, Human
ccagcugggucccugcuggggc

SEQ ID NO: 295892 - RNA, 21 nt, Human
ugagcccaaagcuguauuggu

SEQ ID NO: 295893 - RNA, 22 nt, Human
gggauggggagcuggaaagggg

SEQ ID NO: 295894 - RNA, 22 nt, Human
ccugcuggagucuaguuggucu

SEQ ID NO: 295895 - RNA, 22 nt, Human
cugucucugauaagcucgaggg

SEQ ID NO: 295896 - RNA, 22 nt, Human
uuaugccuguuaggcagcaucu

SEQ ID NO: 295897 - RNA, 22 nt, Human
uggcagccugcgugaaggagcu

SEQ ID NO: 295898 - RNA, 22 nt, Human
gaggagcuucagaggaaucuua

SEQ ID NO: 295899 - RNA, 22 nt, Human
uccauuuacuauucucauaucg

SEQ ID NO: 295900 - RNA, 22 nt, Human
cuuuaaaaauguauuuuugugg

SEQ ID NO: 295901 - RNA, 22 nt, Human
auagagcuggggaagaagcugg

SEQ ID NO: 295902 - RNA, 22 nt, Human
auucuucauguugaagcuguca

SEQ ID NO: 295903 - RNA, 22 nt, Human
ucuuuuucccugguuccuuuuu

SEQ ID NO: 295904 - RNA, 22 nt, Human
uuaacauuguccuuagcagauu

SEQ ID NO: 295905 - RNA, 23 nt, Human
uccuccccaccuuuguccccucc

SEQ ID NO: 295906 - RNA, 22 nt, Human
guaaauaucucacgaaugauuc

SEQ ID NO: 295907 - RNA, 22 nt, Human
ucugagugacguccugacagga

SEQ ID NO: 295908 - RNA, 17 nt, Human
ccacuagauagguugug

SEQ ID NO: 295909 - RNA, 22 nt, Human
uggcacagcuugucauaaacuc

SEQ ID NO: 295910 - RNA, 22 nt, Human
aggauggaaguaacuggauaau

SEQ ID NO: 295911 - RNA, 22 nt, Human
aggguggaggacaggccaguga

SEQ ID NO: 295912 - RNA, 22 nt, Human
gccugggguuugcggggcugca

SEQ ID NO: 295913 - RNA, 17 nt, Human
uuagagcuacauguuga

SEQ ID NO: 295914 - RNA, 22 nt, Human
cauggcggcgcucucccugccu

SEQ ID NO: 295915 - RNA, 22 nt, Human
gguagacugagcuccuugagga

SEQ ID NO: 295916 - RNA, 22 nt, Human
gugaaauuguacacucaguacc

SEQ ID NO: 295917 - RNA, 20 nt, Human
agaaggagagaugaggcaaa

SEQ ID NO: 295918 - RNA, 22 nt, Human
uuuuuaaaagaugauuuaauga

SEQ ID NO: 295919 - RNA, 22 nt, Human
ucagccuugguuuugguguugg

SEQ ID NO: 295920 - RNA, 22 nt, Human
agcucugcuucuugggaagaug

SEQ ID NO: 295921 - RNA, 22 nt, Human
aauauuuaccuaccugucaucu

SEQ ID NO: 295922 - RNA, 16 nt, Human
gaauuccauugcucug

SEQ ID NO: 295923 - RNA, 22 nt, Human
aaauguuugguggauaaaagga

SEQ ID NO: 295924 - RNA, 22 nt, Human
uggacacugguggauauggaau

SEQ ID NO: 295925 - RNA, 22 nt, Human
agggcugggcuuggcaggcugg

SEQ ID NO: 295926 - RNA, 22 nt, Human
gaagcccuggaggggcuggagg

SEQ ID NO: 295927 - RNA, 22 nt, Human
uucauggauuugugaaauuuag

SEQ ID NO: 295928 - RNA, 22 nt, Human
uauauuaaagugcuuugcagug

SEQ ID NO: 295929 - RNA, 22 nt, Human
cuucuucaucuuuuggaggaac

SEQ ID NO: 295930 - RNA, 22 nt, Human
augccugcugucaggaacucuu

SEQ ID NO: 295931 - RNA, 22 nt, Human
uggguauauauguugcuacaga

SEQ ID NO: 295932 - RNA, 22 nt, Human
ucagcucucucuuggugaucuc

SEQ ID NO: 295933 - RNA, 22 nt, Human
cuccaugagccaggagggcuac

SEQ ID NO: 295934 - RNA, 22 nt, Human
uuuugaauaauucagaaacagc

SEQ ID NO: 295935 - RNA, 22 nt, Human
uuuuccuuagaaauacauugau

SEQ ID NO: 295936 - RNA, 22 nt, Human
gcucagagaaaacuggggcuug

SEQ ID NO: 295937 - RNA, 22 nt, Human
augcuuucucuucuauuucuca

SEQ ID NO: 295938 - RNA, 22 nt, Human
cauuucaaacaguuacagcugc

SEQ ID NO: 295939 - RNA, 22 nt, Human
guuuccaggcuuugguaugguu

SEQ ID NO: 295940 - RNA, 22 nt, Human
uucaugucuuugauucugauaa

SEQ ID NO: 295941 - RNA, 22 nt, Human
caauaccucuuggugauugggc

SEQ ID NO: 295942 - RNA, 22 nt, Human
aaaacauuuaggguuuuuuuua

SEQ ID NO: 295943 - RNA, 23 nt, Human
ucagaccaaccucuugcuggaac

SEQ ID NO: 295944 - RNA, 22 nt, Human
uucacugugauguuuaagagaa

SEQ ID NO: 295945 - RNA, 22 nt, Human
gaauuccaggugagagaaggua

SEQ ID NO: 295946 - RNA, 22 nt, Human
uaguggaaccuucuaaaugacg

SEQ ID NO: 295947 - RNA, 22 nt, Human
uggggcuccuccuggcaggagg

SEQ ID NO: 295948 - RNA, 22 nt, Human
aaugauuuucugcaaacaguga

SEQ ID NO: 295949 - RNA, 22 nt, Human
caguacugucuuccugauggca

SEQ ID NO: 295950 - RNA, 22 nt, Human
cucuguguguuugugugugugu

SEQ ID NO: 295951 - RNA, 22 nt, Human
accugcagguguuuccacacuu

SEQ ID NO: 295952 - RNA, 22 nt, Human
uuaaacauuuccacuugccagu

SEQ ID NO: 295953 - RNA, 23 nt, Human
agagggaagagcuuagaugggga

SEQ ID NO: 295954 - RNA, 22 nt, Human
uuuucucaguuuuuuucaaaag

SEQ ID NO: 295955 - RNA, 22 nt, Human
ugcccacuucaaaaucuucauu

SEQ ID NO: 295956 - RNA, 22 nt, Human
uauuuuuuuaacauuuauugua

SEQ ID NO: 295957 - RNA, 22 nt, Human
auuuucuucauuuugauuguau

SEQ ID NO: 295958 - RNA, 22 nt, Human
ucccugcugggcgaucuucucu

SEQ ID NO: 295959 - RNA, 22 nt, Human
ggggaggguuuggaugagaguc

SEQ ID NO: 295960 - RNA, 19 nt, Human
augaaauagcauuuucuga

SEQ ID NO: 295961 - RNA, 22 nt, Human
ucccaaguguuuggcgaggaga

SEQ ID NO: 295962 - RNA, 22 nt, Human
aaggucuucgaaccuuauguua

SEQ ID NO: 295963 - RNA, 22 nt, Human
ggaggaugaggguggugguguu

SEQ ID NO: 295964 - RNA, 22 nt, Human
auauauguauauaugugugugu

SEQ ID NO: 295965 - RNA, 22 nt, Human
aaaucauagccaugaacauuug

SEQ ID NO: 295966 - RNA, 22 nt, Human
gaggccagcacccagaugcaug

SEQ ID NO: 295967 - RNA, 22 nt, Human
cauaggcucuucagagaacuga

SEQ ID NO: 295968 - RNA, 22 nt, Human
guuuuaucuauguaauuauaaa

SEQ ID NO: 295969 - RNA, 22 nt, Human
guucuucagauuccauuucagu

SEQ ID NO: 295970 - RNA, 22 nt, Human
agugagaguauuaaugugaacu

SEQ ID NO: 295971 - RNA, 22 nt, Human
uggagccugauggauaggaacg

SEQ ID NO: 295972 - RNA, 22 nt, Human
uuucuaaaaccagaguuuauaa

SEQ ID NO: 295973 - RNA, 22 nt, Human
cuucauccguaccacggccaca

SEQ ID NO: 295974 - RNA, 22 nt, Human
uccagcugugcuccaggaggug

SEQ ID NO: 295975 - RNA, 22 nt, Human
ugggggagggagaguugauggg

SEQ ID NO: 295976 - RNA, 22 nt, Human
gguuuucacgauccucccuuuu

SEQ ID NO: 295977 - RNA, 22 nt, Human
auuguuuugugaaacauaguga

SEQ ID NO: 295978 - RNA, 22 nt, Human
ugcaggaacucgaaaacuauag

SEQ ID NO: 295979 - RNA, 22 nt, Human
uucucugcgcuccggcccaguu

SEQ ID NO: 295980 - RNA, 22 nt, Human
uggcaaggccacaggugcaguu

SEQ ID NO: 295981 - RNA, 22 nt, Human
auccugugggguauugcugcau

SEQ ID NO: 295982 - RNA, 22 nt, Human
guuaaaaugauuugugauuuau

SEQ ID NO: 295983 - RNA, 22 nt, Human
caauggagccaagaggaggaaa

SEQ ID NO: 295984 - RNA, 22 nt, Human
uuucauguuggauacuguuuca

SEQ ID NO: 295985 - RNA, 22 nt, Human
cucagaauugucaccucaaaaa

SEQ ID NO: 295986 - RNA, 22 nt, Human
gaguucuagauguauuauuaau

SEQ ID NO: 295987 - RNA, 22 nt, Human
cacugcacuccagccugggcaa

SEQ ID NO: 295988 - RNA, 21 nt, Human
ugcuuucugugcuuuuucugc

SEQ ID NO: 295989 - RNA, 22 nt, Human
uccucccugcacucagugaagu

SEQ ID NO: 295990 - RNA, 22 nt, Human
acugucuuguuguaugugagcu

SEQ ID NO: 295991 - RNA, 22 nt, Human
uauuucaugagugaauaucuag

SEQ ID NO: 295992 - RNA, 20 nt, Human
ucacuguaauugccuacauu

SEQ ID NO: 295993 - RNA, 22 nt, Human
uucuucuuuccuauaauuaauu

SEQ ID NO: 295994 - RNA, 22 nt, Human
uuggugaugcccaccuuuucau

SEQ ID NO: 295995 - RNA, 17 nt, Human
ugucuuuuuccuccucc

SEQ ID NO: 295996 - RNA, 22 nt, Human
ugagagggagacagcucuagca

SEQ ID NO: 295997 - RNA, 22 nt, Human
uauuuuagccaacagaaugaug

SEQ ID NO: 295998 - RNA, 22 nt, Human
cagcuuguucugaccugugauu

SEQ ID NO: 295999 - RNA, 22 nt, Human
guuuaaaagcaaccaacaggcu

SEQ ID NO: 296000 - RNA, 22 nt, Human
gaagaaggaagaucaugcuuga

SEQ ID NO: 296001 - RNA, 22 nt, Human
acauuccugaagguaaugagaa

SEQ ID NO: 296002 - RNA, 20 nt, Human
uucacagaggacucagguca

SEQ ID NO: 296003 - RNA, 22 nt, Human
ugagauguaauguaguacuuug

SEQ ID NO: 296004 - RNA, 22 nt, Human
gucacuuugcuugcgaugcucc

SEQ ID NO: 296005 - RNA, 20 nt, Human
gaacauaaauaacucuuuac

SEQ ID NO: 296006 - RNA, 20 nt, Human
ugccagagagcucauacccu

SEQ ID NO: 296007 - RNA, 22 nt, Human
cuccucccagcccaggcgccac

SEQ ID NO: 296008 - RNA, 22 nt, Human
gcucucuggccugggaggagga

SEQ ID NO: 296009 - RNA, 22 nt, Human
cuuggggauuuuaaagaccucu

SEQ ID NO: 296010 - RNA, 22 nt, Human
cuguguguauaauguuugauaa

SEQ ID NO: 296011 - RNA, 22 nt, Human
agaucugucaccauccuggagc

SEQ ID NO: 296012 - RNA, 22 nt, Human
uuuauaauuacguaaaauauuu

SEQ ID NO: 296013 - RNA, 22 nt, Human
cagcuccagcccaggcagcucc

SEQ ID NO: 296014 - RNA, 22 nt, Human
auucuuuucucuaaaugaugaa

SEQ ID NO: 296015 - RNA, 22 nt, Human
cuccugcuuuuucuucuuccga

SEQ ID NO: 296016 - RNA, 22 nt, Human
uuuaaaacagcauuuaaaaggu

SEQ ID NO: 296017 - RNA, 22 nt, Human
auuuccacaaauuaagauugca

SEQ ID NO: 296018 - RNA, 22 nt, Human
uuauuuaaaauguagguuggga

SEQ ID NO: 296019 - RNA, 22 nt, Human
aagggagagggagaagguggga

SEQ ID NO: 296020 - RNA, 22 nt, Human
gagggggaaaagggcagcagag

SEQ ID NO: 296021 - RNA, 22 nt, Human
aauaucuugaguuauaaauuca

SEQ ID NO: 296022 - RNA, 20 nt, Human
uuggagaucacguguccagg

SEQ ID NO: 296023 - RNA, 22 nt, Human
uauuuuuacuguuugaugauuc

SEQ ID NO: 296024 - RNA, 22 nt, Human
aguaggauguuuagcccuucuu

SEQ ID NO: 296025 - RNA, 20 nt, Human
gacaugagggagcaaagagc

SEQ ID NO: 296026 - RNA, 22 nt, Human
gugggugaguggggccgccuga

SEQ ID NO: 296027 - RNA, 22 nt, Human
uuuuuuccuguuugucuuuggg

SEQ ID NO: 296028 - RNA, 22 nt, Human
ugaccucaagcaugcggagggc

SEQ ID NO: 296029 - RNA, 22 nt, Human
aggggcugagaguuugaugugg

SEQ ID NO: 296030 - RNA, 22 nt, Human
uuucuugugauuuugaugaacu

SEQ ID NO: 296031 - RNA, 22 nt, Human
ucccagguugaggccuugccug

SEQ ID NO: 296032 - RNA, 22 nt, Human
aaugcuuuuugcgaaaugugca

SEQ ID NO: 296033 - RNA, 22 nt, Human
auacauauaugcacauuaauau

SEQ ID NO: 296034 - RNA, 22 nt, Human
cagugcucauagcuguuccucc

SEQ ID NO: 296035 - RNA, 22 nt, Human
aacgagcugggggggccggggg

SEQ ID NO: 296036 - RNA, 22 nt, Human
cuagcacagugcuuggcacaca

SEQ ID NO: 296037 - RNA, 22 nt, Human
uuuaaucaguugguaauauuga

SEQ ID NO: 296038 - RNA, 22 nt, Human
uuauuuuuguuuguuaagccua

SEQ ID NO: 296039 - RNA, 22 nt, Human
cacugcaaccuccaccucccgg

SEQ ID NO: 296040 - RNA, 23 nt, Human
cagagaaaauagaauaugcugug

SEQ ID NO: 296041 - RNA, 22 nt, Human
gaggugauuccucccauguaau

SEQ ID NO: 296042 - RNA, 22 nt, Human
uuuuagaagcauuuaugagauu

SEQ ID NO: 296043 - RNA, 22 nt, Human
ugaguucugacugagcaugggg

SEQ ID NO: 296044 - RNA, 22 nt, Human
gggggcugugugcccgcucccc

SEQ ID NO: 296045 - RNA, 22 nt, Human
ucugcagggcccuuggcuccug

SEQ ID NO: 296046 - RNA, 22 nt, Human
ugcuuggauuuccaaaugguuu

SEQ ID NO: 296047 - RNA, 22 nt, Human
aagagaggaaagggugugaggu

SEQ ID NO: 296048 - RNA, 22 nt, Human
cccagagggcugaggauaugaa

SEQ ID NO: 296049 - RNA, 22 nt, Human
uccuuucaaauuuauuugacau

SEQ ID NO: 296050 - RNA, 22 nt, Human
uuauuucaggcauuuguaaaug

SEQ ID NO: 296051 - RNA, 22 nt, Human
ggcagggagagcgccgccaugc

SEQ ID NO: 296052 - RNA, 22 nt, Human
agauggaggaaagcaguuagaa

SEQ ID NO: 296053 - RNA, 22 nt, Human
ugaggaagugguuguaugguuu

SEQ ID NO: 296054 - RNA, 22 nt, Human
gugugucucaguugcuccgaag

SEQ ID NO: 296055 - RNA, 18 nt, Human
ggccucagccuggccgga

SEQ ID NO: 296056 - RNA, 21 nt, Human
auauuguugggguuuucuuuu

SEQ ID NO: 296057 - RNA, 22 nt, Human
uucuugugugaauauaauuaca

SEQ ID NO: 296058 - RNA, 22 nt, Human
auauucaaugaggucauauaag

SEQ ID NO: 296059 - RNA, 22 nt, Human
agggcaggguuggugcuggugc

SEQ ID NO: 296060 - RNA, 22 nt, Human
ucgagcucagcagggaggugcg

SEQ ID NO: 296061 - RNA, 22 nt, Human
uauauaauacacaaauauguac

SEQ ID NO: 296062 - RNA, 22 nt, Human
aaauucuuccaggaggaaauac

SEQ ID NO: 296063 - RNA, 22 nt, Human
ugugugcuaguuuugucaguau

SEQ ID NO: 296064 - RNA, 22 nt, Human
guacauauccuuuacguuuugu

SEQ ID NO: 296065 - RNA, 22 nt, Human
cucaucagagcccuccucuggc

SEQ ID NO: 296066 - RNA, 22 nt, Human
ugugucuuuggcgaugucugga

SEQ ID NO: 296067 - RNA, 22 nt, Human
aacucugcaaugaaaucauguu

SEQ ID NO: 296068 - RNA, 22 nt, Human
agagauacugcaggccauaaau

SEQ ID NO: 296069 - RNA, 22 nt, Human
acuguugagggaagcagaugaa

SEQ ID NO: 296070 - RNA, 22 nt, Human
uggaggcccagcugggggccgg

SEQ ID NO: 296071 - RNA, 22 nt, Human
cugcaucacagcaggaggcaca

SEQ ID NO: 296072 - RNA, 22 nt, Human
aaaauaauauuauaccacugcu

SEQ ID NO: 296073 - RNA, 22 nt, Human
uauuuuaaaagcauuaauucuu

SEQ ID NO: 296074 - RNA, 22 nt, Human
ggcugggagguggcgaggaggc

SEQ ID NO: 296075 - RNA, 22 nt, Human
auucauucugaccucaagagaa

SEQ ID NO: 296076 - RNA, 22 nt, Human
aggcaguguguagcuggaagag

SEQ ID NO: 296077 - RNA, 22 nt, Human
aagcucugggacugaggcuccu

SEQ ID NO: 296078 - RNA, 17 nt, Human
auucaugaacauguccu

SEQ ID NO: 296079 - RNA, 22 nt, Human
uuagaaauguccuacuaauaug

SEQ ID NO: 296080 - RNA, 22 nt, Human
auguuccaugacuaugcaugaa

SEQ ID NO: 296081 - RNA, 22 nt, Human
uuauuuucgugugugugugugu

SEQ ID NO: 296082 - RNA, 22 nt, Human
ugggcagggauuuggggaaacu

SEQ ID NO: 296083 - RNA, 23 nt, Human
uuuuccaaaucgacucucuaguu

SEQ ID NO: 296084 - RNA, 22 nt, Human
uguuuagcucugacuaugugau

SEQ ID NO: 296085 - RNA, 22 nt, Human
ggcugugguggacgcgggaaac

SEQ ID NO: 296086 - RNA, 20 nt, Human
agugauuuguuaguacauug

SEQ ID NO: 296087 - RNA, 22 nt, Human
cacuguugagcaauguacagug

SEQ ID NO: 296088 - RNA, 22 nt, Human
aagaggcuacagcccugugucu

SEQ ID NO: 296089 - RNA, 22 nt, Human
uugauagauuuuagaggcaggc

SEQ ID NO: 296090 - RNA, 22 nt, Human
guuuuguagucuggagacuguc

SEQ ID NO: 296091 - RNA, 22 nt, Human
uauaagaaaagucauuaucaaa

SEQ ID NO: 296092 - RNA, 22 nt, Human
ucccuguggauuaaggagaugu

SEQ ID NO: 296093 - RNA, 22 nt, Human
cuuuuuuucuccauauuucugg

SEQ ID NO: 296094 - RNA, 22 nt, Human
auguaugagagauucuuuuauu

SEQ ID NO: 296095 - RNA, 22 nt, Human
uccucagcaaacacuucacucu

SEQ ID NO: 296096 - RNA, 21 nt, Human
cuauaaaaaugguucuuugcg

SEQ ID NO: 296097 - RNA, 22 nt, Human
ggagagcuagugagcuggaggu

SEQ ID NO: 296098 - RNA, 22 nt, Human
uuuucucuuugcuucucuaaaa

SEQ ID NO: 296099 - RNA, 22 nt, Human
gggcugagagcuggaaucugag

SEQ ID NO: 296100 - RNA, 19 nt, Human
acuggggcaggcugggcuu

SEQ ID NO: 296101 - RNA, 19 nt, Human
uagaggagaauggcaaaga

SEQ ID NO: 296102 - RNA, 22 nt, Human
acucauucgccuugcccaaggc

SEQ ID NO: 296103 - RNA, 19 nt, Human
ucaggaggucgaccuggca

SEQ ID NO: 296104 - RNA, 22 nt, Human
acucacuguuuugaaauugaac

SEQ ID NO: 296105 - RNA, 22 nt, Human
ugaaguuuagaaaaagugccuu

SEQ ID NO: 296106 - RNA, 22 nt, Human
auucuuuauuuucuguacuugc

SEQ ID NO: 296107 - RNA, 22 nt, Human
guggguauauauaugugugcug

SEQ ID NO: 296108 - RNA, 22 nt, Human
aggcagagaggucuuccuggaa

SEQ ID NO: 296109 - RNA, 22 nt, Human
aaauauuugaaugguguaagau

SEQ ID NO: 296110 - RNA, 22 nt, Human
uacaacuuacuugaauggcuuu

SEQ ID NO: 296111 - RNA, 22 nt, Human
ucgcccagguuggagugcagug

SEQ ID NO: 296112 - RNA, 22 nt, Human
ugaaaaauauuuuuagaaauaa

SEQ ID NO: 296113 - RNA, 22 nt, Human
ccauuucacaucccugacaugu

SEQ ID NO: 296114 - RNA, 22 nt, Human
guggagaaagcuggaaucugag

SEQ ID NO: 296115 - RNA, 22 nt, Human
caaaaaauccauagaaagaggu

SEQ ID NO: 296116 - RNA, 22 nt, Human
agauuuucuuuuccaucuuugu

SEQ ID NO: 296117 - RNA, 22 nt, Human
uguuuuuauucuuaauguuuca

SEQ ID NO: 296118 - RNA, 22 nt, Human
uuaucuuuuaaaaacacuugug

SEQ ID NO: 296119 - RNA, 22 nt, Human
ggugucuuugauguugggcuga

SEQ ID NO: 296120 - RNA, 22 nt, Human
ggcucccgugggaugguggagc

SEQ ID NO: 296121 - RNA, 22 nt, Human
aucuucuuucaucagccccuca

SEQ ID NO: 296122 - RNA, 19 nt, Human
agagucuccacuccacuug

SEQ ID NO: 296123 - RNA, 22 nt, Human
ugucuuugaccuuaagaaguuu

SEQ ID NO: 296124 - RNA, 22 nt, Human
gcagaggcugccgugggcagga

SEQ ID NO: 296125 - RNA, 22 nt, Human
ggacauaguugcuauggagagu

SEQ ID NO: 296126 - RNA, 22 nt, Human
uuguuauaggaucagugucacu

SEQ ID NO: 296127 - RNA, 22 nt, Human
uggaaaauuuagaaagauuuau

SEQ ID NO: 296128 - RNA, 22 nt, Human
uuauuuuauaaagagaagacuu

SEQ ID NO: 296129 - RNA, 22 nt, Human
ggcagagcugugcgcccaccca

SEQ ID NO: 296130 - RNA, 22 nt, Human
cagcuggggagagacauggcag

SEQ ID NO: 296131 - RNA, 22 nt, Human
auuuuuuuuccugucucuuuca

SEQ ID NO: 296132 - RNA, 22 nt, Human
ccucaucagaaagcagaaagca

SEQ ID NO: 296133 - RNA, 22 nt, Human
uuucuggacuaaagggagagau

SEQ ID NO: 296134 - RNA, 22 nt, Human
augcugugccuggaaagcggcu

SEQ ID NO: 296135 - RNA, 22 nt, Human
cuccacagccccuccaguggca

SEQ ID NO: 296136 - RNA, 22 nt, Human
guugagaaucucuagcuuagga

SEQ ID NO: 296137 - RNA, 22 nt, Human
ccagucuuggugucuguagcac

SEQ ID NO: 296138 - RNA, 22 nt, Human
uauaaagaccuuauccuucaua

SEQ ID NO: 296139 - RNA, 22 nt, Human
gcacaaaagguacuucauguag

SEQ ID NO: 296140 - RNA, 22 nt, Human
uucacccuucucuggcuuucag

SEQ ID NO: 296141 - RNA, 18 nt, Human
cccagaggaaugccugga

SEQ ID NO: 296142 - RNA, 22 nt, Human
ucacucuuuaucuuuuaugucu

SEQ ID NO: 296143 - RNA, 22 nt, Human
uauuuuuaccuaauuuaugaga

SEQ ID NO: 296144 - RNA, 22 nt, Human
ccagggaggucauagugcuggu

SEQ ID NO: 296145 - RNA, 22 nt, Human
uucacugugauugggguggauu

SEQ ID NO: 296146 - RNA, 22 nt, Human
uuuucauuguuaguuucuccuu

SEQ ID NO: 296147 - RNA, 22 nt, Human
ugcuuucaaaacucagaggaau

SEQ ID NO: 296148 - RNA, 22 nt, Human
cagaccuggaaaacaggcuugc

SEQ ID NO: 296149 - RNA, 22 nt, Human
cucuugugucaccauggauaaa

SEQ ID NO: 296150 - RNA, 20 nt, Human
ucagugggaaagugagagug

SEQ ID NO: 296151 - RNA, 22 nt, Human
ggcuagggaucuagaccaggac

SEQ ID NO: 296152 - RNA, 23 nt, Human
uaagccugugccugcuaccugcu

SEQ ID NO: 296153 - RNA, 22 nt, Human
ugaaauuuuuuggagauaauuu

SEQ ID NO: 296154 - RNA, 22 nt, Human
caguagcuuuuugcagacaaga

SEQ ID NO: 296155 - RNA, 22 nt, Human
ggccugcuaccagcugugaccu

SEQ ID NO: 296156 - RNA, 22 nt, Human
uuucagaaauggcacugaaauc

SEQ ID NO: 296157 - RNA, 22 nt, Human
ugccagcuccgaggagcugcag

SEQ ID NO: 296158 - RNA, 22 nt, Human
acucugcaguaaggaauuguuu

SEQ ID NO: 296159 - RNA, 22 nt, Human
aggcaguggagcuggaauaggc

SEQ ID NO: 296160 - RNA, 22 nt, Human
cucugugucugauucugggaag

SEQ ID NO: 296161 - RNA, 22 nt, Human
uagcugucauuggaucagaagg

SEQ ID NO: 296162 - RNA, 22 nt, Human
gaggggacugucuggcuccgag

SEQ ID NO: 296163 - RNA, 22 nt, Human
aggcuccucugggggccccgga

SEQ ID NO: 296164 - RNA, 22 nt, Human
gggcagagagcuggaacuccuu

SEQ ID NO: 296165 - RNA, 22 nt, Human
uguugaagcaccucugucuuuc

SEQ ID NO: 296166 - RNA, 22 nt, Human
uuuuuuaaucaaguaggaaaca

SEQ ID NO: 296167 - RNA, 22 nt, Human
gaaggagaggauugugaggcug

SEQ ID NO: 296168 - RNA, 22 nt, Human
uggagucuugcuuugggagugc

SEQ ID NO: 296169 - RNA, 22 nt, Human
uccauguauugcuaacaaauag

SEQ ID NO: 296170 - RNA, 22 nt, Human
uagcauuucacugaucuucacu

SEQ ID NO: 296171 - RNA, 22 nt, Human
ugggggaggaggagacagacug

SEQ ID NO: 296172 - RNA, 22 nt, Human
uggaugccuugggggaggagga

SEQ ID NO: 296173 - RNA, 19 nt, Human
caggucuucuuggaggacu

SEQ ID NO: 296174 - RNA, 22 nt, Human
ccagggcuggaggaggucagga

SEQ ID NO: 296175 - RNA, 21 nt, Human
gggagaguagcgguagggagg

SEQ ID NO: 296176 - RNA, 22 nt, Human
ccucaggaauuuauucuucugu

SEQ ID NO: 296177 - RNA, 22 nt, Human
agggaguuccgaucugugcacc

SEQ ID NO: 296178 - RNA, 22 nt, Human
uuuuucuuugcuuuccacuggc

SEQ ID NO: 296179 - RNA, 22 nt, Human
guuuucuccugcuauacagugc

SEQ ID NO: 296180 - RNA, 22 nt, Human
aacugcauaagcuucgggaccu

SEQ ID NO: 296181 - RNA, 22 nt, Human
gcuggccugcgagggcaggcug

SEQ ID NO: 296182 - RNA, 18 nt, Human
aggcuggggaucacaggg

SEQ ID NO: 296183 - RNA, 22 nt, Human
uaauuccacacucccgcaagcg

SEQ ID NO: 296184 - RNA, 22 nt, Human
ccucccuucccggcauggcucu

SEQ ID NO: 296185 - RNA, 22 nt, Human
uuauuguuuggguauaauuuga

SEQ ID NO: 296186 - RNA, 22 nt, Human
agaaaaggaagcuuagacugua

SEQ ID NO: 296187 - RNA, 22 nt, Human
agcggccucgcugccugcucag

SEQ ID NO: 296188 - RNA, 22 nt, Human
aaauuuuguugaaaaauauuuu

SEQ ID NO: 296189 - RNA, 22 nt, Human
guuguuuuuguuaaaacaguga

SEQ ID NO: 296190 - RNA, 20 nt, Human
uuguacuuaugugagaagga

SEQ ID NO: 296191 - RNA, 22 nt, Human
ggagacagauggcgucucaguu

SEQ ID NO: 296192 - RNA, 22 nt, Human
acuggagcccguggaggcgcag

SEQ ID NO: 296193 - RNA, 22 nt, Human
uguuggaaucuucuagucuucc

SEQ ID NO: 296194 - RNA, 22 nt, Human
ggaggcccagaaggaagcccag

SEQ ID NO: 296195 - RNA, 22 nt, Human
auauguuaugccauuuucaagg

SEQ ID NO: 296196 - RNA, 22 nt, Human
ucuucacagaugcauauacuuc

SEQ ID NO: 296197 - RNA, 22 nt, Human
uguaaauucuauacacuuaaaa

SEQ ID NO: 296198 - RNA, 22 nt, Human
gacuggcucuaucaggauaaau

SEQ ID NO: 296199 - RNA, 23 nt, Human
ucugccuccuaauuguugguguc

SEQ ID NO: 296200 - RNA, 22 nt, Human
cacugguugccucuuucuguuc

SEQ ID NO: 296201 - RNA, 22 nt, Human
caagaaaaaacaugaugagugu

SEQ ID NO: 296202 - RNA, 22 nt, Human
augcggcugugggggaauggga

SEQ ID NO: 296203 - RNA, 22 nt, Human
gagggcugccacguugggcgag

SEQ ID NO: 296204 - RNA, 22 nt, Human
gaauuagguaauagaacuagua

SEQ ID NO: 296205 - RNA, 22 nt, Human
ucaaauaugggccagaggaaau

SEQ ID NO: 296206 - RNA, 22 nt, Human
uggcucagcgcggccuggucuu

SEQ ID NO: 296207 - RNA, 22 nt, Human
auauuuuugcagaauuuuucgu

SEQ ID NO: 296208 - RNA, 22 nt, Human
gaauauuuaucucagcugcaga

SEQ ID NO: 296209 - RNA, 22 nt, Human
ggcucagaggagcuggaacggu

SEQ ID NO: 296210 - RNA, 22 nt, Human
guucaaucucucaugcauuuuc

SEQ ID NO: 296211 - RNA, 22 nt, Human
cagcuguggagauggggugcau

SEQ ID NO: 296212 - RNA, 22 nt, Human
cugccucucaugccugcuugcu

SEQ ID NO: 296213 - RNA, 21 nt, Human
gcagcucaggauauagacuug

SEQ ID NO: 296214 - RNA, 22 nt, Human
cccuguccugcuaggcccuggu

SEQ ID NO: 296215 - RNA, 22 nt, Human
gugauggucgagcgcuuguugu

SEQ ID NO: 296216 - RNA, 22 nt, Human
uggaguuuuaaucuguacagaa

SEQ ID NO: 296217 - RNA, 22 nt, Human
auagggaggcggagggagcugg

SEQ ID NO: 296218 - RNA, 22 nt, Human
agagggagagauuggcaaucag

SEQ ID NO: 296219 - RNA, 22 nt, Human
aacacuaaaggucaguuagaag

SEQ ID NO: 296220 - RNA, 22 nt, Human
uuauuuuuguaacacuguauag

SEQ ID NO: 296221 - RNA, 22 nt, Human
augaaaacgugugugugugugu

SEQ ID NO: 296222 - RNA, 22 nt, Human
uuuacuguuuacagcuaaugca

SEQ ID NO: 296223 - RNA, 22 nt, Human
augaaaacggaccagagcuauu

SEQ ID NO: 296224 - RNA, 22 nt, Human
ggaggccgugcugugcugccag

SEQ ID NO: 296225 - RNA, 22 nt, Human
gaauucuaguucuguaucucug

SEQ ID NO: 296226 - RNA, 22 nt, Human
uugaaaauuaauagguguacaa

SEQ ID NO: 296227 - RNA, 20 nt, Human
acuagaaagucacugggggg

SEQ ID NO: 296228 - RNA, 22 nt, Human
aggggaggcugcgggcugccgu

SEQ ID NO: 296229 - RNA, 21 nt, Human
agcaucugaggcaguuuccua

SEQ ID NO: 296230 - RNA, 22 nt, Human
ugcucacugcuuguguucaguu

SEQ ID NO: 296231 - RNA, 22 nt, Human
agagacuguaaugagagguaca

SEQ ID NO: 296232 - RNA, 22 nt, Human
ucauuguuucugcuuuucauga

SEQ ID NO: 296233 - RNA, 22 nt, Human
uugccaggggacaucuggagcc

SEQ ID NO: 296234 - RNA, 22 nt, Human
cuuucuuucaaguucugcuuua

SEQ ID NO: 296235 - RNA, 23 nt, Human
uccugcagauaagcugguugaca

SEQ ID NO: 296236 - RNA, 22 nt, Human
uaguuucuucaacugucccagc

SEQ ID NO: 296237 - RNA, 22 nt, Human
aguuauuuuucacuauuaggcu

SEQ ID NO: 296238 - RNA, 22 nt, Human
gcaggaaugguacauaccuguu

SEQ ID NO: 296239 - RNA, 20 nt, Human
uucucugcagcaggcggccc

SEQ ID NO: 296240 - RNA, 22 nt, Human
auuaaaaaaagauaaugaguua

SEQ ID NO: 296241 - RNA, 22 nt, Human
uaggauugguguauguagguuu

SEQ ID NO: 296242 - RNA, 22 nt, Human
auuuuagagaaacaaacguagg

SEQ ID NO: 296243 - RNA, 22 nt, Human
cugggagaugacucagagcagg

SEQ ID NO: 296244 - RNA, 22 nt, Human
cucacugucagcugcagggcuu

SEQ ID NO: 296245 - RNA, 22 nt, Human
gggagggucugagagcugcacc

SEQ ID NO: 296246 - RNA, 20 nt, Human
cuggaguguagcaguggcug

SEQ ID NO: 296247 - RNA, 22 nt, Human
gccugcagccagggaguucucu

SEQ ID NO: 296248 - RNA, 22 nt, Human
gagcagcucgagaaggaagcag

SEQ ID NO: 296249 - RNA, 22 nt, Human
aggcucagcaucugauucauau

SEQ ID NO: 296250 - RNA, 22 nt, Human
auuuuuuuggucauaugagaua

SEQ ID NO: 296251 - RNA, 22 nt, Human
ggcugcagggaacaggaugggu

SEQ ID NO: 296252 - RNA, 22 nt, Human
aagagaggcccaaguggcuggc

SEQ ID NO: 296253 - RNA, 22 nt, Human
agguggucccaauggcugggca

SEQ ID NO: 296254 - RNA, 22 nt, Human
agagggagagaccuccgugccu

SEQ ID NO: 296255 - RNA, 23 nt, Human
caggggacaggugaccugggcuc

SEQ ID NO: 296256 - RNA, 22 nt, Human
uaagggagcagaagcugugaaa

SEQ ID NO: 296257 - RNA, 22 nt, Human
caagggcagaggcagggccccg

SEQ ID NO: 296258 - RNA, 23 nt, Human
uugcuuuugccccaaaagaguua

SEQ ID NO: 296259 - RNA, 22 nt, Human
uuuaaauuucugaaucuugagg

SEQ ID NO: 296260 - RNA, 22 nt, Human
uuauaucagaaggugagauuga

SEQ ID NO: 296261 - RNA, 22 nt, Human
uggaagugggcaucaccaucca

SEQ ID NO: 296262 - RNA, 22 nt, Human
uaguauuuguaauuaucaaagc

SEQ ID NO: 296263 - RNA, 20 nt, Human
aauaaauauaacccauaauu

SEQ ID NO: 296264 - RNA, 22 nt, Human
ugcauucugaacguaaauguga

SEQ ID NO: 296265 - RNA, 22 nt, Human
uucaaaaugcagaauaguuugg

SEQ ID NO: 296266 - RNA, 22 nt, Human
uacaagcucuuguagggggaaa

SEQ ID NO: 296267 - RNA, 22 nt, Human
aggauggauagcaaggaagccg

SEQ ID NO: 296268 - RNA, 22 nt, Human
ggaaggggagcuggaaagggua

SEQ ID NO: 296269 - RNA, 22 nt, Human
uuccucauuuggcacaucugag

SEQ ID NO: 296270 - RNA, 22 nt, Human
aaggugggacugagaggggaca

SEQ ID NO: 296271 - RNA, 22 nt, Human
aagccucaugccagauccaggu

SEQ ID NO: 296272 - RNA, 22 nt, Human
uaaaacuaugcaaccuacuacc

SEQ ID NO: 296273 - RNA, 22 nt, Human
uuuguacuuucuaauguauuua

SEQ ID NO: 296274 - RNA, 22 nt, Human
ccagaugggggcugugggaggg

SEQ ID NO: 296275 - RNA, 22 nt, Human
auaaaucaagggcaguauuucc

SEQ ID NO: 296276 - RNA, 22 nt, Human
cccuguccuucccuccaucuga

SEQ ID NO: 296277 - RNA, 22 nt, Human
cucugcuagaaggucaaucucu

SEQ ID NO: 296278 - RNA, 22 nt, Human
auuuucauauggguuauuugua

SEQ ID NO: 296279 - RNA, 22 nt, Human
aaauauagugacacuuauaguc

SEQ ID NO: 296280 - RNA, 22 nt, Human
cuguggcugcgcccugggggag

SEQ ID NO: 296281 - RNA, 22 nt, Human
cugguuuauuucauaguuuguu

SEQ ID NO: 296282 - RNA, 22 nt, Human
auuuuugguuucaccugcacgc

SEQ ID NO: 296283 - RNA, 22 nt, Human
aggggcugugucauuuguccua

SEQ ID NO: 296284 - RNA, 22 nt, Human
gggcuguggggccugcagaagg

SEQ ID NO: 296285 - RNA, 20 nt, Human
ucucuuuuucuucuuuucuc

SEQ ID NO: 296286 - RNA, 22 nt, Human
auggugaugaugaugaugauaa

SEQ ID NO: 296287 - RNA, 22 nt, Human
ggagugaguauguucugaugca

SEQ ID NO: 296288 - RNA, 22 nt, Human
gcagggcucagccgcucccacc

SEQ ID NO: 296289 - RNA, 22 nt, Human
uuuuuaagguuuguuuauauau

SEQ ID NO: 296290 - RNA, 22 nt, Human
gcuguguaugaugcaggcaccu

SEQ ID NO: 296291 - RNA, 22 nt, Human
uuacuuuuuucccccuuagaug

SEQ ID NO: 296292 - RNA, 22 nt, Human
auuuuauuuugggaucuuuuua

SEQ ID NO: 296293 - RNA, 22 nt, Human
uuuuauaauacccuugacuaau

SEQ ID NO: 296294 - RNA, 20 nt, Human
uuuuuuaaauagagcuguug

SEQ ID NO: 296295 - RNA, 22 nt, Human
cugcagagaccuaggucagguu

SEQ ID NO: 296296 - RNA, 22 nt, Human
cuccuuugagcaaaucuuugau

SEQ ID NO: 296297 - RNA, 22 nt, Human
gagcagcugagcuggaaugaga

SEQ ID NO: 296298 - RNA, 22 nt, Human
uuauuucauguaaaauuuaugu

SEQ ID NO: 296299 - RNA, 22 nt, Human
agucaccuacagcucaugcuuc

SEQ ID NO: 296300 - RNA, 22 nt, Human
uggucuuuccuucauuguccag

SEQ ID NO: 296301 - RNA, 22 nt, Human
uucuucuucuuccucauccuca

SEQ ID NO: 296302 - RNA, 22 nt, Human
ucugcaugccucaggaggccug

SEQ ID NO: 296303 - RNA, 22 nt, Human
aagaaggaaggcaagagauggg

SEQ ID NO: 296304 - RNA, 22 nt, Human
auuuuacuaugauaguugagaa

SEQ ID NO: 296305 - RNA, 22 nt, Human
ggcugugaaguacguugaaggu

SEQ ID NO: 296306 - RNA, 21 nt, Human
uuccuggaggcagaaacguga

SEQ ID NO: 296307 - RNA, 23 nt, Human
uucuuuccuuaucccauuuacuu

SEQ ID NO: 296308 - RNA, 22 nt, Human
agucccugauggacuggaugag

SEQ ID NO: 296309 - RNA, 20 nt, Human
cuccuccccucggccccacc

SEQ ID NO: 296310 - RNA, 22 nt, Human
agugccaucuuuaacuguccca

SEQ ID NO: 296311 - RNA, 22 nt, Human
gauuuuaaaagauguauaaggu

SEQ ID NO: 296312 - RNA, 22 nt, Human
ucccuugacauuacuugggagg

SEQ ID NO: 296313 - RNA, 22 nt, Human
gucuuuguaguuuuaauuugag

SEQ ID NO: 296314 - RNA, 22 nt, Human
agauggggccugaggacacugu

SEQ ID NO: 296315 - RNA, 22 nt, Human
auguacugacuguacuuuuaaa

SEQ ID NO: 296316 - RNA, 22 nt, Human
agauggaguccugaagccagaa

SEQ ID NO: 296317 - RNA, 22 nt, Human
uggggcauacgugaaauaauuu

SEQ ID NO: 296318 - RNA, 22 nt, Human
uuugcaggaaauguacugaaug

SEQ ID NO: 296319 - RNA, 18 nt, Human
guucaagcauuuugcucu

SEQ ID NO: 296320 - RNA, 17 nt, Human
ucuguguccgcucaguc

SEQ ID NO: 296321 - RNA, 22 nt, Human
acugcaggucccaucaccugcg

SEQ ID NO: 296322 - RNA, 22 nt, Human
uuucacuucgaucagaguuuuu

SEQ ID NO: 296323 - RNA, 22 nt, Human
cuguuaauugugaauuuuacau

SEQ ID NO: 296324 - RNA, 22 nt, Human
ggcagaggagcuggaaacaugg

SEQ ID NO: 296325 - RNA, 22 nt, Human
ggggcaucguugauugcauggu

SEQ ID NO: 296326 - RNA, 22 nt, Human
uucuuuucuucccuguuuauua

SEQ ID NO: 296327 - RNA, 22 nt, Human
uugcuuucuuuguagguuuucc

SEQ ID NO: 296328 - RNA, 22 nt, Human
ucuucaaauacagucauauuga

SEQ ID NO: 296329 - RNA, 22 nt, Human
gccagggcucgagcaggccagc

SEQ ID NO: 296330 - RNA, 22 nt, Human
uagcacauaguaggcacaggcu

SEQ ID NO: 296331 - RNA, 22 nt, Human
aaauguauuagccuaugugaga

SEQ ID NO: 296332 - RNA, 22 nt, Human
cucucugcugucuuucgggaaa

SEQ ID NO: 296333 - RNA, 22 nt, Human
gcuuauuagguuauuucaagga

SEQ ID NO: 296334 - RNA, 22 nt, Human
uacuuuaauugcaaaaauaaau

SEQ ID NO: 296335 - RNA, 22 nt, Human
uugucaggaacuaugauuaugc

SEQ ID NO: 296336 - RNA, 22 nt, Human
cggggcuggcguuagggaggca

SEQ ID NO: 296337 - RNA, 22 nt, Human
gggggacagugugccuggugug

SEQ ID NO: 296338 - RNA, 22 nt, Human
gaaccauuuaauggagaugcuc

SEQ ID NO: 296339 - RNA, 22 nt, Human
uucauaugaauuggguuuuuuu

SEQ ID NO: 296340 - RNA, 22 nt, Human
ucuuuuaucuguuguguaacaa

SEQ ID NO: 296341 - RNA, 22 nt, Human
augaggaacagcaagaauauuu

SEQ ID NO: 296342 - RNA, 22 nt, Human
ugauucacagacuucacaaggc

SEQ ID NO: 296343 - RNA, 20 nt, Human
ugcugugugucuacuguggg

SEQ ID NO: 296344 - RNA, 22 nt, Human
aggugagaacguggaggggcgg

SEQ ID NO: 296345 - RNA, 22 nt, Human
aauguaaauaauuguaaaauuu

SEQ ID NO: 296346 - RNA, 22 nt, Human
uuuaaaauguuuuauuuauuua

SEQ ID NO: 296347 - RNA, 22 nt, Human
gcccagccucagggcaucagcu

SEQ ID NO: 296348 - RNA, 22 nt, Human
ucauuguuuacugucuuuuuuc

SEQ ID NO: 296349 - RNA, 22 nt, Human
aggccccacaaacucgccuuug

SEQ ID NO: 296350 - RNA, 22 nt, Human
ugucuuuuaaaaauguguaaaa

SEQ ID NO: 296351 - RNA, 22 nt, Human
aaucauaacaaaagcaauuaua

SEQ ID NO: 296352 - RNA, 22 nt, Human
guguugaugugucuguauucua

SEQ ID NO: 296353 - RNA, 22 nt, Human
aggcauauaguguuuaaaaaaa

SEQ ID NO: 296354 - RNA, 22 nt, Human
cgugccugguggagagcgaggg

SEQ ID NO: 296355 - RNA, 22 nt, Human
ggcuggggccuguugaagaugc

SEQ ID NO: 296356 - RNA, 22 nt, Human
aacccugaacuuaguucuagga

SEQ ID NO: 296357 - RNA, 22 nt, Human
gccaguggucagugggagggug

SEQ ID NO: 296358 - RNA, 22 nt, Human
ccuccuuuccuguuuuccugag

SEQ ID NO: 296359 - RNA, 22 nt, Human
cuaaaccaauauauuuucuucc

SEQ ID NO: 296360 - RNA, 20 nt, Human
uugauucacaaaaagcuuag

SEQ ID NO: 296361 - RNA, 22 nt, Human
gcuucuguuaggauguggcuua

SEQ ID NO: 296362 - RNA, 22 nt, Human
gagaggaagugccugcucccag

SEQ ID NO: 296363 - RNA, 22 nt, Human
ucuugugguggaucccucauuu

SEQ ID NO: 296364 - RNA, 22 nt, Human
agagcuccaggguuuuguagug

SEQ ID NO: 296365 - RNA, 22 nt, Human
guggagaaauauguucagcuuc

SEQ ID NO: 296366 - RNA, 22 nt, Human
ugaauucaaacuuuuuaacaag

SEQ ID NO: 296367 - RNA, 22 nt, Human
uuuaucaggccaucuuaugucu

SEQ ID NO: 296368 - RNA, 22 nt, Human
uugcaagcccugaagggcugga

SEQ ID NO: 296369 - RNA, 22 nt, Human
cccagaggcugaguugggagca

SEQ ID NO: 296370 - RNA, 22 nt, Human
uagacugugagcuccuugaggg

SEQ ID NO: 296371 - RNA, 22 nt, Human
ccugccugggcucacuugccag

SEQ ID NO: 296372 - RNA, 22 nt, Human
auuuuuauuugccuaugauaua

SEQ ID NO: 296373 - RNA, 22 nt, Human
ugugaagaauuaaugugaauca

SEQ ID NO: 296374 - RNA, 22 nt, Human
guuauuuugucuuguucaugaa

SEQ ID NO: 296375 - RNA, 22 nt, Human
agcagggagacagugcagcauu

SEQ ID NO: 296376 - RNA, 22 nt, Human
acuuuauacuagugauaguuug

SEQ ID NO: 296377 - RNA, 22 nt, Human
ugagggaggggaaugugugcag

SEQ ID NO: 296378 - RNA, 21 nt, Human
uccccugugccuggcauacag

SEQ ID NO: 296379 - RNA, 22 nt, Human
ugcuuucagauaucuguuucaa

SEQ ID NO: 296380 - RNA, 22 nt, Human
ugggcagggagcuggaaccaca

SEQ ID NO: 296381 - RNA, 22 nt, Human
aauauuuugggacugaggaauu

SEQ ID NO: 296382 - RNA, 20 nt, Human
cauuccaugcaucuuggucc

SEQ ID NO: 296383 - RNA, 22 nt, Human
aggggaggggaguaucaggauu

SEQ ID NO: 296384 - RNA, 20 nt, Human
ucugugugccaucaccuaac

SEQ ID NO: 296385 - RNA, 22 nt, Human
ugagguauuuggauuuauauuu

SEQ ID NO: 296386 - RNA, 22 nt, Human
guucuucagcccucagguccua

SEQ ID NO: 296387 - RNA, 22 nt, Human
uucugcuuuaaagcucauguuu

SEQ ID NO: 296388 - RNA, 22 nt, Human
gaggggaacaggcauucuuaag

SEQ ID NO: 296389 - RNA, 22 nt, Human
ucacuguuucaccgucugaagg

SEQ ID NO: 296390 - RNA, 19 nt, Human
gauauugagcugagaauuc

SEQ ID NO: 296391 - RNA, 22 nt, Human
cagggcagaguuaagaugcugg

SEQ ID NO: 296392 - RNA, 22 nt, Human
uucccugugcaguauguuccaa

SEQ ID NO: 296393 - RNA, 22 nt, Human
agugaggggagaaugaggugga

SEQ ID NO: 296394 - RNA, 22 nt, Human
cuggguguggugggugcugccg

SEQ ID NO: 296395 - RNA, 21 nt, Human
acugggcuagccugacuucug

SEQ ID NO: 296396 - RNA, 22 nt, Human
ggacggggagcuggaaagggga

SEQ ID NO: 296397 - RNA, 22 nt, Human
uggggagacauggaguaaaaga

SEQ ID NO: 296398 - RNA, 22 nt, Human
gggagccucccacugggggaag

SEQ ID NO: 296399 - RNA, 22 nt, Human
gaggcaggcggggcccaggugg

SEQ ID NO: 296400 - RNA, 22 nt, Human
gggggcagguuccaggccagcu

SEQ ID NO: 296401 - RNA, 22 nt, Human
gcuguggagaagcugccuaugg

SEQ ID NO: 296402 - RNA, 22 nt, Human
uccuccauguugugcacuugaa

SEQ ID NO: 296403 - RNA, 22 nt, Human
guuuuucuuugauuuagaacca

SEQ ID NO: 296404 - RNA, 22 nt, Human
caauccccaggucccagaacag

SEQ ID NO: 296405 - RNA, 22 nt, Human
gcuuucagggucacugucaaca

SEQ ID NO: 296406 - RNA, 20 nt, Human
ggcagagcuaugucuguugc

SEQ ID NO: 296407 - RNA, 22 nt, Human
cuggaagcgucggaggaagggc

SEQ ID NO: 296408 - RNA, 22 nt, Human
uuuuacaaugcaaauucuugcu

SEQ ID NO: 296409 - RNA, 22 nt, Human
cuacuucucccuagaucagaaa

SEQ ID NO: 296410 - RNA, 22 nt, Human
uguugaaacagcuauugacuuu

SEQ ID NO: 296411 - RNA, 22 nt, Human
uacuauuuugacaugaaauuga

SEQ ID NO: 296412 - RNA, 22 nt, Human
aucuguuccccuaugcucucua

SEQ ID NO: 296413 - RNA, 22 nt, Human
cggcugcagcggagcaggcugg

SEQ ID NO: 296414 - RNA, 22 nt, Human
ggcucacuguaccugccgccgc

SEQ ID NO: 296415 - RNA, 22 nt, Human
uauuuguauugucuuaucacuu

SEQ ID NO: 296416 - RNA, 22 nt, Human
cuccccuuauuccucaacauga

SEQ ID NO: 296417 - RNA, 22 nt, Human
uggagccuugugagaccacaau

SEQ ID NO: 296418 - RNA, 22 nt, Human
ucucucugcuguccagcguuau

SEQ ID NO: 296419 - RNA, 22 nt, Human
gugccugcucauucucaauauu

SEQ ID NO: 296420 - RNA, 22 nt, Human
cagguggauggcgagcccugca

SEQ ID NO: 296421 - RNA, 22 nt, Human
uccucagcaagacgcuggcagc

SEQ ID NO: 296422 - RNA, 22 nt, Human
cuauguuucagauauauauaua

SEQ ID NO: 296423 - RNA, 22 nt, Human
ugcauugccucuauucauuaua

SEQ ID NO: 296424 - RNA, 22 nt, Human
ucauacuuuuuugacccuugug

SEQ ID NO: 296425 - RNA, 22 nt, Human
gcagguggaagcagcagacuca

SEQ ID NO: 296426 - RNA, 22 nt, Human
auuuccagcagcauauuugucu

SEQ ID NO: 296427 - RNA, 22 nt, Human
cuugcaaugaaggcacacuuau

SEQ ID NO: 296428 - RNA, 22 nt, Human
ccccauggaaaacccaccuagg

SEQ ID NO: 296429 - RNA, 22 nt, Human
uucuccaccugcuccucccacc

SEQ ID NO: 296430 - RNA, 22 nt, Human
cauaaauuuuaccuuguaagug

SEQ ID NO: 296431 - RNA, 22 nt, Human
uacaaaugaucaucucuuugaa

SEQ ID NO: 296432 - RNA, 21 nt, Human
guucuuaguuauauucucaau

SEQ ID NO: 296433 - RNA, 22 nt, Human
ggggaggugugcaggacaccuc

SEQ ID NO: 296434 - RNA, 19 nt, Human
ggaggguguccucaguguc

SEQ ID NO: 296435 - RNA, 22 nt, Human
uuuucacugacuuggucuggaa

SEQ ID NO: 296436 - RNA, 22 nt, Human
gaggagggagcuggaagcucuu

SEQ ID NO: 296437 - RNA, 22 nt, Human
uucauagaagggaguuuuuccu

SEQ ID NO: 296438 - RNA, 22 nt, Human
gagaaaaauuucuuugcugcac

SEQ ID NO: 296439 - RNA, 22 nt, Human
gugcugggaggcccaggaugga

SEQ ID NO: 296440 - RNA, 22 nt, Human
uccacagcagagcacgguaccu

SEQ ID NO: 296441 - RNA, 22 nt, Human
cagggggacuuguuagguuuua

SEQ ID NO: 296442 - RNA, 22 nt, Human
ugguugauuaauuuugccaagc

SEQ ID NO: 296443 - RNA, 22 nt, Human
auggauggaagcagccugaacu

SEQ ID NO: 296444 - RNA, 22 nt, Human
uauauacacgcacauauacaua

SEQ ID NO: 296445 - RNA, 22 nt, Human
caguggagaccugccugcugga

SEQ ID NO: 296446 - RNA, 21 nt, Human
uggcaggcagcuggaagcuug

SEQ ID NO: 296447 - RNA, 22 nt, Human
auuuucuugucucuguuguagg

SEQ ID NO: 296448 - RNA, 22 nt, Human
guuuauuucuuaucaucacuau

SEQ ID NO: 296449 - RNA, 22 nt, Human
uuguuuucuaguguuuugaaua

SEQ ID NO: 296450 - RNA, 22 nt, Human
caguggacacuuccucuacaau

SEQ ID NO: 296451 - RNA, 22 nt, Human
ggcuagggagacagagggcaug

SEQ ID NO: 296452 - RNA, 22 nt, Human
aguaggaauucaaagagacaaa

SEQ ID NO: 296453 - RNA, 22 nt, Human
ucucucucucuuccagcauguu

SEQ ID NO: 296454 - RNA, 22 nt, Human
aaaauauucuauaucaaagaua

SEQ ID NO: 296455 - RNA, 19 nt, Human
aacucugccgaggcaagcc

SEQ ID NO: 296456 - RNA, 22 nt, Human
aagugugugugcgcaugugcau

SEQ ID NO: 296457 - RNA, 22 nt, Human
uuuuaaauaaacuacacugauu

SEQ ID NO: 296458 - RNA, 22 nt, Human
uggaagcccagaaggaagcaga

SEQ ID NO: 296459 - RNA, 22 nt, Human
aagugaggagaccucuucuuca

SEQ ID NO: 296460 - RNA, 22 nt, Human
uuuuaaaacaugucaaaaugug

SEQ ID NO: 296461 - RNA, 22 nt, Human
uuggugauguagcagcaauugu

SEQ ID NO: 296462 - RNA, 22 nt, Human
auguguguaugacugaaucuau

SEQ ID NO: 296463 - RNA, 22 nt, Human
guuauuguuauugcguugucga

SEQ ID NO: 296464 - RNA, 23 nt, Human
aggcugcagaagaauagggucau

SEQ ID NO: 296465 - RNA, 22 nt, Human
cagagagcguccauccggugcc

SEQ ID NO: 296466 - RNA, 22 nt, Human
uuguuauuauuauuuucguucu

SEQ ID NO: 296467 - RNA, 22 nt, Human
uguuuuuuagagugauacuuuu

SEQ ID NO: 296468 - RNA, 22 nt, Human
uugucuuucguauggaacacua

SEQ ID NO: 296469 - RNA, 22 nt, Human
auacaucuuaacgcgcucuugg

SEQ ID NO: 296470 - RNA, 22 nt, Human
ccugacucugauuucgcugcau

SEQ ID NO: 296471 - RNA, 22 nt, Human
gugaucagaagaaccugccgaa

SEQ ID NO: 296472 - RNA, 22 nt, Human
auuaauaucaauauauuauaug

SEQ ID NO: 296473 - RNA, 22 nt, Human
gcuucucacccuuacuaucucu

SEQ ID NO: 296474 - RNA, 22 nt, Human
cuguuucucugccugcacacau

SEQ ID NO: 296475 - RNA, 22 nt, Human
gggggagcuacaggucccuugg

SEQ ID NO: 296476 - RNA, 22 nt, Human
gggcaagaagcuggaagcauuc

SEQ ID NO: 296477 - RNA, 22 nt, Human
ucauuauuuugauguauuuccu

SEQ ID NO: 296478 - RNA, 22 nt, Human
uaauauaacugccaguuaaggu

SEQ ID NO: 296479 - RNA, 22 nt, Human
uggggcugguaccguaauauau

SEQ ID NO: 296480 - RNA, 22 nt, Human
aaaauacuaggaaaauaaauca

SEQ ID NO: 296481 - RNA, 22 nt, Human
uccaugaguuuuuuaguuucac

SEQ ID NO: 296482 - RNA, 19 nt, Human
agugaacuccauaucaggu

SEQ ID NO: 296483 - RNA, 22 nt, Human
aggcaguguggagggcuguugc

SEQ ID NO: 296484 - RNA, 22 nt, Human
uuuuucuccucucucuuucauu

SEQ ID NO: 296485 - RNA, 22 nt, Human
agguguaauuacucuugcaguu

SEQ ID NO: 296486 - RNA, 22 nt, Human
ccuaggcuggcugucuucaggu

SEQ ID NO: 296487 - RNA, 22 nt, Human
aauuauguugaaauaugagaac

SEQ ID NO: 296488 - RNA, 22 nt, Human
uugguuuacucuggggauaucu

SEQ ID NO: 296489 - RNA, 22 nt, Human
gcuguugugaggaucagcauau

SEQ ID NO: 296490 - RNA, 22 nt, Human
gccucucuggcaaagcggugau

SEQ ID NO: 296491 - RNA, 22 nt, Human
agccccaauuacagcugugcug

SEQ ID NO: 296492 - RNA, 22 nt, Human
agggcucacuacaacccuggga

SEQ ID NO: 296493 - RNA, 22 nt, Human
gcuggaaauaacuuguguagaa

SEQ ID NO: 296494 - RNA, 22 nt, Human
augugugugcgagcgugugugu

SEQ ID NO: 296495 - RNA, 22 nt, Human
uucuugucuuuguuauguagga

SEQ ID NO: 296496 - RNA, 22 nt, Human
gaaacauuuguugaguacuugc

SEQ ID NO: 296497 - RNA, 22 nt, Human
uaccuggauaaauguacaaccg

SEQ ID NO: 296498 - RNA, 22 nt, Human
agggaggagggacagaaagagg

SEQ ID NO: 296499 - RNA, 22 nt, Human
gagggagugggcccgugggcac

SEQ ID NO: 296500 - RNA, 22 nt, Human
aggcgaagggaccagacgguag

SEQ ID NO: 296501 - RNA, 22 nt, Human
ggcuccaggguaccccuggaug

SEQ ID NO: 296502 - RNA, 23 nt, Human
uggaaguugagagucugcuuugu

SEQ ID NO: 296503 - RNA, 22 nt, Human
caaaucuguuaauuucaaguug

SEQ ID NO: 296504 - RNA, 22 nt, Human
auauuuuacagcucucguugaa

SEQ ID NO: 296505 - RNA, 22 nt, Human
cuguccauuuucgugccuccuu

SEQ ID NO: 296506 - RNA, 22 nt, Human
uuucacugaguaggagagcacu

SEQ ID NO: 296507 - RNA, 22 nt, Human
aggggaggcugggcuggggggc

SEQ ID NO: 296508 - RNA, 22 nt, Human
agcaaggguugguuuucugaca

SEQ ID NO: 296509 - RNA, 22 nt, Human
auauaguacauguauauauaua

SEQ ID NO: 296510 - RNA, 22 nt, Human
uaaaugauaguauugaagguag

SEQ ID NO: 296511 - RNA, 22 nt, Human
uuuucaauuuucauuugcaaga

SEQ ID NO: 296512 - RNA, 22 nt, Human
cagagcugucauuugccaguga

SEQ ID NO: 296513 - RNA, 22 nt, Human
gcaggggguaaggggcagggcu

SEQ ID NO: 296514 - RNA, 17 nt, Human
ucuuuuacuuucucucc

SEQ ID NO: 296515 - RNA, 22 nt, Human
uauuaaaagagaaaaagccacc

SEQ ID NO: 296516 - RNA, 22 nt, Human
gcugcagggagcuggaaggcuc

SEQ ID NO: 296517 - RNA, 22 nt, Human
agauucucccuccuggcgcugu

SEQ ID NO: 296518 - RNA, 22 nt, Human
uuaaaagaauccuguuauccuc

SEQ ID NO: 296519 - RNA, 22 nt, Human
ucucuucacuuguaugcuauca

SEQ ID NO: 296520 - RNA, 22 nt, Human
cagaccagaaggaagccgacaa

SEQ ID NO: 296521 - RNA, 22 nt, Human
aggcaggggagcuggaagggua

SEQ ID NO: 296522 - RNA, 22 nt, Human
aguacuuuuuguucaauugugc

SEQ ID NO: 296523 - RNA, 22 nt, Human
ucuuucugaugggaagggucaa

SEQ ID NO: 296524 - RNA, 20 nt, Human
uucacagaucucuaacugag

SEQ ID NO: 296525 - RNA, 22 nt, Human
aagugauuuucccaccaucuac

SEQ ID NO: 296526 - RNA, 21 nt, Human
caguucuaagugucaucuuuu

SEQ ID NO: 296527 - RNA, 22 nt, Human
uacauuugauuuuugcuucuuu

SEQ ID NO: 296528 - RNA, 22 nt, Human
ccaaggcuguggggcugugcag

SEQ ID NO: 296529 - RNA, 22 nt, Human
gcuguggaaaaugggucuccaa

SEQ ID NO: 296530 - RNA, 22 nt, Human
uguccuuuauauguuuuuuagu

SEQ ID NO: 296531 - RNA, 22 nt, Human
gaggagcugggucagggagaca

SEQ ID NO: 296532 - RNA, 22 nt, Human
aagcucagcugguggugauugc

SEQ ID NO: 296533 - RNA, 20 nt, Human
ccuuguggaugucuuuuuug

SEQ ID NO: 296534 - RNA, 22 nt, Human
agugugaguuacaaagugugaa

SEQ ID NO: 296535 - RNA, 19 nt, Human
agcucaggcccaucguccc

SEQ ID NO: 296536 - RNA, 22 nt, Human
auuugcuuguucaccaguacuu

SEQ ID NO: 296537 - RNA, 22 nt, Human
gggagguaaugggggugcaggg

SEQ ID NO: 296538 - RNA, 22 nt, Human
uuuccuaggaaaugauugaagu

SEQ ID NO: 296539 - RNA, 22 nt, Human
uuuauguuuguuuuugaaauaa

SEQ ID NO: 296540 - RNA, 22 nt, Human
uuucucuuguauuugaaucacu

SEQ ID NO: 296541 - RNA, 21 nt, Human
aggugaaggcgagggggacag

SEQ ID NO: 296542 - RNA, 22 nt, Human
uaauaaaaauuuaauucacauu

SEQ ID NO: 296543 - RNA, 22 nt, Human
uucaaacaguguagaauauaug

SEQ ID NO: 296544 - RNA, 22 nt, Human
aucguuaugauagagaaagaga

SEQ ID NO: 296545 - RNA, 22 nt, Human
cugggggacagagagaggcggu

SEQ ID NO: 296546 - RNA, 22 nt, Human
uacuuacacugaagcaaagaua

SEQ ID NO: 296547 - RNA, 22 nt, Human
ccuucugcuggucaucccagug

SEQ ID NO: 296548 - RNA, 22 nt, Human
auuuuguugaaacccuuguugu

SEQ ID NO: 296549 - RNA, 22 nt, Human
uuuugcuucuaguauauuuuuu

SEQ ID NO: 296550 - RNA, 22 nt, Human
ggcucccccauggcugacagac

SEQ ID NO: 296551 - RNA, 22 nt, Human
auuucacucuuaauugcuuccu

SEQ ID NO: 296552 - RNA, 22 nt, Human
agcaaaauuccaaaaugcuaau

SEQ ID NO: 296553 - RNA, 22 nt, Human
uuuuaaaagguugcuguuauaa

SEQ ID NO: 296554 - RNA, 22 nt, Human
uugugugugcccaccuguggcc

SEQ ID NO: 296555 - RNA, 22 nt, Human
ugcuuucaaugaauuguauacu

SEQ ID NO: 296556 - RNA, 22 nt, Human
ccauuuggccauucaguuguuc

SEQ ID NO: 296557 - RNA, 22 nt, Human
aggaaauaggaccagacaaagc

SEQ ID NO: 296558 - RNA, 19 nt, Human
uccuacaugagacagagag

SEQ ID NO: 296559 - RNA, 22 nt, Human
agcgcucauuuuccuccugcuc

SEQ ID NO: 296560 - RNA, 22 nt, Human
uguacauacauagauauacaca

SEQ ID NO: 296561 - RNA, 22 nt, Human
cuguggcuaggaagcuguggga

SEQ ID NO: 296562 - RNA, 22 nt, Human
agggggaauccugcuuauggau

SEQ ID NO: 296563 - RNA, 22 nt, Human
uuugcauuaguuuagauuucaa

SEQ ID NO: 296564 - RNA, 22 nt, Human
aagcucuuuccacuaaaccacu

SEQ ID NO: 296565 - RNA, 22 nt, Human
uccuuuauuuaugggcagugua

SEQ ID NO: 296566 - RNA, 22 nt, Human
uuccgcuuucaauggcuuggcu

SEQ ID NO: 296567 - RNA, 22 nt, Human
gagggaggugacaaggacauag

SEQ ID NO: 296568 - RNA, 22 nt, Human
cuggaugucugggaggcuuccc

SEQ ID NO: 296569 - RNA, 22 nt, Human
cuucuuucuuuucuucuucucu

SEQ ID NO: 296570 - RNA, 22 nt, Human
ccuuugcccugagaaauguucc

SEQ ID NO: 296571 - RNA, 22 nt, Human
ggcaaggaagaaagcagaaguu

SEQ ID NO: 296572 - RNA, 22 nt, Human
aaaugcuuuaauugaguucaug

SEQ ID NO: 296573 - RNA, 22 nt, Human
uggcucaguaaucgagucuccu

SEQ ID NO: 296574 - RNA, 22 nt, Human
guuuggguggcuagagaaagaa

SEQ ID NO: 296575 - RNA, 22 nt, Human
uucauuagcacauuuccuuggu

SEQ ID NO: 296576 - RNA, 22 nt, Human
ggaggaagagaccagggggcuu

SEQ ID NO: 296577 - RNA, 22 nt, Human
ucaguggaacacacagaguggg

SEQ ID NO: 296578 - RNA, 22 nt, Human
auucccucaagagacccacagc

SEQ ID NO: 296579 - RNA, 22 nt, Human
uguuuucuuuccccuucuuuuc

SEQ ID NO: 296580 - RNA, 22 nt, Human
uaaaaucaugacagauugacau

SEQ ID NO: 296581 - RNA, 23 nt, Human
ucucacucauucuccucugucca

SEQ ID NO: 296582 - RNA, 22 nt, Human
uguguuguuuggggauguccau

SEQ ID NO: 296583 - RNA, 22 nt, Human
cuuuuuaaaguaaauggcuaga

SEQ ID NO: 296584 - RNA, 22 nt, Human
uucuaauauuaugauuucuaag

SEQ ID NO: 296585 - RNA, 21 nt, Human
gggagugaguaaugauggggg

SEQ ID NO: 296586 - RNA, 22 nt, Human
aucauguauauuuuugcuauua

SEQ ID NO: 296587 - RNA, 22 nt, Human
augggagggagcagugaguguu

SEQ ID NO: 296588 - RNA, 22 nt, Human
agcacagugccugacauauaug

SEQ ID NO: 296589 - RNA, 22 nt, Human
cguuuugaguagauagccauau

SEQ ID NO: 296590 - RNA, 22 nt, Human
gagccucaggguuuuguugaca

SEQ ID NO: 296591 - RNA, 22 nt, Human
gucuugugaagacggcagaaag

SEQ ID NO: 296592 - RNA, 22 nt, Human
gcuggggaucgaaggcagagcc

SEQ ID NO: 296593 - RNA, 17 nt, Human
auuguuuuuaauuugca

SEQ ID NO: 296594 - RNA, 22 nt, Human
uggcucaggccuacgacgccuu

SEQ ID NO: 296595 - RNA, 22 nt, Human
acauuuuaaaaacaguaccugg

SEQ ID NO: 296596 - RNA, 22 nt, Human
uguauuuuuucccugaaauaaa

SEQ ID NO: 296597 - RNA, 22 nt, Human
cuaaauucuauauccuugcuuc

SEQ ID NO: 296598 - RNA, 22 nt, Human
ggagagaacguaaucuaguauu

SEQ ID NO: 296599 - RNA, 23 nt, Human
aaggugaagccaccaggugagga

SEQ ID NO: 296600 - RNA, 23 nt, Human
aaguggugacugugcuacugaga

SEQ ID NO: 296601 - RNA, 22 nt, Human
ggggcucauuugcaggggggag

SEQ ID NO: 296602 - RNA, 22 nt, Human
gugguuuagccuucauuaaccu

SEQ ID NO: 296603 - RNA, 22 nt, Human
uacagaccaguaguucucagcg

SEQ ID NO: 296604 - RNA, 18 nt, Human
acaaaaauagugcuuugg

SEQ ID NO: 296605 - RNA, 22 nt, Human
agggagucuggccgucggcugg

SEQ ID NO: 296606 - RNA, 22 nt, Human
aagccugguuauuugaggaugu

SEQ ID NO: 296607 - RNA, 22 nt, Human
agggcugcugcuccgggcccag

SEQ ID NO: 296608 - RNA, 22 nt, Human
ggcagucuuucccuugagcucu

SEQ ID NO: 296609 - RNA, 22 nt, Human
accuccauggcccacaucuagu

SEQ ID NO: 296610 - RNA, 22 nt, Human
ugucccaucacagaggagacua

SEQ ID NO: 296611 - RNA, 20 nt, Human
uaguggaccuugaaggccuc

SEQ ID NO: 296612 - RNA, 22 nt, Human
acauauaugugcauacaacuau

SEQ ID NO: 296613 - RNA, 22 nt, Human
uuauuuuuaggaauguagaggu

SEQ ID NO: 296614 - RNA, 20 nt, Human
cuuauuuuggagaacuuuuc

SEQ ID NO: 296615 - RNA, 20 nt, Human
uggguucaguuguuucuggc

SEQ ID NO: 296616 - RNA, 22 nt, Human
auggaguguggccaggcaguaa

SEQ ID NO: 296617 - RNA, 22 nt, Human
uggccccauuuuucuggagccu

SEQ ID NO: 296618 - RNA, 22 nt, Human
ggaggccagagaagagccaggc

SEQ ID NO: 296619 - RNA, 22 nt, Human
cucuuucauucuguccuuguuu

SEQ ID NO: 296620 - RNA, 19 nt, Human
agcaucuccacagaaaaag

SEQ ID NO: 296621 - RNA, 22 nt, Human
ccugccagaaaagagggaguuc

SEQ ID NO: 296622 - RNA, 19 nt, Human
ccaguuuuuuaauauucaa

SEQ ID NO: 296623 - RNA, 23 nt, Human
cuuauauaaucauuagaaaccau

SEQ ID NO: 296624 - RNA, 22 nt, Human
gacuggggcauuagaguagcuu

SEQ ID NO: 296625 - RNA, 22 nt, Human
cacauuuuccagaagaaucaga

SEQ ID NO: 296626 - RNA, 22 nt, Human
agcugaggccccgcagcagggu

SEQ ID NO: 296627 - RNA, 22 nt, Human
uaugggcaagagauaggugguc

SEQ ID NO: 296628 - RNA, 22 nt, Human
aggcugccuaugaaggcagaag

SEQ ID NO: 296629 - RNA, 22 nt, Human
uucacuuuuucucugcuugaga

SEQ ID NO: 296630 - RNA, 22 nt, Human
uuuuaaaguaauugaagcuugu

SEQ ID NO: 296631 - RNA, 22 nt, Human
gucugcagcacugugcacgguc

SEQ ID NO: 296632 - RNA, 22 nt, Human
uuuuuaaaauuaggacggcacg

SEQ ID NO: 296633 - RNA, 22 nt, Human
ccagcaggagacuagcaacaua

SEQ ID NO: 296634 - RNA, 23 nt, Human
aggcugccacucagggugaggcu

SEQ ID NO: 296635 - RNA, 22 nt, Human
agcaagggucucucauggcuug

SEQ ID NO: 296636 - RNA, 22 nt, Human
ggcagagguagcuggaaccagg

SEQ ID NO: 296637 - RNA, 22 nt, Human
ugcagcuuuugguuucuagaug

SEQ ID NO: 296638 - RNA, 22 nt, Human
auagaaauagacaaugcaaaga

SEQ ID NO: 296639 - RNA, 22 nt, Human
uagggaggguuugggguggagg

SEQ ID NO: 296640 - RNA, 22 nt, Human
ucuucaucucuaaaaugggaac

SEQ ID NO: 296641 - RNA, 22 nt, Human
cauggcaggugcagauucugug

SEQ ID NO: 296642 - RNA, 22 nt, Human
guguucuuuguagaggaucuug

SEQ ID NO: 296643 - RNA, 22 nt, Human
aaauuaaaguuuuauuuagagc

SEQ ID NO: 296644 - RNA, 22 nt, Human
uuuucauagccagaaacugaaa

SEQ ID NO: 296645 - RNA, 22 nt, Human
ugagggaguguggauacaguag

SEQ ID NO: 296646 - RNA, 22 nt, Human
aaauguuucauucuauuuuuag

SEQ ID NO: 296647 - RNA, 22 nt, Human
gugugugucuacuuucaucucu

SEQ ID NO: 296648 - RNA, 22 nt, Human
acuuuuccuggguagcuccugg

SEQ ID NO: 296649 - RNA, 22 nt, Human
uuuauuuuccaugucucuaggu

SEQ ID NO: 296650 - RNA, 22 nt, Human
uuuguuuccagccuuuugucuu

SEQ ID NO: 296651 - RNA, 22 nt, Human
uucuuuuaauagagauccugug

SEQ ID NO: 296652 - RNA, 22 nt, Human
aucucacuucugucauguggca

SEQ ID NO: 296653 - RNA, 22 nt, Human
uggggcuggccaggaggagucu

SEQ ID NO: 296654 - RNA, 22 nt, Human
gagggugguggcggccggcacc

SEQ ID NO: 296655 - RNA, 22 nt, Human
auaaaaauguuuuuguguggua

SEQ ID NO: 296656 - RNA, 22 nt, Human
cuccuugguuccggcguuggag

SEQ ID NO: 296657 - RNA, 22 nt, Human
cuucuuuucuacuggccuagaa

SEQ ID NO: 296658 - RNA, 21 nt, Human
agucaagcugccugcuuggca

SEQ ID NO: 296659 - RNA, 22 nt, Human
gcagagcugucuaagucacuuc

SEQ ID NO: 296660 - RNA, 22 nt, Human
uuuuuuuaaguuuugauuuuag

SEQ ID NO: 296661 - RNA, 22 nt, Human
augggagggugaggaggcagcu

SEQ ID NO: 296662 - RNA, 22 nt, Human
cagcucugcugggaggaugcag

SEQ ID NO: 296663 - RNA, 17 nt, Human
guucucaaacugacuga

SEQ ID NO: 296664 - RNA, 22 nt, Human
auuagugguguauuuggcacua

SEQ ID NO: 296665 - RNA, 22 nt, Human
guucuacaugacacucaacauu

SEQ ID NO: 296666 - RNA, 22 nt, Human
acucauuuggauuuuggaguuu

SEQ ID NO: 296667 - RNA, 22 nt, Human
uuuuauuuguauguugaaugua

SEQ ID NO: 296668 - RNA, 20 nt, Human
ccugggcuccaggagccccg

SEQ ID NO: 296669 - RNA, 22 nt, Human
ugguucuagaugagaugaugag

SEQ ID NO: 296670 - RNA, 22 nt, Human
acagagcucccagccaucuccu

SEQ ID NO: 296671 - RNA, 22 nt, Human
ucuccucucugaucuugcuccg

SEQ ID NO: 296672 - RNA, 22 nt, Human
aaagggagauaaaguaauuuua

SEQ ID NO: 296673 - RNA, 22 nt, Human
ucacuuccuugcagcuguagaa

SEQ ID NO: 296674 - RNA, 22 nt, Human
uggguucaaauccugguuccac

SEQ ID NO: 296675 - RNA, 21 nt, Human
ucauccagguccugcuucuuc

SEQ ID NO: 296676 - RNA, 22 nt, Human
uucuuuuaauuucugucugcag

SEQ ID NO: 296677 - RNA, 22 nt, Human
aauucuguugguuagaguugga

SEQ ID NO: 296678 - RNA, 22 nt, Human
aaucacuucuuugucuucuuca

SEQ ID NO: 296679 - RNA, 22 nt, Human
cauuuugguaauguucguuugc

SEQ ID NO: 296680 - RNA, 22 nt, Human
ggagccucuaaacaguuaucaa

SEQ ID NO: 296681 - RNA, 22 nt, Human
aauguugaaccuuuuuggccug

SEQ ID NO: 296682 - RNA, 22 nt, Human
uuuuuuuuacuccggacagcuc

SEQ ID NO: 296683 - RNA, 22 nt, Human
uucauuuccauuuuauagauaa

SEQ ID NO: 296684 - RNA, 22 nt, Human
acgugugugugcacguguguau

SEQ ID NO: 296685 - RNA, 22 nt, Human
agcuuucuauauaugaguugcu

SEQ ID NO: 296686 - RNA, 22 nt, Human
aaaauauaaaggauguggguuu

SEQ ID NO: 296687 - RNA, 22 nt, Human
aaugaaaaucugucaguucaag

SEQ ID NO: 296688 - RNA, 22 nt, Human
uuuuguuuacauuaaauuuuga

SEQ ID NO: 296689 - RNA, 22 nt, Human
ccuuuuaucgcgaagaacucca

SEQ ID NO: 296690 - RNA, 22 nt, Human
gucucacuucauuuucuuagcc

SEQ ID NO: 296691 - RNA, 22 nt, Human
gcugcaggaggugguagggucu

SEQ ID NO: 296692 - RNA, 22 nt, Human
uguguuguuggggauguuuuca

SEQ ID NO: 296693 - RNA, 22 nt, Human
ugcaaggcacccacucugcuuu

SEQ ID NO: 296694 - RNA, 22 nt, Human
uauuguuuuaagguguauuaau

SEQ ID NO: 296695 - RNA, 22 nt, Human
ccaggcuccccaggaggcccuu

SEQ ID NO: 296696 - RNA, 22 nt, Human
uuuguuugcugagugaauucaa

SEQ ID NO: 296697 - RNA, 22 nt, Human
ucugaggacagugcugugccug

SEQ ID NO: 296698 - RNA, 22 nt, Human
auuuuucuuucacauuuucuua

SEQ ID NO: 296699 - RNA, 22 nt, Human
agccacagucuguagccagcuu

SEQ ID NO: 296700 - RNA, 22 nt, Human
uggggggacagauggagaggac

SEQ ID NO: 296701 - RNA, 22 nt, Human
augcaaaaucuuauuuuuucua

SEQ ID NO: 296702 - RNA, 22 nt, Human
ggagaggaaguuuaaagaauug

SEQ ID NO: 296703 - RNA, 22 nt, Yersinia pestis KIM
aaaugcuacagaaguucuacuu

SEQ ID NO: 296704 - RNA, 23 nt, Yersinia pestis KIM
cggcugagauagagcgccguguu

SEQ ID NO: 296705 - RNA, 22 nt, Yersinia pestis KIM
ugaugcuaaauuuaucagcaaa

SEQ ID NO: 296706 - RNA, 22 nt, Yersinia pestis KIM
uaaccagugguuuauugcuggu

SEQ ID NO: 296707 - RNA, 22 nt, Yersinia pestis KIM
cgccguugaacguugcgucgac

SEQ ID NO: 296708 - RNA, 22 nt, Yersinia pestis KIM
gauacuguaucgguacucaccg

SEQ ID NO: 296709 - RNA, 22 nt, Yersinia pestis KIM
cgugcguugcguucuggucauc

SEQ ID NO: 296710 - RNA, 22 nt, Yersinia pestis KIM
uuacggacuauccagccgcgcg

SEQ ID NO: 296711 - RNA, 22 nt, Yersinia pestis KIM
ugcugccagauacauacccucu

SEQ ID NO: 296712 - RNA, 21 nt, Yersinia pestis KIM
gaacgucgguacgauggucau

SEQ ID NO: 296713 - RNA, 22 nt, Yersinia pestis KIM
cauggguacugaaagaaccuga

SEQ ID NO: 296714 - RNA, 22 nt, Yersinia pestis KIM
cuguagcgugaguggugcuaug

SEQ ID NO: 296715 - RNA, 22 nt, Yersinia pestis KIM
guucccagcucaccgugacggg

SEQ ID NO: 296716 - RNA, 22 nt, Yersinia pestis KIM
uugagucucagggcgaugccag

SEQ ID NO: 296717 - RNA, 22 nt, Yersinia pestis KIM
accauaggggccgguauugauu

SEQ ID NO: 296718 - RNA, 22 nt, Yersinia pestis KIM
ucaugggcuugagucccgacgg

SEQ ID NO: 296719 - RNA, 22 nt, Yersinia pestis KIM
ggcuuccugcauucguucagcc

SEQ ID NO: 296720 - RNA, 22 nt, Yersinia pestis KIM
cgcuauuugccgcgcugcuaca

SEQ ID NO: 296721 - RNA, 22 nt, Yersinia pestis KIM
cauugguguacgccacucagcc

SEQ ID NO: 296722 - RNA, 22 nt, Yersinia pestis KIM
uauugggauuugugcguuugca

SEQ ID NO: 296723 - RNA, 20 nt, Yersinia pestis KIM
agguuaccguguagucuccc

SEQ ID NO: 296724 - RNA, 22 nt, Yersinia pestis KIM
ucagaguuuaucuucguagguu

SEQ ID NO: 296725 - RNA, 22 nt, Yersinia pestis KIM
auaaugccuugauugaaggaga

SEQ ID NO: 296726 - RNA, 22 nt, Yersinia pestis KIM
gaacaugauuaugccguauuua

SEQ ID NO: 296727 - RNA, 22 nt, Yersinia pestis KIM
uuaagccauugaauauuguuau

SEQ ID NO: 296728 - RNA, 22 nt, Yersinia pestis KIM
uuugcacugaaccccagaucuu

SEQ ID NO: 296729 - RNA, 22 nt, Yersinia pestis KIM
aguggucaaauggugcgcuuaa

SEQ ID NO: 296730 - RNA, 22 nt, Yersinia pestis KIM
uggaaaccuugccuggggugga

SEQ ID NO: 296731 - RNA, 22 nt, Yersinia pestis KIM
cauuccgugccggugcugaaga

SEQ ID NO: 296732 - RNA, 22 nt, Yersinia pestis KIM
gugaaccaauuguuagcuaagg

SEQ ID NO: 296733 - RNA, 22 nt, Yersinia pestis KIM
ucauugagcguagcaaugaacu

SEQ ID NO: 296734 - RNA, 22 nt, Yersinia pestis KIM
uacggcagcgaucaucagcggu

SEQ ID NO: 296735 - RNA, 22 nt, Yersinia pestis KIM
gcucuacauuguugcucgcgag

SEQ ID NO: 296736 - RNA, 22 nt, Yersinia pestis KIM
uacgcuaauuuauacgucgggu

SEQ ID NO: 296737 - RNA, 22 nt, Yersinia pestis KIM
ugccauuggcucacauuguuua

SEQ ID NO: 296738 - RNA, 22 nt, Yersinia pestis KIM
ggugauauguaacuguucuugc

SEQ ID NO: 296739 - RNA, 22 nt, Yersinia pestis KIM
caggacuucaguuaucgcaucg

SEQ ID NO: 296740 - RNA, 22 nt, Yersinia pestis KIM
ugguuaaacaauacggugcccu

SEQ ID NO: 296741 - RNA, 22 nt, Yersinia pestis KIM
aucuuuggaucuaaacgggccu

SEQ ID NO: 296742 - RNA, 22 nt, Yersinia pestis KIM
gaacguuucuacccgcagggga

SEQ ID NO: 296743 - RNA, 22 nt, Yersinia pestis KIM
uuaggccggccaauuggcgcuu

SEQ ID NO: 296744 - RNA, 22 nt, Yersinia pestis KIM
ucacaaaguucgucuguuguug

SEQ ID NO: 296745 - RNA, 22 nt, Yersinia pestis KIM
guugcaguucgcgcaaagugcc

SEQ ID NO: 296746 - RNA, 22 nt, Yersinia pestis KIM
uaucaauguuggcuuguaaaua

SEQ ID NO: 296747 - RNA, 22 nt, Yersinia pestis KIM
ccuguucacgauaggcgguguu

SEQ ID NO: 296748 - RNA, 22 nt, Yersinia pestis KIM
ugaugcuaaaacugugaacuag

SEQ ID NO: 296749 - RNA, 22 nt, Yersinia pestis KIM
ugcaccgggccgccgugaugag

SEQ ID NO: 296750 - RNA, 22 nt, Yersinia pestis KIM
gccaguguuacccaccaaggaa

SEQ ID NO: 296751 - RNA, 22 nt, Yersinia pestis KIM
uaaugguauuaucgccgacucu

SEQ ID NO: 296752 - RNA, 22 nt, Yersinia pestis KIM
acgcggcauucgcauccuauuu

SEQ ID NO: 296753 - RNA, 22 nt, Yersinia pestis KIM
auggugacaaagagauagcugu

SEQ ID NO: 296754 - RNA, 22 nt, Yersinia pestis KIM
gcugucuguugccugacgcaga

SEQ ID NO: 296755 - RNA, 22 nt, Yersinia pestis KIM
guuaaugucacuuuaccagguu

SEQ ID NO: 296756 - RNA, 22 nt, Yersinia pestis KIM
uaaaccgauaucauucuggcgc

SEQ ID NO: 296757 - RNA, 22 nt, Yersinia pestis KIM
ugaaaugauuaaacgccuggga

SEQ ID NO: 296758 - RNA, 20 nt, Yersinia pestis KIM
uggcgcagcgcagaugccgc

SEQ ID NO: 296759 - RNA, 22 nt, Yersinia pestis KIM
acaggugaaacgcuggggcuga

SEQ ID NO: 296760 - RNA, 22 nt, Yersinia pestis KIM
ccugaccuuaacgcacagugaa

SEQ ID NO: 296761 - RNA, 22 nt, Yersinia pestis KIM
auucugaaaucuaugaggugua

SEQ ID NO: 296762 - RNA, 22 nt, Yersinia pestis KIM
cugugccgcagcuagccuauua

SEQ ID NO: 296763 - RNA, 22 nt, Yersinia pestis KIM
uugaugacugacgaugggcagu

SEQ ID NO: 296764 - RNA, 22 nt, Yersinia pestis KIM
ucacagccauggcugugcgcaa

SEQ ID NO: 296765 - RNA, 22 nt, Yersinia pestis KIM
auugaugugccaggggauaaua

SEQ ID NO: 296766 - RNA, 22 nt, Yersinia pestis KIM
aaccggcaauuuauccaauaug

SEQ ID NO: 296767 - RNA, 22 nt, Yersinia pestis KIM
ucgcgcuuuuuaggauguuucu

SEQ ID NO: 296768 - RNA, 22 nt, Yersinia pestis KIM
gggaauugauugaggcuaauca

SEQ ID NO: 296769 - RNA, 19 nt, Yersinia pestis KIM
uugcugcaaaauauuuuca

SEQ ID NO: 296770 - RNA, 22 nt, Yersinia pestis KIM
gcauccggcuggccugucgcca

SEQ ID NO: 296771 - RNA, 22 nt, Yersinia pestis KIM
accgguugaaaaaaggacuugu

SEQ ID NO: 296772 - RNA, 21 nt, Yersinia pestis KIM
uaacggcauugcguucacggc

SEQ ID NO: 296773 - RNA, 22 nt, Yersinia pestis KIM
aagccgauuaauuuccgaauau

SEQ ID NO: 296774 - RNA, 22 nt, Yersinia pestis KIM
gcgauaaaaaagguugaguuca

SEQ ID NO: 296775 - RNA, 22 nt, Yersinia pestis KIM
guugcacugaaccccagaucuu

SEQ ID NO: 296776 - RNA, 22 nt, Yersinia pestis KIM
cguacuuuacguaaagaaacgu

SEQ ID NO: 296777 - RNA, 22 nt, Yersinia pestis KIM
cuuggauauuauccgccgcuau

SEQ ID NO: 296778 - RNA, 22 nt, Yersinia pestis KIM
augcugauuuuguacuguucgu

SEQ ID NO: 296779 - RNA, 20 nt, Yersinia pestis KIM
acucaccgggacucagaaua

SEQ ID NO: 296780 - RNA, 22 nt, Yersinia pestis KIM
gcgcuguuuuuauaaauaaccc

SEQ ID NO: 296781 - RNA, 22 nt, Yersinia pestis KIM
ugcggaccggaaaauguggaac

SEQ ID NO: 296782 - RNA, 22 nt, Yersinia pestis KIM
ucagauccugucaccuucuuca

SEQ ID NO: 296783 - RNA, 22 nt, Yersinia pestis KIM
agccagguauacguuguuugcg

SEQ ID NO: 296784 - RNA, 22 nt, Yersinia pestis KIM
gcccauuggcaguugaaguaau

SEQ ID NO: 296785 - RNA, 22 nt, Yersinia pestis KIM
ucugaacgucaucuagccguug

SEQ ID NO: 296786 - RNA, 22 nt, Yersinia pestis KIM
caucgauuaccgcaugauuaaa

SEQ ID NO: 296787 - RNA, 22 nt, Yersinia pestis KIM
cuggucgccugcugaaccgggc

SEQ ID NO: 296788 - RNA, 22 nt, Yersinia pestis KIM
cgcuguacgccgauccgcauuu

SEQ ID NO: 296789 - RNA, 22 nt, Yersinia pestis KIM
cagacggaacugguuaaaccau

SEQ ID NO: 296790 - RNA, 22 nt, Yersinia pestis KIM
agucucaguucaucaacguauc

SEQ ID NO: 296791 - RNA, 19 nt, Yersinia pestis KIM
acaggacagcaacagcagc

SEQ ID NO: 296792 - RNA, 19 nt, Yersinia pestis KIM
ggcagccuguuuauugcag

SEQ ID NO: 296793 - RNA, 22 nt, Yersinia pestis KIM
auauugucguugauauugucgc

SEQ ID NO: 296794 - RNA, 20 nt, Yersinia pestis KIM
acuugcugaguauuuucgug

SEQ ID NO: 296795 - RNA, 22 nt, Yersinia pestis KIM
cgaucuguuagccauuaaaccg

SEQ ID NO: 296796 - RNA, 23 nt, Yersinia pestis KIM
aucacccgcuuccagaaaaucaa

SEQ ID NO: 296797 - RNA, 22 nt, Yersinia pestis KIM
cgucaauguugaccaggugcug

SEQ ID NO: 296798 - RNA, 22 nt, Yersinia pestis KIM
ccagcguuguucugcccugcgu

SEQ ID NO: 296799 - RNA, 22 nt, Yersinia pestis KIM
uagcccauugcuggcugauggu

SEQ ID NO: 296800 - RNA, 22 nt, Yersinia pestis KIM
ugcucgcacagggucuggcgua

SEQ ID NO: 296801 - RNA, 22 nt, Yersinia pestis KIM
gaugaggcguucaagaauuugg

SEQ ID NO: 296802 - RNA, 22 nt, Yersinia pestis KIM
guuaggcauuauuaaaaauaga

SEQ ID NO: 296803 - RNA, 22 nt, Yersinia pestis KIM
cggcgguugucgguauggcgcu

SEQ ID NO: 296804 - RNA, 22 nt, Yersinia pestis KIM
ggcgauauugcgucaggcacug

SEQ ID NO: 296805 - RNA, 22 nt, Yersinia pestis KIM
agcgcuguuaucgccagccacu

SEQ ID NO: 296806 - RNA, 22 nt, Yersinia pestis KIM
accucugauuaucucugaacaa

SEQ ID NO: 296807 - RNA, 22 nt, Yersinia pestis KIM
acagaugacuacgaugugacua

SEQ ID NO: 296808 - RNA, 22 nt, Yersinia pestis KIM
gugagcuguagugggugagcgc

SEQ ID NO: 296809 - RNA, 22 nt, Yersinia pestis KIM
auggcccaccguggccguuuga

SEQ ID NO: 296810 - RNA, 22 nt, Yersinia pestis KIM
gauugaugcacuuaaagcagag

SEQ ID NO: 296811 - RNA, 22 nt, Yersinia pestis KIM
uagccauuauauucagcgccau

SEQ ID NO: 296812 - RNA, 22 nt, Yersinia pestis KIM
gucaucaugaagauggcaguga

SEQ ID NO: 296813 - RNA, 22 nt, Yersinia pestis KIM
auacugaagucaguuuuucgcc

SEQ ID NO: 296814 - RNA, 22 nt, Yersinia pestis KIM
uugaccaguggugcgcuggaau

SEQ ID NO: 296815 - RNA, 22 nt, Yersinia pestis KIM
ugacaaaucucugggcgcaggg

SEQ ID NO: 296816 - RNA, 22 nt, Yersinia pestis KIM
cuacagggcuauagcaugcguc

SEQ ID NO: 296817 - RNA, 22 nt, Yersinia pestis KIM
agcagugagcgcagauaacgau

SEQ ID NO: 296818 - RNA, 22 nt, Yersinia pestis KIM
aaucgccagacaacucuagcaa

SEQ ID NO: 296819 - RNA, 22 nt, Yersinia pestis KIM
agcagcuuuguuuggcgcuguu

SEQ ID NO: 296820 - RNA, 22 nt, Yersinia pestis KIM
uagcugucaauggugguuuuga

SEQ ID NO: 296821 - RNA, 22 nt, Yersinia pestis KIM
uggccgaagaacauggguucga

SEQ ID NO: 296822 - RNA, 22 nt, Yersinia pestis KIM
uggcugagcagggcauguugga

SEQ ID NO: 296823 - RNA, 19 nt, Yersinia pestis KIM
gcaucauauaauuauuggu

SEQ ID NO: 296824 - RNA, 22 nt, Yersinia pestis KIM
ugaugcaagugaucccuggcgg

SEQ ID NO: 296825 - RNA, 22 nt, Yersinia pestis KIM
auccuugaauucagucacugua

SEQ ID NO: 296826 - RNA, 22 nt, Yersinia pestis KIM
ggcaaacggguugccauugugg

SEQ ID NO: 296827 - RNA, 22 nt, Yersinia pestis KIM
ggucggauguuuugaccggugu

SEQ ID NO: 296828 - RNA, 22 nt, Yersinia pestis KIM
ugcaccaggcguuuuuacagca

SEQ ID NO: 296829 - RNA, 22 nt, Yersinia pestis KIM
augaccguuugugccguuuccc

SEQ ID NO: 296830 - RNA, 22 nt, Yersinia pestis KIM
aaugugguuggccugcgcaucg

SEQ ID NO: 296831 - RNA, 21 nt, Yersinia pestis KIM
cuguucagugcguucgauacu

SEQ ID NO: 296832 - RNA, 22 nt, Yersinia pestis KIM
uaucgauaauaugugcuguuuu

SEQ ID NO: 296833 - RNA, 22 nt, Yersinia pestis KIM
gagcagcguuaugguauucggu

SEQ ID NO: 296834 - RNA, 22 nt, Yersinia pestis KIM
aaugccauggucacaucguuau

SEQ ID NO: 296835 - RNA, 22 nt, Yersinia pestis KIM
ccgaugucuuaaguaacaccac

SEQ ID NO: 296836 - RNA, 18 nt, Yersinia pestis KIM
guaaagcuugcuccugau

SEQ ID NO: 296837 - RNA, 22 nt, Yersinia pestis KIM
auuggccgaggugauuuuagcc

SEQ ID NO: 296838 - RNA, 21 nt, Yersinia pestis KIM
auucaugacaccacaacggau

SEQ ID NO: 296839 - RNA, 22 nt, Yersinia pestis KIM
uguaaggaugcaaucaggggca

SEQ ID NO: 296840 - RNA, 22 nt, Yersinia pestis KIM
cagacauuguugcauaugguca

SEQ ID NO: 296841 - RNA, 22 nt, Yersinia pestis KIM
agcgcugguuuucucgacaaau

SEQ ID NO: 296842 - RNA, 21 nt, Yersinia pestis KIM
ggugaucacuuuuauuucucg

SEQ ID NO: 296843 - RNA, 22 nt, Yersinia pestis KIM
agcuugaacagcagguuaucca

SEQ ID NO: 296844 - RNA, 22 nt, Yersinia pestis KIM
agcuaauuguguuuuuaggcug

SEQ ID NO: 296845 - RNA, 22 nt, Yersinia pestis KIM
guaauggucgauguugaucgcg

SEQ ID NO: 296846 - RNA, 22 nt, Yersinia pestis KIM
aacuuucaugcuauuacccuua

SEQ ID NO: 296847 - RNA, 22 nt, Yersinia pestis KIM
ucaucccauucucuagccgggg

SEQ ID NO: 296848 - RNA, 22 nt, Yersinia pestis KIM
uagcaguuuuuggucacugcgg

SEQ ID NO: 296849 - RNA, 22 nt, Yersinia pestis KIM
gccaauaaaguccgugaaaucg

SEQ ID NO: 296850 - RNA, 22 nt, Yersinia pestis KIM
caaagauuauugguuaguugcg

SEQ ID NO: 296851 - RNA, 22 nt, Yersinia pestis KIM
uauaccaaccugcaaggaugcc

SEQ ID NO: 296852 - RNA, 22 nt, Yersinia pestis KIM
uugacguuuugacgaucaaucg

SEQ ID NO: 296853 - RNA, 22 nt, Yersinia pestis KIM
aucaccgcaucauauuacugac

SEQ ID NO: 296854 - RNA, 22 nt, Yersinia pestis KIM
ucauccaucugucgcccgguca

SEQ ID NO: 296855 - RNA, 22 nt, Yersinia pestis KIM
ccauggaauuacuauuuacugg

SEQ ID NO: 296856 - RNA, 23 nt, Yersinia pestis KIM
gugaccuguauuucauuauucac

SEQ ID NO: 296857 - RNA, 22 nt, Yersinia pestis KIM
ggagaucagauucucugggugg

SEQ ID NO: 296858 - RNA, 22 nt, Yersinia pestis KIM
gccagguaaaacgaauggauuc

SEQ ID NO: 296859 - RNA, 18 nt, Yersinia pestis KIM
ggaugcagugauuacggc

SEQ ID NO: 296860 - RNA, 22 nt, Yersinia pestis KIM
ucugguuaguggcagugauauc

SEQ ID NO: 296861 - RNA, 22 nt, Yersinia pestis KIM
cagcaacuggcguuucggaucc

SEQ ID NO: 296862 - RNA, 22 nt, Yersinia pestis KIM
ucuucaguggccgugaugaaau

SEQ ID NO: 296863 - RNA, 22 nt, Yersinia pestis KIM
ucgucgcagucgaaaggccucu

SEQ ID NO: 296864 - RNA, 22 nt, Yersinia pestis KIM
cagagcagucauuaaauuuuau

SEQ ID NO: 296865 - RNA, 22 nt, Yersinia pestis KIM
augacuacgccguugcugaugc

SEQ ID NO: 296866 - RNA, 22 nt, Yersinia pestis KIM
gguugacauuguugaugagcaa

SEQ ID NO: 296867 - RNA, 18 nt, Yersinia pestis KIM
agcccgcuuauuggucag

SEQ ID NO: 296868 - RNA, 23 nt, Yersinia pestis KIM
cgcaucaaugccuuuaaagaaac

SEQ ID NO: 296869 - RNA, 21 nt, Yersinia pestis KIM
cgcuaucaccaagcauuauuu

SEQ ID NO: 296870 - RNA, 22 nt, Yersinia pestis KIM
acuaaugguuuuaugugcacua

SEQ ID NO: 296871 - RNA, 22 nt, Yersinia pestis KIM
uccuuaacugaucggcauuggg

SEQ ID NO: 296872 - RNA, 22 nt, Yersinia pestis KIM
aucugcccgcguuggcggcugc

SEQ ID NO: 296873 - RNA, 22 nt, Yersinia pestis KIM
acagaguauuaccgcaaaauga

SEQ ID NO: 296874 - RNA, 22 nt, Yersinia pestis KIM
cagggccuuaccaucaacgagc

SEQ ID NO: 296875 - RNA, 21 nt, Yersinia pestis KIM
agcaacugagcuggcuuuuuu

SEQ ID NO: 296876 - RNA, 22 nt, Yersinia pestis KIM
gaugaucuucaugugcugcucg

SEQ ID NO: 296877 - RNA, 22 nt, Yersinia pestis KIM
acgccuuguucgcaaccgaaga

SEQ ID NO: 296878 - RNA, 22 nt, Yersinia pestis KIM
uuacucaucuggaaggcuaccg

SEQ ID NO: 296879 - RNA, 22 nt, Yersinia pestis KIM
ucgucacgcuaaacagauaagc

SEQ ID NO: 296880 - RNA, 22 nt, Yersinia pestis KIM
accggugcugcguuugacagcu

SEQ ID NO: 296881 - RNA, 22 nt, Yersinia pestis KIM
aucaaggauaagcaguucuggc

SEQ ID NO: 296882 - RNA, 22 nt, Yersinia pestis KIM
agagcgauaaccaugacgccuu

SEQ ID NO: 296883 - RNA, 22 nt, Yersinia pestis KIM
guggcccugauugguacggcca

SEQ ID NO: 296884 - RNA, 22 nt, Yersinia pestis KIM
cggcugguguacagcacgggca

SEQ ID NO: 296885 - RNA, 22 nt, Yersinia pestis KIM
cuagaagaaccgucauuauuac

SEQ ID NO: 296886 - RNA, 20 nt, Yersinia pestis KIM
ggccauuugggugcacucua

SEQ ID NO: 296887 - RNA, 22 nt, Yersinia pestis KIM
uggcugcguuagccccugcggc

SEQ ID NO: 296888 - RNA, 22 nt, Yersinia pestis KIM
uugauagcucuguugagcgugg

SEQ ID NO: 296889 - RNA, 22 nt, Yersinia pestis KIM
cgcugccuguggauucgccacu

SEQ ID NO: 296890 - RNA, 22 nt, Yersinia pestis KIM
cucaucaagucaacgcugacuu

SEQ ID NO: 296891 - RNA, 22 nt, Yersinia pestis KIM
aaacgucauuauuauuuaauau

SEQ ID NO: 296892 - RNA, 22 nt, Yersinia pestis KIM
accugaaggcugggcaagaggu

SEQ ID NO: 296893 - RNA, 22 nt, Yersinia pestis KIM
accgccugauugccggugaauc

SEQ ID NO: 296894 - RNA, 22 nt, Yersinia pestis KIM
cgccauggugaucauguccuga

SEQ ID NO: 296895 - RNA, 22 nt, Yersinia pestis KIM
aaccgcagauggcggcggaucu

SEQ ID NO: 296896 - RNA, 22 nt, Yersinia pestis KIM
agccuguccauaauucugugua

SEQ ID NO: 296897 - RNA, 23 nt, Yersinia pestis KIM
ucgggaguagcuuucucagugcg

SEQ ID NO: 296898 - RNA, 22 nt, Yersinia pestis KIM
uugccgauaucgauacucguaa

SEQ ID NO: 296899 - RNA, 22 nt, Yersinia pestis KIM
ugauggcggacagugguauaac

SEQ ID NO: 296900 - RNA, 22 nt, Yersinia pestis KIM
aaggauguaugcuugaaggcuu

SEQ ID NO: 296901 - RNA, 22 nt, Yersinia pestis KIM
ugaauuucacaucacgacauuu

SEQ ID NO: 296902 - RNA, 22 nt, Yersinia pestis KIM
aagcgguaaucaguagucauug

SEQ ID NO: 296903 - RNA, 22 nt, Yersinia pestis KIM
gaucgcugaauuacuuuccggu

SEQ ID NO: 296904 - RNA, 22 nt, Yersinia pestis KIM
auucguuuagagcgcacggggu

SEQ ID NO: 296905 - RNA, 22 nt, Yersinia pestis KIM
gaccacaugggacauaugccug

SEQ ID NO: 296906 - RNA, 22 nt, Yersinia pestis KIM
uagaacaagguuuagcgggcaa

SEQ ID NO: 296907 - RNA, 22 nt, Yersinia pestis KIM
gcggauuaccguuuugauaucg

SEQ ID NO: 296908 - RNA, 22 nt, Yersinia pestis KIM
cgcuguaugaugccgccugcgc

SEQ ID NO: 296909 - RNA, 22 nt, Yersinia pestis KIM
augcuggcggcuaucgauguaa

SEQ ID NO: 296910 - RNA, 22 nt, Yersinia pestis KIM
ccugucauguugggugaggcua

SEQ ID NO: 296911 - RNA, 22 nt, Yersinia pestis KIM
ggugaacgcuuugguuuggcug

SEQ ID NO: 296912 - RNA, 22 nt, Yersinia pestis KIM
uggcuagccagccgugcagcca

SEQ ID NO: 296913 - RNA, 22 nt, Yersinia pestis KIM
cucacuggagggauucaucaag

SEQ ID NO: 296914 - RNA, 22 nt, Yersinia pestis KIM
uggauaacaagauguuuacagu

SEQ ID NO: 296915 - RNA, 22 nt, Yersinia pestis KIM
cugguauuccgcauugucaauu

SEQ ID NO: 296916 - RNA, 23 nt, Yersinia pestis KIM
cgcuauguugaugaacaggcucc

SEQ ID NO: 296917 - RNA, 22 nt, Yersinia pestis KIM
gccagcuugucggucaguguuu

SEQ ID NO: 296918 - RNA, 22 nt, Yersinia pestis KIM
uaugccguaugaagauaagggg

SEQ ID NO: 296919 - RNA, 22 nt, Yersinia pestis KIM
agugccuuucgcgcggcguugg

SEQ ID NO: 296920 - RNA, 22 nt, Yersinia pestis KIM
ugauggauaggcccaucgucag

SEQ ID NO: 296921 - RNA, 22 nt, Yersinia pestis KIM
uuugacuucugauucagcgagu

SEQ ID NO: 296922 - RNA, 21 nt, Yersinia pestis KIM
ggauaaucugugcgccggugc

SEQ ID NO: 296923 - RNA, 22 nt, Yersinia pestis KIM
gagauuagagguuauugacaaa

SEQ ID NO: 296924 - RNA, 22 nt, Yersinia pestis KIM
uggcguuagcccaacgggcaca

SEQ ID NO: 296925 - RNA, 22 nt, Yersinia pestis KIM
cgugcuuucuugaaagaaacgu

SEQ ID NO: 296926 - RNA, 21 nt, Yersinia pestis KIM
aucgccauccugguguugaug

SEQ ID NO: 296927 - RNA, 22 nt, Yersinia pestis KIM
cagggcuguuuacacgcaagau

SEQ ID NO: 296928 - RNA, 22 nt, Yersinia pestis KIM
acauuguuugcggacagaauug

SEQ ID NO: 296929 - RNA, 22 nt, Yersinia pestis KIM
ugugcugauaauaggugugaug

SEQ ID NO: 296930 - RNA, 20 nt, Yersinia pestis KIM
acugacuggacgugauugua

SEQ ID NO: 296931 - RNA, 22 nt, Yersinia pestis KIM
ugugagucacaguauuaaaaug

SEQ ID NO: 296932 - RNA, 22 nt, Yersinia pestis KIM
uugccgauaugaacgagguucu

SEQ ID NO: 296933 - RNA, 22 nt, Yersinia pestis KIM
agagcgacugcauggucgcugu

SEQ ID NO: 296934 - RNA, 22 nt, Yersinia pestis KIM
ucaguuaaucugagugcgcuau

SEQ ID NO: 296935 - RNA, 22 nt, Yersinia pestis KIM
agugccugcaucuguuuaccgg

SEQ ID NO: 296936 - RNA, 22 nt, Yersinia pestis KIM
aggcuauauuggugaccggcgc

SEQ ID NO: 296937 - RNA, 22 nt, Yersinia pestis KIM
uauugcuguugaauuuacguua

SEQ ID NO: 296938 - RNA, 22 nt, Yersinia pestis KIM
ggauuauguuauagucguuaaa

SEQ ID NO: 296939 - RNA, 22 nt, Yersinia pestis KIM
agcaggccaucacgaccuugcu

SEQ ID NO: 296940 - RNA, 22 nt, Yersinia pestis KIM
uggugacgaacugcguucaaug

SEQ ID NO: 296941 - RNA, 22 nt, Yersinia pestis KIM
gguugcgcacgguacgggcauc

SEQ ID NO: 296942 - RNA, 22 nt, Yersinia pestis KIM
gccaauacacccggaugccgua

SEQ ID NO: 296943 - RNA, 19 nt, Yersinia pestis KIM
aauugaugugcuuucgccg

SEQ ID NO: 296944 - RNA, 22 nt, Yersinia pestis KIM
ccuagccgaaacagugcucuac

SEQ ID NO: 296945 - RNA, 22 nt, Yersinia pestis KIM
caccgccuggcuauagcccuga

SEQ ID NO: 296946 - RNA, 22 nt, Yersinia pestis KIM
ugaagccagcggcaauccauuu

SEQ ID NO: 296947 - RNA, 22 nt, Yersinia pestis KIM
ugaacauauuccacugccugau

SEQ ID NO: 296948 - RNA, 22 nt, Yersinia pestis KIM
ugauacaucaguaacaggugua

SEQ ID NO: 296949 - RNA, 22 nt, Yersinia pestis KIM
cgacauuauucauuucgcuuug

SEQ ID NO: 296950 - RNA, 22 nt, Yersinia pestis KIM
uuacggugaucggaauuuguuc

SEQ ID NO: 296951 - RNA, 22 nt, Yersinia pestis KIM
uagcccagacgcuauugcgccg

SEQ ID NO: 296952 - RNA, 22 nt, Yersinia pestis KIM
ucugggcuguuggucgauugca

SEQ ID NO: 296953 - RNA, 22 nt, Yersinia pestis KIM
aggugcaauuacagaagcuuga

SEQ ID NO: 296954 - RNA, 22 nt, Yersinia pestis KIM
cagcggcuaacguugaauauuu

SEQ ID NO: 296955 - RNA, 22 nt, Yersinia pestis KIM
caccgcuaauaucuuggcuuca

SEQ ID NO: 296956 - RNA, 20 nt, Yersinia pestis KIM
gcucuucggcaauaacagcu

SEQ ID NO: 296957 - RNA, 22 nt, Yersinia pestis KIM
uucaugcugcaacacugacagg

SEQ ID NO: 296958 - RNA, 22 nt, Yersinia pestis KIM
agcccgauaccauaaaaccgga

SEQ ID NO: 296959 - RNA, 22 nt, Yersinia pestis KIM
gaccguaagauauacagccaga

SEQ ID NO: 296960 - RNA, 22 nt, Yersinia pestis KIM
cggcgugaugggucuccgcaga

SEQ ID NO: 296961 - RNA, 22 nt, Yersinia pestis KIM
guaaagccaagaguaugagcau

SEQ ID NO: 296962 - RNA, 22 nt, Yersinia pestis KIM
ugccagauccccagccuucacu

SEQ ID NO: 296963 - RNA, 22 nt, Yersinia pestis KIM
auucaugucagugcuaucacuc

SEQ ID NO: 296964 - RNA, 22 nt, Yersinia pestis KIM
agcuuugugggauaccguauca

SEQ ID NO: 296965 - RNA, 22 nt, Yersinia pestis KIM
ggagugcuuccgccaaccagac

SEQ ID NO: 296966 - RNA, 22 nt, Yersinia pestis KIM
cguuggauauugagcacaaauu

SEQ ID NO: 296967 - RNA, 22 nt, Yersinia pestis KIM
auuuggcggugcaaugguguuc

SEQ ID NO: 296968 - RNA, 22 nt, Yersinia pestis KIM
uucagguggauacccaguuuca

SEQ ID NO: 296969 - RNA, 22 nt, Yersinia pestis KIM
cgccgguagcgccuuugguugg

SEQ ID NO: 296970 - RNA, 22 nt, Yersinia pestis KIM
ucuacuggcaggcgagcugccu

SEQ ID NO: 296971 - RNA, 22 nt, Yersinia pestis KIM
auucagaugccaaucuucuugg

SEQ ID NO: 296972 - RNA, 22 nt, Yersinia pestis KIM
acaguauugggacaguauuugu

SEQ ID NO: 296973 - RNA, 22 nt, Yersinia pestis KIM
aucauagguauuauucagcuga

SEQ ID NO: 296974 - RNA, 21 nt, Yersinia pestis KIM
caugaucguccaugaagcggc

SEQ ID NO: 296975 - RNA, 22 nt, Yersinia pestis KIM
gaucaugaaaaaacuguccggu

SEQ ID NO: 296976 - RNA, 22 nt, Yersinia pestis KIM
uaaacguguggccgugaucggg

SEQ ID NO: 296977 - RNA, 22 nt, Yersinia pestis KIM
agugcugcuugagaacuuacua

SEQ ID NO: 296978 - RNA, 22 nt, Yersinia pestis KIM
caagucgccuuagguauccguc

SEQ ID NO: 296979 - RNA, 21 nt, Yersinia pestis KIM
ugauugaguuguucaucagcg

SEQ ID NO: 296980 - RNA, 20 nt, Yersinia pestis KIM
ucgauuucacgugcaacaga

SEQ ID NO: 296981 - RNA, 22 nt, Yersinia pestis KIM
ucuugcagcuucgccucugcga

SEQ ID NO: 296982 - RNA, 22 nt, Yersinia pestis KIM
ugcacagcuggaugugagucug

SEQ ID NO: 296983 - RNA, 21 nt, Yersinia pestis KIM
cugugucagggugauauuggc

SEQ ID NO: 296984 - RNA, 22 nt, Yersinia pestis KIM
ugcucagauuaucaggccagua

SEQ ID NO: 296985 - RNA, 22 nt, Yersinia pestis KIM
uaucagcccuggaugaagauga

SEQ ID NO: 296986 - RNA, 22 nt, Yersinia pestis KIM
augauagauucuaauggcuggu

SEQ ID NO: 296987 - RNA, 19 nt, Yersinia pestis KIM
aucgggauuugugcgcugc

SEQ ID NO: 296988 - RNA, 22 nt, Yersinia pestis KIM
uugcuggcccacguguuauuga

SEQ ID NO: 296989 - RNA, 22 nt, Yersinia pestis KIM
gcggauauacccaaguugcuga

SEQ ID NO: 296990 - RNA, 22 nt, Yersinia pestis KIM
cgugcggaacaggugaugcagg

SEQ ID NO: 296991 - RNA, 22 nt, Yersinia pestis KIM
aagggugccuggcuaacgcucc

SEQ ID NO: 296992 - RNA, 22 nt, Yersinia pestis KIM
uguccguugcgcaggauccacg

SEQ ID NO: 296993 - RNA, 22 nt, Yersinia pestis KIM
aacgguauuaaguuuuucucca

SEQ ID NO: 296994 - RNA, 22 nt, Yersinia pestis KIM
aaacgcauuuauaaguucccga

SEQ ID NO: 296995 - RNA, 22 nt, Yersinia pestis KIM
gugcauugcaguucguuacgug

SEQ ID NO: 296996 - RNA, 22 nt, Yersinia pestis KIM
cugauucugguaauccauaauu

SEQ ID NO: 296997 - RNA, 22 nt, Yersinia pestis KIM
aaauugcuuucuuuauguugau

SEQ ID NO: 296998 - RNA, 22 nt, Yersinia pestis KIM
acagugcaauaucguucagguu

SEQ ID NO: 296999 - RNA, 21 nt, Yersinia pestis KIM
ucgagcagccucaucuggugu

SEQ ID NO: 297000 - RNA, 22 nt, Yersinia pestis KIM
uguugccaaaggagcucagcau

SEQ ID NO: 297001 - RNA, 22 nt, Yersinia pestis KIM
agcaaugccgaucaguuaagga

SEQ ID NO: 297002 - RNA, 22 nt, Yersinia pestis KIM
ggcagcugugaugauaacugug

SEQ ID NO: 297003 - RNA, 22 nt, Yersinia pestis KIM
gcuucgauguggcaauaaauuu

SEQ ID NO: 297004 - RNA, 22 nt, Yersinia pestis KIM
uuucagacaaguuagugccuaa

SEQ ID NO: 297005 - RNA, 22 nt, Yersinia pestis KIM
uaccgcauuacuaauacucauu

SEQ ID NO: 297006 - RNA, 22 nt, Yersinia pestis KIM
cagcgggacggucaauaucacc

SEQ ID NO: 297007 - RNA, 22 nt, Yersinia pestis KIM
gccauuggauaaagcacuggaa

SEQ ID NO: 297008 - RNA, 22 nt, Yersinia pestis KIM
ugugacaauaaugcauauucgu

SEQ ID NO: 297009 - RNA, 22 nt, Yersinia pestis KIM
auuaagcaggcuuugcuguagu

SEQ ID NO: 297010 - RNA, 22 nt, Yersinia pestis KIM
gcgauugagcggggugagucua

SEQ ID NO: 297011 - RNA, 22 nt, Yersinia pestis KIM
gucgugaagacaaagccauugu

SEQ ID NO: 297012 - RNA, 22 nt, Yersinia pestis KIM
cguucguggauccugcguaacu

SEQ ID NO: 297013 - RNA, 22 nt, Yersinia pestis KIM
ugcugaaccggucaccgcaggc

SEQ ID NO: 297014 - RNA, 22 nt, Yersinia pestis KIM
uagcugccaaucucaucgcuug

SEQ ID NO: 297015 - RNA, 22 nt, Yersinia pestis KIM
gagugcuaacucaauagcugaa

SEQ ID NO: 297016 - RNA, 22 nt, Yersinia pestis KIM
uagucgguaaggaguuauuugc

SEQ ID NO: 297017 - RNA, 22 nt, Yersinia pestis KIM
accuguuugaaagccugaaucu

SEQ ID NO: 297018 - RNA, 22 nt, Yersinia pestis KIM
auuggaaaacccuggaucuggg

SEQ ID NO: 297019 - RNA, 22 nt, Yersinia pestis KIM
gcaugacugaaaggccgaguuu

SEQ ID NO: 297020 - RNA, 22 nt, Yersinia pestis KIM
gucgucauucacacccaaugua

SEQ ID NO: 297021 - RNA, 22 nt, Yersinia pestis KIM
uugagcugcgccugaccggugg

SEQ ID NO: 297022 - RNA, 22 nt, Yersinia pestis KIM
auguugaugaguucuguugagu

SEQ ID NO: 297023 - RNA, 22 nt, Yersinia pestis KIM
gcgucguuuauaucucguugua

SEQ ID NO: 297024 - RNA, 22 nt, Yersinia pestis KIM
accgcucaauccguugcagggc

SEQ ID NO: 297025 - RNA, 22 nt, Yersinia pestis KIM
gggugcaggcgacggguaucac

SEQ ID NO: 297026 - RNA, 22 nt, Yersinia pestis KIM
uaugcccucacaucugcaacuu

SEQ ID NO: 297027 - RNA, 22 nt, Yersinia pestis KIM
ggucuuuaccuucaaugcguug

SEQ ID NO: 297028 - RNA, 22 nt, Yersinia pestis KIM
uugcagcggccucgucgagacg

SEQ ID NO: 297029 - RNA, 20 nt, Yersinia pestis KIM
gcucugucauaucauuguug

SEQ ID NO: 297030 - RNA, 22 nt, Yersinia pestis KIM
uauccgauauucaucuuggauu

SEQ ID NO: 297031 - RNA, 19 nt, Yersinia pestis KIM
gucacgacagcugcugcaa

SEQ ID NO: 297032 - RNA, 22 nt, Yersinia pestis KIM
cgucagccguacccgcucucuc

SEQ ID NO: 297033 - RNA, 22 nt, Yersinia pestis KIM
aacgucagaagacaguugaucg

SEQ ID NO: 297034 - RNA, 22 nt, Yersinia pestis KIM
auuacagcuauuauucugcgcc

SEQ ID NO: 297035 - RNA, 22 nt, Yersinia pestis KIM
uugcucaguccagucgucagca

SEQ ID NO: 297036 - RNA, 22 nt, Yersinia pestis KIM
uaacggguaauuaugccgcaug

SEQ ID NO: 297037 - RNA, 22 nt, Yersinia pestis KIM
uagcaaguaaugauagaaaugu

SEQ ID NO: 297038 - RNA, 22 nt, Yersinia pestis KIM
auuuagguaacgauaaauuugu

SEQ ID NO: 297039 - RNA, 22 nt, Yersinia pestis KIM
aaugucgaagcagguuuggucg

SEQ ID NO: 297040 - RNA, 21 nt, Yersinia pestis KIM
cggucgucgccgaugcguguu

SEQ ID NO: 297041 - RNA, 22 nt, Yersinia pestis KIM
uaugucacacaguggguuauug

SEQ ID NO: 297042 - RNA, 22 nt, Yersinia pestis KIM
aacuugaaguaugggggguaua

SEQ ID NO: 297043 - RNA, 21 nt, Yersinia pestis KIM
augucgcugaacauacgcugc

SEQ ID NO: 297044 - RNA, 22 nt, Yersinia pestis KIM
cgaucguggucagcauguguug

SEQ ID NO: 297045 - RNA, 20 nt, Yersinia pestis KIM
acagcaguaauaucaguauc

SEQ ID NO: 297046 - RNA, 21 nt, Yersinia pestis KIM
cgucauguagcuauucuuggu

SEQ ID NO: 297047 - RNA, 22 nt, Yersinia pestis KIM
uuuccagcggaauuucaagcug

SEQ ID NO: 297048 - RNA, 22 nt, Yersinia pestis KIM
uaccauauuaagaauugaacaa

SEQ ID NO: 297049 - RNA, 22 nt, Yersinia pestis KIM
auugucagcaacgaaaaaaggc

SEQ ID NO: 297050 - RNA, 22 nt, Yersinia pestis KIM
augagccuauugcugcccgaga

SEQ ID NO: 297051 - RNA, 22 nt, Yersinia pestis KIM
cugacgauuauguuuaucaaug

SEQ ID NO: 297052 - RNA, 22 nt, Yersinia pestis KIM
auaucguauucguaaacccgca

SEQ ID NO: 297053 - RNA, 22 nt, Yersinia pestis KIM
aacacggucgcucuaccugcua

SEQ ID NO: 297054 - RNA, 22 nt, Yersinia pestis KIM
uacagugccugauauucgcguu

SEQ ID NO: 297055 - RNA, 22 nt, Yersinia pestis KIM
gaguaucucaagcggcacaaua

SEQ ID NO: 297056 - RNA, 22 nt, Yersinia pestis KIM
cagcgcgaaucguuacacggua

SEQ ID NO: 297057 - RNA, 22 nt, Yersinia pestis KIM
cuggcguuauacucgugcgcgu

SEQ ID NO: 297058 - RNA, 22 nt, Yersinia pestis KIM
gccacgcugcgcugugagggug

SEQ ID NO: 297059 - RNA, 22 nt, Yersinia pestis KIM
auguucaccuuccauucccaug

SEQ ID NO: 297060 - RNA, 22 nt, Yersinia pestis KIM
ugccagcaauaagauggguggu

SEQ ID NO: 297061 - RNA, 22 nt, Yersinia pestis KIM
acggaauauuguuacgguggug

SEQ ID NO: 297062 - RNA, 22 nt, Yersinia pestis KIM
gcucauuggucucguuuuuggu

SEQ ID NO: 297063 - RNA, 22 nt, Yersinia pestis KIM
uauugaugacaaaagggccugg

SEQ ID NO: 297064 - RNA, 22 nt, Yersinia pestis KIM
aacgccgcucuucagcaucagg

SEQ ID NO: 297065 - RNA, 22 nt, Yersinia pestis KIM
uagcaugaaugcaguucaaauu

SEQ ID NO: 297066 - RNA, 22 nt, Yersinia pestis KIM
agucuguuaucaaucugucucg

SEQ ID NO: 297067 - RNA, 22 nt, Yersinia pestis KIM
ugucguuaauucaaaguaaugc

SEQ ID NO: 297068 - RNA, 22 nt, Yersinia pestis KIM
ucugauuuuacugaugucuauu

SEQ ID NO: 297069 - RNA, 22 nt, Yersinia pestis KIM
auccugaucgccuccggcguuc

SEQ ID NO: 297070 - RNA, 22 nt, Yersinia pestis KIM
uugacaugcaguucagucagga

SEQ ID NO: 297071 - RNA, 22 nt, Yersinia pestis KIM
uagccauguauuuauaggcaga

SEQ ID NO: 297072 - RNA, 20 nt, Yersinia pestis KIM
ccagcuugcaauucggcgau

SEQ ID NO: 297073 - RNA, 22 nt, Yersinia pestis KIM
ugcucagcauguugauguccuu

SEQ ID NO: 297074 - RNA, 20 nt, Yersinia pestis KIM
cagauuguugugcguucauu

SEQ ID NO: 297075 - RNA, 22 nt, Yersinia pestis KIM
auggcggcagaggcgcguauug

SEQ ID NO: 297076 - RNA, 22 nt, Yersinia pestis KIM
cugggugauccgcgcaucgcca

SEQ ID NO: 297077 - RNA, 22 nt, Yersinia pestis KIM
ggaacgccaaguaugcaggccc

SEQ ID NO: 297078 - RNA, 22 nt, Yersinia pestis KIM
uugagcguuauccggggguguu

SEQ ID NO: 297079 - RNA, 19 nt, Yersinia pestis KIM
cgagcgaacggauggugac

SEQ ID NO: 297080 - RNA, 22 nt, Yersinia pestis KIM
gcaaagugucuggcaugaccgu

SEQ ID NO: 297081 - RNA, 22 nt, Yersinia pestis KIM
uuuaaggucauggaaggugaaa

SEQ ID NO: 297082 - RNA, 22 nt, Yersinia pestis KIM
gaaauacuccuguucuaucgaa

SEQ ID NO: 297083 - RNA, 19 nt, Yersinia pestis KIM
cagcaaagccagcaguuuu

SEQ ID NO: 297084 - RNA, 22 nt, Yersinia pestis KIM
ugcggcaggcauuguggcucgu

SEQ ID NO: 297085 - RNA, 22 nt, Yersinia pestis KIM
ugacuaucaugagugcggcaac

SEQ ID NO: 297086 - RNA, 22 nt, Yersinia pestis KIM
cuuaaucugucugguuaucagg

SEQ ID NO: 297087 - RNA, 22 nt, Yersinia pestis KIM
auucgcaagcugguuauccaag

SEQ ID NO: 297088 - RNA, 22 nt, Yersinia pestis KIM
gagaggcuuuagacuccguaau

SEQ ID NO: 297089 - RNA, 22 nt, Yersinia pestis KIM
ugugugacggaugcggucaaug

SEQ ID NO: 297090 - RNA, 22 nt, Yersinia pestis KIM
aguggcuuggggcgagacugaa

SEQ ID NO: 297091 - RNA, 21 nt, Yersinia pestis KIM
ccagauuuucagguacgcugg

SEQ ID NO: 297092 - RNA, 22 nt, Yersinia pestis KIM
ucgcgaauacuauugaugguuu

SEQ ID NO: 297093 - RNA, 22 nt, Yersinia pestis KIM
gcguaaugguaagguugucggu

SEQ ID NO: 297094 - RNA, 22 nt, Yersinia pestis KIM
ugaugccgguaccgcuugcucc

SEQ ID NO: 297095 - RNA, 22 nt, Yersinia pestis KIM
gcagcucuauuccauggguaca

SEQ ID NO: 297096 - RNA, 22 nt, Yersinia pestis KIM
cuuauguugaucauggauaucg

SEQ ID NO: 297097 - RNA, 22 nt, Yersinia pestis KIM
ugacugaugggcgguuauccaa

SEQ ID NO: 297098 - RNA, 22 nt, Yersinia pestis KIM
aaugagucaauagcauucaagc

SEQ ID NO: 297099 - RNA, 22 nt, Yersinia pestis KIM
uacggucauaucgguacucaac

SEQ ID NO: 297100 - RNA, 22 nt, Yersinia pestis KIM
ucagugaaguaaaugauuacga

SEQ ID NO: 297101 - RNA, 22 nt, Yersinia pestis KIM
accagucaugccuuuuaucaug

SEQ ID NO: 297102 - RNA, 20 nt, Yersinia pestis KIM
caguucaauuucgagggcuu

SEQ ID NO: 297103 - RNA, 22 nt, Yersinia pestis KIM
gguagcuaaauguuuaucuuga

SEQ ID NO: 297104 - RNA, 22 nt, Yersinia pestis KIM
gaugagugauggcgacaauaaa

SEQ ID NO: 297105 - RNA, 21 nt, Yersinia pestis KIM
gcaggcugucgccgucagcau

SEQ ID NO: 297106 - RNA, 22 nt, Yersinia pestis KIM
aauacguucgcggaucaccggu

SEQ ID NO: 297107 - RNA, 22 nt, Yersinia pestis KIM
uguucccgcagaugccaguacc

SEQ ID NO: 297108 - RNA, 22 nt, Yersinia pestis KIM
ccgaugaugcagcaguaucuuc

SEQ ID NO: 297109 - RNA, 22 nt, Yersinia pestis KIM
ugacuaaucgacggcugccuca

SEQ ID NO: 297110 - RNA, 19 nt, Yersinia pestis KIM
ucaggcgcuuggauuuuac

SEQ ID NO: 297111 - RNA, 22 nt, Yersinia pestis KIM
uagucggccgggaguucguauu

SEQ ID NO: 297112 - RNA, 21 nt, Yersinia pestis KIM
guagccguagcggauccguug

SEQ ID NO: 297113 - RNA, 22 nt, Yersinia pestis KIM
uacuggauguagauuauaauga

SEQ ID NO: 297114 - RNA, 22 nt, Yersinia pestis KIM
ugcugugaguaauacucuugca

SEQ ID NO: 297115 - RNA, 22 nt, Yersinia pestis KIM
uuagggauaagcggaaagacga

SEQ ID NO: 297116 - RNA, 19 nt, Yersinia pestis KIM
gauugccgccgguucguug

SEQ ID NO: 297117 - RNA, 22 nt, Yersinia pestis KIM
gcucuggcacaguaucgugagc

SEQ ID NO: 297118 - RNA, 22 nt, Yersinia pestis KIM
gcgcuugauuauuggccucugc

SEQ ID NO: 297119 - RNA, 19 nt, Yersinia pestis KIM
aucagcagagaaaaugcgc

SEQ ID NO: 297120 - RNA, 22 nt, Yersinia pestis KIM
ugagaaugccguuguguuuucu

SEQ ID NO: 297121 - RNA, 22 nt, Yersinia pestis KIM
cgauagcugccauguggacggc

SEQ ID NO: 297122 - RNA, 22 nt, Yersinia pestis KIM
uacuguaucuuaauuuuaugcu

SEQ ID NO: 297123 - RNA, 22 nt, Yersinia pestis KIM
agccgccaauauugucaaaauu

SEQ ID NO: 297124 - RNA, 22 nt, Yersinia pestis KIM
aguaacgaauuacgcugaauug

SEQ ID NO: 297125 - RNA, 22 nt, Yersinia pestis KIM
ugaacguguucccaauauugau

SEQ ID NO: 297126 - RNA, 22 nt, Yersinia pestis KIM
caucgaggaaauuucagaggug

SEQ ID NO: 297127 - RNA, 22 nt, Yersinia pestis KIM
uuguugacacuaagcguuucac

SEQ ID NO: 297128 - RNA, 22 nt, Yersinia pestis KIM
cauuggcugaaaugucagauag

SEQ ID NO: 297129 - RNA, 22 nt, Yersinia pestis KIM
gcgcaggaacugauugaccauu

SEQ ID NO: 297130 - RNA, 22 nt, Yersinia pestis KIM
gcuagcaagaagaauugaucau

SEQ ID NO: 297131 - RNA, 18 nt, Yersinia pestis KIM
uuggcggcauccauccac

SEQ ID NO: 297132 - RNA, 22 nt, Yersinia pestis KIM
accaacugaccaaaucaugaug

SEQ ID NO: 297133 - RNA, 22 nt, Yersinia pestis KIM
uggcuagagacgcuggccgauu

SEQ ID NO: 297134 - RNA, 22 nt, Yersinia pestis KIM
gagcccgugauuugaaagggau

SEQ ID NO: 297135 - RNA, 22 nt, Yersinia pestis KIM
uauuaggaugguuagaguggga

SEQ ID NO: 297136 - RNA, 22 nt, Yersinia pestis KIM
guauggcgguguccaccagcag

SEQ ID NO: 297137 - RNA, 22 nt, Yersinia pestis KIM
ggcaacauucagcggaacggau

SEQ ID NO: 297138 - RNA, 22 nt, Yersinia pestis KIM
gccagcuuuguaaucuggcaga

SEQ ID NO: 297139 - RNA, 22 nt, Yersinia pestis KIM
gaaugccauuaauacuguggca

SEQ ID NO: 297140 - RNA, 22 nt, Yersinia pestis KIM
caccgcaguaaagaauuuaugc

SEQ ID NO: 297141 - RNA, 22 nt, Yersinia pestis KIM
guaaaguaucgauggccacggg

SEQ ID NO: 297142 - RNA, 22 nt, Yersinia pestis KIM
acuguugauggcgacuucguua

SEQ ID NO: 297143 - RNA, 22 nt, Yersinia pestis KIM
cuguauugcgccaaugacugug

SEQ ID NO: 297144 - RNA, 18 nt, Yersinia pestis KIM
auucgccaacugaugcag

SEQ ID NO: 297145 - RNA, 22 nt, Yersinia pestis KIM
uggauaccuggcaaauggcgga

SEQ ID NO: 297146 - RNA, 22 nt, Yersinia pestis KIM
gccguggugagcggguauggcu

SEQ ID NO: 297147 - RNA, 22 nt, Yersinia pestis KIM
aaccauugacgggggcuuccag

SEQ ID NO: 297148 - RNA, 22 nt, Yersinia pestis KIM
caaucguuguuucugauagcga

SEQ ID NO: 297149 - RNA, 22 nt, Yersinia pestis KIM
cagcggauccugauagcccaca

SEQ ID NO: 297150 - RNA, 22 nt, Yersinia pestis KIM
gcugcuuaaacccgguaugauu

SEQ ID NO: 297151 - RNA, 22 nt, Yersinia pestis KIM
cugcauuauuuguugagccaau

SEQ ID NO: 297152 - RNA, 22 nt, Yersinia pestis KIM
ugcggcugaacgucugcugaug

SEQ ID NO: 297153 - RNA, 22 nt, Yersinia pestis KIM
uagccacguucacauacccaga

SEQ ID NO: 297154 - RNA, 22 nt, Yersinia pestis KIM
auccgguggcguuaccgguuca

SEQ ID NO: 297155 - RNA, 22 nt, Yersinia pestis KIM
guaaugcuucaugaaguugcgg

SEQ ID NO: 297156 - RNA, 22 nt, Yersinia pestis KIM
cucagccgccccggagauagcg

SEQ ID NO: 297157 - RNA, 22 nt, Yersinia pestis KIM
cacucgucauauuucacguggg

SEQ ID NO: 297158 - RNA, 22 nt, Yersinia pestis KIM
cuggaugggagcgagagugcau

SEQ ID NO: 297159 - RNA, 22 nt, Yersinia pestis KIM
uucgguaugaguuuauugcuuu

SEQ ID NO: 297160 - RNA, 20 nt, Yersinia pestis KIM
ccauugguaauaaacgcggu

SEQ ID NO: 297161 - RNA, 22 nt, Yersinia pestis KIM
uaucgcuuugggcuugcucccu

SEQ ID NO: 297162 - RNA, 18 nt, Yersinia pestis KIM
cguugaugcagaugaagu

SEQ ID NO: 297163 - RNA, 22 nt, Yersinia pestis KIM
uggcaucauagagccuggagau

SEQ ID NO: 297164 - RNA, 18 nt, Yersinia pestis KIM
uaauuggucaccuucugc

SEQ ID NO: 297165 - RNA, 22 nt, Yersinia pestis KIM
accugcucuacaggcaauugcg

SEQ ID NO: 297166 - RNA, 22 nt, Yersinia pestis KIM
agagauucuagucgcccacgau

SEQ ID NO: 297167 - RNA, 22 nt, Yersinia pestis KIM
uggacgacguguugauucaacu

SEQ ID NO: 297168 - RNA, 22 nt, Yersinia pestis KIM
aagcauuacugcgugagaucca

SEQ ID NO: 297169 - RNA, 22 nt, Yersinia pestis KIM
ggcccucacguucaccacggua

SEQ ID NO: 297170 - RNA, 22 nt, Yersinia pestis KIM
gaucucccgcaauaccguuaaa

SEQ ID NO: 297171 - RNA, 22 nt, Yersinia pestis KIM
uauagcagcaugaauuuaacag

SEQ ID NO: 297172 - RNA, 22 nt, Yersinia pestis KIM
gcgucacuucgccacgucauca

SEQ ID NO: 297173 - RNA, 23 nt, Yersinia pestis KIM
aucaggucagcagugaugaagug

SEQ ID NO: 297174 - RNA, 22 nt, Yersinia pestis KIM
agccauucgugaaauuauggcg

SEQ ID NO: 297175 - RNA, 22 nt, Yersinia pestis KIM
accggcaaugcugaagaaaugg

SEQ ID NO: 297176 - RNA, 22 nt, Yersinia pestis KIM
uuagauugcccgguugucuucc

SEQ ID NO: 297177 - RNA, 22 nt, Yersinia pestis KIM
ugguugcaccgggcgcugaaag

SEQ ID NO: 297178 - RNA, 18 nt, Yersinia pestis KIM
acugggugaaauggguga

SEQ ID NO: 297179 - RNA, 22 nt, Yersinia pestis KIM
uacuggucccguccacguuggu

SEQ ID NO: 297180 - RNA, 22 nt, Yersinia pestis KIM
gagucuaaaaauaacauaagcu

SEQ ID NO: 297181 - RNA, 22 nt, Yersinia pestis KIM
cagcgugagcagcgcggcagac

SEQ ID NO: 297182 - RNA, 22 nt, Yersinia pestis KIM
gcaauggcauuacguguuaagu

SEQ ID NO: 297183 - RNA, 22 nt, Yersinia pestis KIM
cuugcgugaacgggcugaagau

SEQ ID NO: 297184 - RNA, 22 nt, Yersinia pestis KIM
uaacugcacgcaucucaguuug

SEQ ID NO: 297185 - RNA, 22 nt, Yersinia pestis KIM
gcugaaagcacccgcgguggca

SEQ ID NO: 297186 - RNA, 22 nt, Yersinia pestis KIM
aguaugcuggcgcuguugcugg

SEQ ID NO: 297187 - RNA, 22 nt, Yersinia pestis KIM
guuacccauaaguugccugagu

SEQ ID NO: 297188 - RNA, 22 nt, Yersinia pestis KIM
gcgcguuaguacuggguagcua

SEQ ID NO: 297189 - RNA, 22 nt, Yersinia pestis KIM
caccuucagucuccaaugugaa

SEQ ID NO: 297190 - RNA, 22 nt, Yersinia pestis KIM
uggcauugcuauugguggucgu

SEQ ID NO: 297191 - RNA, 22 nt, Yersinia pestis KIM
uagcugauagucuuuaguagcu

SEQ ID NO: 297192 - RNA, 22 nt, Yersinia pestis KIM
gccuuucagacugcugacaaac

SEQ ID NO: 297193 - RNA, 22 nt, Yersinia pestis KIM
accagagauuaaaucaggggau

SEQ ID NO: 297194 - RNA, 22 nt, Yersinia pestis KIM
cguauugacccuaaaaccggua

SEQ ID NO: 297195 - RNA, 22 nt, Yersinia pestis KIM
ccagauaaguuuaaaugguuuc

SEQ ID NO: 297196 - RNA, 22 nt, Yersinia pestis KIM
uccgguauuucucuggaugaga

SEQ ID NO: 297197 - RNA, 22 nt, Yersinia pestis KIM
gcauccagaaugcguugcugau

SEQ ID NO: 297198 - RNA, 22 nt, Yersinia pestis KIM
cggaggauauuuauuugugcuc

SEQ ID NO: 297199 - RNA, 22 nt, Yersinia pestis KIM
ucgcgcuggcugaacguuuugg

SEQ ID NO: 297200 - RNA, 22 nt, Yersinia pestis KIM
aggcgguuaguucauguucaaa

SEQ ID NO: 297201 - RNA, 22 nt, Yersinia pestis KIM
uggauccuuuagggagcgguau

SEQ ID NO: 297202 - RNA, 21 nt, Yersinia pestis KIM
uaucgcuuucgcuacgccacc

SEQ ID NO: 297203 - RNA, 22 nt, Yersinia pestis KIM
uugcaaugaauguuaauggugu

SEQ ID NO: 297204 - RNA, 22 nt, Yersinia pestis KIM
ccguagcgaaguaaugucacaa

SEQ ID NO: 297205 - RNA, 22 nt, Yersinia pestis KIM
ucaggauuauucauuggcacaa

SEQ ID NO: 297206 - RNA, 22 nt, Yersinia pestis KIM
ucucaggugugagguuauugac

SEQ ID NO: 297207 - RNA, 22 nt, Yersinia pestis KIM
aacucgaauuauuuaggguaua

SEQ ID NO: 297208 - RNA, 22 nt, Yersinia pestis KIM
ugcaaaggucagacgugggggu

SEQ ID NO: 297209 - RNA, 22 nt, Yersinia pestis KIM
uggcuaagacuucauuacgcuc

SEQ ID NO: 297210 - RNA, 22 nt, Yersinia pestis KIM
gcggugcugcucgguuuuggug

SEQ ID NO: 297211 - RNA, 22 nt, Yersinia pestis KIM
acgucuaaauagaaaaugacgg

SEQ ID NO: 297212 - RNA, 22 nt, Yersinia pestis KIM
augccaccugccgccgcuuuau

SEQ ID NO: 297213 - RNA, 22 nt, Yersinia pestis KIM
uguaucuugcaagguuggugua

SEQ ID NO: 297214 - RNA, 22 nt, Yersinia pestis KIM
auagcgaccaucgagacguacu

SEQ ID NO: 297215 - RNA, 22 nt, Yersinia pestis KIM
acuucaucgcacuuaaucaacg

SEQ ID NO: 297216 - RNA, 22 nt, Yersinia pestis KIM
aucgccuugucgguugguuuug

SEQ ID NO: 297217 - RNA, 22 nt, Yersinia pestis KIM
gggcuggauuuaaauggcggua

SEQ ID NO: 297218 - RNA, 22 nt, Yersinia pestis KIM
acgauuaacaugaucguguugc

SEQ ID NO: 297219 - RNA, 22 nt, Yersinia pestis KIM
guuggaaugcccauggcccguu

SEQ ID NO: 297220 - RNA, 22 nt, Yersinia pestis KIM
ugcuauugaugucuuugaacuc

SEQ ID NO: 297221 - RNA, 22 nt, Yersinia pestis KIM
cugaugguggacucuggcgcug

SEQ ID NO: 297222 - RNA, 22 nt, Yersinia pestis KIM
gucgggcaccguauaccacgac

SEQ ID NO: 297223 - RNA, 22 nt, Yersinia pestis KIM
auggaccgguaucagucaugcu

SEQ ID NO: 297224 - RNA, 22 nt, Yersinia pestis KIM
aagccguauuaacugaauacca

SEQ ID NO: 297225 - RNA, 22 nt, Yersinia pestis KIM
guagccauuaugucgggaguaa

SEQ ID NO: 297226 - RNA, 22 nt, Yersinia pestis KIM
cauuacugucaacguuguggca

SEQ ID NO: 297227 - RNA, 22 nt, Yersinia pestis KIM
guugucagcagucugaaaucuc

SEQ ID NO: 297228 - RNA, 21 nt, Yersinia pestis KIM
gcagauugcggauaacaggag

SEQ ID NO: 297229 - RNA, 22 nt, Yersinia pestis KIM
ugauggcauaaaggaaacggua

SEQ ID NO: 297230 - RNA, 22 nt, Yersinia pestis KIM
auucuggcuggggaucauaucu

SEQ ID NO: 297231 - RNA, 22 nt, Yersinia pestis KIM
ccaguuggaugaucgccuggca

SEQ ID NO: 297232 - RNA, 22 nt, Yersinia pestis KIM
accgauggugcggcguuaucaa

SEQ ID NO: 297233 - RNA, 22 nt, Yersinia pestis KIM
cuggcuuuuuuauccagauuau

SEQ ID NO: 297234 - RNA, 22 nt, Yersinia pestis KIM
ggcuggcaaacguuucacacuc

SEQ ID NO: 297235 - RNA, 23 nt, Yersinia pestis KIM
guacacgaacgcgcaggcuuggc

SEQ ID NO: 297236 - RNA, 22 nt, Yersinia pestis KIM
acaaugaugacguggcgaagug

SEQ ID NO: 297237 - RNA, 22 nt, Yersinia pestis KIM
gguucacuuauuauggaauugg

SEQ ID NO: 297238 - RNA, 22 nt, Yersinia pestis KIM
agcgcuuucuggguaucugccu

SEQ ID NO: 297239 - RNA, 22 nt, Yersinia pestis KIM
gauggugcucuuuagcguuuug

SEQ ID NO: 297240 - RNA, 22 nt, Yersinia pestis KIM
agucgccgcaaccggugauggc

SEQ ID NO: 297241 - RNA, 22 nt, Yersinia pestis KIM
agauuacugacgaucuugcuga

SEQ ID NO: 297242 - RNA, 22 nt, Yersinia pestis KIM
acgauaucgaaccugaaugacg

SEQ ID NO: 297243 - RNA, 22 nt, Yersinia pestis KIM
caacccgucaacuauguugcaa

SEQ ID NO: 297244 - RNA, 22 nt, Yersinia pestis KIM
uacauuggcuccccuuuggguu

SEQ ID NO: 297245 - RNA, 22 nt, Yersinia pestis KIM
uugcaguuuagccagcaacuga

SEQ ID NO: 297246 - RNA, 22 nt, Yersinia pestis KIM
uccugcuacgcugaaaugugac

SEQ ID NO: 297247 - RNA, 22 nt, Yersinia pestis KIM
gaugucaaagcaauggaauggc

SEQ ID NO: 297248 - RNA, 22 nt, Yersinia pestis KIM
aaccggauaugucacauguuca

SEQ ID NO: 297249 - RNA, 19 nt, Yersinia pestis KIM
cauuuagucuacgcucuac

SEQ ID NO: 297250 - RNA, 22 nt, Yersinia pestis KIM
uugagaaaacucuuauagugcu

SEQ ID NO: 297251 - RNA, 22 nt, Yersinia pestis KIM
aauagcaucguauucacuggcg

SEQ ID NO: 297252 - RNA, 22 nt, Yersinia pestis KIM
ggccaguauuuacuguuccgga

SEQ ID NO: 297253 - RNA, 22 nt, Yersinia pestis KIM
cuaaccucagauaggagacagg

SEQ ID NO: 297254 - RNA, 22 nt, Yersinia pestis KIM
uauucugaacuggaagaagagu

SEQ ID NO: 297255 - RNA, 22 nt, Yersinia pestis KIM
aauucaguaauucgcucugugu

SEQ ID NO: 297256 - RNA, 22 nt, Yersinia pestis KIM
acaacgguaagaaagccgggcg

SEQ ID NO: 297257 - RNA, 22 nt, Yersinia pestis KIM
gaacgccucgaucucgaugagc

SEQ ID NO: 297258 - RNA, 22 nt, Yersinia pestis KIM
aaacuuugaacaaacgcuuguu

SEQ ID NO: 297259 - RNA, 22 nt, Yersinia pestis KIM
aucuuugguggccagaagguug

SEQ ID NO: 297260 - RNA, 22 nt, Yersinia pestis KIM
guagggcgcugauagagugaga

SEQ ID NO: 297261 - RNA, 23 nt, Yersinia pestis KIM
uucgaaccacaaucuggcuauuu

SEQ ID NO: 297262 - RNA, 23 nt, Yersinia pestis KIM
uguaaucgcuauucaggcccgcc

SEQ ID NO: 297263 - RNA, 22 nt, Yersinia pestis KIM
ugcuuaucaggugauuggggcg

SEQ ID NO: 297264 - RNA, 23 nt, Yersinia pestis KIM
ucuugcguaaucuuuaucgcgcg

SEQ ID NO: 297265 - RNA, 18 nt, Yersinia pestis KIM
cagugccacaauaaacag

SEQ ID NO: 297266 - RNA, 22 nt, Yersinia pestis KIM
acugagauaaaaaggaugacug

SEQ ID NO: 297267 - RNA, 22 nt, Yersinia pestis KIM
auggcagaaggugauuaucggg

SEQ ID NO: 297268 - RNA, 22 nt, Yersinia pestis KIM
ccuuguaaaaaauacgccauuu

SEQ ID NO: 297269 - RNA, 22 nt, Yersinia pestis KIM
ugcccguugggcuaacgccaug

SEQ ID NO: 297270 - RNA, 22 nt, Yersinia pestis KIM
aaugaagccaggguugcagcaa

SEQ ID NO: 297271 - RNA, 22 nt, Yersinia pestis KIM
aagaugacgauuuugguuucug

SEQ ID NO: 297272 - RNA, 22 nt, Yersinia pestis KIM
uugcuugauuucacauuacguc

SEQ ID NO: 297273 - RNA, 22 nt, Yersinia pestis KIM
uggccugcgggaugugauguca

SEQ ID NO: 297274 - RNA, 22 nt, Yersinia pestis KIM
cugcuagcaauaucugcguauu

SEQ ID NO: 297275 - RNA, 22 nt, Yersinia pestis KIM
augccauauuuacauucgcgau

SEQ ID NO: 297276 - RNA, 22 nt, Yersinia pestis KIM
cgaucauuuuggacuuaauucg

SEQ ID NO: 297277 - RNA, 22 nt, Yersinia pestis KIM
uaacgccguggaacauuugccu

SEQ ID NO: 297278 - RNA, 22 nt, Yersinia pestis KIM
gaccuucaccguauugccuacc

SEQ ID NO: 297279 - RNA, 22 nt, Yersinia pestis KIM
uacgccauguuuccgaaaccca

SEQ ID NO: 297280 - RNA, 22 nt, Yersinia pestis KIM
agaaauugguauccgucgucuu

SEQ ID NO: 297281 - RNA, 22 nt, Yersinia pestis KIM
uuaaucgacaaguuacuguucu

SEQ ID NO: 297282 - RNA, 20 nt, Yersinia pestis KIM
gaugauauuaagaauagcua

SEQ ID NO: 297283 - RNA, 19 nt, Yersinia pestis KIM
auaugaguuuugaugaauu

SEQ ID NO: 297284 - RNA, 22 nt, Yersinia pestis KIM
uuugaaucaggcauuaaucaaa

SEQ ID NO: 297285 - RNA, 18 nt, Yersinia pestis KIM
cgggucacccaacugaau

SEQ ID NO: 297286 - RNA, 22 nt, Yersinia pestis KIM
gccgcauugcguuuggucggug

SEQ ID NO: 297287 - RNA, 22 nt, Yersinia pestis KIM
gucuaucuguuacaaacacgca

SEQ ID NO: 297288 - RNA, 22 nt, Yersinia pestis KIM
gccaagcuugccagaucaugaa

SEQ ID NO: 297289 - RNA, 22 nt, Yersinia pestis KIM
cuugccgcuucaauuugauuag

SEQ ID NO: 297290 - RNA, 19 nt, Yersinia pestis KIM
uguagugaugcugaauuua

SEQ ID NO: 297291 - RNA, 22 nt, Yersinia pestis KIM
ggaugccguagauuuuuuugcc

SEQ ID NO: 297292 - RNA, 19 nt, Yersinia pestis KIM
aggauugcgguggugucuu

SEQ ID NO: 297293 - RNA, 22 nt, Yersinia pestis KIM
auagacgguugaucuguaggua

SEQ ID NO: 297294 - RNA, 22 nt, Yersinia pestis KIM
uggcugcagguaacagccugga

SEQ ID NO: 297295 - RNA, 22 nt, Yersinia pestis KIM
uugcgcaggguccggugucgcu

SEQ ID NO: 297296 - RNA, 22 nt, Yersinia pestis KIM
gcaauguccgaucgagugcagg

SEQ ID NO: 297297 - RNA, 22 nt, Yersinia pestis KIM
ugaggcaggaaaucggcucuuu

SEQ ID NO: 297298 - RNA, 22 nt, Yersinia pestis KIM
caauagacauaauuagggaacu

SEQ ID NO: 297299 - RNA, 22 nt, Yersinia pestis KIM
uaauacgcauauucggcuggaa

SEQ ID NO: 297300 - RNA, 22 nt, Yersinia pestis KIM
ugcucaaguaucagugcucgca

SEQ ID NO: 297301 - RNA, 22 nt, Yersinia pestis KIM
uggcgauugccaguggugugcc

SEQ ID NO: 297302 - RNA, 22 nt, Yersinia pestis KIM
ggaaacauaaccugaucaauaa

SEQ ID NO: 297303 - RNA, 22 nt, Yersinia pestis KIM
uugacgcauugaaaaguaauaa

SEQ ID NO: 297304 - RNA, 18 nt, Yersinia pestis KIM
augcacgacaucuugagu

SEQ ID NO: 297305 - RNA, 19 nt, Yersinia pestis KIM
uagauaacauaggguucgc

SEQ ID NO: 297306 - RNA, 22 nt, Yersinia pestis KIM
auuugcuggccuguuuaaucug

SEQ ID NO: 297307 - RNA, 22 nt, Yersinia pestis KIM
cccgauguuggguggugguaca

SEQ ID NO: 297308 - RNA, 22 nt, Yersinia pestis KIM
guuacggugcauguccgucgua

SEQ ID NO: 297309 - RNA, 22 nt, Yersinia pestis KIM
ugaucagcuuaauauuuugcac

SEQ ID NO: 297310 - RNA, 22 nt, Yersinia pestis KIM
ggugccuuaucuggucgcgcca

SEQ ID NO: 297311 - RNA, 19 nt, Yersinia pestis KIM
ugcugagauugugcuuguu

SEQ ID NO: 297312 - RNA, 20 nt, Yersinia pestis KIM
uugaacagaacgcggaagcc

SEQ ID NO: 297313 - RNA, 22 nt, Yersinia pestis KIM
ccaguuagcgcuauaugauuua

SEQ ID NO: 297314 - RNA, 22 nt, Yersinia pestis KIM
acguuagcaugaugauuguugu

SEQ ID NO: 297315 - RNA, 22 nt, Yersinia pestis KIM
gcggcgaauucuaccuauaaga

SEQ ID NO: 297316 - RNA, 22 nt, Yersinia pestis KIM
guguucauauucaugguuucaa

SEQ ID NO: 297317 - RNA, 22 nt, Yersinia pestis KIM
augaguauguggagcuugaaca

SEQ ID NO: 297318 - RNA, 22 nt, Yersinia pestis KIM
cauccugagaggcuugcaguaa

SEQ ID NO: 297319 - RNA, 22 nt, Yersinia pestis KIM
cuggaugcauucaauaaaggcu

SEQ ID NO: 297320 - RNA, 22 nt, Yersinia pestis KIM
gcaugugaauaagcuugaacaa

SEQ ID NO: 297321 - RNA, 21 nt, Yersinia pestis KIM
ugaaucgugcugucaccgugc

SEQ ID NO: 297322 - RNA, 22 nt, Yersinia pestis KIM
auacccgugauacuucaaguug

SEQ ID NO: 297323 - RNA, 22 nt, Yersinia pestis KIM
aucugcugauuauauugguuca

SEQ ID NO: 297324 - RNA, 22 nt, Yersinia pestis KIM
gaucccucguggagaggcucaa

SEQ ID NO: 297325 - RNA, 22 nt, Yersinia pestis KIM
aacgguaacgguauaggcgaag

SEQ ID NO: 297326 - RNA, 22 nt, Yersinia pestis KIM
agccaguuaucgauaaucucuu

SEQ ID NO: 297327 - RNA, 22 nt, Yersinia pestis KIM
ucaguuuaucgggcagguguua

SEQ ID NO: 297328 - RNA, 22 nt, Yersinia pestis KIM
gcucauuaauuccgaugagcuu

SEQ ID NO: 297329 - RNA, 22 nt, Yersinia pestis KIM
cauuugugcugaagcuggguuc

SEQ ID NO: 297330 - RNA, 22 nt, Yersinia pestis KIM
ggcguaauacaccauugauaag

SEQ ID NO: 297331 - RNA, 22 nt, Yersinia pestis KIM
cugcugucggcaauacuucacc

SEQ ID NO: 297332 - RNA, 22 nt, Yersinia pestis KIM
ccgacgcuggacuuaaccacgu

SEQ ID NO: 297333 - RNA, 22 nt, Yersinia pestis KIM
agaacauacuuuuggucauggu

SEQ ID NO: 297334 - RNA, 22 nt, Yersinia pestis KIM
acuaacgugucauuaccggcac

SEQ ID NO: 297335 - RNA, 22 nt, Yersinia pestis KIM
aaaguggccagagaucuguuua

SEQ ID NO: 297336 - RNA, 22 nt, Yersinia pestis KIM
uucagauguugagugggcacgu

SEQ ID NO: 297337 - RNA, 22 nt, Yersinia pestis KIM
uuccgugcuaccuauuuuggcu

SEQ ID NO: 297338 - RNA, 22 nt, Yersinia pestis KIM
gucaggaugccauuuuauucug

SEQ ID NO: 297339 - RNA, 22 nt, Yersinia pestis KIM
agauuaucgccaccauucuggu

SEQ ID NO: 297340 - RNA, 19 nt, Yersinia pestis KIM
gcauugguaggcccuaucc

SEQ ID NO: 297341 - RNA, 22 nt, Yersinia pestis KIM
ucaaccagauuauguuguucug

SEQ ID NO: 297342 - RNA, 19 nt, Yersinia pestis KIM
ugaccggugcuucauaacc

SEQ ID NO: 297343 - RNA, 22 nt, Yersinia pestis KIM
cacugcuccagcgccauuaaug

SEQ ID NO: 297344 - RNA, 22 nt, Yersinia pestis KIM
gagcguugcgcuguccguuauu

SEQ ID NO: 297345 - RNA, 22 nt, Yersinia pestis KIM
aauaggcuaacguuguauuuau

SEQ ID NO: 297346 - RNA, 22 nt, Yersinia pestis KIM
auugugcuuucugaugccugau

SEQ ID NO: 297347 - RNA, 22 nt, Yersinia pestis KIM
gccauuggcauuaaugccuugg

SEQ ID NO: 297348 - RNA, 22 nt, Yersinia pestis KIM
agccaguucuucaucugaugga

SEQ ID NO: 297349 - RNA, 22 nt, Yersinia pestis KIM
uggcucuuuacgaucaagugga

SEQ ID NO: 297350 - RNA, 22 nt, Yersinia pestis KIM
ggauuggauagaugccggaucg

SEQ ID NO: 297351 - RNA, 22 nt, Yersinia pestis KIM
uacauucucgcaaaguuugugc

SEQ ID NO: 297352 - RNA, 19 nt, Yersinia pestis KIM
aguccugaccgguaucgcc

SEQ ID NO: 297353 - RNA, 22 nt, Yersinia pestis KIM
ugguuaucuaugaaggcgagcu

SEQ ID NO: 297354 - RNA, 22 nt, Yersinia pestis KIM
uuguaauguagacaaggagaau

SEQ ID NO: 297355 - RNA, 17 nt, Yersinia pestis KIM
gcugucagucguuugac

SEQ ID NO: 297356 - RNA, 22 nt, Yersinia pestis KIM
aucgggcugagaugcgugccua

SEQ ID NO: 297357 - RNA, 22 nt, Yersinia pestis KIM
acagugauaaaacccgccugca

SEQ ID NO: 297358 - RNA, 22 nt, Yersinia pestis KIM
caggcgauuucgcaaaggcaug

SEQ ID NO: 297359 - RNA, 22 nt, Yersinia pestis KIM
uaccggcaccaaacaguauugc

SEQ ID NO: 297360 - RNA, 22 nt, Yersinia pestis KIM
gauuugccauucgcuugcugcc

SEQ ID NO: 297361 - RNA, 22 nt, Yersinia pestis KIM
uuggcagcaaaccgcggaccca

SEQ ID NO: 297362 - RNA, 22 nt, Yersinia pestis KIM
ugccgugaaaaucaggcaccgg

SEQ ID NO: 297363 - RNA, 22 nt, Yersinia pestis KIM
uuuguagacauuguuauuggua

SEQ ID NO: 297364 - RNA, 22 nt, Yersinia pestis KIM
gcugccagcgcuguuucacggc

SEQ ID NO: 297365 - RNA, 22 nt, Yersinia pestis KIM
caguggauagacauaauggagu

SEQ ID NO: 297366 - RNA, 22 nt, Yersinia pestis KIM
gugaauaaugcuaacaccaucg

SEQ ID NO: 297367 - RNA, 20 nt, Yersinia pestis KIM
aucguuaugccaacaaugau

SEQ ID NO: 297368 - RNA, 22 nt, Yersinia pestis KIM
augccguugaauugaucagacc

SEQ ID NO: 297369 - RNA, 22 nt, Yersinia pestis KIM
aauaacguuagaaaucaacaua

SEQ ID NO: 297370 - RNA, 20 nt, Yersinia pestis KIM
auugucuugaugagauucaa

SEQ ID NO: 297371 - RNA, 22 nt, Yersinia pestis KIM
aaucauguuguagagaaacgaa

SEQ ID NO: 297372 - RNA, 22 nt, Yersinia pestis KIM
caaaucaugauaaaugauggug

SEQ ID NO: 297373 - RNA, 20 nt, Yersinia pestis KIM
caacgcgccgcugcugucgc

SEQ ID NO: 297374 - RNA, 22 nt, Yersinia pestis KIM
aguauuacuguucuugucuggu

SEQ ID NO: 297375 - RNA, 23 nt, Yersinia pestis KIM
uuuaacaguccgguauucgaagu

SEQ ID NO: 297376 - RNA, 22 nt, Yersinia pestis KIM
ucagacagagaggaauaugaac

SEQ ID NO: 297377 - RNA, 22 nt, Yersinia pestis KIM
uggcuuauuucaguuaccugaa

SEQ ID NO: 297378 - RNA, 22 nt, Yersinia pestis KIM
aaggccucugcuucauacagca

SEQ ID NO: 297379 - RNA, 21 nt, Yersinia pestis KIM
ucaaucguggauucugcuccc

SEQ ID NO: 297380 - RNA, 22 nt, Yersinia pestis KIM
cugccgauauuaucgucagaca

SEQ ID NO: 297381 - RNA, 22 nt, Yersinia pestis KIM
ugugaacagagucaacuuuuuu

SEQ ID NO: 297382 - RNA, 22 nt, Yersinia pestis KIM
guuagcuguucucgugcuauuc

SEQ ID NO: 297383 - RNA, 22 nt, Yersinia pestis KIM
gcggucaguaagacuucuuugg

SEQ ID NO: 297384 - RNA, 18 nt, Yersinia pestis KIM
gcucacugauuaacgcac

SEQ ID NO: 297385 - RNA, 22 nt, Yersinia pestis KIM
cgcugaugauuauuacagugcu

SEQ ID NO: 297386 - RNA, 22 nt, Yersinia pestis KIM
aauaacagaaacucagcauuua

SEQ ID NO: 297387 - RNA, 22 nt, Yersinia pestis KIM
ccguugaauaauggucguuuua

SEQ ID NO: 297388 - RNA, 22 nt, Yersinia pestis KIM
agcgcauuuaaaaauaaugauc

SEQ ID NO: 297389 - RNA, 18 nt, Yersinia pestis KIM
guccugaaguuaucaaug

SEQ ID NO: 297390 - RNA, 21 nt, Yersinia pestis KIM
gccgaagauuuugagcugcuu

SEQ ID NO: 297391 - RNA, 22 nt, Yersinia pestis KIM
augcagcaggccugcccggaua

SEQ ID NO: 297392 - RNA, 22 nt, Yersinia pestis KIM
gcgauaacgugacguugcuacg

SEQ ID NO: 297393 - RNA, 17 nt, Yersinia pestis KIM
ugcaaagggcuguaucg

SEQ ID NO: 297394 - RNA, 22 nt, Yersinia pestis KIM
cuuggugcuuagcacgcguuau

SEQ ID NO: 297395 - RNA, 22 nt, Yersinia pestis KIM
ugcacugaaccccagaucuugg

SEQ ID NO: 297396 - RNA, 22 nt, Yersinia pestis KIM
uggccaauaugucccaugagcu

SEQ ID NO: 297397 - RNA, 22 nt, Yersinia pestis KIM
cauggcuuucgugguuugauca

SEQ ID NO: 297398 - RNA, 20 nt, Yersinia pestis KIM
aagcguuuguaguaacguuu

SEQ ID NO: 297399 - RNA, 22 nt, Yersinia pestis KIM
cgugguaugcgccgccagccag

SEQ ID NO: 297400 - RNA, 22 nt, Yersinia pestis KIM
gguaucgguauugaugaauugu

SEQ ID NO: 297401 - RNA, 22 nt, Yersinia pestis KIM
aauggauugauacugaucugau

SEQ ID NO: 297402 - RNA, 22 nt, Yersinia pestis KIM
gcucaugaguuaaugcgucucg

SEQ ID NO: 297403 - RNA, 19 nt, Yersinia pestis KIM
aaaguaccggucgugaaua

SEQ ID NO: 297404 - RNA, 18 nt, Yersinia pestis KIM
uggucaguaaagcggcuu

SEQ ID NO: 297405 - RNA, 22 nt, Yersinia pestis KIM
guaagucgauguugcucacgua

SEQ ID NO: 297406 - RNA, 22 nt, Yersinia pestis KIM
gauauucgcgcagcacagauug

SEQ ID NO: 297407 - RNA, 22 nt, Yersinia pestis KIM
gaacauaggguggcggcuaaaa

SEQ ID NO: 297408 - RNA, 22 nt, Yersinia pestis KIM
agauaauggcauacucguuugg

SEQ ID NO: 297409 - RNA, 22 nt, Yersinia pestis KIM
acacauauuucaggcuguugcg

SEQ ID NO: 297410 - RNA, 22 nt, Yersinia pestis KIM
gcaguaagaauaggcugcucau

SEQ ID NO: 297411 - RNA, 22 nt, Yersinia pestis KIM
gugacuauugauauguugugcg

SEQ ID NO: 297412 - RNA, 22 nt, Yersinia pestis KIM
gugucaaaauagauauuggcca

SEQ ID NO: 297413 - RNA, 22 nt, Yersinia pestis KIM
uacuugaauggaaaucccggcc

SEQ ID NO: 297414 - RNA, 20 nt, Yersinia pestis KIM
agccgcuauuuacggaugcc

SEQ ID NO: 297415 - RNA, 20 nt, Yersinia pestis KIM
uuauagguagaauucgccgc

SEQ ID NO: 297416 - RNA, 22 nt, Yersinia pestis KIM
ggccagauaguccuugaugggc

SEQ ID NO: 297417 - RNA, 22 nt, Yersinia pestis KIM
aauagcgcuaguuuaucaauuu

SEQ ID NO: 297418 - RNA, 22 nt, Yersinia pestis KIM
gcaguagaacuacagccuggac

SEQ ID NO: 297419 - RNA, 22 nt, Yersinia pestis KIM
gauuuagaugcaaucaauagag

SEQ ID NO: 297420 - RNA, 20 nt, Yersinia pestis KIM
auggucaaucaguuccugcg

SEQ ID NO: 297421 - RNA, 22 nt, Yersinia pestis KIM
ucaguaagaggggacaggguau

SEQ ID NO: 297422 - RNA, 22 nt, Yersinia pestis KIM
cuggcgaguugagggagucugu

SEQ ID NO: 297423 - RNA, 22 nt, Yersinia pestis KIM
cgcggcuaaugagagacuuuaa

SEQ ID NO: 297424 - RNA, 22 nt, Yersinia pestis KIM
ucgccagcuaucagagcgguca

SEQ ID NO: 297425 - RNA, 22 nt, Yersinia pestis KIM
gucaguuuccugcucuguucca

SEQ ID NO: 297426 - RNA, 22 nt, Yersinia pestis KIM
aacgacuggcgucacuggauaa

SEQ ID NO: 297427 - RNA, 22 nt, Yersinia pestis KIM
aguugcugauugcucaaccagc

SEQ ID NO: 297428 - RNA, 21 nt, Yersinia pestis KIM
gccguucaagaggcuuuauua

SEQ ID NO: 297429 - RNA, 22 nt, Yersinia pestis KIM
acggguaacgguggcguaaugc

SEQ ID NO: 297430 - RNA, 22 nt, Yersinia pestis KIM
ccgcgguugagauugcggauga

SEQ ID NO: 297431 - RNA, 22 nt, Yersinia pestis KIM
cgauugguugguaccgccaggg

SEQ ID NO: 297432 - RNA, 22 nt, Yersinia pestis KIM
ugcuacaccugcacagcgugaa

SEQ ID NO: 297433 - RNA, 22 nt, Yersinia pestis KIM
agauggcaucguuggcgacauu

SEQ ID NO: 297434 - RNA, 18 nt, Yersinia pestis KIM
uggcccaacucucuuaau

SEQ ID NO: 297435 - RNA, 22 nt, Yersinia pestis KIM
uugcugaugaaugguuagcuua

SEQ ID NO: 297436 - RNA, 22 nt, Yersinia pestis KIM
uaugcucaacggagccaaucga

SEQ ID NO: 297437 - RNA, 22 nt, Yersinia pestis KIM
guggcgaugcuggcaaugcugg

SEQ ID NO: 297438 - RNA, 22 nt, Yersinia pestis KIM
ucagugaacucgaugauaauca

SEQ ID NO: 297439 - RNA, 22 nt, Yersinia pestis KIM
uucauaggcgguuaagguucgg

SEQ ID NO: 297440 - RNA, 22 nt, Yersinia pestis KIM
aggccacugucagcugaacuga

SEQ ID NO: 297441 - RNA, 19 nt, Yersinia pestis KIM
gccgucgaaacgcugcaac

SEQ ID NO: 297442 - RNA, 22 nt, Yersinia pestis KIM
augcggugggugugauugguuu

SEQ ID NO: 297443 - RNA, 22 nt, Yersinia pestis KIM
gcggcguuucuucaugauugca

SEQ ID NO: 297444 - RNA, 22 nt, Yersinia pestis KIM
aacaucagcacuggugagauua

SEQ ID NO: 297445 - RNA, 22 nt, Yersinia pestis KIM
acguuggcaauagugccgucca

SEQ ID NO: 297446 - RNA, 20 nt, Yersinia pestis KIM
cugaauuagaagcauuaauu

SEQ ID NO: 297447 - RNA, 22 nt, Yersinia pestis KIM
uggcuauugaugggcaauaugu

SEQ ID NO: 297448 - RNA, 17 nt, Yersinia pestis KIM
gcagaacuuacgguuaa

SEQ ID NO: 297449 - RNA, 22 nt, Yersinia pestis KIM
ucgcaguggggggcacggucca

SEQ ID NO: 297450 - RNA, 22 nt, Yersinia pestis KIM
cguaauggcagaagccgguggu

SEQ ID NO: 297451 - RNA, 22 nt, Yersinia pestis KIM
cgccgguuucaagcgucaggua

SEQ ID NO: 297452 - RNA, 22 nt, Yersinia pestis KIM
gucaaauugaccgaugcugauc

SEQ ID NO: 297453 - RNA, 22 nt, Yersinia pestis KIM
caguucauugccagugaagaca

SEQ ID NO: 297454 - RNA, 22 nt, Yersinia pestis KIM
gcccaugaccguuuugguggcu

SEQ ID NO: 297455 - RNA, 22 nt, Yersinia pestis KIM
gaagauccgcuggggauggaag

SEQ ID NO: 297456 - RNA, 22 nt, Yersinia pestis KIM
ccuggcucauuucuucacucca

SEQ ID NO: 297457 - RNA, 22 nt, Yersinia pestis KIM
aggcgcuguugcgccaguuggc

SEQ ID NO: 297458 - RNA, 22 nt, Yersinia pestis KIM
ucguauaccauaaugcgcugua

SEQ ID NO: 297459 - RNA, 22 nt, Yersinia pestis KIM
ccugacuauugccgcagcgauu

SEQ ID NO: 297460 - RNA, 21 nt, Yersinia pestis KIM
acgcugaucagugucaguuuc

SEQ ID NO: 297461 - RNA, 19 nt, Yersinia pestis KIM
ggugaauauucaucgguug

SEQ ID NO: 297462 - RNA, 22 nt, Yersinia pestis KIM
gugcaguaucgaucugagcuug

SEQ ID NO: 297463 - RNA, 22 nt, Yersinia pestis KIM
agauuaagcgccucaaacaggc

SEQ ID NO: 297464 - RNA, 22 nt, Yersinia pestis KIM
ggccuucagaaugcugacaaac

SEQ ID NO: 297465 - RNA, 18 nt, Yersinia pestis KIM
augguucguuuccugcgu

SEQ ID NO: 297466 - RNA, 22 nt, Yersinia pestis KIM
cugcgggaauggcaagugcuua

SEQ ID NO: 297467 - RNA, 22 nt, Yersinia pestis KIM
auaggcaacuucaauuaugcgg

SEQ ID NO: 297468 - RNA, 22 nt, Yersinia pestis KIM
ugcugggcauugagccguuauu

SEQ ID NO: 297469 - RNA, 23 nt, Yersinia pestis KIM
uguacgcgauauuugucaccuac

SEQ ID NO: 297470 - RNA, 22 nt, Yersinia pestis KIM
uauugcgcuuuuguuagcgggu

SEQ ID NO: 297471 - RNA, 22 nt, Yersinia pestis KIM
agugcacugaaccccagaucuu

SEQ ID NO: 297472 - RNA, 22 nt, Yersinia pestis KIM
agcguugcacguaugcugaauu

SEQ ID NO: 297473 - RNA, 22 nt, Yersinia pestis KIM
ucaguuguuccugacgccuguu

SEQ ID NO: 297474 - RNA, 22 nt, Yersinia pestis KIM
gcguaacaaauuacucacugaa

SEQ ID NO: 297475 - RNA, 22 nt, Yersinia pestis KIM
agauuucagacugcugacaacc

SEQ ID NO: 297476 - RNA, 21 nt, Yersinia pestis KIM
uaacagggcuaguucagcucg

SEQ ID NO: 297477 - RNA, 22 nt, Yersinia pestis KIM
cauauucgucaacguaguagga

SEQ ID NO: 297478 - RNA, 22 nt, Yersinia pestis KIM
uucacugaguguuugcaguaau

SEQ ID NO: 297479 - RNA, 22 nt, Yersinia pestis KIM
aacccguugaaguugggcaaau

SEQ ID NO: 297480 - RNA, 22 nt, Yersinia pestis KIM
gccgguauuggcguuugauaug

SEQ ID NO: 297481 - RNA, 21 nt, Yersinia pestis KIM
ccagaagcguuagcgcugguu

SEQ ID NO: 297482 - RNA, 22 nt, Yersinia pestis KIM
gccagagacaaugucgacgacg

SEQ ID NO: 297483 - RNA, 22 nt, Yersinia pestis KIM
gaagcaguuuccaaugagaaau

SEQ ID NO: 297484 - RNA, 21 nt, Yersinia pestis KIM
ugccacucuagcgaccgaaga

SEQ ID NO: 297485 - RNA, 22 nt, Yersinia pestis KIM
ucgaauugaauggucagaaaau

SEQ ID NO: 297486 - RNA, 20 nt, Yersinia pestis KIM
ucacucacuuauucgccugu

SEQ ID NO: 297487 - RNA, 22 nt, Yersinia pestis KIM
uaccgcucagaaacguuuagau

SEQ ID NO: 297488 - RNA, 22 nt, Yersinia pestis KIM
ggacgaucagguuuugcucauu

SEQ ID NO: 297489 - RNA, 22 nt, Yersinia pestis KIM
cuugauaccgaugguggauuuc

SEQ ID NO: 297490 - RNA, 22 nt, Yersinia pestis KIM
uugcuugcgcgagacgaaggga

SEQ ID NO: 297491 - RNA, 22 nt, Yersinia pestis KIM
uugcgaccaucacccugacugc

SEQ ID NO: 297492 - RNA, 22 nt, Yersinia pestis KIM
uggaugaagugcagucaauuug

SEQ ID NO: 297493 - RNA, 22 nt, Yersinia pestis KIM
acgugcuauuggugaagugggg

SEQ ID NO: 297494 - RNA, 22 nt, Yersinia pestis KIM
uuaccgauuuucaacgucagcu

SEQ ID NO: 297495 - RNA, 22 nt, Yersinia pestis KIM
uauccauauagcuguucagggu

SEQ ID NO: 297496 - RNA, 22 nt, Yersinia pestis KIM
gaugauguucuucaaaacaaag

SEQ ID NO: 297497 - RNA, 22 nt, Yersinia pestis KIM
auaccggaagagcuaacgacag

SEQ ID NO: 297498 - RNA, 22 nt, Yersinia pestis KIM
gagugaugauugaaacacaggu

SEQ ID NO: 297499 - RNA, 22 nt, Yersinia pestis KIM
guuuaucugcugauuaccaacg

SEQ ID NO: 297500 - RNA, 22 nt, Yersinia pestis KIM
ccgccauugggcgaucuuugau

SEQ ID NO: 297501 - RNA, 22 nt, Yersinia pestis KIM
uauaggugguguuaccgguguu

SEQ ID NO: 297502 - RNA, 22 nt, Yersinia pestis KIM
ggaucugaacauucuccggcaa

SEQ ID NO: 297503 - RNA, 22 nt, Yersinia pestis KIM
gcugcugggauguuucgaugau

SEQ ID NO: 297504 - RNA, 22 nt, Yersinia pestis KIM
uuugccgauaauuaacauaagc

SEQ ID NO: 297505 - RNA, 20 nt, Yersinia pestis KIM
ccgcgucaaucugauuggcg

SEQ ID NO: 297506 - RNA, 22 nt, Yersinia pestis KIM
uggccuggguguggaugccuuu

SEQ ID NO: 297507 - RNA, 22 nt, Yersinia pestis KIM
cgcaaucacaaugaccguuuug

SEQ ID NO: 297508 - RNA, 22 nt, Yersinia pestis KIM
agagauguggcgcgaucaguuc

SEQ ID NO: 297509 - RNA, 22 nt, Yersinia pestis KIM
cauugaaucggaucggugaauc

SEQ ID NO: 297510 - RNA, 22 nt, Yersinia pestis KIM
uuaccgucuacccguggaagcg

SEQ ID NO: 297511 - RNA, 22 nt, Yersinia pestis KIM
uuugccguguuggguaacgugg

SEQ ID NO: 297512 - RNA, 22 nt, Yersinia pestis KIM
auuucgaaguguacugggcggc

SEQ ID NO: 297513 - RNA, 20 nt, Yersinia pestis KIM
caguuaauggaaaaagcguu

SEQ ID NO: 297514 - RNA, 22 nt, Yersinia pestis KIM
auaagguugccagucggucgcc

SEQ ID NO: 297515 - RNA, 22 nt, Yersinia pestis KIM
gucaguuaucugcgucgcuugc

SEQ ID NO: 297516 - RNA, 22 nt, Yersinia pestis KIM
cgguggucucccuugaugguuu

SEQ ID NO: 297517 - RNA, 22 nt, Yersinia pestis KIM
cugguuaaugagcgcccgauug

SEQ ID NO: 297518 - RNA, 22 nt, Yersinia pestis KIM
ugcucagugggcuuaucgcccu

SEQ ID NO: 297519 - RNA, 22 nt, Yersinia pestis KIM
uggugcuauuaauggggcuugc

SEQ ID NO: 297520 - RNA, 20 nt, Yersinia pestis KIM
ugcuggcacugaugggggca

SEQ ID NO: 297521 - RNA, 22 nt, Yersinia pestis KIM
auucgcuguucgggaguaagag

SEQ ID NO: 297522 - RNA, 22 nt, Yersinia pestis KIM
ccaguggcaccacaccgaaacu

SEQ ID NO: 297523 - RNA, 22 nt, Yersinia pestis KIM
aaacucggccuuucagucaugc

SEQ ID NO: 297524 - RNA, 22 nt, Yersinia pestis KIM
gugcucuucaauauuaauuuua

SEQ ID NO: 297525 - RNA, 22 nt, Yersinia pestis KIM
aggugagcagcaccaaacgguu

SEQ ID NO: 297526 - RNA, 22 nt, Yersinia pestis KIM
uuagccauaccaugacugacac

SEQ ID NO: 297527 - RNA, 22 nt, Yersinia pestis KIM
ucugaauucuccgaaauugugg

SEQ ID NO: 297528 - RNA, 22 nt, Yersinia pestis KIM
cggugagcgaugauaaucaccg

SEQ ID NO: 297529 - RNA, 22 nt, Yersinia pestis KIM
ucucaaauuagaaaaugccgcu

SEQ ID NO: 297530 - RNA, 22 nt, Yersinia pestis KIM
uucgccaaucagauugacgcgg

SEQ ID NO: 297531 - RNA, 22 nt, Yersinia pestis KIM
aaaguuguucaaccaucauguc

SEQ ID NO: 297532 - RNA, 22 nt, Yersinia pestis KIM
agguaguguuguaacagcgggu

SEQ ID NO: 297533 - RNA, 22 nt, Yersinia pestis KIM
aggcgcauaugaaaaaccuccg

SEQ ID NO: 297534 - RNA, 22 nt, Yersinia pestis KIM
uggcaggagguucucguucagg

SEQ ID NO: 297535 - RNA, 22 nt, Yersinia pestis KIM
gaguugcugcaaaaacuggcag

SEQ ID NO: 297536 - RNA, 22 nt, Yersinia pestis KIM
uugcugaaauuaggcuucaccg

SEQ ID NO: 297537 - RNA, 21 nt, Yersinia pestis KIM
cugcagugaaugaccgccuac

SEQ ID NO: 297538 - RNA, 22 nt, Yersinia pestis KIM
aaucggugcugacaccacagga

SEQ ID NO: 297539 - RNA, 22 nt, Yersinia pestis KIM
gcuuaugcauuaggugcgucuu

SEQ ID NO: 297540 - RNA, 17 nt, Yersinia pestis KIM
aaacggcuucagugauu

SEQ ID NO: 297541 - RNA, 22 nt, Yersinia pestis KIM
ucuggcugagcguaucagcgaa

SEQ ID NO: 297542 - RNA, 22 nt, Yersinia pestis KIM
cgccaacguuccaugccugagc

SEQ ID NO: 297543 - RNA, 21 nt, Yersinia pestis KIM
caugaugauguccacucucgc

SEQ ID NO: 297544 - RNA, 22 nt, Yersinia pestis KIM
gccacgauccccgguuuacuua

SEQ ID NO: 297545 - RNA, 22 nt, Yersinia pestis KIM
cguccgaagggcgcuuugugua

SEQ ID NO: 297546 - RNA, 22 nt, Yersinia pestis KIM
guggcacaucuggucgcguugc

SEQ ID NO: 297547 - RNA, 22 nt, Yersinia pestis KIM
auggauggcaaguuaacgugcu

SEQ ID NO: 297548 - RNA, 22 nt, Yersinia pestis KIM
uaccgcuuuaccccgcugcaaa

SEQ ID NO: 297549 - RNA, 22 nt, Yersinia pestis KIM
ggucaauagauguuuggcaggu

SEQ ID NO: 297550 - RNA, 22 nt, Yersinia pestis KIM
caucaagaugcacgucauacuc

SEQ ID NO: 297551 - RNA, 22 nt, Yersinia pestis KIM
gaacgugauccgcagcguuucc

SEQ ID NO: 297552 - RNA, 22 nt, Yersinia pestis KIM
gggauaacaccgauccgcuggc

SEQ ID NO: 297553 - RNA, 21 nt, Yersinia pestis KIM
aagugauucggguuauugagc

SEQ ID NO: 297554 - RNA, 20 nt, Yersinia pestis KIM
cagcauggaucccagcggcu

SEQ ID NO: 297555 - RNA, 22 nt, Yersinia pestis KIM
ucgcaaagcgaugaucacggca

SEQ ID NO: 297556 - RNA, 22 nt, Yersinia pestis KIM
cucggcaaguugugguaggaag

SEQ ID NO: 297557 - RNA, 22 nt, Yersinia pestis KIM
ugauaucucugcaucaacauag

SEQ ID NO: 297558 - RNA, 22 nt, Yersinia pestis KIM
uuguucaauggcgauuuguuca

SEQ ID NO: 297559 - RNA, 22 nt, Yersinia pestis KIM
cugcgucuaugacaucacuaac

SEQ ID NO: 297560 - RNA, 22 nt, Yersinia pestis KIM
uuggcuaacguugccguguuac

SEQ ID NO: 297561 - RNA, 22 nt, Yersinia pestis KIM
ccagcauucauuuuggggaugu

SEQ ID NO: 297562 - RNA, 19 nt, Yersinia pestis KIM
uugugcacugccaucggcc

SEQ ID NO: 297563 - RNA, 22 nt, Yersinia pestis KIM
aauggcagauaucgcaacaauc

SEQ ID NO: 297564 - RNA, 20 nt, Yersinia pestis KIM
ucaauuaggagccgugccca

SEQ ID NO: 297565 - RNA, 18 nt, Yersinia pestis KIM
gugccgaucaccgggugc

SEQ ID NO: 297566 - RNA, 22 nt, Yersinia pestis KIM
guugucauccaauuggucgcca

SEQ ID NO: 297567 - RNA, 22 nt, Yersinia pestis KIM
aguugagcuucaugcacuguug

SEQ ID NO: 297568 - RNA, 22 nt, Yersinia pestis KIM
auguuaucaaggcgcuauuuga

SEQ ID NO: 297569 - RNA, 22 nt, Yersinia pestis KIM
ucagccaaguacagaagaaauu

SEQ ID NO: 297570 - RNA, 22 nt, Yersinia pestis KIM
agucuucgcuggcagugccuau

SEQ ID NO: 297571 - RNA, 22 nt, Yersinia pestis KIM
aaugacugagauuauuaacagu

SEQ ID NO: 297572 - RNA, 22 nt, Yersinia pestis KIM
ucaacaucguaccugaacgauc

SEQ ID NO: 297573 - RNA, 21 nt, Yersinia pestis KIM
caguuuacauuacgagggcuu

SEQ ID NO: 297574 - RNA, 22 nt, Yersinia pestis KIM
uacucuguuagcgguguaucug

SEQ ID NO: 297575 - RNA, 22 nt, Yersinia pestis KIM
aagccuuuauugaaugcaucca

SEQ ID NO: 297576 - RNA, 22 nt, Yersinia pestis KIM
uggcuuaauuuggguaagaccu

SEQ ID NO: 297577 - RNA, 22 nt, Yersinia pestis KIM
gcucuggcccaaaguauguuua

SEQ ID NO: 297578 - RNA, 22 nt, Yersinia pestis KIM
agcgauaaaccgguaugcagga

SEQ ID NO: 297579 - RNA, 22 nt, Yersinia pestis KIM
cacgcgcuaacguuucucaggu

SEQ ID NO: 297580 - RNA, 22 nt, Yersinia pestis KIM
gugauucagcuucugcgcuugc

SEQ ID NO: 297581 - RNA, 22 nt, Yersinia pestis KIM
gcgucguuuuuagugucgcaau

SEQ ID NO: 297582 - RNA, 22 nt, Yersinia pestis KIM
gcggguauuggcgcauuuauug

SEQ ID NO: 297583 - RNA, 22 nt, Yersinia pestis KIM
aaacacugaaucuccaacagcg

SEQ ID NO: 297584 - RNA, 22 nt, Yersinia pestis KIM
accaagguuuaugguuuucaau

SEQ ID NO: 297585 - RNA, 21 nt, Yersinia pestis KIM
acgcagccgauagagaccgcu

SEQ ID NO: 297586 - RNA, 22 nt, Yersinia pestis KIM
gguuaucgguggucuaaaaaaa

SEQ ID NO: 297587 - RNA, 19 nt, Yersinia pestis KIM
aauaccauauauucccucu

SEQ ID NO: 297588 - RNA, 22 nt, Yersinia pestis KIM
gucauugcuuugauacggcugg

SEQ ID NO: 297589 - RNA, 22 nt, Yersinia pestis KIM
ggguauuacggucugcauccaa

SEQ ID NO: 297590 - RNA, 22 nt, Yersinia pestis KIM
cagccagccauugcaggucgau

SEQ ID NO: 297591 - RNA, 22 nt, Yersinia pestis KIM
auaaacaggcgggucgguaacu

SEQ ID NO: 297592 - RNA, 22 nt, Yersinia pestis KIM
auggcugauuuuucuggagcgg

SEQ ID NO: 297593 - RNA, 22 nt, Yersinia pestis KIM
gaugcgcugggaccaacuauuu

SEQ ID NO: 297594 - RNA, 22 nt, Yersinia pestis KIM
aucgccgaacugauuguggaca

SEQ ID NO: 297595 - RNA, 18 nt, Yersinia pestis KIM
cggcguaacuggccguua

SEQ ID NO: 297596 - RNA, 22 nt, Yersinia pestis KIM
acuggaguggaucuaucgcuug

SEQ ID NO: 297597 - RNA, 23 nt, Yersinia pestis KIM
aaacgguguucuguuuuuuaugg

SEQ ID NO: 297598 - RNA, 22 nt, Yersinia pestis KIM
cgggaaauagugaguucgucgc

SEQ ID NO: 297599 - RNA, 19 nt, Yersinia pestis KIM
acguuaucuugguuugacc

SEQ ID NO: 297600 - RNA, 22 nt, Yersinia pestis KIM
ugccaccgguauuuggacauuc

SEQ ID NO: 297601 - RNA, 22 nt, Yersinia pestis KIM
ucguucagugaucaccuaauca

SEQ ID NO: 297602 - RNA, 22 nt, Yersinia pestis KIM
auuaucgcuuguuaauaaaugu

SEQ ID NO: 297603 - RNA, 22 nt, Yersinia pestis KIM
gcguugagcgccgcuugcaccg

SEQ ID NO: 297604 - RNA, 22 nt, Yersinia pestis KIM
ugauauugcuggcgugcgucug

SEQ ID NO: 297605 - RNA, 22 nt, Yersinia pestis KIM
ugccaucuuaaucgcagccaga

SEQ ID NO: 297606 - RNA, 22 nt, Yersinia pestis KIM
aaguaaugcgggugugagugcu

SEQ ID NO: 297607 - RNA, 22 nt, Yersinia pestis KIM
guagcgggugaauucaaggcuu

SEQ ID NO: 297608 - RNA, 22 nt, Yersinia pestis KIM
uggcggauuauagauggugagg

SEQ ID NO: 297609 - RNA, 22 nt, Yersinia pestis KIM
auccugcguacugagcgacggu

SEQ ID NO: 297610 - RNA, 22 nt, Yersinia pestis KIM
ucaguugaucaacuuuagcguu

SEQ ID NO: 297611 - RNA, 22 nt, Yersinia pestis KIM
ucgcuuguggugcuaucucugg

SEQ ID NO: 297612 - RNA, 22 nt, Yersinia pestis KIM
gauuggcuggcacagcgugaug

SEQ ID NO: 297613 - RNA, 22 nt, Yersinia pestis KIM
ugguuucacuuuggcgggugcu

SEQ ID NO: 297614 - RNA, 22 nt, Yersinia pestis KIM
gcauuuaguugccgaacgaucc

SEQ ID NO: 297615 - RNA, 22 nt, Yersinia pestis KIM
auggcacgauccacgccgcggg

SEQ ID NO: 297616 - RNA, 22 nt, Yersinia pestis KIM
cccgacaugaccuccagcauau

SEQ ID NO: 297617 - RNA, 22 nt, Yersinia pestis KIM
gagcaacgucucggccauuauu

SEQ ID NO: 297618 - RNA, 22 nt, Yersinia pestis KIM
cggcgaucucaugguggugucu

SEQ ID NO: 297619 - RNA, 22 nt, Yersinia pestis KIM
aucgaaaugguagucaaacaau

SEQ ID NO: 297620 - RNA, 22 nt, Yersinia pestis KIM
gucaguuuuauuuggcccgcuc

SEQ ID NO: 297621 - RNA, 22 nt, Yersinia pestis KIM
auggcaagagaguggccgcugg

SEQ ID NO: 297622 - RNA, 22 nt, Yersinia pestis KIM
gagggauuuuugcaguaguccu

SEQ ID NO: 297623 - RNA, 21 nt, Yersinia pestis KIM
uaucaagguacaagacccuga

SEQ ID NO: 297624 - RNA, 22 nt, Yersinia pestis KIM
uacuggaagccagagcagggau

SEQ ID NO: 297625 - RNA, 22 nt, Yersinia pestis KIM
uaaucguuugcuaagcacgaaa

SEQ ID NO: 297626 - RNA, 22 nt, Yersinia pestis KIM
ugagcuggcgccgaaagcgguc

SEQ ID NO: 297627 - RNA, 17 nt, Yersinia pestis KIM
ccgcucuggcacuaucu

SEQ ID NO: 297628 - RNA, 22 nt, Yersinia pestis KIM
cgucagugcgcaguaagaccuu

SEQ ID NO: 297629 - RNA, 22 nt, Yersinia pestis KIM
aaguuaugguucuggacaucga

SEQ ID NO: 297630 - RNA, 22 nt, Yersinia pestis KIM
ugaagauggcuaugaugcacug

SEQ ID NO: 297631 - RNA, 22 nt, Yersinia pestis KIM
ccuuacauccgauagccgguca

SEQ ID NO: 297632 - RNA, 22 nt, Yersinia pestis KIM
gcuggcuuaaugaucaagcggc

SEQ ID NO: 297633 - RNA, 22 nt, Yersinia pestis KIM
uugccgguuauuuugcauucac

SEQ ID NO: 297634 - RNA, 22 nt, Yersinia pestis KIM
gccaaaucauugugacuaguuu

SEQ ID NO: 297635 - RNA, 22 nt, Yersinia pestis KIM
uuggccauaacacaauauuagu

SEQ ID NO: 297636 - RNA, 22 nt, Yersinia pestis KIM
ggcaauccgacagaugacccaa

SEQ ID NO: 297637 - RNA, 22 nt, Yersinia pestis KIM
aagcgcuggauccggauucauu

SEQ ID NO: 297638 - RNA, 22 nt, Yersinia pestis KIM
auugaucugauuuuacugaaag

SEQ ID NO: 297639 - RNA, 22 nt, Yersinia pestis KIM
cacugcccaucgucagucauca

SEQ ID NO: 297640 - RNA, 22 nt, Yersinia pestis KIM
augaucuggagguucgguucaa

SEQ ID NO: 297641 - RNA, 22 nt, Yersinia pestis KIM
auucauucuguggauucaugac

SEQ ID NO: 297642 - RNA, 22 nt, Yersinia pestis KIM
cuuggcugaaguuaaucucaau

SEQ ID NO: 297643 - RNA, 22 nt, Yersinia pestis KIM
auuuggacaucccggcguuuuu

SEQ ID NO: 297644 - RNA, 22 nt, Yersinia pestis KIM
ccugacauaggcuagcugauaa

SEQ ID NO: 297645 - RNA, 22 nt, Yersinia pestis KIM
agguaaugauuuuguagccagc

SEQ ID NO: 297646 - RNA, 22 nt, Yersinia pestis KIM
uacugcaucauguuugcugauu

SEQ ID NO: 297647 - RNA, 17 nt, Yersinia pestis KIM
ucauggcccagucugag

SEQ ID NO: 297648 - RNA, 23 nt, Yersinia pestis KIM
aaaggccgcgacgaucgacguuu

SEQ ID NO: 297649 - RNA, 22 nt, Yersinia pestis KIM
uccauugaacccgugucauuaa

SEQ ID NO: 297650 - RNA, 22 nt, Yersinia pestis KIM
gggcacaagaagcaaucgggau

SEQ ID NO: 297651 - RNA, 22 nt, Yersinia pestis KIM
aaugacaguguuacccgagaga

SEQ ID NO: 297652 - RNA, 22 nt, Yersinia pestis KIM
ugccaagcgcuuuggcaauuuc

SEQ ID NO: 297653 - RNA, 22 nt, Yersinia pestis KIM
auugaauccaugcuaaaccggu

SEQ ID NO: 297654 - RNA, 22 nt, Yersinia pestis KIM
auuugucauuauuuaugagcgu

SEQ ID NO: 297655 - RNA, 22 nt, Yersinia pestis KIM
acugguugcgcaauaugggaua

SEQ ID NO: 297656 - RNA, 22 nt, Yersinia pestis KIM
cuuugucaauacccugaaggcc

SEQ ID NO: 297657 - RNA, 22 nt, Yersinia pestis KIM
aguaacguuagucauuaaucag

SEQ ID NO: 297658 - RNA, 22 nt, Yersinia pestis KIM
agacugaugcaagauggcggua

SEQ ID NO: 297659 - RNA, 22 nt, Yersinia pestis KIM
uuaaggauugucauuagucgcg

SEQ ID NO: 297660 - RNA, 22 nt, Yersinia pestis KIM
agcgcauuaaccacuggauagu

SEQ ID NO: 297661 - RNA, 22 nt, Yersinia pestis KIM
ccgguauuaaagcggcaucacc

SEQ ID NO: 297662 - RNA, 22 nt, Yersinia pestis KIM
ucaccagagacguaucuuuuuc

SEQ ID NO: 297663 - RNA, 22 nt, Yersinia pestis KIM
aauaagcgaauuugguugucau

SEQ ID NO: 297664 - RNA, 22 nt, Yersinia pestis KIM
ucaauguucgucgugagggcga

SEQ ID NO: 297665 - RNA, 22 nt, Yersinia pestis KIM
agguuaaucacaucguuacuuu

SEQ ID NO: 297666 - RNA, 22 nt, Yersinia pestis KIM
acaaggucugaaugccgauaug

SEQ ID NO: 297667 - RNA, 22 nt, Yersinia pestis KIM
aaucacuuuggcuuccaguuuu

SEQ ID NO: 297668 - RNA, 22 nt, Yersinia pestis KIM
ccugacuuucuguuguguuggu

SEQ ID NO: 297669 - RNA, 22 nt, Yersinia pestis KIM
gcacuauauuccgaugaauaug

SEQ ID NO: 297670 - RNA, 20 nt, Yersinia pestis KIM
ucagaugaaucggggagcgc

SEQ ID NO: 297671 - RNA, 22 nt, Yersinia pestis KIM
ggcaaauaucagguuuggggug

SEQ ID NO: 297672 - RNA, 22 nt, Yersinia pestis KIM
aaacaguuuggcgauuaucgca

SEQ ID NO: 297673 - RNA, 22 nt, Yersinia pestis KIM
caucaauauagcguauugaauc

SEQ ID NO: 297674 - RNA, 22 nt, Yersinia pestis KIM
aucuggcucacgauaucuuugc

SEQ ID NO: 297675 - RNA, 22 nt, Yersinia pestis KIM
uugcugaccccaaauuauuuua

SEQ ID NO: 297676 - RNA, 19 nt, Yersinia pestis KIM
cgguuaugacccucuggcc

SEQ ID NO: 297677 - RNA, 22 nt, Yersinia pestis KIM
acgugguuaaguccagcgucgg

SEQ ID NO: 297678 - RNA, 22 nt, Yersinia pestis KIM
cucgucaauuaccugauuacug

SEQ ID NO: 297679 - RNA, 22 nt, Yersinia pestis KIM
acgguugucugugggaagaggu

SEQ ID NO: 297680 - RNA, 22 nt, Yersinia pestis KIM
cguauucugacgauaaguagcc

SEQ ID NO: 297681 - RNA, 22 nt, Yersinia pestis KIM
ucacuugggugcauuggaugaa

SEQ ID NO: 297682 - RNA, 22 nt, Yersinia pestis KIM
aaguggcuaucggcggcaagcg

SEQ ID NO: 297683 - RNA, 20 nt, Yersinia pestis KIM
ugcuguaacaugacuuauag

SEQ ID NO: 297684 - RNA, 22 nt, Yersinia pestis KIM
gcgccaguuccccuuccaggcu

SEQ ID NO: 297685 - RNA, 22 nt, Yersinia pestis KIM
uaucgccgucauugguucuuga

SEQ ID NO: 297686 - RNA, 22 nt, Yersinia pestis KIM
guggaaauuaucgaguuaccag

SEQ ID NO: 297687 - RNA, 22 nt, Yersinia pestis KIM
guucauugcuauucugcaucgc

SEQ ID NO: 297688 - RNA, 22 nt, Yersinia pestis KIM
uugucucauuuauugauaguga

SEQ ID NO: 297689 - RNA, 22 nt, Yersinia pestis KIM
ugaaacagcgcuggcagcagca

SEQ ID NO: 297690 - RNA, 22 nt, Yersinia pestis KIM
gguuaagcgguugacugagaug

SEQ ID NO: 297691 - RNA, 22 nt, Yersinia pestis KIM
auaacgcuauucauauggccag

SEQ ID NO: 297692 - RNA, 22 nt, Yersinia pestis KIM
augaaacuguaaauaagucugu

SEQ ID NO: 297693 - RNA, 22 nt, Yersinia pestis KIM
gagcagcaugaucaacaguuga

SEQ ID NO: 297694 - RNA, 22 nt, Yersinia pestis KIM
uagguauaucugugacaccucc

SEQ ID NO: 297695 - RNA, 22 nt, Yersinia pestis KIM
cauugaaauagaauaaugucuc

SEQ ID NO: 297696 - RNA, 22 nt, Yersinia pestis KIM
gccguguaaaugcacaacaagc

SEQ ID NO: 297697 - RNA, 22 nt, Yersinia pestis KIM
uacuugaaucuauuaugauagu

SEQ ID NO: 297698 - RNA, 22 nt, Yersinia pestis KIM
uagacagacacgcgccauugcc

SEQ ID NO: 297699 - RNA, 22 nt, Yersinia pestis KIM
gcaaagcgaaaugaauaauguc

SEQ ID NO: 297700 - RNA, 22 nt, Yersinia pestis KIM
ccguacuuggcacaaucugcca

SEQ ID NO: 297701 - RNA, 22 nt, Yersinia pestis KIM
uuuggcaccuuggauuuuggau

SEQ ID NO: 297702 - RNA, 22 nt, Yersinia pestis KIM
auuagcagugaugguuauuuau

SEQ ID NO: 297703 - RNA, 22 nt, Yersinia pestis KIM
acggcaaauauguucuggcugg

SEQ ID NO: 297704 - RNA, 22 nt, Yersinia pestis KIM
cuggcugauggcccuaaggcag

SEQ ID NO: 297705 - RNA, 22 nt, Yersinia pestis KIM
ugucuuuaaccuugauaccaga

SEQ ID NO: 297706 - RNA, 22 nt, Yersinia pestis KIM
cgcagaaauauucagagaggcg

SEQ ID NO: 297707 - RNA, 22 nt, Yersinia pestis KIM
cgcggguaacuuccuacacaug

SEQ ID NO: 297708 - RNA, 22 nt, Yersinia pestis KIM
cauuacugauaguuuguugcgu

SEQ ID NO: 297709 - RNA, 22 nt, Yersinia pestis KIM
aauggugcggcgaugaagucgc

SEQ ID NO: 297710 - RNA, 22 nt, Yersinia pestis KIM
uuggcagucaggccaggaugcu

SEQ ID NO: 297711 - RNA, 22 nt, Yersinia pestis KIM
aauaugcagcuugaacuggcca

SEQ ID NO: 297712 - RNA, 22 nt, Yersinia pestis KIM
cuggcggaucauugcuaccgcg

SEQ ID NO: 297713 - RNA, 22 nt, Yersinia pestis KIM
gaacuugggaucagacagauau

SEQ ID NO: 297714 - RNA, 22 nt, Yersinia pestis KIM
aauugcgggaugauaaacaucg

SEQ ID NO: 297715 - RNA, 22 nt, Yersinia pestis KIM
uaaccguaugcgccagcagggg

SEQ ID NO: 297716 - RNA, 22 nt, Yersinia pestis KIM
aucauugauggcguacgguuau

SEQ ID NO: 297717 - RNA, 22 nt, Yersinia pestis KIM
auacuccugccggcugacaggu

SEQ ID NO: 297718 - RNA, 22 nt, Yersinia pestis KIM
gccggugucgagaucauuggcg

SEQ ID NO: 297719 - RNA, 22 nt, Yersinia pestis KIM
gugcauggcguugcugcagaua

SEQ ID NO: 297720 - RNA, 22 nt, Yersinia pestis KIM
ccaauugagcaccguagcuuug

SEQ ID NO: 297721 - RNA, 22 nt, Yersinia pestis KIM
uaccgccgucagguucaggugu

SEQ ID NO: 297722 - RNA, 19 nt, Yersinia pestis KIM
aacagcagggcauuauccc

SEQ ID NO: 297723 - RNA, 22 nt, Yersinia pestis KIM
caaucaugauauggcgagcccc

SEQ ID NO: 297724 - RNA, 22 nt, Yersinia pestis KIM
uauuacacaaucuggauaucaa

SEQ ID NO: 297725 - RNA, 22 nt, Yersinia pestis KIM
uugauacgaagaaggauuucaa

SEQ ID NO: 297726 - RNA, 22 nt, Yersinia pestis KIM
gcagcauacaacuuccgcauca

SEQ ID NO: 297727 - RNA, 22 nt, Yersinia pestis KIM
ucucauuaaucggcucuggugc

SEQ ID NO: 297728 - RNA, 21 nt, Yersinia pestis KIM
auucccguuuaucauuauagg

SEQ ID NO: 297729 - RNA, 22 nt, Yersinia pestis KIM
accgcgcacgauaaagguaaua

SEQ ID NO: 297730 - RNA, 22 nt, Yersinia pestis KIM
ucacggcuuguaugaggcugaa

SEQ ID NO: 297731 - RNA, 23 nt, Yersinia pestis KIM
agucaaagaauccaugucuggcu

SEQ ID NO: 297732 - RNA, 22 nt, Yersinia pestis KIM
caggcuguguauuccgcacccg

SEQ ID NO: 297733 - RNA, 22 nt, Yersinia pestis KIM
aagauacccugucgauuuuacg

SEQ ID NO: 297734 - RNA, 22 nt, Yersinia pestis KIM
gcugaaaguaucgguaugaaag

SEQ ID NO: 297735 - RNA, 22 nt, Yersinia pestis KIM
acguuucuuuacguaaaguacg

SEQ ID NO: 297736 - RNA, 22 nt, Yersinia pestis KIM
cauuaaccuguucuugauguua

SEQ ID NO: 297737 - RNA, 22 nt, Yersinia pestis KIM
ugucgaugaacugcguuuauau

SEQ ID NO: 297738 - RNA, 22 nt, Yersinia pestis KIM
aguagugccuuacguagcauga

SEQ ID NO: 297739 - RNA, 22 nt, Yersinia pestis KIM
aauggaaucaggauguggcuga

SEQ ID NO: 297740 - RNA, 22 nt, Yersinia pestis KIM
cacccuuguuaaacgucaguaa

SEQ ID NO: 297741 - RNA, 22 nt, Yersinia pestis KIM
uugauagcguugaagcgcaagc

SEQ ID NO: 297742 - RNA, 22 nt, Yersinia pestis KIM
acguuucuuucaagaaagcacg

SEQ ID NO: 297743 - RNA, 22 nt, Yersinia pestis KIM
uaucgguauuuaguuguauaag

SEQ ID NO: 297744 - RNA, 22 nt, Yersinia pestis KIM
agccguccagaaagcgcuuugg

SEQ ID NO: 297745 - RNA, 22 nt, Yersinia pestis KIM
auucgguuaguggugaucagcg

SEQ ID NO: 297746 - RNA, 22 nt, Yersinia pestis KIM
ucucuggaagagaacauugaaa

SEQ ID NO: 297747 - RNA, 22 nt, Yersinia pestis KIM
gggucagcagacgcacgguugu

SEQ ID NO: 297748 - RNA, 22 nt, Yersinia pestis KIM
aacgucgagcaacaagagcgug

SEQ ID NO: 297749 - RNA, 22 nt, Yersinia pestis KIM
uacuggcugagccacuggucgg

SEQ ID NO: 297750 - RNA, 21 nt, Yersinia pestis KIM
agaugguaucccugcuguggu

SEQ ID NO: 297751 - RNA, 22 nt, Yersinia pestis KIM
ucuuccggugcaaauacuggca

SEQ ID NO: 297752 - RNA, 22 nt, Yersinia pestis KIM
ggaacucgaugaaaauuaguuu

SEQ ID NO: 297753 - RNA, 20 nt, Yersinia pestis KIM
gccaaggugcuuuuacgcga

SEQ ID NO: 297754 - RNA, 23 nt, Yersinia pestis KIM
uggcggaugaugucgcguguggg

SEQ ID NO: 297755 - RNA, 22 nt, Yersinia pestis KIM
ggguauucgccuuuggucagug

SEQ ID NO: 297756 - RNA, 22 nt, Yersinia pestis KIM
uucaaugauggucgaagggcgu

SEQ ID NO: 297757 - RNA, 22 nt, Yersinia pestis KIM
auugucaugcagaaucgaaacu

SEQ ID NO: 297758 - RNA, 22 nt, Yersinia pestis KIM
ccagcuaaucugauggcgaucu

SEQ ID NO: 297759 - RNA, 22 nt, Yersinia pestis KIM
gcuaucaaugaugccgcuacug

SEQ ID NO: 297760 - RNA, 22 nt, Yersinia pestis KIM
uucagguagauuucgcgcccuu

SEQ ID NO: 297761 - RNA, 22 nt, Yersinia pestis KIM
ggugcgcauuaccgaucccggc

SEQ ID NO: 297762 - RNA, 18 nt, Yersinia pestis KIM
uucauggaugggcgguga

SEQ ID NO: 297763 - RNA, 22 nt, Yersinia pestis KIM
acgcucuugaugaccuacuuug

SEQ ID NO: 297764 - RNA, 22 nt, Yersinia pestis KIM
gggaauuuaaugcagggaauac

SEQ ID NO: 297765 - RNA, 22 nt, Yersinia pestis KIM
gugcuguaugggaagacugaau

SEQ ID NO: 297766 - RNA, 22 nt, Yersinia pestis KIM
uccuggcuaaugcugccgccgg

SEQ ID NO: 297767 - RNA, 22 nt, Yersinia pestis KIM
gaguaguggccagacgguugag

SEQ ID NO: 297768 - RNA, 19 nt, Yersinia pestis KIM
uuugcccguaauaugcaag

SEQ ID NO: 297769 - RNA, 22 nt, Yersinia pestis KIM
gucagggagagauaacggcacc

SEQ ID NO: 297770 - RNA, 22 nt, Yersinia pestis KIM
cugaugaauuacgugaugcggu

SEQ ID NO: 297771 - RNA, 22 nt, Yersinia pestis KIM
acgcgcugcuucaacauuguag

SEQ ID NO: 297772 - RNA, 22 nt, Yersinia pestis KIM
cucagcagcaaaugagagaagu

SEQ ID NO: 297773 - RNA, 22 nt, Yersinia pestis KIM
ugcacaacgaaccggaaaugcu

SEQ ID NO: 297774 - RNA, 22 nt, Yersinia pestis KIM
cuguucuauugucuuauugucu

SEQ ID NO: 297775 - RNA, 22 nt, Yersinia pestis KIM
gaacauacuuuuagcgauagaa

SEQ ID NO: 297776 - RNA, 22 nt, Yersinia pestis KIM
cauggcguuuaaucugaagcug

SEQ ID NO: 297777 - RNA, 22 nt, Yersinia pestis KIM
uaauacguugaucccggaugug

SEQ ID NO: 297778 - RNA, 22 nt, Yersinia pestis KIM
guggcccaaucgacauggacau

SEQ ID NO: 297779 - RNA, 22 nt, Yersinia pestis KIM
aaguguuagugcggauugucgc

SEQ ID NO: 297780 - RNA, 22 nt, Yersinia pestis KIM
acaugguauuacugacucaacg

SEQ ID NO: 297781 - RNA, 22 nt, Yersinia pestis KIM
caguugauuaagcagccuuuca

SEQ ID NO: 297782 - RNA, 22 nt, Yersinia pestis KIM
cguuucaguacuguugcgccuu

SEQ ID NO: 297783 - RNA, 22 nt, Yersinia pestis KIM
aacacaggcguuauguagcgaa

SEQ ID NO: 297784 - RNA, 22 nt, Yersinia pestis KIM
accgggcagcaaauggagugga

SEQ ID NO: 297785 - RNA, 22 nt, Yersinia pestis KIM
ccgauaagagucugcgagccuu

SEQ ID NO: 297786 - RNA, 22 nt, Yersinia pestis KIM
cagucuggcuuuucgcaaaauu

SEQ ID NO: 297787 - RNA, 22 nt, Yersinia pestis KIM
auaucgcuggcugguuagugug

SEQ ID NO: 297788 - RNA, 22 nt, Yersinia pestis KIM
aaccagcguuccagucuuuggu

SEQ ID NO: 297789 - RNA, 22 nt, Yersinia pestis KIM
cuggccagacuguacgcuuugg

SEQ ID NO: 297790 - RNA, 22 nt, Yersinia pestis KIM
gccaguaggcuaacgcgcuugc

SEQ ID NO: 297791 - RNA, 22 nt, Yersinia pestis KIM
caggcauuugauuuaugaaugg

SEQ ID NO: 297792 - RNA, 22 nt, Yersinia pestis KIM
gcuuuccgcuucuuugucacca

SEQ ID NO: 297793 - RNA, 22 nt, Yersinia pestis KIM
agucuaucguuaucugauggca

SEQ ID NO: 297794 - RNA, 22 nt, Yersinia pestis KIM
cgguacgcuuaccuuucagcuc

SEQ ID NO: 297795 - RNA, 22 nt, Yersinia pestis KIM
cgcgcaaauuuuuuagcaagua

SEQ ID NO: 297796 - RNA, 22 nt, Yersinia pestis KIM
aaugagguuauuaugucagcga

SEQ ID NO: 297797 - RNA, 20 nt, Yersinia pestis KIM
cccgucagcggcguuauccc

SEQ ID NO: 297798 - RNA, 22 nt, Yersinia pestis KIM
uggcugccagcacuguuuaucc

SEQ ID NO: 297799 - RNA, 22 nt, Yersinia pestis KIM
ggcaagacgguauuuaggcgcu

SEQ ID NO: 297800 - RNA, 22 nt, Yersinia pestis KIM
gcaccugguaguuggcaccacu

SEQ ID NO: 297801 - RNA, 22 nt, Yersinia pestis KIM
ggccauuugcgguuuagagaaa

SEQ ID NO: 297802 - RNA, 22 nt, Yersinia pestis KIM
ugcuagguuuuaaucugaucag

SEQ ID NO: 297803 - RNA, 18 nt, Yersinia pestis KIM
acuucuuagugcgcuagc

SEQ ID NO: 297804 - RNA, 22 nt, Yersinia pestis KIM
auuauggccgauaagacauuag

SEQ ID NO: 297805 - RNA, 22 nt, Yersinia pestis KIM
ccgccuaugccacccguauugc

SEQ ID NO: 297806 - RNA, 22 nt, Yersinia pestis KIM
cauaacauccuaaaaagcgcga

SEQ ID NO: 297807 - RNA, 22 nt, Yersinia pestis KIM
ugggcauuguucucaauugaga

SEQ ID NO: 297808 - RNA, 22 nt, Yersinia pestis KIM
augugcugagcaggagcaguua

SEQ ID NO: 297809 - RNA, 22 nt, Yersinia pestis KIM
acuuccugauacugguacucuu

SEQ ID NO: 297810 - RNA, 22 nt, Yersinia pestis KIM
auuggcacguaccgugacgguu

SEQ ID NO: 297811 - RNA, 19 nt, Yersinia pestis KIM
uuugaucaccaguuucggu

SEQ ID NO: 297812 - RNA, 22 nt, Yersinia pestis KIM
caugugagaaauaugaaguuaa

SEQ ID NO: 297813 - RNA, 22 nt, Yersinia pestis KIM
cuuugucaauaaccucuaaucu

SEQ ID NO: 297814 - RNA, 22 nt, Yersinia pestis KIM
uuugucagcagucugaaaggcc

SEQ ID NO: 297815 - RNA, 22 nt, Yersinia pestis KIM
auugccguaaaugagugagucg

SEQ ID NO: 297816 - RNA, 21 nt, Yersinia pestis KIM
gcgauugaaagucacaccgag

SEQ ID NO: 297817 - RNA, 22 nt, Yersinia pestis KIM
aaugucuuuauugaucgauuca

SEQ ID NO: 297818 - RNA, 22 nt, Yersinia pestis KIM
cgcaggaaacgaaccauacgca

SEQ ID NO: 297819 - RNA, 20 nt, Yersinia pestis KIM
cgugauguuggauuaccgua

SEQ ID NO: 297820 - RNA, 22 nt, Yersinia pestis KIM
uagccugacagauagaagggcc

SEQ ID NO: 297821 - RNA, 22 nt, Yersinia pestis KIM
gauugcagccaguguuuccccg

SEQ ID NO: 297822 - RNA, 22 nt, Yersinia pestis KIM
uuuaucagcaacaguggcuuuu

SEQ ID NO: 297823 - RNA, 22 nt, Yersinia pestis KIM
cagugccuggauauaucuguau

SEQ ID NO: 297824 - RNA, 18 nt, Yersinia pestis KIM
gauaucauugaaauggau

SEQ ID NO: 297825 - RNA, 22 nt, Yersinia pestis KIM
ucgauucuuguucugcaacggu

SEQ ID NO: 297826 - RNA, 22 nt, Yersinia pestis KIM
gaugaguuuugcguuuaaugaa

SEQ ID NO: 297827 - RNA, 22 nt, Yersinia pestis KIM
acggaaaccaacuaaaugggua

SEQ ID NO: 297828 - RNA, 23 nt, Yersinia pestis KIM
gaucaacacagcaggaagccgga

SEQ ID NO: 297829 - RNA, 22 nt, Yersinia pestis KIM
ugcggaguuggucacauugaug

SEQ ID NO: 297830 - RNA, 22 nt, Yersinia pestis KIM
aaaucuguguuguacagagggu

SEQ ID NO: 297831 - RNA, 22 nt, Yersinia pestis KIM
gccacaagcaacauuaucgucu

SEQ ID NO: 297832 - RNA, 22 nt, Yersinia pestis KIM
aggugcagccacuaucagcuac

SEQ ID NO: 297833 - RNA, 22 nt, Yersinia pestis KIM
uucaucacgauaaagucagguu

SEQ ID NO: 297834 - RNA, 22 nt, Yersinia pestis KIM
uuucgauacgaugcauauuaug

SEQ ID NO: 297835 - RNA, 22 nt, Yersinia pestis KIM
gccagucaaggggucuaugauu

SEQ ID NO: 297836 - RNA, 23 nt, Yersinia pestis KIM
ucugucacaccggaguuggcagc

SEQ ID NO: 297837 - RNA, 22 nt, Yersinia pestis KIM
aacggcguugaguuacagacug

SEQ ID NO: 297838 - RNA, 22 nt, Yersinia pestis KIM
gucacgguugaaauaccgcugu

SEQ ID NO: 297839 - RNA, 22 nt, Yersinia pestis KIM
caagauguucgugguguagguu

SEQ ID NO: 297840 - RNA, 22 nt, Yersinia pestis KIM
ccuuucagcagcgcaggaaggu

SEQ ID NO: 297841 - RNA, 20 nt, Yersinia pestis KIM
gguagcgauccucccacugu

SEQ ID NO: 297842 - RNA, 22 nt, Yersinia pestis KIM
uagcuuaugggguaaugguuac

SEQ ID NO: 297843 - RNA, 22 nt, Yersinia pestis KIM
ugcaaguucaggaagcggauuu

SEQ ID NO: 297844 - RNA, 22 nt, Yersinia pestis KIM
uugcguaauaaugcggcuuggu

SEQ ID NO: 297845 - RNA, 22 nt, Yersinia pestis KIM
cagggucaguuggugguacauc

SEQ ID NO: 297846 - RNA, 22 nt, Yersinia pestis KIM
aacgguucaucagugcgauuga

SEQ ID NO: 297847 - RNA, 23 nt, Yersinia pestis KIM
ugaugcagagcuggauaugcguc

SEQ ID NO: 297848 - RNA, 22 nt, Yersinia pestis KIM
ccgcgaauauccgugguugugg

SEQ ID NO: 297849 - RNA, 22 nt, Yersinia pestis KIM
cgggaugagaaaccgaugcuca

SEQ ID NO: 297850 - RNA, 22 nt, Yersinia pestis KIM
uugcagagaguauggugauagc

SEQ ID NO: 297851 - RNA, 22 nt, Yersinia pestis KIM
cuguauauaaaaccagucuaua

SEQ ID NO: 297852 - RNA, 22 nt, Yersinia pestis KIM
ccuuacugagaaucgaugagug

SEQ ID NO: 297853 - RNA, 22 nt, Yersinia pestis KIM
ggaugcauucuucaaugauauc

SEQ ID NO: 297854 - RNA, 22 nt, Yersinia pestis KIM
caagauggcguguauaacgaug

SEQ ID NO: 297855 - RNA, 22 nt, Yersinia pestis KIM
gcaggucagaccuaaguugugu

SEQ ID NO: 297856 - RNA, 22 nt, Yersinia pestis KIM
uugcuguagaugauugcucuau

SEQ ID NO: 297857 - RNA, 22 nt, Yersinia pestis KIM
ggauaggcagaagaauaaagcg

SEQ ID NO: 297858 - RNA, 22 nt, Yersinia pestis KIM
auuggcuuuaucgguacucaau

SEQ ID NO: 297859 - RNA, 22 nt, Yersinia pestis KIM
cagguaacugagguuuauggug

SEQ ID NO: 297860 - RNA, 22 nt, Yersinia pestis KIM
uaaugcggggguagucauacaa

SEQ ID NO: 297861 - RNA, 22 nt, Yersinia pestis KIM
agacuauauucuggcaaaugcu

SEQ ID NO: 297862 - RNA, 22 nt, Yersinia pestis KIM
uggcgagauggagcuguaccgc

SEQ ID NO: 297863 - RNA, 22 nt, Yersinia pestis KIM
guuaaccgauaagcgaguuugc

SEQ ID NO: 297864 - RNA, 22 nt, Yersinia pestis KIM
augcaugggcugguaucacuug

SEQ ID NO: 297865 - RNA, 22 nt, Yersinia pestis KIM
ugguauaggccugaaaauaagc

SEQ ID NO: 297866 - RNA, 22 nt, Yersinia pestis KIM
uguuugaagcaccuacugcagg

SEQ ID NO: 297867 - RNA, 22 nt, Yersinia pestis KIM
ugguagcgguuauuuucaggaa

SEQ ID NO: 297868 - RNA, 20 nt, Yersinia pestis KIM
uauucugcuggaagaguugc

SEQ ID NO: 297869 - RNA, 22 nt, Yersinia pestis KIM
gcuggauuugaguggcgguacg

SEQ ID NO: 297870 - RNA, 22 nt, Yersinia pestis KIM
aaggaucgcgcuuugugguggg

SEQ ID NO: 297871 - RNA, 22 nt, Yersinia pestis KIM
auggaucuuguccugagugcgg

SEQ ID NO: 297872 - RNA, 22 nt, Yersinia pestis KIM
cuggcuauggacugugcggcuu

SEQ ID NO: 297873 - RNA, 22 nt, Yersinia pestis KIM
gcgauccugucuuagcgaucau

SEQ ID NO: 297874 - RNA, 22 nt, Yersinia pestis KIM
auucuuugaaaacggcgaggca

SEQ ID NO: 297875 - RNA, 22 nt, Yersinia pestis KIM
guugacguguuguaugccguua

SEQ ID NO: 297876 - RNA, 22 nt, Yersinia pestis KIM
ugucugaacuugcuuuagugga

SEQ ID NO: 297877 - RNA, 22 nt, Yersinia pestis KIM
gauugccauucuggggcuggua

SEQ ID NO: 297878 - RNA, 22 nt, Yersinia pestis KIM
cagaacgccaugaauaauaaaa

SEQ ID NO: 297879 - RNA, 22 nt, Yersinia pestis KIM
uaucagagugcgcugauuuaac

SEQ ID NO: 297880 - RNA, 20 nt, Yersinia pestis KIM
ugaagccuugcucaauggcc

SEQ ID NO: 297881 - RNA, 22 nt, Yersinia pestis KIM
guugaugagugccugccgguag

SEQ ID NO: 297882 - RNA, 22 nt, Yersinia pestis KIM
ccugcucguucaggccacggau

SEQ ID NO: 297883 - RNA, 23 nt, Yersinia pestis KIM
cggugugacccgccaccacgauc

SEQ ID NO: 297884 - RNA, 18 nt, Yersinia pestis KIM
ucucauugccauuuaaau

SEQ ID NO: 297885 - RNA, 22 nt, Yersinia pestis KIM
agguaaucgcauugauugguau

SEQ ID NO: 297886 - RNA, 18 nt, Yersinia pestis KIM
uaacuggcuguagcggug

SEQ ID NO: 297887 - RNA, 22 nt, Yersinia pestis KIM
uguaauccaaccaauuuuauug

SEQ ID NO: 297888 - RNA, 22 nt, Yersinia pestis KIM
guuaaagauuauugcacccgag

SEQ ID NO: 297889 - RNA, 22 nt, Yersinia pestis KIM
augucggcauguuuguuggugc

SEQ ID NO: 297890 - RNA, 22 nt, Yersinia pestis KIM
uugaucauggcugagguguguc

SEQ ID NO: 297891 - RNA, 22 nt, Yersinia pestis KIM
gauagcgaucaguagugucagu

SEQ ID NO: 297892 - RNA, 22 nt, Yersinia pestis KIM
augcugaugaugacguuggccg

SEQ ID NO: 297893 - RNA, 22 nt, Yersinia pestis KIM
gcuaucaguggauuaggguucu

SEQ ID NO: 297894 - RNA, 22 nt, Yersinia pestis KIM
acucaauggggugauugguuuu

SEQ ID NO: 297895 - RNA, 22 nt, Yersinia pestis KIM
uuagcguacagguguacacuga

SEQ ID NO: 297896 - RNA, 19 nt, Yersinia pestis KIM
ugcgagaaccuggcgacaa

SEQ ID NO: 297897 - RNA, 22 nt, Yersinia pestis KIM
ggguccuucuuguuugcuggcc

SEQ ID NO: 297898 - RNA, 22 nt, Yersinia pestis KIM
aaugaccaucaaagaguuacug

SEQ ID NO: 297899 - RNA, 23 nt, Yersinia pestis KIM
ccaugaucuggagguucgguuca

SEQ ID NO: 297900 - RNA, 22 nt, Yersinia pestis KIM
aagucgggagaauagcgcgcug

SEQ ID NO: 297901 - RNA, 22 nt, Yersinia pestis KIM
ggccauuggcagcuuuauauau

SEQ ID NO: 297902 - RNA, 23 nt, Yersinia pestis KIM
uucgccugaagaaugcacugguu

SEQ ID NO: 297903 - RNA, 22 nt, Yersinia pestis KIM
cugcgugugccggcccuccgca

SEQ ID NO: 297904 - RNA, 22 nt, Yersinia pestis KIM
aaaguaguuaagggcagcgaaa

SEQ ID NO: 297905 - RNA, 22 nt, Yersinia pestis KIM
ucugugcgcccauguucucgaa

SEQ ID NO: 297906 - RNA, 22 nt, Yersinia pestis KIM
cgagaauggcagugguccacuc

SEQ ID NO: 297907 - RNA, 22 nt, Yersinia pestis KIM
uuggauucaacggcccaguuag

SEQ ID NO: 297908 - RNA, 22 nt, Yersinia pestis KIM
cggcguagugggcgaccugacc

SEQ ID NO: 297909 - RNA, 22 nt, Yersinia pestis KIM
ccgguagguaauaucuauccag

SEQ ID NO: 297910 - RNA, 23 nt, Yersinia pestis KIM
uaugccgguauugauucggggaa

SEQ ID NO: 297911 - RNA, 22 nt, Yersinia pestis KIM
uuauagguccggcucaggaaga

SEQ ID NO: 297912 - RNA, 22 nt, Yersinia pestis KIM
uugggcgauuaccaaugggaac

SEQ ID NO: 297913 - RNA, 22 nt, Yersinia pestis KIM
uccuuaacugaucggcauugcu

SEQ ID NO: 297914 - RNA, 22 nt, Yersinia pestis KIM
cuuaagguuuaucgagaugccu

SEQ ID NO: 297915 - RNA, 19 nt, Yersinia pestis KIM
gaauuccaucgugcucgcu

SEQ ID NO: 297916 - RNA, 22 nt, Yersinia pestis KIM
guugaugagcguguuggccgug

SEQ ID NO: 297917 - RNA, 22 nt, Yersinia pestis KIM
gaauugcggcagcggaaucagu

SEQ ID NO: 297918 - RNA, 22 nt, Yersinia pestis KIM
ucaucuuguaagaguucugccc

SEQ ID NO: 297919 - RNA, 22 nt, Yersinia pestis KIM
gcaugguuugggaacgucggug

SEQ ID NO: 297920 - RNA, 20 nt, Yersinia pestis KIM
ugcacagcuggaugugaguc

SEQ ID NO: 297921 - RNA, 22 nt, Yersinia pestis KIM
cuggaagguuaauugauggggu

SEQ ID NO: 297922 - RNA, 22 nt, Yersinia pestis KIM
uacguugauuagacggagggau

SEQ ID NO: 297923 - RNA, 22 nt, Yersinia pestis KIM
aggaguuugaaggccauugucu

SEQ ID NO: 297924 - RNA, 22 nt, Yersinia pestis KIM
gcaaugaucacacgggguauag

SEQ ID NO: 297925 - RNA, 22 nt, Yersinia pestis KIM
cgguaaccaacgcuugugcaau

SEQ ID NO: 297926 - RNA, 22 nt, Yersinia pestis KIM
ucgauuaaucuaucauaguaag

SEQ ID NO: 297927 - RNA, 22 nt, Yersinia pestis KIM
gcggcaaugugcuguauaccgc

SEQ ID NO: 297928 - RNA, 22 nt, Yersinia pestis KIM
auuggcacggguugcugucgau

SEQ ID NO: 297929 - RNA, 23 nt, Yersinia pestis KIM
gucagcagauuaccuauuucggg

SEQ ID NO: 297930 - RNA, 22 nt, Yersinia pestis KIM
ucauggcggugaggaauaucuu

SEQ ID NO: 297931 - RNA, 19 nt, Yersinia pestis KIM
gggauuuauuuagccugcu

SEQ ID NO: 297932 - RNA, 22 nt, Yersinia pestis KIM
uaucagcgaagcuacgcauauu

SEQ ID NO: 297933 - RNA, 23 nt, Yersinia pestis KIM
ccgaccaguggcucagccaguaa

SEQ ID NO: 297934 - RNA, 22 nt, Yersinia pestis KIM
ugucaucgccgaacugauuuug

SEQ ID NO: 297935 - RNA, 22 nt, Yersinia pestis KIM
uuggcgcugauaacuaaacuuu

SEQ ID NO: 297936 - RNA, 22 nt, Yersinia pestis KIM
acggcuaaccucauagcgcccg

SEQ ID NO: 297937 - RNA, 22 nt, Yersinia pestis KIM
gacgcuuuugauccggcgcugg

SEQ ID NO: 297938 - RNA, 22 nt, Yersinia pestis KIM
gauccugucaauauugggauau

SEQ ID NO: 297939 - RNA, 22 nt, Yersinia pestis KIM
acgccgcuucaaagaugacguu

SEQ ID NO: 297940 - RNA, 22 nt, Yersinia pestis KIM
ccgcuugguuaacugcgucauu

SEQ ID NO: 297941 - RNA, 22 nt, Yersinia pestis KIM
gucaucuucaucgcugauacga

SEQ ID NO: 297942 - RNA, 22 nt, Yersinia pestis KIM
augcuguugccaagggaacuaa

SEQ ID NO: 297943 - RNA, 22 nt, Yersinia pestis KIM
accagagauuaaaucaggggau

SEQ ID NO: 297944 - RNA, 22 nt, Yersinia pestis KIM
acauuguuugcggacagaauug

SEQ ID NO: 297945 - RNA, 22 nt, Yersinia pestis KIM
accaacugaccaaaucaugaug

SEQ ID NO: 297946 - RNA, 22 nt, Yersinia pestis KIM
acaguauugggacaguauuugu

SEQ ID NO: 297947 - RNA, 22 nt, Yersinia pestis KIM
acuggaguggaucuaucgcuug

SEQ ID NO: 297948 - RNA, 22 nt, Yersinia pestis KIM
aaugucuuuauugaucgauuca

SEQ ID NO: 297949 - RNA, 22 nt, Yersinia pestis KIM
aauucaguaauucgcucugugu

SEQ ID NO: 297950 - RNA, 17 nt, Yersinia pestis KIM
acacugucuuuauucgg

SEQ ID NO: 297951 - RNA, 20 nt, Yersinia pestis KIM
aucguuaugccaacaaugau

SEQ ID NO: 297952 - RNA, 17 nt, Yersinia pestis KIM
aguaggguuauguguga

SEQ ID NO: 297953 - RNA, 22 nt, Yersinia pestis KIM
aguggucaaauggugcgcuuaa

SEQ ID NO: 297954 - RNA, 22 nt, Yersinia pestis KIM
aguucuauguucgugaacgccg

SEQ ID NO: 297955 - RNA, 20 nt, Yersinia pestis KIM
cagcauggaucccagcggcu

SEQ ID NO: 297956 - RNA, 22 nt, Yersinia pestis KIM
cacgcgcuaacguuucucaggu

SEQ ID NO: 297957 - RNA, 22 nt, Yersinia pestis KIM
auuaagcaggcuuugcuguagu

SEQ ID NO: 297958 - RNA, 22 nt, Yersinia pestis KIM
auucauucuguggauucaugac

SEQ ID NO: 297959 - RNA, 22 nt, Yersinia pestis KIM
auugucaugcagaaucgaaacu

SEQ ID NO: 297960 - RNA, 22 nt, Yersinia pestis KIM
uaacugcacgcaucucaguuug

SEQ ID NO: 297961 - RNA, 22 nt, Yersinia pestis KIM
uaucgauaauaugugcuguuuu

SEQ ID NO: 297962 - RNA, 22 nt, Yersinia pestis KIM
uguaucuugcaagguuggugua

SEQ ID NO: 297963 - RNA, 22 nt, Yersinia pestis KIM
ugugacuucaacaugccgcugc

SEQ ID NO: 297964 - RNA, 22 nt, Yersinia pestis KIM
uggcugcagguaacagccugga

SEQ ID NO: 297965 - RNA, 22 nt, Yersinia pestis KIM
uggccugcgggaugugauguca

SEQ ID NO: 297966 - RNA, 22 nt, Yersinia pestis KIM
uggccgaagaacauggguucga

SEQ ID NO: 297967 - RNA, 17 nt, Yersinia pestis KIM
ucauggcccagucugag

SEQ ID NO: 297968 - RNA, 22 nt, Yersinia pestis KIM
ucagugaacucgaugauaauca

SEQ ID NO: 297969 - RNA, 22 nt, Yersinia pestis KIM
ucagugaaguaaaugauuacga

SEQ ID NO: 297970 - RNA, 22 nt, Yersinia pestis KIM
ucuucaguggccgugaugaaau

SEQ ID NO: 297971 - RNA, 22 nt, Yersinia pestis KIM
gccagagacaaugucgacgacg

SEQ ID NO: 297972 - RNA, 22 nt, Yersinia pestis KIM
gccacgcugcgcugugagggug

SEQ ID NO: 297973 - RNA, 22 nt, Yersinia pestis KIM
gcaugugaauaagcuugaacaa

SEQ ID NO: 297974 - RNA, 21 nt, Yersinia pestis KIM
gccgaagauuuugagcugcuu

SEQ ID NO: 297975 - RNA, 22 nt, Yersinia pestis KIM
gaauucauaagguagacuugga

SEQ ID NO: 297976 - RNA, 19 nt, Yersinia pestis KIM
gaauuccaucgugcucgcu

SEQ ID NO: 297977 - RNA, 21 nt, Yersinia pestis KIM
gcaggcugucgccgucagcau

SEQ ID NO: 297978 - RNA, 22 nt, Yersinia pestis KIM
ggauuggauagaugccggaucg

SEQ ID NO: 297979 - RNA, 22 nt, Yersinia pestis KIM
cagggcuguuuacacgcaagau

SEQ ID NO: 297980 - RNA, 22 nt, Yersinia pestis KIM
cagggucaguuggugguacauc

SEQ ID NO: 297981 - RNA, 22 nt, Yersinia pestis KIM
caguucauugccagugaagaca

SEQ ID NO: 297982 - RNA, 22 nt, Yersinia pestis KIM
cauauaguccgguaauuguugc

SEQ ID NO: 297983 - RNA, 22 nt, Yersinia pestis KIM
cagguuggcuguuguaugguag

SEQ ID NO: 297984 - RNA, 22 nt, Yersinia pestis KIM
caucaucacgccacuccucugc

SEQ ID NO: 297985 - RNA, 22 nt, Yersinia pestis KIM
cucagcagcaaaugagagaagu

SEQ ID NO: 297986 - RNA, 21 nt, Yersinia pestis KIM
cugugucagggugauauuggc

SEQ ID NO: 297987 - RNA, 22 nt, Yersinia pestis KIM
cuguucuauugucuuauugucu

SEQ ID NO: 297988 - RNA, 22 nt, Yersinia pestis KIM
gaacauaggguggcggcuaaaa

SEQ ID NO: 297989 - RNA, 22 nt, Yersinia pestis KIM
gaacauacuuuuagcgauagaa

SEQ ID NO: 297990 - RNA, 22 nt, Yersinia pestis KIM
uuacucaucuggaaggcuaccg

SEQ ID NO: 297991 - RNA, 22 nt, Yersinia pestis KIM
uuagccauaccaugacugacac

SEQ ID NO: 297992 - RNA, 22 nt, Yersinia pestis KIM
uguuugaagcaccuacugcagg

SEQ ID NO: 297993 - RNA, 22 nt, Yersinia pestis KIM
ugucugaacuugcuuuagugga

SEQ ID NO: 297994 - RNA, 22 nt, Yersinia pestis KIM
aggcaucucugucauccaguaa

SEQ ID NO: 297995 - RNA, 22 nt, Yersinia pestis KIM
agccuguccauaauucugugua

SEQ ID NO: 297996 - RNA, 22 nt, Yersinia pestis KIM
agccgcagggucaguugguggu

SEQ ID NO: 297997 - RNA, 22 nt, Yersinia pestis KIM
agagcgauaaccaugacgccuu

SEQ ID NO: 297998 - RNA, 22 nt, Yersinia pestis KIM
agaggcucuguuagcgguaaag

SEQ ID NO: 297999 - RNA, 22 nt, Yersinia pestis KIM
agauuucagacugcugacaacc

SEQ ID NO: 298000 - RNA, 22 nt, Yersinia pestis KIM
accucaguaaagggaggagauc

SEQ ID NO: 298001 - RNA, 22 nt, Yersinia pestis KIM
uuuccagugccgccuuugccau

SEQ ID NO: 298002 - RNA, 23 nt, Yersinia pestis KIM
uuggccaugcucguuuuacauag

SEQ ID NO: 298003 - RNA, 22 nt, Yersinia pestis KIM
uugcucaguccagucgucagca

SEQ ID NO: 298004 - RNA, 22 nt, Yersinia pestis KIM
uucaggcugcgguucaugguca

SEQ ID NO: 298005 - RNA, 22 nt, Yersinia pestis KIM
ucacagccauggcugugcgcaa

SEQ ID NO: 298006 - RNA, 22 nt, Yersinia pestis KIM
ugccaagcgcuuuggcaauuuc

SEQ ID NO: 298007 - RNA, 22 nt, Yersinia pestis KIM
ugaacauauuccacugccugau

SEQ ID NO: 298008 - RNA, 22 nt, Yersinia pestis KIM
uggaaguuauggggaauguuuu

SEQ ID NO: 298009 - RNA, 22 nt, Yersinia pestis KIM
ugcugugaguaauacucuugca

SEQ ID NO: 298010 - RNA, 22 nt, Yersinia pestis KIM
guuuaucugcugauuaccaacg

SEQ ID NO: 298011 - RNA, 22 nt, Yersinia pestis KIM
uacugcaucauguuugcugauu

SEQ ID NO: 298012 - RNA, 22 nt, Yersinia pestis KIM
uagccauguauuuauaggcaga

SEQ ID NO: 298013 - RNA, 22 nt, Yersinia pestis KIM
guucauugcuauucugcaucgc

SEQ ID NO: 298014 - RNA, 22 nt, Yersinia pestis KIM
ggagugcuuccgccaaccagac

SEQ ID NO: 298015 - RNA, 18 nt, Yersinia pestis KIM
gcucacugauuaacgcac

SEQ ID NO: 298016 - RNA, 22 nt, Yersinia pestis KIM
gcucccaugcucgucugaccua

SEQ ID NO: 298017 - RNA, 22 nt, Yersinia pestis KIM
guagccauuaugucgggaguaa

SEQ ID NO: 298018 - RNA, 22 nt, Yersinia pestis KIM
gucaggaugccauuuuauucug

SEQ ID NO: 298019 - RNA, 23 nt, Yersinia pestis KIM
cccacagguuuuuacccauccuc

SEQ ID NO: 298020 - RNA, 22 nt, Yersinia pestis KIM
cuggaugggagcgagagugcau

SEQ ID NO: 298021 - RNA, 22 nt, Yersinia pestis KIM
gauugccauucuggggcuggua

SEQ ID NO: 298022 - RNA, 14 nt, Bordetella pertussis
aaaggacacgcgcg

SEQ ID NO: 298023 - RNA, 15 nt, Bordetella pertussis
aaauagccgaccacc

SEQ ID NO: 298024 - RNA, 11 nt, Bordetella pertussis
aacaaggcggu

SEQ ID NO: 298025 - RNA, 21 nt, Bordetella pertussis
aacaagguacccgcgccggcg

SEQ ID NO: 298026 - RNA, 17 nt, Bordetella pertussis
aacagcauggcggcgcc

SEQ ID NO: 298027 - RNA, 23 nt, Bordetella pertussis
aacagccgcgagguauuggccuu

SEQ ID NO: 298028 - RNA, 18 nt, Bordetella pertussis
aacagcgaaagcacggcg

SEQ ID NO: 298029 - RNA, 19 nt, Bordetella pertussis
aacaguugcaccagugcgc

SEQ ID NO: 298030 - RNA, 18 nt, Bordetella pertussis
aacaucaaugacauggcc

SEQ ID NO: 298031 - RNA, 20 nt, Bordetella pertussis
aacauguccaccagccggcc

SEQ ID NO: 298032 - RNA, 23 nt, Bordetella pertussis
aacauguuguuggucgccacgcc

SEQ ID NO: 298033 - RNA, 21 nt, Bordetella pertussis
aaccacccuucgcgcugcaga

SEQ ID NO: 298034 - RNA, 17 nt, Bordetella pertussis
aaccaggccgccagggc

SEQ ID NO: 298035 - RNA, 14 nt, Bordetella pertussis
aaccccaccggcaa

SEQ ID NO: 298036 - RNA, 16 nt, Bordetella pertussis
aaccccgagggcgcgg

SEQ ID NO: 298037 - RNA, 23 nt, Bordetella pertussis
aaccccgagggcgcggcgccgcu

SEQ ID NO: 298038 - RNA, 22 nt, Bordetella pertussis
aaccccgccagguucgccuggc

SEQ ID NO: 298039 - RNA, 18 nt, Bordetella pertussis
aaccccggcugcgcggcc

SEQ ID NO: 298040 - RNA, 22 nt, Bordetella pertussis
aacccgaguccuugacgccgcc

SEQ ID NO: 298041 - RNA, 23 nt, Bordetella pertussis
aacccgccgcgaucagcgcggcc

SEQ ID NO: 298042 - RNA, 15 nt, Bordetella pertussis
aacccgcggcaguuc

SEQ ID NO: 298043 - RNA, 18 nt, Bordetella pertussis
aacccggccggcgccggc

SEQ ID NO: 298044 - RNA, 17 nt, Bordetella pertussis
aacccgggccgucgccg

SEQ ID NO: 298045 - RNA, 22 nt, Bordetella pertussis
aacccgggcuuucggucucgcg

SEQ ID NO: 298046 - RNA, 16 nt, Bordetella pertussis
aacccuucgcgcagca

SEQ ID NO: 298047 - RNA, 23 nt, Bordetella pertussis
aacccuuuuuacaugcagccgcc

SEQ ID NO: 298048 - RNA, 19 nt, Bordetella pertussis
aaccgaauuccggcucgga

SEQ ID NO: 298049 - RNA, 19 nt, Bordetella pertussis
aaccgcagaagcagccgcg

SEQ ID NO: 298050 - RNA, 14 nt, Bordetella pertussis
aaccgcagcgccac

SEQ ID NO: 298051 - RNA, 16 nt, Bordetella pertussis
aaccgcagcgccaccg

SEQ ID NO: 298052 - RNA, 18 nt, Bordetella pertussis
aaccgccgcaagacggcg

SEQ ID NO: 298053 - RNA, 18 nt, Bordetella pertussis
aaccgcgcccuggggcgc

SEQ ID NO: 298054 - RNA, 15 nt, Bordetella pertussis
aaccgcgcagccgcu

SEQ ID NO: 298055 - RNA, 22 nt, Bordetella pertussis
aacgaagaacagccgcugcaga

SEQ ID NO: 298056 - RNA, 14 nt, Bordetella pertussis
aacgacagcgacac

SEQ ID NO: 298057 - RNA, 13 nt, Bordetella pertussis
aacgauucggucg

SEQ ID NO: 298058 - RNA, 16 nt, Bordetella pertussis
aacgcaggcgccgccc

SEQ ID NO: 298059 - RNA, 14 nt, Bordetella pertussis
aacgcauugcgcgu

SEQ ID NO: 298060 - RNA, 19 nt, Bordetella pertussis
aacgcauugcgcguaucca

SEQ ID NO: 298061 - RNA, 16 nt, Bordetella pertussis
aacgccgcgcucagca

SEQ ID NO: 298062 - RNA, 16 nt, Bordetella pertussis
aacgccgggccgcgcc

SEQ ID NO: 298063 - RNA, 19 nt, Bordetella pertussis
aacgccgggccgcgccgcc

SEQ ID NO: 298064 - RNA, 17 nt, Bordetella pertussis
aacgccgggccgugcgc

SEQ ID NO: 298065 - RNA, 19 nt, Bordetella pertussis
aacgcgcagcgaacggccc

SEQ ID NO: 298066 - RNA, 21 nt, Bordetella pertussis
aacgcgcagcgaacggcccac

SEQ ID NO: 298067 - RNA, 14 nt, Bordetella pertussis
aacgcgccggccca

SEQ ID NO: 298068 - RNA, 21 nt, Bordetella pertussis
aacgcgcgccggccagcggca

SEQ ID NO: 298069 - RNA, 16 nt, Bordetella pertussis
aacggauugccgccgc

SEQ ID NO: 298070 - RNA, 17 nt, Bordetella pertussis
aacggcaagagccuggc

SEQ ID NO: 298071 - RNA, 12 nt, Bordetella pertussis
aacgggccggcc

SEQ ID NO: 298072 - RNA, 12 nt, Bordetella pertussis
aacgggcguggc

SEQ ID NO: 298073 - RNA, 15 nt, Bordetella pertussis
aacggggacgggcgc

SEQ ID NO: 298074 - RNA, 14 nt, Bordetella pertussis
aacggggucaucgc

SEQ ID NO: 298075 - RNA, 19 nt, Bordetella pertussis
aacgggguggccggcgcgc

SEQ ID NO: 298076 - RNA, 16 nt, Bordetella pertussis
aacgguaucgcgucgg

SEQ ID NO: 298077 - RNA, 16 nt, Bordetella pertussis
aacggugagccggcca

SEQ ID NO: 298078 - RNA, 17 nt, Bordetella pertussis
aacgugccgucgggcgc

SEQ ID NO: 298079 - RNA, 21 nt, Bordetella pertussis
aacgugccgucgggcgccgca

SEQ ID NO: 298080 - RNA, 13 nt, Bordetella pertussis
aacgugcgccagg

SEQ ID NO: 298081 - RNA, 15 nt, Bordetella pertussis
aacguugcugcagcg

SEQ ID NO: 298082 - RNA, 23 nt, Bordetella pertussis
aagagccuggagcucgggugggc

SEQ ID NO: 298083 - RNA, 16 nt, Bordetella pertussis
aagcaacaaccgcgcc

SEQ ID NO: 298084 - RNA, 13 nt, Bordetella pertussis
aagcacaagcgcg

SEQ ID NO: 298085 - RNA, 15 nt, Bordetella pertussis
aagcagacccgcgcc

SEQ ID NO: 298086 - RNA, 13 nt, Bordetella pertussis
aagcagccgcgcu

SEQ ID NO: 298087 - RNA, 23 nt, Bordetella pertussis
aagcagggaugccgguucgggcg

SEQ ID NO: 298088 - RNA, 17 nt, Bordetella pertussis
aagcaggugaugcgcgc

SEQ ID NO: 298089 - RNA, 15 nt, Bordetella pertussis
aagccuugcgcggcc

SEQ ID NO: 298090 - RNA, 16 nt, Bordetella pertussis
aagccuugcgcggcca

SEQ ID NO: 298091 - RNA, 19 nt, Bordetella pertussis
aagccuugcgcggccagca

SEQ ID NO: 298092 - RNA, 20 nt, Bordetella pertussis
aagcgagugcgccccgccac

SEQ ID NO: 298093 - RNA, 12 nt, Bordetella pertussis
aagcgcgccgcg

SEQ ID NO: 298094 - RNA, 14 nt, Bordetella pertussis
aagcgcgccgcgcg

SEQ ID NO: 298095 - RNA, 20 nt, Bordetella pertussis
aagcgcgcguccugcgccag

SEQ ID NO: 298096 - RNA, 19 nt, Bordetella pertussis
aagcgcggcugcgggccgg

SEQ ID NO: 298097 - RNA, 22 nt, Bordetella pertussis
aagcgcgucgagcaggccggcg

SEQ ID NO: 298098 - RNA, 16 nt, Bordetella pertussis
aagcgcgucgauggag

SEQ ID NO: 298099 - RNA, 15 nt, Bordetella pertussis
aagcgcguggccggc

SEQ ID NO: 298100 - RNA, 23 nt, Bordetella pertussis
aagcgcucggccacgcucacgcc

SEQ ID NO: 298101 - RNA, 12 nt, Bordetella pertussis
aagcggccggcc

SEQ ID NO: 298102 - RNA, 16 nt, Bordetella pertussis
aagcugcuggccggcc

SEQ ID NO: 298103 - RNA, 15 nt, Bordetella pertussis
aagcugcuggcgcgc

SEQ ID NO: 298104 - RNA, 21 nt, Bordetella pertussis
aagcuggagaagcgccgcgcc

SEQ ID NO: 298105 - RNA, 12 nt, Bordetella pertussis
aagcuggcggcg

SEQ ID NO: 298106 - RNA, 15 nt, Bordetella pertussis
aagcuggcggcgcgc

SEQ ID NO: 298107 - RNA, 15 nt, Bordetella pertussis
aaggaaguggccgag

SEQ ID NO: 298108 - RNA, 16 nt, Bordetella pertussis
aaggacaaggcgcgua

SEQ ID NO: 298109 - RNA, 19 nt, Bordetella pertussis
aaggcgccgacggcgcccu

SEQ ID NO: 298110 - RNA, 19 nt, Bordetella pertussis
aaggcgugcugaacgcgcg

SEQ ID NO: 298111 - RNA, 20 nt, Bordetella pertussis
aagggcaggucgucgagccg

SEQ ID NO: 298112 - RNA, 13 nt, Bordetella pertussis
aagggcgcgccag

SEQ ID NO: 298113 - RNA, 18 nt, Bordetella pertussis
aagggcgucuucgccgac

SEQ ID NO: 298114 - RNA, 12 nt, Bordetella pertussis
aaggggccggcg

SEQ ID NO: 298115 - RNA, 22 nt, Bordetella pertussis
aaguagugcccccacgcugcgc

SEQ ID NO: 298116 - RNA, 22 nt, Bordetella pertussis
aauacaccuuguuggcgccggc

SEQ ID NO: 298117 - RNA, 17 nt, Bordetella pertussis
aauacgaaacaggcgcc

SEQ ID NO: 298118 - RNA, 16 nt, Bordetella pertussis
aauccagggccacgcc

SEQ ID NO: 298119 - RNA, 23 nt, Bordetella pertussis
aaucccccgcgucggacgcgcgc

SEQ ID NO: 298120 - RNA, 22 nt, Bordetella pertussis
aauccgcaacccagcagcggca

SEQ ID NO: 298121 - RNA, 17 nt, Bordetella pertussis
aaucgaacuuggcgcgg

SEQ ID NO: 298122 - RNA, 24 nt, Bordetella pertussis
aaucgacgaacaaggccggagcca

SEQ ID NO: 298123 - RNA, 14 nt, Bordetella pertussis
aaucgacucggccg

SEQ ID NO: 298124 - RNA, 16 nt, Bordetella pertussis
aaucgauacgccgggc

SEQ ID NO: 298125 - RNA, 23 nt, Bordetella pertussis
aaucgaugaagaucaggcggcug

SEQ ID NO: 298126 - RNA, 18 nt, Bordetella pertussis
aaucgaugaucacgcgcu

SEQ ID NO: 298127 - RNA, 15 nt, Bordetella pertussis
aaucgcccggcgcca

SEQ ID NO: 298128 - RNA, 12 nt, Bordetella pertussis
aaucggcgucgg

SEQ ID NO: 298129 - RNA, 22 nt, Bordetella pertussis
aaucggucacgaucuggccgau

SEQ ID NO: 298130 - RNA, 17 nt, Bordetella pertussis
aaucgugccgucgauga

SEQ ID NO: 298131 - RNA, 15 nt, Bordetella pertussis
aaucguucacgcccg

SEQ ID NO: 298132 - RNA, 12 nt, Bordetella pertussis
aaugaugcgcau

SEQ ID NO: 298133 - RNA, 14 nt, Bordetella pertussis
aaugccgccgugau

SEQ ID NO: 298134 - RNA, 13 nt, Bordetella pertussis
aauggaugcgcgc

SEQ ID NO: 298135 - RNA, 17 nt, Bordetella pertussis
aauguauuuggcggcuu

SEQ ID NO: 298136 - RNA, 22 nt, Bordetella pertussis
acagcaugaccucggccugcgg

SEQ ID NO: 298137 - RNA, 13 nt, Bordetella pertussis
acagcauggcggc

SEQ ID NO: 298138 - RNA, 16 nt, Bordetella pertussis
acagcauggcggcgcc

SEQ ID NO: 298139 - RNA, 20 nt, Bordetella pertussis
acagcaucuuggccgccacg

SEQ ID NO: 298140 - RNA, 13 nt, Bordetella pertussis
acagccacgcgcg

SEQ ID NO: 298141 - RNA, 20 nt, Bordetella pertussis
acagccacgcgcgauccgcg

SEQ ID NO: 298142 - RNA, 13 nt, Bordetella pertussis
acagccccagcag

SEQ ID NO: 298143 - RNA, 21 nt, Bordetella pertussis
acagccccagcgccagcgugg

SEQ ID NO: 298144 - RNA, 20 nt, Bordetella pertussis
acagcccgcgcuggcgcagc

SEQ ID NO: 298145 - RNA, 19 nt, Bordetella pertussis
acagcccggcccccagccc

SEQ ID NO: 298146 - RNA, 15 nt, Bordetella pertussis
acagccgcagccguc

SEQ ID NO: 298147 - RNA, 20 nt, Bordetella pertussis
acagccgcagccgucgcgcu

SEQ ID NO: 298148 - RNA, 14 nt, Bordetella pertussis
acagccgccccagc

SEQ ID NO: 298149 - RNA, 16 nt, Bordetella pertussis
acagccgccccagcag

SEQ ID NO: 298150 - RNA, 16 nt, Bordetella pertussis
acagcgccagcccgcu

SEQ ID NO: 298151 - RNA, 13 nt, Bordetella pertussis
acagcgccgcggc

SEQ ID NO: 298152 - RNA, 23 nt, Bordetella pertussis
acagcgcccccagcacgguugcc

SEQ ID NO: 298153 - RNA, 19 nt, Bordetella pertussis
acagcgccgaccgcacgau

SEQ ID NO: 298154 - RNA, 19 nt, Bordetella pertussis
acagcgccugcauccggcc

SEQ ID NO: 298155 - RNA, 16 nt, Bordetella pertussis
acagcgcggcgaaggc

SEQ ID NO: 298156 - RNA, 18 nt, Bordetella pertussis
acagcgcggcgaaggcgc

SEQ ID NO: 298157 - RNA, 20 nt, Bordetella pertussis
acagcgugacggcggcgcgc

SEQ ID NO: 298158 - RNA, 22 nt, Bordetella pertussis
acagcucguagaucuugccggc

SEQ ID NO: 298159 - RNA, 15 nt, Bordetella pertussis
acagcucgcgccagg

SEQ ID NO: 298160 - RNA, 19 nt, Bordetella pertussis
acaggauggcgaucaggaa

SEQ ID NO: 298161 - RNA, 19 nt, Bordetella pertussis
acaggcacacucugucgcg

SEQ ID NO: 298162 - RNA, 21 nt, Bordetella pertussis
acaggcaccccgucguccguc

SEQ ID NO: 298163 - RNA, 14 nt, Bordetella pertussis
acaggcacccgcac

SEQ ID NO: 298164 - RNA, 17 nt, Bordetella pertussis
acaggcacccgcgcgca

SEQ ID NO: 298165 - RNA, 23 nt, Bordetella pertussis
acaggcacccugucauacgccau

SEQ ID NO: 298166 - RNA, 17 nt, Bordetella pertussis
acaggcacccuugccgc

SEQ ID NO: 298167 - RNA, 21 nt, Bordetella pertussis
acaggcaccgaacgggcgugg

SEQ ID NO: 298168 - RNA, 16 nt, Bordetella pertussis
acaggcaccgccgcac

SEQ ID NO: 298169 - RNA, 23 nt, Bordetella pertussis
acaggcacgacgcgaaccaggcc

SEQ ID NO: 298170 - RNA, 13 nt, Bordetella pertussis
acaggcacgcgcc

SEQ ID NO: 298171 - RNA, 15 nt, Bordetella pertussis
acaggcacgcgccga

SEQ ID NO: 298172 - RNA, 20 nt, Bordetella pertussis
acaggcacucuugccgcugc

SEQ ID NO: 298173 - RNA, 11 nt, Bordetella pertussis
acaggcagcgg

SEQ ID NO: 298174 - RNA, 15 nt, Bordetella pertussis
acaggccaucgccgc

SEQ ID NO: 298175 - RNA, 19 nt, Bordetella pertussis
acaggccaucggcgccaag

SEQ ID NO: 298176 - RNA, 16 nt, Bordetella pertussis
acaggcccagcgccag

SEQ ID NO: 298177 - RNA, 19 nt, Bordetella pertussis
acaggcccgcgcggccagc

SEQ ID NO: 298178 - RNA, 16 nt, Bordetella pertussis
acaggcccgcggccgc

SEQ ID NO: 298179 - RNA, 13 nt, Bordetella pertussis
acaggcugcgcag

SEQ ID NO: 298180 - RNA, 20 nt, Bordetella pertussis
acaggcuguggccgcggccc

SEQ ID NO: 298181 - RNA, 23 nt, Bordetella pertussis
acaggcuguggccgcggcccagc

SEQ ID NO: 298182 - RNA, 12 nt, Bordetella pertussis
acagggcgucgc

SEQ ID NO: 298183 - RNA, 13 nt, Bordetella pertussis
acaggggcaaggc

SEQ ID NO: 298184 - RNA, 13 nt, Bordetella pertussis
acagggggacugg

SEQ ID NO: 298185 - RNA, 13 nt, Bordetella pertussis
acagggggucugg

SEQ ID NO: 298186 - RNA, 18 nt, Bordetella pertussis
acagggucaaggcgcggc

SEQ ID NO: 298187 - RNA, 19 nt, Bordetella pertussis
acagggucaaggcgcggcc

SEQ ID NO: 298188 - RNA, 19 nt, Bordetella pertussis
acagguacccccagcggcg

SEQ ID NO: 298189 - RNA, 19 nt, Bordetella pertussis
acagguaggcgccggucca

SEQ ID NO: 298190 - RNA, 21 nt, Bordetella pertussis
acagguaggcgccgguccagc

SEQ ID NO: 298191 - RNA, 17 nt, Bordetella pertussis
acagugucuaucauggc

SEQ ID NO: 298192 - RNA, 21 nt, Bordetella pertussis
acauacgugguggugcgggcc

SEQ ID NO: 298193 - RNA, 18 nt, Bordetella pertussis
acauagcggccggcgcgc

SEQ ID NO: 298194 - RNA, 19 nt, Bordetella pertussis
acauagcggccggcgcgcg

SEQ ID NO: 298195 - RNA, 17 nt, Bordetella pertussis
acaucagcgugccgccg

SEQ ID NO: 298196 - RNA, 19 nt, Bordetella pertussis
acaucauccccagcgccgc

SEQ ID NO: 298197 - RNA, 20 nt, Bordetella pertussis
acaucauccccagcgccgcc

SEQ ID NO: 298198 - RNA, 15 nt, Bordetella pertussis
acaucaucgaccacc

SEQ ID NO: 298199 - RNA, 22 nt, Bordetella pertussis
acaucaugggcgaagccacggc

SEQ ID NO: 298200 - RNA, 24 nt, Bordetella pertussis
acaucgccgcugcgcagcagcgcg

SEQ ID NO: 298201 - RNA, 14 nt, Bordetella pertussis
acaucgcgaaggug

SEQ ID NO: 298202 - RNA, 22 nt, Bordetella pertussis
acaucgcuaugcagcugcgcca

SEQ ID NO: 298203 - RNA, 17 nt, Bordetella pertussis
acaucggaauuggcggc

SEQ ID NO: 298204 - RNA, 17 nt, Bordetella pertussis
acaucggggucgaucgc

SEQ ID NO: 298205 - RNA, 16 nt, Bordetella pertussis
acaugaccgcguccgc

SEQ ID NO: 298206 - RNA, 22 nt, Bordetella pertussis
acaugacgauggucuugccgcc

SEQ ID NO: 298207 - RNA, 23 nt, Bordetella pertussis
acaugagccaugccgucuggcgg

SEQ ID NO: 298208 - RNA, 17 nt, Bordetella pertussis
acaugaugcccagcgcc

SEQ ID NO: 298209 - RNA, 13 nt, Bordetella pertussis
acaugcagccgcc

SEQ ID NO: 298210 - RNA, 16 nt, Bordetella pertussis
acaugcccgccggcac

SEQ ID NO: 298211 - RNA, 21 nt, Bordetella pertussis
acaugcccggccaccagcgug

SEQ ID NO: 298212 - RNA, 14 nt, Bordetella pertussis
acaugccgcgcgcg

SEQ ID NO: 298213 - RNA, 17 nt, Bordetella pertussis
acaugcucgaugccggc

SEQ ID NO: 298214 - RNA, 20 nt, Bordetella pertussis
acaugcugcgacagcagggc

SEQ ID NO: 298215 - RNA, 18 nt, Bordetella pertussis
acauggccacggcccugg

SEQ ID NO: 298216 - RNA, 18 nt, Bordetella pertussis
acauggcggugaaggcgc

SEQ ID NO: 298217 - RNA, 22 nt, Bordetella pertussis
acaugggcgcgguagcgccccu

SEQ ID NO: 298218 - RNA, 22 nt, Bordetella pertussis
acauugucaagcagcgccggcu

SEQ ID NO: 298219 - RNA, 20 nt, Bordetella pertussis
accaacucgaggcggcgcag

SEQ ID NO: 298220 - RNA, 16 nt, Bordetella pertussis
accaacugccugcagc

SEQ ID NO: 298221 - RNA, 20 nt, Bordetella pertussis
accaacugguagugcggcgc

SEQ ID NO: 298222 - RNA, 21 nt, Bordetella pertussis
accaacugguagugcggcgcc

SEQ ID NO: 298223 - RNA, 12 nt, Bordetella pertussis
accaagcgccac

SEQ ID NO: 298224 - RNA, 20 nt, Bordetella pertussis
accaagcgccacagcgccau

SEQ ID NO: 298225 - RNA, 12 nt, Bordetella pertussis
accaagcugcgc

SEQ ID NO: 298226 - RNA, 14 nt, Bordetella pertussis
accaauacgccgcc

SEQ ID NO: 298227 - RNA, 22 nt, Bordetella pertussis
accaauacaggaagcgcuggcc

SEQ ID NO: 298228 - RNA, 17 nt, Bordetella pertussis
accaaucuugccaggcc

SEQ ID NO: 298229 - RNA, 21 nt, Bordetella pertussis
accaaucuugccaggcccggc

SEQ ID NO: 298230 - RNA, 15 nt, Bordetella pertussis
accacaguucggcca

SEQ ID NO: 298231 - RNA, 15 nt, Bordetella pertussis
accacaucgccggcg

SEQ ID NO: 298232 - RNA, 22 nt, Bordetella pertussis
accacaucgccggcggcguggc

SEQ ID NO: 298233 - RNA, 18 nt, Bordetella pertussis
accaccagcaucgcgccu

SEQ ID NO: 298234 - RNA, 14 nt, Bordetella pertussis
accacccaggccca

SEQ ID NO: 298235 - RNA, 15 nt, Bordetella pertussis
accacccgcgccagg

SEQ ID NO: 298236 - RNA, 15 nt, Bordetella pertussis
accacccggccaucg

SEQ ID NO: 298237 - RNA, 22 nt, Bordetella pertussis
accaccgagaaaccgauggugc

SEQ ID NO: 298238 - RNA, 15 nt, Bordetella pertussis
accaccgauccgaug

SEQ ID NO: 298239 - RNA, 22 nt, Bordetella pertussis
accaccggcacgccggcggcgc

SEQ ID NO: 298240 - RNA, 23 nt, Bordetella pertussis
accaccgucucgaacgccgcguc

SEQ ID NO: 298241 - RNA, 20 nt, Bordetella pertussis
accacgaccuuggcggccga

SEQ ID NO: 298242 - RNA, 20 nt, Bordetella pertussis
accacgagcugcagcccggc

SEQ ID NO: 298243 - RNA, 16 nt, Bordetella pertussis
accacgcccaucugcc

SEQ ID NO: 298244 - RNA, 16 nt, Bordetella pertussis
accacgcccgcgccgc

SEQ ID NO: 298245 - RNA, 17 nt, Bordetella pertussis
accacgccgcccagcgc

SEQ ID NO: 298246 - RNA, 21 nt, Bordetella pertussis
accacgccgcccagcgcgugg

SEQ ID NO: 298247 - RNA, 17 nt, Bordetella pertussis
accacgccuucgagcac

SEQ ID NO: 298248 - RNA, 14 nt, Bordetella pertussis
accacgcgcugcgc

SEQ ID NO: 298249 - RNA, 17 nt, Bordetella pertussis
accacgcgcgcgccgcc

SEQ ID NO: 298250 - RNA, 23 nt, Bordetella pertussis
accacgcugggccagaccgcgcg

SEQ ID NO: 298251 - RNA, 15 nt, Bordetella pertussis
accacggccagcagc

SEQ ID NO: 298252 - RNA, 12 nt, Bordetella pertussis
accacggcgcgc

SEQ ID NO: 298253 - RNA, 13 nt, Bordetella pertussis
accacggcgcgcc

SEQ ID NO: 298254 - RNA, 13 nt, Bordetella pertussis
accacggcgcgga

SEQ ID NO: 298255 - RNA, 12 nt, Bordetella pertussis
accacggcggcc

SEQ ID NO: 298256 - RNA, 22 nt, Bordetella pertussis
accacgggcucgcugaccggcg

SEQ ID NO: 298257 - RNA, 16 nt, Bordetella pertussis
accacgucgaucaggc

SEQ ID NO: 298258 - RNA, 20 nt, Bordetella pertussis
accacgucgcggcugggcaa

SEQ ID NO: 298259 - RNA, 19 nt, Bordetella pertussis
accacguccuggggcgcgg

SEQ ID NO: 298260 - RNA, 20 nt, Bordetella pertussis
accacuggaagcugcggccg

SEQ ID NO: 298261 - RNA, 16 nt, Bordetella pertussis
accagcaacgcgccgc

SEQ ID NO: 298262 - RNA, 15 nt, Bordetella pertussis
accagcaagccggcg

SEQ ID NO: 298263 - RNA, 18 nt, Bordetella pertussis
accagcaagccggcgguc

SEQ ID NO: 298264 - RNA, 14 nt, Bordetella pertussis
accagcaccagcgc

SEQ ID NO: 298265 - RNA, 20 nt, Bordetella pertussis
accagcaccgaugcgccggc

SEQ ID NO: 298266 - RNA, 14 nt, Bordetella pertussis
accagcaccgccac

SEQ ID NO: 298267 - RNA, 21 nt, Bordetella pertussis
accagcagcggguugcgcgcc

SEQ ID NO: 298268 - RNA, 22 nt, Bordetella pertussis
accagcagcggguugcgcgcca

SEQ ID NO: 298269 - RNA, 13 nt, Bordetella pertussis
accagcagcccca

SEQ ID NO: 298270 - RNA, 20 nt, Bordetella pertussis
accagcaggcccaccagggc

SEQ ID NO: 298271 - RNA, 18 nt, Bordetella pertussis
accagcaggcggccgacc

SEQ ID NO: 298272 - RNA, 19 nt, Bordetella pertussis
accagcaggcggccgacca

SEQ ID NO: 298273 - RNA, 14 nt, Bordetella pertussis
accagcaucgcgcc

SEQ ID NO: 298274 - RNA, 21 nt, Bordetella pertussis
accagcaucgcgccuucggcg

SEQ ID NO: 298275 - RNA, 18 nt, Bordetella pertussis
accagcauguccgccaug

SEQ ID NO: 298276 - RNA, 14 nt, Bordetella pertussis
accagcaugcgcgu

SEQ ID NO: 298277 - RNA, 23 nt, Bordetella pertussis
accagcaugcgcgucuccagcgc

SEQ ID NO: 298278 - RNA, 14 nt, Bordetella pertussis
accagccagccgcc

SEQ ID NO: 298279 - RNA, 16 nt, Bordetella pertussis
accagcccagcccgcc

SEQ ID NO: 298280 - RNA, 12 nt, Bordetella pertussis
accagcccaguu

SEQ ID NO: 298281 - RNA, 20 nt, Bordetella pertussis
accagcccgaugcgccaggc

SEQ ID NO: 298282 - RNA, 17 nt, Bordetella pertussis
accagccggccgccgaa

SEQ ID NO: 298283 - RNA, 19 nt, Bordetella pertussis
accagccggccgccgaacg

SEQ ID NO: 298284 - RNA, 15 nt, Bordetella pertussis
accagccgggcggcc

SEQ ID NO: 298285 - RNA, 15 nt, Bordetella pertussis
accagcgacagcacg

SEQ ID NO: 298286 - RNA, 23 nt, Bordetella pertussis
accagcgcauugccgccgcccug

SEQ ID NO: 298287 - RNA, 14 nt, Bordetella pertussis
accagcgccacgcc

SEQ ID NO: 298288 - RNA, 18 nt, Bordetella pertussis
accagcgccacgccggcc

SEQ ID NO: 298289 - RNA, 15 nt, Bordetella pertussis
accagcgccaggaac

SEQ ID NO: 298290 - RNA, 15 nt, Bordetella pertussis
accagcgccgacggc

SEQ ID NO: 298291 - RNA, 13 nt, Bordetella pertussis
accagcgccggcg

SEQ ID NO: 298292 - RNA, 15 nt, Bordetella pertussis
accagcgccggcgca

SEQ ID NO: 298293 - RNA, 14 nt, Bordetella pertussis
accagcgcgccgcg

SEQ ID NO: 298294 - RNA, 15 nt, Bordetella pertussis
accagcgcggccagc

SEQ ID NO: 298295 - RNA, 17 nt, Bordetella pertussis
accagcgcggccagcac

SEQ ID NO: 298296 - RNA, 22 nt, Bordetella pertussis
accagcgcggccgucaccgccg

SEQ ID NO: 298297 - RNA, 18 nt, Bordetella pertussis
accagcgcgucgccgcca

SEQ ID NO: 298298 - RNA, 22 nt, Bordetella pertussis
accagcggcgugcggcccagcc

SEQ ID NO: 298299 - RNA, 14 nt, Bordetella pertussis
accagcggcguggc

SEQ ID NO: 298300 - RNA, 15 nt, Bordetella pertussis
accagcggcuggcgg

SEQ ID NO: 298301 - RNA, 22 nt, Bordetella pertussis
accagcgucagcacaucgcccg

SEQ ID NO: 298302 - RNA, 14 nt, Bordetella pertussis
accagcucgacgcc

SEQ ID NO: 298303 - RNA, 16 nt, Bordetella pertussis
accagcucgacgccau

SEQ ID NO: 298304 - RNA, 23 nt, Bordetella pertussis
accagcuguaccgguagcccgcg

SEQ ID NO: 298305 - RNA, 18 nt, Bordetella pertussis
accagcuugcgcgccgca

SEQ ID NO: 298306 - RNA, 17 nt, Bordetella pertussis
accaggaaaaccggcgc

SEQ ID NO: 298307 - RNA, 18 nt, Bordetella pertussis
accaggaagagcuggcgc

SEQ ID NO: 298308 - RNA, 23 nt, Bordetella pertussis
accaggaaguugcccaccgacau

SEQ ID NO: 298309 - RNA, 21 nt, Bordetella pertussis
accaggaugaugcagcacacg

SEQ ID NO: 298310 - RNA, 14 nt, Bordetella pertussis
accaggcagccggc

SEQ ID NO: 298311 - RNA, 19 nt, Bordetella pertussis
accaggcagccggccccgc

SEQ ID NO: 298312 - RNA, 23 nt, Bordetella pertussis
accaggcccgccacggcgcccga

SEQ ID NO: 298313 - RNA, 21 nt, Bordetella pertussis
accaggccgacgaggcgcugu

SEQ ID NO: 298314 - RNA, 17 nt, Bordetella pertussis
acccacagcagcgcgcc

SEQ ID NO: 298315 - RNA, 20 nt, Bordetella pertussis
acccacagcagcgcgccgcc

SEQ ID NO: 298316 - RNA, 19 nt, Bordetella pertussis
acccacagguuggccgcga

SEQ ID NO: 298317 - RNA, 17 nt, Bordetella pertussis
acccacacuuggccggc

SEQ ID NO: 298318 - RNA, 18 nt, Bordetella pertussis
acccacacuuggccggcg

SEQ ID NO: 298319 - RNA, 18 nt, Bordetella pertussis
acccacccccagcagcau

SEQ ID NO: 298320 - RNA, 20 nt, Bordetella pertussis
acccacccccagcagcaugg

SEQ ID NO: 298321 - RNA, 19 nt, Bordetella pertussis
acccacggcgauggccgac

SEQ ID NO: 298322 - RNA, 18 nt, Bordetella pertussis
acccacggcguggcgcgc

SEQ ID NO: 298323 - RNA, 17 nt, Bordetella pertussis
acccagaacccggccgg

SEQ ID NO: 298324 - RNA, 21 nt, Bordetella pertussis
acccagcagcggcagcagcag

SEQ ID NO: 298325 - RNA, 14 nt, Bordetella pertussis
acccaggcgccgau

SEQ ID NO: 298326 - RNA, 20 nt, Bordetella pertussis
acccaggcggcaggcgccgc

SEQ ID NO: 298327 - RNA, 18 nt, Bordetella pertussis
acccagggcuugacgcgc

SEQ ID NO: 298328 - RNA, 20 nt, Bordetella pertussis
acccagggcuugacgcgcgu

SEQ ID NO: 298329 - RNA, 14 nt, Bordetella pertussis
acccaggucgccgc

SEQ ID NO: 298330 - RNA, 16 nt, Bordetella pertussis
acccaguucggccgcc

SEQ ID NO: 298331 - RNA, 19 nt, Bordetella pertussis
accccgccaccgcccccgc

SEQ ID NO: 298332 - RNA, 12 nt, Bordetella pertussis
accccgccgcug

SEQ ID NO: 298333 - RNA, 21 nt, Bordetella pertussis
accccgccgugccgggccugg

SEQ ID NO: 298334 - RNA, 23 nt, Bordetella pertussis
accccggucagcagggcgccgac

SEQ ID NO: 298335 - RNA, 15 nt, Bordetella pertussis
accccgucaucgccg

SEQ ID NO: 298336 - RNA, 14 nt, Bordetella pertussis
accccgucgaccgc

SEQ ID NO: 298337 - RNA, 19 nt, Bordetella pertussis
accccguugcagcccagcg

SEQ ID NO: 298338 - RNA, 21 nt, Bordetella pertussis
accccucauuggcgcgcuuga

SEQ ID NO: 298339 - RNA, 16 nt, Bordetella pertussis
accccuugcggccgcc

SEQ ID NO: 298340 - RNA, 18 nt, Bordetella pertussis
accccuugcggccgccga

SEQ ID NO: 298341 - RNA, 23 nt, Bordetella pertussis
acccgaaacccagaucgccuggg

SEQ ID NO: 298342 - RNA, 15 nt, Bordetella pertussis
acccgaaggcgcggc

SEQ ID NO: 298343 - RNA, 17 nt, Bordetella pertussis
acccgaaggcgcggccg

SEQ ID NO: 298344 - RNA, 19 nt, Bordetella pertussis
acccgaaggcgcggccggg

SEQ ID NO: 298345 - RNA, 23 nt, Bordetella pertussis
acccgagcccuggcuuggccgaa

SEQ ID NO: 298346 - RNA, 13 nt, Bordetella pertussis
acccgcacgccgg

SEQ ID NO: 298347 - RNA, 14 nt, Bordetella pertussis
acccgcacgggcag

SEQ ID NO: 298348 - RNA, 21 nt, Bordetella pertussis
acccgcacgggcagacgccau

SEQ ID NO: 298349 - RNA, 20 nt, Bordetella pertussis
acccgcaggccguuggccgc

SEQ ID NO: 298350 - RNA, 14 nt, Bordetella pertussis
acccgcaggcggcu

SEQ ID NO: 298351 - RNA, 19 nt, Bordetella pertussis
acccgccggccaucacgcc

SEQ ID NO: 298352 - RNA, 13 nt, Bordetella pertussis
acccgccgccggc

SEQ ID NO: 298353 - RNA, 16 nt, Bordetella pertussis
acccgccgcgaucagc

SEQ ID NO: 298354 - RNA, 16 nt, Bordetella pertussis
acccggcacgcgccga

SEQ ID NO: 298355 - RNA, 20 nt, Bordetella pertussis
acccggcccaugaccggcgu

SEQ ID NO: 298356 - RNA, 12 nt, Bordetella pertussis
acccggccgcug

SEQ ID NO: 298357 - RNA, 13 nt, Bordetella pertussis
acccggccggcgc

SEQ ID NO: 298358 - RNA, 14 nt, Bordetella pertussis
acccggccggcgcc

SEQ ID NO: 298359 - RNA, 16 nt, Bordetella pertussis
acccggccggcgccgg

SEQ ID NO: 298360 - RNA, 17 nt, Bordetella pertussis
acccggccucagcggcc

SEQ ID NO: 298361 - RNA, 19 nt, Bordetella pertussis
acccggcgaagccggcacg

SEQ ID NO: 298362 - RNA, 21 nt, Bordetella pertussis
acccggcucagccucgaggug

SEQ ID NO: 298363 - RNA, 17 nt, Bordetella pertussis
acccgggcgggcgucuc

SEQ ID NO: 298364 - RNA, 21 nt, Bordetella pertussis
acccggucgaucagggcgcgg

SEQ ID NO: 298365 - RNA, 23 nt, Bordetella pertussis
acccggucgaucagggcgcggac

SEQ ID NO: 298366 - RNA, 15 nt, Bordetella pertussis
acccggucggcccag

SEQ ID NO: 298367 - RNA, 19 nt, Bordetella pertussis
acccggugcagcguggcgc

SEQ ID NO: 298368 - RNA, 20 nt, Bordetella pertussis
acccgucccugguccagcag

SEQ ID NO: 298369 - RNA, 20 nt, Bordetella pertussis
acccguccuuggcguccggc

SEQ ID NO: 298370 - RNA, 14 nt, Bordetella pertussis
acccgucgacgcag

SEQ ID NO: 298371 - RNA, 18 nt, Bordetella pertussis
acccucccacgaccugca

SEQ ID NO: 298372 - RNA, 21 nt, Bordetella pertussis
acccucgugaucgaccgccag

SEQ ID NO: 298373 - RNA, 15 nt, Bordetella pertussis
acccugccccauccc

SEQ ID NO: 298374 - RNA, 15 nt, Bordetella pertussis
acccugcccggcagg

SEQ ID NO: 298375 - RNA, 16 nt, Bordetella pertussis
acccugccuccaggcg

SEQ ID NO: 298376 - RNA, 21 nt, Bordetella pertussis
acccugcgcacccgccuggac

SEQ ID NO: 298377 - RNA, 15 nt, Bordetella pertussis
acccugcgcgccgcc

SEQ ID NO: 298378 - RNA, 12 nt, Bordetella pertussis
acccuggccgaa

SEQ ID NO: 298379 - RNA, 13 nt, Bordetella pertussis
acccuucgcgcug

SEQ ID NO: 298380 - RNA, 22 nt, Bordetella pertussis
acccuugcucagucgggcagcg

SEQ ID NO: 298381 - RNA, 21 nt, Bordetella pertussis
acccuuucauuucggcgccgc

SEQ ID NO: 298382 - RNA, 20 nt, Bordetella pertussis
acccuuuuuacaugcagccg

SEQ ID NO: 298383 - RNA, 20 nt, Bordetella pertussis
accgacgcggccagcggcgc

SEQ ID NO: 298384 - RNA, 13 nt, Bordetella pertussis
accgacggccugg

SEQ ID NO: 298385 - RNA, 14 nt, Bordetella pertussis
accgacggcgcggc

SEQ ID NO: 298386 - RNA, 17 nt, Bordetella pertussis
accgacgugcugcugca

SEQ ID NO: 298387 - RNA, 14 nt, Bordetella pertussis
accgacugcgcaug

SEQ ID NO: 298388 - RNA, 16 nt, Bordetella pertussis
accgagacgcugucgc

SEQ ID NO: 298389 - RNA, 18 nt, Bordetella pertussis
accgagacgcugucgcgc

SEQ ID NO: 298390 - RNA, 15 nt, Bordetella pertussis
accgagccggccagc

SEQ ID NO: 298391 - RNA, 12 nt, Bordetella pertussis
accgagcgcgcc

SEQ ID NO: 298392 - RNA, 16 nt, Bordetella pertussis
accgcaugggccaggc

SEQ ID NO: 298393 - RNA, 17 nt, Bordetella pertussis
accgccacagcgccgcg

SEQ ID NO: 298394 - RNA, 20 nt, Bordetella pertussis
accgccaccguggcguccau

SEQ ID NO: 298395 - RNA, 18 nt, Bordetella pertussis
accgccacgaagugcgcc

SEQ ID NO: 298396 - RNA, 13 nt, Bordetella pertussis
accgccaugcgca

SEQ ID NO: 298397 - RNA, 16 nt, Bordetella pertussis
accgccaugugcgccg

SEQ ID NO: 298398 - RNA, 18 nt, Bordetella pertussis
accgccaugugcgccgcg

SEQ ID NO: 298399 - RNA, 19 nt, Bordetella pertussis
accgccaugugcgccgcgc

SEQ ID NO: 298400 - RNA, 19 nt, Bordetella pertussis
accgccgauaccacgcgcg

SEQ ID NO: 298401 - RNA, 21 nt, Bordetella pertussis
accgccgauaccacgcgcggc

SEQ ID NO: 298402 - RNA, 20 nt, Bordetella pertussis
accgccgaugccgccaucau

SEQ ID NO: 298403 - RNA, 21 nt, Bordetella pertussis
accgccgccgccaccagcggc

SEQ ID NO: 298404 - RNA, 22 nt, Bordetella pertussis
accgccgccgccaccagcggcg

SEQ ID NO: 298405 - RNA, 15 nt, Bordetella pertussis
accgccguggccggc

SEQ ID NO: 298406 - RNA, 21 nt, Bordetella pertussis
accgccugcugcgccuggccg

SEQ ID NO: 298407 - RNA, 23 nt, Bordetella pertussis
accgccugcugcgccuggccgcg

SEQ ID NO: 298408 - RNA, 20 nt, Bordetella pertussis
accgccugugccagcuggcc

SEQ ID NO: 298409 - RNA, 18 nt, Bordetella pertussis
accgccuugccuugcgcg

SEQ ID NO: 298410 - RNA, 21 nt, Bordetella pertussis
accgccuuggccgucaagcgu

SEQ ID NO: 298411 - RNA, 19 nt, Bordetella pertussis
accgcgaaccaggccugcg

SEQ ID NO: 298412 - RNA, 14 nt, Bordetella pertussis
accgcgaagccgcc

SEQ ID NO: 298413 - RNA, 15 nt, Bordetella pertussis
accgcgaagcgcgcc

SEQ ID NO: 298414 - RNA, 20 nt, Bordetella pertussis
accgcgacccgauagccgcg

SEQ ID NO: 298415 - RNA, 13 nt, Bordetella pertussis
accgcgacgcgcc

SEQ ID NO: 298416 - RNA, 23 nt, Bordetella pertussis
accgcgcgcacgaccaccagcgc

SEQ ID NO: 298417 - RNA, 22 nt, Bordetella pertussis
accgcggacgccauggcggcgg

SEQ ID NO: 298418 - RNA, 15 nt, Bordetella pertussis
accgcggcgacagcg

SEQ ID NO: 298419 - RNA, 23 nt, Bordetella pertussis
accgcggcgaucucgucgaccgc

SEQ ID NO: 298420 - RNA, 19 nt, Bordetella pertussis
accgcggcgggcucggcgc

SEQ ID NO: 298421 - RNA, 12 nt, Bordetella pertussis
accgcggcgcag

SEQ ID NO: 298422 - RNA, 22 nt, Bordetella pertussis
accgcguaggccuucaccuugc

SEQ ID NO: 298423 - RNA, 20 nt, Bordetella pertussis
accgcguaguugucggcgca

SEQ ID NO: 298424 - RNA, 21 nt, Bordetella pertussis
accgcguaguugucggcgcag

SEQ ID NO: 298425 - RNA, 19 nt, Bordetella pertussis
accgcuauuuuucgacacc

SEQ ID NO: 298426 - RNA, 17 nt, Bordetella pertussis
accggaaucaccgccgc

SEQ ID NO: 298427 - RNA, 17 nt, Bordetella pertussis
accggcacgcgccaggc

SEQ ID NO: 298428 - RNA, 15 nt, Bordetella pertussis
accggcagauggugc

SEQ ID NO: 298429 - RNA, 13 nt, Bordetella pertussis
accggaccguucc

SEQ ID NO: 298430 - RNA, 17 nt, Bordetella pertussis
accggcaggccgcgcug

SEQ ID NO: 298431 - RNA, 17 nt, Bordetella pertussis
accggccaagcuccagg

SEQ ID NO: 298432 - RNA, 18 nt, Bordetella pertussis
accggccaggggcgcugg

SEQ ID NO: 298433 - RNA, 23 nt, Bordetella pertussis
accggccagucccaggaucaccg

SEQ ID NO: 298434 - RNA, 19 nt, Bordetella pertussis
accggccagucgcggugca

SEQ ID NO: 298435 - RNA, 16 nt, Bordetella pertussis
accggccgacccgcgg

SEQ ID NO: 298436 - RNA, 14 nt, Bordetella pertussis
accggccccaccug

SEQ ID NO: 298437 - RNA, 16 nt, Bordetella pertussis
accggccccaccuggc

SEQ ID NO: 298438 - RNA, 21 nt, Bordetella pertussis
accggccgcggguggccgcuc

SEQ ID NO: 298439 - RNA, 19 nt, Bordetella pertussis
accggcgccgacgcgcugg

SEQ ID NO: 298440 - RNA, 13 nt, Bordetella pertussis
accggcgccuggc

SEQ ID NO: 298441 - RNA, 16 nt, Bordetella pertussis
accggcgccuggccca

SEQ ID NO: 298442 - RNA, 18 nt, Bordetella pertussis
accggcgccuggcccaga

SEQ ID NO: 298443 - RNA, 13 nt, Bordetella pertussis
accggcgcgcgca

SEQ ID NO: 298444 - RNA, 21 nt, Bordetella pertussis
accggcgcgcgcaugcccgac

SEQ ID NO: 298445 - RNA, 15 nt, Bordetella pertussis
accggcgcgcgcggc

SEQ ID NO: 298446 - RNA, 19 nt, Bordetella pertussis
accggcgcgcgcggccagu

SEQ ID NO: 298447 - RNA, 20 nt, Bordetella pertussis
accggcgcgcgcggccaguu

SEQ ID NO: 298448 - RNA, 12 nt, Bordetella pertussis
accggcggcacc

SEQ ID NO: 298449 - RNA, 14 nt, Bordetella pertussis
accggcggcacggc

SEQ ID NO: 298450 - RNA, 19 nt, Bordetella pertussis
accggcgugagcgccaccg

SEQ ID NO: 298451 - RNA, 20 nt, Bordetella pertussis
accggcguguccagcggcgc

SEQ ID NO: 298452 - RNA, 19 nt, Bordetella pertussis
accggcuauaccgggcugg

SEQ ID NO: 298453 - RNA, 18 nt, Bordetella pertussis
accggcugcaugcgcgaa

SEQ ID NO: 298454 - RNA, 15 nt, Bordetella pertussis
accggcugccagggc

SEQ ID NO: 298455 - RNA, 21 nt, Bordetella pertussis
accggcuuggccucggccggc

SEQ ID NO: 298456 - RNA, 18 nt, Bordetella pertussis
accggcuuggggcgcgcc

SEQ ID NO: 298457 - RNA, 14 nt, Bordetella pertussis
accgggaauggcgc

SEQ ID NO: 298458 - RNA, 18 nt, Bordetella pertussis
accgggaauggcgccgug

SEQ ID NO: 298459 - RNA, 22 nt, Bordetella pertussis
accgggcccggaucauccgggc

SEQ ID NO: 298460 - RNA, 22 nt, Bordetella pertussis
accgggccgaccaggccggcgg

SEQ ID NO: 298461 - RNA, 13 nt, Bordetella pertussis
accgggccgacgc

SEQ ID NO: 298462 - RNA, 16 nt, Bordetella pertussis
accugcccgagaccgc

SEQ ID NO: 298463 - RNA, 13 nt, Bordetella pertussis
accugccgcccga

SEQ ID NO: 298464 - RNA, 12 nt, Bordetella pertussis
accugccugccg

SEQ ID NO: 298465 - RNA, 18 nt, Bordetella pertussis
accugcgcaccggccggc

SEQ ID NO: 298466 - RNA, 14 nt, Bordetella pertussis
accugcgccaggug

SEQ ID NO: 298467 - RNA, 22 nt, Bordetella pertussis
accugcgccaggugcuugcggc

SEQ ID NO: 298468 - RNA, 19 nt, Bordetella pertussis
accugcgccgcuuccggcc

SEQ ID NO: 298469 - RNA, 17 nt, Bordetella pertussis
accugcgacagcaccgg

SEQ ID NO: 298470 - RNA, 11 nt, Bordetella pertussis
accugcgcgcc

SEQ ID NO: 298471 - RNA, 21 nt, Bordetella pertussis
accugcgcuaugggggcgagc

SEQ ID NO: 298472 - RNA, 14 nt, Bordetella pertussis
accugcgggccgca

SEQ ID NO: 298473 - RNA, 15 nt, Bordetella pertussis
accugcgggcgcagc

SEQ ID NO: 298474 - RNA, 21 nt, Bordetella pertussis
accugcgucugcacgcugaac

SEQ ID NO: 298475 - RNA, 17 nt, Bordetella pertussis
accugcugcggcacggc

SEQ ID NO: 298476 - RNA, 20 nt, Bordetella pertussis
accugcugcggcacggccag

SEQ ID NO: 298477 - RNA, 20 nt, Bordetella pertussis
accugcugcuugaccuuggc

SEQ ID NO: 298478 - RNA, 16 nt, Bordetella pertussis
accugcuggccgccgg

SEQ ID NO: 298479 - RNA, 17 nt, Bordetella pertussis
accugcuggccgccggc

SEQ ID NO: 298480 - RNA, 22 nt, Bordetella pertussis
accugcuggccgccggcgcggu

SEQ ID NO: 298481 - RNA, 22 nt, Bordetella pertussis
accugcugguuuucggacgcag

SEQ ID NO: 298482 - RNA, 22 nt, Bordetella pertussis
accugcuugacguagaugcggg

SEQ ID NO: 298483 - RNA, 23 nt, Bordetella pertussis
accugcuugacguagaugcgggu

SEQ ID NO: 298484 - RNA, 19 nt, Bordetella pertussis
accugcuuggcgaacacca

SEQ ID NO: 298485 - RNA, 18 nt, Bordetella pertussis
accuggccacaagcggcc

SEQ ID NO: 298486 - RNA, 14 nt, Bordetella pertussis
accugcuggcgcgc

SEQ ID NO: 298487 - RNA, 16 nt, Bordetella pertussis
accuggcccggcaccg

SEQ ID NO: 298488 - RNA, 23 nt, Bordetella pertussis
accuggcgaucgucaccaucgcc

SEQ ID NO: 298489 - RNA, 19 nt, Bordetella pertussis
accuggcgcccgacggcgc

SEQ ID NO: 298490 - RNA, 18 nt, Bordetella pertussis
accuggcgcccggcggcg

SEQ ID NO: 298491 - RNA, 22 nt, Bordetella pertussis
accuggcgcccggcggcgcgcu

SEQ ID NO: 298492 - RNA, 13 nt, Bordetella pertussis
accuggcgcgcgg

SEQ ID NO: 298493 - RNA, 18 nt, Bordetella pertussis
accuggcggugcgccgca

SEQ ID NO: 298494 - RNA, 17 nt, Bordetella pertussis
accugggcaaccgccac

SEQ ID NO: 298495 - RNA, 23 nt, Bordetella pertussis
accugggcaucaacacgcuggac

SEQ ID NO: 298496 - RNA, 15 nt, Bordetella pertussis
accugggccgccugc

SEQ ID NO: 298497 - RNA, 13 nt, Bordetella pertussis
accugggcgucga

SEQ ID NO: 298498 - RNA, 17 nt, Bordetella pertussis
accugguacggcauccc

SEQ ID NO: 298499 - RNA, 20 nt, Bordetella pertussis
accugguacggcaucccgac

SEQ ID NO: 298500 - RNA, 17 nt, Bordetella pertussis
accugguccugcgugau

SEQ ID NO: 298501 - RNA, 16 nt, Bordetella pertussis
accuggucgaucagcc

SEQ ID NO: 298502 - RNA, 14 nt, Bordetella pertussis
accuggucgggcgu

SEQ ID NO: 298503 - RNA, 13 nt, Bordetella pertussis
accugguggcgcu

SEQ ID NO: 298504 - RNA, 13 nt, Bordetella pertussis
accugguguucgg

SEQ ID NO: 298505 - RNA, 15 nt, Bordetella pertussis
accuguggcgcaccc

SEQ ID NO: 298506 - RNA, 16 nt, Bordetella pertussis
accuguucggcggcgc

SEQ ID NO: 298507 - RNA, 17 nt, Bordetella pertussis
accuucgcgcagcggcg

SEQ ID NO: 298508 - RNA, 18 nt, Bordetella pertussis
accuucucgaugcgcgcc

SEQ ID NO: 298509 - RNA, 14 nt, Bordetella pertussis
acgagaucgccugg

SEQ ID NO: 298510 - RNA, 14 nt, Bordetella pertussis
acgagccggccgcg

SEQ ID NO: 298511 - RNA, 20 nt, Bordetella pertussis
acgagccggccgcgcccgag

SEQ ID NO: 298512 - RNA, 15 nt, Bordetella pertussis
acgagcgcaccaugg

SEQ ID NO: 298513 - RNA, 16 nt, Bordetella pertussis
acgagcgcaccauggc

SEQ ID NO: 298514 - RNA, 16 nt, Bordetella pertussis
acgauauccaggcgcg

SEQ ID NO: 298515 - RNA, 14 nt, Bordetella pertussis
acgaucaccgccgc

SEQ ID NO: 298516 - RNA, 13 nt, Bordetella pertussis
acgaucagcgccc

SEQ ID NO: 298517 - RNA, 16 nt, Bordetella pertussis
acgaucucggcguuga

SEQ ID NO: 298518 - RNA, 14 nt, Bordetella pertussis
acgaucuggcgcgc

SEQ ID NO: 298519 - RNA, 18 nt, Bordetella pertussis
acgaugaagaugccgaac

SEQ ID NO: 298520 - RNA, 20 nt, Bordetella pertussis
acgaugcccagggccgcgcc

SEQ ID NO: 298521 - RNA, 22 nt, Bordetella pertussis
acgaugcccagggccgcgccgg

SEQ ID NO: 298522 - RNA, 21 nt, Bordetella pertussis
acgaugcccaggucguugcgc

SEQ ID NO: 298523 - RNA, 17 nt, Bordetella pertussis
acgaugcccugcgccag

SEQ ID NO: 298524 - RNA, 14 nt, Bordetella pertussis
acgaugccgccgcc

SEQ ID NO: 298525 - RNA, 15 nt, Bordetella pertussis
acgaugccgccgccg

SEQ ID NO: 298526 - RNA, 23 nt, Bordetella pertussis
acgaugccggucuccagcgcguc

SEQ ID NO: 298527 - RNA, 17 nt, Bordetella pertussis
acgaugccgucgccgcc

SEQ ID NO: 298528 - RNA, 18 nt, Bordetella pertussis
acgaugcgcgaagcgccc

SEQ ID NO: 298529 - RNA, 19 nt, Bordetella pertussis
acgaugcgcgaagcgcccu

SEQ ID NO: 298530 - RNA, 14 nt, Bordetella pertussis
acgaugcgggcauc

SEQ ID NO: 298531 - RNA, 14 nt, Bordetella pertussis
acgaugcguugcgc

SEQ ID NO: 298532 - RNA, 14 nt, Bordetella pertussis
acgauggccggcgc

SEQ ID NO: 298533 - RNA, 21 nt, Bordetella pertussis
acgauggccggggcgucgucg

SEQ ID NO: 298534 - RNA, 14 nt, Bordetella pertussis
acgauggccggauc

SEQ ID NO: 298535 - RNA, 17 nt, Bordetella pertussis
acgauggcgcccacggc

SEQ ID NO: 298536 - RNA, 17 nt, Bordetella pertussis
acgcagccuucguccug

SEQ ID NO: 298537 - RNA, 13 nt, Bordetella pertussis
acgcagccgcccg

SEQ ID NO: 298538 - RNA, 23 nt, Bordetella pertussis
acgcagcgcgugugguuggcgcu

SEQ ID NO: 298539 - RNA, 23 nt, Bordetella pertussis
acgcagcgcucauguucgggcgc

SEQ ID NO: 298540 - RNA, 15 nt, Bordetella pertussis
acgcaggcgccgcac

SEQ ID NO: 298541 - RNA, 18 nt, Bordetella pertussis
acgcaggcgggcgccgcg

SEQ ID NO: 298542 - RNA, 22 nt, Bordetella pertussis
acgcauagguaucggcccgcgc

SEQ ID NO: 298543 - RNA, 13 nt, Bordetella pertussis
acgcaucggcgcc

SEQ ID NO: 298544 - RNA, 22 nt, Bordetella pertussis
acgcaugcgacaugagcugcgc

SEQ ID NO: 298545 - RNA, 16 nt, Bordetella pertussis
acgcaugcgugcgcau

SEQ ID NO: 298546 - RNA, 17 nt, Bordetella pertussis
acgcauuugcagcggcg

SEQ ID NO: 298547 - RNA, 18 nt, Bordetella pertussis
acgccaagcugcuggccg

SEQ ID NO: 298548 - RNA, 14 nt, Bordetella pertussis
acgccaccaggccg

SEQ ID NO: 298549 - RNA, 15 nt, Bordetella pertussis
acgccaccaggccga

SEQ ID NO: 298550 - RNA, 17 nt, Bordetella pertussis
acgccaccagugcgccg

SEQ ID NO: 298551 - RNA, 21 nt, Bordetella pertussis
acgccacuacacucugcccga

SEQ ID NO: 298552 - RNA, 16 nt, Bordetella pertussis
acgccacuugcaggcc

SEQ ID NO: 298553 - RNA, 18 nt, Bordetella pertussis
acgccacuugcaggccgc

SEQ ID NO: 298554 - RNA, 22 nt, Bordetella pertussis
acgccagcccgacggccagcgc

SEQ ID NO: 298555 - RNA, 13 nt, Bordetella pertussis
acgccagcccgcc

SEQ ID NO: 298556 - RNA, 14 nt, Bordetella pertussis
acgccagcccgccg

SEQ ID NO: 298557 - RNA, 18 nt, Bordetella pertussis
acgccagcccgccggcgc

SEQ ID NO: 298558 - RNA, 20 nt, Bordetella pertussis
acgccagcccgccggcgcgc

SEQ ID NO: 298559 - RNA, 20 nt, Bordetella pertussis
acgccagggucugcuggucg

SEQ ID NO: 298560 - RNA, 22 nt, Bordetella pertussis
acgccaucgacgcuugccggcg

SEQ ID NO: 298561 - RNA, 15 nt, Bordetella pertussis
acgccaucucgcgcg

SEQ ID NO: 298562 - RNA, 19 nt, Bordetella pertussis
acgccaucuugcaggcgcc

SEQ ID NO: 298563 - RNA, 16 nt, Bordetella pertussis
acgccauggacgccga

SEQ ID NO: 298564 - RNA, 17 nt, Bordetella pertussis
acgccauggacgccgaa

SEQ ID NO: 298565 - RNA, 13 nt, Bordetella pertussis
acgccauggcggc

SEQ ID NO: 298566 - RNA, 20 nt, Bordetella pertussis
acgccauggucucguccacc

SEQ ID NO: 298567 - RNA, 13 nt, Bordetella pertussis
acgcccacgcgcc

SEQ ID NO: 298568 - RNA, 20 nt, Bordetella pertussis
acgcccacuuccucggcgcg

SEQ ID NO: 298569 - RNA, 14 nt, Bordetella pertussis
acgcccagcaggcu

SEQ ID NO: 298570 - RNA, 14 nt, Bordetella pertussis
acgcccagccugcc

SEQ ID NO: 298571 - RNA, 13 nt, Bordetella pertussis
acgcccagcuggg

SEQ ID NO: 298572 - RNA, 16 nt, Bordetella pertussis
acgcccaggccguggc

SEQ ID NO: 298573 - RNA, 20 nt, Bordetella pertussis
acgcccaggccguggcgcac

SEQ ID NO: 298574 - RNA, 15 nt, Bordetella pertussis
acgcccagcgccggc

SEQ ID NO: 298575 - RNA, 18 nt, Bordetella pertussis
acgcccagcgccggcacg

SEQ ID NO: 298576 - RNA, 17 nt, Bordetella pertussis
acgcccagguugcggcc

SEQ ID NO: 298577 - RNA, 22 nt, Bordetella pertussis
acgcccaguauggugaccggcg

SEQ ID NO: 298578 - RNA, 20 nt, Bordetella pertussis
acgcccaugauggugccggu

SEQ ID NO: 298579 - RNA, 19 nt, Bordetella pertussis
acgcccaugcgaucggccu

SEQ ID NO: 298580 - RNA, 22 nt, Bordetella pertussis
acgcccauggucaggacgacga

SEQ ID NO: 298581 - RNA, 20 nt, Bordetella pertussis
acgcccauguagaacgccag

SEQ ID NO: 298582 - RNA, 20 nt, Bordetella pertussis
acgccccggccgaucgcgcc

SEQ ID NO: 298583 - RNA, 23 nt, Bordetella pertussis
acgcccaucugguugagcagcac

SEQ ID NO: 298584 - RNA, 14 nt, Bordetella pertussis
acgcccgcccgcug

SEQ ID NO: 298585 - RNA, 17 nt, Bordetella pertussis
acgcccgcccgcugacc

SEQ ID NO: 298586 - RNA, 17 nt, Bordetella pertussis
acgcccgcgacgcuggc

SEQ ID NO: 298587 - RNA, 13 nt, Bordetella pertussis
acgcccgcgcgcg

SEQ ID NO: 298588 - RNA, 16 nt, Bordetella pertussis
acgcccgcggcgccca

SEQ ID NO: 298589 - RNA, 13 nt, Bordetella pertussis
acgcccggcccag

SEQ ID NO: 298590 - RNA, 22 nt, Bordetella pertussis
acgcccggcccaggccgggcgu

SEQ ID NO: 298591 - RNA, 13 nt, Bordetella pertussis
acgcccggcgcgg

SEQ ID NO: 298592 - RNA, 16 nt, Bordetella pertussis
acgcccgucucgcgcg

SEQ ID NO: 298593 - RNA, 17 nt, Bordetella pertussis
acgcccgucucgcgcgc

SEQ ID NO: 298594 - RNA, 20 nt, Bordetella pertussis
acgcccgucucgcgcgccag

SEQ ID NO: 298595 - RNA, 21 nt, Bordetella pertussis
acgcccgucucgcgcgccagg

SEQ ID NO: 298596 - RNA, 23 nt, Bordetella pertussis
acgcccgucucgcgcgccaggug

SEQ ID NO: 298597 - RNA, 20 nt, Bordetella pertussis
acgcccugaacuauggcgcg

SEQ ID NO: 298598 - RNA, 23 nt, Bordetella pertussis
acgcccuggccguacauggccag

SEQ ID NO: 298599 - RNA, 13 nt, Bordetella pertussis
acgcccuggcgca

SEQ ID NO: 298600 - RNA, 18 nt, Bordetella pertussis
acgcccuggcgcaggccg

SEQ ID NO: 298601 - RNA, 20 nt, Bordetella pertussis
acgcccuggcgcaggccggc

SEQ ID NO: 298602 - RNA, 15 nt, Bordetella pertussis
acgcccuggcggucu

SEQ ID NO: 298603 - RNA, 16 nt, Bordetella pertussis
acgcccuggcuggcgg

SEQ ID NO: 298604 - RNA, 18 nt, Bordetella pertussis
acgcccuggcuggcggcc

SEQ ID NO: 298605 - RNA, 21 nt, Bordetella pertussis
acgcccuggcuggcggcccau

SEQ ID NO: 298606 - RNA, 15 nt, Bordetella pertussis
acgcccuggcagcug

SEQ ID NO: 298607 - RNA, 21 nt, Bordetella pertussis
acgcccuggcagcuggcgcgg

SEQ ID NO: 298608 - RNA, 19 nt, Bordetella pertussis
acgccgaaggucuuggcgu

SEQ ID NO: 298609 - RNA, 21 nt, Bordetella pertussis
acgccgaaggucuuggcgugc

SEQ ID NO: 298610 - RNA, 22 nt, Bordetella pertussis
acgccgaacugcuugcgcgugc

SEQ ID NO: 298611 - RNA, 19 nt, Bordetella pertussis
acgccgaauugcuggagcg

SEQ ID NO: 298612 - RNA, 19 nt, Bordetella pertussis
acgccgaccucggcaccga

SEQ ID NO: 298613 - RNA, 16 nt, Bordetella pertussis
acgccgaccuggcgcc

SEQ ID NO: 298614 - RNA, 18 nt, Bordetella pertussis
acgccgaccuggcgcccg

SEQ ID NO: 298615 - RNA, 20 nt, Bordetella pertussis
acgccgaccuggcgcccgac

SEQ ID NO: 298616 - RNA, 16 nt, Bordetella pertussis
acgccgaucgcgcaca

SEQ ID NO: 298617 - RNA, 20 nt, Bordetella pertussis
acgccgaucgcgcacagcau

SEQ ID NO: 298618 - RNA, 15 nt, Bordetella pertussis
acgccgaugaccagg

SEQ ID NO: 298619 - RNA, 19 nt, Bordetella pertussis
acgccgaugaccagggcgc

SEQ ID NO: 298620 - RNA, 20 nt, Bordetella pertussis
acgccgaugaccagggcgcc

SEQ ID NO: 298621 - RNA, 14 nt, Bordetella pertussis
acgccgauggcgcg

SEQ ID NO: 298622 - RNA, 15 nt, Bordetella pertussis
acgccgauggcgcgg

SEQ ID NO: 298623 - RNA, 17 nt, Bordetella pertussis
acgccgauugaggccag

SEQ ID NO: 298624 - RNA, 20 nt, Bordetella pertussis
acgccgauugaggccagcac

SEQ ID NO: 298625 - RNA, 23 nt, Bordetella pertussis
acgccgauugaggccagcacgcc

SEQ ID NO: 298626 - RNA, 21 nt, Bordetella pertussis
acgccgauguccacgaaggcg

SEQ ID NO: 298627 - RNA, 23 nt, Bordetella pertussis
acgccgauguccacgaaggcgcc

SEQ ID NO: 298628 - RNA, 19 nt, Bordetella pertussis
acgccgccacgcuggccgc

SEQ ID NO: 298629 - RNA, 22 nt, Bordetella pertussis
acgccgccacgcuggccgcgcu

SEQ ID NO: 298630 - RNA, 16 nt, Bordetella pertussis
acgccgccauggugcc

SEQ ID NO: 298631 - RNA, 13 nt, Bordetella pertussis
acgccgcccagcg

SEQ ID NO: 298632 - RNA, 16 nt, Bordetella pertussis
acgccgcccagcgcgu

SEQ ID NO: 298633 - RNA, 14 nt, Bordetella pertussis
acgccgccgauggc

SEQ ID NO: 298634 - RNA, 17 nt, Bordetella pertussis
acgccgccgauggcgcc

SEQ ID NO: 298635 - RNA, 17 nt, Bordetella pertussis
acgccgccggccagcug

SEQ ID NO: 298636 - RNA, 14 nt, Bordetella pertussis
acgccgccggccca

SEQ ID NO: 298637 - RNA, 12 nt, Bordetella pertussis
acgccgccggcc

SEQ ID NO: 298638 - RNA, 20 nt, Bordetella pertussis
acgccgccggcgcacccggu

SEQ ID NO: 298639 - RNA, 15 nt, Bordetella pertussis
acgccgccuggcccg

SEQ ID NO: 298640 - RNA, 16 nt, Bordetella pertussis
acgccgccuggcccga

SEQ ID NO: 298641 - RNA, 20 nt, Bordetella pertussis
acgccgcgacacaaggcggc

SEQ ID NO: 298642 - RNA, 15 nt, Bordetella pertussis
acgccgcgcccgccc

SEQ ID NO: 298643 - RNA, 20 nt, Bordetella pertussis
acgccgcgcgcgucgccgcu

SEQ ID NO: 298644 - RNA, 20 nt, Bordetella pertussis
acgccgcgcucagcaccagg

SEQ ID NO: 298645 - RNA, 16 nt, Bordetella pertussis
acgccgcgccggcgcg

SEQ ID NO: 298646 - RNA, 18 nt, Bordetella pertussis
acgccgcguccgcccgcu

SEQ ID NO: 298647 - RNA, 17 nt, Bordetella pertussis
acgccgcgucgcuggcc

SEQ ID NO: 298648 - RNA, 21 nt, Bordetella pertussis
acgccgcgucgcuggccggac

SEQ ID NO: 298649 - RNA, 20 nt, Bordetella pertussis
acgccgcugauggcggucac

SEQ ID NO: 298650 - RNA, 15 nt, Bordetella pertussis
acgccggaccagucg

SEQ ID NO: 298651 - RNA, 14 nt, Bordetella pertussis
acgccggccagcuu

SEQ ID NO: 298652 - RNA, 23 nt, Bordetella pertussis
acgccggccaggucggcggccag

SEQ ID NO: 298653 - RNA, 19 nt, Bordetella pertussis
acgccggccauggcggccg

SEQ ID NO: 298654 - RNA, 21 nt, Bordetella pertussis
acgccggccauggcggccggc

SEQ ID NO: 298655 - RNA, 22 nt, Bordetella pertussis
acgccggccauggcggccggcg

SEQ ID NO: 298656 - RNA, 14 nt, Bordetella pertussis
acgccggccugacg

SEQ ID NO: 298657 - RNA, 16 nt, Bordetella pertussis
acgccggccugacgcg

SEQ ID NO: 298658 - RNA, 18 nt, Bordetella pertussis
acgccggcgaaugccggc

SEQ ID NO: 298659 - RNA, 20 nt, Bordetella pertussis
acgccggcgaaugccggccg

SEQ ID NO: 298660 - RNA, 13 nt, Bordetella pertussis
acgccggcgcgcc

SEQ ID NO: 298661 - RNA, 15 nt, Bordetella pertussis
acgccggcgcgccgg

SEQ ID NO: 298662 - RNA, 19 nt, Bordetella pertussis
acgccggcggcccauucgc

SEQ ID NO: 298663 - RNA, 14 nt, Bordetella pertussis
acgccggcggcgcu

SEQ ID NO: 298664 - RNA, 22 nt, Bordetella pertussis
acgccggcggcgugcgccugcu

SEQ ID NO: 298665 - RNA, 17 nt, Bordetella pertussis
acgccggcgggcaggcu

SEQ ID NO: 298666 - RNA, 18 nt, Bordetella pertussis
acgccggcgggcaggcuc

SEQ ID NO: 298667 - RNA, 19 nt, Bordetella pertussis
acgccggcggucacgccga

SEQ ID NO: 298668 - RNA, 17 nt, Bordetella pertussis
acgccggcucaggccag

SEQ ID NO: 298669 - RNA, 19 nt, Bordetella pertussis
acgccggcucaggccagcg

SEQ ID NO: 298670 - RNA, 21 nt, Bordetella pertussis
acgccggcucaggccagcgac

SEQ ID NO: 298671 - RNA, 20 nt, Bordetella pertussis
acgccggcuuucagcgccga

SEQ ID NO: 298672 - RNA, 21 nt, Bordetella pertussis
acgccggcuuucagcgccgag

SEQ ID NO: 298673 - RNA, 20 nt, Bordetella pertussis
acgccggguugcggcggaca

SEQ ID NO: 298674 - RNA, 18 nt, Bordetella pertussis
acgccguacugggcacca

SEQ ID NO: 298675 - RNA, 15 nt, Bordetella pertussis
acgccgucgcggacc

SEQ ID NO: 298676 - RNA, 21 nt, Bordetella pertussis
acgccgugcugaucgacaugc

SEQ ID NO: 298677 - RNA, 16 nt, Bordetella pertussis
acgccguggcgcaagg

SEQ ID NO: 298678 - RNA, 22 nt, Bordetella pertussis
acgccgugguggucacguucga

SEQ ID NO: 298679 - RNA, 14 nt, Bordetella pertussis
acgccguugcggcc

SEQ ID NO: 298680 - RNA, 19 nt, Bordetella pertussis
acgccguugcggcccgccg

SEQ ID NO: 298681 - RNA, 15 nt, Bordetella pertussis
acgccugcaccgccg

SEQ ID NO: 298682 - RNA, 17 nt, Bordetella pertussis
acgccugcaccgccgcg

SEQ ID NO: 298683 - RNA, 20 nt, Bordetella pertussis
acgccugccgcgcccggcgg

SEQ ID NO: 298684 - RNA, 22 nt, Bordetella pertussis
acgccugccgcgcccggcggcc

SEQ ID NO: 298685 - RNA, 21 nt, Bordetella pertussis
acgccugcgccggguccggcc

SEQ ID NO: 298686 - RNA, 21 nt, Bordetella pertussis
acgccuggaccggcuccggcc

SEQ ID NO: 298687 - RNA, 22 nt, Bordetella pertussis
acgccuggaccggcuccggccg

SEQ ID NO: 298688 - RNA, 15 nt, Bordetella pertussis
acgccuuccggcccc

SEQ ID NO: 298689 - RNA, 21 nt, Bordetella pertussis
acgccuuccuugaacugcgcg

SEQ ID NO: 298690 - RNA, 21 nt, Bordetella pertussis
acgccuucgagcaccaugccg

SEQ ID NO: 298691 - RNA, 15 nt, Bordetella pertussis
acgccuucggcgacu

SEQ ID NO: 298692 - RNA, 19 nt, Bordetella pertussis
acgcgacgcgggcggccga

SEQ ID NO: 298693 - RNA, 21 nt, Bordetella pertussis
acgcgaggcagaaguggucgc

SEQ ID NO: 298694 - RNA, 18 nt, Bordetella pertussis
acgcgaugcccgcgcacc

SEQ ID NO: 298695 - RNA, 20 nt, Bordetella pertussis
acgcgaugcccgcgcaccag

SEQ ID NO: 298696 - RNA, 21 nt, Bordetella pertussis
acgcgaugcccgcgcaccagg

SEQ ID NO: 298697 - RNA, 19 nt, Bordetella pertussis
acgcgaugccgaucgccga

SEQ ID NO: 298698 - RNA, 19 nt, Bordetella pertussis
acgcgauguccagcuccag

SEQ ID NO: 298699 - RNA, 22 nt, Bordetella pertussis
acgcgcauucgucgcugccgcg

SEQ ID NO: 298700 - RNA, 12 nt, Bordetella pertussis
acgcgccagcug

SEQ ID NO: 298701 - RNA, 18 nt, Bordetella pertussis
acgcgcccucaguccagc

SEQ ID NO: 298702 - RNA, 19 nt, Bordetella pertussis
acgcgccgccaggcgcgau

SEQ ID NO: 298703 - RNA, 15 nt, Bordetella pertussis
acgcgccggcccagg

SEQ ID NO: 298704 - RNA, 19 nt, Bordetella pertussis
acgcgccggcccaggcgcg

SEQ ID NO: 298705 - RNA, 23 nt, Bordetella pertussis
acgcgccggaugcgcguggcgcg

SEQ ID NO: 298706 - RNA, 14 nt, Bordetella pertussis
acgcgccgggccac

SEQ ID NO: 298707 - RNA, 19 nt, Bordetella pertussis
acgcgccgggcgaaccggu

SEQ ID NO: 298708 - RNA, 11 nt, Bordetella pertussis
acgcgcgccac

SEQ ID NO: 298709 - RNA, 21 nt, Bordetella pertussis
acgcgcgccacuauguggcgu

SEQ ID NO: 298710 - RNA, 17 nt, Bordetella pertussis
acgcgcgcaaugcgcgg

SEQ ID NO: 298711 - RNA, 21 nt, Bordetella pertussis
acgcgcgcaaugcgcggcgcu

SEQ ID NO: 298712 - RNA, 12 nt, Bordetella pertussis
acgcgcgccgca

SEQ ID NO: 298713 - RNA, 15 nt, Bordetella pertussis
acgcgcgcgcccugc

SEQ ID NO: 298714 - RNA, 22 nt, Bordetella pertussis
acgcgcgcgcccugcacgcgcg

SEQ ID NO: 298715 - RNA, 15 nt, Bordetella pertussis
acgcgcgcgccggca

SEQ ID NO: 298716 - RNA, 17 nt, Bordetella pertussis
acgcggccagaccuugc

SEQ ID NO: 298717 - RNA, 20 nt, Bordetella pertussis
acgcggccagaccuugcgcg

SEQ ID NO: 298718 - RNA, 15 nt, Bordetella pertussis
acgcggccagcggau

SEQ ID NO: 298719 - RNA, 23 nt, Bordetella pertussis
acgcggccaugcggugcgccgcg

SEQ ID NO: 298720 - RNA, 15 nt, Bordetella pertussis
acgcggccgcgcagg

SEQ ID NO: 298721 - RNA, 21 nt, Bordetella pertussis
acgcggccgcgggccgcuggu

SEQ ID NO: 298722 - RNA, 21 nt, Bordetella pertussis
acgcggccguggaggcggcgg

SEQ ID NO: 298723 - RNA, 19 nt, Bordetella pertussis
acgcggccguggcggccug

SEQ ID NO: 298724 - RNA, 14 nt, Bordetella pertussis
acgcggcgcagcau

SEQ ID NO: 298725 - RNA, 15 nt, Bordetella pertussis
acgcggcgcggcagg

SEQ ID NO: 298726 - RNA, 13 nt, Bordetella pertussis
acgcggcgcugcu

SEQ ID NO: 298727 - RNA, 20 nt, Bordetella pertussis
acgcggcgcugcuggccggc

SEQ ID NO: 298728 - RNA, 16 nt, Bordetella pertussis
acgcguacggcccugg

SEQ ID NO: 298729 - RNA, 23 nt, Bordetella pertussis
acgcguaggucaggcccacgccg

SEQ ID NO: 298730 - RNA, 14 nt, Bordetella pertussis
acgcguccaggccc

SEQ ID NO: 298731 - RNA, 16 nt, Bordetella pertussis
acgcguccucggccag

SEQ ID NO: 298732 - RNA, 17 nt, Bordetella pertussis
acgcguccucggccagc

SEQ ID NO: 298733 - RNA, 18 nt, Bordetella pertussis
acgcguccucggccagcc

SEQ ID NO: 298734 - RNA, 23 nt, Bordetella pertussis
acgcgugaacuccugcaacuggu

SEQ ID NO: 298735 - RNA, 19 nt, Bordetella pertussis
acgcgugaauaccgcgcac

SEQ ID NO: 298736 - RNA, 15 nt, Bordetella pertussis
acgcgugcaccagcc

SEQ ID NO: 298737 - RNA, 15 nt, Bordetella pertussis
acgcgugcgcggccg

SEQ ID NO: 298738 - RNA, 16 nt, Bordetella pertussis
acgcgugcgcggccgc

SEQ ID NO: 298739 - RNA, 17 nt, Bordetella pertussis
acgcgugcgcggccgcg

SEQ ID NO: 298740 - RNA, 21 nt, Bordetella pertussis
acgcgugcgcggccgcgcgcu

SEQ ID NO: 298741 - RNA, 20 nt, Bordetella pertussis
acgcguucaagucgcccugc

SEQ ID NO: 298742 - RNA, 18 nt, Bordetella pertussis
acgcguucgggcggcagg

SEQ ID NO: 298743 - RNA, 15 nt, Bordetella pertussis
acgcguucgccgucg

SEQ ID NO: 298744 - RNA, 22 nt, Bordetella pertussis
acgcguuguucgggccggcugc

SEQ ID NO: 298745 - RNA, 17 nt, Bordetella pertussis
acgcucuacacggccgc

SEQ ID NO: 298746 - RNA, 20 nt, Bordetella pertussis
acgcucuacacggccgccac

SEQ ID NO: 298747 - RNA, 15 nt, Bordetella pertussis
acgcucuugagcgcg

SEQ ID NO: 298748 - RNA, 17 nt, Bordetella pertussis
acgcucuugagcgcggc

SEQ ID NO: 298749 - RNA, 23 nt, Bordetella pertussis
acgcucuugagcgcggccucgcc

SEQ ID NO: 298750 - RNA, 16 nt, Bordetella pertussis
acgcugaagcgccgcc

SEQ ID NO: 298751 - RNA, 18 nt, Bordetella pertussis
acgcugaagcgccgccac

SEQ ID NO: 298752 - RNA, 18 nt, Bordetella pertussis
acgcugaccgagggcgcg

SEQ ID NO: 298753 - RNA, 15 nt, Bordetella pertussis
acgcuggcgcccgcc

SEQ ID NO: 298754 - RNA, 20 nt, Bordetella pertussis
acgcuggcgcccgccugcgc

SEQ ID NO: 298755 - RNA, 14 nt, Bordetella pertussis
acgcuggccgcgcu

SEQ ID NO: 298756 - RNA, 18 nt, Bordetella pertussis
acgcugggccagaccgcg

SEQ ID NO: 298757 - RNA, 22 nt, Bordetella pertussis
acgcugggccagaccgcgcgca

SEQ ID NO: 298758 - RNA, 18 nt, Bordetella pertussis
acgcugggcgaggcgcug

SEQ ID NO: 298759 - RNA, 19 nt, Bordetella pertussis
acgcugggcgaggcgcugg

SEQ ID NO: 298760 - RNA, 22 nt, Bordetella pertussis
acgcugggcgaggcgcuggccg

SEQ ID NO: 298761 - RNA, 17 nt, Bordetella pertussis
acgcugggcuacgaccc

SEQ ID NO: 298762 - RNA, 23 nt, Bordetella pertussis
acgcuggucgagagccugggcgc

SEQ ID NO: 298763 - RNA, 15 nt, Bordetella pertussis
acggccccagcgccg

SEQ ID NO: 298764 - RNA, 18 nt, Bordetella pertussis
acggccccagcgccgcga

SEQ ID NO: 298765 - RNA, 21 nt, Bordetella pertussis
acggcccgccaggaagcgggc

SEQ ID NO: 298766 - RNA, 18 nt, Bordetella pertussis
acggccgcaagcuggccg

SEQ ID NO: 298767 - RNA, 20 nt, Bordetella pertussis
acggccgcaagcuggccgau

SEQ ID NO: 298768 - RNA, 19 nt, Bordetella pertussis
acgcugguggccaccagcc

SEQ ID NO: 298769 - RNA, 22 nt, Bordetella pertussis
acgcugguggccaccagcccca

SEQ ID NO: 298770 - RNA, 22 nt, Bordetella pertussis
acggccgcaugcgugaagccca

SEQ ID NO: 298771 - RNA, 11 nt, Bordetella pertussis
acggccgccac

SEQ ID NO: 298772 - RNA, 20 nt, Bordetella pertussis
acggccgccaccugggccgc

SEQ ID NO: 298773 - RNA, 24 nt, Bordetella pertussis
acggccgccaccugggccgccugc

SEQ ID NO: 298774 - RNA, 14 nt, Bordetella pertussis
acggccggccaggc

SEQ ID NO: 298775 - RNA, 20 nt, Bordetella pertussis
acggccggccaggcgccgcu

SEQ ID NO: 298776 - RNA, 14 nt, Bordetella pertussis
acggccggcgcacg

SEQ ID NO: 298777 - RNA, 19 nt, Bordetella pertussis
acggccggcgcacgccgga

SEQ ID NO: 298778 - RNA, 20 nt, Bordetella pertussis
acggccggcgcgugcuggcg

SEQ ID NO: 298779 - RNA, 13 nt, Bordetella pertussis
acggccgggcgcc

SEQ ID NO: 298780 - RNA, 18 nt, Bordetella pertussis
acggccggucagcccagg

SEQ ID NO: 298781 - RNA, 23 nt, Bordetella pertussis
acggccggucagcccaggcgggc

SEQ ID NO: 298782 - RNA, 14 nt, Bordetella pertussis
acggccucggccag

SEQ ID NO: 298783 - RNA, 14 nt, Bordetella pertussis
acggccugcgcgcc

SEQ ID NO: 298784 - RNA, 18 nt, Bordetella pertussis
acggccugcgcgccgacc

SEQ ID NO: 298785 - RNA, 23 nt, Bordetella pertussis
acggccuggaggccgagcgcgag

SEQ ID NO: 298786 - RNA, 19 nt, Bordetella pertussis
acggccuucauggcgucgu

SEQ ID NO: 298787 - RNA, 19 nt, Bordetella pertussis
acggcgaggaggugcgccg

SEQ ID NO: 298788 - RNA, 21 nt, Bordetella pertussis
acggcgaggaggugcgccgcu

SEQ ID NO: 298789 - RNA, 19 nt, Bordetella pertussis
acggcgaugaacagcggca

SEQ ID NO: 298790 - RNA, 20 nt, Bordetella pertussis
acggcgaugaacagcggcac

SEQ ID NO: 298791 - RNA, 18 nt, Bordetella pertussis
acggcgaugccggcgcug

SEQ ID NO: 298792 - RNA, 17 nt, Bordetella pertussis
acggcgaugcugccguc

SEQ ID NO: 298793 - RNA, 15 nt, Bordetella pertussis
acggcgauggccgac

SEQ ID NO: 298794 - RNA, 18 nt, Bordetella pertussis
acggcgcccugcagggca

SEQ ID NO: 298795 - RNA, 17 nt, Bordetella pertussis
acggcgccgauccggcg

SEQ ID NO: 298796 - RNA, 19 nt, Bordetella pertussis
acggcgccgauccggcgca

SEQ ID NO: 298797 - RNA, 12 nt, Bordetella pertussis
acggcgccgucc

SEQ ID NO: 298798 - RNA, 22 nt, Bordetella pertussis
acggcgccguccgcaucgcgca

SEQ ID NO: 298799 - RNA, 18 nt, Bordetella pertussis
acggcgccuggcgcauga

SEQ ID NO: 298800 - RNA, 14 nt, Bordetella pertussis
acggcgcgaaggug

SEQ ID NO: 298801 - RNA, 12 nt, Bordetella pertussis
acggcgcgcccg

SEQ ID NO: 298802 - RNA, 17 nt, Bordetella pertussis
acggcgcgcccgccgcg

SEQ ID NO: 298803 - RNA, 12 nt, Bordetella pertussis
acggcgcgcgcc

SEQ ID NO: 298804 - RNA, 15 nt, Bordetella pertussis
acggcgcgcgccugc

SEQ ID NO: 298805 - RNA, 16 nt, Bordetella pertussis
acggcgcgcgccugcu

SEQ ID NO: 298806 - RNA, 16 nt, Bordetella pertussis
acggcgcgcgcguuga

SEQ ID NO: 298807 - RNA, 13 nt, Bordetella pertussis
acggcgcggaucg

SEQ ID NO: 298808 - RNA, 20 nt, Bordetella pertussis
acggcgcggaugccguccac

SEQ ID NO: 298809 - RNA, 16 nt, Bordetella pertussis
acggcgcggcgaucgg

SEQ ID NO: 298810 - RNA, 20 nt, Bordetella pertussis
acggcgcgggcacucggcca

SEQ ID NO: 298811 - RNA, 14 nt, Bordetella pertussis
acggcgcucggccu

SEQ ID NO: 298812 - RNA, 15 nt, Bordetella pertussis
acggcgcucggccuc

SEQ ID NO: 298813 - RNA, 17 nt, Bordetella pertussis
acggcgcucggccucga

SEQ ID NO: 298814 - RNA, 18 nt, Bordetella pertussis
acggcgucgaugcgcgcg

SEQ ID NO: 298815 - RNA, 23 nt, Bordetella pertussis
acggcgucgggcagcaggcgcau

SEQ ID NO: 298816 - RNA, 18 nt, Bordetella pertussis
acggcgugcugcgcgugg

SEQ ID NO: 298817 - RNA, 19 nt, Bordetella pertussis
acggcgugcugcggcugau

SEQ ID NO: 298818 - RNA, 22 nt, Bordetella pertussis
acggcucgagcuccugcucgau

SEQ ID NO: 298819 - RNA, 20 nt, Bordetella pertussis
acggcuggaaagaccugcgc

SEQ ID NO: 298820 - RNA, 19 nt, Bordetella pertussis
acggcuggcugggcgcgcc

SEQ ID NO: 298821 - RNA, 21 nt, Bordetella pertussis
acggcuggcugggcgcgccgc

SEQ ID NO: 298822 - RNA, 19 nt, Bordetella pertussis
acggcuucgaccacgcggc

SEQ ID NO: 298823 - RNA, 19 nt, Bordetella pertussis
acggcuugcgcauacgcgg

SEQ ID NO: 298824 - RNA, 14 nt, Bordetella pertussis
acggcuugcgcgcc

SEQ ID NO: 298825 - RNA, 21 nt, Bordetella pertussis
acggcuugcgcguaggcgcgc

SEQ ID NO: 298826 - RNA, 21 nt, Bordetella pertussis
acggcuugcuucaggcuggcc

SEQ ID NO: 298827 - RNA, 22 nt, Bordetella pertussis
acggcuuggcgugcgcgagcug

SEQ ID NO: 298828 - RNA, 17 nt, Bordetella pertussis
acgggcaggcccagcca

SEQ ID NO: 298829 - RNA, 14 nt, Bordetella pertussis
acgggccgagugga

SEQ ID NO: 298830 - RNA, 19 nt, Bordetella pertussis
acgggccauggaugcgcgc

SEQ ID NO: 298831 - RNA, 23 nt, Bordetella pertussis
acgggccgcuggucaccgccccg

SEQ ID NO: 298832 - RNA, 20 nt, Bordetella pertussis
acggggaacaggcgcgccag

SEQ ID NO: 298833 - RNA, 16 nt, Bordetella pertussis
acggggacuggcaccg

SEQ ID NO: 298834 - RNA, 22 nt, Bordetella pertussis
acggggcaucaauagcccgugc

SEQ ID NO: 298835 - RNA, 14 nt, Bordetella pertussis
acggggccgccucg

SEQ ID NO: 298836 - RNA, 23 nt, Bordetella pertussis
acggggccgccucggcggccagc

SEQ ID NO: 298837 - RNA, 17 nt, Bordetella pertussis
acggggccgccaacgcc

SEQ ID NO: 298838 - RNA, 16 nt, Bordetella pertussis
acggggcggcgccugc

SEQ ID NO: 298839 - RNA, 17 nt, Bordetella pertussis
acggggcugucgcgcgc

SEQ ID NO: 298840 - RNA, 23 nt, Bordetella pertussis
acggggcugucgcgcgcaucgcc

SEQ ID NO: 298841 - RNA, 14 nt, Bordetella pertussis
acgggguggccggc

SEQ ID NO: 298842 - RNA, 16 nt, Bordetella pertussis
acgggguggccggcgc

SEQ ID NO: 298843 - RNA, 21 nt, Bordetella pertussis
acggugaccggguggcugcgc

SEQ ID NO: 298844 - RNA, 18 nt, Bordetella pertussis
acggugagccggccaccu

SEQ ID NO: 298845 - RNA, 13 nt, Bordetella pertussis
acggugccggcca

SEQ ID NO: 298846 - RNA, 16 nt, Bordetella pertussis
acggugccggccagcc

SEQ ID NO: 298847 - RNA, 18 nt, Bordetella pertussis
acggugccuugcggcgcc

SEQ ID NO: 298848 - RNA, 20 nt, Bordetella pertussis
acggugccuugcggcgccgu

SEQ ID NO: 298849 - RNA, 14 nt, Bordetella pertussis
acggugcgcacgau

SEQ ID NO: 298850 - RNA, 21 nt, Bordetella pertussis
acggugcgcgccacggcgucg

SEQ ID NO: 298851 - RNA, 20 nt, Bordetella pertussis
acgguggauucggacgccuc

SEQ ID NO: 298852 - RNA, 21 nt, Bordetella pertussis
acgguggauucggacgccucg

SEQ ID NO: 298853 - RNA, 23 nt, Bordetella pertussis
acgguggauucggacgccucgcc

SEQ ID NO: 298854 - RNA, 15 nt, Bordetella pertussis
acguacaaccgcgcc

SEQ ID NO: 298855 - RNA, 17 nt, Bordetella pertussis
acguaccaagccugcuu

SEQ ID NO: 298856 - RNA, 15 nt, Bordetella pertussis
acguacucgccgucg

SEQ ID NO: 298857 - RNA, 19 nt, Bordetella pertussis
acguagaaauacgcgcgcg

SEQ ID NO: 298858 - RNA, 23 nt, Bordetella pertussis
acgucaaggccugcccgggcacc

SEQ ID NO: 298859 - RNA, 13 nt, Bordetella pertussis
acgucaucguggc

SEQ ID NO: 298860 - RNA, 18 nt, Bordetella pertussis
acgucaucguggccgcgc

SEQ ID NO: 298861 - RNA, 14 nt, Bordetella pertussis
acgucauggccgau

SEQ ID NO: 298862 - RNA, 18 nt, Bordetella pertussis
acgucauugcaucgcagc

SEQ ID NO: 298863 - RNA, 16 nt, Bordetella pertussis
acgucauccugggcgc

SEQ ID NO: 298864 - RNA, 21 nt, Bordetella pertussis
acgucauccugggcgcgcgcc

SEQ ID NO: 298865 - RNA, 16 nt, Bordetella pertussis
acguccagcgccgcgc

SEQ ID NO: 298866 - RNA, 21 nt, Bordetella pertussis
acguccccaccuccaccucga

SEQ ID NO: 298867 - RNA, 18 nt, Bordetella pertussis
acguccggcgggccgcug

SEQ ID NO: 298868 - RNA, 18 nt, Bordetella pertussis
acgucgaccucgagcacc

SEQ ID NO: 298869 - RNA, 15 nt, Bordetella pertussis
acgucugagcgccgg

SEQ ID NO: 298870 - RNA, 13 nt, Bordetella pertussis
acgucuugcugcc

SEQ ID NO: 298871 - RNA, 14 nt, Bordetella pertussis
acgucuugcugccg

SEQ ID NO: 298872 - RNA, 15 nt, Bordetella pertussis
acgugaagcgccgcg

SEQ ID NO: 298873 - RNA, 16 nt, Bordetella pertussis
acgugaagcgccgcgc

SEQ ID NO: 298874 - RNA, 14 nt, Bordetella pertussis
acgugacgccggcg

SEQ ID NO: 298875 - RNA, 19 nt, Bordetella pertussis
acgugccgucgggcgccgc

SEQ ID NO: 298876 - RNA, 13 nt, Bordetella pertussis
acgugcgcgccag

SEQ ID NO: 298877 - RNA, 14 nt, Bordetella pertussis
acgugcgcgccagc

SEQ ID NO: 298878 - RNA, 16 nt, Bordetella pertussis
acgugcgcgccagcuc

SEQ ID NO: 298879 - RNA, 21 nt, Bordetella pertussis
acgugcggcagggccuccugc

SEQ ID NO: 298880 - RNA, 19 nt, Bordetella pertussis
acgugguggugcgggccgc

SEQ ID NO: 298881 - RNA, 21 nt, Bordetella pertussis
acgugguggugcgggccgcgc

SEQ ID NO: 298882 - RNA, 23 nt, Bordetella pertussis
acgugguggugcgggccgcgcug

SEQ ID NO: 298883 - RNA, 16 nt, Bordetella pertussis
acguugaagcgcagcc

SEQ ID NO: 298884 - RNA, 22 nt, Bordetella pertussis
acguugcauaccucgauggcgg

SEQ ID NO: 298885 - RNA, 15 nt, Bordetella pertussis
acguugccgcgcgcg

SEQ ID NO: 298886 - RNA, 15 nt, Bordetella pertussis
acuauggcgcgcgca

SEQ ID NO: 298887 - RNA, 21 nt, Bordetella pertussis
acuauggcgcgcgcacgcugg

SEQ ID NO: 298888 - RNA, 21 nt, Bordetella pertussis
acucaccgccgcccgcaggca

SEQ ID NO: 298889 - RNA, 14 nt, Bordetella pertussis
acucacgcaaggcc

SEQ ID NO: 298890 - RNA, 20 nt, Bordetella pertussis
acucagcgcacugaucgccg

SEQ ID NO: 298891 - RNA, 12 nt, Bordetella pertussis
acuccaccggcg

SEQ ID NO: 298892 - RNA, 20 nt, Bordetella pertussis
acuccauuucgugcgugacc

SEQ ID NO: 298893 - RNA, 21 nt, Bordetella pertussis
acuccauuucgugcgugacca

SEQ ID NO: 298894 - RNA, 17 nt, Bordetella pertussis
acuccggauaccgccgc

SEQ ID NO: 298895 - RNA, 18 nt, Bordetella pertussis
acuccggcugcuugccca

SEQ ID NO: 298896 - RNA, 16 nt, Bordetella pertussis
acucgaaacgggcggc

SEQ ID NO: 298897 - RNA, 15 nt, Bordetella pertussis
acucgaacaccggcu

SEQ ID NO: 298898 - RNA, 14 nt, Bordetella pertussis
acucgaggcggcgc

SEQ ID NO: 298899 - RNA, 15 nt, Bordetella pertussis
acucgauccgggccu

SEQ ID NO: 298900 - RNA, 17 nt, Bordetella pertussis
acucgauccgggccugg

SEQ ID NO: 298901 - RNA, 20 nt, Bordetella pertussis
acucgauggcgcaggcgcgc

SEQ ID NO: 298902 - RNA, 21 nt, Bordetella pertussis
acucgauggcgcaggcgcgcc

SEQ ID NO: 298903 - RNA, 21 nt, Bordetella pertussis
acucgccgaacugccggcgcg

SEQ ID NO: 298904 - RNA, 19 nt, Bordetella pertussis
acucgccggucgcggcguu

SEQ ID NO: 298905 - RNA, 13 nt, Bordetella pertussis
acucgcugcgcgg

SEQ ID NO: 298906 - RNA, 16 nt, Bordetella pertussis
acucggccagcgcgcg

SEQ ID NO: 298907 - RNA, 22 nt, Bordetella pertussis
acucggccauggugccccaugc

SEQ ID NO: 298908 - RNA, 18 nt, Bordetella pertussis
acucgggguggaacuggg

SEQ ID NO: 298909 - RNA, 16 nt, Bordetella pertussis
acucggugcgcgcgcc

SEQ ID NO: 298910 - RNA, 14 nt, Bordetella pertussis
acucguuggccagc

SEQ ID NO: 298911 - RNA, 23 nt, Bordetella pertussis
acucguuggccagcgcgccuucg

SEQ ID NO: 298912 - RNA, 23 nt, Bordetella pertussis
acucuuccccgucggcggcaagc

SEQ ID NO: 298913 - RNA, 17 nt, Bordetella pertussis
acugccugcagcgcgcg

SEQ ID NO: 298914 - RNA, 18 nt, Bordetella pertussis
acugccugcagcgcgcgc

SEQ ID NO: 298915 - RNA, 20 nt, Bordetella pertussis
acugcuggaacaccaugccc

SEQ ID NO: 298916 - RNA, 13 nt, Bordetella pertussis
acuggcaccggcc

SEQ ID NO: 298917 - RNA, 18 nt, Bordetella pertussis
acuggcaccggccaagcu

SEQ ID NO: 298918 - RNA, 20 nt, Bordetella pertussis
acuggcagaccgagcgcgcc

SEQ ID NO: 298919 - RNA, 20 nt, Bordetella pertussis
acuggcucccaccggugcgg

SEQ ID NO: 298920 - RNA, 20 nt, Bordetella pertussis
acuggcuggucuucgagcgc

SEQ ID NO: 298921 - RNA, 18 nt, Bordetella pertussis
acugggacaggcccagcc

SEQ ID NO: 298922 - RNA, 14 nt, Bordetella pertussis
acugggcgccggcc

SEQ ID NO: 298923 - RNA, 12 nt, Bordetella pertussis
acugggcggcga

SEQ ID NO: 298924 - RNA, 17 nt, Bordetella pertussis
acuucgccgucgacguc

SEQ ID NO: 298925 - RNA, 18 nt, Bordetella pertussis
acuugaucagggccacgg

SEQ ID NO: 298926 - RNA, 13 nt, Bordetella pertussis
acuugccggccgc

SEQ ID NO: 298927 - RNA, 17 nt, Bordetella pertussis
acuugccggccgcccag

SEQ ID NO: 298928 - RNA, 16 nt, Bordetella pertussis
acuugcgcagcgcggc

SEQ ID NO: 298929 - RNA, 18 nt, Bordetella pertussis
acuugcgcagcgcggcgu

SEQ ID NO: 298930 - RNA, 20 nt, Bordetella pertussis
acuugcggguccagcaggau

SEQ ID NO: 298931 - RNA, 19 nt, Bordetella pertussis
acuuggccggcgauugcgc

SEQ ID NO: 298932 - RNA, 24 nt, Bordetella pertussis
acuuggccggcgauugcgccagcg

SEQ ID NO: 298933 - RNA, 19 nt, Bordetella pertussis
acuugggaucggccaggcc

SEQ ID NO: 298934 - RNA, 16 nt, Bordetella pertussis
acuugucgcgcccgaa

SEQ ID NO: 298935 - RNA, 18 nt, Bordetella pertussis
agcaaccccagcagcgcc

SEQ ID NO: 298936 - RNA, 17 nt, Bordetella pertussis
agcaaccggaacaccag

SEQ ID NO: 298937 - RNA, 16 nt, Bordetella pertussis
agcaacgccacgcgcg

SEQ ID NO: 298938 - RNA, 23 nt, Bordetella pertussis
agcaacgccacgcgcggaucggc

SEQ ID NO: 298939 - RNA, 12 nt, Bordetella pertussis
agcaacgccggc

SEQ ID NO: 298940 - RNA, 23 nt, Bordetella pertussis
agcaacucuuccccgucggcggc

SEQ ID NO: 298941 - RNA, 15 nt, Bordetella pertussis
agcaagcccaccggg

SEQ ID NO: 298942 - RNA, 22 nt, Bordetella pertussis
agcaagccccaggcaggcgggc

SEQ ID NO: 298943 - RNA, 15 nt, Bordetella pertussis
agcaagcgcgccaug

SEQ ID NO: 298944 - RNA, 13 nt, Bordetella pertussis
agcaaggcgucgg

SEQ ID NO: 298945 - RNA, 19 nt, Bordetella pertussis
agcaaggcgucggccaggc

SEQ ID NO: 298946 - RNA, 17 nt, Bordetella pertussis
agcaagggccccagcau

SEQ ID NO: 298947 - RNA, 21 nt, Bordetella pertussis
agcaagggcgucuucgccgac

SEQ ID NO: 298948 - RNA, 16 nt, Bordetella pertussis
agcaagucagcccgcg

SEQ ID NO: 298949 - RNA, 18 nt, Bordetella pertussis
agcaaucaagggccuuuu

SEQ ID NO: 298950 - RNA, 16 nt, Bordetella pertussis
agcaauucgaccggca

SEQ ID NO: 298951 - RNA, 15 nt, Bordetella pertussis
agcacauacgccgcc

SEQ ID NO: 298952 - RNA, 16 nt, Bordetella pertussis
agcacauacgccgccg

SEQ ID NO: 298953 - RNA, 19 nt, Bordetella pertussis
agcacauccgacagauggc

SEQ ID NO: 298954 - RNA, 20 nt, Bordetella pertussis
agcacauggcgcgccggccg

SEQ ID NO: 298955 - RNA, 22 nt, Bordetella pertussis
agcaccaacugguagugcggcg

SEQ ID NO: 298956 - RNA, 22 nt, Bordetella pertussis
agcaccacaucgccggcggcgu

SEQ ID NO: 298957 - RNA, 22 nt, Bordetella pertussis
agcaccacggcaucggcgccgc

SEQ ID NO: 298958 - RNA, 12 nt, Bordetella pertussis
agcaccacggcg

SEQ ID NO: 298959 - RNA, 19 nt, Bordetella pertussis
agcaccacguccuggggcg

SEQ ID NO: 298960 - RNA, 20 nt, Bordetella pertussis
agcaccacguccuggggcgc

SEQ ID NO: 298961 - RNA, 14 nt, Bordetella pertussis
agcaccacggcgcg

SEQ ID NO: 298962 - RNA, 16 nt, Bordetella pertussis
agcaccacggcggcca

SEQ ID NO: 298963 - RNA, 15 nt, Bordetella pertussis
agcaccaggccgaac

SEQ ID NO: 298964 - RNA, 17 nt, Bordetella pertussis
agcaccaggccgccggc

SEQ ID NO: 298965 - RNA, 19 nt, Bordetella pertussis
agcaccaggccgccggcca

SEQ ID NO: 298966 - RNA, 12 nt, Bordetella pertussis
agcaccaggcuu

SEQ ID NO: 298967 - RNA, 15 nt, Bordetella pertussis
agcaccagggcgcgc

SEQ ID NO: 298968 - RNA, 23 nt, Bordetella pertussis
agcaccagggcgcgcagcaggcc

SEQ ID NO: 298969 - RNA, 19 nt, Bordetella pertussis
agcacccagcguucgcgcu

SEQ ID NO: 298970 - RNA, 14 nt, Bordetella pertussis
agcaccccgucggc

SEQ ID NO: 298971 - RNA, 13 nt, Bordetella pertussis
agcacccgcaggc

SEQ ID NO: 298972 - RNA, 18 nt, Bordetella pertussis
agcaccgagcugccgccu

SEQ ID NO: 298973 - RNA, 21 nt, Bordetella pertussis
agcaccgagcugccgccuucg

SEQ ID NO: 298974 - RNA, 15 nt, Bordetella pertussis
agcaccgaugcgccg

SEQ ID NO: 298975 - RNA, 18 nt, Bordetella pertussis
agcaccgaugcgccggcc

SEQ ID NO: 298976 - RNA, 19 nt, Bordetella pertussis
agcaccgaugcgccggccu

SEQ ID NO: 298977 - RNA, 17 nt, Bordetella pertussis
agcaccgccaccguggc

SEQ ID NO: 298978 - RNA, 16 nt, Bordetella pertussis
agcaccgccagcgcgu

SEQ ID NO: 298979 - RNA, 12 nt, Bordetella pertussis
agcaccgccucg

SEQ ID NO: 298980 - RNA, 15 nt, Bordetella pertussis
agcaccgcggcgggc

SEQ ID NO: 298981 - RNA, 20 nt, Bordetella pertussis
agcaccggauccugcggcgc

SEQ ID NO: 298982 - RNA, 22 nt, Bordetella pertussis
agcaccggauccugcggcgcgg

SEQ ID NO: 298983 - RNA, 17 nt, Bordetella pertussis
agcaccggcacgacggc

SEQ ID NO: 298984 - RNA, 18 nt, Bordetella pertussis
agcaccggcacgcgccag

SEQ ID NO: 298985 - RNA, 15 nt, Bordetella pertussis
agcaccggccgccgc

SEQ ID NO: 298986 - RNA, 20 nt, Bordetella pertussis
agcaccggguaauggcgcuc

SEQ ID NO: 298987 - RNA, 15 nt, Bordetella pertussis
agcaccucgacgcag

SEQ ID NO: 298988 - RNA, 14 nt, Bordetella pertussis
agcaccucggcgcc

SEQ ID NO: 298989 - RNA, 20 nt, Bordetella pertussis
agcaccucggcgcccagcug

SEQ ID NO: 298990 - RNA, 15 nt, Bordetella pertussis
agcaccucggggcgc

SEQ ID NO: 298991 - RNA, 15 nt, Bordetella pertussis
agcaccugcaggccg

SEQ ID NO: 298992 - RNA, 15 nt, Bordetella pertussis
agcaccugguggcgc

SEQ ID NO: 298993 - RNA, 20 nt, Bordetella pertussis
agcaccugguggcgcuggcc

SEQ ID NO: 298994 - RNA, 20 nt, Bordetella pertussis
agcacgaagggcagcagcag

SEQ ID NO: 298995 - RNA, 11 nt, Bordetella pertussis
agcacgacgac

SEQ ID NO: 298996 - RNA, 16 nt, Bordetella pertussis
agcacgaucuggcgcg

SEQ ID NO: 298997 - RNA, 19 nt, Bordetella pertussis
agcacgaucuggcgcgcga

SEQ ID NO: 298998 - RNA, 16 nt, Bordetella pertussis
agcacgauggcgccca

SEQ ID NO: 298999 - RNA, 13 nt, Bordetella pertussis
agcacgauggggc

SEQ ID NO: 299000 - RNA, 14 nt, Bordetella pertussis
agcacgauggggcc

SEQ ID NO: 299001 - RNA, 14 nt, Bordetella pertussis
agcacgcaccaggc

SEQ ID NO: 299002 - RNA, 22 nt, Bordetella pertussis
agcacgcaccaggcgcacggcg

SEQ ID NO: 299003 - RNA, 21 nt, Bordetella pertussis
agcacgccauggucucgucca

SEQ ID NO: 299004 - RNA, 15 nt, Bordetella pertussis
agcacgccgaucgcg

SEQ ID NO: 299005 - RNA, 13 nt, Bordetella pertussis
agcacgccgcgcc

SEQ ID NO: 299006 - RNA, 13 nt, Bordetella pertussis
agcacgccgcgcu

SEQ ID NO: 299007 - RNA, 17 nt, Bordetella pertussis
agcacgcgcaccaggcc

SEQ ID NO: 299008 - RNA, 16 nt, Bordetella pertussis
agcacgcggcgcagca

SEQ ID NO: 299009 - RNA, 15 nt, Bordetella pertussis
agcacgcggcgcggc

SEQ ID NO: 299010 - RNA, 14 nt, Bordetella pertussis
agcacgcuggccuu

SEQ ID NO: 299011 - RNA, 23 nt, Bordetella pertussis
agcacggccacggccggcagcgc

SEQ ID NO: 299012 - RNA, 16 nt, Bordetella pertussis
agcacggccgcggccg

SEQ ID NO: 299013 - RNA, 13 nt, Bordetella pertussis
agcacggcgcggc

SEQ ID NO: 299014 - RNA, 16 nt, Bordetella pertussis
agcacggucggcgcgu

SEQ ID NO: 299015 - RNA, 13 nt, Bordetella pertussis
agcacgguggcgc

SEQ ID NO: 299016 - RNA, 22 nt, Bordetella pertussis
agcacgguggcgcccggcggcg

SEQ ID NO: 299017 - RNA, 23 nt, Bordetella pertussis
agcacgguggcgcccggcggcgc

SEQ ID NO: 299018 - RNA, 17 nt, Bordetella pertussis
agcacguccagcggcgc

SEQ ID NO: 299019 - RNA, 18 nt, Bordetella pertussis
agcacguccagcggcgcg

SEQ ID NO: 299020 - RNA, 14 nt, Bordetella pertussis
agcacgucggcguc

SEQ ID NO: 299021 - RNA, 16 nt, Bordetella pertussis
agcacgucggcgucgg

SEQ ID NO: 299022 - RNA, 23 nt, Bordetella pertussis
agcacuaccugcgcuaugggggc

SEQ ID NO: 299023 - RNA, 17 nt, Bordetella pertussis
agcacugcaggccaucg

SEQ ID NO: 299024 - RNA, 22 nt, Bordetella pertussis
agcacugcaggccaucgcgguc

SEQ ID NO: 299025 - RNA, 16 nt, Bordetella pertussis
agcacuugccggccgc

SEQ ID NO: 299026 - RNA, 17 nt, Bordetella pertussis
agcagaaugccgcccac

SEQ ID NO: 299027 - RNA, 17 nt, Bordetella pertussis
agcagacccuggcgcgc

SEQ ID NO: 299028 - RNA, 16 nt, Bordetella pertussis
agcagauaccggcaug

SEQ ID NO: 299029 - RNA, 17 nt, Bordetella pertussis
aaaccgacgcggccagc

SEQ ID NO: 299030 - RNA, 15 nt, Bordetella pertussis
agcagaucggcggcc

SEQ ID NO: 299031 - RNA, 15 nt, Bordetella pertussis
agcagaugcaccggc

SEQ ID NO: 299032 - RNA, 18 nt, Bordetella pertussis
agcagaugcaccggccag

SEQ ID NO: 299033 - RNA, 15 nt, Bordetella pertussis
agcagauggccaucg

SEQ ID NO: 299034 - RNA, 21 nt, Bordetella pertussis
agcagauucaugggcggcgag

SEQ ID NO: 299035 - RNA, 20 nt, Bordetella pertussis
agcagauugccgcgcggcgc

SEQ ID NO: 299036 - RNA, 18 nt, Bordetella pertussis
agcagcacgaucgcggcg

SEQ ID NO: 299037 - RNA, 23 nt, Bordetella pertussis
agcagcacgaucgcggcgcuggc

SEQ ID NO: 299038 - RNA, 15 nt, Bordetella pertussis
agcagcacgccuucg

SEQ ID NO: 299039 - RNA, 14 nt, Bordetella pertussis
agcagcagcgagcc

SEQ ID NO: 299040 - RNA, 18 nt, Bordetella pertussis
agcagcagcgagcccgcc

SEQ ID NO: 299041 - RNA, 15 nt, Bordetella pertussis
agcagcagcgccgcg

SEQ ID NO: 299042 - RNA, 17 nt, Bordetella pertussis
agcagcagcgccgcgcc

SEQ ID NO: 299043 - RNA, 12 nt, Bordetella pertussis
agcagcagcggg

SEQ ID NO: 299044 - RNA, 21 nt, Bordetella pertussis
agcagcaggcccuccggcgcc

SEQ ID NO: 299045 - RNA, 17 nt, Bordetella pertussis
agcagcagggccaggcc

SEQ ID NO: 299046 - RNA, 15 nt, Bordetella pertussis
agcagcaugcggccc

SEQ ID NO: 299047 - RNA, 17 nt, Bordetella pertussis
agcagcaugcggcccgc

SEQ ID NO: 299048 - RNA, 15 nt, Bordetella pertussis
agcagcauggcgggc

SEQ ID NO: 299049 - RNA, 15 nt, Bordetella pertussis
agcagcccagcacga

SEQ ID NO: 299050 - RNA, 13 nt, Bordetella pertussis
agcagccgcgcgg

SEQ ID NO: 299051 - RNA, 14 nt, Bordetella pertussis
agcagccgcgcggc

SEQ ID NO: 299052 - RNA, 20 nt, Bordetella pertussis
agcagcgaggacacgcagcu

SEQ ID NO: 299053 - RNA, 12 nt, Bordetella pertussis
agcagcgcaucg

SEQ ID NO: 299054 - RNA, 14 nt, Bordetella pertussis
agcagcgcaucgau

SEQ ID NO: 299055 - RNA, 23 nt, Bordetella pertussis
agcagcgcaucgaucucggccuc

SEQ ID NO: 299056 - RNA, 16 nt, Bordetella pertussis
agcagcgccaccgugg

SEQ ID NO: 299057 - RNA, 11 nt, Bordetella pertussis
agcagcgccag

SEQ ID NO: 299058 - RNA, 12 nt, Bordetella pertussis
agcagcgccagg

SEQ ID NO: 299059 - RNA, 14 nt, Bordetella pertussis
agcagcgccagggc

SEQ ID NO: 299060 - RNA, 15 nt, Bordetella pertussis
agcagcgccgccagc

SEQ ID NO: 299061 - RNA, 20 nt, Bordetella pertussis
agcagcgccgccagcauggc

SEQ ID NO: 299062 - RNA, 20 nt, Bordetella pertussis
agcagcgccggcaggcgcgc

SEQ ID NO: 299063 - RNA, 13 nt, Bordetella pertussis
agcagcgccggcu

SEQ ID NO: 299064 - RNA, 19 nt, Bordetella pertussis
agcagcgccugggggucgg

SEQ ID NO: 299065 - RNA, 20 nt, Bordetella pertussis
agcagcgcgccgggcggguc

SEQ ID NO: 299066 - RNA, 15 nt, Bordetella pertussis
agcagcgcggcgccg

SEQ ID NO: 299067 - RNA, 18 nt, Bordetella pertussis
agcagcggcucgagcggc

SEQ ID NO: 299068 - RNA, 18 nt, Bordetella pertussis
agcagcggguugcgcgcc

SEQ ID NO: 299069 - RNA, 22 nt, Bordetella pertussis
agcagcuuggccacuucgccgg

SEQ ID NO: 299070 - RNA, 15 nt, Bordetella pertussis
agcaggaacaggcug

SEQ ID NO: 299071 - RNA, 17 nt, Bordetella pertussis
agcaggagcccgcugcc

SEQ ID NO: 299072 - RNA, 19 nt, Bordetella pertussis
agcaggauggaucccuggu

SEQ ID NO: 299073 - RNA, 14 nt, Bordetella pertussis
agcaggcccaccag

SEQ ID NO: 299074 - RNA, 21 nt, Bordetella pertussis
agcagguccugcacgcgggcc

SEQ ID NO: 299075 - RNA, 21 nt, Bordetella pertussis
agcaggucggagucggcgccg

SEQ ID NO: 299076 - RNA, 23 nt, Bordetella pertussis
agcaggucggagucggcgccgcg

SEQ ID NO: 299077 - RNA, 14 nt, Bordetella pertussis
agcaggucggcgcg

SEQ ID NO: 299078 - RNA, 20 nt, Bordetella pertussis
agcaggugaugcgcgcggcc

SEQ ID NO: 299079 - RNA, 22 nt, Bordetella pertussis
agcaggugaugcgcgcggccag

SEQ ID NO: 299080 - RNA, 24 nt, Bordetella pertussis
agcaggugaugcgcgcggccagcg

SEQ ID NO: 299081 - RNA, 22 nt, Bordetella pertussis
agcagguggaucgacgagaugc

SEQ ID NO: 299082 - RNA, 18 nt, Bordetella pertussis
agcaggucguuggccguc

SEQ ID NO: 299083 - RNA, 16 nt, Bordetella pertussis
agcaucagcggcagca

SEQ ID NO: 299084 - RNA, 21 nt, Bordetella pertussis
agcaucauggcgcgcgccgcg

SEQ ID NO: 299085 - RNA, 15 nt, Bordetella pertussis
agcauccgcgccagg

SEQ ID NO: 299086 - RNA, 14 nt, Bordetella pertussis
agcaucccggcgcu

SEQ ID NO: 299087 - RNA, 15 nt, Bordetella pertussis
agcaucgccgccagc

SEQ ID NO: 299088 - RNA, 15 nt, Bordetella pertussis
agcaucgcgccuucg

SEQ ID NO: 299089 - RNA, 21 nt, Bordetella pertussis
agcaucggcacccagccggac

SEQ ID NO: 299090 - RNA, 15 nt, Bordetella pertussis
agcaucguaucgggc

SEQ ID NO: 299091 - RNA, 18 nt, Bordetella pertussis
agcaucguaucgggcguc

SEQ ID NO: 299092 - RNA, 14 nt, Bordetella pertussis
agcauggucgccuc

SEQ ID NO: 299093 - RNA, 19 nt, Bordetella pertussis
agcauguauucaucacggg

SEQ ID NO: 299094 - RNA, 20 nt, Bordetella pertussis
agcauguccguaucgcggcc

SEQ ID NO: 299095 - RNA, 21 nt, Bordetella pertussis
agccaaugccgcgguugcggu

SEQ ID NO: 299096 - RNA, 19 nt, Bordetella pertussis
agccacacgaucagcgccc

SEQ ID NO: 299097 - RNA, 15 nt, Bordetella pertussis
agccaccccgucauc

SEQ ID NO: 299098 - RNA, 18 nt, Bordetella pertussis
agccagauaaaggccgca

SEQ ID NO: 299099 - RNA, 17 nt, Bordetella pertussis
agccaggccagcgccag

SEQ ID NO: 299100 - RNA, 12 nt, Bordetella pertussis
agccaggccgca

SEQ ID NO: 299101 - RNA, 14 nt, Bordetella pertussis
agccaggccucggc

SEQ ID NO: 299102 - RNA, 14 nt, Bordetella pertussis
agccaggcgccagc

SEQ ID NO: 299103 - RNA, 13 nt, Bordetella pertussis
agccaggcggcgu

SEQ ID NO: 299104 - RNA, 16 nt, Bordetella pertussis
agcccaccagcgccac

SEQ ID NO: 299105 - RNA, 23 nt, Bordetella pertussis
agcccaccagcgccacgccggcc

SEQ ID NO: 299106 - RNA, 20 nt, Bordetella pertussis
agcccaccgcgaaccaggcc

SEQ ID NO: 299107 - RNA, 22 nt, Bordetella pertussis
agcccaccgggccggccugcgu

SEQ ID NO: 299108 - RNA, 19 nt, Bordetella pertussis
agcccacucacgcaaggcc

SEQ ID NO: 299109 - RNA, 20 nt, Bordetella pertussis
agcccacucacgcaaggccg

SEQ ID NO: 299110 - RNA, 22 nt, Bordetella pertussis
agcccacucacgcaaggccgac

SEQ ID NO: 299111 - RNA, 18 nt, Bordetella pertussis
agcccagcaaggguucgg

SEQ ID NO: 299112 - RNA, 20 nt, Bordetella pertussis
agcccagcaccacggcaucg

SEQ ID NO: 299113 - RNA, 22 nt, Bordetella pertussis
agcccagcaccugcaggccgcc

SEQ ID NO: 299114 - RNA, 14 nt, Bordetella pertussis
agcccagcccgccu

SEQ ID NO: 299115 - RNA, 11 nt, Bordetella pertussis
agcccaggccc

SEQ ID NO: 299116 - RNA, 15 nt, Bordetella pertussis
agcccagguccagcg

SEQ ID NO: 299117 - RNA, 17 nt, Bordetella pertussis
agcccagguccagcgcc

SEQ ID NO: 299118 - RNA, 20 nt, Bordetella pertussis
agcccagguccagcgccacg

SEQ ID NO: 299119 - RNA, 19 nt, Bordetella pertussis
agcccagugucucgaccau

SEQ ID NO: 299120 - RNA, 13 nt, Bordetella pertussis
agcccauggccag

SEQ ID NO: 299121 - RNA, 16 nt, Bordetella pertussis
agcccauggccaggga

SEQ ID NO: 299122 - RNA, 23 nt, Bordetella pertussis
agcccauguugaacugcaggccg

SEQ ID NO: 299123 - RNA, 13 nt, Bordetella pertussis
agccccgcggccg

SEQ ID NO: 299124 - RNA, 19 nt, Bordetella pertussis
agccccggcgcgccggccg

SEQ ID NO: 299125 - RNA, 22 nt, Bordetella pertussis
agccccguuucguaaggcugcg

SEQ ID NO: 299126 - RNA, 12 nt, Bordetella pertussis
agcccgccaucg

SEQ ID NO: 299127 - RNA, 23 nt, Bordetella pertussis
agcccgccgauccacucggccag

SEQ ID NO: 299128 - RNA, 15 nt, Bordetella pertussis
agcccgccuggcgcc

SEQ ID NO: 299129 - RNA, 17 nt, Bordetella pertussis
agcccgccuggcgccgc

SEQ ID NO: 299130 - RNA, 17 nt, Bordetella pertussis
agcccgcgcacgcccgc

SEQ ID NO: 299131 - RNA, 13 nt, Bordetella pertussis
agcccggcgccac

SEQ ID NO: 299132 - RNA, 15 nt, Bordetella pertussis
agcccggcgcgaugg

SEQ ID NO: 299133 - RNA, 22 nt, Bordetella pertussis
agcccggcugcucguucugcgc

SEQ ID NO: 299134 - RNA, 22 nt, Bordetella pertussis
agccgaaguacacggccagcac

SEQ ID NO: 299135 - RNA, 16 nt, Bordetella pertussis
agccgaauccggccag

SEQ ID NO: 299136 - RNA, 19 nt, Bordetella pertussis
agccgaauccggccagcac

SEQ ID NO: 299137 - RNA, 18 nt, Bordetella pertussis
agccgaccacccgcgcca

SEQ ID NO: 299138 - RNA, 19 nt, Bordetella pertussis
agccgaccacccgcgccag

SEQ ID NO: 299139 - RNA, 20 nt, Bordetella pertussis
agccgaccacccgcgccagg

SEQ ID NO: 299140 - RNA, 15 nt, Bordetella pertussis
agccgacaggcgcgc

SEQ ID NO: 299141 - RNA, 23 nt, Bordetella pertussis
agccgacgggcggggugaucugc

SEQ ID NO: 299142 - RNA, 20 nt, Bordetella pertussis
agccgaugaccggccaggcg

SEQ ID NO: 299143 - RNA, 23 nt, Bordetella pertussis
agccgauggcauggggcaggcgc

SEQ ID NO: 299144 - RNA, 16 nt, Bordetella pertussis
agccgcaagcuggcgg

SEQ ID NO: 299145 - RNA, 19 nt, Bordetella pertussis
agccgcaagcuggcggcgc

SEQ ID NO: 299146 - RNA, 16 nt, Bordetella pertussis
agccgcagaacagcag

SEQ ID NO: 299147 - RNA, 18 nt, Bordetella pertussis
agccgcagaacagcagcg

SEQ ID NO: 299148 - RNA, 21 nt, Bordetella pertussis
agccgcagaacagcagcguga

SEQ ID NO: 299149 - RNA, 13 nt, Bordetella pertussis
agccgcacgcccg

SEQ ID NO: 299150 - RNA, 14 nt, Bordetella pertussis
agccgcacgcccgc

SEQ ID NO: 299151 - RNA, 19 nt, Bordetella pertussis
agccgcacgcccgccugca

SEQ ID NO: 299152 - RNA, 12 nt, Bordetella pertussis
agccgccgucga

SEQ ID NO: 299153 - RNA, 14 nt, Bordetella pertussis
agccgccgucgaug

SEQ ID NO: 299154 - RNA, 16 nt, Bordetella pertussis
agccgccugagcacau

SEQ ID NO: 299155 - RNA, 23 nt, Bordetella pertussis
agccgccugagcacaugcccggc

SEQ ID NO: 299156 - RNA, 14 nt, Bordetella pertussis
agccgccuggcgcg

SEQ ID NO: 299157 - RNA, 18 nt, Bordetella pertussis
agccgccuggcgcggcgc

SEQ ID NO: 299158 - RNA, 19 nt, Bordetella pertussis
agccgccuggcgcggcgcc

SEQ ID NO: 299159 - RNA, 18 nt, Bordetella pertussis
agccgcuaugacgaccgc

SEQ ID NO: 299160 - RNA, 15 nt, Bordetella pertussis
agccgcucagguaga

SEQ ID NO: 299161 - RNA, 22 nt, Bordetella pertussis
agccgcucagguagaccacgcg

SEQ ID NO: 299162 - RNA, 15 nt, Bordetella pertussis
agccgcuccagccac

SEQ ID NO: 299163 - RNA, 19 nt, Bordetella pertussis
agccgcuccagccaccacu

SEQ ID NO: 299164 - RNA, 19 nt, Bordetella pertussis
agccgggcugccggcagca

SEQ ID NO: 299165 - RNA, 20 nt, Bordetella pertussis
agccgggcugccggcagcag

SEQ ID NO: 299166 - RNA, 19 nt, Bordetella pertussis
agccgggucuggccggccg

SEQ ID NO: 299167 - RNA, 21 nt, Bordetella pertussis
agccgggucuggccggccgcg

SEQ ID NO: 299168 - RNA, 22 nt, Bordetella pertussis
agccggguggucgcgcccgccg

SEQ ID NO: 299169 - RNA, 20 nt, Bordetella pertussis
agccgguacagccaggccag

SEQ ID NO: 299170 - RNA, 18 nt, Bordetella pertussis
agccgguaucgcggcgca

SEQ ID NO: 299171 - RNA, 22 nt, Bordetella pertussis
agccgguaucgcggcgcaggcg

SEQ ID NO: 299172 - RNA, 15 nt, Bordetella pertussis
agccgguccgccucg

SEQ ID NO: 299173 - RNA, 17 nt, Bordetella pertussis
agccggucuggucggcg

SEQ ID NO: 299174 - RNA, 18 nt, Bordetella pertussis
agccguccucgcgggccu

SEQ ID NO: 299175 - RNA, 20 nt, Bordetella pertussis
agccguccuugagggcgcgg

SEQ ID NO: 299176 - RNA, 20 nt, Bordetella pertussis
agccguccuuggcgccggcg

SEQ ID NO: 299177 - RNA, 16 nt, Bordetella pertussis
agccguuaugcggacg

SEQ ID NO: 299178 - RNA, 18 nt, Bordetella pertussis
agccuggcaaugcguggc

SEQ ID NO: 299179 - RNA, 13 nt, Bordetella pertussis
agccuggcgccaa

SEQ ID NO: 299180 - RNA, 23 nt, Bordetella pertussis
agccuggcgccaacccgccaucc

SEQ ID NO: 299181 - RNA, 23 nt, Bordetella pertussis
agccuggcguagggcugcacgau

SEQ ID NO: 299182 - RNA, 17 nt, Bordetella pertussis
agccugggcgcgcgccc

SEQ ID NO: 299183 - RNA, 20 nt, Bordetella pertussis
agccugggcgcgcgcccagg

SEQ ID NO: 299184 - RNA, 22 nt, Bordetella pertussis
aaacgccagcccgacggccagc

SEQ ID NO: 299185 - RNA, 15 nt, Bordetella pertussis
aaacgcgcagcaccg

SEQ ID NO: 299186 - RNA, 18 nt, Bordetella pertussis
aaacgcggcgccgccggc

SEQ ID NO: 299187 - RNA, 19 nt, Bordetella pertussis
agcgacaacaggucguggc

SEQ ID NO: 299188 - RNA, 14 nt, Bordetella pertussis
agcgacacggcggu

SEQ ID NO: 299189 - RNA, 23 nt, Bordetella pertussis
agcgacgcgcgccggcgcucgcg

SEQ ID NO: 299190 - RNA, 14 nt, Bordetella pertussis
agcgacuccggccg

SEQ ID NO: 299191 - RNA, 17 nt, Bordetella pertussis
agcgacuccggccgggc

SEQ ID NO: 299192 - RNA, 18 nt, Bordetella pertussis
agcgacucgaacaccggc

SEQ ID NO: 299193 - RNA, 19 nt, Bordetella pertussis
agcgacucgaacaccggcu

SEQ ID NO: 299194 - RNA, 13 nt, Bordetella pertussis
agcgagccggcca

SEQ ID NO: 299195 - RNA, 20 nt, Bordetella pertussis
agcgagccggccagcgccac

SEQ ID NO: 299196 - RNA, 13 nt, Bordetella pertussis
agcgagcggggcu

SEQ ID NO: 299197 - RNA, 16 nt, Bordetella pertussis
agcgagcugcgcugcu

SEQ ID NO: 299198 - RNA, 14 nt, Bordetella pertussis
agcgaggcggcaag

SEQ ID NO: 299199 - RNA, 17 nt, Bordetella pertussis
agcgaggcaucgaaggc

SEQ ID NO: 299200 - RNA, 21 nt, Bordetella pertussis
agcgcaagcaggucacgacgg

SEQ ID NO: 299201 - RNA, 14 nt, Bordetella pertussis
agcgcaagcccagg

SEQ ID NO: 299202 - RNA, 18 nt, Bordetella pertussis
agcgcaaggguuguggcc

SEQ ID NO: 299203 - RNA, 18 nt, Bordetella pertussis
agcgcaauggacacagcg

SEQ ID NO: 299204 - RNA, 16 nt, Bordetella pertussis
agcgcaccaccagcac

SEQ ID NO: 299205 - RNA, 20 nt, Bordetella pertussis
agcgcaccaccagcaccgcc

SEQ ID NO: 299206 - RNA, 15 nt, Bordetella pertussis
agcgcaccgacggca

SEQ ID NO: 299207 - RNA, 17 nt, Bordetella pertussis
agcgcagcgccacgcug

SEQ ID NO: 299208 - RNA, 22 nt, Bordetella pertussis
agcgcagcuucuaucugccgcg

SEQ ID NO: 299209 - RNA, 17 nt, Bordetella pertussis
agcgccagcguggccga

SEQ ID NO: 299210 - RNA, 15 nt, Bordetella pertussis
agcgccagcguucgg

SEQ ID NO: 299211 - RNA, 21 nt, Bordetella pertussis
agcgccagcguucggccaccc

SEQ ID NO: 299212 - RNA, 13 nt, Bordetella pertussis
agcgccagcguca

SEQ ID NO: 299213 - RNA, 14 nt, Bordetella pertussis
agcgccaggccgcg

SEQ ID NO: 299214 - RNA, 15 nt, Bordetella pertussis
agcgccaggccgcgc

SEQ ID NO: 299215 - RNA, 16 nt, Bordetella pertussis
agcgccaggccgcgca

SEQ ID NO: 299216 - RNA, 15 nt, Bordetella pertussis
agcgccaggcuccau

SEQ ID NO: 299217 - RNA, 17 nt, Bordetella pertussis
agcgccagggccaggcc

SEQ ID NO: 299218 - RNA, 15 nt, Bordetella pertussis
agcgccagggccgcc

SEQ ID NO: 299219 - RNA, 14 nt, Bordetella pertussis
agcgccaguccgcg

SEQ ID NO: 299220 - RNA, 18 nt, Bordetella pertussis
agcgcccgccuucgcuga

SEQ ID NO: 299221 - RNA, 17 nt, Bordetella pertussis
agcgccgaagucggcuc

SEQ ID NO: 299222 - RNA, 16 nt, Bordetella pertussis
agcgccgacgggccgg

SEQ ID NO: 299223 - RNA, 11 nt, Bordetella pertussis
agcgccgccac

SEQ ID NO: 299224 - RNA, 16 nt, Bordetella pertussis
agcgccgccaggccgu

SEQ ID NO: 299225 - RNA, 18 nt, Bordetella pertussis
agcgccgccaggccgucg

SEQ ID NO: 299226 - RNA, 22 nt, Bordetella pertussis
agcgccgccagccgcuggcgcg

SEQ ID NO: 299227 - RNA, 12 nt, Bordetella pertussis
agcgccgccagg

SEQ ID NO: 299228 - RNA, 11 nt, Bordetella pertussis
agcgccgccau

SEQ ID NO: 299229 - RNA, 19 nt, Bordetella pertussis
agcgccgccgacggcaugg

SEQ ID NO: 299230 - RNA, 13 nt, Bordetella pertussis
agcgccgccaugg

SEQ ID NO: 299231 - RNA, 22 nt, Bordetella pertussis
agcgccgccauggcggcgccca

SEQ ID NO: 299232 - RNA, 20 nt, Bordetella pertussis
agcgccgcgaacuggcgguu

SEQ ID NO: 299233 - RNA, 17 nt, Bordetella pertussis
agcgccgcgagcgccga

SEQ ID NO: 299234 - RNA, 23 nt, Bordetella pertussis
agcgccucaucguucugcgucaa

SEQ ID NO: 299235 - RNA, 16 nt, Bordetella pertussis
agcgccucgcaucggc

SEQ ID NO: 299236 - RNA, 20 nt, Bordetella pertussis
agcgccucgcaucggccugc

SEQ ID NO: 299237 - RNA, 12 nt, Bordetella pertussis
agcgccucgcgc

SEQ ID NO: 299238 - RNA, 14 nt, Bordetella pertussis
agcgccucgcgcuc

SEQ ID NO: 299239 - RNA, 17 nt, Bordetella pertussis
agcgccucgcgcuccau

SEQ ID NO: 299240 - RNA, 19 nt, Bordetella pertussis
agcgccucgcgcuccaugg

SEQ ID NO: 299241 - RNA, 17 nt, Bordetella pertussis
agcgccucgcgcucgag

SEQ ID NO: 299242 - RNA, 21 nt, Bordetella pertussis
agcgccucgcgcucgagcgcg

SEQ ID NO: 299243 - RNA, 19 nt, Bordetella pertussis
agcgccugcauccggccca

SEQ ID NO: 299244 - RNA, 12 nt, Bordetella pertussis
agcgccugcgcg

SEQ ID NO: 299245 - RNA, 17 nt, Bordetella pertussis
agcgccuggaccuggac

SEQ ID NO: 299246 - RNA, 12 nt, Bordetella pertussis
agcgccuggccg

SEQ ID NO: 299247 - RNA, 14 nt, Bordetella pertussis
agcgccuggccgag

SEQ ID NO: 299248 - RNA, 19 nt, Bordetella pertussis
agcgccugggguaggcgcg

SEQ ID NO: 299249 - RNA, 16 nt, Bordetella pertussis
agcgccugggcggcca

SEQ ID NO: 299250 - RNA, 17 nt, Bordetella pertussis
agcgccugggcggccac

SEQ ID NO: 299251 - RNA, 15 nt, Bordetella pertussis
agcgccuugccgccg

SEQ ID NO: 299252 - RNA, 14 nt, Bordetella pertussis
agcgccuugcggcg

SEQ ID NO: 299253 - RNA, 15 nt, Bordetella pertussis
agcgccuugcggcgc

SEQ ID NO: 299254 - RNA, 19 nt, Bordetella pertussis
agcgcgaaaacccgcggca

SEQ ID NO: 299255 - RNA, 21 nt, Bordetella pertussis
agcgcgaaauccagcgcgccc

SEQ ID NO: 299256 - RNA, 16 nt, Bordetella pertussis
agcgcgaacggcgggc

SEQ ID NO: 299257 - RNA, 18 nt, Bordetella pertussis
agcgcgacagcaccaacu

SEQ ID NO: 299258 - RNA, 12 nt, Bordetella pertussis
agcgcgacgcgc

SEQ ID NO: 299259 - RNA, 18 nt, Bordetella pertussis
agcgcgaugccaucgcug

SEQ ID NO: 299260 - RNA, 21 nt, Bordetella pertussis
agcgcgaugucgcccaugcug

SEQ ID NO: 299261 - RNA, 21 nt, Bordetella pertussis
agcgcgauucccuggcgcgcc

SEQ ID NO: 299262 - RNA, 16 nt, Bordetella pertussis
agcgcgcaacccacgg

SEQ ID NO: 299263 - RNA, 18 nt, Bordetella pertussis
agcgcgcaggacaaggcg

SEQ ID NO: 299264 - RNA, 20 nt, Bordetella pertussis
agcgcgcaggacaaggcgcg

SEQ ID NO: 299265 - RNA, 23 nt, Bordetella pertussis
agcgcgcaggugugccagccgcu

SEQ ID NO: 299266 - RNA, 22 nt, Bordetella pertussis
agcgcgccacaauugccagccu

SEQ ID NO: 299267 - RNA, 13 nt, Bordetella pertussis
agcgcgccagcac

SEQ ID NO: 299268 - RNA, 17 nt, Bordetella pertussis
agcgcgccagcgcgcga

SEQ ID NO: 299269 - RNA, 13 nt, Bordetella pertussis
agcgcgccaggcg

SEQ ID NO: 299270 - RNA, 21 nt, Bordetella pertussis
agcgcgccaugaacucgcgcu

SEQ ID NO: 299271 - RNA, 22 nt, Bordetella pertussis
agcgcgccaugaacucgcgcuc

SEQ ID NO: 299272 - RNA, 23 nt, Bordetella pertussis
agcgcgcccgcuugggccgcgcc

SEQ ID NO: 299273 - RNA, 16 nt, Bordetella pertussis
agcgcgcccucguuga

SEQ ID NO: 299274 - RNA, 21 nt, Bordetella pertussis
agcgcgccgaagcgcaggccu

SEQ ID NO: 299275 - RNA, 21 nt, Bordetella pertussis
agcgcgccgaggaucuggccg

SEQ ID NO: 299276 - RNA, 22 nt, Bordetella pertussis
agcgcgccgcccaccaccagcg

SEQ ID NO: 299277 - RNA, 18 nt, Bordetella pertussis
agcgcgccgcgccgggcg

SEQ ID NO: 299278 - RNA, 13 nt, Bordetella pertussis
agcgcgccgcgcg

SEQ ID NO: 299279 - RNA, 22 nt, Bordetella pertussis
agcgcgccgcgcgcggcggccu

SEQ ID NO: 299280 - RNA, 17 nt, Bordetella pertussis
agcgcgccggccagggc

SEQ ID NO: 299281 - RNA, 23 nt, Bordetella pertussis
agcgcgccucgugcgaggccacg

SEQ ID NO: 299282 - RNA, 23 nt, Bordetella pertussis
agcgcgccugcccaggccagcgc

SEQ ID NO: 299283 - RNA, 20 nt, Bordetella pertussis
agcgcgcgauagauggccag

SEQ ID NO: 299284 - RNA, 14 nt, Bordetella pertussis
agcgcgccggccag

SEQ ID NO: 299285 - RNA, 22 nt, Bordetella pertussis
agcgcgcgcagccgcgccaagg

SEQ ID NO: 299286 - RNA, 13 nt, Bordetella pertussis
agcgcgcgccagu

SEQ ID NO: 299287 - RNA, 19 nt, Bordetella pertussis
agcgcgcgcgaggcggcgg

SEQ ID NO: 299288 - RNA, 14 nt, Bordetella pertussis
agcgcgcggccggc

SEQ ID NO: 299289 - RNA, 16 nt, Bordetella pertussis
agcgcgcggccggccg

SEQ ID NO: 299290 - RNA, 17 nt, Bordetella pertussis
agcgcgcggccggccgc

SEQ ID NO: 299291 - RNA, 18 nt, Bordetella pertussis
agcgcgcgggcgauggcc

SEQ ID NO: 299292 - RNA, 19 nt, Bordetella pertussis
agcgcgcggugccgccugg

SEQ ID NO: 299293 - RNA, 23 nt, Bordetella pertussis
agcgcgcgugcagguaggacggc

SEQ ID NO: 299294 - RNA, 21 nt, Bordetella pertussis
agcgcggcauagcccaggccg

SEQ ID NO: 299295 - RNA, 14 nt, Bordetella pertussis
agcgcggcaucggc

SEQ ID NO: 299296 - RNA, 18 nt, Bordetella pertussis
agcgcggcaucggccaug

SEQ ID NO: 299297 - RNA, 16 nt, Bordetella pertussis
agcgcggcaugccgcu

SEQ ID NO: 299298 - RNA, 16 nt, Bordetella pertussis
agcgcggccacggccu

SEQ ID NO: 299299 - RNA, 17 nt, Bordetella pertussis
agcgcggccacggccug

SEQ ID NO: 299300 - RNA, 14 nt, Bordetella pertussis
agcgcggccagcac

SEQ ID NO: 299301 - RNA, 21 nt, Bordetella pertussis
agcgcggccagcaccggccgc

SEQ ID NO: 299302 - RNA, 22 nt, Bordetella pertussis
agcgcggccagcaccggccgcc

SEQ ID NO: 299303 - RNA, 14 nt, Bordetella pertussis
agcgcggccagcgc

SEQ ID NO: 299304 - RNA, 19 nt, Bordetella pertussis
agcgcggccgggucggccu

SEQ ID NO: 299305 - RNA, 16 nt, Bordetella pertussis
agcgcggccucgccgg

SEQ ID NO: 299306 - RNA, 19 nt, Bordetella pertussis
agcgcggccucgccggccu

SEQ ID NO: 299307 - RNA, 21 nt, Bordetella pertussis
agcgcggccucgccggccugg

SEQ ID NO: 299308 - RNA, 22 nt, Bordetella pertussis
agcgcggccucgccggccuggc

SEQ ID NO: 299309 - RNA, 13 nt, Bordetella pertussis
agcgcggccuuuu

SEQ ID NO: 299310 - RNA, 19 nt, Bordetella pertussis
agcgcggccaggcgcgugc

SEQ ID NO: 299311 - RNA, 22 nt, Bordetella pertussis
agcgcggccaggucggcgucgu

SEQ ID NO: 299312 - RNA, 23 nt, Bordetella pertussis
agcgcgggccacugcgccugggc

SEQ ID NO: 299313 - RNA, 13 nt, Bordetella pertussis
agcgcgggccgcc

SEQ ID NO: 299314 - RNA, 14 nt, Bordetella pertussis
agcgcgggcgcaca

SEQ ID NO: 299315 - RNA, 19 nt, Bordetella pertussis
agcgcgguggccagcgaac

SEQ ID NO: 299316 - RNA, 18 nt, Bordetella pertussis
agcgcgugucccagccgg

SEQ ID NO: 299317 - RNA, 23 nt, Bordetella pertussis
agcgcgugucccagccggcggca

SEQ ID NO: 299318 - RNA, 19 nt, Bordetella pertussis
agcgcguggaaccgccgcu

SEQ ID NO: 299319 - RNA, 21 nt, Bordetella pertussis
agcgcguggccggcgacggca

SEQ ID NO: 299320 - RNA, 23 nt, Bordetella pertussis
agcgcuggguguagucgcggccg

SEQ ID NO: 299321 - RNA, 17 nt, Bordetella pertussis
agcgcugguucgaccug

SEQ ID NO: 299322 - RNA, 18 nt, Bordetella pertussis
agcgcugguucgaccuga

SEQ ID NO: 299323 - RNA, 22 nt, Bordetella pertussis
agcgcuucgggcagcucgcgcg

SEQ ID NO: 299324 - RNA, 21 nt, Bordetella pertussis
agcgcuucgugcagcgcgugg

SEQ ID NO: 299325 - RNA, 15 nt, Bordetella pertussis
agcgcuugacggcca

SEQ ID NO: 299326 - RNA, 16 nt, Bordetella pertussis
agcgcuugacggccaa

SEQ ID NO: 299327 - RNA, 14 nt, Bordetella pertussis
agcgcuugcacgcc

SEQ ID NO: 299328 - RNA, 18 nt, Bordetella pertussis
agcgcuugcacgccauag

SEQ ID NO: 299329 - RNA, 13 nt, Bordetella pertussis
agcgcuugccuga

SEQ ID NO: 299330 - RNA, 23 nt, Bordetella pertussis
agcgcuugccugacgugcgccac

SEQ ID NO: 299331 - RNA, 13 nt, Bordetella pertussis
agcggacggcgcg

SEQ ID NO: 299332 - RNA, 18 nt, Bordetella pertussis
agcggacgguagcgcacg

SEQ ID NO: 299333 - RNA, 15 nt, Bordetella pertussis
agcggaccuggucgu

SEQ ID NO: 299334 - RNA, 15 nt, Bordetella pertussis
agcggagcgacggca

SEQ ID NO: 299335 - RNA, 17 nt, Bordetella pertussis
agcggaucgccgggcag

SEQ ID NO: 299336 - RNA, 15 nt, Bordetella pertussis
agcggaucgccggua

SEQ ID NO: 299337 - RNA, 18 nt, Bordetella pertussis
agcggaucgccgguagcg

SEQ ID NO: 299338 - RNA, 16 nt, Bordetella pertussis
agcggaucgcggcgcg

SEQ ID NO: 299339 - RNA, 16 nt, Bordetella pertussis
agcggcacgacgucgu

SEQ ID NO: 299340 - RNA, 14 nt, Bordetella pertussis
agcggcacgccggc

SEQ ID NO: 299341 - RNA, 17 nt, Bordetella pertussis
agcggcagcauggcgcg

SEQ ID NO: 299342 - RNA, 19 nt, Bordetella pertussis
agcggcagcagcagcgcgg

SEQ ID NO: 299343 - RNA, 23 nt, Bordetella pertussis
agcggcagcgcaccgucgccagg

SEQ ID NO: 299344 - RNA, 13 nt, Bordetella pertussis
agcggcagcgcgc

SEQ ID NO: 299345 - RNA, 15 nt, Bordetella pertussis
agcggcagcgcgcag

SEQ ID NO: 299346 - RNA, 16 nt, Bordetella pertussis
agcggcaggcuggccg

SEQ ID NO: 299347 - RNA, 23 nt, Bordetella pertussis
agcggcaggcuggccggcguggc

SEQ ID NO: 299348 - RNA, 22 nt, Bordetella pertussis
agcggccagcaagcgcgccaug

SEQ ID NO: 299349 - RNA, 12 nt, Bordetella pertussis
agcggcgccagc

SEQ ID NO: 299350 - RNA, 21 nt, Bordetella pertussis
agcggcgccggaucggccggc

SEQ ID NO: 299351 - RNA, 19 nt, Bordetella pertussis
agcggcgcgacgcgcuuga

SEQ ID NO: 299352 - RNA, 16 nt, Bordetella pertussis
agcggcgcgagcgcac

SEQ ID NO: 299353 - RNA, 17 nt, Bordetella pertussis
agcggcgcgagcgcaca

SEQ ID NO: 299354 - RNA, 19 nt, Bordetella pertussis
agcggcgcgagcgcacagg

SEQ ID NO: 299355 - RNA, 21 nt, Bordetella pertussis
agcggcgcgagcgcacaggcg

SEQ ID NO: 299356 - RNA, 17 nt, Bordetella pertussis
agcggcgcgcccaccag

SEQ ID NO: 299357 - RNA, 16 nt, Bordetella pertussis
agcggcgcggcgcgcu

SEQ ID NO: 299358 - RNA, 12 nt, Bordetella pertussis
agcggcggcacg

SEQ ID NO: 299359 - RNA, 19 nt, Bordetella pertussis
agcggcucuggaucgugcc

SEQ ID NO: 299360 - RNA, 21 nt, Bordetella pertussis
agcggcuggccacuggccgcg

SEQ ID NO: 299361 - RNA, 22 nt, Bordetella pertussis
agcggcuggccacuggccgcgc

SEQ ID NO: 299362 - RNA, 15 nt, Bordetella pertussis
agcggcuggcgcacg

SEQ ID NO: 299363 - RNA, 14 nt, Bordetella pertussis
agcggcuggcggug

SEQ ID NO: 299364 - RNA, 22 nt, Bordetella pertussis
agcggcuggcggugcgugcgcc

SEQ ID NO: 299365 - RNA, 18 nt, Bordetella pertussis
agcggggccgcgccggcu

SEQ ID NO: 299366 - RNA, 15 nt, Bordetella pertussis
agcggguugcgcgcc

SEQ ID NO: 299367 - RNA, 19 nt, Bordetella pertussis
agcggguugcgcgccagcu

SEQ ID NO: 299368 - RNA, 22 nt, Bordetella pertussis
agcgguagggcgauggcgcguc

SEQ ID NO: 299369 - RNA, 17 nt, Bordetella pertussis
agcgguaguccaucgcg

SEQ ID NO: 299370 - RNA, 19 nt, Bordetella pertussis
agcgguaguccaucgcguc

SEQ ID NO: 299371 - RNA, 16 nt, Bordetella pertussis
agcgguauucguugcc

SEQ ID NO: 299372 - RNA, 13 nt, Bordetella pertussis
agcgguccagcug

SEQ ID NO: 299373 - RNA, 20 nt, Bordetella pertussis
agcggucgccgcggucgcag

SEQ ID NO: 299374 - RNA, 22 nt, Bordetella pertussis
agcggucgauguccagcgccag

SEQ ID NO: 299375 - RNA, 20 nt, Bordetella pertussis
agcggugcaggggccgcacg

SEQ ID NO: 299376 - RNA, 13 nt, Bordetella pertussis
agcgguggcggcc

SEQ ID NO: 299377 - RNA, 14 nt, Bordetella pertussis
agcgguggcggccg

SEQ ID NO: 299378 - RNA, 13 nt, Bordetella pertussis
agcgguggcgggc

SEQ ID NO: 299379 - RNA, 13 nt, Bordetella pertussis
agcguccgcgcgc

SEQ ID NO: 299380 - RNA, 15 nt, Bordetella pertussis
agcgucgagcugacg

SEQ ID NO: 299381 - RNA, 17 nt, Bordetella pertussis
agcgucgauggcguaca

SEQ ID NO: 299382 - RNA, 14 nt, Bordetella pertussis
agcgucugcgcauc

SEQ ID NO: 299383 - RNA, 22 nt, Bordetella pertussis
agcgucugcgcaucgaugcggc

SEQ ID NO: 299384 - RNA, 13 nt, Bordetella pertussis
agcgucugcuggu

SEQ ID NO: 299385 - RNA, 16 nt, Bordetella pertussis
agcgugaagucggccg

SEQ ID NO: 299386 - RNA, 22 nt, Bordetella pertussis
agcgugaccgacaggccuggcu

SEQ ID NO: 299387 - RNA, 16 nt, Bordetella pertussis
agcgugacggcggcgc

SEQ ID NO: 299388 - RNA, 17 nt, Bordetella pertussis
agcgugacggcggcgcg

SEQ ID NO: 299389 - RNA, 16 nt, Bordetella pertussis
agcgugaugccgucga

SEQ ID NO: 299390 - RNA, 15 nt, Bordetella pertussis
agcgugauggggccg

SEQ ID NO: 299391 - RNA, 15 nt, Bordetella pertussis
agcgugccgccggcg

SEQ ID NO: 299392 - RNA, 16 nt, Bordetella pertussis
agcgugccgccggcgc

SEQ ID NO: 299393 - RNA, 23 nt, Bordetella pertussis
agcgugccgccggcgcguugcgg

SEQ ID NO: 299394 - RNA, 24 nt, Bordetella pertussis
agcgugccgggaugcugcucggcc

SEQ ID NO: 299395 - RNA, 17 nt, Bordetella pertussis
agcguggccaccaggcg

SEQ ID NO: 299396 - RNA, 20 nt, Bordetella pertussis
agcguggccaccaggcgcgc

SEQ ID NO: 299397 - RNA, 15 nt, Bordetella pertussis
agcguucgccgucga

SEQ ID NO: 299398 - RNA, 14 nt, Bordetella pertussis
agcguucggccacc

SEQ ID NO: 299399 - RNA, 14 nt, Bordetella pertussis
agcguugcggcguc

SEQ ID NO: 299400 - RNA, 13 nt, Bordetella pertussis
agcguuggcggcc

SEQ ID NO: 299401 - RNA, 16 nt, Bordetella pertussis
agcguuggcggccggc

SEQ ID NO: 299402 - RNA, 18 nt, Bordetella pertussis
agcguuggcggccggcca

SEQ ID NO: 299403 - RNA, 14 nt, Bordetella pertussis
agcuccagcgcgcc

SEQ ID NO: 299404 - RNA, 16 nt, Bordetella pertussis
agcuccagcuggcgca

SEQ ID NO: 299405 - RNA, 13 nt, Bordetella pertussis
agcuccggcggca

SEQ ID NO: 299406 - RNA, 21 nt, Bordetella pertussis
agcuccguauccuggucgauc

SEQ ID NO: 299407 - RNA, 14 nt, Bordetella pertussis
agcuccucgaccug

SEQ ID NO: 299408 - RNA, 14 nt, Bordetella pertussis
agcuccucggccug

SEQ ID NO: 299409 - RNA, 18 nt, Bordetella pertussis
agcuccucggccugccgg

SEQ ID NO: 299410 - RNA, 21 nt, Bordetella pertussis
agcuccucggccugccggcgc

SEQ ID NO: 299411 - RNA, 13 nt, Bordetella pertussis
agcucgcgccagg

SEQ ID NO: 299412 - RNA, 20 nt, Bordetella pertussis
agcucgcgcugcgcgccgcc

SEQ ID NO: 299413 - RNA, 23 nt, Bordetella pertussis
agcucgcgcugcgcgccgccgcg

SEQ ID NO: 299414 - RNA, 20 nt, Bordetella pertussis
agcucgcguugcaccgcguc

SEQ ID NO: 299415 - RNA, 22 nt, Bordetella pertussis
agcucgcguugcaccgcgucgg

SEQ ID NO: 299416 - RNA, 22 nt, Bordetella pertussis
agcucguagaucuugccggccg

SEQ ID NO: 299417 - RNA, 14 nt, Bordetella pertussis
agcucgucgccgcu

SEQ ID NO: 299418 - RNA, 19 nt, Bordetella pertussis
agcucgucggucagcucaa

SEQ ID NO: 299419 - RNA, 15 nt, Bordetella pertussis
agcucguggcgcgcc

SEQ ID NO: 299420 - RNA, 21 nt, Bordetella pertussis
agcucguggcgcgccuccagc

SEQ ID NO: 299421 - RNA, 22 nt, Bordetella pertussis
agcucugguccaggcggugcgu

SEQ ID NO: 299422 - RNA, 17 nt, Bordetella pertussis
agcucuucgagcgcggc

SEQ ID NO: 299423 - RNA, 19 nt, Bordetella pertussis
agcucuucgagcgcggcgc

SEQ ID NO: 299424 - RNA, 22 nt, Bordetella pertussis
agcucuuucuguaccagcaugu

SEQ ID NO: 299425 - RNA, 20 nt, Bordetella pertussis
agcugaccucgcccaggccg

SEQ ID NO: 299426 - RNA, 15 nt, Bordetella pertussis
agcugagcaccagca

SEQ ID NO: 299427 - RNA, 15 nt, Bordetella pertussis
agcugcucaccucga

SEQ ID NO: 299428 - RNA, 20 nt, Bordetella pertussis
agcugcucaccucgaucgcg

SEQ ID NO: 299429 - RNA, 20 nt, Bordetella pertussis
agcugcucgagcaugcgggc

SEQ ID NO: 299430 - RNA, 14 nt, Bordetella pertussis
agcugcuggcgcgc

SEQ ID NO: 299431 - RNA, 17 nt, Bordetella pertussis
agcugcuggcgcgccag

SEQ ID NO: 299432 - RNA, 18 nt, Bordetella pertussis
agcugcuggcgcgccagg

SEQ ID NO: 299433 - RNA, 20 nt, Bordetella pertussis
agcugcuggcgcgccaggcg

SEQ ID NO: 299434 - RNA, 14 nt, Bordetella pertussis
agcugcuguuggcc

SEQ ID NO: 299435 - RNA, 19 nt, Bordetella pertussis
agcugcuguuggccuucgg

SEQ ID NO: 299436 - RNA, 23 nt, Bordetella pertussis
agcugcuugcccaggccggcgcg

SEQ ID NO: 299437 - RNA, 15 nt, Bordetella pertussis
agcuggaagcgcgcc

SEQ ID NO: 299438 - RNA, 17 nt, Bordetella pertussis
agcuggaagcgcgccag

SEQ ID NO: 299439 - RNA, 20 nt, Bordetella pertussis
agcuggaccccuugcggccg

SEQ ID NO: 299440 - RNA, 19 nt, Bordetella pertussis
agcuggagaagcgccgcgc

SEQ ID NO: 299441 - RNA, 24 nt, Bordetella pertussis
agcuggcccaguucggcgacgauc

SEQ ID NO: 299442 - RNA, 14 nt, Bordetella pertussis
agcuggccggcgac

SEQ ID NO: 299443 - RNA, 17 nt, Bordetella pertussis
agcuggccggcgacuuc

SEQ ID NO: 299444 - RNA, 18 nt, Bordetella pertussis
agcuggcgcaccaggcug

SEQ ID NO: 299445 - RNA, 17 nt, Bordetella pertussis
agcuggcgcagcacgcc

SEQ ID NO: 299446 - RNA, 21 nt, Bordetella pertussis
aggcacucuugccgcugcgcg

SEQ ID NO: 299447 - RNA, 13 nt, Bordetella pertussis
aggcacuggcgcg

SEQ ID NO: 299448 - RNA, 12 nt, Bordetella pertussis
aggcagccggcc

SEQ ID NO: 299449 - RNA, 14 nt, Bordetella pertussis
aggcagccggcccc

SEQ ID NO: 299450 - RNA, 21 nt, Bordetella pertussis
aggcagccugucguucggcug

SEQ ID NO: 299451 - RNA, 16 nt, Bordetella pertussis
aggcagcgcggccggc

SEQ ID NO: 299452 - RNA, 13 nt, Bordetella pertussis
aggcagcggccgc

SEQ ID NO: 299453 - RNA, 16 nt, Bordetella pertussis
aggcagcggccgcgcg

SEQ ID NO: 299454 - RNA, 20 nt, Bordetella pertussis
aggcaggcgggcccgcaucg

SEQ ID NO: 299455 - RNA, 13 nt, Bordetella pertussis
aggcaggcgcgcc

SEQ ID NO: 299456 - RNA, 16 nt, Bordetella pertussis
aggcaguuggcggcgc

SEQ ID NO: 299457 - RNA, 19 nt, Bordetella pertussis
aggcauacaggcuguggcc

SEQ ID NO: 299458 - RNA, 20 nt, Bordetella pertussis
aggcauacaggcuguggccg

SEQ ID NO: 299459 - RNA, 17 nt, Bordetella pertussis
aggcaucgaccagcgca

SEQ ID NO: 299460 - RNA, 15 nt, Bordetella pertussis
aggcaugcgccagcg

SEQ ID NO: 299461 - RNA, 23 nt, Bordetella pertussis
aggcauucgaacaacagcgccug

SEQ ID NO: 299462 - RNA, 20 nt, Bordetella pertussis
aggcauucgugaugccccag

SEQ ID NO: 299463 - RNA, 22 nt, Bordetella pertussis
aggccacgaugauggaggccag

SEQ ID NO: 299464 - RNA, 13 nt, Bordetella pertussis
aggccagcacgcc

SEQ ID NO: 299465 - RNA, 16 nt, Bordetella pertussis
aggccagcacgccggc

SEQ ID NO: 299466 - RNA, 14 nt, Bordetella pertussis
aggccagcccgcgc

SEQ ID NO: 299467 - RNA, 16 nt, Bordetella pertussis
aggccagcccgcgcgc

SEQ ID NO: 299468 - RNA, 14 nt, Bordetella pertussis
aggccagcgccgcg

SEQ ID NO: 299469 - RNA, 18 nt, Bordetella pertussis
aggccagcgccgcggccg

SEQ ID NO: 299470 - RNA, 16 nt, Bordetella pertussis
aggcccagccgcucgu

SEQ ID NO: 299471 - RNA, 14 nt, Bordetella pertussis
aggcccagcgccag

SEQ ID NO: 299472 - RNA, 16 nt, Bordetella pertussis
aggcccagcgcgccau

SEQ ID NO: 299473 - RNA, 17 nt, Bordetella pertussis
aggcccaguucggcgcg

SEQ ID NO: 299474 - RNA, 20 nt, Bordetella pertussis
aggcccaguucggcgcgcgu

SEQ ID NO: 299475 - RNA, 24 nt, Bordetella pertussis
aggcccaugaaggcggccagcaug

SEQ ID NO: 299476 - RNA, 13 nt, Bordetella pertussis
aggccccgcgacc

SEQ ID NO: 299477 - RNA, 13 nt, Bordetella pertussis
aggccccggcccg

SEQ ID NO: 299478 - RNA, 12 nt, Bordetella pertussis
aggccccggccg

SEQ ID NO: 299479 - RNA, 23 nt, Bordetella pertussis
aggcccgaaacgcgcagcaccgg

SEQ ID NO: 299480 - RNA, 12 nt, Bordetella pertussis
aggcccgcccgg

SEQ ID NO: 299481 - RNA, 16 nt, Bordetella pertussis
aggcccgcgcggccag

SEQ ID NO: 299482 - RNA, 19 nt, Bordetella pertussis
aggcccgcgcggccagcgc

SEQ ID NO: 299483 - RNA, 15 nt, Bordetella pertussis
aggcccgcggcgcca

SEQ ID NO: 299484 - RNA, 16 nt, Bordetella pertussis
aggcccgcggcgccag

SEQ ID NO: 299485 - RNA, 19 nt, Bordetella pertussis
aggcccgcggcgccagcgc

SEQ ID NO: 299486 - RNA, 13 nt, Bordetella pertussis
aggcccggccgca

SEQ ID NO: 299487 - RNA, 12 nt, Bordetella pertussis
aggcccggcgcg

SEQ ID NO: 299488 - RNA, 22 nt, Bordetella pertussis
aggcccggauauggccggcgcg

SEQ ID NO: 299489 - RNA, 19 nt, Bordetella pertussis
aggccgacgcgcuguccga

SEQ ID NO: 299490 - RNA, 17 nt, Bordetella pertussis
aggccgagaugugcggc

SEQ ID NO: 299491 - RNA, 19 nt, Bordetella pertussis
aggccgagccauugucggu

SEQ ID NO: 299492 - RNA, 15 nt, Bordetella pertussis
aggccgagcgcgagc

SEQ ID NO: 299493 - RNA, 13 nt, Bordetella pertussis
aggccgaggccag

SEQ ID NO: 299494 - RNA, 19 nt, Bordetella pertussis
aggccgaguagcggcgcaa

SEQ ID NO: 299495 - RNA, 16 nt, Bordetella pertussis
aggccgauagcguucg

SEQ ID NO: 299496 - RNA, 16 nt, Bordetella pertussis
aggccgauauugcggu

SEQ ID NO: 299497 - RNA, 23 nt, Bordetella pertussis
aggccgaucagcgacagcagggu

SEQ ID NO: 299498 - RNA, 14 nt, Bordetella pertussis
aggccgaucagcgg

SEQ ID NO: 299499 - RNA, 12 nt, Bordetella pertussis
aggccgccggcc

SEQ ID NO: 299500 - RNA, 14 nt, Bordetella pertussis
aggccgccggccac

SEQ ID NO: 299501 - RNA, 15 nt, Bordetella pertussis
aggccgccggccagc

SEQ ID NO: 299502 - RNA, 16 nt, Bordetella pertussis
aggccgccggccagcg

SEQ ID NO: 299503 - RNA, 17 nt, Bordetella pertussis
aggccgccggccagcgc

SEQ ID NO: 299504 - RNA, 18 nt, Bordetella pertussis
aggccgccggccagcgcg

SEQ ID NO: 299505 - RNA, 13 nt, Bordetella pertussis
aggccgccggcgg

SEQ ID NO: 299506 - RNA, 14 nt, Bordetella pertussis
aggccgccgccggu

SEQ ID NO: 299507 - RNA, 16 nt, Bordetella pertussis
aggccgccggcggcgu

SEQ ID NO: 299508 - RNA, 22 nt, Bordetella pertussis
aggccgccuauguaggcgccgc

SEQ ID NO: 299509 - RNA, 18 nt, Bordetella pertussis
aggccgccggggaggccu

SEQ ID NO: 299510 - RNA, 15 nt, Bordetella pertussis
aggccgccguacgag

SEQ ID NO: 299511 - RNA, 18 nt, Bordetella pertussis
aggccgcgaacgcgccgg

SEQ ID NO: 299512 - RNA, 23 nt, Bordetella pertussis
aggccgcgcagcacgcccgcgcg

SEQ ID NO: 299513 - RNA, 23 nt, Bordetella pertussis
aggccgcgccgcggcaagccgcg

SEQ ID NO: 299514 - RNA, 12 nt, Bordetella pertussis
aggccgcgccua

SEQ ID NO: 299515 - RNA, 22 nt, Bordetella pertussis
aggccgcgccuauaucgacggc

SEQ ID NO: 299516 - RNA, 13 nt, Bordetella pertussis
aggccgcgcgccu

SEQ ID NO: 299517 - RNA, 16 nt, Bordetella pertussis
aggccgcggccaggcc

SEQ ID NO: 299518 - RNA, 20 nt, Bordetella pertussis
aggccgcggcgcccggugcg

SEQ ID NO: 299519 - RNA, 22 nt, Bordetella pertussis
aggccgcggcgcccggugcgcg

SEQ ID NO: 299520 - RNA, 17 nt, Bordetella pertussis
aggccgcgcugccagcc

SEQ ID NO: 299521 - RNA, 19 nt, Bordetella pertussis
aggccgcgcuggugcuggc

SEQ ID NO: 299522 - RNA, 23 nt, Bordetella pertussis
aggccgcgcuggugcuggccgaa

SEQ ID NO: 299523 - RNA, 21 nt, Bordetella pertussis
aggccgcuucgaugcuggcgg

SEQ ID NO: 299524 - RNA, 20 nt, Bordetella pertussis
aggccgcuuucgaccagcga

SEQ ID NO: 299525 - RNA, 21 nt, Bordetella pertussis
aggccggcaagaugccggccu

SEQ ID NO: 299526 - RNA, 18 nt, Bordetella pertussis
aggccggcaugcgccggc

SEQ ID NO: 299527 - RNA, 23 nt, Bordetella pertussis
aggccggccagggccacgccggc

SEQ ID NO: 299528 - RNA, 14 nt, Bordetella pertussis
aggccggcccgccc

SEQ ID NO: 299529 - RNA, 21 nt, Bordetella pertussis
aggccggccugcaaugcggcc

SEQ ID NO: 299530 - RNA, 18 nt, Bordetella pertussis
aggccggccugcaggcuc

SEQ ID NO: 299531 - RNA, 15 nt, Bordetella pertussis
aggccggcgccagcc

SEQ ID NO: 299532 - RNA, 18 nt, Bordetella pertussis
aggccggcgccagccgcu

SEQ ID NO: 299533 - RNA, 15 nt, Bordetella pertussis
aggccggcgcgccgg

SEQ ID NO: 299534 - RNA, 17 nt, Bordetella pertussis
aggccggcgcgcgcgua

SEQ ID NO: 299535 - RNA, 13 nt, Bordetella pertussis
aggccggcgcgcu

SEQ ID NO: 299536 - RNA, 22 nt, Bordetella pertussis
aggccggcggcacgcugcgcag

SEQ ID NO: 299537 - RNA, 16 nt, Bordetella pertussis
aggccggcggccagcg

SEQ ID NO: 299538 - RNA, 23 nt, Bordetella pertussis
aggccggcggcgagcgcggcgcg

SEQ ID NO: 299539 - RNA, 22 nt, Bordetella pertussis
aggccggcgucuggagcggccu

SEQ ID NO: 299540 - RNA, 19 nt, Bordetella pertussis
aggccggcgugcuguccgu

SEQ ID NO: 299541 - RNA, 19 nt, Bordetella pertussis
aggccggggaaacggccaa

SEQ ID NO: 299542 - RNA, 15 nt, Bordetella pertussis
aggccggugcgcaca

SEQ ID NO: 299543 - RNA, 18 nt, Bordetella pertussis
aggccggugcgcacaugg

SEQ ID NO: 299544 - RNA, 21 nt, Bordetella pertussis
aggccgguggaccagggcacg

SEQ ID NO: 299545 - RNA, 17 nt, Bordetella pertussis
aggccguaaccggccag

SEQ ID NO: 299546 - RNA, 14 nt, Bordetella pertussis
aggccgucggccag

SEQ ID NO: 299547 - RNA, 15 nt, Bordetella pertussis
aggccguggcccagc

SEQ ID NO: 299548 - RNA, 15 nt, Bordetella pertussis
aggccguggcgcacc

SEQ ID NO: 299549 - RNA, 18 nt, Bordetella pertussis
aggccguuggccgcgcgg

SEQ ID NO: 299550 - RNA, 20 nt, Bordetella pertussis
aggccguuggccgcgcggua

SEQ ID NO: 299551 - RNA, 22 nt, Bordetella pertussis
aggccguuggccgcgcgguacg

SEQ ID NO: 299552 - RNA, 14 nt, Bordetella pertussis
aggccguuggcgcg

SEQ ID NO: 299553 - RNA, 15 nt, Bordetella pertussis
aggccguuggcgcgc

SEQ ID NO: 299554 - RNA, 19 nt, Bordetella pertussis
aggccguuguccuggcgcg

SEQ ID NO: 299555 - RNA, 20 nt, Bordetella pertussis
aggccguuguccuggcgcgc

SEQ ID NO: 299556 - RNA, 22 nt, Bordetella pertussis
aggccucgcccgaucggccggc

SEQ ID NO: 299557 - RNA, 13 nt, Bordetella pertussis
aggccucgcgcuc

SEQ ID NO: 299558 - RNA, 22 nt, Bordetella pertussis
aggccucgcgcucgaacaucgc

SEQ ID NO: 299559 - RNA, 14 nt, Bordetella pertussis
aggccucggccacc

SEQ ID NO: 299560 - RNA, 21 nt, Bordetella pertussis
aggccucggccaccuggcgca

SEQ ID NO: 299561 - RNA, 14 nt, Bordetella pertussis
aggccucggucgcc

SEQ ID NO: 299562 - RNA, 21 nt, Bordetella pertussis
aggccugcccgggcaccaggu

SEQ ID NO: 299563 - RNA, 15 nt, Bordetella pertussis
aggccugcugcagcg

SEQ ID NO: 299564 - RNA, 17 nt, Bordetella pertussis
aggccugcugcagcgug

SEQ ID NO: 299565 - RNA, 19 nt, Bordetella pertussis
aggccugcugcagcgugau

SEQ ID NO: 299566 - RNA, 18 nt, Bordetella pertussis
aggccuggcuuggcggcc

SEQ ID NO: 299567 - RNA, 12 nt, Bordetella pertussis
aggccuggucga

SEQ ID NO: 299568 - RNA, 23 nt, Bordetella pertussis
aggccuggucggggucggccacc

SEQ ID NO: 299569 - RNA, 15 nt, Bordetella pertussis
aggccuguucggccg

SEQ ID NO: 299570 - RNA, 20 nt, Bordetella pertussis
aggccuucaccuugccgcug

SEQ ID NO: 299571 - RNA, 17 nt, Bordetella pertussis
aggccuucgacguccag

SEQ ID NO: 299572 - RNA, 16 nt, Bordetella pertussis
aggccuugccgccgcc

SEQ ID NO: 299573 - RNA, 19 nt, Bordetella pertussis
aggccuugccgccgccgcg

SEQ ID NO: 299574 - RNA, 21 nt, Bordetella pertussis
aggccuugccgccgccgcgcg

SEQ ID NO: 299575 - RNA, 22 nt, Bordetella pertussis
aggcgaaaccggugaucagcag

SEQ ID NO: 299576 - RNA, 17 nt, Bordetella pertussis
aggcgaacauggccgag

SEQ ID NO: 299577 - RNA, 15 nt, Bordetella pertussis
aggcgagcaggucca

SEQ ID NO: 299578 - RNA, 23 nt, Bordetella pertussis
aggcgagcgccgcgcuccagggc

SEQ ID NO: 299579 - RNA, 14 nt, Bordetella pertussis
aggcgagcgcggca

SEQ ID NO: 299580 - RNA, 22 nt, Bordetella pertussis
aggcgagcgcggcauagcccag

SEQ ID NO: 299581 - RNA, 14 nt, Bordetella pertussis
aggcgagcggcguc

SEQ ID NO: 299582 - RNA, 18 nt, Bordetella pertussis
aggcgaugcccagcgccg

SEQ ID NO: 299583 - RNA, 17 nt, Bordetella pertussis
aggcgcacaaccuggua

SEQ ID NO: 299584 - RNA, 14 nt, Bordetella pertussis
aggcgcaccagcgc

SEQ ID NO: 299585 - RNA, 17 nt, Bordetella pertussis
aggcgcaccagcgcgcc

SEQ ID NO: 299586 - RNA, 16 nt, Bordetella pertussis
aggcgcagcaggccag

SEQ ID NO: 299587 - RNA, 15 nt, Bordetella pertussis
aggcgcaggccgacg

SEQ ID NO: 299588 - RNA, 15 nt, Bordetella pertussis
aggcgcaggccgcgc

SEQ ID NO: 299589 - RNA, 19 nt, Bordetella pertussis
aggcgcaggcgcgagacga

SEQ ID NO: 299590 - RNA, 19 nt, Bordetella pertussis
aggcgcaguaucuggugcg

SEQ ID NO: 299591 - RNA, 16 nt, Bordetella pertussis
aggcgcauauggagcc

SEQ ID NO: 299592 - RNA, 14 nt, Bordetella pertussis
aggcgcaucagcuu

SEQ ID NO: 299593 - RNA, 19 nt, Bordetella pertussis
aggcgcaucgacagcgcgc

SEQ ID NO: 299594 - RNA, 16 nt, Bordetella pertussis
aggcgcauucgcgccu

SEQ ID NO: 299595 - RNA, 17 nt, Bordetella pertussis
aggcgcauucgcgccug

SEQ ID NO: 299596 - RNA, 21 nt, Bordetella pertussis
aggcgcauucgcgccugagcu

SEQ ID NO: 299597 - RNA, 19 nt, Bordetella pertussis
aggcgccagaugcgccgca

SEQ ID NO: 299598 - RNA, 20 nt, Bordetella pertussis
aggcgccagaugcgccgcac

SEQ ID NO: 299599 - RNA, 14 nt, Bordetella pertussis
aggcgccagcggca

SEQ ID NO: 299600 - RNA, 19 nt, Bordetella pertussis
aggcgcauggugagggcca

SEQ ID NO: 299601 - RNA, 18 nt, Bordetella pertussis
aggcgccccaggcgucgg

SEQ ID NO: 299602 - RNA, 20 nt, Bordetella pertussis
aggcgcccgacggcgcgccc

SEQ ID NO: 299603 - RNA, 13 nt, Bordetella pertussis
aggcgcccgccac

SEQ ID NO: 299604 - RNA, 15 nt, Bordetella pertussis
aggcgcccgugcgcg

SEQ ID NO: 299605 - RNA, 19 nt, Bordetella pertussis
aggcgccgaaauuggcgac

SEQ ID NO: 299606 - RNA, 18 nt, Bordetella pertussis
aggcgccgccccgucauc

SEQ ID NO: 299607 - RNA, 18 nt, Bordetella pertussis
aggcgccgccgcccggca

SEQ ID NO: 299608 - RNA, 12 nt, Bordetella pertussis
aggcgccgcgcc

SEQ ID NO: 299609 - RNA, 22 nt, Bordetella pertussis
aggcgccgcggaggcgaaauac

SEQ ID NO: 299610 - RNA, 13 nt, Bordetella pertussis
aggcgccggccag

SEQ ID NO: 299611 - RNA, 14 nt, Bordetella pertussis
aggcgccggccagg

SEQ ID NO: 299612 - RNA, 18 nt, Bordetella pertussis
aggcgccggccaggcccu

SEQ ID NO: 299613 - RNA, 19 nt, Bordetella pertussis
aggcgccgguccagcgccc

SEQ ID NO: 299614 - RNA, 20 nt, Bordetella pertussis
aggcgccgguccagcgcccg

SEQ ID NO: 299615 - RNA, 22 nt, Bordetella pertussis
aggcgccgguccagcgcccgaa

SEQ ID NO: 299616 - RNA, 16 nt, Bordetella pertussis
aggcgccucgcgacgg

SEQ ID NO: 299617 - RNA, 19 nt, Bordetella pertussis
aggcgccucgcgacggccu

SEQ ID NO: 299618 - RNA, 15 nt, Bordetella pertussis
aggcgccugccccgc

SEQ ID NO: 299619 - RNA, 12 nt, Bordetella pertussis
aggcgcgcacca

SEQ ID NO: 299620 - RNA, 21 nt, Bordetella pertussis
aggcgcgcaccagcccgcccg

SEQ ID NO: 299621 - RNA, 23 nt, Bordetella pertussis
aggcgcgcaccagcccgcccgcg

SEQ ID NO: 299622 - RNA, 14 nt, Bordetella pertussis
aggcgcgccaccgg

SEQ ID NO: 299623 - RNA, 18 nt, Bordetella pertussis
aggcgcgccagccgcgcg

SEQ ID NO: 299624 - RNA, 19 nt, Bordetella pertussis
aggcgcgccagccgcgcga

SEQ ID NO: 299625 - RNA, 19 nt, Bordetella pertussis
aggcgcgccgggccggcgg

SEQ ID NO: 299626 - RNA, 11 nt, Bordetella pertussis
aggcgcgcgcg

SEQ ID NO: 299627 - RNA, 15 nt, Bordetella pertussis
aggcgcgcgcgcgga

SEQ ID NO: 299628 - RNA, 22 nt, Bordetella pertussis
aggcgcgcgccaucgacgggcg

SEQ ID NO: 299629 - RNA, 13 nt, Bordetella pertussis
aggcgcgcggccu

SEQ ID NO: 299630 - RNA, 16 nt, Bordetella pertussis
aggcgcgcggccucga

SEQ ID NO: 299631 - RNA, 22 nt, Bordetella pertussis
aggcgcgcucaggccgccggcg

SEQ ID NO: 299632 - RNA, 22 nt, Bordetella pertussis
aggcgcggcgccggcgcgucac

SEQ ID NO: 299633 - RNA, 12 nt, Bordetella pertussis
aggcgcggcgua

SEQ ID NO: 299634 - RNA, 16 nt, Bordetella pertussis
aggcgcggcucgccgg

SEQ ID NO: 299635 - RNA, 22 nt, Bordetella pertussis
aggcgcgggcagcaccggggca

SEQ ID NO: 299636 - RNA, 17 nt, Bordetella pertussis
aggcgcgugcgcaggcg

SEQ ID NO: 299637 - RNA, 18 nt, Bordetella pertussis
aggcgcgugcucaucggc

SEQ ID NO: 299638 - RNA, 15 nt, Bordetella pertussis
aggcgcucaagggcc

SEQ ID NO: 299639 - RNA, 17 nt, Bordetella pertussis
aggcgcucaagggccug

SEQ ID NO: 299640 - RNA, 17 nt, Bordetella pertussis
aggcgcgucgcugcgcg

SEQ ID NO: 299641 - RNA, 18 nt, Bordetella pertussis
aggcgcuccagcaccugc

SEQ ID NO: 299642 - RNA, 21 nt, Bordetella pertussis
aggcgcuccauggcgccggcg

SEQ ID NO: 299643 - RNA, 22 nt, Bordetella pertussis
aggcgcuccauggcgccggcgg

SEQ ID NO: 299644 - RNA, 14 nt, Bordetella pertussis
aggcgcucggccuu

SEQ ID NO: 299645 - RNA, 20 nt, Bordetella pertussis
aggcgcucgaggcgcuggcg

SEQ ID NO: 299646 - RNA, 14 nt, Bordetella pertussis
aggcgcucgcccuc

SEQ ID NO: 299647 - RNA, 21 nt, Bordetella pertussis
aggcgcucgcccucgcgccac

SEQ ID NO: 299648 - RNA, 16 nt, Bordetella pertussis
aggcgcucggccagcg

SEQ ID NO: 299649 - RNA, 19 nt, Bordetella pertussis
aggcgcugcgcgaaacggc

SEQ ID NO: 299650 - RNA, 17 nt, Bordetella pertussis
aggcgcuggccggcgug

SEQ ID NO: 299651 - RNA, 22 nt, Bordetella pertussis
aggcgcugguaguaggccacug

SEQ ID NO: 299652 - RNA, 18 nt, Bordetella pertussis
aggcgcuugcgcagggcg

SEQ ID NO: 299653 - RNA, 21 nt, Bordetella pertussis
aggcggaucucuccgaacgcg

SEQ ID NO: 299654 - RNA, 16 nt, Bordetella pertussis
aggcggcaaacccggc

SEQ ID NO: 299655 - RNA, 14 nt, Bordetella pertussis
aggcggaugcggua

SEQ ID NO: 299656 - RNA, 16 nt, Bordetella pertussis
aggcggcaggcgccgc

SEQ ID NO: 299657 - RNA, 11 nt, Bordetella pertussis
aggcggccagg

SEQ ID NO: 299658 - RNA, 13 nt, Bordetella pertussis
aggcggccaggcc

SEQ ID NO: 299659 - RNA, 11 nt, Bordetella pertussis
aggcggccagu

SEQ ID NO: 299660 - RNA, 18 nt, Bordetella pertussis
aggcggccaucgccgcca

SEQ ID NO: 299661 - RNA, 19 nt, Bordetella pertussis
aggcggccaucgccgccac

SEQ ID NO: 299662 - RNA, 21 nt, Bordetella pertussis
aggcggcccagcguggcggug

SEQ ID NO: 299663 - RNA, 20 nt, Bordetella pertussis
aggcggcccaggcguccagg

SEQ ID NO: 299664 - RNA, 15 nt, Bordetella pertussis
aggcggccgaccagc

SEQ ID NO: 299665 - RNA, 17 nt, Bordetella pertussis
aggcggccgaccagcac

SEQ ID NO: 299666 - RNA, 14 nt, Bordetella pertussis
aggcggccggcagg

SEQ ID NO: 299667 - RNA, 22 nt, Bordetella pertussis
aggcggccggcaggccggccag

SEQ ID NO: 299668 - RNA, 15 nt, Bordetella pertussis
aggcggccgcgggcg

SEQ ID NO: 299669 - RNA, 18 nt, Bordetella pertussis
aggcggcgacgcagcacg

SEQ ID NO: 299670 - RNA, 20 nt, Bordetella pertussis
aggcggcgacgcagcacggc

SEQ ID NO: 299671 - RNA, 16 nt, Bordetella pertussis
aggcggcgcaggccag

SEQ ID NO: 299672 - RNA, 19 nt, Bordetella pertussis
aggcggcgcaggccagcgc

SEQ ID NO: 299673 - RNA, 14 nt, Bordetella pertussis
aggcggcgccggca

SEQ ID NO: 299674 - RNA, 18 nt, Bordetella pertussis
aggcggcgcgcccgccuu

SEQ ID NO: 299675 - RNA, 14 nt, Bordetella pertussis
aggcggcggugcca

SEQ ID NO: 299676 - RNA, 18 nt, Bordetella pertussis
aggcggcggugccagcgc

SEQ ID NO: 299677 - RNA, 21 nt, Bordetella pertussis
aggcggcggccggggccgccc

SEQ ID NO: 299678 - RNA, 19 nt, Bordetella pertussis
aggcggcugcccaccuugc

SEQ ID NO: 299679 - RNA, 22 nt, Bordetella pertussis
aggcggcugcccaccuugcgcg

SEQ ID NO: 299680 - RNA, 17 nt, Bordetella pertussis
aggcggcuguagucgcc

SEQ ID NO: 299681 - RNA, 15 nt, Bordetella pertussis
aggcgggacuggcga

SEQ ID NO: 299682 - RNA, 21 nt, Bordetella pertussis
aggcgggcccgcaucgcgcgc

SEQ ID NO: 299683 - RNA, 14 nt, Bordetella pertussis
aggcgggcagcggc

SEQ ID NO: 299684 - RNA, 16 nt, Bordetella pertussis
aggcgggcuggucgcg

SEQ ID NO: 299685 - RNA, 23 nt, Bordetella pertussis
aggcgggcuggucgcgccgguca

SEQ ID NO: 299686 - RNA, 18 nt, Bordetella pertussis
aggcggggcuggcgcggc

SEQ ID NO: 299687 - RNA, 19 nt, Bordetella pertussis
aggcgguacaggccggcgg

SEQ ID NO: 299688 - RNA, 22 nt, Bordetella pertussis
aggcgguacaggccggcggcga

SEQ ID NO: 299689 - RNA, 17 nt, Bordetella pertussis
aggcggucgaggcgcag

SEQ ID NO: 299690 - RNA, 23 nt, Bordetella pertussis
aggcggucuucgaugcuggcgcg

SEQ ID NO: 299691 - RNA, 16 nt, Bordetella pertussis
aggcggugcguccagg

SEQ ID NO: 299692 - RNA, 13 nt, Bordetella pertussis
aggcgguggccag

SEQ ID NO: 299693 - RNA, 20 nt, Bordetella pertussis
aggcgguuggccuugacggc

SEQ ID NO: 299694 - RNA, 19 nt, Bordetella pertussis
aggcguaucgauagccgac

SEQ ID NO: 299695 - RNA, 23 nt, Bordetella pertussis
aggcguccagccccugcgggccg

SEQ ID NO: 299696 - RNA, 15 nt, Bordetella pertussis
aggcguucggccacu

SEQ ID NO: 299697 - RNA, 15 nt, Bordetella pertussis
aggcguugcgccgca

SEQ ID NO: 299698 - RNA, 17 nt, Bordetella pertussis
aggcguugcgccgcaac

SEQ ID NO: 299699 - RNA, 14 nt, Bordetella pertussis
aggcguuucgccag

SEQ ID NO: 299700 - RNA, 17 nt, Bordetella pertussis
aggcucagcccggcgag

SEQ ID NO: 299701 - RNA, 14 nt, Bordetella pertussis
aggcuccucgccac

SEQ ID NO: 299702 - RNA, 23 nt, Bordetella pertussis
aggcuccacagccacugcggccc

SEQ ID NO: 299703 - RNA, 17 nt, Bordetella pertussis
aggcucuugaccagcuu

SEQ ID NO: 299704 - RNA, 20 nt, Bordetella pertussis
aggcucuuuuucccggcgcg

SEQ ID NO: 299705 - RNA, 20 nt, Bordetella pertussis
aggcugacgcccggcucgcu

SEQ ID NO: 299706 - RNA, 19 nt, Bordetella pertussis
aggcugggagagccggcca

SEQ ID NO: 299707 - RNA, 20 nt, Bordetella pertussis
aggcugggagagccggccac

SEQ ID NO: 299708 - RNA, 17 nt, Bordetella pertussis
aggcugggcgaaacggc

SEQ ID NO: 299709 - RNA, 22 nt, Bordetella pertussis
aggcugggcgaaacggccagcg

SEQ ID NO: 299710 - RNA, 21 nt, Bordetella pertussis
aggcuggggccgagcgugccg

SEQ ID NO: 299711 - RNA, 17 nt, Bordetella pertussis
aggcuguccccgcaugg

SEQ ID NO: 299712 - RNA, 14 nt, Bordetella pertussis
aggcuguggccgcg

SEQ ID NO: 299713 - RNA, 21 nt, Bordetella pertussis
aggcuguggccgcggcccagc

SEQ ID NO: 299714 - RNA, 20 nt, Bordetella pertussis
agggccagcuugacguccag

SEQ ID NO: 299715 - RNA, 16 nt, Bordetella pertussis
agggccaggccgccgc

SEQ ID NO: 299716 - RNA, 15 nt, Bordetella pertussis
agggccagucguuca

SEQ ID NO: 299717 - RNA, 19 nt, Bordetella pertussis
agggccauguggcgcagcg

SEQ ID NO: 299718 - RNA, 12 nt, Bordetella pertussis
agggccauucuc

SEQ ID NO: 299719 - RNA, 19 nt, Bordetella pertussis
agggccccuccggcgccgc

SEQ ID NO: 299720 - RNA, 23 nt, Bordetella pertussis
agggccgaucccuugugcgcgcc

SEQ ID NO: 299721 - RNA, 19 nt, Bordetella pertussis
agggccgccagcaccugcu

SEQ ID NO: 299722 - RNA, 14 nt, Bordetella pertussis
agggccgcccaguc

SEQ ID NO: 299723 - RNA, 15 nt, Bordetella pertussis
agggccgccgcgccc

SEQ ID NO: 299724 - RNA, 19 nt, Bordetella pertussis
agggccgcgagcaugcgca

SEQ ID NO: 299725 - RNA, 11 nt, Bordetella pertussis
agggccgcgcg

SEQ ID NO: 299726 - RNA, 12 nt, Bordetella pertussis
agggccgcggcg

SEQ ID NO: 299727 - RNA, 17 nt, Bordetella pertussis
agggccggacuggcgcg

SEQ ID NO: 299728 - RNA, 17 nt, Bordetella pertussis
agggcgaucagcaccgc

SEQ ID NO: 299729 - RNA, 21 nt, Bordetella pertussis
agggcgaucagcaccgcggcg

SEQ ID NO: 299730 - RNA, 17 nt, Bordetella pertussis
agggcgaucuugccggc

SEQ ID NO: 299731 - RNA, 19 nt, Bordetella pertussis
agggcgaugcggcggccga

SEQ ID NO: 299732 - RNA, 14 nt, Bordetella pertussis
agggcgauggcgcg

SEQ ID NO: 299733 - RNA, 18 nt, Bordetella pertussis
agggcgcaacgccggccg

SEQ ID NO: 299734 - RNA, 22 nt, Bordetella pertussis
agggcgcaacgccggccgccau

SEQ ID NO: 299735 - RNA, 21 nt, Bordetella pertussis
agggcgccgacgaugccgccc

SEQ ID NO: 299736 - RNA, 17 nt, Bordetella pertussis
agggcgccgcgcggucg

SEQ ID NO: 299737 - RNA, 20 nt, Bordetella pertussis
agggcgccgcggcggcgagg

SEQ ID NO: 299738 - RNA, 14 nt, Bordetella pertussis
agggcgccgcgggg

SEQ ID NO: 299739 - RNA, 23 nt, Bordetella pertussis
agggcgccgggcggaucgccgaa

SEQ ID NO: 299740 - RNA, 13 nt, Bordetella pertussis
agggcgccgcgcc

SEQ ID NO: 299741 - RNA, 13 nt, Bordetella pertussis
agggcgccgcgcg

SEQ ID NO: 299742 - RNA, 18 nt, Bordetella pertussis
agggcgcgacgccagcgc

SEQ ID NO: 299743 - RNA, 23 nt, Bordetella pertussis
agggcgcgacgccagcgcgccau

SEQ ID NO: 299744 - RNA, 13 nt, Bordetella pertussis
agggcgcgccagc

SEQ ID NO: 299745 - RNA, 18 nt, Bordetella pertussis
agggcgucgcgaugcgcc

SEQ ID NO: 299746 - RNA, 14 nt, Bordetella pertussis
agggcgucggccgc

SEQ ID NO: 299747 - RNA, 17 nt, Bordetella pertussis
agggcgucggccgcgcc

SEQ ID NO: 299748 - RNA, 20 nt, Bordetella pertussis
agggcgucggccgcgcccag

SEQ ID NO: 299749 - RNA, 21 nt, Bordetella pertussis
agggcgucugcucgccguucu

SEQ ID NO: 299750 - RNA, 21 nt, Bordetella pertussis
agggcgucuucgccgaccagc

SEQ ID NO: 299751 - RNA, 13 nt, Bordetella pertussis
agggcucgaccgc

SEQ ID NO: 299752 - RNA, 16 nt, Bordetella pertussis
agggcucgaccgccgc

SEQ ID NO: 299753 - RNA, 19 nt, Bordetella pertussis
agggcucgaccgccgccac

SEQ ID NO: 299754 - RNA, 22 nt, Bordetella pertussis
agggcugaucuugaugcggccg

SEQ ID NO: 299755 - RNA, 17 nt, Bordetella pertussis
agggcugcgaugcgggc

SEQ ID NO: 299756 - RNA, 15 nt, Bordetella pertussis
agggcuggccggcca

SEQ ID NO: 299757 - RNA, 18 nt, Bordetella pertussis
agggcuugaccagggcgg

SEQ ID NO: 299758 - RNA, 13 nt, Bordetella pertussis
agggcuugcggcg

SEQ ID NO: 299759 - RNA, 15 nt, Bordetella pertussis
aggggcaggcgcacg

SEQ ID NO: 299760 - RNA, 14 nt, Bordetella pertussis
aggggcaugccggc

SEQ ID NO: 299761 - RNA, 13 nt, Bordetella pertussis
aggggcggcgcgg

SEQ ID NO: 299762 - RNA, 15 nt, Bordetella pertussis
aggggcggcgcggcg

SEQ ID NO: 299763 - RNA, 22 nt, Bordetella pertussis
aggggcuccaggaacaccaccu

SEQ ID NO: 299764 - RNA, 13 nt, Bordetella pertussis
aggggcucgcgcc

SEQ ID NO: 299765 - RNA, 14 nt, Bordetella pertussis
agggucucggccac

SEQ ID NO: 299766 - RNA, 14 nt, Bordetella pertussis
agggucuggcggcc

SEQ ID NO: 299767 - RNA, 17 nt, Bordetella pertussis
agggucugcuggucgcg

SEQ ID NO: 299768 - RNA, 21 nt, Bordetella pertussis
agggugaccaugucgccguug

SEQ ID NO: 299769 - RNA, 15 nt, Bordetella pertussis
agggugcaccaggug

SEQ ID NO: 299770 - RNA, 21 nt, Bordetella pertussis
agggugcccaguucgcggccg

SEQ ID NO: 299771 - RNA, 18 nt, Bordetella pertussis
agguaugcacgaccaggc

SEQ ID NO: 299772 - RNA, 16 nt, Bordetella pertussis
agguauuccgccguca

SEQ ID NO: 299773 - RNA, 12 nt, Bordetella pertussis
aggucaggccca

SEQ ID NO: 299774 - RNA, 19 nt, Bordetella pertussis
aggucaugcagaacagggu

SEQ ID NO: 299775 - RNA, 16 nt, Bordetella pertussis
agguccgccggcacgc

SEQ ID NO: 299776 - RNA, 19 nt, Bordetella pertussis
agguccgccggcacgcgcg

SEQ ID NO: 299777 - RNA, 23 nt, Bordetella pertussis
agguccugcacgcgggccaguug

SEQ ID NO: 299778 - RNA, 16 nt, Bordetella pertussis
agguccugcgccagcu

SEQ ID NO: 299779 - RNA, 18 nt, Bordetella pertussis
agguccuggcggccgccc

SEQ ID NO: 299780 - RNA, 15 nt, Bordetella pertussis
aggucgaacaggcug

SEQ ID NO: 299781 - RNA, 13 nt, Bordetella pertussis
aggucggccagcc

SEQ ID NO: 299782 - RNA, 18 nt, Bordetella pertussis
aggucggccagccggccg

SEQ ID NO: 299783 - RNA, 19 nt, Bordetella pertussis
aggucggccagccggccga

SEQ ID NO: 299784 - RNA, 12 nt, Bordetella pertussis
aggucggccagg

SEQ ID NO: 299785 - RNA, 16 nt, Bordetella pertussis
aggucggcggccagcg

SEQ ID NO: 299786 - RNA, 17 nt, Bordetella pertussis
aggucggcggccagcgc

SEQ ID NO: 299787 - RNA, 19 nt, Bordetella pertussis
aggugaacgacagcgacac

SEQ ID NO: 299788 - RNA, 18 nt, Bordetella pertussis
aggugcaggguuggcgcg

SEQ ID NO: 299789 - RNA, 20 nt, Bordetella pertussis
aggugcaggguuggcgcgcc

SEQ ID NO: 299790 - RNA, 21 nt, Bordetella pertussis
aggugcaggguuggcgcgccg

SEQ ID NO: 299791 - RNA, 20 nt, Bordetella pertussis
aggugcacgugggcacgccg

SEQ ID NO: 299792 - RNA, 17 nt, Bordetella pertussis
aggugcccgcgaagcag

SEQ ID NO: 299793 - RNA, 21 nt, Bordetella pertussis
aggugcccgcgaagcagccgg

SEQ ID NO: 299794 - RNA, 23 nt, Bordetella pertussis
aggugcccgcgaagcagccggcc

SEQ ID NO: 299795 - RNA, 16 nt, Bordetella pertussis
aggugccgccggcgcg

SEQ ID NO: 299796 - RNA, 20 nt, Bordetella pertussis
aggugccuguccccccaugg

SEQ ID NO: 299797 - RNA, 20 nt, Bordetella pertussis
aggugccuguccccgcgggg

SEQ ID NO: 299798 - RNA, 18 nt, Bordetella pertussis
aggugcgcagccgggcug

SEQ ID NO: 299799 - RNA, 16 nt, Bordetella pertussis
aggugcgcggcgcgcc

SEQ ID NO: 299800 - RNA, 13 nt, Bordetella pertussis
agguugcggccgc

SEQ ID NO: 299801 - RNA, 14 nt, Bordetella pertussis
agguugcggccgcc

SEQ ID NO: 299802 - RNA, 16 nt, Bordetella pertussis
agguugcggccgccac

SEQ ID NO: 299803 - RNA, 20 nt, Bordetella pertussis
agguugcuuucggcgacuuc

SEQ ID NO: 299804 - RNA, 18 nt, Bordetella pertussis
agguuggccgcgacgauc

SEQ ID NO: 299805 - RNA, 17 nt, Bordetella pertussis
agguuguccagcgcgcc

SEQ ID NO: 299806 - RNA, 22 nt, Bordetella pertussis
agguugugccccuugcccaacg

SEQ ID NO: 299807 - RNA, 15 nt, Bordetella pertussis
aguacucgccggcgc

SEQ ID NO: 299808 - RNA, 14 nt, Bordetella pertussis
aguagaacgccggc

SEQ ID NO: 299809 - RNA, 15 nt, Bordetella pertussis
aguagaacgccggcu

SEQ ID NO: 299810 - RNA, 18 nt, Bordetella pertussis
aguagaaguaggcggcca

SEQ ID NO: 299811 - RNA, 21 nt, Bordetella pertussis
aguagaaguaggcggccaggc

SEQ ID NO: 299812 - RNA, 16 nt, Bordetella pertussis
aguaugcaaccggcac

SEQ ID NO: 299813 - RNA, 17 nt, Bordetella pertussis
aguauucacgccgcgac

SEQ ID NO: 299814 - RNA, 20 nt, Bordetella pertussis
agugcgccccgccacgucgc

SEQ ID NO: 299815 - RNA, 17 nt, Bordetella pertussis
agugcgccggcgcggcg

SEQ ID NO: 299816 - RNA, 16 nt, Bordetella pertussis
agugcgccggcggcgg

SEQ ID NO: 299817 - RNA, 14 nt, Bordetella pertussis
agugcuggcccgcc

SEQ ID NO: 299818 - RNA, 23 nt, Bordetella pertussis
aguggaaccgcgguacgcgggca

SEQ ID NO: 299819 - RNA, 22 nt, Bordetella pertussis
aguggaugcgcuugccgcccac

SEQ ID NO: 299820 - RNA, 18 nt, Bordetella pertussis
agugguggugcagcggca

SEQ ID NO: 299821 - RNA, 19 nt, Bordetella pertussis
agugguggugcagcggcag

SEQ ID NO: 299822 - RNA, 20 nt, Bordetella pertussis
agugguggugcagcggcagc

SEQ ID NO: 299823 - RNA, 20 nt, Bordetella pertussis
agugguucaucgggccggcg

SEQ ID NO: 299824 - RNA, 23 nt, Bordetella pertussis
agugguucaugcguucggccagc

SEQ ID NO: 299825 - RNA, 17 nt, Bordetella pertussis
aguucaucaucgccgac

SEQ ID NO: 299826 - RNA, 15 nt, Bordetella pertussis
aguucccagcgcgcg

SEQ ID NO: 299827 - RNA, 16 nt, Bordetella pertussis
aguucgcggccggccg

SEQ ID NO: 299828 - RNA, 16 nt, Bordetella pertussis
aguucggccagcggca

SEQ ID NO: 299829 - RNA, 14 nt, Bordetella pertussis
aguucggccgccag

SEQ ID NO: 299830 - RNA, 22 nt, Bordetella pertussis
aguucggcgcgcgugccgcgca

SEQ ID NO: 299831 - RNA, 14 nt, Bordetella pertussis
aguucggcgcgugc

SEQ ID NO: 299832 - RNA, 21 nt, Bordetella pertussis
aguucggcgucggugccgucc

SEQ ID NO: 299833 - RNA, 22 nt, Bordetella pertussis
aguucgucgucggucggcuuga

SEQ ID NO: 299834 - RNA, 14 nt, Bordetella pertussis
aguugacgccggcg

SEQ ID NO: 299835 - RNA, 17 nt, Bordetella pertussis
aguugcaccagugcgcc

SEQ ID NO: 299836 - RNA, 21 nt, Bordetella pertussis
aguugcaccagugcgccggcg

SEQ ID NO: 299837 - RNA, 14 nt, Bordetella pertussis
aguugcgccccgcc

SEQ ID NO: 299838 - RNA, 21 nt, Bordetella pertussis
aguugcggccgugcgccagcg

SEQ ID NO: 299839 - RNA, 20 nt, Bordetella pertussis
aguugcgggucgucccagcg

SEQ ID NO: 299840 - RNA, 21 nt, Bordetella pertussis
auacaacgaguaccugcuggu

SEQ ID NO: 299841 - RNA, 17 nt, Bordetella pertussis
auacaggcuguggccgc

SEQ ID NO: 299842 - RNA, 14 nt, Bordetella pertussis
auacagggcggugc

SEQ ID NO: 299843 - RNA, 21 nt, Bordetella pertussis
auaccgcgcacaggucgccga

SEQ ID NO: 299844 - RNA, 15 nt, Bordetella pertussis
auaccggagcggcuc

SEQ ID NO: 299845 - RNA, 15 nt, Bordetella pertussis
auaccggccgcgggu

SEQ ID NO: 299846 - RNA, 21 nt, Bordetella pertussis
auaccggccgcggguggccgc

SEQ ID NO: 299847 - RNA, 17 nt, Bordetella pertussis
auaccgucuuggcaguc

SEQ ID NO: 299848 - RNA, 15 nt, Bordetella pertussis
auaccgucuuggccg

SEQ ID NO: 299849 - RNA, 17 nt, Bordetella pertussis
auaccgucuuggccguc

SEQ ID NO: 299850 - RNA, 17 nt, Bordetella pertussis
auaccucgauggcggug

SEQ ID NO: 299851 - RNA, 17 nt, Bordetella pertussis
auaccuucggcaugguc

SEQ ID NO: 299852 - RNA, 11 nt, Bordetella pertussis
auacgcgcgcg

SEQ ID NO: 299853 - RNA, 19 nt, Bordetella pertussis
auacgcgacaguucgcccc

SEQ ID NO: 299854 - RNA, 18 nt, Bordetella pertussis
auacgcgaugccgaucgc

SEQ ID NO: 299855 - RNA, 18 nt, Bordetella pertussis
auacgggcgcggcgucga

SEQ ID NO: 299856 - RNA, 23 nt, Bordetella pertussis
auacuggccgauggucagcaugu

SEQ ID NO: 299857 - RNA, 21 nt, Bordetella pertussis
auacuucguggcgcagcuccg

SEQ ID NO: 299858 - RNA, 21 nt, Bordetella pertussis
auacuugcgcagcgcggcguu

SEQ ID NO: 299859 - RNA, 12 nt, Bordetella pertussis
auagaccagcag

SEQ ID NO: 299860 - RNA, 16 nt, Bordetella pertussis
auagaguucggcgcgg

SEQ ID NO: 299861 - RNA, 20 nt, Bordetella pertussis
auagccaugcggacgccagc

SEQ ID NO: 299862 - RNA, 21 nt, Bordetella pertussis
auagcccagcaccugcaggcc

SEQ ID NO: 299863 - RNA, 13 nt, Bordetella pertussis
auagcccaggcgg

SEQ ID NO: 299864 - RNA, 16 nt, Bordetella pertussis
auagcccgugcgggcc

SEQ ID NO: 299865 - RNA, 18 nt, Bordetella pertussis
auagcccgugcgggccug

SEQ ID NO: 299866 - RNA, 11 nt, Bordetella pertussis
auagccgcgcg

SEQ ID NO: 299867 - RNA, 21 nt, Bordetella pertussis
auagccgcggcgccgcauuuc

SEQ ID NO: 299868 - RNA, 14 nt, Bordetella pertussis
auagcgcccgccuu

SEQ ID NO: 299869 - RNA, 23 nt, Bordetella pertussis
auagcgcuugccugacgugcgcc

SEQ ID NO: 299870 - RNA, 19 nt, Bordetella pertussis
auauagccggucuggucgg

SEQ ID NO: 299871 - RNA, 16 nt, Bordetella pertussis
auaucgacggcgccua

SEQ ID NO: 299872 - RNA, 21 nt, Bordetella pertussis
auaugcgcccgaugcucgccg

SEQ ID NO: 299873 - RNA, 19 nt, Bordetella pertussis
auauggagccaggcggcgu

SEQ ID NO: 299874 - RNA, 20 nt, Bordetella pertussis
auauggagccaggcggcgua

SEQ ID NO: 299875 - RNA, 13 nt, Bordetella pertussis
auauggccagggu

SEQ ID NO: 299876 - RNA, 16 nt, Bordetella pertussis
auauggccggcgcgcu

SEQ ID NO: 299877 - RNA, 13 nt, Bordetella pertussis
auauggcgccgca

SEQ ID NO: 299878 - RNA, 17 nt, Bordetella pertussis
auaugggcgagcaggcc

SEQ ID NO: 299879 - RNA, 24 nt, Bordetella pertussis
aucaccaggguggcgggcgccugc

SEQ ID NO: 299880 - RNA, 13 nt, Bordetella pertussis
aucacccagcggc

SEQ ID NO: 299881 - RNA, 22 nt, Bordetella pertussis
aucacccgauacgacacgccgc

SEQ ID NO: 299882 - RNA, 18 nt, Bordetella pertussis
aucacggugccgccgauc

SEQ ID NO: 299883 - RNA, 18 nt, Bordetella pertussis
aucacggugucgaugggc

SEQ ID NO: 299884 - RNA, 19 nt, Bordetella pertussis
aucagcaccgcgaccaugc

SEQ ID NO: 299885 - RNA, 18 nt, Bordetella pertussis
aucagcaggucggcgcgg

SEQ ID NO: 299886 - RNA, 14 nt, Bordetella pertussis
aucagcgcggccgc

SEQ ID NO: 299887 - RNA, 20 nt, Bordetella pertussis
aucaggaugggcgcggcgcg

SEQ ID NO: 299888 - RNA, 22 nt, Bordetella pertussis
aucaggaugggcgcggcgcgcg

SEQ ID NO: 299889 - RNA, 13 nt, Bordetella pertussis
aucaggccgaacu

SEQ ID NO: 299890 - RNA, 19 nt, Bordetella pertussis
aucaggccgaugcguccgc

SEQ ID NO: 299891 - RNA, 12 nt, Bordetella pertussis
aucaggcggcgc

SEQ ID NO: 299892 - RNA, 14 nt, Bordetella pertussis
aucaggcggcgcgg

SEQ ID NO: 299893 - RNA, 17 nt, Bordetella pertussis
aucaggcggcgcggcga

SEQ ID NO: 299894 - RNA, 18 nt, Bordetella pertussis
aucgacaugcccgccggc

SEQ ID NO: 299895 - RNA, 19 nt, Bordetella pertussis
aucgacaugcccgccggca

SEQ ID NO: 299896 - RNA, 14 nt, Bordetella pertussis
aucgaccaccagcg

SEQ ID NO: 299897 - RNA, 18 nt, Bordetella pertussis
aucgacgcgauguccagc

SEQ ID NO: 299898 - RNA, 18 nt, Bordetella pertussis
aucgacgcuugccggcga

SEQ ID NO: 299899 - RNA, 14 nt, Bordetella pertussis
aucgacgucggccu

SEQ ID NO: 299900 - RNA, 16 nt, Bordetella pertussis
aucgacuuggccuggu

SEQ ID NO: 299901 - RNA, 18 nt, Bordetella pertussis
aucgagaaaccagccgcc

SEQ ID NO: 299902 - RNA, 15 nt, Bordetella pertussis
aucgagcaggccgcc

SEQ ID NO: 299903 - RNA, 22 nt, Bordetella pertussis
aucgagcuggcccacgcccaug

SEQ ID NO: 299904 - RNA, 17 nt, Bordetella pertussis
aucgaggcguucggcca

SEQ ID NO: 299905 - RNA, 23 nt, Bordetella pertussis
aucgaguggugcgcgguccaugc

SEQ ID NO: 299906 - RNA, 18 nt, Bordetella pertussis
aucgauaccaacugccug

SEQ ID NO: 299907 - RNA, 23 nt, Bordetella pertussis
aucgauacgccgggcgcguggcc

SEQ ID NO: 299908 - RNA, 21 nt, Bordetella pertussis
aucgaucaguaucucggcgcc

SEQ ID NO: 299909 - RNA, 21 nt, Bordetella pertussis
aucgaugugcaugccgucgcg

SEQ ID NO: 299910 - RNA, 19 nt, Bordetella pertussis
aucgcacacaccgcgucau

SEQ ID NO: 299911 - RNA, 18 nt, Bordetella pertussis
aucgcauuucucggccug

SEQ ID NO: 299912 - RNA, 15 nt, Bordetella pertussis
aucgccaacgucggc

SEQ ID NO: 299913 - RNA, 17 nt, Bordetella pertussis
aucgccaugacgcuggu

SEQ ID NO: 299914 - RNA, 15 nt, Bordetella pertussis
aucgccaugccggcc

SEQ ID NO: 299915 - RNA, 14 nt, Bordetella pertussis
aucgccaugcugcc

SEQ ID NO: 299916 - RNA, 22 nt, Bordetella pertussis
aucgccauggccacgacgagag

SEQ ID NO: 299917 - RNA, 14 nt, Bordetella pertussis
aucgcccggcaggu

SEQ ID NO: 299918 - RNA, 13 nt, Bordetella pertussis
aucgcccggcgcc

SEQ ID NO: 299919 - RNA, 14 nt, Bordetella pertussis
aucgcccggcgcca

SEQ ID NO: 299920 - RNA, 17 nt, Bordetella pertussis
aucgcccgggcgccggc

SEQ ID NO: 299921 - RNA, 22 nt, Bordetella pertussis
aucgcccugaaaaccaaggagu

SEQ ID NO: 299922 - RNA, 14 nt, Bordetella pertussis
aucgccgacgcgcc

SEQ ID NO: 299923 - RNA, 19 nt, Bordetella pertussis
aucgccgcugaugcuggca

SEQ ID NO: 299924 - RNA, 17 nt, Bordetella pertussis
aucgccggcggcguggc

SEQ ID NO: 299925 - RNA, 18 nt, Bordetella pertussis
aucgccggcuacggcaag

SEQ ID NO: 299926 - RNA, 16 nt, Bordetella pertussis
aucgccuggggcgggc

SEQ ID NO: 299927 - RNA, 22 nt, Bordetella pertussis
aucgccuggggcgggcgcugcg

SEQ ID NO: 299928 - RNA, 21 nt, Bordetella pertussis
aucgccuguaucugcgccgug

SEQ ID NO: 299929 - RNA, 13 nt, Bordetella pertussis
aucgcgaugcgca

SEQ ID NO: 299930 - RNA, 18 nt, Bordetella pertussis
aucgcgcagcaccgccag

SEQ ID NO: 299931 - RNA, 14 nt, Bordetella pertussis
aucgcgcagcgccu

SEQ ID NO: 299932 - RNA, 16 nt, Bordetella pertussis
aucgcgcagcgccugg

SEQ ID NO: 299933 - RNA, 22 nt, Bordetella pertussis
aucgcgcauuucgaacaaggcg

SEQ ID NO: 299934 - RNA, 23 nt, Bordetella pertussis
aucgcgccagcgccgcgcgcgug

SEQ ID NO: 299935 - RNA, 13 nt, Bordetella pertussis
aucgcgccggccu

SEQ ID NO: 299936 - RNA, 14 nt, Bordetella pertussis
aucgcgccggccug

SEQ ID NO: 299937 - RNA, 15 nt, Bordetella pertussis
aucgcgccggccugg

SEQ ID NO: 299938 - RNA, 19 nt, Bordetella pertussis
aucgcgcuggcgcgcgacg

SEQ ID NO: 299939 - RNA, 20 nt, Bordetella pertussis
aucgcgcuggcgcgcgacgg

SEQ ID NO: 299940 - RNA, 19 nt, Bordetella pertussis
aucgcggcagcccggcacg

SEQ ID NO: 299941 - RNA, 18 nt, Bordetella pertussis
aucgcggccagcggcagg

SEQ ID NO: 299942 - RNA, 13 nt, Bordetella pertussis
aucgcggcgcggc

SEQ ID NO: 299943 - RNA, 15 nt, Bordetella pertussis
aucgcggcgcggcgc

SEQ ID NO: 299944 - RNA, 14 nt, Bordetella pertussis
aucgcggcgcggcu

SEQ ID NO: 299945 - RNA, 17 nt, Bordetella pertussis
aucgcggcgcugugcaa

SEQ ID NO: 299946 - RNA, 23 nt, Bordetella pertussis
aucgcggcuccagcucagcagcg

SEQ ID NO: 299947 - RNA, 22 nt, Bordetella pertussis
aucgcgguccugaccggcggcg

SEQ ID NO: 299948 - RNA, 20 nt, Bordetella pertussis
aucgcgucggccaaggccgg

SEQ ID NO: 299949 - RNA, 17 nt, Bordetella pertussis
aucgcuuccuuggucag

SEQ ID NO: 299950 - RNA, 23 nt, Bordetella pertussis
aucggagaaaucgccgccggcgg

SEQ ID NO: 299951 - RNA, 16 nt, Bordetella pertussis
aucggcaaggcgcaca

SEQ ID NO: 299952 - RNA, 16 nt, Bordetella pertussis
aucggcacccagccgg

SEQ ID NO: 299953 - RNA, 19 nt, Bordetella pertussis
aucggcaccucggcgccgc

SEQ ID NO: 299954 - RNA, 17 nt, Bordetella pertussis
aucggcaggccggcgcg

SEQ ID NO: 299955 - RNA, 18 nt, Bordetella pertussis
aucggcaggccggcgcgc

SEQ ID NO: 299956 - RNA, 21 nt, Bordetella pertussis
aucggcauuucgcauaccggc

SEQ ID NO: 299957 - RNA, 17 nt, Bordetella pertussis
aucggccauggcgguga

SEQ ID NO: 299958 - RNA, 16 nt, Bordetella pertussis
aucggcccgcgccagc

SEQ ID NO: 299959 - RNA, 22 nt, Bordetella pertussis
aucggcccgcgccagcgccacg

SEQ ID NO: 299960 - RNA, 20 nt, Bordetella pertussis
aucggccggcggucgcgcug

SEQ ID NO: 299961 - RNA, 11 nt, Bordetella pertussis
aucggcgccaa

SEQ ID NO: 299962 - RNA, 18 nt, Bordetella pertussis
aucggcgccaagcggcag

SEQ ID NO: 299963 - RNA, 13 nt, Bordetella pertussis
aucggcgccauga

SEQ ID NO: 299964 - RNA, 15 nt, Bordetella pertussis
aucggcgccgcgcgc

SEQ ID NO: 299965 - RNA, 15 nt, Bordetella pertussis
aucggcgccggcguc

SEQ ID NO: 299966 - RNA, 22 nt, Bordetella pertussis
aucggcgccggcguccacggca

SEQ ID NO: 299967 - RNA, 23 nt, Bordetella pertussis
aucggcgccuggccgcccagcgc

SEQ ID NO: 299968 - RNA, 14 nt, Bordetella pertussis
aucggcgcgcgcug

SEQ ID NO: 299969 - RNA, 22 nt, Bordetella pertussis
aucggcgcgcgcugcacggccu

SEQ ID NO: 299970 - RNA, 17 nt, Bordetella pertussis
aucggcggcuugcgguc

SEQ ID NO: 299971 - RNA, 22 nt, Bordetella pertussis
aucggcguaccaggcagccggc

SEQ ID NO: 299972 - RNA, 14 nt, Bordetella pertussis
aucggcgucagcgc

SEQ ID NO: 299973 - RNA, 21 nt, Bordetella pertussis
aucggcuugccgcgcggcgua

SEQ ID NO: 299974 - RNA, 21 nt, Bordetella pertussis
aucggggggugcgaggcgaac

SEQ ID NO: 299975 - RNA, 16 nt, Bordetella pertussis
aucggggucgaucgca

SEQ ID NO: 299976 - RNA, 20 nt, Bordetella pertussis
aucggggucgaucgcaucgc

SEQ ID NO: 299977 - RNA, 16 nt, Bordetella pertussis
aucgggguggcgccgu

SEQ ID NO: 299978 - RNA, 17 nt, Bordetella pertussis
aucgggguggcgccguu

SEQ ID NO: 299979 - RNA, 20 nt, Bordetella pertussis
aucgggguuccacagcgccg

SEQ ID NO: 299980 - RNA, 23 nt, Bordetella pertussis
aucgggugcugcgggucgaguug

SEQ ID NO: 299981 - RNA, 19 nt, Bordetella pertussis
aucguccagcgacuccggc

SEQ ID NO: 299982 - RNA, 13 nt, Bordetella pertussis
aucgucggcgcca

SEQ ID NO: 299983 - RNA, 15 nt, Bordetella pertussis
aucgucggcgccaug

SEQ ID NO: 299984 - RNA, 21 nt, Bordetella pertussis
aucgucggcgccaugcuggcc

SEQ ID NO: 299985 - RNA, 14 nt, Bordetella pertussis
aucgucuugaccag

SEQ ID NO: 299986 - RNA, 14 nt, Bordetella pertussis
aucgugacgcuggc

SEQ ID NO: 299987 - RNA, 15 nt, Bordetella pertussis
aucgugcacgcccgc

SEQ ID NO: 299988 - RNA, 14 nt, Bordetella pertussis
aucguugucgcgcc

SEQ ID NO: 299989 - RNA, 17 nt, Bordetella pertussis
aucguugucgcgccgcg

SEQ ID NO: 299990 - RNA, 19 nt, Bordetella pertussis
aucguuuucgcgaccugcg

SEQ ID NO: 299991 - RNA, 14 nt, Bordetella pertussis
aucucaaccacgaa

SEQ ID NO: 299992 - RNA, 19 nt, Bordetella pertussis
aucuccggauccagccgcu

SEQ ID NO: 299993 - RNA, 13 nt, Bordetella pertussis
aucugcggcgugg

SEQ ID NO: 299994 - RNA, 14 nt, Bordetella pertussis
aucugcgucgccug

SEQ ID NO: 299995 - RNA, 16 nt, Bordetella pertussis
aucugcgucgccuggu

SEQ ID NO: 299996 - RNA, 17 nt, Bordetella pertussis
aucugcguuuucuggcc

SEQ ID NO: 299997 - RNA, 17 nt, Bordetella pertussis
aucugcuugaggccgcg

SEQ ID NO: 299998 - RNA, 19 nt, Bordetella pertussis
aucugguagugcaggccgc

SEQ ID NO: 299999 - RNA, 19 nt, Bordetella pertussis
aucugguccacggcggcgg

SEQ ID NO: 300000 - RNA, 17 nt, Bordetella pertussis
aucugguccugggccgu

SEQ ID NO: 300001 - RNA, 18 nt, Bordetella pertussis
aucugguccugggccguc

SEQ ID NO: 300002 - RNA, 14 nt, Bordetella pertussis
aucuguaccgccgg

SEQ ID NO: 300003 - RNA, 16 nt, Bordetella pertussis
aucuguucggcgccgg

SEQ ID NO: 300004 - RNA, 18 nt, Bordetella pertussis
aucuucugcgccacggcg

SEQ ID NO: 300005 - RNA, 12 nt, Bordetella pertussis
augaccaucgcg

SEQ ID NO: 300006 - RNA, 22 nt, Bordetella pertussis
augacccugcacgauuccgccu

SEQ ID NO: 300007 - RNA, 17 nt, Bordetella pertussis
augaccgacaggcggcu

SEQ ID NO: 300008 - RNA, 18 nt, Bordetella pertussis
augaccgacaggcggcug

SEQ ID NO: 300009 - RNA, 14 nt, Bordetella pertussis
augaccgacgccgu

SEQ ID NO: 300010 - RNA, 14 nt, Bordetella pertussis
augaccgccgccag

SEQ ID NO: 300011 - RNA, 17 nt, Bordetella pertussis
augaccgccgcgccggu

SEQ ID NO: 300012 - RNA, 20 nt, Bordetella pertussis
augaccgccggcaccagcgc

SEQ ID NO: 300013 - RNA, 20 nt, Bordetella pertussis
augaccgcguccgcgacgcu

SEQ ID NO: 300014 - RNA, 19 nt, Bordetella pertussis
augaccggccaggcgcgga

SEQ ID NO: 300015 - RNA, 22 nt, Bordetella pertussis
augaccggcguguccagcggcg

SEQ ID NO: 300016 - RNA, 19 nt, Bordetella pertussis
augaccucggcgagcgccu

SEQ ID NO: 300017 - RNA, 15 nt, Bordetella pertussis
augaccucggccugc

SEQ ID NO: 300018 - RNA, 19 nt, Bordetella pertussis
augacgguggugucggcgg

SEQ ID NO: 300019 - RNA, 17 nt, Bordetella pertussis
augacguccagcgccac

SEQ ID NO: 300020 - RNA, 21 nt, Bordetella pertussis
augacguucuccagcgccguc

SEQ ID NO: 300021 - RNA, 14 nt, Bordetella pertussis
augauccugcuggu

SEQ ID NO: 300022 - RNA, 15 nt, Bordetella pertussis
augaucuacgcgcgc

SEQ ID NO: 300023 - RNA, 14 nt, Bordetella pertussis
augaugagcgcgcc

SEQ ID NO: 300024 - RNA, 15 nt, Bordetella pertussis
augauggccggccug

SEQ ID NO: 300025 - RNA, 17 nt, Bordetella pertussis
augauggugcugccgcu

SEQ ID NO: 300026 - RNA, 15 nt, Bordetella pertussis
augccgauggcggug

SEQ ID NO: 300027 - RNA, 23 nt, Bordetella pertussis
augccgauugugcaugacggcca

SEQ ID NO: 300028 - RNA, 17 nt, Bordetella pertussis
augccgcagauggccag

SEQ ID NO: 300029 - RNA, 22 nt, Bordetella pertussis
augccgcagcaccacaucgccg

SEQ ID NO: 300030 - RNA, 22 nt, Bordetella pertussis
augccgcaguugaacacgcggu

SEQ ID NO: 300031 - RNA, 22 nt, Bordetella pertussis
augccgccaucauccuggucga

SEQ ID NO: 300032 - RNA, 20 nt, Bordetella pertussis
augccgccgugaugccgccc

SEQ ID NO: 300033 - RNA, 11 nt, Bordetella pertussis
augccgcgcgc

SEQ ID NO: 300034 - RNA, 19 nt, Bordetella pertussis
augccgcgcaccugggcgu

SEQ ID NO: 300035 - RNA, 13 nt, Bordetella pertussis
augccgcggcaug

SEQ ID NO: 300036 - RNA, 20 nt, Bordetella pertussis
augccgcgggcggcgccggc

SEQ ID NO: 300037 - RNA, 17 nt, Bordetella pertussis
augccgcgguugcgguu

SEQ ID NO: 300038 - RNA, 17 nt, Bordetella pertussis
augccgcugaccagcac

SEQ ID NO: 300039 - RNA, 16 nt, Bordetella pertussis
augccgcuggcgaugg

SEQ ID NO: 300040 - RNA, 22 nt, Bordetella pertussis
augccggucaggaugcgcgcca

SEQ ID NO: 300041 - RNA, 14 nt, Bordetella pertussis
augccguaggcgcc

SEQ ID NO: 300042 - RNA, 16 nt, Bordetella pertussis
augccguaggcgccgg

SEQ ID NO: 300043 - RNA, 18 nt, Bordetella pertussis
augccguaggcgccggcc

SEQ ID NO: 300044 - RNA, 16 nt, Bordetella pertussis
augccguccacgccca

SEQ ID NO: 300045 - RNA, 19 nt, Bordetella pertussis
augccguccacgcccagcg

SEQ ID NO: 300046 - RNA, 15 nt, Bordetella pertussis
augccguccuggccg

SEQ ID NO: 300047 - RNA, 20 nt, Bordetella pertussis
augccgucgaaggccgcaac

SEQ ID NO: 300048 - RNA, 20 nt, Bordetella pertussis
augccgucgagcgcggccag

SEQ ID NO: 300049 - RNA, 15 nt, Bordetella pertussis
augccgucggccugg

SEQ ID NO: 300050 - RNA, 23 nt, Bordetella pertussis
augccgucuuggcgggcuagcug

SEQ ID NO: 300051 - RNA, 18 nt, Bordetella pertussis
augccguggacgugcgcg

SEQ ID NO: 300052 - RNA, 21 nt, Bordetella pertussis
augccguggacgugcgcgacc

SEQ ID NO: 300053 - RNA, 16 nt, Bordetella pertussis
augccucgaagcggcu

SEQ ID NO: 300054 - RNA, 22 nt, Bordetella pertussis
augcgauagcgggccugcagca

SEQ ID NO: 300055 - RNA, 14 nt, Bordetella pertussis
augcgaucggccuc

SEQ ID NO: 300056 - RNA, 14 nt, Bordetella pertussis
augcgcaccuuguc

SEQ ID NO: 300057 - RNA, 14 nt, Bordetella pertussis
augcgcacgcgcgu

SEQ ID NO: 300058 - RNA, 22 nt, Bordetella pertussis
augcgcacggacagcccgcgcu

SEQ ID NO: 300059 - RNA, 16 nt, Bordetella pertussis
augcgcacgggcgagg

SEQ ID NO: 300060 - RNA, 18 nt, Bordetella pertussis
augcgcagcagcagcgca

SEQ ID NO: 300061 - RNA, 14 nt, Bordetella pertussis
augcgcagcaggcg

SEQ ID NO: 300062 - RNA, 16 nt, Bordetella pertussis
augcgcagcaggcgcg

SEQ ID NO: 300063 - RNA, 17 nt, Bordetella pertussis
augcgcaccggccaggg

SEQ ID NO: 300064 - RNA, 13 nt, Bordetella pertussis
augcgcagcgcgu

SEQ ID NO: 300065 - RNA, 15 nt, Bordetella pertussis
augcgcguggcgcga

SEQ ID NO: 300066 - RNA, 18 nt, Bordetella pertussis
augcgcguuggccugacc

SEQ ID NO: 300067 - RNA, 13 nt, Bordetella pertussis
augcgcugcugga

SEQ ID NO: 300068 - RNA, 23 nt, Bordetella pertussis
augcgcugcuggaggccggcgug

SEQ ID NO: 300069 - RNA, 14 nt, Bordetella pertussis
augcgcuggccggc

SEQ ID NO: 300070 - RNA, 17 nt, Bordetella pertussis
augcgcuggccggccgc

SEQ ID NO: 300071 - RNA, 20 nt, Bordetella pertussis
augcgcuggccggccgcgug

SEQ ID NO: 300072 - RNA, 16 nt, Bordetella pertussis
augcgcugggccaggc

SEQ ID NO: 300073 - RNA, 22 nt, Bordetella pertussis
augcgcuggucgcgcagcacga

SEQ ID NO: 300074 - RNA, 23 nt, Bordetella pertussis
augcgcuugccgcccacugccag

SEQ ID NO: 300075 - RNA, 15 nt, Bordetella pertussis
augcgcuugucgccg

SEQ ID NO: 300076 - RNA, 19 nt, Bordetella pertussis
augcgcuugucgccgcugc

SEQ ID NO: 300077 - RNA, 13 nt, Bordetella pertussis
augcggacgccag

SEQ ID NO: 300078 - RNA, 18 nt, Bordetella pertussis
augcggaugaacgaccag

SEQ ID NO: 300079 - RNA, 13 nt, Bordetella pertussis
augcggcagcagg

SEQ ID NO: 300080 - RNA, 13 nt, Bordetella pertussis
augcgggcggcgg

SEQ ID NO: 300081 - RNA, 11 nt, Bordetella pertussis
augcggggacu

SEQ ID NO: 300082 - RNA, 13 nt, Bordetella pertussis
augcggggcggcg

SEQ ID NO: 300083 - RNA, 19 nt, Bordetella pertussis
augcgggucaaggcggggc

SEQ ID NO: 300084 - RNA, 19 nt, Bordetella pertussis
augcgggucggcgccauga

SEQ ID NO: 300085 - RNA, 16 nt, Bordetella pertussis
augcgguaccacgcga

SEQ ID NO: 300086 - RNA, 21 nt, Bordetella pertussis
augcgguacugcggcgccugg

SEQ ID NO: 300087 - RNA, 19 nt, Bordetella pertussis
augcgguaggcccagcaau

SEQ ID NO: 300088 - RNA, 17 nt, Bordetella pertussis
augcgucaggggcaugc

SEQ ID NO: 300089 - RNA, 21 nt, Bordetella pertussis
augcgucaggggcaugccggc

SEQ ID NO: 300090 - RNA, 20 nt, Bordetella pertussis
augcguccgccgugcaggcc

SEQ ID NO: 300091 - RNA, 16 nt, Bordetella pertussis
augcgucgaacggccg

SEQ ID NO: 300092 - RNA, 18 nt, Bordetella pertussis
augcgugacacggccauc

SEQ ID NO: 300093 - RNA, 19 nt, Bordetella pertussis
augcgugcgcaucagcgca

SEQ ID NO: 300094 - RNA, 14 nt, Bordetella pertussis
augcguggccggcg

SEQ ID NO: 300095 - RNA, 16 nt, Bordetella pertussis
augcgugguacggcga

SEQ ID NO: 300096 - RNA, 17 nt, Bordetella pertussis
augcguguuccagcgcc

SEQ ID NO: 300097 - RNA, 16 nt, Bordetella pertussis
augcguucgcccgugc

SEQ ID NO: 300098 - RNA, 13 nt, Bordetella pertussis
augcguucggcca

SEQ ID NO: 300099 - RNA, 19 nt, Bordetella pertussis
augcuugccauaggccagc

SEQ ID NO: 300100 - RNA, 18 nt, Bordetella pertussis
augcuugcuugccagcuc

SEQ ID NO: 300101 - RNA, 21 nt, Bordetella pertussis
auggaacucguuggccagcgc

SEQ ID NO: 300102 - RNA, 20 nt, Bordetella pertussis
auggaaucauuggccagcgc

SEQ ID NO: 300103 - RNA, 21 nt, Bordetella pertussis
auggacacagcggcgcgagcg

SEQ ID NO: 300104 - RNA, 14 nt, Bordetella pertussis
auggacagcaccga

SEQ ID NO: 300105 - RNA, 19 nt, Bordetella pertussis
auggccacgaccaccagcg

SEQ ID NO: 300106 - RNA, 18 nt, Bordetella pertussis
auggccagcacauacgcc

SEQ ID NO: 300107 - RNA, 20 nt, Bordetella pertussis
auggccagcagcgccgccag

SEQ ID NO: 300108 - RNA, 14 nt, Bordetella pertussis
auggccagcgcgcg

SEQ ID NO: 300109 - RNA, 21 nt, Bordetella pertussis
auggcccagggcagcggccag

SEQ ID NO: 300110 - RNA, 16 nt, Bordetella pertussis
auggccgugcgcccga

SEQ ID NO: 300111 - RNA, 18 nt, Bordetella pertussis
auggccguuggccagcgc

SEQ ID NO: 300112 - RNA, 23 nt, Bordetella pertussis
auggccguuggccagcgccgcca

SEQ ID NO: 300113 - RNA, 19 nt, Bordetella pertussis
auggccucggcauggcgcg

SEQ ID NO: 300114 - RNA, 16 nt, Bordetella pertussis
auggccucggcggccu

SEQ ID NO: 300115 - RNA, 17 nt, Bordetella pertussis
auggccugcuuggcgcg

SEQ ID NO: 300116 - RNA, 22 nt, Bordetella pertussis
auggccuggaugugcaggccga

SEQ ID NO: 300117 - RNA, 23 nt, Bordetella pertussis
auggccuggcccagcuccagcug

SEQ ID NO: 300118 - RNA, 15 nt, Bordetella pertussis
auggccugugcggcc

SEQ ID NO: 300119 - RNA, 20 nt, Bordetella pertussis
auggcgcuccagcccuucgc

SEQ ID NO: 300120 - RNA, 20 nt, Bordetella pertussis
auggcggcaacgugcaggcc

SEQ ID NO: 300121 - RNA, 21 nt, Bordetella pertussis
auggcggcaacgugcaggcca

SEQ ID NO: 300122 - RNA, 12 nt, Bordetella pertussis
auggcggccagc

SEQ ID NO: 300123 - RNA, 13 nt, Bordetella pertussis
auggcggccaggc

SEQ ID NO: 300124 - RNA, 21 nt, Bordetella pertussis
auggcggccaggcgcgccgcg

SEQ ID NO: 300125 - RNA, 17 nt, Bordetella pertussis
auggcggccgccagcgc

SEQ ID NO: 300126 - RNA, 21 nt, Bordetella pertussis
auggcggcgaugccgcugucg

SEQ ID NO: 300127 - RNA, 13 nt, Bordetella pertussis
auggcggcggcca

SEQ ID NO: 300128 - RNA, 15 nt, Bordetella pertussis
auggcguccagcagc

SEQ ID NO: 300129 - RNA, 15 nt, Bordetella pertussis
auggcguccgcgucg

SEQ ID NO: 300130 - RNA, 18 nt, Bordetella pertussis
auggcguccgcgucgccg

SEQ ID NO: 300131 - RNA, 22 nt, Bordetella pertussis
auggcgucgaccgccaugcgca

SEQ ID NO: 300132 - RNA, 12 nt, Bordetella pertussis
auggcgucggcc

SEQ ID NO: 300133 - RNA, 16 nt, Bordetella pertussis
auggcgucggccacgu

SEQ ID NO: 300134 - RNA, 17 nt, Bordetella pertussis
auggcgucugcccgugc

SEQ ID NO: 300135 - RNA, 19 nt, Bordetella pertussis
auggcgucugcccgugcgu

SEQ ID NO: 300136 - RNA, 15 nt, Bordetella pertussis
auggcugcgcgccgu

SEQ ID NO: 300137 - RNA, 16 nt, Bordetella pertussis
auggcugcgcgccgug

SEQ ID NO: 300138 - RNA, 18 nt, Bordetella pertussis
auggcuuccugcggcacg

SEQ ID NO: 300139 - RNA, 20 nt, Bordetella pertussis
auggcuuucuaucaucaggc

SEQ ID NO: 300140 - RNA, 23 nt, Bordetella pertussis
auggcuuucuaucaucaggccca

SEQ ID NO: 300141 - RNA, 13 nt, Bordetella pertussis
augggcaagccga

SEQ ID NO: 300142 - RNA, 16 nt, Bordetella pertussis
augggcagcucgccuu

SEQ ID NO: 300143 - RNA, 13 nt, Bordetella pertussis
auggucgaccagc

SEQ ID NO: 300144 - RNA, 21 nt, Bordetella pertussis
auggucgcggccgaggccagc

SEQ ID NO: 300145 - RNA, 17 nt, Bordetella pertussis
auggucggcauggccag

SEQ ID NO: 300146 - RNA, 19 nt, Bordetella pertussis
auggugagggccacgcgcu

SEQ ID NO: 300147 - RNA, 14 nt, Bordetella pertussis
auggugggcaugac

SEQ ID NO: 300148 - RNA, 19 nt, Bordetella pertussis
augguggggcuggccgccg

SEQ ID NO: 300149 - RNA, 23 nt, Bordetella pertussis
augguguaccgggccgacgcgcc

SEQ ID NO: 300150 - RNA, 22 nt, Bordetella pertussis
auguacagcgguucguagccgg

SEQ ID NO: 300151 - RNA, 19 nt, Bordetella pertussis
auguacgcaucggcgccgg

SEQ ID NO: 300152 - RNA, 15 nt, Bordetella pertussis
auguacucggccagg

SEQ ID NO: 300153 - RNA, 13 nt, Bordetella pertussis
auguaggccaggu

SEQ ID NO: 300154 - RNA, 14 nt, Bordetella pertussis
auguccauggccug

SEQ ID NO: 300155 - RNA, 16 nt, Bordetella pertussis
auguccgcgucggccg

SEQ ID NO: 300156 - RNA, 20 nt, Bordetella pertussis
auguccguaucgcggccgag

SEQ ID NO: 300157 - RNA, 19 nt, Bordetella pertussis
auguccggggcgcuugcca

SEQ ID NO: 300158 - RNA, 20 nt, Bordetella pertussis
augucggccuucugcgccag

SEQ ID NO: 300159 - RNA, 17 nt, Bordetella pertussis
augucggcuaccacgug

SEQ ID NO: 300160 - RNA, 16 nt, Bordetella pertussis
augugcagcgcacggu

SEQ ID NO: 300161 - RNA, 21 nt, Bordetella pertussis
augugcgagagcuccagccgg

SEQ ID NO: 300162 - RNA, 16 nt, Bordetella pertussis
augugcgcgggcgcgg

SEQ ID NO: 300163 - RNA, 12 nt, Bordetella pertussis
augugcggcgug

SEQ ID NO: 300164 - RNA, 18 nt, Bordetella pertussis
augugcugcggcagccag

SEQ ID NO: 300165 - RNA, 22 nt, Bordetella pertussis
auguggccgucgucaucgccau

SEQ ID NO: 300166 - RNA, 17 nt, Bordetella pertussis
auguggccuaccgcuau

SEQ ID NO: 300167 - RNA, 21 nt, Bordetella pertussis
auguggggguuguggcggguc

SEQ ID NO: 300168 - RNA, 18 nt, Bordetella pertussis
augugguagccgccgucg

SEQ ID NO: 300169 - RNA, 16 nt, Bordetella pertussis
auguggucggcgccga

SEQ ID NO: 300170 - RNA, 23 nt, Bordetella pertussis
auguggucggcgccgaggcgguc

SEQ ID NO: 300171 - RNA, 20 nt, Bordetella pertussis
auguucaggccaugcugggc

SEQ ID NO: 300172 - RNA, 18 nt, Bordetella pertussis
auucgaacaacagcgccu

SEQ ID NO: 300173 - RNA, 19 nt, Bordetella pertussis
auucgaacaacagcgccug

SEQ ID NO: 300174 - RNA, 15 nt, Bordetella pertussis
auucggaccagggcu

SEQ ID NO: 300175 - RNA, 11 nt, Bordetella pertussis
auucggccagg

SEQ ID NO: 300176 - RNA, 19 nt, Bordetella pertussis
auucuggugcagcggcucg

SEQ ID NO: 300177 - RNA, 20 nt, Bordetella pertussis
auucuuuccuggccggcgcc

SEQ ID NO: 300178 - RNA, 16 nt, Bordetella pertussis
auugaguucgcgcgcc

SEQ ID NO: 300179 - RNA, 15 nt, Bordetella pertussis
auugaucgaucagcc

SEQ ID NO: 300180 - RNA, 23 nt, Bordetella pertussis
auugaugcagcacgucggcgucg

SEQ ID NO: 300181 - RNA, 14 nt, Bordetella pertussis
auugccgucggccg

SEQ ID NO: 300182 - RNA, 15 nt, Bordetella pertussis
auugcuugacgccgc

SEQ ID NO: 300183 - RNA, 19 nt, Bordetella pertussis
auugcuuuuccacgcccgc

SEQ ID NO: 300184 - RNA, 19 nt, Bordetella pertussis
auugggcggcaucucgcgg

SEQ ID NO: 300185 - RNA, 13 nt, Bordetella pertussis
auugguguugccg

SEQ ID NO: 300186 - RNA, 20 nt, Bordetella pertussis
caaagccggaauccuggcga

SEQ ID NO: 300187 - RNA, 15 nt, Bordetella pertussis
caaagcgcagcguga

SEQ ID NO: 300188 - RNA, 15 nt, Bordetella pertussis
caaagcgcgcguccu

SEQ ID NO: 300189 - RNA, 23 nt, Bordetella pertussis
caaagcggguugcggcagcgccg

SEQ ID NO: 300190 - RNA, 18 nt, Bordetella pertussis
caacaacggggucaucgc

SEQ ID NO: 300191 - RNA, 15 nt, Bordetella pertussis
caacaagccgggcgc

SEQ ID NO: 300192 - RNA, 16 nt, Bordetella pertussis
caacaagccgggcgcc

SEQ ID NO: 300193 - RNA, 17 nt, Bordetella pertussis
caacaagccgggcgccg

SEQ ID NO: 300194 - RNA, 17 nt, Bordetella pertussis
caacacgauccacggcc

SEQ ID NO: 300195 - RNA, 15 nt, Bordetella pertussis
caacagcucgcgcca

SEQ ID NO: 300196 - RNA, 18 nt, Bordetella pertussis
caacagcuugcccacgcg

SEQ ID NO: 300197 - RNA, 21 nt, Bordetella pertussis
caacagcuugcccacgcgcuc

SEQ ID NO: 300198 - RNA, 23 nt, Bordetella pertussis
caacagcuugcccacgcgcuccu

SEQ ID NO: 300199 - RNA, 14 nt, Bordetella pertussis
caacaugccggaca

SEQ ID NO: 300200 - RNA, 21 nt, Bordetella pertussis
caacauuggguacgacggccg

SEQ ID NO: 300201 - RNA, 23 nt, Bordetella pertussis
caacauuggguacgacggccggg

SEQ ID NO: 300202 - RNA, 19 nt, Bordetella pertussis
caaccacccuucgcgcugc

SEQ ID NO: 300203 - RNA, 22 nt, Bordetella pertussis
caaccacgagcugcagcccggc

SEQ ID NO: 300204 - RNA, 15 nt, Bordetella pertussis
caaccagggccgcca

SEQ ID NO: 300205 - RNA, 19 nt, Bordetella pertussis
caaccaggggcggcgcggc

SEQ ID NO: 300206 - RNA, 20 nt, Bordetella pertussis
caaccaggggcggcgcggcg

SEQ ID NO: 300207 - RNA, 19 nt, Bordetella pertussis
caacccacggcguggcgcg

SEQ ID NO: 300208 - RNA, 19 nt, Bordetella pertussis
caacccagcagcggcagca

SEQ ID NO: 300209 - RNA, 18 nt, Bordetella pertussis
caaccccgagggcgcggc

SEQ ID NO: 300210 - RNA, 21 nt, Bordetella pertussis
caaccccgagggcgcggcgcc

SEQ ID NO: 300211 - RNA, 21 nt, Bordetella pertussis
caacccggccucagcggccgc

SEQ ID NO: 300212 - RNA, 22 nt, Bordetella pertussis
caacccggccucagcggccgcu

SEQ ID NO: 300213 - RNA, 14 nt, Bordetella pertussis
caacccgucgacgc

SEQ ID NO: 300214 - RNA, 15 nt, Bordetella pertussis
caacccgucgacgca

SEQ ID NO: 300215 - RNA, 20 nt, Bordetella pertussis
caacccugccuccaggcgca

SEQ ID NO: 300216 - RNA, 15 nt, Bordetella pertussis
caaccgccacgugcu

SEQ ID NO: 300217 - RNA, 21 nt, Bordetella pertussis
caaccgcgcguaucggcgcga

SEQ ID NO: 300218 - RNA, 14 nt, Bordetella pertussis
caaccgcggcgaca

SEQ ID NO: 300219 - RNA, 19 nt, Bordetella pertussis
caaccggcguucuggcgca

SEQ ID NO: 300220 - RNA, 13 nt, Bordetella pertussis
caaccucgacgcg

SEQ ID NO: 300221 - RNA, 18 nt, Bordetella pertussis
caaccucgccgcgccagc

SEQ ID NO: 300222 - RNA, 21 nt, Bordetella pertussis
caaccugcacgcgggcgcuga

SEQ ID NO: 300223 - RNA, 16 nt, Bordetella pertussis
caaccugguauccggc

SEQ ID NO: 300224 - RNA, 18 nt, Bordetella pertussis
caaccugguauccggcgc

SEQ ID NO: 300225 - RNA, 19 nt, Bordetella pertussis
caaccugguauccggcgca

SEQ ID NO: 300226 - RNA, 14 nt, Bordetella pertussis
caaccuggcgcgcg

SEQ ID NO: 300227 - RNA, 17 nt, Bordetella pertussis
caacgacgcaggcgccg

SEQ ID NO: 300228 - RNA, 17 nt, Bordetella pertussis
caacgcccugacgacca

SEQ ID NO: 300229 - RNA, 13 nt, Bordetella pertussis
caacgccgccggc

SEQ ID NO: 300230 - RNA, 19 nt, Bordetella pertussis
caacgccggccauggcggc

SEQ ID NO: 300231 - RNA, 12 nt, Bordetella pertussis
caacgccggcgg

SEQ ID NO: 300232 - RNA, 12 nt, Bordetella pertussis
caacgccggccg

SEQ ID NO: 300233 - RNA, 22 nt, Bordetella pertussis
caacgcgaucucagccaucauc

SEQ ID NO: 300234 - RNA, 17 nt, Bordetella pertussis
caacggccaccagggcc

SEQ ID NO: 300235 - RNA, 19 nt, Bordetella pertussis
caacggccuucggcggcgc

SEQ ID NO: 300236 - RNA, 16 nt, Bordetella pertussis
caacggcuggcugggc

SEQ ID NO: 300237 - RNA, 20 nt, Bordetella pertussis
caacggcuggcugggcgcgc

SEQ ID NO: 300238 - RNA, 23 nt, Bordetella pertussis
caacggcuggcugggcgcgccgc

SEQ ID NO: 300239 - RNA, 17 nt, Bordetella pertussis
caacggcgugcugcggc

SEQ ID NO: 300240 - RNA, 14 nt, Bordetella pertussis
caacgggccggccg

SEQ ID NO: 300241 - RNA, 17 nt, Bordetella pertussis
caacgggccggccgccg

SEQ ID NO: 300242 - RNA, 22 nt, Bordetella pertussis
caacgggccggccgccggcggc

SEQ ID NO: 300243 - RNA, 17 nt, Bordetella pertussis
caacgggucgcgcagca

SEQ ID NO: 300244 - RNA, 16 nt, Bordetella pertussis
caacggugagccggcc

SEQ ID NO: 300245 - RNA, 18 nt, Bordetella pertussis
caacggugagccggccac

SEQ ID NO: 300246 - RNA, 15 nt, Bordetella pertussis
caacguugcugcagc

SEQ ID NO: 300247 - RNA, 16 nt, Bordetella pertussis
caacguugcugcagcg

SEQ ID NO: 300248 - RNA, 21 nt, Bordetella pertussis
caacucuuccccgucggcggc

SEQ ID NO: 300249 - RNA, 14 nt, Bordetella pertussis
caagaccgcggccg

SEQ ID NO: 300250 - RNA, 16 nt, Bordetella pertussis
caagaccgcggccgcg

SEQ ID NO: 300251 - RNA, 17 nt, Bordetella pertussis
caagaccgcggccgcgc

SEQ ID NO: 300252 - RNA, 22 nt, Bordetella pertussis
caagacgcccaggcccaccgca

SEQ ID NO: 300253 - RNA, 20 nt, Bordetella pertussis
caagccgauccgcgacgccc

SEQ ID NO: 300254 - RNA, 15 nt, Bordetella pertussis
caagccgcaccaugc

SEQ ID NO: 300255 - RNA, 13 nt, Bordetella pertussis
caagccgggcgcc

SEQ ID NO: 300256 - RNA, 16 nt, Bordetella pertussis
caagccgggcgccggc

SEQ ID NO: 300257 - RNA, 19 nt, Bordetella pertussis
caagccuugcggcccuugc

SEQ ID NO: 300258 - RNA, 16 nt, Bordetella pertussis
caagcugcuggccggc

SEQ ID NO: 300259 - RNA, 19 nt, Bordetella pertussis
caagcuggagaagcgccgc

SEQ ID NO: 300260 - RNA, 17 nt, Bordetella pertussis
caagcuggcggcgcgcg

SEQ ID NO: 300261 - RNA, 16 nt, Bordetella pertussis
caaggacaaggcgcgu

SEQ ID NO: 300262 - RNA, 20 nt, Bordetella pertussis
caaggacgcguccucggcca

SEQ ID NO: 300263 - RNA, 22 nt, Bordetella pertussis
caaggacgcguccucggccagc

SEQ ID NO: 300264 - RNA, 15 nt, Bordetella pertussis
caaggauggacuggc

SEQ ID NO: 300265 - RNA, 17 nt, Bordetella pertussis
caaggauggacuggccg

SEQ ID NO: 300266 - RNA, 20 nt, Bordetella pertussis
caaggcaagaaucgacucgg

SEQ ID NO: 300267 - RNA, 14 nt, Bordetella pertussis
caaggcccgcccgg

SEQ ID NO: 300268 - RNA, 17 nt, Bordetella pertussis
caaggcccgcccggggu

SEQ ID NO: 300269 - RNA, 17 nt, Bordetella pertussis
caaggccgaauugccgc

SEQ ID NO: 300270 - RNA, 22 nt, Bordetella pertussis
caaggccgaauugccgccgcug

SEQ ID NO: 300271 - RNA, 14 nt, Bordetella pertussis
caaggccggcggca

SEQ ID NO: 300272 - RNA, 15 nt, Bordetella pertussis
caaggccugcccggg

SEQ ID NO: 300273 - RNA, 16 nt, Bordetella pertussis
caaggcgacggucgca

SEQ ID NO: 300274 - RNA, 24 nt, Bordetella pertussis
caaggcgcggccgucgugcagcgu

SEQ ID NO: 300275 - RNA, 22 nt, Bordetella pertussis
caaggcggcaaacccggcgaag

SEQ ID NO: 300276 - RNA, 13 nt, Bordetella pertussis
caaggcggccgcg

SEQ ID NO: 300277 - RNA, 20 nt, Bordetella pertussis
caaggcgggcuggucgcgcc

SEQ ID NO: 300278 - RNA, 20 nt, Bordetella pertussis
caagggccccccggcgcggc

SEQ ID NO: 300279 - RNA, 16 nt, Bordetella pertussis
caagggcgcgccagca

SEQ ID NO: 300280 - RNA, 19 nt, Bordetella pertussis
caaguccgguauccuggcg

SEQ ID NO: 300281 - RNA, 20 nt, Bordetella pertussis
caauacuucguggcgcagcu

SEQ ID NO: 300282 - RNA, 17 nt, Bordetella pertussis
caaucagauggcgcagc

SEQ ID NO: 300283 - RNA, 20 nt, Bordetella pertussis
caauccgcgaagugccuguc

SEQ ID NO: 300284 - RNA, 18 nt, Bordetella pertussis
caauccgcccguugcggc

SEQ ID NO: 300285 - RNA, 15 nt, Bordetella pertussis
caauccgccgccagc

SEQ ID NO: 300286 - RNA, 16 nt, Bordetella pertussis
caauccgucaggcagc

SEQ ID NO: 300287 - RNA, 14 nt, Bordetella pertussis
caauccuggcugau

SEQ ID NO: 300288 - RNA, 18 nt, Bordetella pertussis
caaucgaaaagcccgccg

SEQ ID NO: 300289 - RNA, 21 nt, Bordetella pertussis
caaucgaaaagcccgccgagu

SEQ ID NO: 300290 - RNA, 22 nt, Bordetella pertussis
caaucgaugaucacgcgcuccg

SEQ ID NO: 300291 - RNA, 14 nt, Bordetella pertussis
caaucuugccaggc

SEQ ID NO: 300292 - RNA, 20 nt, Bordetella pertussis
caaucuugccaggcccggcg

SEQ ID NO: 300293 - RNA, 13 nt, Bordetella pertussis
caaucuugccgcc

SEQ ID NO: 300294 - RNA, 22 nt, Bordetella pertussis
caaugccagggugaccuggcgc

SEQ ID NO: 300295 - RNA, 15 nt, Bordetella pertussis
caaugccagucgccg

SEQ ID NO: 300296 - RNA, 20 nt, Bordetella pertussis
caauggacacagcggcgcga

SEQ ID NO: 300297 - RNA, 20 nt, Bordetella pertussis
caauggccgcggcgugcugc

SEQ ID NO: 300298 - RNA, 13 nt, Bordetella pertussis
caauucgagcagg

SEQ ID NO: 300299 - RNA, 20 nt, Bordetella pertussis
caauucgagcaggcgcaggc

SEQ ID NO: 300300 - RNA, 15 nt, Bordetella pertussis
cacaaagacggcuug

SEQ ID NO: 300301 - RNA, 16 nt, Bordetella pertussis
cacagcaugaccucgg

SEQ ID NO: 300302 - RNA, 20 nt, Bordetella pertussis
cacagcaugcgcuggucgcg

SEQ ID NO: 300303 - RNA, 16 nt, Bordetella pertussis
cacagcauggccacca

SEQ ID NO: 300304 - RNA, 18 nt, Bordetella pertussis
cacagccaggccgaucag

SEQ ID NO: 300305 - RNA, 20 nt, Bordetella pertussis
cacagccauugcccacagca

SEQ ID NO: 300306 - RNA, 12 nt, Bordetella pertussis
cacagcccggcc

SEQ ID NO: 300307 - RNA, 16 nt, Bordetella pertussis
cacaggaacagccugc

SEQ ID NO: 300308 - RNA, 21 nt, Bordetella pertussis
cacaggaacaggccggccugg

SEQ ID NO: 300309 - RNA, 16 nt, Bordetella pertussis
cacaggcccgcgcggc

SEQ ID NO: 300310 - RNA, 18 nt, Bordetella pertussis
cacaggcccgcgcggcca

SEQ ID NO: 300311 - RNA, 22 nt, Bordetella pertussis
cacaggcccgcgcggccagcgc

SEQ ID NO: 300312 - RNA, 16 nt, Bordetella pertussis
cacaguugcaggccau

SEQ ID NO: 300313 - RNA, 16 nt, Bordetella pertussis
cacaguuugucggcga

SEQ ID NO: 300314 - RNA, 17 nt, Bordetella pertussis
cacauacaaggcgcggc

SEQ ID NO: 300315 - RNA, 14 nt, Bordetella pertussis
cacauagcccggcg

SEQ ID NO: 300316 - RNA, 15 nt, Bordetella pertussis
cacauagcccggcgc

SEQ ID NO: 300317 - RNA, 16 nt, Bordetella pertussis
cacauagcccggcgcg

SEQ ID NO: 300318 - RNA, 18 nt, Bordetella pertussis
cacauagcccggcgcgau

SEQ ID NO: 300319 - RNA, 14 nt, Bordetella pertussis
cacauaggccggca

SEQ ID NO: 300320 - RNA, 15 nt, Bordetella pertussis
cacauaggccggcac

SEQ ID NO: 300321 - RNA, 15 nt, Bordetella pertussis
cacauagaccggcug

SEQ ID NO: 300322 - RNA, 22 nt, Bordetella pertussis
cacaucaggucgaccugcuugc

SEQ ID NO: 300323 - RNA, 14 nt, Bordetella pertussis
cacauccagccgau

SEQ ID NO: 300324 - RNA, 16 nt, Bordetella pertussis
cacauccgacagaugg

SEQ ID NO: 300325 - RNA, 16 nt, Bordetella pertussis
cacaugaugcccagcg

SEQ ID NO: 300326 - RNA, 17 nt, Bordetella pertussis
cacaugcccggccacca

SEQ ID NO: 300327 - RNA, 17 nt, Bordetella pertussis
cacauggcgcaucucgu

SEQ ID NO: 300328 - RNA, 13 nt, Bordetella pertussis
cacauggcgcgcc

SEQ ID NO: 300329 - RNA, 20 nt, Bordetella pertussis
cacauggcgcgccggccggu

SEQ ID NO: 300330 - RNA, 20 nt, Bordetella pertussis
cacauggggacuggcacccg

SEQ ID NO: 300331 - RNA, 17 nt, Bordetella pertussis
cacauggucgcccagca

SEQ ID NO: 300332 - RNA, 13 nt, Bordetella pertussis
caccaccaccgcc

SEQ ID NO: 300333 - RNA, 17 nt, Bordetella pertussis
caccaccagcgcggcca

SEQ ID NO: 300334 - RNA, 14 nt, Bordetella pertussis
caccaccagcggcg

SEQ ID NO: 300335 - RNA, 15 nt, Bordetella pertussis
caccaccagcggcgu

SEQ ID NO: 300336 - RNA, 14 nt, Bordetella pertussis
caccaccaggccgg

SEQ ID NO: 300337 - RNA, 19 nt, Bordetella pertussis
caccaccaggccggccagg

SEQ ID NO: 300338 - RNA, 11 nt, Bordetella pertussis
caccaccggca

SEQ ID NO: 300339 - RNA, 14 nt, Bordetella pertussis
caccaccggcaagg

SEQ ID NO: 300340 - RNA, 15 nt, Bordetella pertussis
caccaccggcaaggc

SEQ ID NO: 300341 - RNA, 17 nt, Bordetella pertussis
caccaccggcaaggccg

SEQ ID NO: 300342 - RNA, 17 nt, Bordetella pertussis
caccacgaugucggcgc

SEQ ID NO: 300343 - RNA, 15 nt, Bordetella pertussis
caccacgcccgcgcc

SEQ ID NO: 300344 - RNA, 16 nt, Bordetella pertussis
caccacgcccgcgccg

SEQ ID NO: 300345 - RNA, 21 nt, Bordetella pertussis
caccacgccuucgagcaccau

SEQ ID NO: 300346 - RNA, 13 nt, Bordetella pertussis
caccacgcuggcu

SEQ ID NO: 300347 - RNA, 15 nt, Bordetella pertussis
caccacggcgcgcgc

SEQ ID NO: 300348 - RNA, 15 nt, Bordetella pertussis
caccacggcggccag

SEQ ID NO: 300349 - RNA, 17 nt, Bordetella pertussis
caccacggcggccaggc

SEQ ID NO: 300350 - RNA, 12 nt, Bordetella pertussis
caccacggcggg

SEQ ID NO: 300351 - RNA, 14 nt, Bordetella pertussis
caccacgggcucgc

SEQ ID NO: 300352 - RNA, 19 nt, Bordetella pertussis
caccacgggcucgcugacc

SEQ ID NO: 300353 - RNA, 17 nt, Bordetella pertussis
caccacgucgcggcugg

SEQ ID NO: 300354 - RNA, 19 nt, Bordetella pertussis
caccacgucgcggcugggc

SEQ ID NO: 300355 - RNA, 18 nt, Bordetella pertussis
caccacguccuggggcgc

SEQ ID NO: 300356 - RNA, 15 nt, Bordetella pertussis
caccagcccgcccgc

SEQ ID NO: 300357 - RNA, 20 nt, Bordetella pertussis
caccagcccgcccgcgccca

SEQ ID NO: 300358 - RNA, 15 nt, Bordetella pertussis
caccagccgcccggc

SEQ ID NO: 300359 - RNA, 13 nt, Bordetella pertussis
caccagccggccg

SEQ ID NO: 300360 - RNA, 17 nt, Bordetella pertussis
caccagccggccgccga

SEQ ID NO: 300361 - RNA, 17 nt, Bordetella pertussis
caccagccgggcggcca

SEQ ID NO: 300362 - RNA, 19 nt, Bordetella pertussis
caccagccgggcggccacg

SEQ ID NO: 300363 - RNA, 14 nt, Bordetella pertussis
caccagcgccagga

SEQ ID NO: 300364 - RNA, 15 nt, Bordetella pertussis
caccagcgcauugcc

SEQ ID NO: 300365 - RNA, 22 nt, Bordetella pertussis
caccagcggcgugcggcccagc

SEQ ID NO: 300366 - RNA, 21 nt, Bordetella pertussis
caccagcggcguggcggccag

SEQ ID NO: 300367 - RNA, 18 nt, Bordetella pertussis
caccagcgucaccagcag

SEQ ID NO: 300368 - RNA, 23 nt, Bordetella pertussis
caccagcgucaccagcaggcggc

SEQ ID NO: 300369 - RNA, 16 nt, Bordetella pertussis
caccagcuccucgacc

SEQ ID NO: 300370 - RNA, 15 nt, Bordetella pertussis
caccagcucggcggc

SEQ ID NO: 300371 - RNA, 20 nt, Bordetella pertussis
caccagcucggcggcgauca

SEQ ID NO: 300372 - RNA, 16 nt, Bordetella pertussis
caccagcucgcggccc

SEQ ID NO: 300373 - RNA, 14 nt, Bordetella pertussis
caccaggcgcgcgc

SEQ ID NO: 300374 - RNA, 16 nt, Bordetella pertussis
caccaggcgcgcgcca

SEQ ID NO: 300375 - RNA, 20 nt, Bordetella pertussis
caccaggcgcgcgccaucga

SEQ ID NO: 300376 - RNA, 13 nt, Bordetella pertussis
caccaggcgcggc

SEQ ID NO: 300377 - RNA, 14 nt, Bordetella pertussis
caccaggcgcggcg

SEQ ID NO: 300378 - RNA, 18 nt, Bordetella pertussis
caccaggcgcucgcgcgc

SEQ ID NO: 300379 - RNA, 20 nt, Bordetella pertussis
caccaggcugaucacccaca

SEQ ID NO: 300380 - RNA, 17 nt, Bordetella pertussis
caccaggcuuugcgcgc

SEQ ID NO: 300381 - RNA, 19 nt, Bordetella pertussis
caccaggcuuugcgcgcca

SEQ ID NO: 300382 - RNA, 22 nt, Bordetella pertussis
caccaggcuuugcgcgccaugc

SEQ ID NO: 300383 - RNA, 15 nt, Bordetella pertussis
caccagggcccggac

SEQ ID NO: 300384 - RNA, 22 nt, Bordetella pertussis
caccagggcccggacgcggccg

SEQ ID NO: 300385 - RNA, 21 nt, Bordetella pertussis
caccagggaccaauacgccgc

SEQ ID NO: 300386 - RNA, 21 nt, Bordetella pertussis
caccagggcgcccgccgacga

SEQ ID NO: 300387 - RNA, 13 nt, Bordetella pertussis
caccagggcgcgc

SEQ ID NO: 300388 - RNA, 16 nt, Bordetella pertussis
caccagggcgcgcagc

SEQ ID NO: 300389 - RNA, 18 nt, Bordetella pertussis
caccagggcgcgcagcag

SEQ ID NO: 300390 - RNA, 19 nt, Bordetella pertussis
caccagggcgcgcagcagg

SEQ ID NO: 300391 - RNA, 15 nt, Bordetella pertussis
caccagggugccgcc

SEQ ID NO: 300392 - RNA, 19 nt, Bordetella pertussis
caccagggugccgccuucg

SEQ ID NO: 300393 - RNA, 22 nt, Bordetella pertussis
caccaggguggcgccggccacc

SEQ ID NO: 300394 - RNA, 23 nt, Bordetella pertussis
caccaggguggcgccggccaccg

SEQ ID NO: 300395 - RNA, 22 nt, Bordetella pertussis
caccaggguuuccucgccgacg

SEQ ID NO: 300396 - RNA, 18 nt, Bordetella pertussis
caccaggguggcgggcgc

SEQ ID NO: 300397 - RNA, 19 nt, Bordetella pertussis
caccaggguggcgggcgcc

SEQ ID NO: 300398 - RNA, 19 nt, Bordetella pertussis
caccagguccuggcggccg

SEQ ID NO: 300399 - RNA, 18 nt, Bordetella pertussis
caccagugcgccggcgcg

SEQ ID NO: 300400 - RNA, 20 nt, Bordetella pertussis
caccagugcgccggcgcggc

SEQ ID NO: 300401 - RNA, 17 nt, Bordetella pertussis
caccagugcgccggcgg

SEQ ID NO: 300402 - RNA, 18 nt, Bordetella pertussis
caccagugcgccggcggc

SEQ ID NO: 300403 - RNA, 19 nt, Bordetella pertussis
caccagugcgccggcggcg

SEQ ID NO: 300404 - RNA, 21 nt, Bordetella pertussis
caccaguuuucucauggccgc

SEQ ID NO: 300405 - RNA, 22 nt, Bordetella pertussis
caccaguuuucucauggccgcg

SEQ ID NO: 300406 - RNA, 23 nt, Bordetella pertussis
caccaguuuucucauggccgcgc

SEQ ID NO: 300407 - RNA, 18 nt, Bordetella pertussis
caccaucaacgggccgcu

SEQ ID NO: 300408 - RNA, 19 nt, Bordetella pertussis
caccaucaagaugaacgcg

SEQ ID NO: 300409 - RNA, 23 nt, Bordetella pertussis
caccaugauggccgcgcgcagcg

SEQ ID NO: 300410 - RNA, 14 nt, Bordetella pertussis
caccaugccgacga

SEQ ID NO: 300411 - RNA, 15 nt, Bordetella pertussis
caccaugccuugcgc

SEQ ID NO: 300412 - RNA, 13 nt, Bordetella pertussis
caccaugcgcagc

SEQ ID NO: 300413 - RNA, 17 nt, Bordetella pertussis
caccaugcggucgauga

SEQ ID NO: 300414 - RNA, 14 nt, Bordetella pertussis
caccaugcggugcg

SEQ ID NO: 300415 - RNA, 21 nt, Bordetella pertussis
caccauggccgacagcgucga

SEQ ID NO: 300416 - RNA, 16 nt, Bordetella pertussis
caccauggcgcccacg

SEQ ID NO: 300417 - RNA, 20 nt, Bordetella pertussis
caccauggcgcccacggccg

SEQ ID NO: 300418 - RNA, 19 nt, Bordetella pertussis
caccaugggcgucgucgcc

SEQ ID NO: 300419 - RNA, 17 nt, Bordetella pertussis
caccauucucgcccugc

SEQ ID NO: 300420 - RNA, 14 nt, Bordetella pertussis
caccauugccggcg

SEQ ID NO: 300421 - RNA, 15 nt, Bordetella pertussis
caccauugccggcgc

SEQ ID NO: 300422 - RNA, 16 nt, Bordetella pertussis
caccauugccggcgcg

SEQ ID NO: 300423 - RNA, 13 nt, Bordetella pertussis
cacccccagggcg

SEQ ID NO: 300424 - RNA, 20 nt, Bordetella pertussis
caccccgagauaggcggcca

SEQ ID NO: 300425 - RNA, 20 nt, Bordetella pertussis
caccccgcccggcggcgcgc

SEQ ID NO: 300426 - RNA, 19 nt, Bordetella pertussis
caccccguugcucuuggca

SEQ ID NO: 300427 - RNA, 15 nt, Bordetella pertussis
caccccucccugugg

SEQ ID NO: 300428 - RNA, 13 nt, Bordetella pertussis
caccccugcgcug

SEQ ID NO: 300429 - RNA, 17 nt, Bordetella pertussis
cacccgauacgacacgc

SEQ ID NO: 300430 - RNA, 19 nt, Bordetella pertussis
cacccgauacgacacgccg

SEQ ID NO: 300431 - RNA, 22 nt, Bordetella pertussis
cacccgauacgacacgccgcgc

SEQ ID NO: 300432 - RNA, 19 nt, Bordetella pertussis
cacccgaugacggggcggc

SEQ ID NO: 300433 - RNA, 21 nt, Bordetella pertussis
cacccgaugacggggcggcgc

SEQ ID NO: 300434 - RNA, 13 nt, Bordetella pertussis
cacccgcacgccg

SEQ ID NO: 300435 - RNA, 14 nt, Bordetella pertussis
cacccgcacgccgg

SEQ ID NO: 300436 - RNA, 16 nt, Bordetella pertussis
cacccgcacgccggcc

SEQ ID NO: 300437 - RNA, 14 nt, Bordetella pertussis
cacccgcauggugg

SEQ ID NO: 300438 - RNA, 15 nt, Bordetella pertussis
cacccgcaugguggc

SEQ ID NO: 300439 - RNA, 13 nt, Bordetella pertussis
cacccgcaggccg

SEQ ID NO: 300440 - RNA, 16 nt, Bordetella pertussis
cacccgccgccggcga

SEQ ID NO: 300441 - RNA, 13 nt, Bordetella pertussis
cacccgccuggac

SEQ ID NO: 300442 - RNA, 18 nt, Bordetella pertussis
cacccgccuggacggcga

SEQ ID NO: 300443 - RNA, 13 nt, Bordetella pertussis
cacccgcgcgcag

SEQ ID NO: 300444 - RNA, 13 nt, Bordetella pertussis
cacccgcggcgca

SEQ ID NO: 300445 - RNA, 22 nt, Bordetella pertussis
cacccggaucgacaggaacagc

SEQ ID NO: 300446 - RNA, 16 nt, Bordetella pertussis
cacccggcacgcgccg

SEQ ID NO: 300447 - RNA, 14 nt, Bordetella pertussis
cacccggccgcugu

SEQ ID NO: 300448 - RNA, 19 nt, Bordetella pertussis
cacccggccaucgaagcca

SEQ ID NO: 300449 - RNA, 16 nt, Bordetella pertussis
cacccggcgcaugcug

SEQ ID NO: 300450 - RNA, 18 nt, Bordetella pertussis
cacccgguauccgcgcau

SEQ ID NO: 300451 - RNA, 22 nt, Bordetella pertussis
cacccggugaucaugccgcuga

SEQ ID NO: 300452 - RNA, 17 nt, Bordetella pertussis
cacccguuccagcaugu

SEQ ID NO: 300453 - RNA, 22 nt, Bordetella pertussis
cacccugccgugggacaggcac

SEQ ID NO: 300454 - RNA, 23 nt, Bordetella pertussis
cacccugguacccaugcggggcg

SEQ ID NO: 300455 - RNA, 13 nt, Bordetella pertussis
caccgaacgggcg

SEQ ID NO: 300456 - RNA, 16 nt, Bordetella pertussis
caccgaacgggcgugg

SEQ ID NO: 300457 - RNA, 19 nt, Bordetella pertussis
caccgaacgggcguggcgc

SEQ ID NO: 300458 - RNA, 20 nt, Bordetella pertussis
caccgaacgggcguggcgca

SEQ ID NO: 300459 - RNA, 14 nt, Bordetella pertussis
caccgaagcggcgu

SEQ ID NO: 300460 - RNA, 14 nt, Bordetella pertussis
caccgauacgcugg

SEQ ID NO: 300461 - RNA, 15 nt, Bordetella pertussis
caccgaugcgccggc

SEQ ID NO: 300462 - RNA, 16 nt, Bordetella pertussis
caccgaugcgccggcc

SEQ ID NO: 300463 - RNA, 19 nt, Bordetella pertussis
caccgaugcgccggccugg

SEQ ID NO: 300464 - RNA, 15 nt, Bordetella pertussis
caccgcaucgcgcag

SEQ ID NO: 300465 - RNA, 20 nt, Bordetella pertussis
caccgcaucgcgcagcgugc

SEQ ID NO: 300466 - RNA, 21 nt, Bordetella pertussis
caccgcaugggccaggcgcuc

SEQ ID NO: 300467 - RNA, 22 nt, Bordetella pertussis
caccgccagaucguugaucucg

SEQ ID NO: 300468 - RNA, 12 nt, Bordetella pertussis
caccgccgcaca

SEQ ID NO: 300469 - RNA, 22 nt, Bordetella pertussis
caccgccgaugccgccaucauc

SEQ ID NO: 300470 - RNA, 20 nt, Bordetella pertussis
caccgccgcccgccaggcca

SEQ ID NO: 300471 - RNA, 21 nt, Bordetella pertussis
caccgccgcccgccaggccag

SEQ ID NO: 300472 - RNA, 17 nt, Bordetella pertussis
caccgccggcggcgugc

SEQ ID NO: 300473 - RNA, 20 nt, Bordetella pertussis
caccgccgguucggucgacg

SEQ ID NO: 300474 - RNA, 23 nt, Bordetella pertussis
caccgccgguucggucgacgacg

SEQ ID NO: 300475 - RNA, 13 nt, Bordetella pertussis
caccgccguggcc

SEQ ID NO: 300476 - RNA, 23 nt, Bordetella pertussis
caccgccugcgggaacugcguga

SEQ ID NO: 300477 - RNA, 23 nt, Bordetella pertussis
caccgcgaccaugcggccgucgc

SEQ ID NO: 300478 - RNA, 19 nt, Bordetella pertussis
caccgcgucauacacggcg

SEQ ID NO: 300479 - RNA, 14 nt, Bordetella pertussis
caccgcgucggccu

SEQ ID NO: 300480 - RNA, 21 nt, Bordetella pertussis
caccgcugcgggaggugccgc

SEQ ID NO: 300481 - RNA, 22 nt, Bordetella pertussis
caccgcugcgggaggugccgca

SEQ ID NO: 300482 - RNA, 17 nt, Bordetella pertussis
caccggcacgccggcgg

SEQ ID NO: 300483 - RNA, 12 nt, Bordetella pertussis
caccggcacgcg

SEQ ID NO: 300484 - RNA, 19 nt, Bordetella pertussis
caccggcacgcgccagcug

SEQ ID NO: 300485 - RNA, 15 nt, Bordetella pertussis
caccggcacgacggc

SEQ ID NO: 300486 - RNA, 19 nt, Bordetella pertussis
caccggcacgacggccucc

SEQ ID NO: 300487 - RNA, 14 nt, Bordetella pertussis
caccggcaggccgc

SEQ ID NO: 300488 - RNA, 16 nt, Bordetella pertussis
caccggcaggccgcgc

SEQ ID NO: 300489 - RNA, 17 nt, Bordetella pertussis
caccggcaugccgucca

SEQ ID NO: 300490 - RNA, 13 nt, Bordetella pertussis
caccggccgccgc

SEQ ID NO: 300491 - RNA, 13 nt, Bordetella pertussis
caccggccggccg

SEQ ID NO: 300492 - RNA, 16 nt, Bordetella pertussis
caccggccggccgggc

SEQ ID NO: 300493 - RNA, 15 nt, Bordetella pertussis
caccggcgagccgau

SEQ ID NO: 300494 - RNA, 21 nt, Bordetella pertussis
caccggcgccacggcuugcgc

SEQ ID NO: 300495 - RNA, 14 nt, Bordetella pertussis
caccgggccgaaca

SEQ ID NO: 300496 - RNA, 16 nt, Bordetella pertussis
caccgggcggcccggc

SEQ ID NO: 300497 - RNA, 14 nt, Bordetella pertussis
caccggggcagggc

SEQ ID NO: 300498 - RNA, 21 nt, Bordetella pertussis
caccggggcagggcgggcggg

SEQ ID NO: 300499 - RNA, 14 nt, Bordetella pertussis
caccgucacgcgca

SEQ ID NO: 300500 - RNA, 18 nt, Bordetella pertussis
caccgucacgcgcuccag

SEQ ID NO: 300501 - RNA, 23 nt, Bordetella pertussis
caccguccagcauuucucgggcg

SEQ ID NO: 300502 - RNA, 22 nt, Bordetella pertussis
caccgucgacuucgacccggac

SEQ ID NO: 300503 - RNA, 23 nt, Bordetella pertussis
caccgucgacuucgacccggaca

SEQ ID NO: 300504 - RNA, 19 nt, Bordetella pertussis
caccgucuggcguacgcug

SEQ ID NO: 300505 - RNA, 21 nt, Bordetella pertussis
caccgucuugcccgccagcgc

SEQ ID NO: 300506 - RNA, 21 nt, Bordetella pertussis
caccgugaaggugccggacgc

SEQ ID NO: 300507 - RNA, 18 nt, Bordetella pertussis
caccgugauauagaccag

SEQ ID NO: 300508 - RNA, 20 nt, Bordetella pertussis
caccgugauauagaccagca

SEQ ID NO: 300509 - RNA, 23 nt, Bordetella pertussis
caccgugauauagaccagcagcu

SEQ ID NO: 300510 - RNA, 15 nt, Bordetella pertussis
caccgugaugcgcgc

SEQ ID NO: 300511 - RNA, 18 nt, Bordetella pertussis
caccgugaugcgcgccgc

SEQ ID NO: 300512 - RNA, 18 nt, Bordetella pertussis
caccguucccggugccag

SEQ ID NO: 300513 - RNA, 14 nt, Bordetella pertussis
caccguucuuccgc

SEQ ID NO: 300514 - RNA, 22 nt, Bordetella pertussis
caccguucuuccgcacgccgac

SEQ ID NO: 300515 - RNA, 20 nt, Bordetella pertussis
caccguuuccaagcgcacgc

SEQ ID NO: 300516 - RNA, 21 nt, Bordetella pertussis
caccguuuccaagcgcacgcg

SEQ ID NO: 300517 - RNA, 17 nt, Bordetella pertussis
caccuaccucagcaugg

SEQ ID NO: 300518 - RNA, 14 nt, Bordetella pertussis
caccuccaccgcca

SEQ ID NO: 300519 - RNA, 16 nt, Bordetella pertussis
caccuccaccgccagc

SEQ ID NO: 300520 - RNA, 14 nt, Bordetella pertussis
caccuccaccucga

SEQ ID NO: 300521 - RNA, 16 nt, Bordetella pertussis
cacgcgccgcccgggc

SEQ ID NO: 300522 - RNA, 20 nt, Bordetella pertussis
cacgcgccgcccgggccggc

SEQ ID NO: 300523 - RNA, 18 nt, Bordetella pertussis
cacgcgcgauccgcgcca

SEQ ID NO: 300524 - RNA, 20 nt, Bordetella pertussis
cacgcgcgauccgcgccagg

SEQ ID NO: 300525 - RNA, 19 nt, Bordetella pertussis
cacgcgcgcaaugcgcggc

SEQ ID NO: 300526 - RNA, 22 nt, Bordetella pertussis
cacgcgccgugcagacggcggc

SEQ ID NO: 300527 - RNA, 12 nt, Bordetella pertussis
cacgcgcgccgg

SEQ ID NO: 300528 - RNA, 14 nt, Bordetella pertussis
cacgcgcgccggca

SEQ ID NO: 300529 - RNA, 17 nt, Bordetella pertussis
cacgcgcgccggcaggg

SEQ ID NO: 300530 - RNA, 16 nt, Bordetella pertussis
cacgcgcgcggcgcgg

SEQ ID NO: 300531 - RNA, 17 nt, Bordetella pertussis
cacgcgcgcgggcgcgc

SEQ ID NO: 300532 - RNA, 18 nt, Bordetella pertussis
cacgcgcgcgggcgcgcc

SEQ ID NO: 300533 - RNA, 14 nt, Bordetella pertussis
cacgcgcggaucgg

SEQ ID NO: 300534 - RNA, 23 nt, Bordetella pertussis
cacgcgcuccaugaucucgggcg

SEQ ID NO: 300535 - RNA, 21 nt, Bordetella pertussis
cacgcgcuccggcugcgcgcg

SEQ ID NO: 300536 - RNA, 19 nt, Bordetella pertussis
cacgcgcuccugcucggcg

SEQ ID NO: 300537 - RNA, 17 nt, Bordetella pertussis
cacgcgcuugcgcgcca

SEQ ID NO: 300538 - RNA, 14 nt, Bordetella pertussis
cacgcggccgcgca

SEQ ID NO: 300539 - RNA, 16 nt, Bordetella pertussis
cacgcggccgcgcagg

SEQ ID NO: 300540 - RNA, 18 nt, Bordetella pertussis
cacgcggccgcgggccgc

SEQ ID NO: 300541 - RNA, 14 nt, Bordetella pertussis
cacgcggccgggca

SEQ ID NO: 300542 - RNA, 17 nt, Bordetella pertussis
cacgcggccguggcggc

SEQ ID NO: 300543 - RNA, 14 nt, Bordetella pertussis
cacgcggcgcggca

SEQ ID NO: 300544 - RNA, 17 nt, Bordetella pertussis
cacgcggcuucgcccgg

SEQ ID NO: 300545 - RNA, 12 nt, Bordetella pertussis
cacgcgggccgg

SEQ ID NO: 300546 - RNA, 15 nt, Bordetella pertussis
cacgcgggccggccg

SEQ ID NO: 300547 - RNA, 12 nt, Bordetella pertussis
cacgcgggcgcu

SEQ ID NO: 300548 - RNA, 20 nt, Bordetella pertussis
cacgcggguggugcugcuca

SEQ ID NO: 300549 - RNA, 16 nt, Bordetella pertussis
cacgcgguccacgccg

SEQ ID NO: 300550 - RNA, 14 nt, Bordetella pertussis
cacgcgguccagcc

SEQ ID NO: 300551 - RNA, 17 nt, Bordetella pertussis
cacgcgguccagccccu

SEQ ID NO: 300552 - RNA, 16 nt, Bordetella pertussis
cacgcggucgaugcgc

SEQ ID NO: 300553 - RNA, 17 nt, Bordetella pertussis
cacgcggugcaucucgg

SEQ ID NO: 300554 - RNA, 18 nt, Bordetella pertussis
cacgcgugaauaccgcgc

SEQ ID NO: 300555 - RNA, 19 nt, Bordetella pertussis
cacgcgugaauaccgcgca

SEQ ID NO: 300556 - RNA, 20 nt, Bordetella pertussis
cacgcgugaauaccgcgcac

SEQ ID NO: 300557 - RNA, 21 nt, Bordetella pertussis
cacgcgugaauaccgcgcaca

SEQ ID NO: 300558 - RNA, 23 nt, Bordetella pertussis
cacgcgugaauaccgcgcacagg

SEQ ID NO: 300559 - RNA, 17 nt, Bordetella pertussis
cacgcguucgggcggca

SEQ ID NO: 300560 - RNA, 14 nt, Bordetella pertussis
cacgcucacgcccg

SEQ ID NO: 300561 - RNA, 14 nt, Bordetella pertussis
cacgcucagcaugc

SEQ ID NO: 300562 - RNA, 16 nt, Bordetella pertussis
cacgcucagcaugcgc

SEQ ID NO: 300563 - RNA, 18 nt, Bordetella pertussis
cacgcucauguugggggc

SEQ ID NO: 300564 - RNA, 20 nt, Bordetella pertussis
cacgcucuacacggccgcca

SEQ ID NO: 300565 - RNA, 21 nt, Bordetella pertussis
cacgcucugcaccuugggcgc

SEQ ID NO: 300566 - RNA, 19 nt, Bordetella pertussis
cacgcucuggagccaccag

SEQ ID NO: 300567 - RNA, 16 nt, Bordetella pertussis
cacgcugaagcgccgc

SEQ ID NO: 300568 - RNA, 23 nt, Bordetella pertussis
cacgcugaagcgccgccacaggc

SEQ ID NO: 300569 - RNA, 13 nt, Bordetella pertussis
cacgcugaucgcc

SEQ ID NO: 300570 - RNA, 18 nt, Bordetella pertussis
cacgcugaucgccggcgc

SEQ ID NO: 300571 - RNA, 15 nt, Bordetella pertussis
cacgcugcgcaggcg

SEQ ID NO: 300572 - RNA, 18 nt, Bordetella pertussis
cacgcugcgcaggcgcgc

SEQ ID NO: 300573 - RNA, 19 nt, Bordetella pertussis
cacgcugcgcaggcgcgcg

SEQ ID NO: 300574 - RNA, 17 nt, Bordetella pertussis
cacgcuggacgacgugc

SEQ ID NO: 300575 - RNA, 15 nt, Bordetella pertussis
cacgcuggcaucguc

SEQ ID NO: 300576 - RNA, 14 nt, Bordetella pertussis
cacgcuggccgcgc

SEQ ID NO: 300577 - RNA, 21 nt, Bordetella pertussis
cacgcuggccgcgcuggcggc

SEQ ID NO: 300578 - RNA, 14 nt, Bordetella pertussis
cacgcuggcgcccg

SEQ ID NO: 300579 - RNA, 15 nt, Bordetella pertussis
cacgcuggcgcccgc

SEQ ID NO: 300580 - RNA, 21 nt, Bordetella pertussis
cacgcuggcgcccgccugcgc

SEQ ID NO: 300581 - RNA, 23 nt, Bordetella pertussis
cacgcuggcgcccgccugcgcca

SEQ ID NO: 300582 - RNA, 17 nt, Bordetella pertussis
cacgcuggcggacacgc

SEQ ID NO: 300583 - RNA, 23 nt, Bordetella pertussis
cacgcuggcggacacgcccuggc

SEQ ID NO: 300584 - RNA, 19 nt, Bordetella pertussis
cacgcuggcuucgucgccg

SEQ ID NO: 300585 - RNA, 23 nt, Bordetella pertussis
cacgcuggcuucgucgccggcgu

SEQ ID NO: 300586 - RNA, 20 nt, Bordetella pertussis
cacgcugggccagaccgcgc

SEQ ID NO: 300587 - RNA, 23 nt, Bordetella pertussis
cacgcugggccagaccgcgcgca

SEQ ID NO: 300588 - RNA, 21 nt, Bordetella pertussis
cacgcugggcuacgacccgcu

SEQ ID NO: 300589 - RNA, 16 nt, Bordetella pertussis
cacgcugguggccacc

SEQ ID NO: 300590 - RNA, 20 nt, Bordetella pertussis
cacgcuguuuucggccgacu

SEQ ID NO: 300591 - RNA, 22 nt, Bordetella pertussis
cacgcuuugcgucuccacgccg

SEQ ID NO: 300592 - RNA, 20 nt, Bordetella pertussis
cacggaaauccuagucaugc

SEQ ID NO: 300593 - RNA, 18 nt, Bordetella pertussis
cacggaauguugauccgg

SEQ ID NO: 300594 - RNA, 14 nt, Bordetella pertussis
cacggacagcccgc

SEQ ID NO: 300595 - RNA, 16 nt, Bordetella pertussis
cacggacagcccgcgc

SEQ ID NO: 300596 - RNA, 15 nt, Bordetella pertussis
cacggaucagccgcu

SEQ ID NO: 300597 - RNA, 22 nt, Bordetella pertussis
cacggcaaaagccggggugcca

SEQ ID NO: 300598 - RNA, 16 nt, Bordetella pertussis
cacggcaagacggcgc

SEQ ID NO: 300599 - RNA, 21 nt, Bordetella pertussis
cacggcaaugucgcaggccgc

SEQ ID NO: 300600 - RNA, 12 nt, Bordetella pertussis
cacggcaucgcc

SEQ ID NO: 300601 - RNA, 16 nt, Bordetella pertussis
cacggcaucggccagc

SEQ ID NO: 300602 - RNA, 15 nt, Bordetella pertussis
cacggcauggccagc

SEQ ID NO: 300603 - RNA, 16 nt, Bordetella pertussis
cacggcauggccagcu

SEQ ID NO: 300604 - RNA, 22 nt, Bordetella pertussis
cacggcaugucccgaggcgccc

SEQ ID NO: 300605 - RNA, 23 nt, Bordetella pertussis
cacggccaacccucgcacggccg

SEQ ID NO: 300606 - RNA, 14 nt, Bordetella pertussis
cacggccacggccg

SEQ ID NO: 300607 - RNA, 17 nt, Bordetella pertussis
cacggccacggccggca

SEQ ID NO: 300608 - RNA, 14 nt, Bordetella pertussis
cacggccagcacgu

SEQ ID NO: 300609 - RNA, 12 nt, Bordetella pertussis
cacggccagcau

SEQ ID NO: 300610 - RNA, 14 nt, Bordetella pertussis
cacggccauccguc

SEQ ID NO: 300611 - RNA, 14 nt, Bordetella pertussis
cacggcccgccagg

SEQ ID NO: 300612 - RNA, 18 nt, Bordetella pertussis
cacggccggcagcgccuu

SEQ ID NO: 300613 - RNA, 16 nt, Bordetella pertussis
cacggccggccaggcg

SEQ ID NO: 300614 - RNA, 12 nt, Bordetella pertussis
cacggccggcgc

SEQ ID NO: 300615 - RNA, 13 nt, Bordetella pertussis
cacggccggcgca

SEQ ID NO: 300616 - RNA, 16 nt, Bordetella pertussis
cacggccggccugcag

SEQ ID NO: 300617 - RNA, 20 nt, Bordetella pertussis
cacggccgucaacagcaugg

SEQ ID NO: 300618 - RNA, 14 nt, Bordetella pertussis
cacggccugcccgg

SEQ ID NO: 300619 - RNA, 17 nt, Bordetella pertussis
cacggccugcgcgccga

SEQ ID NO: 300620 - RNA, 22 nt, Bordetella pertussis
cacggccugcgcgccgaccagg

SEQ ID NO: 300621 - RNA, 20 nt, Bordetella pertussis
cacggcgaugaacagcggca

SEQ ID NO: 300622 - RNA, 13 nt, Bordetella pertussis
cacggcgaugcug

SEQ ID NO: 300623 - RNA, 16 nt, Bordetella pertussis
cacggcgauggccgac

SEQ ID NO: 300624 - RNA, 13 nt, Bordetella pertussis
cacggcgccaugc

SEQ ID NO: 300625 - RNA, 12 nt, Bordetella pertussis
cacggcgcccga

SEQ ID NO: 300626 - RNA, 20 nt, Bordetella pertussis
cacggcgccaaagcacagga

SEQ ID NO: 300627 - RNA, 14 nt, Bordetella pertussis
cacggcgcgcgccu

SEQ ID NO: 300628 - RNA, 23 nt, Bordetella pertussis
cacggcgcggcugcccucgguca

SEQ ID NO: 300629 - RNA, 19 nt, Bordetella pertussis
cacggcgcgggcggucggc

SEQ ID NO: 300630 - RNA, 21 nt, Bordetella pertussis
cacggcgcgggcggucggcgc

SEQ ID NO: 300631 - RNA, 22 nt, Bordetella pertussis
cacggcgcgggcggucggcgcg

SEQ ID NO: 300632 - RNA, 19 nt, Bordetella pertussis
cacggcggaaugcggcgac

SEQ ID NO: 300633 - RNA, 22 nt, Bordetella pertussis
cacggcggcaaagucggggcgc

SEQ ID NO: 300634 - RNA, 13 nt, Bordetella pertussis
cacggcggccagg

SEQ ID NO: 300635 - RNA, 14 nt, Bordetella pertussis
cacggcggcgauca

SEQ ID NO: 300636 - RNA, 23 nt, Bordetella pertussis
cacggcggcgaucacgccgucga

SEQ ID NO: 300637 - RNA, 16 nt, Bordetella pertussis
cacggcgggaucgggc

SEQ ID NO: 300638 - RNA, 23 nt, Bordetella pertussis
cacggcgggaucgggcagcuugg

SEQ ID NO: 300639 - RNA, 21 nt, Bordetella pertussis
cacggcggugaccaccaggcc

SEQ ID NO: 300640 - RNA, 21 nt, Bordetella pertussis
cacggcggugaucugcucgcc

SEQ ID NO: 300641 - RNA, 16 nt, Bordetella pertussis
cacggcggugccgcgc

SEQ ID NO: 300642 - RNA, 23 nt, Bordetella pertussis
cacggcggugcugaacgccucgg

SEQ ID NO: 300643 - RNA, 12 nt, Bordetella pertussis
cacggcggcggc

SEQ ID NO: 300644 - RNA, 17 nt, Bordetella pertussis
cacggcggcuucggccg

SEQ ID NO: 300645 - RNA, 16 nt, Bordetella pertussis
cacggcgucgccggcc

SEQ ID NO: 300646 - RNA, 16 nt, Bordetella pertussis
cacggcgucgaugcgc

SEQ ID NO: 300647 - RNA, 20 nt, Bordetella pertussis
cacggcgucgaugcgcgcgc

SEQ ID NO: 300648 - RNA, 17 nt, Bordetella pertussis
cacggcguggcgcgcac

SEQ ID NO: 300649 - RNA, 21 nt, Bordetella pertussis
cacggcguggcgcgcacacug

SEQ ID NO: 300650 - RNA, 16 nt, Bordetella pertussis
cacggcguggcgcgcc

SEQ ID NO: 300651 - RNA, 21 nt, Bordetella pertussis
cacggcuggaaagaccugcgc

SEQ ID NO: 300652 - RNA, 19 nt, Bordetella pertussis
cacgggaaugaagcgcgac

SEQ ID NO: 300653 - RNA, 12 nt, Bordetella pertussis
cacgggaccgcu

SEQ ID NO: 300654 - RNA, 20 nt, Bordetella pertussis
cacgggcacgauggccgcgc

SEQ ID NO: 300655 - RNA, 14 nt, Bordetella pertussis
cacgggccauggau

SEQ ID NO: 300656 - RNA, 14 nt, Bordetella pertussis
cacgggcgaagcgg

SEQ ID NO: 300657 - RNA, 19 nt, Bordetella pertussis
cacgggcgaggcggggcug

SEQ ID NO: 300658 - RNA, 23 nt, Bordetella pertussis
cacgggcgaggcggggcuggcgc

SEQ ID NO: 300659 - RNA, 12 nt, Bordetella pertussis
cacgggcgccag

SEQ ID NO: 300660 - RNA, 14 nt, Bordetella pertussis
cacgggcgccagca

SEQ ID NO: 300661 - RNA, 18 nt, Bordetella pertussis
cacgggcgccagcagcgg

SEQ ID NO: 300662 - RNA, 13 nt, Bordetella pertussis
cacgggcgccugg

SEQ ID NO: 300663 - RNA, 18 nt, Bordetella pertussis
cacggggacuggcaccgg

SEQ ID NO: 300664 - RNA, 21 nt, Bordetella pertussis
cacggggacuggcacgcgcug

SEQ ID NO: 300665 - RNA, 18 nt, Bordetella pertussis
cacggggcaaccggccuu

SEQ ID NO: 300666 - RNA, 22 nt, Bordetella pertussis
cacgggcuguucgcgcagcagg

SEQ ID NO: 300667 - RNA, 17 nt, Bordetella pertussis
cacggggacaggcacgc

SEQ ID NO: 300668 - RNA, 15 nt, Bordetella pertussis
cacgguacgccgaac

SEQ ID NO: 300669 - RNA, 14 nt, Bordetella pertussis
cacggucggcacgu

SEQ ID NO: 300670 - RNA, 20 nt, Bordetella pertussis
cacggucuggcccacgcgca

SEQ ID NO: 300671 - RNA, 16 nt, Bordetella pertussis
cacggucuggcgcgac

SEQ ID NO: 300672 - RNA, 15 nt, Bordetella pertussis
cacggucgcgagcug

SEQ ID NO: 300673 - RNA, 21 nt, Bordetella pertussis
cacggucgcgagcugcgcgac

SEQ ID NO: 300674 - RNA, 13 nt, Bordetella pertussis
cacggugccgcgc

SEQ ID NO: 300675 - RNA, 22 nt, Bordetella pertussis
cacgguggauucggacgccucg

SEQ ID NO: 300676 - RNA, 16 nt, Bordetella pertussis
cacgguggcgcccggc

SEQ ID NO: 300677 - RNA, 23 nt, Bordetella pertussis
cacgguggcguaguagcccaggc

SEQ ID NO: 300678 - RNA, 20 nt, Bordetella pertussis
cacggugggcagcagcacgc

SEQ ID NO: 300679 - RNA, 23 nt, Bordetella pertussis
cacggugggcagcagcacgccca

SEQ ID NO: 300680 - RNA, 19 nt, Bordetella pertussis
cacggugggcgacgcggcg

SEQ ID NO: 300681 - RNA, 23 nt, Bordetella pertussis
cacggugucgaugggcccgggca

SEQ ID NO: 300682 - RNA, 17 nt, Bordetella pertussis
cacgguguugaccacca

SEQ ID NO: 300683 - RNA, 19 nt, Bordetella pertussis
cacgguugccacggugaag

SEQ ID NO: 300684 - RNA, 18 nt, Bordetella pertussis
cacgguuucgccgugcug

SEQ ID NO: 300685 - RNA, 16 nt, Bordetella pertussis
cacguagccggccagg

SEQ ID NO: 300686 - RNA, 14 nt, Bordetella pertussis
cacguagcgcagca

SEQ ID NO: 300687 - RNA, 20 nt, Bordetella pertussis
cacguaggccauugaaagcg

SEQ ID NO: 300688 - RNA, 18 nt, Bordetella pertussis
cacguagguggucagcau

SEQ ID NO: 300689 - RNA, 18 nt, Bordetella pertussis
cacgucauaggcuucgcc

SEQ ID NO: 300690 - RNA, 16 nt, Bordetella pertussis
cacgucaucguggccg

SEQ ID NO: 300691 - RNA, 15 nt, Bordetella pertussis
cacguccaaugccag

SEQ ID NO: 300692 - RNA, 23 nt, Bordetella pertussis
cacguccagagucugccuggcga

SEQ ID NO: 300693 - RNA, 17 nt, Bordetella pertussis
cacgucccagucgccgc

SEQ ID NO: 300694 - RNA, 22 nt, Bordetella pertussis
cacguccgagaggaucaccgca

SEQ ID NO: 300695 - RNA, 13 nt, Bordetella pertussis
cacguccggaucu

SEQ ID NO: 300696 - RNA, 20 nt, Bordetella pertussis
cacgucgaucaggcccagca

SEQ ID NO: 300697 - RNA, 21 nt, Bordetella pertussis
cacgucgcgcaauacgccgcc

SEQ ID NO: 300698 - RNA, 14 nt, Bordetella pertussis
cacgucggcggccg

SEQ ID NO: 300699 - RNA, 16 nt, Bordetella pertussis
cacgucggcggccgcc

SEQ ID NO: 300700 - RNA, 12 nt, Bordetella pertussis
cacgucggucga

SEQ ID NO: 300701 - RNA, 22 nt, Bordetella pertussis
cacgucggucgcuuccagcgca

SEQ ID NO: 300702 - RNA, 22 nt, Bordetella pertussis
cacgucggugggaaucggcacc

SEQ ID NO: 300703 - RNA, 15 nt, Bordetella pertussis
cacgugaagcgccgc

SEQ ID NO: 300704 - RNA, 17 nt, Bordetella pertussis
cacgugaagcgccgcgc

SEQ ID NO: 300705 - RNA, 20 nt, Bordetella pertussis
cacgugccggauggcgcgga

SEQ ID NO: 300706 - RNA, 16 nt, Bordetella pertussis
cacgugcugcuggaga

SEQ ID NO: 300707 - RNA, 16 nt, Bordetella pertussis
cacguguggcaggcca

SEQ ID NO: 300708 - RNA, 20 nt, Bordetella pertussis
cacguguggcaggccagcgc

SEQ ID NO: 300709 - RNA, 15 nt, Bordetella pertussis
cacguucagcgccgg

SEQ ID NO: 300710 - RNA, 20 nt, Bordetella pertussis
cacguucagcgccggcauga

SEQ ID NO: 300711 - RNA, 16 nt, Bordetella pertussis
cacguugaagcgcagc

SEQ ID NO: 300712 - RNA, 15 nt, Bordetella pertussis
cacucgaccgccggg

SEQ ID NO: 300713 - RNA, 17 nt, Bordetella pertussis
cacucgaccgccgggac

SEQ ID NO: 300714 - RNA, 16 nt, Bordetella pertussis
cacucgaugggcgcgc

SEQ ID NO: 300715 - RNA, 14 nt, Bordetella pertussis
cacucggccagcgc

SEQ ID NO: 300716 - RNA, 22 nt, Bordetella pertussis
cacucggugcgcgcgcccaccg

SEQ ID NO: 300717 - RNA, 16 nt, Bordetella pertussis
cacugagaaaggccgc

SEQ ID NO: 300718 - RNA, 14 nt, Bordetella pertussis
cacugcccgcgccg

SEQ ID NO: 300719 - RNA, 17 nt, Bordetella pertussis
cacuggccagcaagcgc

SEQ ID NO: 300720 - RNA, 14 nt, Bordetella pertussis
cacuggcccuggca

SEQ ID NO: 300721 - RNA, 21 nt, Bordetella pertussis
cacuggccgcgcucaggccgc

SEQ ID NO: 300722 - RNA, 18 nt, Bordetella pertussis
cacuggccuugugcgccg

SEQ ID NO: 300723 - RNA, 16 nt, Bordetella pertussis
cacuggguggccagcg

SEQ ID NO: 300724 - RNA, 18 nt, Bordetella pertussis
cacuggguggccagcgcc

SEQ ID NO: 300725 - RNA, 20 nt, Bordetella pertussis
cacuggguggccagcgccgc

SEQ ID NO: 300726 - RNA, 16 nt, Bordetella pertussis
cacugggugacgcugg

SEQ ID NO: 300727 - RNA, 16 nt, Bordetella pertussis
cacugucgccacgggc

SEQ ID NO: 300728 - RNA, 23 nt, Bordetella pertussis
cacugucggcguuccuggcgcug

SEQ ID NO: 300729 - RNA, 22 nt, Bordetella pertussis
cagaaaccccaggggacggcgc

SEQ ID NO: 300730 - RNA, 19 nt, Bordetella pertussis
cagaaaccgccacagcgcc

SEQ ID NO: 300731 - RNA, 18 nt, Bordetella pertussis
cagaagcagccgcgcggc

SEQ ID NO: 300732 - RNA, 16 nt, Bordetella pertussis
cagaccaagcgccaca

SEQ ID NO: 300733 - RNA, 16 nt, Bordetella pertussis
cagacccgcgcccagc

SEQ ID NO: 300734 - RNA, 23 nt, Bordetella pertussis
cagacccgggccgcuggcccggg

SEQ ID NO: 300735 - RNA, 21 nt, Bordetella pertussis
cagaccgagcgcgcccgcuug

SEQ ID NO: 300736 - RNA, 16 nt, Bordetella pertussis
cagaccgcgcgcacca

SEQ ID NO: 300737 - RNA, 19 nt, Bordetella pertussis
cagaccguagcgcaggcgc

SEQ ID NO: 300738 - RNA, 17 nt, Bordetella pertussis
cagaccuaccaggccga

SEQ ID NO: 300739 - RNA, 18 nt, Bordetella pertussis
cagaccuaccaggccgac

SEQ ID NO: 300740 - RNA, 17 nt, Bordetella pertussis
cagaccugcgcgccggc

SEQ ID NO: 300741 - RNA, 18 nt, Bordetella pertussis
cagaccugcgcgccggca

SEQ ID NO: 300742 - RNA, 19 nt, Bordetella pertussis
cagacgaucauccaggccg

SEQ ID NO: 300743 - RNA, 20 nt, Bordetella pertussis
cagacgaucauccaggccgu

SEQ ID NO: 300744 - RNA, 22 nt, Bordetella pertussis
cagacgaucauccaggccguga

SEQ ID NO: 300745 - RNA, 22 nt, Bordetella pertussis
cagacgccaucuugcaggcgcc

SEQ ID NO: 300746 - RNA, 19 nt, Bordetella pertussis
cagacgcgagaccaugacg

SEQ ID NO: 300747 - RNA, 18 nt, Bordetella pertussis
cagacgcgcucaggcggu

SEQ ID NO: 300748 - RNA, 24 nt, Bordetella pertussis
cagacgcgcucaggcggugacgcc

SEQ ID NO: 300749 - RNA, 16 nt, Bordetella pertussis
cagacgcuucaggccg

SEQ ID NO: 300750 - RNA, 19 nt, Bordetella pertussis
cagacgggcuggaagacgc

SEQ ID NO: 300751 - RNA, 18 nt, Bordetella pertussis
aaagaaauugggcguggc

SEQ ID NO: 300752 - RNA, 16 nt, Bordetella pertussis
cagauagcccaggcgg

SEQ ID NO: 300753 - RNA, 15 nt, Bordetella pertussis
cagcaacccgcccgg

SEQ ID NO: 300754 - RNA, 16 nt, Bordetella pertussis
cagcaacccgcccggg

SEQ ID NO: 300755 - RNA, 12 nt, Bordetella pertussis
cagcaacgcggc

SEQ ID NO: 300756 - RNA, 23 nt, Bordetella pertussis
cagcaacgcggcguaccggucca

SEQ ID NO: 300757 - RNA, 13 nt, Bordetella pertussis
cagcacacgguca

SEQ ID NO: 300758 - RNA, 22 nt, Bordetella pertussis
cagcacacgcauuugcagcggc

SEQ ID NO: 300759 - RNA, 19 nt, Bordetella pertussis
cagcacauacgccgccgag

SEQ ID NO: 300760 - RNA, 18 nt, Bordetella pertussis
cagcacauggcgcgccgg

SEQ ID NO: 300761 - RNA, 21 nt, Bordetella pertussis
cagcacauggcgcgccggccg

SEQ ID NO: 300762 - RNA, 22 nt, Bordetella pertussis
cagcacauggcgcgccggccgg

SEQ ID NO: 300763 - RNA, 17 nt, Bordetella pertussis
cagcacaucgacgucgg

SEQ ID NO: 300764 - RNA, 16 nt, Bordetella pertussis
cagcaccacaucgccg

SEQ ID NO: 300765 - RNA, 17 nt, Bordetella pertussis
cagcaccacaucgccgg

SEQ ID NO: 300766 - RNA, 18 nt, Bordetella pertussis
cagcaccacaucgccggc

SEQ ID NO: 300767 - RNA, 16 nt, Bordetella pertussis
cagcaccacggcaucg

SEQ ID NO: 300768 - RNA, 15 nt, Bordetella pertussis
cagcaccacggcggc

SEQ ID NO: 300769 - RNA, 17 nt, Bordetella pertussis
cagcaccacggcggcca

SEQ ID NO: 300770 - RNA, 20 nt, Bordetella pertussis
cagcaccacggcggccaggc

SEQ ID NO: 300771 - RNA, 21 nt, Bordetella pertussis
cagcaccacgggcucgcugac

SEQ ID NO: 300772 - RNA, 23 nt, Bordetella pertussis
cagcaccacgggcucgcugaccg

SEQ ID NO: 300773 - RNA, 13 nt, Bordetella pertussis
cagcaccagcaug

SEQ ID NO: 300774 - RNA, 16 nt, Bordetella pertussis
cagcaccagcaugcgc

SEQ ID NO: 300775 - RNA, 14 nt, Bordetella pertussis
cagcaccagcaugu

SEQ ID NO: 300776 - RNA, 14 nt, Bordetella pertussis
cagcaccagcgccu

SEQ ID NO: 300777 - RNA, 18 nt, Bordetella pertussis
cagcaccagcgccugccg

SEQ ID NO: 300778 - RNA, 13 nt, Bordetella pertussis
cagcaccaggccg

SEQ ID NO: 300779 - RNA, 14 nt, Bordetella pertussis
cagcaccaggccgc

SEQ ID NO: 300780 - RNA, 16 nt, Bordetella pertussis
cagcaccaggccgccg

SEQ ID NO: 300781 - RNA, 17 nt, Bordetella pertussis
cagcaccaggccgccgg

SEQ ID NO: 300782 - RNA, 16 nt, Bordetella pertussis
cagcaccagggcgcgc

SEQ ID NO: 300783 - RNA, 17 nt, Bordetella pertussis
cagcaccagggcgcgca

SEQ ID NO: 300784 - RNA, 14 nt, Bordetella pertussis
cagcaccaggucga

SEQ ID NO: 300785 - RNA, 18 nt, Bordetella pertussis
cagcaccaugccgaugcc

SEQ ID NO: 300786 - RNA, 20 nt, Bordetella pertussis
cagcaccggcugccagggcc

SEQ ID NO: 300787 - RNA, 21 nt, Bordetella pertussis
cagcaccggcugccagggccg

SEQ ID NO: 300788 - RNA, 21 nt, Bordetella pertussis
cagcaccgggaaguccgccgc

SEQ ID NO: 300789 - RNA, 21 nt, Bordetella pertussis
cagcaccggggcagggcgggc

SEQ ID NO: 300790 - RNA, 16 nt, Bordetella pertussis
cagcaccgugccggcg

SEQ ID NO: 300791 - RNA, 15 nt, Bordetella pertussis
cagcaccucgacgca

SEQ ID NO: 300792 - RNA, 16 nt, Bordetella pertussis
cagcaccucgacgcag

SEQ ID NO: 300793 - RNA, 16 nt, Bordetella pertussis
cagcaccucggcgccc

SEQ ID NO: 300794 - RNA, 17 nt, Bordetella pertussis
cagcaccucggcgccca

SEQ ID NO: 300795 - RNA, 18 nt, Bordetella pertussis
cagcaccucggcgcccag

SEQ ID NO: 300796 - RNA, 19 nt, Bordetella pertussis
cagcaccucggcgcccagc

SEQ ID NO: 300797 - RNA, 14 nt, Bordetella pertussis
cagcaccucggggc

SEQ ID NO: 300798 - RNA, 16 nt, Bordetella pertussis
cagcaccucggggcgc

SEQ ID NO: 300799 - RNA, 20 nt, Bordetella pertussis
cagcacgaucuggcgcgcga

SEQ ID NO: 300800 - RNA, 16 nt, Bordetella pertussis
cagcacgauggggcca

SEQ ID NO: 300801 - RNA, 19 nt, Bordetella pertussis
cagcacgauggggccaugg

SEQ ID NO: 300802 - RNA, 13 nt, Bordetella pertussis
cagcacgaugguc

SEQ ID NO: 300803 - RNA, 19 nt, Bordetella pertussis
cagcacgauggucagcggc

SEQ ID NO: 300804 - RNA, 15 nt, Bordetella pertussis
cagcacgcaccaggc

SEQ ID NO: 300805 - RNA, 18 nt, Bordetella pertussis
cagcacgcaccaggcgca

SEQ ID NO: 300806 - RNA, 22 nt, Bordetella pertussis
cagcacgcaccaggcgcacggc

SEQ ID NO: 300807 - RNA, 14 nt, Bordetella pertussis
cagcacgcagaugu

SEQ ID NO: 300808 - RNA, 19 nt, Bordetella pertussis
cagcacgauggcgcccacg

SEQ ID NO: 300809 - RNA, 23 nt, Bordetella pertussis
cagcacgauggcgcccacggccu

SEQ ID NO: 300810 - RNA, 12 nt, Bordetella pertussis
cagcacgcccag

SEQ ID NO: 300811 - RNA, 13 nt, Bordetella pertussis
cagcacgcccaga

SEQ ID NO: 300812 - RNA, 14 nt, Bordetella pertussis
cagcacgcccaugg

SEQ ID NO: 300813 - RNA, 13 nt, Bordetella pertussis
cagcacgcccgcg

SEQ ID NO: 300814 - RNA, 12 nt, Bordetella pertussis
cagcacgccgcg

SEQ ID NO: 300815 - RNA, 19 nt, Bordetella pertussis
cagcacggccacggccggc

SEQ ID NO: 300816 - RNA, 15 nt, Bordetella pertussis
cagcacggccgcggc

SEQ ID NO: 300817 - RNA, 23 nt, Bordetella pertussis
cagcacgggaugcuccagcuugc

SEQ ID NO: 300818 - RNA, 20 nt, Bordetella pertussis
cagcacggucugcaccugcg

SEQ ID NO: 300819 - RNA, 18 nt, Bordetella pertussis
cagcacgguggcgcccgg

SEQ ID NO: 300820 - RNA, 19 nt, Bordetella pertussis
cagcacgguggcgcccggc

SEQ ID NO: 300821 - RNA, 21 nt, Bordetella pertussis
cagcacgguggcgcccggcgg

SEQ ID NO: 300822 - RNA, 18 nt, Bordetella pertussis
cagcacguaaucgaagcc

SEQ ID NO: 300823 - RNA, 22 nt, Bordetella pertussis
cagcacgucauccugggcgcgc

SEQ ID NO: 300824 - RNA, 14 nt, Bordetella pertussis
cagcacgucggcgu

SEQ ID NO: 300825 - RNA, 15 nt, Bordetella pertussis
cagcacgucggcguc

SEQ ID NO: 300826 - RNA, 22 nt, Bordetella pertussis
cagcacgucggcgucgggcuug

SEQ ID NO: 300827 - RNA, 22 nt, Bordetella pertussis
cagcacgucguagcgcugcagc

SEQ ID NO: 300828 - RNA, 23 nt, Bordetella pertussis
cagcacgucguagcgcugcagcc

SEQ ID NO: 300829 - RNA, 19 nt, Bordetella pertussis
cagcagauugccgcgcggc

SEQ ID NO: 300830 - RNA, 16 nt, Bordetella pertussis
cagcagaucggcggcc

SEQ ID NO: 300831 - RNA, 21 nt, Bordetella pertussis
cagcagcaauacggguaugcg

SEQ ID NO: 300832 - RNA, 14 nt, Bordetella pertussis
cagcagcaggcccu

SEQ ID NO: 300833 - RNA, 22 nt, Bordetella pertussis
cagcagcaggcccuccggcgcc

SEQ ID NO: 300834 - RNA, 13 nt, Bordetella pertussis
cagcagcaggccg

SEQ ID NO: 300835 - RNA, 14 nt, Bordetella pertussis
cagcagcaggcugg

SEQ ID NO: 300836 - RNA, 13 nt, Bordetella pertussis
cagcagcagggcc

SEQ ID NO: 300837 - RNA, 14 nt, Bordetella pertussis
cagcagcagcgugc

SEQ ID NO: 300838 - RNA, 13 nt, Bordetella pertussis
cagcagcaugccg

SEQ ID NO: 300839 - RNA, 14 nt, Bordetella pertussis
cagcagcaugcggc

SEQ ID NO: 300840 - RNA, 15 nt, Bordetella pertussis
cagcagcaugcggcc

SEQ ID NO: 300841 - RNA, 16 nt, Bordetella pertussis
cagcagcauggcgggc

SEQ ID NO: 300842 - RNA, 19 nt, Bordetella pertussis
cagcagcauuucgaugcgc

SEQ ID NO: 300843 - RNA, 14 nt, Bordetella pertussis
cagcagcccgcugg

SEQ ID NO: 300844 - RNA, 21 nt, Bordetella pertussis
cagcagccccagcguccaggc

SEQ ID NO: 300845 - RNA, 13 nt, Bordetella pertussis
cagcagccgguug

SEQ ID NO: 300846 - RNA, 18 nt, Bordetella pertussis
cagcagccgguuggcgcc

SEQ ID NO: 300847 - RNA, 22 nt, Bordetella pertussis
cagcagccgguuggcgccuucc

SEQ ID NO: 300848 - RNA, 14 nt, Bordetella pertussis
cagcagcgacggcc

SEQ ID NO: 300849 - RNA, 22 nt, Bordetella pertussis
cagcagcgacggccccagcgcc

SEQ ID NO: 300850 - RNA, 20 nt, Bordetella pertussis
cagcagcgagcccgccaucg

SEQ ID NO: 300851 - RNA, 14 nt, Bordetella pertussis
cagcagcgcaucga

SEQ ID NO: 300852 - RNA, 15 nt, Bordetella pertussis
cagcagcgcaucgcg

SEQ ID NO: 300853 - RNA, 18 nt, Bordetella pertussis
cagcagcgcaucgcgcgc

SEQ ID NO: 300854 - RNA, 22 nt, Bordetella pertussis
cagcagcgcaucgcgcgcgccg

SEQ ID NO: 300855 - RNA, 12 nt, Bordetella pertussis
cagcagcgccag

SEQ ID NO: 300856 - RNA, 22 nt, Bordetella pertussis
cagcagcgccagggccaggccg

SEQ ID NO: 300857 - RNA, 16 nt, Bordetella pertussis
cagcagcgccgccagc

SEQ ID NO: 300858 - RNA, 13 nt, Bordetella pertussis
cagcagcgccggc

SEQ ID NO: 300859 - RNA, 15 nt, Bordetella pertussis
cagcaggccggcggc

SEQ ID NO: 300860 - RNA, 18 nt, Bordetella pertussis
cagcaggccguaaccggc

SEQ ID NO: 300861 - RNA, 18 nt, Bordetella pertussis
cagcaggcgaaacgccag

SEQ ID NO: 300862 - RNA, 17 nt, Bordetella pertussis
cagcaggcgcaccagcg

SEQ ID NO: 300863 - RNA, 22 nt, Bordetella pertussis
cagcaggcgcaccagcgcgccg

SEQ ID NO: 300864 - RNA, 20 nt, Bordetella pertussis
cagcaggcgcaucagcuugg

SEQ ID NO: 300865 - RNA, 16 nt, Bordetella pertussis
cagcaggcgcgcggcc

SEQ ID NO: 300866 - RNA, 20 nt, Bordetella pertussis
cagcaggcgcgugaggucgc

SEQ ID NO: 300867 - RNA, 15 nt, Bordetella pertussis
cagcaggcgcgugcu

SEQ ID NO: 300868 - RNA, 17 nt, Bordetella pertussis
cagcaggcgcgugcuca

SEQ ID NO: 300869 - RNA, 14 nt, Bordetella pertussis
cagcaggcgcucgg

SEQ ID NO: 300870 - RNA, 19 nt, Bordetella pertussis
cagcaggcgcucggccagc

SEQ ID NO: 300871 - RNA, 20 nt, Bordetella pertussis
cagcaggcgcuggucgucgc

SEQ ID NO: 300872 - RNA, 21 nt, Bordetella pertussis
cagcaggcgcuggucgucgcg

SEQ ID NO: 300873 - RNA, 16 nt, Bordetella pertussis
cagcaggcggccgacc

SEQ ID NO: 300874 - RNA, 17 nt, Bordetella pertussis
cagcaggcggccgacca

SEQ ID NO: 300875 - RNA, 14 nt, Bordetella pertussis
cagcaggcucagcg

SEQ ID NO: 300876 - RNA, 16 nt, Bordetella pertussis
cagcaggcugccgccg

SEQ ID NO: 300877 - RNA, 18 nt, Bordetella pertussis
cagcaggcugccgccggc

SEQ ID NO: 300878 - RNA, 20 nt, Bordetella pertussis
cagcaggcugccgccggcga

SEQ ID NO: 300879 - RNA, 15 nt, Bordetella pertussis
cagcaggcugggcga

SEQ ID NO: 300880 - RNA, 16 nt, Bordetella pertussis
cagcaggucacgggcg

SEQ ID NO: 300881 - RNA, 13 nt, Bordetella pertussis
cagcaggucgcgc

SEQ ID NO: 300882 - RNA, 14 nt, Bordetella pertussis
cagcaggucgcgca

SEQ ID NO: 300883 - RNA, 17 nt, Bordetella pertussis
cagcaggucgcgcacgc

SEQ ID NO: 300884 - RNA, 17 nt, Bordetella pertussis
cagcaggucggcgcggc

SEQ ID NO: 300885 - RNA, 20 nt, Bordetella pertussis
cagcaggucggucgccugua

SEQ ID NO: 300886 - RNA, 16 nt, Bordetella pertussis
cagcaucaccagcucg

SEQ ID NO: 300887 - RNA, 15 nt, Bordetella pertussis
cagcaucacggugcc

SEQ ID NO: 300888 - RNA, 19 nt, Bordetella pertussis
cagcaucacggugccgccg

SEQ ID NO: 300889 - RNA, 13 nt, Bordetella pertussis
cagcaucagcggc

SEQ ID NO: 300890 - RNA, 14 nt, Bordetella pertussis
cagcaucuugcgcc

SEQ ID NO: 300891 - RNA, 19 nt, Bordetella pertussis
cagcaucuugcgccgcugc

SEQ ID NO: 300892 - RNA, 17 nt, Bordetella pertussis
cagcaucuuggccgcca

SEQ ID NO: 300893 - RNA, 21 nt, Bordetella pertussis
cagcaugaagcgguggcggcc

SEQ ID NO: 300894 - RNA, 18 nt, Bordetella pertussis
cagcaugaagcugcccag

SEQ ID NO: 300895 - RNA, 14 nt, Bordetella pertussis
cagcaugcacgacu

SEQ ID NO: 300896 - RNA, 23 nt, Bordetella pertussis
cagcaugaucuugccgaccgcgu

SEQ ID NO: 300897 - RNA, 22 nt, Bordetella pertussis
cagccacaccagguugucggcg

SEQ ID NO: 300898 - RNA, 23 nt, Bordetella pertussis
cagccacacgaucagcgcccagg

SEQ ID NO: 300899 - RNA, 14 nt, Bordetella pertussis
cagccacacgcuga

SEQ ID NO: 300900 - RNA, 19 nt, Bordetella pertussis
cagccacacgcugaagcgc

SEQ ID NO: 300901 - RNA, 22 nt, Bordetella pertussis
cagccaccacugcaaggcccgc

SEQ ID NO: 300902 - RNA, 19 nt, Bordetella pertussis
cagccacugcggcccgagc

SEQ ID NO: 300903 - RNA, 23 nt, Bordetella pertussis
cagccagaacaugagccaugccg

SEQ ID NO: 300904 - RNA, 14 nt, Bordetella pertussis
cagccagccgccgc

SEQ ID NO: 300905 - RNA, 18 nt, Bordetella pertussis
cagccagccgccgcgcgg

SEQ ID NO: 300906 - RNA, 14 nt, Bordetella pertussis
cagccagccggcgg

SEQ ID NO: 300907 - RNA, 19 nt, Bordetella pertussis
cagccagccggcggccagc

SEQ ID NO: 300908 - RNA, 22 nt, Bordetella pertussis
cagccagccggcggccagcuug

SEQ ID NO: 300909 - RNA, 12 nt, Bordetella pertussis
cagccagccgcu

SEQ ID NO: 300910 - RNA, 11 nt, Bordetella pertussis
cagccagcgau

SEQ ID NO: 300911 - RNA, 19 nt, Bordetella pertussis
cagccagcgccgcagcguc

SEQ ID NO: 300912 - RNA, 13 nt, Bordetella pertussis
cagccagcggccg

SEQ ID NO: 300913 - RNA, 19 nt, Bordetella pertussis
cagccagcggccgauagcc

SEQ ID NO: 300914 - RNA, 14 nt, Bordetella pertussis
cagccagcggugcg

SEQ ID NO: 300915 - RNA, 18 nt, Bordetella pertussis
cagccagcggugcgcggc

SEQ ID NO: 300916 - RNA, 17 nt, Bordetella pertussis
cagccaggccagcgcca

SEQ ID NO: 300917 - RNA, 12 nt, Bordetella pertussis
cagccaggccga

SEQ ID NO: 300918 - RNA, 13 nt, Bordetella pertussis
cagccaggccgau

SEQ ID NO: 300919 - RNA, 12 nt, Bordetella pertussis
cagccaggccgc

SEQ ID NO: 300920 - RNA, 13 nt, Bordetella pertussis
cagccaggcgcca

SEQ ID NO: 300921 - RNA, 18 nt, Bordetella pertussis
cagccaggcgccagcggc

SEQ ID NO: 300922 - RNA, 13 nt, Bordetella pertussis
cagccaggcgcgc

SEQ ID NO: 300923 - RNA, 16 nt, Bordetella pertussis
cagccaggcgguggcc

SEQ ID NO: 300924 - RNA, 13 nt, Bordetella pertussis
cagccagggcagg

SEQ ID NO: 300925 - RNA, 15 nt, Bordetella pertussis
cagccagggcagggc

SEQ ID NO: 300926 - RNA, 19 nt, Bordetella pertussis
cagccagguaagcuggcgc

SEQ ID NO: 300927 - RNA, 22 nt, Bordetella pertussis
cagccagguggcgaugccgggc

SEQ ID NO: 300928 - RNA, 18 nt, Bordetella pertussis
cagccaguugggccaggg

SEQ ID NO: 300929 - RNA, 14 nt, Bordetella pertussis
cagccaucaucauc

SEQ ID NO: 300930 - RNA, 19 nt, Bordetella pertussis
cagccaucaucaucgucgg

SEQ ID NO: 300931 - RNA, 15 nt, Bordetella pertussis
cagccauccucgccc

SEQ ID NO: 300932 - RNA, 19 nt, Bordetella pertussis
cagccauccucgcccagcg

SEQ ID NO: 300933 - RNA, 16 nt, Bordetella pertussis
cagccauggaagcggc

SEQ ID NO: 300934 - RNA, 13 nt, Bordetella pertussis
cagccauucggcc

SEQ ID NO: 300935 - RNA, 17 nt, Bordetella pertussis
cagccauucggccaggu

SEQ ID NO: 300936 - RNA, 16 nt, Bordetella pertussis
cagccauucgauggcg

SEQ ID NO: 300937 - RNA, 16 nt, Bordetella pertussis
cagcccaccagcgcca

SEQ ID NO: 300938 - RNA, 16 nt, Bordetella pertussis
cagcccaccgcgaacc

SEQ ID NO: 300939 - RNA, 23 nt, Bordetella pertussis
cagcccagcaccacggcaucggc

SEQ ID NO: 300940 - RNA, 13 nt, Bordetella pertussis
cagcccagcgcga

SEQ ID NO: 300941 - RNA, 13 nt, Bordetella pertussis
cagcccaggcggg

SEQ ID NO: 300942 - RNA, 21 nt, Bordetella pertussis
cagcccaguugcuggcccagg

SEQ ID NO: 300943 - RNA, 17 nt, Bordetella pertussis
cagccccaccuugccca

SEQ ID NO: 300944 - RNA, 23 nt, Bordetella pertussis
cagccccaccuugcccagcagcu

SEQ ID NO: 300945 - RNA, 13 nt, Bordetella pertussis
cagccccacgccg

SEQ ID NO: 300946 - RNA, 13 nt, Bordetella pertussis
cagccccagcgcc

SEQ ID NO: 300947 - RNA, 16 nt, Bordetella pertussis
cagccccagcgccagc

SEQ ID NO: 300948 - RNA, 15 nt, Bordetella pertussis
cagccccagcgccca

SEQ ID NO: 300949 - RNA, 16 nt, Bordetella pertussis
cagccccagcgcccag

SEQ ID NO: 300950 - RNA, 17 nt, Bordetella pertussis
cagccccagcgcccagg

SEQ ID NO: 300951 - RNA, 20 nt, Bordetella pertussis
cagccccagcgcccaggcga

SEQ ID NO: 300952 - RNA, 14 nt, Bordetella pertussis
cagccccagcgucc

SEQ ID NO: 300953 - RNA, 18 nt, Bordetella pertussis
cagccccagcguccaggc

SEQ ID NO: 300954 - RNA, 23 nt, Bordetella pertussis
cagccccccguaggcggcccagg

SEQ ID NO: 300955 - RNA, 13 nt, Bordetella pertussis
cagccccggcgcg

SEQ ID NO: 300956 - RNA, 14 nt, Bordetella pertussis
cagccccggcgcgc

SEQ ID NO: 300957 - RNA, 17 nt, Bordetella pertussis
cagccccggcgcgccgg

SEQ ID NO: 300958 - RNA, 22 nt, Bordetella pertussis
cagccccggcgcgccggccgcc

SEQ ID NO: 300959 - RNA, 16 nt, Bordetella pertussis
cagcccgccaucgcgc

SEQ ID NO: 300960 - RNA, 19 nt, Bordetella pertussis
cagcccgcccgcgagcggc

SEQ ID NO: 300961 - RNA, 15 nt, Bordetella pertussis
cagcccgcccgcgcc

SEQ ID NO: 300962 - RNA, 20 nt, Bordetella pertussis
cagcccgcccgcgcccagcu

SEQ ID NO: 300963 - RNA, 23 nt, Bordetella pertussis
cagcccgcccgcgcccagcuuga

SEQ ID NO: 300964 - RNA, 17 nt, Bordetella pertussis
cagcccgcgcacgcccg

SEQ ID NO: 300965 - RNA, 20 nt, Bordetella pertussis
cagcccgcgcacgcccgcga

SEQ ID NO: 300966 - RNA, 13 nt, Bordetella pertussis
cagcccgcgcgcg

SEQ ID NO: 300967 - RNA, 17 nt, Bordetella pertussis
cagcccgcgcuggcgca

SEQ ID NO: 300968 - RNA, 21 nt, Bordetella pertussis
cagcccgcgcuggcgcagcag

SEQ ID NO: 300969 - RNA, 13 nt, Bordetella pertussis
cagcccgcgucgc

SEQ ID NO: 300970 - RNA, 22 nt, Bordetella pertussis
cagcccgcgucgcugucggcga

SEQ ID NO: 300971 - RNA, 18 nt, Bordetella pertussis
cagcccgcguucaggcgc

SEQ ID NO: 300972 - RNA, 14 nt, Bordetella pertussis
cagcccgcuggccg

SEQ ID NO: 300973 - RNA, 15 nt, Bordetella pertussis
cagcccgcuggccga

SEQ ID NO: 300974 - RNA, 13 nt, Bordetella pertussis
cagcccggaucgc

SEQ ID NO: 300975 - RNA, 16 nt, Bordetella pertussis
cagcccggcacgucgg

SEQ ID NO: 300976 - RNA, 15 nt, Bordetella pertussis
cagcccggccagagc

SEQ ID NO: 300977 - RNA, 23 nt, Bordetella pertussis
cagcccggccagagccuggaagu

SEQ ID NO: 300978 - RNA, 14 nt, Bordetella pertussis
cagcccggccgcca

SEQ ID NO: 300979 - RNA, 19 nt, Bordetella pertussis
cagcccggccgccagcaug

SEQ ID NO: 300980 - RNA, 15 nt, Bordetella pertussis
cagccgacaggcgcg

SEQ ID NO: 300981 - RNA, 17 nt, Bordetella pertussis
cagccgacaggcgcgca

SEQ ID NO: 300982 - RNA, 15 nt, Bordetella pertussis
cagccgagccuggcg

SEQ ID NO: 300983 - RNA, 15 nt, Bordetella pertussis
cagccgaucagccgg

SEQ ID NO: 300984 - RNA, 16 nt, Bordetella pertussis
cagccgaucagccggc

SEQ ID NO: 300985 - RNA, 23 nt, Bordetella pertussis
cagccgaucagccggccauggcc

SEQ ID NO: 300986 - RNA, 13 nt, Bordetella pertussis
cagccgcccgccg

SEQ ID NO: 300987 - RNA, 14 nt, Bordetella pertussis
cagccgcccgccgg

SEQ ID NO: 300988 - RNA, 15 nt, Bordetella pertussis
cagccgcccgccggg

SEQ ID NO: 300989 - RNA, 15 nt, Bordetella pertussis
cagccgccgcgcggc

SEQ ID NO: 300990 - RNA, 18 nt, Bordetella pertussis
cagccgccuggcgcggcg

SEQ ID NO: 300991 - RNA, 16 nt, Bordetella pertussis
cagccgccugagcaca

SEQ ID NO: 300992 - RNA, 10 nt, Bordetella pertussis
cagccgcgcc

SEQ ID NO: 300993 - RNA, 20 nt, Bordetella pertussis
cagccgcgccaagggcgugc

SEQ ID NO: 300994 - RNA, 13 nt, Bordetella pertussis
cagccgcgccagc

SEQ ID NO: 300995 - RNA, 17 nt, Bordetella pertussis
cagccgcgccagcgccu

SEQ ID NO: 300996 - RNA, 14 nt, Bordetella pertussis
cagccgcgccaggg

SEQ ID NO: 300997 - RNA, 19 nt, Bordetella pertussis
cagccgcgccagggcgcgg

SEQ ID NO: 300998 - RNA, 20 nt, Bordetella pertussis
cagccgcgccagggcgcgga

SEQ ID NO: 300999 - RNA, 14 nt, Bordetella pertussis
cagccgcgcgaaca

SEQ ID NO: 301000 - RNA, 24 nt, Bordetella pertussis
cagccgcgcgccuuccugggcgcc

SEQ ID NO: 301001 - RNA, 18 nt, Bordetella pertussis
cagccgcgcgcggccggc

SEQ ID NO: 301002 - RNA, 22 nt, Bordetella pertussis
cagccgcgcgcggccggcgcgc

SEQ ID NO: 301003 - RNA, 14 nt, Bordetella pertussis
cagccgcgcggccg

SEQ ID NO: 301004 - RNA, 17 nt, Bordetella pertussis
cagccgcgcggccgggc

SEQ ID NO: 301005 - RNA, 23 nt, Bordetella pertussis
cagccgcuaugacgaccgcuacc

SEQ ID NO: 301006 - RNA, 16 nt, Bordetella pertussis
cagccgcuccagccac

SEQ ID NO: 301007 - RNA, 14 nt, Bordetella pertussis
cagccggccaaggc

SEQ ID NO: 301008 - RNA, 14 nt, Bordetella pertussis
cagccggccauggc

SEQ ID NO: 301009 - RNA, 13 nt, Bordetella pertussis
cagccggcccagc

SEQ ID NO: 301010 - RNA, 22 nt, Bordetella pertussis
cagccggcccagcacgccgcgc

SEQ ID NO: 301011 - RNA, 13 nt, Bordetella pertussis
cagccggccccgc

SEQ ID NO: 301012 - RNA, 14 nt, Bordetella pertussis
cagccggccgauga

SEQ ID NO: 301013 - RNA, 22 nt, Bordetella pertussis
cagccggccgaugacaucgccg

SEQ ID NO: 301014 - RNA, 17 nt, Bordetella pertussis
cagccguugcgccagcg

SEQ ID NO: 301015 - RNA, 18 nt, Bordetella pertussis
cagccguuggcgcccagc

SEQ ID NO: 301016 - RNA, 19 nt, Bordetella pertussis
cagccguuggcgcccagcg

SEQ ID NO: 301017 - RNA, 21 nt, Bordetella pertussis
cagccguuggcgcccagcgcc

SEQ ID NO: 301018 - RNA, 19 nt, Bordetella pertussis
cagccugauucccaggccc

SEQ ID NO: 301019 - RNA, 17 nt, Bordetella pertussis
cagccugcccucgggcg

SEQ ID NO: 301020 - RNA, 22 nt, Bordetella pertussis
cagccugcccucgggcgacagg

SEQ ID NO: 301021 - RNA, 16 nt, Bordetella pertussis
cagccugccgcggccg

SEQ ID NO: 301022 - RNA, 19 nt, Bordetella pertussis
cagccugccggcgcgccca

SEQ ID NO: 301023 - RNA, 14 nt, Bordetella pertussis
cagccugccggcgg

SEQ ID NO: 301024 - RNA, 16 nt, Bordetella pertussis
cagccugccggcggcc

SEQ ID NO: 301025 - RNA, 22 nt, Bordetella pertussis
cagccuggcaaugcguggccgg

SEQ ID NO: 301026 - RNA, 13 nt, Bordetella pertussis
cagccugggccug

SEQ ID NO: 301027 - RNA, 15 nt, Bordetella pertussis
cagccugggccugua

SEQ ID NO: 301028 - RNA, 23 nt, Bordetella pertussis
cagccuggucagguugcgccggc

SEQ ID NO: 301029 - RNA, 15 nt, Bordetella pertussis
cagccuggccuugcg

SEQ ID NO: 301030 - RNA, 17 nt, Bordetella pertussis
cagccuucguccugcca

SEQ ID NO: 301031 - RNA, 16 nt, Bordetella pertussis
cagccuugaaagaggc

SEQ ID NO: 301032 - RNA, 18 nt, Bordetella pertussis
cagccuugcuccggcgug

SEQ ID NO: 301033 - RNA, 19 nt, Bordetella pertussis
cagccuugcuccggcguga

SEQ ID NO: 301034 - RNA, 21 nt, Bordetella pertussis
cagccuuggcccacucaugcg

SEQ ID NO: 301035 - RNA, 14 nt, Bordetella pertussis
cagccuugucgcgg

SEQ ID NO: 301036 - RNA, 18 nt, Bordetella pertussis
cagccuugucgcgggcag

SEQ ID NO: 301037 - RNA, 15 nt, Bordetella pertussis
cagcgaaagcacggc

SEQ ID NO: 301038 - RNA, 16 nt, Bordetella pertussis
cagcgaaagcacggcg

SEQ ID NO: 301039 - RNA, 23 nt, Bordetella pertussis
cagcgaaagcacggcgaugcugc

SEQ ID NO: 301040 - RNA, 22 nt, Bordetella pertussis
cagcgaaaugccgaagcgcgcg

SEQ ID NO: 301041 - RNA, 20 nt, Bordetella pertussis
cagcgaaccgaaaugccgca

SEQ ID NO: 301042 - RNA, 16 nt, Bordetella pertussis
cagcgacaucgugcug

SEQ ID NO: 301043 - RNA, 24 nt, Bordetella pertussis
cagcgacgacuugaucagggccac

SEQ ID NO: 301044 - RNA, 17 nt, Bordetella pertussis
cagcgacgagggcgcca

SEQ ID NO: 301045 - RNA, 19 nt, Bordetella pertussis
cagcgacuugucgcgcccg

SEQ ID NO: 301046 - RNA, 22 nt, Bordetella pertussis
cagcgagagcgccacgccagcg

SEQ ID NO: 301047 - RNA, 20 nt, Bordetella pertussis
cagcgagaucagcaccgcga

SEQ ID NO: 301048 - RNA, 19 nt, Bordetella pertussis
cagcgagcccgccaucgcc

SEQ ID NO: 301049 - RNA, 13 nt, Bordetella pertussis
cagcgagcggggc

SEQ ID NO: 301050 - RNA, 20 nt, Bordetella pertussis
cagcgagcggggcuggucga

SEQ ID NO: 301051 - RNA, 17 nt, Bordetella pertussis
cagcgcaucgccgcagg

SEQ ID NO: 301052 - RNA, 18 nt, Bordetella pertussis
cagcgcaucgccgcaggc

SEQ ID NO: 301053 - RNA, 19 nt, Bordetella pertussis
cagcgcaucgccgcaggcg

SEQ ID NO: 301054 - RNA, 13 nt, Bordetella pertussis
cagcgcaucgagc

SEQ ID NO: 301055 - RNA, 13 nt, Bordetella pertussis
cagcgcaucgcgc

SEQ ID NO: 301056 - RNA, 20 nt, Bordetella pertussis
cagcgcaucgcgcgcgccgg

SEQ ID NO: 301057 - RNA, 16 nt, Bordetella pertussis
cagcgcaugccgucga

SEQ ID NO: 301058 - RNA, 21 nt, Bordetella pertussis
cagcgcauuggugagcacgcg

SEQ ID NO: 301059 - RNA, 22 nt, Bordetella pertussis
cagcgcauuggugagcacgcgc

SEQ ID NO: 301060 - RNA, 14 nt, Bordetella pertussis
cagcgccaccaccg

SEQ ID NO: 301061 - RNA, 15 nt, Bordetella pertussis
cagcgccaccaccgg

SEQ ID NO: 301062 - RNA, 16 nt, Bordetella pertussis
cagcgccaccaccggc

SEQ ID NO: 301063 - RNA, 19 nt, Bordetella pertussis
cagcgccaccagcagcgcc

SEQ ID NO: 301064 - RNA, 22 nt, Bordetella pertussis
cagcgccaccagcagcgccagg

SEQ ID NO: 301065 - RNA, 13 nt, Bordetella pertussis
cagcgccaccggc

SEQ ID NO: 301066 - RNA, 16 nt, Bordetella pertussis
cagcgccaccggcugg

SEQ ID NO: 301067 - RNA, 16 nt, Bordetella pertussis
cagcgccacgccggcc

SEQ ID NO: 301068 - RNA, 17 nt, Bordetella pertussis
cagcgccacgcccaggc

SEQ ID NO: 301069 - RNA, 20 nt, Bordetella pertussis
cagcgccacgcccaggccgc

SEQ ID NO: 301070 - RNA, 18 nt, Bordetella pertussis
cagcgccacgcccuggcg

SEQ ID NO: 301071 - RNA, 20 nt, Bordetella pertussis
cagcgccacgcccuggcggu

SEQ ID NO: 301072 - RNA, 14 nt, Bordetella pertussis
cagcgccagggcca

SEQ ID NO: 301073 - RNA, 15 nt, Bordetella pertussis
cagcgccagggccag

SEQ ID NO: 301074 - RNA, 16 nt, Bordetella pertussis
cagcgccagggccagg

SEQ ID NO: 301075 - RNA, 17 nt, Bordetella pertussis
cagcgccagggccaggc

SEQ ID NO: 301076 - RNA, 20 nt, Bordetella pertussis
cagcgccagggccaggccgc

SEQ ID NO: 301077 - RNA, 20 nt, Bordetella pertussis
cagcgccagggccgccgcgc

SEQ ID NO: 301078 - RNA, 15 nt, Bordetella pertussis
cagcgccaguccgcg

SEQ ID NO: 301079 - RNA, 16 nt, Bordetella pertussis
cagcgccaguccgcgc

SEQ ID NO: 301080 - RNA, 20 nt, Bordetella pertussis
cagcgccaugaugucgcgcg

SEQ ID NO: 301081 - RNA, 23 nt, Bordetella pertussis
cagcgccaugaugucgcgcgccu

SEQ ID NO: 301082 - RNA, 18 nt, Bordetella pertussis
cagcgcccaaucgggcag

SEQ ID NO: 301083 - RNA, 19 nt, Bordetella pertussis
cagcgccgccaccucggcg

SEQ ID NO: 301084 - RNA, 23 nt, Bordetella pertussis
cagcgccgccaccucggcgucgc

SEQ ID NO: 301085 - RNA, 13 nt, Bordetella pertussis
cagcgccgccagc

SEQ ID NO: 301086 - RNA, 20 nt, Bordetella pertussis
cagcgccgccagccgcuggc

SEQ ID NO: 301087 - RNA, 18 nt, Bordetella pertussis
cagcgccgccgacggcau

SEQ ID NO: 301088 - RNA, 20 nt, Bordetella pertussis
cagcgccgccgacggcaugg

SEQ ID NO: 301089 - RNA, 12 nt, Bordetella pertussis
cagcgccgcgaa

SEQ ID NO: 301090 - RNA, 16 nt, Bordetella pertussis
cagcgccgcgccgcgu

SEQ ID NO: 301091 - RNA, 14 nt, Bordetella pertussis
cagcgccgcgccgg

SEQ ID NO: 301092 - RNA, 19 nt, Bordetella pertussis
cagcgccgcgccggaucgu

SEQ ID NO: 301093 - RNA, 16 nt, Bordetella pertussis
cagcgccgcgcgcucg

SEQ ID NO: 301094 - RNA, 14 nt, Bordetella pertussis
cagcgccgcggccg

SEQ ID NO: 301095 - RNA, 16 nt, Bordetella pertussis
cagcgccgcggccggc

SEQ ID NO: 301096 - RNA, 14 nt, Bordetella pertussis
cagcgccgcgucga

SEQ ID NO: 301097 - RNA, 24 nt, Bordetella pertussis
cagcgccgcuuccaccgucuggcg

SEQ ID NO: 301098 - RNA, 14 nt, Bordetella pertussis
cagcgccggaaagc

SEQ ID NO: 301099 - RNA, 13 nt, Bordetella pertussis
cagcgccggcacg

SEQ ID NO: 301100 - RNA, 20 nt, Bordetella pertussis
cagcgccggcacgcugaccg

SEQ ID NO: 301101 - RNA, 17 nt, Bordetella pertussis
cagcgccggcaggcgcg

SEQ ID NO: 301102 - RNA, 21 nt, Bordetella pertussis
cagcgccggcaggcgcgccag

SEQ ID NO: 301103 - RNA, 14 nt, Bordetella pertussis
cagcgccggcauga

SEQ ID NO: 301104 - RNA, 18 nt, Bordetella pertussis
cagcgccggcgcaugagc

SEQ ID NO: 301105 - RNA, 16 nt, Bordetella pertussis
cagcgccggcgcgcgc

SEQ ID NO: 301106 - RNA, 16 nt, Bordetella pertussis
cagcgccggcugggcg

SEQ ID NO: 301107 - RNA, 17 nt, Bordetella pertussis
cagcgccggggggcgca

SEQ ID NO: 301108 - RNA, 20 nt, Bordetella pertussis
cagcgccggggggcgcacgc

SEQ ID NO: 301109 - RNA, 22 nt, Bordetella pertussis
cagcgccggggggcgcacgccg

SEQ ID NO: 301110 - RNA, 21 nt, Bordetella pertussis
cagcgccggggucagcgccgg

SEQ ID NO: 301111 - RNA, 23 nt, Bordetella pertussis
cagcgccggggucagcgccggca

SEQ ID NO: 301112 - RNA, 16 nt, Bordetella pertussis
cagcgccgucaucugc

SEQ ID NO: 301113 - RNA, 23 nt, Bordetella pertussis
cagcggcggcgcggucagcauga

SEQ ID NO: 301114 - RNA, 22 nt, Bordetella pertussis
cagcggcguauaggccaccccg

SEQ ID NO: 301115 - RNA, 23 nt, Bordetella pertussis
cagcggcgugcggcccagccgcu

SEQ ID NO: 301116 - RNA, 13 nt, Bordetella pertussis
cagcggcguggcg

SEQ ID NO: 301117 - RNA, 14 nt, Bordetella pertussis
cagcggcucgacgc

SEQ ID NO: 301118 - RNA, 16 nt, Bordetella pertussis
cagcggcucgacgccg

SEQ ID NO: 301119 - RNA, 17 nt, Bordetella pertussis
cagcggcucgacgccgu

SEQ ID NO: 301120 - RNA, 17 nt, Bordetella pertussis
cagcggcugauucucgg

SEQ ID NO: 301121 - RNA, 16 nt, Bordetella pertussis
cagcggggacaggcac

SEQ ID NO: 301122 - RNA, 18 nt, Bordetella pertussis
cagcggggacaggcaccc

SEQ ID NO: 301123 - RNA, 20 nt, Bordetella pertussis
cagcggggacaggcaccccu

SEQ ID NO: 301124 - RNA, 17 nt, Bordetella pertussis
cagcggggacaggcgcc

SEQ ID NO: 301125 - RNA, 20 nt, Bordetella pertussis
cagcgggcuggccagcgguu

SEQ ID NO: 301126 - RNA, 15 nt, Bordetella pertussis
cagcgggucgaucgu

SEQ ID NO: 301127 - RNA, 16 nt, Bordetella pertussis
cagcgggugaucacgg

SEQ ID NO: 301128 - RNA, 19 nt, Bordetella pertussis
cagcgggugaucacggccg

SEQ ID NO: 301129 - RNA, 15 nt, Bordetella pertussis
cagcguacgcacgcc

SEQ ID NO: 301130 - RNA, 14 nt, Bordetella pertussis
cagcguaucgcccg

SEQ ID NO: 301131 - RNA, 16 nt, Bordetella pertussis
cagcguaucgcccgcg

SEQ ID NO: 301132 - RNA, 20 nt, Bordetella pertussis
cagcguaucgcccgcgcggu

SEQ ID NO: 301133 - RNA, 20 nt, Bordetella pertussis
cagcguaucgccgccgccgg

SEQ ID NO: 301134 - RNA, 17 nt, Bordetella pertussis
cagcgucaauccgccgc

SEQ ID NO: 301135 - RNA, 15 nt, Bordetella pertussis
cagcgucaccagcag

SEQ ID NO: 301136 - RNA, 16 nt, Bordetella pertussis
cagcgucaccagcagg

SEQ ID NO: 301137 - RNA, 20 nt, Bordetella pertussis
cagcgucaccagcaggcggc

SEQ ID NO: 301138 - RNA, 14 nt, Bordetella pertussis
cagcgucagcacau

SEQ ID NO: 301139 - RNA, 16 nt, Bordetella pertussis
cagcgucagcgcaaac

SEQ ID NO: 301140 - RNA, 13 nt, Bordetella pertussis
cagcgucagcugg

SEQ ID NO: 301141 - RNA, 15 nt, Bordetella pertussis
cagcgucaugcgcac

SEQ ID NO: 301142 - RNA, 17 nt, Bordetella pertussis
cagcgucaugcgcaccu

SEQ ID NO: 301143 - RNA, 22 nt, Bordetella pertussis
cagcgucaugcgcaccuugucg

SEQ ID NO: 301144 - RNA, 23 nt, Bordetella pertussis
cagcgucaugcgcaccuugucgc

SEQ ID NO: 301145 - RNA, 15 nt, Bordetella pertussis
cagcgucauggccug

SEQ ID NO: 301146 - RNA, 23 nt, Bordetella pertussis
cagcgucauggccuggcccagcu

SEQ ID NO: 301147 - RNA, 19 nt, Bordetella pertussis
cagcgucaugugcugcggc

SEQ ID NO: 301148 - RNA, 20 nt, Bordetella pertussis
cagcgucaugugcugcggca

SEQ ID NO: 301149 - RNA, 18 nt, Bordetella pertussis
cagcguccaggcggccau

SEQ ID NO: 301150 - RNA, 14 nt, Bordetella pertussis
cagcgucccagcca

SEQ ID NO: 301151 - RNA, 16 nt, Bordetella pertussis
cagcgucgagcugacg

SEQ ID NO: 301152 - RNA, 17 nt, Bordetella pertussis
cagcgucgagcugacga

SEQ ID NO: 301153 - RNA, 19 nt, Bordetella pertussis
cagcgucgagcugacgaag

SEQ ID NO: 301154 - RNA, 20 nt, Bordetella pertussis
cagcgucgagcugacgaagg

SEQ ID NO: 301155 - RNA, 13 nt, Bordetella pertussis
cagcgucucgggc

SEQ ID NO: 301156 - RNA, 23 nt, Bordetella pertussis
cagcgugaccgacaggccuggcu

SEQ ID NO: 301157 - RNA, 14 nt, Bordetella pertussis
cagcguucggccac

SEQ ID NO: 301158 - RNA, 19 nt, Bordetella pertussis
cagcguuuccagggcgcgc

SEQ ID NO: 301159 - RNA, 15 nt, Bordetella pertussis
cagcuacggcuggcc

SEQ ID NO: 301160 - RNA, 20 nt, Bordetella pertussis
cagcuacggcuggccgucga

SEQ ID NO: 301161 - RNA, 14 nt, Bordetella pertussis
cagcucagcagcgc

SEQ ID NO: 301162 - RNA, 15 nt, Bordetella pertussis
cagcucagcagcgcc

SEQ ID NO: 301163 - RNA, 17 nt, Bordetella pertussis
cagcucagcagcgccag

SEQ ID NO: 301164 - RNA, 13 nt, Bordetella pertussis
cagcucagcuugg

SEQ ID NO: 301165 - RNA, 22 nt, Bordetella pertussis
cagcucauggcacagcgcggcg

SEQ ID NO: 301166 - RNA, 20 nt, Bordetella pertussis
cagcuccaccgggcugaaca

SEQ ID NO: 301167 - RNA, 16 nt, Bordetella pertussis
cagcuccagccgcagg

SEQ ID NO: 301168 - RNA, 17 nt, Bordetella pertussis
cagcuccagccgcaggc

SEQ ID NO: 301169 - RNA, 15 nt, Bordetella pertussis
cagcuccagcgcgcc

SEQ ID NO: 301170 - RNA, 17 nt, Bordetella pertussis
cagcuccagcgcgccga

SEQ ID NO: 301171 - RNA, 13 nt, Bordetella pertussis
cagcuccagcgcu

SEQ ID NO: 301172 - RNA, 17 nt, Bordetella pertussis
cagcuccagcuggcgca

SEQ ID NO: 301173 - RNA, 17 nt, Bordetella pertussis
cagcucccccacgccgc

SEQ ID NO: 301174 - RNA, 18 nt, Bordetella pertussis
cagcuccggcggcagcgc

SEQ ID NO: 301175 - RNA, 20 nt, Bordetella pertussis
cagcuccguauccuggucga

SEQ ID NO: 301176 - RNA, 17 nt, Bordetella pertussis
cagcucgaccacggcgg

SEQ ID NO: 301177 - RNA, 18 nt, Bordetella pertussis
cagcucgaccacggcggc

SEQ ID NO: 301178 - RNA, 22 nt, Bordetella pertussis
cagcucgacgccaucucgcgcg

SEQ ID NO: 301179 - RNA, 16 nt, Bordetella pertussis
cagcucgaucaggcgc

SEQ ID NO: 301180 - RNA, 17 nt, Bordetella pertussis
cagcucgaucaggcgcu

SEQ ID NO: 301181 - RNA, 16 nt, Bordetella pertussis
cagcucgcgcagcagg

SEQ ID NO: 301182 - RNA, 18 nt, Bordetella pertussis
cagcucgcgcagcaggcc

SEQ ID NO: 301183 - RNA, 13 nt, Bordetella pertussis
cagcucgcgcugc

SEQ ID NO: 301184 - RNA, 15 nt, Bordetella pertussis
cagcucgcggcccug

SEQ ID NO: 301185 - RNA, 16 nt, Bordetella pertussis
cagcucgcggcccugg

SEQ ID NO: 301186 - RNA, 24 nt, Bordetella pertussis
cagcucgcggcccuggucgucgcg

SEQ ID NO: 301187 - RNA, 13 nt, Bordetella pertussis
cagcucggccacc

SEQ ID NO: 301188 - RNA, 22 nt, Bordetella pertussis
cagcucggcccauugcggcacc

SEQ ID NO: 301189 - RNA, 12 nt, Bordetella pertussis
cagcucggccug

SEQ ID NO: 301190 - RNA, 17 nt, Bordetella pertussis
cagcucggccugcggcu

SEQ ID NO: 301191 - RNA, 21 nt, Bordetella pertussis
cagcucggcgaagccgcagcg

SEQ ID NO: 301192 - RNA, 23 nt, Bordetella pertussis
cagcucggcgaagccgcagcggc

SEQ ID NO: 301193 - RNA, 20 nt, Bordetella pertussis
cagcucggcgaugcgcgagc

SEQ ID NO: 301194 - RNA, 17 nt, Bordetella pertussis
cagcucggcggccgccu

SEQ ID NO: 301195 - RNA, 21 nt, Bordetella pertussis
cagcucggcggccgccugcgc

SEQ ID NO: 301196 - RNA, 23 nt, Bordetella pertussis
cagcucggggaaauugacggcgc

SEQ ID NO: 301197 - RNA, 20 nt, Bordetella pertussis
cagcucggugcagcccagca

SEQ ID NO: 301198 - RNA, 15 nt, Bordetella pertussis
cagcucgguggucaa

SEQ ID NO: 301199 - RNA, 23 nt, Bordetella pertussis
cagcucguccagguugcccgagc

SEQ ID NO: 301200 - RNA, 17 nt, Bordetella pertussis
cagcucgucgccgcugg

SEQ ID NO: 301201 - RNA, 15 nt, Bordetella pertussis
cagcucguggcgcgc

SEQ ID NO: 301202 - RNA, 17 nt, Bordetella pertussis
cagcucguggcgcgccu

SEQ ID NO: 301203 - RNA, 19 nt, Bordetella pertussis
cagcucguggcgcgccucc

SEQ ID NO: 301204 - RNA, 18 nt, Bordetella pertussis
cagcugaccucgcccagg

SEQ ID NO: 301205 - RNA, 19 nt, Bordetella pertussis
cagcugaccucgcccaggc

SEQ ID NO: 301206 - RNA, 21 nt, Bordetella pertussis
cagcugaccucgcccaggccg

SEQ ID NO: 301207 - RNA, 17 nt, Bordetella pertussis
cagcugccugagcaccg

SEQ ID NO: 301208 - RNA, 20 nt, Bordetella pertussis
cagcugcgaaagcgcgucga

SEQ ID NO: 301209 - RNA, 16 nt, Bordetella pertussis
cagcugcgcagcgacu

SEQ ID NO: 301210 - RNA, 15 nt, Bordetella pertussis
cagcugcgcgcgagc

SEQ ID NO: 301211 - RNA, 16 nt, Bordetella pertussis
cagcugcgcgcgagcg

SEQ ID NO: 301212 - RNA, 14 nt, Bordetella pertussis
cagcugcgcgucga

SEQ ID NO: 301213 - RNA, 16 nt, Bordetella pertussis
cagcugcuguuggccu

SEQ ID NO: 301214 - RNA, 22 nt, Bordetella pertussis
cagcugcuguuggccuucggcg

SEQ ID NO: 301215 - RNA, 14 nt, Bordetella pertussis
cagcugcuucaugc

SEQ ID NO: 301216 - RNA, 16 nt, Bordetella pertussis
cagcugcuugcccagg

SEQ ID NO: 301217 - RNA, 17 nt, Bordetella pertussis
cagcuggaacgcgccgc

SEQ ID NO: 301218 - RNA, 16 nt, Bordetella pertussis
cagcuggcaccgcgac

SEQ ID NO: 301219 - RNA, 17 nt, Bordetella pertussis
cagcuggcaccgcgacg

SEQ ID NO: 301220 - RNA, 17 nt, Bordetella pertussis
cagcuggcccuggcaga

SEQ ID NO: 301221 - RNA, 18 nt, Bordetella pertussis
cagcuggcccuggcagac

SEQ ID NO: 301222 - RNA, 14 nt, Bordetella pertussis
cagcuggcgcacca

SEQ ID NO: 301223 - RNA, 17 nt, Bordetella pertussis
cagcuggcgcaccaggc

SEQ ID NO: 301224 - RNA, 18 nt, Bordetella pertussis
cagcuggcgcagcacgcc

SEQ ID NO: 301225 - RNA, 20 nt, Bordetella pertussis
cagcugggaggcgugcugca

SEQ ID NO: 301226 - RNA, 22 nt, Bordetella pertussis
cagcugggcaugcacgauggua

SEQ ID NO: 301227 - RNA, 13 nt, Bordetella pertussis
cagcugggccaca

SEQ ID NO: 301228 - RNA, 19 nt, Bordetella pertussis
cagcugggccaguucggcu

SEQ ID NO: 301229 - RNA, 15 nt, Bordetella pertussis
cagcugggcggcgug

SEQ ID NO: 301230 - RNA, 17 nt, Bordetella pertussis
cagcuguaccgguagcc

SEQ ID NO: 301231 - RNA, 21 nt, Bordetella pertussis
cagcuguaccgguagcccgcg

SEQ ID NO: 301232 - RNA, 16 nt, Bordetella pertussis
cagcuguagcccuggc

SEQ ID NO: 301233 - RNA, 19 nt, Bordetella pertussis
cagcuguccaagcgcgugg

SEQ ID NO: 301234 - RNA, 23 nt, Bordetella pertussis
cagcuguucagacugcugccgga

SEQ ID NO: 301235 - RNA, 14 nt, Bordetella pertussis
cagcuucagccugg

SEQ ID NO: 301236 - RNA, 15 nt, Bordetella pertussis
cagcuuccagaucga

SEQ ID NO: 301237 - RNA, 20 nt, Bordetella pertussis
cagcuucuugaacucggcca

SEQ ID NO: 301238 - RNA, 23 nt, Bordetella pertussis
cagcuucuugaacucggccagca

SEQ ID NO: 301239 - RNA, 16 nt, Bordetella pertussis
cagcuugaacaggcag

SEQ ID NO: 301240 - RNA, 20 nt, Bordetella pertussis
cagcuugaccuugagcacgc

SEQ ID NO: 301241 - RNA, 18 nt, Bordetella pertussis
cagcuugacguccagcca

SEQ ID NO: 301242 - RNA, 17 nt, Bordetella pertussis
cagcuugauaucgaagc

SEQ ID NO: 301243 - RNA, 17 nt, Bordetella pertussis
cagcuugaugccgccga

SEQ ID NO: 301244 - RNA, 17 nt, Bordetella pertussis
cagcuugaugccggcgu

SEQ ID NO: 301245 - RNA, 20 nt, Bordetella pertussis
cagcuugaugccggcguucu

SEQ ID NO: 301246 - RNA, 20 nt, Bordetella pertussis
cagcuugaugggcgaggcga

SEQ ID NO: 301247 - RNA, 13 nt, Bordetella pertussis
cagcuugcccacg

SEQ ID NO: 301248 - RNA, 15 nt, Bordetella pertussis
cagcuugcccacgcg

SEQ ID NO: 301249 - RNA, 17 nt, Bordetella pertussis
cagcuugcccacgcgcu

SEQ ID NO: 301250 - RNA, 16 nt, Bordetella pertussis
cagcuugcccggcgug

SEQ ID NO: 301251 - RNA, 16 nt, Bordetella pertussis
cagcuugccgcccagg

SEQ ID NO: 301252 - RNA, 14 nt, Bordetella pertussis
cagcuugcgcgccc

SEQ ID NO: 301253 - RNA, 21 nt, Bordetella pertussis
cagcuugcgcuggcgcgcggc

SEQ ID NO: 301254 - RNA, 17 nt, Bordetella pertussis
cagcuuggacagcgcgu

SEQ ID NO: 301255 - RNA, 23 nt, Bordetella pertussis
cagcuugggcuugauggccagcg

SEQ ID NO: 301256 - RNA, 16 nt, Bordetella pertussis
cagcuuggccugcgga

SEQ ID NO: 301257 - RNA, 16 nt, Bordetella pertussis
cagcuuggcgcgcgga

SEQ ID NO: 301258 - RNA, 14 nt, Bordetella pertussis
cagcuugucgacca

SEQ ID NO: 301259 - RNA, 16 nt, Bordetella pertussis
cagcuugucgaccacc

SEQ ID NO: 301260 - RNA, 17 nt, Bordetella pertussis
cagcuugucggccgcgc

SEQ ID NO: 301261 - RNA, 17 nt, Bordetella pertussis
caggaaagaggccaggc

SEQ ID NO: 301262 - RNA, 20 nt, Bordetella pertussis
caggaaagaggccaggcccu

SEQ ID NO: 301263 - RNA, 15 nt, Bordetella pertussis
caggaaagccggcgu

SEQ ID NO: 301264 - RNA, 17 nt, Bordetella pertussis
caggaaauacucgagcc

SEQ ID NO: 301265 - RNA, 18 nt, Bordetella pertussis
caggaaaccggcgaccac

SEQ ID NO: 301266 - RNA, 20 nt, Bordetella pertussis
caggaacauguccaccagcc

SEQ ID NO: 301267 - RNA, 21 nt, Bordetella pertussis
caggaacauguccaccagccg

SEQ ID NO: 301268 - RNA, 22 nt, Bordetella pertussis
caggaacauguccaccagccgg

SEQ ID NO: 301269 - RNA, 24 nt, Bordetella pertussis
caggaacauguccaccagccggcc

SEQ ID NO: 301270 - RNA, 22 nt, Bordetella pertussis
caggaacauguucacgcccagg

SEQ ID NO: 301271 - RNA, 14 nt, Bordetella pertussis
caggaacaggccgg

SEQ ID NO: 301272 - RNA, 19 nt, Bordetella pertussis
caggaaccagcggcuggcg

SEQ ID NO: 301273 - RNA, 15 nt, Bordetella pertussis
caggaacgccagcag

SEQ ID NO: 301274 - RNA, 17 nt, Bordetella pertussis
caggaagagcuggcgcu

SEQ ID NO: 301275 - RNA, 15 nt, Bordetella pertussis
caggaagaucggccc

SEQ ID NO: 301276 - RNA, 17 nt, Bordetella pertussis
caggaagcagcccagca

SEQ ID NO: 301277 - RNA, 17 nt, Bordetella pertussis
caggaagcgcaccaguu

SEQ ID NO: 301278 - RNA, 17 nt, Bordetella pertussis
caggaagcggcgcacca

SEQ ID NO: 301279 - RNA, 13 nt, Bordetella pertussis
caggaagcgcgcc

SEQ ID NO: 301280 - RNA, 14 nt, Bordetella pertussis
caggaaggcccggu

SEQ ID NO: 301281 - RNA, 19 nt, Bordetella pertussis
caggaaggcccggucgugg

SEQ ID NO: 301282 - RNA, 21 nt, Bordetella pertussis
caggaaggcgaaaccggugau

SEQ ID NO: 301283 - RNA, 15 nt, Bordetella pertussis
caggacaaggcgcgc

SEQ ID NO: 301284 - RNA, 19 nt, Bordetella pertussis
caggacgggaaagcggcga

SEQ ID NO: 301285 - RNA, 21 nt, Bordetella pertussis
caggacggggaacaggcgcgc

SEQ ID NO: 301286 - RNA, 23 nt, Bordetella pertussis
caggacggggaacaggcgcgcca

SEQ ID NO: 301287 - RNA, 23 nt, Bordetella pertussis
caggacggugucgcugacuucgc

SEQ ID NO: 301288 - RNA, 14 nt, Bordetella pertussis
caggaucgcggcca

SEQ ID NO: 301289 - RNA, 19 nt, Bordetella pertussis
caggaucgcggccagccgg

SEQ ID NO: 301290 - RNA, 19 nt, Bordetella pertussis
caggaucgcggccagcggc

SEQ ID NO: 301291 - RNA, 17 nt, Bordetella pertussis
caggaucgucgucauga

SEQ ID NO: 301292 - RNA, 17 nt, Bordetella pertussis
caggaugaagaccacgu

SEQ ID NO: 301293 - RNA, 23 nt, Bordetella pertussis
caggaucugguagugcaggccgc

SEQ ID NO: 301294 - RNA, 15 nt, Bordetella pertussis
caggaugaggcgccg

SEQ ID NO: 301295 - RNA, 18 nt, Bordetella pertussis
caggaugaugcagcacac

SEQ ID NO: 301296 - RNA, 20 nt, Bordetella pertussis
caggaugcccuggguggcgg

SEQ ID NO: 301297 - RNA, 17 nt, Bordetella pertussis
caggaugccgccuucga

SEQ ID NO: 301298 - RNA, 23 nt, Bordetella pertussis
caggaugcgcaccggccaggggc

SEQ ID NO: 301299 - RNA, 14 nt, Bordetella pertussis
caggaugcgcgcca

SEQ ID NO: 301300 - RNA, 17 nt, Bordetella pertussis
caggcaagcugcuggcg

SEQ ID NO: 301301 - RNA, 21 nt, Bordetella pertussis
caggcaagcugcuggcgcgcc

SEQ ID NO: 301302 - RNA, 22 nt, Bordetella pertussis
caggcaagcugcuggcgcgcca

SEQ ID NO: 301303 - RNA, 19 nt, Bordetella pertussis
caggcaaugcgcaggcccg

SEQ ID NO: 301304 - RNA, 16 nt, Bordetella pertussis
caggcacaccacgcga

SEQ ID NO: 301305 - RNA, 14 nt, Bordetella pertussis
caggcacaccgguc

SEQ ID NO: 301306 - RNA, 15 nt, Bordetella pertussis
caggcacacgaccgg

SEQ ID NO: 301307 - RNA, 21 nt, Bordetella pertussis
caggcacaggaacagccugcc

SEQ ID NO: 301308 - RNA, 14 nt, Bordetella pertussis
caggcaccccagca

SEQ ID NO: 301309 - RNA, 15 nt, Bordetella pertussis
caggcaccccagcac

SEQ ID NO: 301310 - RNA, 17 nt, Bordetella pertussis
caggcaccccggcgccg

SEQ ID NO: 301311 - RNA, 21 nt, Bordetella pertussis
caggcaccccgucguccgucc

SEQ ID NO: 301312 - RNA, 17 nt, Bordetella pertussis
caggcacccgcacgggc

SEQ ID NO: 301313 - RNA, 22 nt, Bordetella pertussis
caggcacccgcacgggcagacg

SEQ ID NO: 301314 - RNA, 16 nt, Bordetella pertussis
caggcacccgcgcgca

SEQ ID NO: 301315 - RNA, 14 nt, Bordetella pertussis
caggcacccggggu

SEQ ID NO: 301316 - RNA, 22 nt, Bordetella pertussis
caggcacccugucauacgccau

SEQ ID NO: 301317 - RNA, 16 nt, Bordetella pertussis
caggcacccuugccgc

SEQ ID NO: 301318 - RNA, 22 nt, Bordetella pertussis
caggcacccuugccgcagcggg

SEQ ID NO: 301319 - RNA, 20 nt, Bordetella pertussis
caggcacccuugccgcagga

SEQ ID NO: 301320 - RNA, 22 nt, Bordetella pertussis
caggcacccuugcucagucggg

SEQ ID NO: 301321 - RNA, 21 nt, Bordetella pertussis
caggcaccugcgaccgagcca

SEQ ID NO: 301322 - RNA, 21 nt, Bordetella pertussis
caggcaccugcggugucccuc

SEQ ID NO: 301323 - RNA, 19 nt, Bordetella pertussis
caggcauucccgcccagcg

SEQ ID NO: 301324 - RNA, 20 nt, Bordetella pertussis
caggcauucgaacaacagcg

SEQ ID NO: 301325 - RNA, 22 nt, Bordetella pertussis
caggcauucgugaugccccagg

SEQ ID NO: 301326 - RNA, 15 nt, Bordetella pertussis
caggcauucucggac

SEQ ID NO: 301327 - RNA, 20 nt, Bordetella pertussis
caggcauugaagcuggcgcc

SEQ ID NO: 301328 - RNA, 16 nt, Bordetella pertussis
caggcauugcgccagc

SEQ ID NO: 301329 - RNA, 17 nt, Bordetella pertussis
caggccaccgcggcgga

SEQ ID NO: 301330 - RNA, 24 nt, Bordetella pertussis
caggccacguugauccagcgcucg

SEQ ID NO: 301331 - RNA, 17 nt, Bordetella pertussis
caggccagcagcucggc

SEQ ID NO: 301332 - RNA, 23 nt, Bordetella pertussis
caggccagcgacccgcaaaaccg

SEQ ID NO: 301333 - RNA, 13 nt, Bordetella pertussis
caggccagcgcca

SEQ ID NO: 301334 - RNA, 14 nt, Bordetella pertussis
caggccagcgccag

SEQ ID NO: 301335 - RNA, 15 nt, Bordetella pertussis
caggccagcugcgcc

SEQ ID NO: 301336 - RNA, 16 nt, Bordetella pertussis
caggccaggaagcggc

SEQ ID NO: 301337 - RNA, 17 nt, Bordetella pertussis
caggccaggaagcggcg

SEQ ID NO: 301338 - RNA, 19 nt, Bordetella pertussis
caggccaggaagcggcgca

SEQ ID NO: 301339 - RNA, 21 nt, Bordetella pertussis
caggccaggaagcggcgcacc

SEQ ID NO: 301340 - RNA, 13 nt, Bordetella pertussis
caggccaggcuca

SEQ ID NO: 301341 - RNA, 17 nt, Bordetella pertussis
caggccagguagucguc

SEQ ID NO: 301342 - RNA, 20 nt, Bordetella pertussis
caggcccagcaucaggcccg

SEQ ID NO: 301343 - RNA, 22 nt, Bordetella pertussis
caggcccagcaucaggcccgac

SEQ ID NO: 301344 - RNA, 17 nt, Bordetella pertussis
caggcccagcccgccga

SEQ ID NO: 301345 - RNA, 22 nt, Bordetella pertussis
caggcccgugcuccagaacgcg

SEQ ID NO: 301346 - RNA, 21 nt, Bordetella pertussis
caggcccguguagacggcaau

SEQ ID NO: 301347 - RNA, 17 nt, Bordetella pertussis
caggcccuccggcgcca

SEQ ID NO: 301348 - RNA, 19 nt, Bordetella pertussis
caggcccuccggcgccagc

SEQ ID NO: 301349 - RNA, 15 nt, Bordetella pertussis
caggcccucgcggcc

SEQ ID NO: 301350 - RNA, 19 nt, Bordetella pertussis
caggcccuggcuggccagc

SEQ ID NO: 301351 - RNA, 20 nt, Bordetella pertussis
caggcccuggcuggccagcc

SEQ ID NO: 301352 - RNA, 14 nt, Bordetella pertussis
caggcccugggcca

SEQ ID NO: 301353 - RNA, 16 nt, Bordetella pertussis
caggcccugggccagc

SEQ ID NO: 301354 - RNA, 19 nt, Bordetella pertussis
caggcccuugaucaggcgc

SEQ ID NO: 301355 - RNA, 23 nt, Bordetella pertussis
caggcccuugaucaggcgcauau

SEQ ID NO: 301356 - RNA, 22 nt, Bordetella pertussis
caggcccuugauggccgggccg

SEQ ID NO: 301357 - RNA, 14 nt, Bordetella pertussis
caggcccuggggcc

SEQ ID NO: 301358 - RNA, 19 nt, Bordetella pertussis
caggccgaggcugcgcgcg

SEQ ID NO: 301359 - RNA, 17 nt, Bordetella pertussis
caggccgaucagcacca

SEQ ID NO: 301360 - RNA, 21 nt, Bordetella pertussis
caggccgaucagcgacagcag

SEQ ID NO: 301361 - RNA, 23 nt, Bordetella pertussis
caggccgaucagcgacagcaggg

SEQ ID NO: 301362 - RNA, 14 nt, Bordetella pertussis
caggccgauggcgu

SEQ ID NO: 301363 - RNA, 23 nt, Bordetella pertussis
caggccgauggcguccagcagca

SEQ ID NO: 301364 - RNA, 14 nt, Bordetella pertussis
caggccgauuucgg

SEQ ID NO: 301365 - RNA, 19 nt, Bordetella pertussis
caggccgauuucggccgcc

SEQ ID NO: 301366 - RNA, 20 nt, Bordetella pertussis
caggccgcagcgggcccguc

SEQ ID NO: 301367 - RNA, 22 nt, Bordetella pertussis
caggccgcauacgacacgucau

SEQ ID NO: 301368 - RNA, 15 nt, Bordetella pertussis
caggccggccugggg

SEQ ID NO: 301369 - RNA, 12 nt, Bordetella pertussis
caggccggccuu

SEQ ID NO: 301370 - RNA, 23 nt, Bordetella pertussis
caggccggccuuggccauguccu

SEQ ID NO: 301371 - RNA, 13 nt, Bordetella pertussis
caggccggcgcca

SEQ ID NO: 301372 - RNA, 15 nt, Bordetella pertussis
caggccggcgccugg

SEQ ID NO: 301373 - RNA, 18 nt, Bordetella pertussis
caggccggcgccuggggc

SEQ ID NO: 301374 - RNA, 18 nt, Bordetella pertussis
caggccggcgcgccggcc

SEQ ID NO: 301375 - RNA, 20 nt, Bordetella pertussis
caggccggcgcgccggccca

SEQ ID NO: 301376 - RNA, 12 nt, Bordetella pertussis
caggccggcggc

SEQ ID NO: 301377 - RNA, 17 nt, Bordetella pertussis
caggccggcggccagcg

SEQ ID NO: 301378 - RNA, 16 nt, Bordetella pertussis
caggccggcggcgagc

SEQ ID NO: 301379 - RNA, 15 nt, Bordetella pertussis
caggccggcggcggg

SEQ ID NO: 301380 - RNA, 14 nt, Bordetella pertussis
caggccggcucgcc

SEQ ID NO: 301381 - RNA, 17 nt, Bordetella pertussis
caggccgggcagcgaga

SEQ ID NO: 301382 - RNA, 20 nt, Bordetella pertussis
caggccggggaaacggccaa

SEQ ID NO: 301383 - RNA, 22 nt, Bordetella pertussis
caggccggggaaacggccaagc

SEQ ID NO: 301384 - RNA, 20 nt, Bordetella pertussis
caggccggggccgcccagca

SEQ ID NO: 301385 - RNA, 16 nt, Bordetella pertussis
caggccgggucguucg

SEQ ID NO: 301386 - RNA, 20 nt, Bordetella pertussis
caggccguaaccggccaguc

SEQ ID NO: 301387 - RNA, 23 nt, Bordetella pertussis
caggccguaaccggccaguccca

SEQ ID NO: 301388 - RNA, 20 nt, Bordetella pertussis
caggccgguggaccagggca

SEQ ID NO: 301389 - RNA, 19 nt, Bordetella pertussis
caggccgucgagccgggcg

SEQ ID NO: 301390 - RNA, 20 nt, Bordetella pertussis
caggccgucgagccgggcgc

SEQ ID NO: 301391 - RNA, 22 nt, Bordetella pertussis
caggccgucgagccgggcgccg

SEQ ID NO: 301392 - RNA, 17 nt, Bordetella pertussis
caggccugccugauggc

SEQ ID NO: 301393 - RNA, 15 nt, Bordetella pertussis
caggccugcggcgcc

SEQ ID NO: 301394 - RNA, 22 nt, Bordetella pertussis
caggccugcggcgccagcgccg

SEQ ID NO: 301395 - RNA, 22 nt, Bordetella pertussis
caggccugcugcagcgugaugg

SEQ ID NO: 301396 - RNA, 20 nt, Bordetella pertussis
caggccuggcuuggcggcca

SEQ ID NO: 301397 - RNA, 23 nt, Bordetella pertussis
caggccuggucgagcgggcgcca

SEQ ID NO: 301398 - RNA, 16 nt, Bordetella pertussis
caggccuguucggccg

SEQ ID NO: 301399 - RNA, 22 nt, Bordetella pertussis
caggccuucguaaacaucgcgc

SEQ ID NO: 301400 - RNA, 20 nt, Bordetella pertussis
caggccuuucucaaggccga

SEQ ID NO: 301401 - RNA, 21 nt, Bordetella pertussis
caggccuuucucaaggccgaa

SEQ ID NO: 301402 - RNA, 14 nt, Bordetella pertussis
caggcgacccagca

SEQ ID NO: 301403 - RNA, 13 nt, Bordetella pertussis
caggcgagcgccg

SEQ ID NO: 301404 - RNA, 17 nt, Bordetella pertussis
caggcgaggcuggcgcc

SEQ ID NO: 301405 - RNA, 22 nt, Bordetella pertussis
caggcgauccugcccaccgccg

SEQ ID NO: 301406 - RNA, 19 nt, Bordetella pertussis
caggcgaugcccagcgccg

SEQ ID NO: 301407 - RNA, 16 nt, Bordetella pertussis
caggcgcgcaggcggg

SEQ ID NO: 301408 - RNA, 17 nt, Bordetella pertussis
caggcgcgcaggcgggc

SEQ ID NO: 301409 - RNA, 14 nt, Bordetella pertussis
caggcgcgcaucgc

SEQ ID NO: 301410 - RNA, 17 nt, Bordetella pertussis
caggcgcgcaucgcgcg

SEQ ID NO: 301411 - RNA, 19 nt, Bordetella pertussis
caggcgcgcaucgcgcggc

SEQ ID NO: 301412 - RNA, 17 nt, Bordetella pertussis
caggcgcgccagcccgc

SEQ ID NO: 301413 - RNA, 17 nt, Bordetella pertussis
caggcgcgccagccgcg

SEQ ID NO: 301414 - RNA, 18 nt, Bordetella pertussis
caggcgcgccagccgcgc

SEQ ID NO: 301415 - RNA, 22 nt, Bordetella pertussis
caggcgcgccagccgcgcgaac

SEQ ID NO: 301416 - RNA, 17 nt, Bordetella pertussis
caggcgcgccagccgcu

SEQ ID NO: 301417 - RNA, 23 nt, Bordetella pertussis
caggcgcgccaggggaugacggg

SEQ ID NO: 301418 - RNA, 24 nt, Bordetella pertussis
caggcgcgccaggggaugacgggc

SEQ ID NO: 301419 - RNA, 19 nt, Bordetella pertussis
caggcgcgccgcgauggcg

SEQ ID NO: 301420 - RNA, 18 nt, Bordetella pertussis
caggcgcgccgggccggc

SEQ ID NO: 301421 - RNA, 14 nt, Bordetella pertussis
caggcgcgcgccau

SEQ ID NO: 301422 - RNA, 17 nt, Bordetella pertussis
caggcgcgcgccaucga

SEQ ID NO: 301423 - RNA, 23 nt, Bordetella pertussis
caggcgcgcggcagggcgucggc

SEQ ID NO: 301424 - RNA, 13 nt, Bordetella pertussis
caggcgcgcggcg

SEQ ID NO: 301425 - RNA, 16 nt, Bordetella pertussis
caggcgcgcggcguug

SEQ ID NO: 301426 - RNA, 18 nt, Bordetella pertussis
caggcgcgcucaggccgc

SEQ ID NO: 301427 - RNA, 15 nt, Bordetella pertussis
caggcgcgcuggcgc

SEQ ID NO: 301428 - RNA, 22 nt, Bordetella pertussis
caggcgcgcuucuuggcgacca

SEQ ID NO: 301429 - RNA, 11 nt, Bordetella pertussis
caggcgcggca

SEQ ID NO: 301430 - RNA, 16 nt, Bordetella pertussis
caggcgcggcguaucg

SEQ ID NO: 301431 - RNA, 19 nt, Bordetella pertussis
caggcgcgugaggucgcgc

SEQ ID NO: 301432 - RNA, 20 nt, Bordetella pertussis
caggcgcgugcgcaggcgcg

SEQ ID NO: 301433 - RNA, 23 nt, Bordetella pertussis
caggcgcgugcgcaggcgcgugg

SEQ ID NO: 301434 - RNA, 19 nt, Bordetella pertussis
caggcgcgugcucaucggc

SEQ ID NO: 301435 - RNA, 18 nt, Bordetella pertussis
caggcgcguggccacggc

SEQ ID NO: 301436 - RNA, 20 nt, Bordetella pertussis
caggcgcguggccacggcgu

SEQ ID NO: 301437 - RNA, 13 nt, Bordetella pertussis
caggcgcgugggc

SEQ ID NO: 301438 - RNA, 22 nt, Bordetella pertussis
caggcgcucagccgugccgcgc

SEQ ID NO: 301439 - RNA, 18 nt, Bordetella pertussis
caggcgcuccauggcgcc

SEQ ID NO: 301440 - RNA, 21 nt, Bordetella pertussis
caggcgcuccauggcgccggc

SEQ ID NO: 301441 - RNA, 23 nt, Bordetella pertussis
caggcgcucgaggcgcuggcguc

SEQ ID NO: 301442 - RNA, 21 nt, Bordetella pertussis
caggcgcucgcgcgccagcag

SEQ ID NO: 301443 - RNA, 17 nt, Bordetella pertussis
caggcgcucggccagcg

SEQ ID NO: 301444 - RNA, 13 nt, Bordetella pertussis
caggcgcucggcg

SEQ ID NO: 301445 - RNA, 15 nt, Bordetella pertussis
caggcgcugcagcaa

SEQ ID NO: 301446 - RNA, 21 nt, Bordetella pertussis
caggcgcugguaaagggcgcg

SEQ ID NO: 301447 - RNA, 22 nt, Bordetella pertussis
caggcgcugguaaagggcgcgg

SEQ ID NO: 301448 - RNA, 18 nt, Bordetella pertussis
caggcgcuggucgucgcg

SEQ ID NO: 301449 - RNA, 15 nt, Bordetella pertussis
caggcgucugcuaca

SEQ ID NO: 301450 - RNA, 15 nt, Bordetella pertussis
caggcgucuugccgg

SEQ ID NO: 301451 - RNA, 21 nt, Bordetella pertussis
caggcgugaacgccccggccg

SEQ ID NO: 301452 - RNA, 22 nt, Bordetella pertussis
caggcguugcgccgcaacgccg

SEQ ID NO: 301453 - RNA, 14 nt, Bordetella pertussis
caggcuaucguggc

SEQ ID NO: 301454 - RNA, 14 nt, Bordetella pertussis
caggcucacgccua

SEQ ID NO: 301455 - RNA, 16 nt, Bordetella pertussis
caggcucaggcggcca

SEQ ID NO: 301456 - RNA, 19 nt, Bordetella pertussis
caggcucaggcggccaggg

SEQ ID NO: 301457 - RNA, 17 nt, Bordetella pertussis
caggcuccacagccacu

SEQ ID NO: 301458 - RNA, 15 nt, Bordetella pertussis
caggcucccgcuggc

SEQ ID NO: 301459 - RNA, 22 nt, Bordetella pertussis
caggcuccucgccacacgccag

SEQ ID NO: 301460 - RNA, 17 nt, Bordetella pertussis
caggcucuugaccagcu

SEQ ID NO: 301461 - RNA, 15 nt, Bordetella pertussis
caggcucugggcgga

SEQ ID NO: 301462 - RNA, 14 nt, Bordetella pertussis
caggcugcggcgga

SEQ ID NO: 301463 - RNA, 12 nt, Bordetella pertussis
caggcuggaagu

SEQ ID NO: 301464 - RNA, 19 nt, Bordetella pertussis
caggcuggaagucagccgg

SEQ ID NO: 301465 - RNA, 20 nt, Bordetella pertussis
caggcuggcauugagggcgu

SEQ ID NO: 301466 - RNA, 16 nt, Bordetella pertussis
caggcuggccggcgug

SEQ ID NO: 301467 - RNA, 19 nt, Bordetella pertussis
caggcuggccggcguggcc

SEQ ID NO: 301468 - RNA, 15 nt, Bordetella pertussis
caggcuggccugcag

SEQ ID NO: 301469 - RNA, 17 nt, Bordetella pertussis
caggcuggccugcaggu

SEQ ID NO: 301470 - RNA, 14 nt, Bordetella pertussis
caggcuggcgcggu

SEQ ID NO: 301471 - RNA, 20 nt, Bordetella pertussis
caggcugggagagccggcca

SEQ ID NO: 301472 - RNA, 18 nt, Bordetella pertussis
caggcuuucgaagccgcc

SEQ ID NO: 301473 - RNA, 18 nt, Bordetella pertussis
cagggacaggcaccccgg

SEQ ID NO: 301474 - RNA, 21 nt, Bordetella pertussis
cagggacgggccagccccggc

SEQ ID NO: 301475 - RNA, 14 nt, Bordetella pertussis
cagggccacgccca

SEQ ID NO: 301476 - RNA, 16 nt, Bordetella pertussis
cagggccacgcccacg

SEQ ID NO: 301477 - RNA, 15 nt, Bordetella pertussis
cagggccacgcccag

SEQ ID NO: 301478 - RNA, 19 nt, Bordetella pertussis
cagggccacgcccaggccg

SEQ ID NO: 301479 - RNA, 13 nt, Bordetella pertussis
cagggccacgccg

SEQ ID NO: 301480 - RNA, 14 nt, Bordetella pertussis
cagggccacgccgg

SEQ ID NO: 301481 - RNA, 16 nt, Bordetella pertussis
cagggccacgccggcc

SEQ ID NO: 301482 - RNA, 18 nt, Bordetella pertussis
cagggccacgccggccgc

SEQ ID NO: 301483 - RNA, 16 nt, Bordetella pertussis
cagggccaccacgccg

SEQ ID NO: 301484 - RNA, 14 nt, Bordetella pertussis
cagggccaggccca

SEQ ID NO: 301485 - RNA, 23 nt, Bordetella pertussis
cagggccaggcccacggcgccaa

SEQ ID NO: 301486 - RNA, 15 nt, Bordetella pertussis
cagggccaggccgau

SEQ ID NO: 301487 - RNA, 14 nt, Bordetella pertussis
cagggccaggccgc

SEQ ID NO: 301488 - RNA, 15 nt, Bordetella pertussis
cagggccaggccgcc

SEQ ID NO: 301489 - RNA, 17 nt, Bordetella pertussis
cagggugaccuggcgcg

SEQ ID NO: 301490 - RNA, 15 nt, Bordetella pertussis
cagggugccgcccuu

SEQ ID NO: 301491 - RNA, 20 nt, Bordetella pertussis
cagggugcuguucaggcgcu

SEQ ID NO: 301492 - RNA, 17 nt, Bordetella pertussis
caggguggcaucgugga

SEQ ID NO: 301493 - RNA, 22 nt, Bordetella pertussis
caggguuguccgaaccacccgg

SEQ ID NO: 301494 - RNA, 24 nt, Bordetella pertussis
caggguuguccgaaccacccggcc

SEQ ID NO: 301495 - RNA, 21 nt, Bordetella pertussis
caggguuuccucgccgacgaa

SEQ ID NO: 301496 - RNA, 21 nt, Bordetella pertussis
cagguagcgccucgcaucggc

SEQ ID NO: 301497 - RNA, 23 nt, Bordetella pertussis
cagguagcgccucgcaucggccu

SEQ ID NO: 301498 - RNA, 19 nt, Bordetella pertussis
cagguaggcgccgguccag

SEQ ID NO: 301499 - RNA, 21 nt, Bordetella pertussis
cagguaggcgccgguccagcg

SEQ ID NO: 301500 - RNA, 21 nt, Bordetella pertussis
cagguauuccgccgucagcuc

SEQ ID NO: 301501 - RNA, 21 nt, Bordetella pertussis
cagguauugcucggcggucag

SEQ ID NO: 301502 - RNA, 13 nt, Bordetella pertussis
caggucaucgcca

SEQ ID NO: 301503 - RNA, 14 nt, Bordetella pertussis
caggucaucgccag

SEQ ID NO: 301504 - RNA, 23 nt, Bordetella pertussis
caggucaucgccaggcgcgugca

SEQ ID NO: 301505 - RNA, 14 nt, Bordetella pertussis
caggucgccagcag

SEQ ID NO: 301506 - RNA, 18 nt, Bordetella pertussis
caggucgccagcaggccc

SEQ ID NO: 301507 - RNA, 15 nt, Bordetella pertussis
caggucgcgcgacgu

SEQ ID NO: 301508 - RNA, 17 nt, Bordetella pertussis
caggucgcggugcgcca

SEQ ID NO: 301509 - RNA, 17 nt, Bordetella pertussis
caggucgcugcccagca

SEQ ID NO: 301510 - RNA, 15 nt, Bordetella pertussis
caggucggggcgcuc

SEQ ID NO: 301511 - RNA, 17 nt, Bordetella pertussis
caggucgucgagccggg

SEQ ID NO: 301512 - RNA, 21 nt, Bordetella pertussis
caggucgucgagccgggccac

SEQ ID NO: 301513 - RNA, 17 nt, Bordetella pertussis
caggucguggcccagcc

SEQ ID NO: 301514 - RNA, 19 nt, Bordetella pertussis
caggucguggcccagccgg

SEQ ID NO: 301515 - RNA, 15 nt, Bordetella pertussis
caggucguggccgug

SEQ ID NO: 301516 - RNA, 17 nt, Bordetella pertussis
caggucguugcgcgaag

SEQ ID NO: 301517 - RNA, 20 nt, Bordetella pertussis
caggucguugcgcgaagcgg

SEQ ID NO: 301518 - RNA, 22 nt, Bordetella pertussis
caggucguuguggcaggcgucg

SEQ ID NO: 301519 - RNA, 19 nt, Bordetella pertussis
caggucuacccgcgcgagc

SEQ ID NO: 301520 - RNA, 13 nt, Bordetella pertussis
caggucugcacga

SEQ ID NO: 301521 - RNA, 15 nt, Bordetella pertussis
caggugcacggugga

SEQ ID NO: 301522 - RNA, 20 nt, Bordetella pertussis
caggugcaggguuggcgcgc

SEQ ID NO: 301523 - RNA, 22 nt, Bordetella pertussis
caggugcaggguuggcgcgccg

SEQ ID NO: 301524 - RNA, 16 nt, Bordetella pertussis
caggugccgccggcgc

SEQ ID NO: 301525 - RNA, 19 nt, Bordetella pertussis
caggugccgccggcgcggc

SEQ ID NO: 301526 - RNA, 16 nt, Bordetella pertussis
caggugccccacgccg

SEQ ID NO: 301527 - RNA, 15 nt, Bordetella pertussis
caggugcgccaugcg

SEQ ID NO: 301528 - RNA, 16 nt, Bordetella pertussis
caggugcgcggcgcgc

SEQ ID NO: 301529 - RNA, 14 nt, Bordetella pertussis
caggugcggccgca

SEQ ID NO: 301530 - RNA, 17 nt, Bordetella pertussis
caggugcggccgcagcg

SEQ ID NO: 301531 - RNA, 23 nt, Bordetella pertussis
cagguggggcagcaggccggcgg

SEQ ID NO: 301532 - RNA, 22 nt, Bordetella pertussis
caggugucgccccccaugccgg

SEQ ID NO: 301533 - RNA, 19 nt, Bordetella pertussis
caggugugccagccgcugg

SEQ ID NO: 301534 - RNA, 22 nt, Bordetella pertussis
cagguguucgcgcaccagcgga

SEQ ID NO: 301535 - RNA, 16 nt, Bordetella pertussis
cagguucaucagccgg

SEQ ID NO: 301536 - RNA, 15 nt, Bordetella pertussis
caguacaccggcgug

SEQ ID NO: 301537 - RNA, 14 nt, Bordetella pertussis
caguacaggcgcgu

SEQ ID NO: 301538 - RNA, 23 nt, Bordetella pertussis
caguccgcacaguuugucggcga

SEQ ID NO: 301539 - RNA, 13 nt, Bordetella pertussis
caguccgcccagc

SEQ ID NO: 301540 - RNA, 13 nt, Bordetella pertussis
caguccguggcgc

SEQ ID NO: 301541 - RNA, 17 nt, Bordetella pertussis
caguccucaugcgggac

SEQ ID NO: 301542 - RNA, 19 nt, Bordetella pertussis
caguccucaugcgggacag

SEQ ID NO: 301543 - RNA, 20 nt, Bordetella pertussis
caguccucaugcgggacagg

SEQ ID NO: 301544 - RNA, 14 nt, Bordetella pertussis
cagucggccuggcg

SEQ ID NO: 301545 - RNA, 15 nt, Bordetella pertussis
cagucgggacggcgc

SEQ ID NO: 301546 - RNA, 18 nt, Bordetella pertussis
cagucgggacggcgcggg

SEQ ID NO: 301547 - RNA, 15 nt, Bordetella pertussis
cagucgggcagcgcc

SEQ ID NO: 301548 - RNA, 15 nt, Bordetella pertussis
cagugccugcgaacg

SEQ ID NO: 301549 - RNA, 14 nt, Bordetella pertussis
cagugccuggacgc

SEQ ID NO: 301550 - RNA, 21 nt, Bordetella pertussis
caguuccacgcggccguggcg

SEQ ID NO: 301551 - RNA, 22 nt, Bordetella pertussis
caguuccacgcggccguggcgg

SEQ ID NO: 301552 - RNA, 14 nt, Bordetella pertussis
caguuccaggcgga

SEQ ID NO: 301553 - RNA, 16 nt, Bordetella pertussis
caguuccggcgggccg

SEQ ID NO: 301554 - RNA, 18 nt, Bordetella pertussis
caguucgacgcccaugcg

SEQ ID NO: 301555 - RNA, 23 nt, Bordetella pertussis
caguucgaugcgcuugccgaccu

SEQ ID NO: 301556 - RNA, 14 nt, Bordetella pertussis
caguucgcgcagca

SEQ ID NO: 301557 - RNA, 16 nt, Bordetella pertussis
caguucgcggccggcc

SEQ ID NO: 301558 - RNA, 17 nt, Bordetella pertussis
caguucgcggcgcagcg

SEQ ID NO: 301559 - RNA, 16 nt, Bordetella pertussis
caguucggccagcggc

SEQ ID NO: 301560 - RNA, 15 nt, Bordetella pertussis
caguucggccggcgg

SEQ ID NO: 301561 - RNA, 16 nt, Bordetella pertussis
caguucggccggcggc

SEQ ID NO: 301562 - RNA, 23 nt, Bordetella pertussis
caguucggcuuguucgagcgcgc

SEQ ID NO: 301563 - RNA, 23 nt, Bordetella pertussis
caguucggcgucggugccgucca

SEQ ID NO: 301564 - RNA, 15 nt, Bordetella pertussis
caguugaacacgcgg

SEQ ID NO: 301565 - RNA, 21 nt, Bordetella pertussis
caguugacccauaccagcccg

SEQ ID NO: 301566 - RNA, 19 nt, Bordetella pertussis
caguugacgaugcccaggu

SEQ ID NO: 301567 - RNA, 14 nt, Bordetella pertussis
caguugcaggccau

SEQ ID NO: 301568 - RNA, 19 nt, Bordetella pertussis
caguugccgccgccggcgc

SEQ ID NO: 301569 - RNA, 16 nt, Bordetella pertussis
caguugcuggcccagg

SEQ ID NO: 301570 - RNA, 14 nt, Bordetella pertussis
caguugcuggcggc

SEQ ID NO: 301571 - RNA, 19 nt, Bordetella pertussis
caguugggcgcgcccagcc

SEQ ID NO: 301572 - RNA, 22 nt, Bordetella pertussis
caguugggcgcgcccagccccg

SEQ ID NO: 301573 - RNA, 21 nt, Bordetella pertussis
caguuguagguccaguacacc

SEQ ID NO: 301574 - RNA, 23 nt, Bordetella pertussis
caguuucgcgaccaccaggucgu

SEQ ID NO: 301575 - RNA, 20 nt, Bordetella pertussis
caguuuucucauggccgcgc

SEQ ID NO: 301576 - RNA, 14 nt, Bordetella pertussis
cauacagcaaggac

SEQ ID NO: 301577 - RNA, 14 nt, Bordetella pertussis
cauaccagcccggc

SEQ ID NO: 301578 - RNA, 14 nt, Bordetella pertussis
cauacccauggcca

SEQ ID NO: 301579 - RNA, 21 nt, Bordetella pertussis
cauagcgccgcucgacgucgc

SEQ ID NO: 301580 - RNA, 17 nt, Bordetella pertussis
cauagcguucgguggcg

SEQ ID NO: 301581 - RNA, 15 nt, Bordetella pertussis
cauaggacgccacca

SEQ ID NO: 301582 - RNA, 16 nt, Bordetella pertussis
cauaggccagcgccuu

SEQ ID NO: 301583 - RNA, 20 nt, Bordetella pertussis
cauagggcgacugcagcagg

SEQ ID NO: 301584 - RNA, 17 nt, Bordetella pertussis
cauaucgaacucgaucc

SEQ ID NO: 301585 - RNA, 14 nt, Bordetella pertussis
caucaaacgcggcg

SEQ ID NO: 301586 - RNA, 14 nt, Bordetella pertussis
caucaacguggcgu

SEQ ID NO: 301587 - RNA, 18 nt, Bordetella pertussis
caucaccagcucgcggcc

SEQ ID NO: 301588 - RNA, 12 nt, Bordetella pertussis
caucaccagggu

SEQ ID NO: 301589 - RNA, 22 nt, Bordetella pertussis
caucaccaggguggcgggcgcc

SEQ ID NO: 301590 - RNA, 11 nt, Bordetella pertussis
caucaccaugg

SEQ ID NO: 301591 - RNA, 20 nt, Bordetella pertussis
caucaucaacuucaucguca

SEQ ID NO: 301592 - RNA, 18 nt, Bordetella pertussis
caucaucaucgucggcgc

SEQ ID NO: 301593 - RNA, 18 nt, Bordetella pertussis
caucaucgccgacgcgcc

SEQ ID NO: 301594 - RNA, 14 nt, Bordetella pertussis
caucaucgcgcugg

SEQ ID NO: 301595 - RNA, 17 nt, Bordetella pertussis
caucaucgcgcuggcgc

SEQ ID NO: 301596 - RNA, 20 nt, Bordetella pertussis
caucaucgcgcuggcgcgcg

SEQ ID NO: 301597 - RNA, 15 nt, Bordetella pertussis
caucaucgucggcgc

SEQ ID NO: 301598 - RNA, 18 nt, Bordetella pertussis
caucaugaggcggcggua

SEQ ID NO: 301599 - RNA, 16 nt, Bordetella pertussis
caucauggccagggcc

SEQ ID NO: 301600 - RNA, 13 nt, Bordetella pertussis
caucauggcgcgc

SEQ ID NO: 301601 - RNA, 14 nt, Bordetella pertussis
caucauggcgcgcg

SEQ ID NO: 301602 - RNA, 16 nt, Bordetella pertussis
caucauggcgcgcgcc

SEQ ID NO: 301603 - RNA, 15 nt, Bordetella pertussis
caucauggcgucggc

SEQ ID NO: 301604 - RNA, 19 nt, Bordetella pertussis
caucauguaaggcgcaugc

SEQ ID NO: 301605 - RNA, 17 nt, Bordetella pertussis
cauccacggcgccaugc

SEQ ID NO: 301606 - RNA, 12 nt, Bordetella pertussis
cauccagccagg

SEQ ID NO: 301607 - RNA, 21 nt, Bordetella pertussis
cauccagccgaucagccggcc

SEQ ID NO: 301608 - RNA, 14 nt, Bordetella pertussis
cauccagcgcgcga

SEQ ID NO: 301609 - RNA, 13 nt, Bordetella pertussis
cauccccagcgcc

SEQ ID NO: 301610 - RNA, 14 nt, Bordetella pertussis
cauccccagcgccg

SEQ ID NO: 301611 - RNA, 15 nt, Bordetella pertussis
cauccccagcgccgc

SEQ ID NO: 301612 - RNA, 17 nt, Bordetella pertussis
cauccccagcgccgcca

SEQ ID NO: 301613 - RNA, 14 nt, Bordetella pertussis
caucccgauuucgg

SEQ ID NO: 301614 - RNA, 21 nt, Bordetella pertussis
caucccgauuucggagcggcu

SEQ ID NO: 301615 - RNA, 20 nt, Bordetella pertussis
cauccgcgccacacgggcgc

SEQ ID NO: 301616 - RNA, 21 nt, Bordetella pertussis
cauccgcgccacacgggcgcc

SEQ ID NO: 301617 - RNA, 13 nt, Bordetella pertussis
cauccgcgcugcu

SEQ ID NO: 301618 - RNA, 18 nt, Bordetella pertussis
cauccucgcccagcggcg

SEQ ID NO: 301619 - RNA, 19 nt, Bordetella pertussis
cauccucgcccagcggcgc

SEQ ID NO: 301620 - RNA, 16 nt, Bordetella pertussis
cauccugaugucggcc

SEQ ID NO: 301621 - RNA, 22 nt, Bordetella pertussis
cauccuggaugugcgcgggcgc

SEQ ID NO: 301622 - RNA, 22 nt, Bordetella pertussis
cauccuggccgauuucgcgcgc

SEQ ID NO: 301623 - RNA, 15 nt, Bordetella pertussis
cauccuggccgccgc

SEQ ID NO: 301624 - RNA, 13 nt, Bordetella pertussis
cauccugggcgcg

SEQ ID NO: 301625 - RNA, 14 nt, Bordetella pertussis
cauccuggucgacg

SEQ ID NO: 301626 - RNA, 17 nt, Bordetella pertussis
cauccuggucgacgcga

SEQ ID NO: 301627 - RNA, 19 nt, Bordetella pertussis
caucgaacgugcugacggu

SEQ ID NO: 301628 - RNA, 20 nt, Bordetella pertussis
caucgacaagcgcuacgacg

SEQ ID NO: 301629 - RNA, 16 nt, Bordetella pertussis
caucgacagcgcgccc

SEQ ID NO: 301630 - RNA, 19 nt, Bordetella pertussis
caucgacagcgcgcccgcu

SEQ ID NO: 301631 - RNA, 16 nt, Bordetella pertussis
caucgaccacgcgcgc

SEQ ID NO: 301632 - RNA, 19 nt, Bordetella pertussis
caucgaccacgcgcgcgcc

SEQ ID NO: 301633 - RNA, 14 nt, Bordetella pertussis
caucgaccagcgca

SEQ ID NO: 301634 - RNA, 21 nt, Bordetella pertussis
caucgagcgccugggcggcca

SEQ ID NO: 301635 - RNA, 21 nt, Bordetella pertussis
caucgagggcgucaucggcgc

SEQ ID NO: 301636 - RNA, 23 nt, Bordetella pertussis
caucgagggcgucaucggcgcgc

SEQ ID NO: 301637 - RNA, 16 nt, Bordetella pertussis
caucgauaugggcggc

SEQ ID NO: 301638 - RNA, 17 nt, Bordetella pertussis
caucgaucagcgcgccg

SEQ ID NO: 301639 - RNA, 14 nt, Bordetella pertussis
caucgaugcgccgc

SEQ ID NO: 301640 - RNA, 15 nt, Bordetella pertussis
caucgaugcgccgca

SEQ ID NO: 301641 - RNA, 19 nt, Bordetella pertussis
caucgaugcgccgcaccag

SEQ ID NO: 301642 - RNA, 23 nt, Bordetella pertussis
caucgaugcgccgcaccagcgcc

SEQ ID NO: 301643 - RNA, 16 nt, Bordetella pertussis
caucgaugugcaugcc

SEQ ID NO: 301644 - RNA, 18 nt, Bordetella pertussis
caucgaugugcaugccgu

SEQ ID NO: 301645 - RNA, 16 nt, Bordetella pertussis
caucgauguggccuac

SEQ ID NO: 301646 - RNA, 19 nt, Bordetella pertussis
caucgauuucucgcugcug

SEQ ID NO: 301647 - RNA, 20 nt, Bordetella pertussis
caucgauuucucgcugcuga

SEQ ID NO: 301648 - RNA, 18 nt, Bordetella pertussis
caucgcccggcaggucga

SEQ ID NO: 301649 - RNA, 21 nt, Bordetella pertussis
caucgccgcaggcgugcccuu

SEQ ID NO: 301650 - RNA, 12 nt, Bordetella pertussis
caucgccgccag

SEQ ID NO: 301651 - RNA, 19 nt, Bordetella pertussis
caucgccgccgccgggcug

SEQ ID NO: 301652 - RNA, 15 nt, Bordetella pertussis
caucgccgcggcggg

SEQ ID NO: 301653 - RNA, 16 nt, Bordetella pertussis
caugcgaaagccggcc

SEQ ID NO: 301654 - RNA, 18 nt, Bordetella pertussis
caugcgaaagcggccagc

SEQ ID NO: 301655 - RNA, 17 nt, Bordetella pertussis
caugcgaaugaucucgc

SEQ ID NO: 301656 - RNA, 22 nt, Bordetella pertussis
caugcgaagaauuggccgucca

SEQ ID NO: 301657 - RNA, 16 nt, Bordetella pertussis
caugcgauccagggcg

SEQ ID NO: 301658 - RNA, 15 nt, Bordetella pertussis
caugcgcaccaccgc

SEQ ID NO: 301659 - RNA, 14 nt, Bordetella pertussis
caugcgcacgcgcg

SEQ ID NO: 301660 - RNA, 19 nt, Bordetella pertussis
caugcgcacggacagcccg

SEQ ID NO: 301661 - RNA, 16 nt, Bordetella pertussis
caugcgcacucgaccg

SEQ ID NO: 301662 - RNA, 14 nt, Bordetella pertussis
caugcgcagcaaca

SEQ ID NO: 301663 - RNA, 14 nt, Bordetella pertussis
caugcgcaugcugg

SEQ ID NO: 301664 - RNA, 16 nt, Bordetella pertussis
caugcgcaugcuggau

SEQ ID NO: 301665 - RNA, 13 nt, Bordetella pertussis
caugcgcauggcc

SEQ ID NO: 301666 - RNA, 16 nt, Bordetella pertussis
caugcgcauggccagc

SEQ ID NO: 301667 - RNA, 18 nt, Bordetella pertussis
caugcgcauggccagcgc

SEQ ID NO: 301668 - RNA, 19 nt, Bordetella pertussis
caugcgcauggccagcgcg

SEQ ID NO: 301669 - RNA, 21 nt, Bordetella pertussis
caugcgcauggccagcgcgca

SEQ ID NO: 301670 - RNA, 23 nt, Bordetella pertussis
caugcgcauggccagcgcgcagg

SEQ ID NO: 301671 - RNA, 21 nt, Bordetella pertussis
caugcgccguccucaggcccg

SEQ ID NO: 301672 - RNA, 15 nt, Bordetella pertussis
caugcgccugcgcca

SEQ ID NO: 301673 - RNA, 14 nt, Bordetella pertussis
caugcgcgaacgcg

SEQ ID NO: 301674 - RNA, 16 nt, Bordetella pertussis
caugcgcgaacgcgcg

SEQ ID NO: 301675 - RNA, 19 nt, Bordetella pertussis
caugcgcgaacgcgcgccg

SEQ ID NO: 301676 - RNA, 21 nt, Bordetella pertussis
caugcgcgaacgcgcgccggc

SEQ ID NO: 301677 - RNA, 23 nt, Bordetella pertussis
caugcgcgagggcaucagcgcga

SEQ ID NO: 301678 - RNA, 21 nt, Bordetella pertussis
caugcgcgaucucguggccca

SEQ ID NO: 301679 - RNA, 21 nt, Bordetella pertussis
caugcgcggcgggacggccau

SEQ ID NO: 301680 - RNA, 16 nt, Bordetella pertussis
caugcgcuggucgcgc

SEQ ID NO: 301681 - RNA, 17 nt, Bordetella pertussis
caugcgcuggucgcgca

SEQ ID NO: 301682 - RNA, 22 nt, Bordetella pertussis
caugcgcuggucgcgcagcacg

SEQ ID NO: 301683 - RNA, 16 nt, Bordetella pertussis
caugcgcuugucgccg

SEQ ID NO: 301684 - RNA, 21 nt, Bordetella pertussis
caugcgcuugucgccgcugcg

SEQ ID NO: 301685 - RNA, 18 nt, Bordetella pertussis
caugcggacgccagcccu

SEQ ID NO: 301686 - RNA, 17 nt, Bordetella pertussis
caugcggaugaacgacc

SEQ ID NO: 301687 - RNA, 22 nt, Bordetella pertussis
caugcggcacaaccuggcgcgc

SEQ ID NO: 301688 - RNA, 14 nt, Bordetella pertussis
caugcggcuggccg

SEQ ID NO: 301689 - RNA, 17 nt, Bordetella pertussis
caugcgggacaggcgcc

SEQ ID NO: 301690 - RNA, 22 nt, Bordetella pertussis
caugcgggacaggcgccacagg

SEQ ID NO: 301691 - RNA, 14 nt, Bordetella pertussis
caugcgggucaggc

SEQ ID NO: 301692 - RNA, 17 nt, Bordetella pertussis
caugcgggucaggccgc

SEQ ID NO: 301693 - RNA, 19 nt, Bordetella pertussis
caugcgggucaggccgccg

SEQ ID NO: 301694 - RNA, 18 nt, Bordetella pertussis
caugcgguuucucagcgc

SEQ ID NO: 301695 - RNA, 20 nt, Bordetella pertussis
caugcgguuucucagcgcgc

SEQ ID NO: 301696 - RNA, 22 nt, Bordetella pertussis
caugcgguuucucagcgcgcuu

SEQ ID NO: 301697 - RNA, 19 nt, Bordetella pertussis
caugcgucgaacggccggg

SEQ ID NO: 301698 - RNA, 20 nt, Bordetella pertussis
caugcgucgaacggccgggc

SEQ ID NO: 301699 - RNA, 14 nt, Bordetella pertussis
caugcguucggcca

SEQ ID NO: 301700 - RNA, 18 nt, Bordetella pertussis
caugcugaauugcgggcc

SEQ ID NO: 301701 - RNA, 21 nt, Bordetella pertussis
caugcugaauugcgggccggc

SEQ ID NO: 301702 - RNA, 23 nt, Bordetella pertussis
caugcugaauugcgggccggcga

SEQ ID NO: 301703 - RNA, 21 nt, Bordetella pertussis
caugcucuggcacaccagcgc

SEQ ID NO: 301704 - RNA, 21 nt, Bordetella pertussis
caugcugcagcugcuugccca

SEQ ID NO: 301705 - RNA, 18 nt, Bordetella pertussis
caugcugccaaccgcgac

SEQ ID NO: 301706 - RNA, 20 nt, Bordetella pertussis
caugcugccaaccgcgacgc

SEQ ID NO: 301707 - RNA, 16 nt, Bordetella pertussis
caugcugcgacagcag

SEQ ID NO: 301708 - RNA, 22 nt, Bordetella pertussis
caugcugcgcgaggugggcggc

SEQ ID NO: 301709 - RNA, 21 nt, Bordetella pertussis
caugcuggucaucuacagcgc

SEQ ID NO: 301710 - RNA, 17 nt, Bordetella pertussis
caugcuggccgccgcgc

SEQ ID NO: 301711 - RNA, 20 nt, Bordetella pertussis
caugcugggcgggcuggugg

SEQ ID NO: 301712 - RNA, 23 nt, Bordetella pertussis
caugcugucgcucaugaccagcg

SEQ ID NO: 301713 - RNA, 21 nt, Bordetella pertussis
caugcuugccauaggccagcg

SEQ ID NO: 301714 - RNA, 14 nt, Bordetella pertussis
cauggacagcaccg

SEQ ID NO: 301715 - RNA, 19 nt, Bordetella pertussis
cauggaccgccgccgucgc

SEQ ID NO: 301716 - RNA, 19 nt, Bordetella pertussis
cauggacgagggccggcgc

SEQ ID NO: 301717 - RNA, 21 nt, Bordetella pertussis
cauggacgagggccggcgcca

SEQ ID NO: 301718 - RNA, 15 nt, Bordetella pertussis
cauggacgccgccgc

SEQ ID NO: 301719 - RNA, 22 nt, Bordetella pertussis
cauggagcuggggccgcgcgcc

SEQ ID NO: 301720 - RNA, 17 nt, Bordetella pertussis
cauggaggggcgcaggc

SEQ ID NO: 301721 - RNA, 16 nt, Bordetella pertussis
cauggcacagcgcggc

SEQ ID NO: 301722 - RNA, 14 nt, Bordetella pertussis
cauggcacaggcca

SEQ ID NO: 301723 - RNA, 15 nt, Bordetella pertussis
cauggcacaggccau

SEQ ID NO: 301724 - RNA, 12 nt, Bordetella pertussis
cauggcagcaga

SEQ ID NO: 301725 - RNA, 16 nt, Bordetella pertussis
cauggcagcagaucgg

SEQ ID NO: 301726 - RNA, 17 nt, Bordetella pertussis
cauggcagggcgccgcg

SEQ ID NO: 301727 - RNA, 18 nt, Bordetella pertussis
cauggcagggcgccgcgc

SEQ ID NO: 301728 - RNA, 15 nt, Bordetella pertussis
cauggcaugagcgcc

SEQ ID NO: 301729 - RNA, 16 nt, Bordetella pertussis
cauggcaugcaccgcg

SEQ ID NO: 301730 - RNA, 21 nt, Bordetella pertussis
cauggccaaugaccgacgccg

SEQ ID NO: 301731 - RNA, 14 nt, Bordetella pertussis
cauggccaccaggu

SEQ ID NO: 301732 - RNA, 16 nt, Bordetella pertussis
cauggccagcgcgcag

SEQ ID NO: 301733 - RNA, 13 nt, Bordetella pertussis
cauggccagggcc

SEQ ID NO: 301734 - RNA, 16 nt, Bordetella pertussis
cauggccagggccgau

SEQ ID NO: 301735 - RNA, 22 nt, Bordetella pertussis
cauggccagguacaggccgccg

SEQ ID NO: 301736 - RNA, 14 nt, Bordetella pertussis
cauggccccgggcg

SEQ ID NO: 301737 - RNA, 13 nt, Bordetella pertussis
cauggccgacagc

SEQ ID NO: 301738 - RNA, 14 nt, Bordetella pertussis
cauggccgacagcg

SEQ ID NO: 301739 - RNA, 19 nt, Bordetella pertussis
cauggccgcgcccagcgcg

SEQ ID NO: 301740 - RNA, 20 nt, Bordetella pertussis
cauggccgcgcccagcgcgg

SEQ ID NO: 301741 - RNA, 19 nt, Bordetella pertussis
cauggccgguucgaugacc

SEQ ID NO: 301742 - RNA, 21 nt, Bordetella pertussis
cauggccguggcgugcaggcc

SEQ ID NO: 301743 - RNA, 23 nt, Bordetella pertussis
cauggccguggcgugcaggccgg

SEQ ID NO: 301744 - RNA, 23 nt, Bordetella pertussis
cauggccucgucgaccacgccgg

SEQ ID NO: 301745 - RNA, 16 nt, Bordetella pertussis
cauggcgcaugacggg

SEQ ID NO: 301746 - RNA, 12 nt, Bordetella pertussis
cauggcgccagc

SEQ ID NO: 301747 - RNA, 19 nt, Bordetella pertussis
cauggcgcccacggccgca

SEQ ID NO: 301748 - RNA, 12 nt, Bordetella pertussis
cauggcgccgcg

SEQ ID NO: 301749 - RNA, 16 nt, Bordetella pertussis
cauggcgccgcgccgc

SEQ ID NO: 301750 - RNA, 14 nt, Bordetella pertussis
cauggcgccggcgg

SEQ ID NO: 301751 - RNA, 17 nt, Bordetella pertussis
cauggcgcgccggccgg

SEQ ID NO: 301752 - RNA, 11 nt, Bordetella pertussis
cauggcgcgcg

SEQ ID NO: 301753 - RNA, 13 nt, Bordetella pertussis
cauggcgcgcgcc

SEQ ID NO: 301754 - RNA, 14 nt, Bordetella pertussis
cauggcgcgcgcca

SEQ ID NO: 301755 - RNA, 22 nt, Bordetella pertussis
cauggcgcgcgccagcggcugc

SEQ ID NO: 301756 - RNA, 14 nt, Bordetella pertussis
cauggcgcgcgccg

SEQ ID NO: 301757 - RNA, 17 nt, Bordetella pertussis
cauggcgcgcgccgcgc

SEQ ID NO: 301758 - RNA, 10 nt, Bordetella pertussis
cauggcgcgu

SEQ ID NO: 301759 - RNA, 15 nt, Bordetella pertussis
cauggcgcgugcgcg

SEQ ID NO: 301760 - RNA, 13 nt, Bordetella pertussis
cauggcgccgcgc

SEQ ID NO: 301761 - RNA, 14 nt, Bordetella pertussis
cauggcgccgcgcc

SEQ ID NO: 301762 - RNA, 21 nt, Bordetella pertussis
cauggcgcuggcaggcgccuu

SEQ ID NO: 301763 - RNA, 19 nt, Bordetella pertussis
cauggcgcuguuggccggc

SEQ ID NO: 301764 - RNA, 21 nt, Bordetella pertussis
cauggcgcuguuggccggcgc

SEQ ID NO: 301765 - RNA, 22 nt, Bordetella pertussis
cauggcgcuguuggccggcgcg

SEQ ID NO: 301766 - RNA, 13 nt, Bordetella pertussis
cauggcggccgcc

SEQ ID NO: 301767 - RNA, 15 nt, Bordetella pertussis
cauggcggccggcgu

SEQ ID NO: 301768 - RNA, 15 nt, Bordetella pertussis
cauggcggcggccac

SEQ ID NO: 301769 - RNA, 22 nt, Bordetella pertussis
cauggcggcggccacgaccggc

SEQ ID NO: 301770 - RNA, 14 nt, Bordetella pertussis
cauggcggccagcu

SEQ ID NO: 301771 - RNA, 16 nt, Bordetella pertussis
cauggcggccaggcgc

SEQ ID NO: 301772 - RNA, 17 nt, Bordetella pertussis
cauggcggccaggcgcg

SEQ ID NO: 301773 - RNA, 21 nt, Bordetella pertussis
cauggcggccaggcgcgccgc

SEQ ID NO: 301774 - RNA, 23 nt, Bordetella pertussis
cauggcggccaggcgcgccgcga

SEQ ID NO: 301775 - RNA, 13 nt, Bordetella pertussis
cauggcggcaggc

SEQ ID NO: 301776 - RNA, 15 nt, Bordetella pertussis
cauggcggcaggcgc

SEQ ID NO: 301777 - RNA, 16 nt, Bordetella pertussis
cauggcgguggccagc

SEQ ID NO: 301778 - RNA, 14 nt, Bordetella pertussis
cauggcgucggcca

SEQ ID NO: 301779 - RNA, 15 nt, Bordetella pertussis
cauggcgucggccac

SEQ ID NO: 301780 - RNA, 23 nt, Bordetella pertussis
cauggcgucggccacgucgccca

SEQ ID NO: 301781 - RNA, 16 nt, Bordetella pertussis
cauggcuggucccugc

SEQ ID NO: 301782 - RNA, 23 nt, Bordetella pertussis
caugggcacauacagcggagccg

SEQ ID NO: 301783 - RNA, 21 nt, Bordetella pertussis
caugggccaggcgcuccagca

SEQ ID NO: 301784 - RNA, 13 nt, Bordetella pertussis
caugggcggcccg

SEQ ID NO: 301785 - RNA, 15 nt, Bordetella pertussis
caugggcggcccggc

SEQ ID NO: 301786 - RNA, 17 nt, Bordetella pertussis
caugggcggcccggcca

SEQ ID NO: 301787 - RNA, 14 nt, Bordetella pertussis
caugggcggcgagc

SEQ ID NO: 301788 - RNA, 12 nt, Bordetella pertussis
caugggcggggc

SEQ ID NO: 301789 - RNA, 15 nt, Bordetella pertussis
caugggcgucgucgc

SEQ ID NO: 301790 - RNA, 21 nt, Bordetella pertussis
caugggcgucgucgccgucgc

SEQ ID NO: 301791 - RNA, 16 nt, Bordetella pertussis
caugggcgugccgcgc

SEQ ID NO: 301792 - RNA, 12 nt, Bordetella pertussis
caugggcgcagg

SEQ ID NO: 301793 - RNA, 16 nt, Bordetella pertussis
caugggcgcaggccgc

SEQ ID NO: 301794 - RNA, 21 nt, Bordetella pertussis
caugggcgccgagggccgcgc

SEQ ID NO: 301795 - RNA, 22 nt, Bordetella pertussis
caugggcgccgagggccgcgcg

SEQ ID NO: 301796 - RNA, 17 nt, Bordetella pertussis
caugggcucgcgcgagc

SEQ ID NO: 301797 - RNA, 19 nt, Bordetella pertussis
caugggcucgugcagcagg

SEQ ID NO: 301798 - RNA, 14 nt, Bordetella pertussis
cauggggcaggcgc

SEQ ID NO: 301799 - RNA, 15 nt, Bordetella pertussis
cauggggcaggcgca

SEQ ID NO: 301800 - RNA, 18 nt, Bordetella pertussis
cauggggcgaggucagca

SEQ ID NO: 301801 - RNA, 21 nt, Bordetella pertussis
cauggguaaagcgccggcccg

SEQ ID NO: 301802 - RNA, 15 nt, Bordetella pertussis
caugggggcuggcgc

SEQ ID NO: 301803 - RNA, 23 nt, Bordetella pertussis
caugggguugacguuguccaggc

SEQ ID NO: 301804 - RNA, 15 nt, Bordetella pertussis
cauggucaggacgac

SEQ ID NO: 301805 - RNA, 13 nt, Bordetella pertussis
cauggucgaccag

SEQ ID NO: 301806 - RNA, 14 nt, Bordetella pertussis
cauggucgaccagc

SEQ ID NO: 301807 - RNA, 16 nt, Bordetella pertussis
cauggucgaccagcag

SEQ ID NO: 301808 - RNA, 14 nt, Bordetella pertussis
cauggucgccucga

SEQ ID NO: 301809 - RNA, 16 nt, Bordetella pertussis
cauggucgcgaccacc

SEQ ID NO: 301810 - RNA, 18 nt, Bordetella pertussis
cauggugaacggccccgc

SEQ ID NO: 301811 - RNA, 21 nt, Bordetella pertussis
cauggugaacggccccgccag

SEQ ID NO: 301812 - RNA, 18 nt, Bordetella pertussis
cauggugagggccacgcg

SEQ ID NO: 301813 - RNA, 23 nt, Bordetella pertussis
cauggugccggaaaaugccgcgg

SEQ ID NO: 301814 - RNA, 16 nt, Bordetella pertussis
cauggugggcaugacg

SEQ ID NO: 301815 - RNA, 17 nt, Bordetella pertussis
cauguacucggccaggc

SEQ ID NO: 301816 - RNA, 17 nt, Bordetella pertussis
cauguagauggccgccu

SEQ ID NO: 301817 - RNA, 16 nt, Bordetella pertussis
cauguauaacguggcg

SEQ ID NO: 301818 - RNA, 22 nt, Bordetella pertussis
cauguauaacguggcgcgcacc

SEQ ID NO: 301819 - RNA, 14 nt, Bordetella pertussis
cauguccagcgcca

SEQ ID NO: 301820 - RNA, 17 nt, Bordetella pertussis
cauguccagcgccaggc

SEQ ID NO: 301821 - RNA, 14 nt, Bordetella pertussis
cauguccgccacgc

SEQ ID NO: 301822 - RNA, 19 nt, Bordetella pertussis
cauguccgccacgccggcc

SEQ ID NO: 301823 - RNA, 14 nt, Bordetella pertussis
cauguccgccaugc

SEQ ID NO: 301824 - RNA, 19 nt, Bordetella pertussis
cauguccguaucgcggccg

SEQ ID NO: 301825 - RNA, 20 nt, Bordetella pertussis
cauguccguaucgcggccga

SEQ ID NO: 301826 - RNA, 22 nt, Bordetella pertussis
cauguccugcagguccugguag

SEQ ID NO: 301827 - RNA, 18 nt, Bordetella pertussis
cauguccuggcaggccgc

SEQ ID NO: 301828 - RNA, 16 nt, Bordetella pertussis
caugucgaugccguac

SEQ ID NO: 301829 - RNA, 22 nt, Bordetella pertussis
caugucgcggcccacggccagc

SEQ ID NO: 301830 - RNA, 22 nt, Bordetella pertussis
caugucgcgggugcgggcaaac

SEQ ID NO: 301831 - RNA, 23 nt, Bordetella pertussis
caugucgcgggugcgggcaaacg

SEQ ID NO: 301832 - RNA, 17 nt, Bordetella pertussis
caugucguacaggccgu

SEQ ID NO: 301833 - RNA, 19 nt, Bordetella pertussis
caugucguccucggccacg

SEQ ID NO: 301834 - RNA, 13 nt, Bordetella pertussis
caugugccaccgc

SEQ ID NO: 301835 - RNA, 15 nt, Bordetella pertussis
caugugcucgggacg

SEQ ID NO: 301836 - RNA, 20 nt, Bordetella pertussis
caugugcugcggcagccagg

SEQ ID NO: 301837 - RNA, 17 nt, Bordetella pertussis
cauguggggacaggcac

SEQ ID NO: 301838 - RNA, 18 nt, Bordetella pertussis
cauguucuucaggcucca

SEQ ID NO: 301839 - RNA, 19 nt, Bordetella pertussis
cauuacccauggcaccgau

SEQ ID NO: 301840 - RNA, 15 nt, Bordetella pertussis
cauuagggcccagcu

SEQ ID NO: 301841 - RNA, 15 nt, Bordetella pertussis
cauucccgcccagcg

SEQ ID NO: 301842 - RNA, 18 nt, Bordetella pertussis
cauuccuuccgggcccgc

SEQ ID NO: 301843 - RNA, 18 nt, Bordetella pertussis
cauucgaacaacagcgcc

SEQ ID NO: 301844 - RNA, 22 nt, Bordetella pertussis
cauucgcagaaggucugggcca

SEQ ID NO: 301845 - RNA, 16 nt, Bordetella pertussis
cauucgcgccugagcu

SEQ ID NO: 301846 - RNA, 16 nt, Bordetella pertussis
cauucgucguagccgc

SEQ ID NO: 301847 - RNA, 22 nt, Bordetella pertussis
cauucgucguagccgccgacgu

SEQ ID NO: 301848 - RNA, 18 nt, Bordetella pertussis
cauugaaagcgcgagcuc

SEQ ID NO: 301849 - RNA, 15 nt, Bordetella pertussis
cauugaucgaucagc

SEQ ID NO: 301850 - RNA, 22 nt, Bordetella pertussis
cauugcagggugucggccaggg

SEQ ID NO: 301851 - RNA, 18 nt, Bordetella pertussis
cauugcccagcaccacgg

SEQ ID NO: 301852 - RNA, 22 nt, Bordetella pertussis
cauugcccagguugaaggccgc

SEQ ID NO: 301853 - RNA, 23 nt, Bordetella pertussis
cauugccgcacgaucgcgccggc

SEQ ID NO: 301854 - RNA, 20 nt, Bordetella pertussis
cauugccgccaacgcggcgc

SEQ ID NO: 301855 - RNA, 21 nt, Bordetella pertussis
cauugccgccacgggcccgcg

SEQ ID NO: 301856 - RNA, 11 nt, Bordetella pertussis
cauugccggcg

SEQ ID NO: 301857 - RNA, 19 nt, Bordetella pertussis
cauugccucgcggcagugg

SEQ ID NO: 301858 - RNA, 21 nt, Bordetella pertussis
cauugccgucggccgcgccca

SEQ ID NO: 301859 - RNA, 23 nt, Bordetella pertussis
cauugcgcggccagggcugcggc

SEQ ID NO: 301860 - RNA, 17 nt, Bordetella pertussis
cauugggacgccagccc

SEQ ID NO: 301861 - RNA, 13 nt, Bordetella pertussis
cauugggcagcgg

SEQ ID NO: 301862 - RNA, 20 nt, Bordetella pertussis
cauugucaagcagcgccggc

SEQ ID NO: 301863 - RNA, 13 nt, Bordetella pertussis
cauuucccagccg

SEQ ID NO: 301864 - RNA, 19 nt, Bordetella pertussis
cauuucccagccgucgcgc

SEQ ID NO: 301865 - RNA, 21 nt, Bordetella pertussis
cauuucgaacaaggcgguggc

SEQ ID NO: 301866 - RNA, 21 nt, Bordetella pertussis
cauuucgaugcgcaccaugcg

SEQ ID NO: 301867 - RNA, 18 nt, Bordetella pertussis
cauuucgauuucggcggc

SEQ ID NO: 301868 - RNA, 20 nt, Bordetella pertussis
cauuucgcgugcguggucgc

SEQ ID NO: 301869 - RNA, 16 nt, Bordetella pertussis
cauuucgcugggcgcg

SEQ ID NO: 301870 - RNA, 18 nt, Bordetella pertussis
cauuucggcgccgcgcug

SEQ ID NO: 301871 - RNA, 20 nt, Bordetella pertussis
cauuucucggccugggcgcg

SEQ ID NO: 301872 - RNA, 15 nt, Bordetella pertussis
cauuugccgcggcga

SEQ ID NO: 301873 - RNA, 17 nt, Bordetella pertussis
cauuuucugccacagcg

SEQ ID NO: 301874 - RNA, 16 nt, Bordetella pertussis
ccaaaacagacaggcc

SEQ ID NO: 301875 - RNA, 22 nt, Bordetella pertussis
ccaaacaccaggaagagcuggc

SEQ ID NO: 301876 - RNA, 23 nt, Bordetella pertussis
ccaacacuuucaucaaacgcggc

SEQ ID NO: 301877 - RNA, 14 nt, Bordetella pertussis
ccaacucgaggcgg

SEQ ID NO: 301878 - RNA, 21 nt, Bordetella pertussis
ccaacugccugcagcgcgcgc

SEQ ID NO: 301879 - RNA, 12 nt, Bordetella pertussis
ccaagcgcacgc

SEQ ID NO: 301880 - RNA, 14 nt, Bordetella pertussis
ccaagcgcgccggc

SEQ ID NO: 301881 - RNA, 19 nt, Bordetella pertussis
ccaagcgcguggccaucaa

SEQ ID NO: 301882 - RNA, 15 nt, Bordetella pertussis
ccaagcggcaggcgg

SEQ ID NO: 301883 - RNA, 17 nt, Bordetella pertussis
ccaagcugcuggccggc

SEQ ID NO: 301884 - RNA, 20 nt, Bordetella pertussis
ccaagcuggagaagcgccgc

SEQ ID NO: 301885 - RNA, 17 nt, Bordetella pertussis
ccaaggcauuggcgccg

SEQ ID NO: 301886 - RNA, 15 nt, Bordetella pertussis
ccaauacgccgccau

SEQ ID NO: 301887 - RNA, 17 nt, Bordetella pertussis
ccaauggccgcggcgug

SEQ ID NO: 301888 - RNA, 14 nt, Bordetella pertussis
ccaauuggccgccc

SEQ ID NO: 301889 - RNA, 14 nt, Bordetella pertussis
ccacaauugccagc

SEQ ID NO: 301890 - RNA, 21 nt, Bordetella pertussis
ccacaccagguugucggcgcc

SEQ ID NO: 301891 - RNA, 15 nt, Bordetella pertussis
ccacagcagcgcgcc

SEQ ID NO: 301892 - RNA, 11 nt, Bordetella pertussis
ccacagccagg

SEQ ID NO: 301893 - RNA, 15 nt, Bordetella pertussis
ccacagccaggccga

SEQ ID NO: 301894 - RNA, 17 nt, Bordetella pertussis
ccacagcccggccccca

SEQ ID NO: 301895 - RNA, 15 nt, Bordetella pertussis
ccacagcgccgcggc

SEQ ID NO: 301896 - RNA, 22 nt, Bordetella pertussis
ccacaggcugacgcccggcucg

SEQ ID NO: 301897 - RNA, 15 nt, Bordetella pertussis
ccacagggcgaaggc

SEQ ID NO: 301898 - RNA, 17 nt, Bordetella pertussis
ccacaggguggcgccca

SEQ ID NO: 301899 - RNA, 20 nt, Bordetella pertussis
ccacaggugcgcggcgcgcc

SEQ ID NO: 301900 - RNA, 21 nt, Bordetella pertussis
ccacaggugcgcggcgcgccg

SEQ ID NO: 301901 - RNA, 22 nt, Bordetella pertussis
ccacaggugcgcggcgcgccgu

SEQ ID NO: 301902 - RNA, 16 nt, Bordetella pertussis
ccacagguuggccgcg

SEQ ID NO: 301903 - RNA, 14 nt, Bordetella pertussis
ccacagucggucgc

SEQ ID NO: 301904 - RNA, 16 nt, Bordetella pertussis
ccacagucggucgccg

SEQ ID NO: 301905 - RNA, 22 nt, Bordetella pertussis
ccacagucggucgccgcaguuc

SEQ ID NO: 301906 - RNA, 16 nt, Bordetella pertussis
ccacaguucggccagc

SEQ ID NO: 301907 - RNA, 17 nt, Bordetella pertussis
ccacaguucggccagcg

SEQ ID NO: 301908 - RNA, 22 nt, Bordetella pertussis
ccacaguucggccagcggcagg

SEQ ID NO: 301909 - RNA, 15 nt, Bordetella pertussis
ccacauaaucgucgg

SEQ ID NO: 301910 - RNA, 17 nt, Bordetella pertussis
ccacauagcggccggcg

SEQ ID NO: 301911 - RNA, 15 nt, Bordetella pertussis
ccacauccgcgcugc

SEQ ID NO: 301912 - RNA, 21 nt, Bordetella pertussis
ccacauccgcgcugcugccgu

SEQ ID NO: 301913 - RNA, 14 nt, Bordetella pertussis
ccacaucgaaggca

SEQ ID NO: 301914 - RNA, 13 nt, Bordetella pertussis
ccacaucgccggc

SEQ ID NO: 301915 - RNA, 16 nt, Bordetella pertussis
ccacaugccgugccag

SEQ ID NO: 301916 - RNA, 21 nt, Bordetella pertussis
ccacauggggacuggcacccg

SEQ ID NO: 301917 - RNA, 15 nt, Bordetella pertussis
ccaccacccaggccc

SEQ ID NO: 301918 - RNA, 17 nt, Bordetella pertussis
ccaccacccaggcccag

SEQ ID NO: 301919 - RNA, 14 nt, Bordetella pertussis
ccaccaccaggccg

SEQ ID NO: 301920 - RNA, 14 nt, Bordetella pertussis
ccaccaccaucugc

SEQ ID NO: 301921 - RNA, 17 nt, Bordetella pertussis
ccaccaccggcacgccg

SEQ ID NO: 301922 - RNA, 15 nt, Bordetella pertussis
ccaccaccucguccg

SEQ ID NO: 301923 - RNA, 22 nt, Bordetella pertussis
ccaccagaucgauaccgucgcg

SEQ ID NO: 301924 - RNA, 15 nt, Bordetella pertussis
ccaccagcaccaugc

SEQ ID NO: 301925 - RNA, 22 nt, Bordetella pertussis
ccaccagcaccgaugcgccggc

SEQ ID NO: 301926 - RNA, 14 nt, Bordetella pertussis
ccaccagcagcgcc

SEQ ID NO: 301927 - RNA, 14 nt, Bordetella pertussis
ccaccagcgucacc

SEQ ID NO: 301928 - RNA, 21 nt, Bordetella pertussis
ccaccagcgucaccagcaggc

SEQ ID NO: 301929 - RNA, 16 nt, Bordetella pertussis
ccaccaggaacgccag

SEQ ID NO: 301930 - RNA, 17 nt, Bordetella pertussis
ccaccagcuugcgcgcc

SEQ ID NO: 301931 - RNA, 12 nt, Bordetella pertussis
ccaccaggccgc

SEQ ID NO: 301932 - RNA, 13 nt, Bordetella pertussis
ccaccaggccgcc

SEQ ID NO: 301933 - RNA, 13 nt, Bordetella pertussis
ccaccaggccguc

SEQ ID NO: 301934 - RNA, 16 nt, Bordetella pertussis
ccaccaggcgcgcgcc

SEQ ID NO: 301935 - RNA, 22 nt, Bordetella pertussis
ccaccagggaccaauacgccgc

SEQ ID NO: 301936 - RNA, 23 nt, Bordetella pertussis
ccaccagggaccaauacgccgcc

SEQ ID NO: 301937 - RNA, 15 nt, Bordetella pertussis
ccaccagggccagcu

SEQ ID NO: 301938 - RNA, 17 nt, Bordetella pertussis
ccaccagggcccggacg

SEQ ID NO: 301939 - RNA, 21 nt, Bordetella pertussis
ccaccagggcccggacgcggc

SEQ ID NO: 301940 - RNA, 13 nt, Bordetella pertussis
ccaccagggcgcc

SEQ ID NO: 301941 - RNA, 18 nt, Bordetella pertussis
ccaccagggcgcccgccg

SEQ ID NO: 301942 - RNA, 19 nt, Bordetella pertussis
ccaccaugagcacgcccca

SEQ ID NO: 301943 - RNA, 18 nt, Bordetella pertussis
ccacccagcucagcggau

SEQ ID NO: 301944 - RNA, 13 nt, Bordetella pertussis
ccacccaggccca

SEQ ID NO: 301945 - RNA, 22 nt, Bordetella pertussis
ccacccaggcggcaggcgccgc

SEQ ID NO: 301946 - RNA, 19 nt, Bordetella pertussis
ccacccagggcuugacgcg

SEQ ID NO: 301947 - RNA, 13 nt, Bordetella pertussis
ccacccccagcag

SEQ ID NO: 301948 - RNA, 14 nt, Bordetella pertussis
ccacccccgggcgc

SEQ ID NO: 301949 - RNA, 15 nt, Bordetella pertussis
ccacccccgggcgca

SEQ ID NO: 301950 - RNA, 23 nt, Bordetella pertussis
ccaccccgagauaggcggccagg

SEQ ID NO: 301951 - RNA, 14 nt, Bordetella pertussis
ccaccccgccgcug

SEQ ID NO: 301952 - RNA, 15 nt, Bordetella pertussis
ccaccccgucaucgc

SEQ ID NO: 301953 - RNA, 20 nt, Bordetella pertussis
ccacccgacagcucggacgg

SEQ ID NO: 301954 - RNA, 15 nt, Bordetella pertussis
ccacccgcacgccgg

SEQ ID NO: 301955 - RNA, 17 nt, Bordetella pertussis
ccacccuucgcgcugca

SEQ ID NO: 301956 - RNA, 19 nt, Bordetella pertussis
ccacccuucgcgcugcaga

SEQ ID NO: 301957 - RNA, 13 nt, Bordetella pertussis
ccaccgggacagg

SEQ ID NO: 301958 - RNA, 13 nt, Bordetella pertussis
ccaccgggccggc

SEQ ID NO: 301959 - RNA, 18 nt, Bordetella pertussis
ccaccgguugcagcgcgc

SEQ ID NO: 301960 - RNA, 20 nt, Bordetella pertussis
ccaccguggccacggccgcg

SEQ ID NO: 301961 - RNA, 20 nt, Bordetella pertussis
ccaccuggccacaagcggcc

SEQ ID NO: 301962 - RNA, 19 nt, Bordetella pertussis
ccaccuggcgcccggcggc

SEQ ID NO: 301963 - RNA, 16 nt, Bordetella pertussis
ccaccuggcggugcgc

SEQ ID NO: 301964 - RNA, 21 nt, Bordetella pertussis
ccaccuggcugaacaggccuu

SEQ ID NO: 301965 - RNA, 15 nt, Bordetella pertussis
ccaccuggucgucgg

SEQ ID NO: 301966 - RNA, 13 nt, Bordetella pertussis
ccaccuugacgcg

SEQ ID NO: 301967 - RNA, 17 nt, Bordetella pertussis
ccaccuugacgcgcagg

SEQ ID NO: 301968 - RNA, 17 nt, Bordetella pertussis
ccacgaccuuggcggcc

SEQ ID NO: 301969 - RNA, 20 nt, Bordetella pertussis
ccacgaccuuggcggccgac

SEQ ID NO: 301970 - RNA, 22 nt, Bordetella pertussis
ccacgaccggcucgaucgccgc

SEQ ID NO: 301971 - RNA, 22 nt, Bordetella pertussis
ccacgacggucugggccaugcc

SEQ ID NO: 301972 - RNA, 23 nt, Bordetella pertussis
ccacgacggucugggccaugccg

SEQ ID NO: 301973 - RNA, 23 nt, Bordetella pertussis
ccacgacguagucggcgcccagc

SEQ ID NO: 301974 - RNA, 11 nt, Bordetella pertussis
ccacgagcagu

SEQ ID NO: 301975 - RNA, 22 nt, Bordetella pertussis
ccacgagcaguacacgcgcaac

SEQ ID NO: 301976 - RNA, 15 nt, Bordetella pertussis
ccacgagaagccgau

SEQ ID NO: 301977 - RNA, 18 nt, Bordetella pertussis
ccacgaucaccacgcccg

SEQ ID NO: 301978 - RNA, 23 nt, Bordetella pertussis
ccacgaucaccacgcccgcgccg

SEQ ID NO: 301979 - RNA, 15 nt, Bordetella pertussis
ccacgcccgcgccgc

SEQ ID NO: 301980 - RNA, 14 nt, Bordetella pertussis
ccacgcccgucccg

SEQ ID NO: 301981 - RNA, 23 nt, Bordetella pertussis
ccacgcccgucccgacccccggc

SEQ ID NO: 301982 - RNA, 17 nt, Bordetella pertussis
ccacgcccgucucgcgc

SEQ ID NO: 301983 - RNA, 19 nt, Bordetella pertussis
ccacgcccgucucgcgcgc

SEQ ID NO: 301984 - RNA, 13 nt, Bordetella pertussis
ccacgcccuggca

SEQ ID NO: 301985 - RNA, 16 nt, Bordetella pertussis
ccacgccgaugccgcg

SEQ ID NO: 301986 - RNA, 17 nt, Bordetella pertussis
ccacgccgaugccgcgc

SEQ ID NO: 301987 - RNA, 19 nt, Bordetella pertussis
ccacgccgaugccgcgcac

SEQ ID NO: 301988 - RNA, 20 nt, Bordetella pertussis
ccacgccgaugccgcgcacc

SEQ ID NO: 301989 - RNA, 13 nt, Bordetella pertussis
ccacgccgccggc

SEQ ID NO: 301990 - RNA, 14 nt, Bordetella pertussis
ccacgccgcgcgcg

SEQ ID NO: 301991 - RNA, 13 nt, Bordetella pertussis
ccacgccgcugau

SEQ ID NO: 301992 - RNA, 14 nt, Bordetella pertussis
ccacgccgcugaug

SEQ ID NO: 301993 - RNA, 21 nt, Bordetella pertussis
ccacgccggccacgaacggcg

SEQ ID NO: 301994 - RNA, 15 nt, Bordetella pertussis
ccacgccggccgccu

SEQ ID NO: 301995 - RNA, 13 nt, Bordetella pertussis
ccacgccggccgg

SEQ ID NO: 301996 - RNA, 16 nt, Bordetella pertussis
ccacgccggccggggu

SEQ ID NO: 301997 - RNA, 16 nt, Bordetella pertussis
ccacgccggcgcgccg

SEQ ID NO: 301998 - RNA, 17 nt, Bordetella pertussis
ccacgccggcgcgccgg

SEQ ID NO: 301999 - RNA, 16 nt, Bordetella pertussis
ccacgccguggcgcaa

SEQ ID NO: 302000 - RNA, 13 nt, Bordetella pertussis
ccacgccuggccg

SEQ ID NO: 302001 - RNA, 16 nt, Bordetella pertussis
ccacgccuggccgcgc

SEQ ID NO: 302002 - RNA, 17 nt, Bordetella pertussis
ccacgccuucgagcacc

SEQ ID NO: 302003 - RNA, 16 nt, Bordetella pertussis
ccacgccuucggcgcg

SEQ ID NO: 302004 - RNA, 18 nt, Bordetella pertussis
ccacgccuucggcgcgcg

SEQ ID NO: 302005 - RNA, 21 nt, Bordetella pertussis
ccacgccuucggcgcgcgccg

SEQ ID NO: 302006 - RNA, 18 nt, Bordetella pertussis
ccacgccuuguucgcgcg

SEQ ID NO: 302007 - RNA, 19 nt, Bordetella pertussis
ccacgccuuguucgcgcgc

SEQ ID NO: 302008 - RNA, 20 nt, Bordetella pertussis
ccacgccuuguucgcgcgcg

SEQ ID NO: 302009 - RNA, 17 nt, Bordetella pertussis
ccacgcgcaacgccgcc

SEQ ID NO: 302010 - RNA, 14 nt, Bordetella pertussis
ccacgcgcaccagc

SEQ ID NO: 302011 - RNA, 20 nt, Bordetella pertussis
ccacgcgcacgacgucgcgc

SEQ ID NO: 302012 - RNA, 18 nt, Bordetella pertussis
ccacgcggguggugcugc

SEQ ID NO: 302013 - RNA, 15 nt, Bordetella pertussis
ccacgcucacgcccg

SEQ ID NO: 302014 - RNA, 14 nt, Bordetella pertussis
ccacggccagcagc

SEQ ID NO: 302015 - RNA, 15 nt, Bordetella pertussis
ccacggccagcagca

SEQ ID NO: 302016 - RNA, 17 nt, Bordetella pertussis
ccacggcggcuucggcc

SEQ ID NO: 302017 - RNA, 17 nt, Bordetella pertussis
ccacggcgggccggcuc

SEQ ID NO: 302018 - RNA, 18 nt, Bordetella pertussis
ccacggcggugaccacca

SEQ ID NO: 302019 - RNA, 16 nt, Bordetella pertussis
ccacggcguggcgcgc

SEQ ID NO: 302020 - RNA, 18 nt, Bordetella pertussis
ccacggcguggcgcgccc

SEQ ID NO: 302021 - RNA, 20 nt, Bordetella pertussis
ccacggcguggcgcgcccgc

SEQ ID NO: 302022 - RNA, 16 nt, Bordetella pertussis
ccacggcgucgaugcg

SEQ ID NO: 302023 - RNA, 19 nt, Bordetella pertussis
ccacggcgucgaugcgcgc

SEQ ID NO: 302024 - RNA, 18 nt, Bordetella pertussis
ccacggcgucgccggcca

SEQ ID NO: 302025 - RNA, 20 nt, Bordetella pertussis
ccacggcgucgccggccagg

SEQ ID NO: 302026 - RNA, 17 nt, Bordetella pertussis
ccacggcuucgcccagc

SEQ ID NO: 302027 - RNA, 19 nt, Bordetella pertussis
ccacggcuucgcccagcgc

SEQ ID NO: 302028 - RNA, 17 nt, Bordetella pertussis
ccacgggaccgcucagc

SEQ ID NO: 302029 - RNA, 20 nt, Bordetella pertussis
ccacggcuuuggcguagccg

SEQ ID NO: 302030 - RNA, 13 nt, Bordetella pertussis
ccacgggaugucc

SEQ ID NO: 302031 - RNA, 23 nt, Bordetella pertussis
ccacgggauguccgcgucggccg

SEQ ID NO: 302032 - RNA, 20 nt, Bordetella pertussis
ccacgggcacgauggccgcg

SEQ ID NO: 302033 - RNA, 15 nt, Bordetella pertussis
ccacgggcccgcgca

SEQ ID NO: 302034 - RNA, 22 nt, Bordetella pertussis
ccacgggcgccugguacgacag

SEQ ID NO: 302035 - RNA, 18 nt, Bordetella pertussis
ccacgucgaucaggccca

SEQ ID NO: 302036 - RNA, 19 nt, Bordetella pertussis
ccacguguggcaggccagc

SEQ ID NO: 302037 - RNA, 20 nt, Bordetella pertussis
ccacguugauccagcgcucg

SEQ ID NO: 302038 - RNA, 23 nt, Bordetella pertussis
ccacuaucagcgcgucacgcuga

SEQ ID NO: 302039 - RNA, 17 nt, Bordetella pertussis
ccacucggugcgcgcgc

SEQ ID NO: 302040 - RNA, 18 nt, Bordetella pertussis
ccacucggugcgcgcgcc

SEQ ID NO: 302041 - RNA, 21 nt, Bordetella pertussis
ccacucggugcgcgcgcccac

SEQ ID NO: 302042 - RNA, 14 nt, Bordetella pertussis
ccacugcaaggccc

SEQ ID NO: 302043 - RNA, 17 nt, Bordetella pertussis
ccacugcaaggcccgcc

SEQ ID NO: 302044 - RNA, 19 nt, Bordetella pertussis
ccacugcaaggcccgcccg

SEQ ID NO: 302045 - RNA, 17 nt, Bordetella pertussis
ccacugcagcaguucgg

SEQ ID NO: 302046 - RNA, 20 nt, Bordetella pertussis
ccacugccaguaggcgcccc

SEQ ID NO: 302047 - RNA, 23 nt, Bordetella pertussis
ccacugccaguaggcgccccagg

SEQ ID NO: 302048 - RNA, 17 nt, Bordetella pertussis
ccacuuccagcgccugc

SEQ ID NO: 302049 - RNA, 20 nt, Bordetella pertussis
ccacuuccagcgccugcucg

SEQ ID NO: 302050 - RNA, 17 nt, Bordetella pertussis
ccacuuccucggcgcgc

SEQ ID NO: 302051 - RNA, 20 nt, Bordetella pertussis
ccacuuccuggugggcggca

SEQ ID NO: 302052 - RNA, 16 nt, Bordetella pertussis
ccacuucgcggccgau

SEQ ID NO: 302053 - RNA, 18 nt, Bordetella pertussis
ccagaaacuggcgcugcc

SEQ ID NO: 302054 - RNA, 19 nt, Bordetella pertussis
ccagaaacuggcgcugccg

SEQ ID NO: 302055 - RNA, 23 nt, Bordetella pertussis
ccagacauugucaagcagcgccg

SEQ ID NO: 302056 - RNA, 13 nt, Bordetella pertussis
ccagaccaagcgc

SEQ ID NO: 302057 - RNA, 17 nt, Bordetella pertussis
ccagaccaagcgccaca

SEQ ID NO: 302058 - RNA, 16 nt, Bordetella pertussis
ccagaccgcgcgcacc

SEQ ID NO: 302059 - RNA, 23 nt, Bordetella pertussis
ccagagcaccgagaccgggcggu

SEQ ID NO: 302060 - RNA, 23 nt, Bordetella pertussis
ccagagcgggauggucgcggccg

SEQ ID NO: 302061 - RNA, 19 nt, Bordetella pertussis
ccagagcuggggcgucccg

SEQ ID NO: 302062 - RNA, 18 nt, Bordetella pertussis
ccagauagcccaggcggg

SEQ ID NO: 302063 - RNA, 17 nt, Bordetella pertussis
ccagcaacuggugcccg

SEQ ID NO: 302064 - RNA, 14 nt, Bordetella pertussis
ccagcaagcgcucg

SEQ ID NO: 302065 - RNA, 17 nt, Bordetella pertussis
ccagcaaggcgucggcc

SEQ ID NO: 302066 - RNA, 23 nt, Bordetella pertussis
ccagcaaggcgucggccaggccg

SEQ ID NO: 302067 - RNA, 23 nt, Bordetella pertussis
ccagcaaggcggcaaacccggcg

SEQ ID NO: 302068 - RNA, 21 nt, Bordetella pertussis
ccagcaauuaugcguggccgc

SEQ ID NO: 302069 - RNA, 23 nt, Bordetella pertussis
ccagcaauuaugcguggccgccg

SEQ ID NO: 302070 - RNA, 15 nt, Bordetella pertussis
ccagcacaucgacgu

SEQ ID NO: 302071 - RNA, 23 nt, Bordetella pertussis
ccagcacaucgacgucggccucg

SEQ ID NO: 302072 - RNA, 12 nt, Bordetella pertussis
ccagcaccacgg

SEQ ID NO: 302073 - RNA, 14 nt, Bordetella pertussis
ccagcaccacgggc

SEQ ID NO: 302074 - RNA, 21 nt, Bordetella pertussis
ccagcaccgagcugccgccuu

SEQ ID NO: 302075 - RNA, 15 nt, Bordetella pertussis
ccagcaccgaugcgc

SEQ ID NO: 302076 - RNA, 19 nt, Bordetella pertussis
ccagcaccgaugcgccggc

SEQ ID NO: 302077 - RNA, 14 nt, Bordetella pertussis
ccagcaccgccacc

SEQ ID NO: 302078 - RNA, 15 nt, Bordetella pertussis
ccagcaccgccacgc

SEQ ID NO: 302079 - RNA, 13 nt, Bordetella pertussis
ccagcaccgccgc

SEQ ID NO: 302080 - RNA, 19 nt, Bordetella pertussis
ccagcaccggcacgcgcca

SEQ ID NO: 302081 - RNA, 21 nt, Bordetella pertussis
ccagcaccggcacgcgccagg

SEQ ID NO: 302082 - RNA, 22 nt, Bordetella pertussis
ccagcaccggcacgcgccaggc

SEQ ID NO: 302083 - RNA, 12 nt, Bordetella pertussis
ccagcaccggcc

SEQ ID NO: 302084 - RNA, 16 nt, Bordetella pertussis
ccagcaccggccgccg

SEQ ID NO: 302085 - RNA, 12 nt, Bordetella pertussis
ccagcaccggcu

SEQ ID NO: 302086 - RNA, 13 nt, Bordetella pertussis
ccagcaccggcug

SEQ ID NO: 302087 - RNA, 17 nt, Bordetella pertussis
ccagcacgccgcgcucg

SEQ ID NO: 302088 - RNA, 17 nt, Bordetella pertussis
ccagcacgccggccagg

SEQ ID NO: 302089 - RNA, 16 nt, Bordetella pertussis
ccagcacgccggcggg

SEQ ID NO: 302090 - RNA, 17 nt, Bordetella pertussis
ccagcacgccggcgggc

SEQ ID NO: 302091 - RNA, 12 nt, Bordetella pertussis
ccagcacgcgcg

SEQ ID NO: 302092 - RNA, 14 nt, Bordetella pertussis
ccagcacgcgcgcc

SEQ ID NO: 302093 - RNA, 15 nt, Bordetella pertussis
ccagcacgcgcgcca

SEQ ID NO: 302094 - RNA, 17 nt, Bordetella pertussis
ccagcacgcgcgccagc

SEQ ID NO: 302095 - RNA, 15 nt, Bordetella pertussis
ccagcacgcggcgca

SEQ ID NO: 302096 - RNA, 17 nt, Bordetella pertussis
ccagcacgcggcgcagc

SEQ ID NO: 302097 - RNA, 13 nt, Bordetella pertussis
ccagcacggccgc

SEQ ID NO: 302098 - RNA, 18 nt, Bordetella pertussis
ccagcacggccgcggccg

SEQ ID NO: 302099 - RNA, 20 nt, Bordetella pertussis
ccagcacgguggcgcccggc

SEQ ID NO: 302100 - RNA, 22 nt, Bordetella pertussis
ccagcacguaaucgaagccggg

SEQ ID NO: 302101 - RNA, 19 nt, Bordetella pertussis
ccagcagauaccggcaugg

SEQ ID NO: 302102 - RNA, 20 nt, Bordetella pertussis
ccagcagauaccggcauggc

SEQ ID NO: 302103 - RNA, 18 nt, Bordetella pertussis
ccagcagaucgcggcggg

SEQ ID NO: 302104 - RNA, 16 nt, Bordetella pertussis
ccagcagaaugccgcc

SEQ ID NO: 302105 - RNA, 20 nt, Bordetella pertussis
ccagcagaaugccgcccacg

SEQ ID NO: 302106 - RNA, 22 nt, Bordetella pertussis
ccagcagcacgaucgcggcgcu

SEQ ID NO: 302107 - RNA, 15 nt, Bordetella pertussis
ccagcagcagcgagc

SEQ ID NO: 302108 - RNA, 15 nt, Bordetella pertussis
ccagcagcagcgccg

SEQ ID NO: 302109 - RNA, 16 nt, Bordetella pertussis
ccagcagcagcgccgc

SEQ ID NO: 302110 - RNA, 18 nt, Bordetella pertussis
ccagcagcagcgccgcgc

SEQ ID NO: 302111 - RNA, 19 nt, Bordetella pertussis
ccagcagcagcgccgcgcc

SEQ ID NO: 302112 - RNA, 12 nt, Bordetella pertussis
ccagcagcaugg

SEQ ID NO: 302113 - RNA, 16 nt, Bordetella pertussis
ccagcagcauggcggg

SEQ ID NO: 302114 - RNA, 14 nt, Bordetella pertussis
ccagcagccccagc

SEQ ID NO: 302115 - RNA, 18 nt, Bordetella pertussis
ccagcagcgacggcccca

SEQ ID NO: 302116 - RNA, 19 nt, Bordetella pertussis
ccagcagcgccaccguggc

SEQ ID NO: 302117 - RNA, 15 nt, Bordetella pertussis
ccagcagcgcaucgc

SEQ ID NO: 302118 - RNA, 20 nt, Bordetella pertussis
ccagcagcgcaucgcgcgcg

SEQ ID NO: 302119 - RNA, 12 nt, Bordetella pertussis
ccagcagcgccg

SEQ ID NO: 302120 - RNA, 14 nt, Bordetella pertussis
ccagcagcgccgcc

SEQ ID NO: 302121 - RNA, 14 nt, Bordetella pertussis
ccagcagcggcagg

SEQ ID NO: 302122 - RNA, 17 nt, Bordetella pertussis
ccagcagcggcaggucg

SEQ ID NO: 302123 - RNA, 15 nt, Bordetella pertussis
ccagcagcgggcugg

SEQ ID NO: 302124 - RNA, 21 nt, Bordetella pertussis
ccagcagcggguugcgcgcca

SEQ ID NO: 302125 - RNA, 23 nt, Bordetella pertussis
ccagcagcggguugcgcgccagc

SEQ ID NO: 302126 - RNA, 13 nt, Bordetella pertussis
ccagcagcgugau

SEQ ID NO: 302127 - RNA, 15 nt, Bordetella pertussis
ccagcagcguggcca

SEQ ID NO: 302128 - RNA, 18 nt, Bordetella pertussis
ccagcagcguggccacca

SEQ ID NO: 302129 - RNA, 20 nt, Bordetella pertussis
ccagcagcucggcgaccagg

SEQ ID NO: 302130 - RNA, 23 nt, Bordetella pertussis
ccagcagcucggcgaccaggccc

SEQ ID NO: 302131 - RNA, 16 nt, Bordetella pertussis
ccagcagcucggcgau

SEQ ID NO: 302132 - RNA, 22 nt, Bordetella pertussis
ccagcagcuccucggccugccg

SEQ ID NO: 302133 - RNA, 17 nt, Bordetella pertussis
ccagcagcucggccacc

SEQ ID NO: 302134 - RNA, 17 nt, Bordetella pertussis
ccagcagcuggcgcagc

SEQ ID NO: 302135 - RNA, 23 nt, Bordetella pertussis
ccagcagcuggcgcagcacgccg

SEQ ID NO: 302136 - RNA, 15 nt, Bordetella pertussis
ccagcaggauggcga

SEQ ID NO: 302137 - RNA, 14 nt, Bordetella pertussis
ccagcaggcccacc

SEQ ID NO: 302138 - RNA, 16 nt, Bordetella pertussis
ccagcaggcccugggc

SEQ ID NO: 302139 - RNA, 12 nt, Bordetella pertussis
ccagcaggccgg

SEQ ID NO: 302140 - RNA, 23 nt, Bordetella pertussis
ccagcaggcgaaacgccagcccg

SEQ ID NO: 302141 - RNA, 13 nt, Bordetella pertussis
ccagcaggcggcc

SEQ ID NO: 302142 - RNA, 14 nt, Bordetella pertussis
ccagcaggcggccg

SEQ ID NO: 302143 - RNA, 20 nt, Bordetella pertussis
ccagcaggcggccgaccagc

SEQ ID NO: 302144 - RNA, 16 nt, Bordetella pertussis
ccagcaggcgcucggc

SEQ ID NO: 302145 - RNA, 14 nt, Bordetella pertussis
ccagcaggcgcucg

SEQ ID NO: 302146 - RNA, 21 nt, Bordetella pertussis
ccagcagggacuugggcaggc

SEQ ID NO: 302147 - RNA, 19 nt, Bordetella pertussis
ccagcagggucagcggccg

SEQ ID NO: 302148 - RNA, 17 nt, Bordetella pertussis
ccagcagggucugcagg

SEQ ID NO: 302149 - RNA, 23 nt, Bordetella pertussis
ccagcagggcggcgucgaucggc

SEQ ID NO: 302150 - RNA, 15 nt, Bordetella pertussis
ccagcaucugcccca

SEQ ID NO: 302151 - RNA, 16 nt, Bordetella pertussis
ccagcaugcgcgcggc

SEQ ID NO: 302152 - RNA, 24 nt, Bordetella pertussis
ccagcaugcgcgucuccagcgccg

SEQ ID NO: 302153 - RNA, 23 nt, Bordetella pertussis
ccagcauggccguggcgugcagg

SEQ ID NO: 302154 - RNA, 19 nt, Bordetella pertussis
ccagcauggcggccaggcg

SEQ ID NO: 302155 - RNA, 23 nt, Bordetella pertussis
ccagcauggcgucgaaacgcugc

SEQ ID NO: 302156 - RNA, 12 nt, Bordetella pertussis
ccagcauggcgu

SEQ ID NO: 302157 - RNA, 24 nt, Bordetella pertussis
ccagcaugucguggcgauagcgcu

SEQ ID NO: 302158 - RNA, 19 nt, Bordetella pertussis
ccagcaugugcgcggcguu

SEQ ID NO: 302159 - RNA, 16 nt, Bordetella pertussis
ccagccagccgccgcg

SEQ ID NO: 302160 - RNA, 17 nt, Bordetella pertussis
ccagccagccgccgcgc

SEQ ID NO: 302161 - RNA, 17 nt, Bordetella pertussis
ccagccagcccuggccc

SEQ ID NO: 302162 - RNA, 15 nt, Bordetella pertussis
ccagccagcgccgca

SEQ ID NO: 302163 - RNA, 12 nt, Bordetella pertussis
ccagccaggccu

SEQ ID NO: 302164 - RNA, 23 nt, Bordetella pertussis
ccagccaggcgccagcggcauug

SEQ ID NO: 302165 - RNA, 16 nt, Bordetella pertussis
ccagccaggcgcgcag

SEQ ID NO: 302166 - RNA, 12 nt, Bordetella pertussis
ccagccaggcgg

SEQ ID NO: 302167 - RNA, 23 nt, Bordetella pertussis
ccagccaggguuguccgaaccac

SEQ ID NO: 302168 - RNA, 22 nt, Bordetella pertussis
ccagcccggugaucgaguaggc

SEQ ID NO: 302169 - RNA, 12 nt, Bordetella pertussis
ccagcccuggcc

SEQ ID NO: 302170 - RNA, 16 nt, Bordetella pertussis
ccagcccuucgcccgc

SEQ ID NO: 302171 - RNA, 16 nt, Bordetella pertussis
ccagccgagccuggcg

SEQ ID NO: 302172 - RNA, 16 nt, Bordetella pertussis
ccagccgaucagccgg

SEQ ID NO: 302173 - RNA, 17 nt, Bordetella pertussis
ccagccgaucagccggc

SEQ ID NO: 302174 - RNA, 19 nt, Bordetella pertussis
ccagccgcgccugcagcag

SEQ ID NO: 302175 - RNA, 23 nt, Bordetella pertussis
ccagccgcgccugcagcagcggc

SEQ ID NO: 302176 - RNA, 13 nt, Bordetella pertussis
ccagccgcgcgac

SEQ ID NO: 302177 - RNA, 18 nt, Bordetella pertussis
ccagccgcucgcgcgacc

SEQ ID NO: 302178 - RNA, 22 nt, Bordetella pertussis
ccagccgcuggcgaucaggccg

SEQ ID NO: 302179 - RNA, 14 nt, Bordetella pertussis
ccagccgcuggcgc

SEQ ID NO: 302180 - RNA, 16 nt, Bordetella pertussis
ccagccgcuggcgcgc

SEQ ID NO: 302181 - RNA, 20 nt, Bordetella pertussis
ccagccgcuggcgcgccgcc

SEQ ID NO: 302182 - RNA, 23 nt, Bordetella pertussis
ccagccgcuugcccgucaugcgc

SEQ ID NO: 302183 - RNA, 19 nt, Bordetella pertussis
ccagccgcuugcggccagg

SEQ ID NO: 302184 - RNA, 23 nt, Bordetella pertussis
ccagccgcuugcggccaggcggg

SEQ ID NO: 302185 - RNA, 15 nt, Bordetella pertussis
ccagccggacccgcg

SEQ ID NO: 302186 - RNA, 19 nt, Bordetella pertussis
ccagccggacccgcgccgc

SEQ ID NO: 302187 - RNA, 13 nt, Bordetella pertussis
ccagccgcugcag

SEQ ID NO: 302188 - RNA, 13 nt, Bordetella pertussis
ccagccggcccag

SEQ ID NO: 302189 - RNA, 14 nt, Bordetella pertussis
ccagccggcccagc

SEQ ID NO: 302190 - RNA, 15 nt, Bordetella pertussis
ccagccggcccagca

SEQ ID NO: 302191 - RNA, 16 nt, Bordetella pertussis
ccagccggugcgcggc

SEQ ID NO: 302192 - RNA, 13 nt, Bordetella pertussis
ccagccgucgcgc

SEQ ID NO: 302193 - RNA, 15 nt, Bordetella pertussis
ccagccgucgcgcug

SEQ ID NO: 302194 - RNA, 17 nt, Bordetella pertussis
ccagccgucgcgcugca

SEQ ID NO: 302195 - RNA, 13 nt, Bordetella pertussis
ccagccgucggca

SEQ ID NO: 302196 - RNA, 14 nt, Bordetella pertussis
ccagccgucggcau

SEQ ID NO: 302197 - RNA, 15 nt, Bordetella pertussis
ccagccgucggcaug

SEQ ID NO: 302198 - RNA, 16 nt, Bordetella pertussis
ccagccgucggcaugg

SEQ ID NO: 302199 - RNA, 21 nt, Bordetella pertussis
ccagccguucaucagcgcgcg

SEQ ID NO: 302200 - RNA, 15 nt, Bordetella pertussis
ccagccguuggcgcc

SEQ ID NO: 302201 - RNA, 17 nt, Bordetella pertussis
ccagccguuggcgccca

SEQ ID NO: 302202 - RNA, 18 nt, Bordetella pertussis
ccagccguuggcgcccag

SEQ ID NO: 302203 - RNA, 20 nt, Bordetella pertussis
ccagccguuggcgcccagcg

SEQ ID NO: 302204 - RNA, 20 nt, Bordetella pertussis
ccagccguugcgccagcggc

SEQ ID NO: 302205 - RNA, 14 nt, Bordetella pertussis
ccagccugcccggg

SEQ ID NO: 302206 - RNA, 14 nt, Bordetella pertussis
ccagccugccgcgg

SEQ ID NO: 302207 - RNA, 15 nt, Bordetella pertussis
ccagccugccgcggc

SEQ ID NO: 302208 - RNA, 16 nt, Bordetella pertussis
ccagccugccggcggc

SEQ ID NO: 302209 - RNA, 13 nt, Bordetella pertussis
ccagccuggccuu

SEQ ID NO: 302210 - RNA, 12 nt, Bordetella pertussis
ccagccuggcgc

SEQ ID NO: 302211 - RNA, 14 nt, Bordetella pertussis
ccagccuggcgcca

SEQ ID NO: 302212 - RNA, 16 nt, Bordetella pertussis
ccagccuggcgccaac

SEQ ID NO: 302213 - RNA, 17 nt, Bordetella pertussis
ccagccugaugcgcaga

SEQ ID NO: 302214 - RNA, 16 nt, Bordetella pertussis
ccagccugugcgccau

SEQ ID NO: 302215 - RNA, 23 nt, Bordetella pertussis
ccagcgaaccgaaaugccgcagc

SEQ ID NO: 302216 - RNA, 15 nt, Bordetella pertussis
ccagcgaggccgcuu

SEQ ID NO: 302217 - RNA, 22 nt, Bordetella pertussis
ccagcgaggccgcuucgugcgg

SEQ ID NO: 302218 - RNA, 14 nt, Bordetella pertussis
ccagcgagcuggug

SEQ ID NO: 302219 - RNA, 19 nt, Bordetella pertussis
ccagcgaguuguccuggcc

SEQ ID NO: 302220 - RNA, 22 nt, Bordetella pertussis
ccagcgauacccgcuucgacgg

SEQ ID NO: 302221 - RNA, 18 nt, Bordetella pertussis
ccagcgcauugccgccgc

SEQ ID NO: 302222 - RNA, 12 nt, Bordetella pertussis
ccagcgccacca

SEQ ID NO: 302223 - RNA, 16 nt, Bordetella pertussis
ccagcgccaccaccgg

SEQ ID NO: 302224 - RNA, 18 nt, Bordetella pertussis
ccagcgccaccaccggca

SEQ ID NO: 302225 - RNA, 23 nt, Bordetella pertussis
ccagcgccaccaccggcacgccg

SEQ ID NO: 302226 - RNA, 13 nt, Bordetella pertussis
ccagcgccaccag

SEQ ID NO: 302227 - RNA, 20 nt, Bordetella pertussis
ccagcgccacgcccaggccg

SEQ ID NO: 302228 - RNA, 17 nt, Bordetella pertussis
ccagcgccacgcccugg

SEQ ID NO: 302229 - RNA, 13 nt, Bordetella pertussis
ccagcgccagcac

SEQ ID NO: 302230 - RNA, 17 nt, Bordetella pertussis
ccagcgccagcaccggc

SEQ ID NO: 302231 - RNA, 23 nt, Bordetella pertussis
ccagcgccagcaccggcacgcgc

SEQ ID NO: 302232 - RNA, 14 nt, Bordetella pertussis
ccagcgccagcacg

SEQ ID NO: 302233 - RNA, 20 nt, Bordetella pertussis
ccagcgccagcagcaggccg

SEQ ID NO: 302234 - RNA, 15 nt, Bordetella pertussis
ccagcgccagcaggg

SEQ ID NO: 302235 - RNA, 16 nt, Bordetella pertussis
ccagcgccacgccggc

SEQ ID NO: 302236 - RNA, 20 nt, Bordetella pertussis
ccagcgccaggaacagcgcc

SEQ ID NO: 302237 - RNA, 16 nt, Bordetella pertussis
ccagcgccaggccgcg

SEQ ID NO: 302238 - RNA, 17 nt, Bordetella pertussis
ccagcgccaggccgcgc

SEQ ID NO: 302239 - RNA, 18 nt, Bordetella pertussis
ccagcgccaggccgcgca

SEQ ID NO: 302240 - RNA, 20 nt, Bordetella pertussis
ccagcgccaggccgcgcagg

SEQ ID NO: 302241 - RNA, 18 nt, Bordetella pertussis
ccagcgccagcguggccg

SEQ ID NO: 302242 - RNA, 19 nt, Bordetella pertussis
ccagcgccagggccgccgc

SEQ ID NO: 302243 - RNA, 21 nt, Bordetella pertussis
ccagcgccgccauggcggcgc

SEQ ID NO: 302244 - RNA, 14 nt, Bordetella pertussis
ccagcgccgccgac

SEQ ID NO: 302245 - RNA, 18 nt, Bordetella pertussis
ccagcgccgccgacggca

SEQ ID NO: 302246 - RNA, 21 nt, Bordetella pertussis
ccagcgccgccuucaccggcc

SEQ ID NO: 302247 - RNA, 11 nt, Bordetella pertussis
ccagcgccgcg

SEQ ID NO: 302248 - RNA, 21 nt, Bordetella pertussis
ccagcgccgcgaacuggcggu

SEQ ID NO: 302249 - RNA, 18 nt, Bordetella pertussis
ccagcgccgcgagcgccg

SEQ ID NO: 302250 - RNA, 20 nt, Bordetella pertussis
ccagcgccgcgagcgccgaa

SEQ ID NO: 302251 - RNA, 14 nt, Bordetella pertussis
ccagcgccgcgccg

SEQ ID NO: 302252 - RNA, 15 nt, Bordetella pertussis
ccagcgccgcgcgcg

SEQ ID NO: 302253 - RNA, 13 nt, Bordetella pertussis
ccagcgccgcggc

SEQ ID NO: 302254 - RNA, 14 nt, Bordetella pertussis
ccagcgccgcggcc

SEQ ID NO: 302255 - RNA, 15 nt, Bordetella pertussis
ccagcgccgcggccg

SEQ ID NO: 302256 - RNA, 20 nt, Bordetella pertussis
ccagcgccgcggccggcggc

SEQ ID NO: 302257 - RNA, 13 nt, Bordetella pertussis
ccagcgccggcac

SEQ ID NO: 302258 - RNA, 16 nt, Bordetella pertussis
ccagcgccggcagccc

SEQ ID NO: 302259 - RNA, 15 nt, Bordetella pertussis
ccagcgccggcgcgc

SEQ ID NO: 302260 - RNA, 16 nt, Bordetella pertussis
ccagcgccggcgcgcg

SEQ ID NO: 302261 - RNA, 19 nt, Bordetella pertussis
ccagcgccggggucagcgc

SEQ ID NO: 302262 - RNA, 14 nt, Bordetella pertussis
ccagcgccucgcgc

SEQ ID NO: 302263 - RNA, 21 nt, Bordetella pertussis
ccagcgccucgcgcucgagcg

SEQ ID NO: 302264 - RNA, 15 nt, Bordetella pertussis
ccagcgccucgucgc

SEQ ID NO: 302265 - RNA, 13 nt, Bordetella pertussis
ccagcgccugccg

SEQ ID NO: 302266 - RNA, 13 nt, Bordetella pertussis
ccagcgccugcgc

SEQ ID NO: 302267 - RNA, 16 nt, Bordetella pertussis
ccagcgccugcgcggc

SEQ ID NO: 302268 - RNA, 20 nt, Bordetella pertussis
ccagcgccuggcgggccugg

SEQ ID NO: 302269 - RNA, 19 nt, Bordetella pertussis
ccagcgccugggcgcggau

SEQ ID NO: 302270 - RNA, 21 nt, Bordetella pertussis
ccagcgcgaaaacccgcggca

SEQ ID NO: 302271 - RNA, 19 nt, Bordetella pertussis
ccagcgcgaaaugcccagc

SEQ ID NO: 302272 - RNA, 23 nt, Bordetella pertussis
ccagcgcgaaaugcccagcgagc

SEQ ID NO: 302273 - RNA, 21 nt, Bordetella pertussis
ccagcgcgaaguaccagcgca

SEQ ID NO: 302274 - RNA, 17 nt, Bordetella pertussis
ccagcgcgcgccggccg

SEQ ID NO: 302275 - RNA, 13 nt, Bordetella pertussis
ccagcgcgcgcga

SEQ ID NO: 302276 - RNA, 22 nt, Bordetella pertussis
ccagcgcgcgcgaggcggcggc

SEQ ID NO: 302277 - RNA, 20 nt, Bordetella pertussis
ccagcgcgaacgccugccag

SEQ ID NO: 302278 - RNA, 14 nt, Bordetella pertussis
ccagcgcgcggccg

SEQ ID NO: 302279 - RNA, 19 nt, Bordetella pertussis
ccagcgcgcggccggccgc

SEQ ID NO: 302280 - RNA, 13 nt, Bordetella pertussis
ccagcgcgcggcg

SEQ ID NO: 302281 - RNA, 22 nt, Bordetella pertussis
ccagcgcgcgggcgauggccac

SEQ ID NO: 302282 - RNA, 19 nt, Bordetella pertussis
ccagcgcggccacggccug

SEQ ID NO: 302283 - RNA, 20 nt, Bordetella pertussis
ccagcgcggccagcgcgucg

SEQ ID NO: 302284 - RNA, 17 nt, Bordetella pertussis
ccagcgcggccaggucg

SEQ ID NO: 302285 - RNA, 20 nt, Bordetella pertussis
ccagcgcggcaugccgcugc

SEQ ID NO: 302286 - RNA, 22 nt, Bordetella pertussis
ccagcgcgucggccagcgccgc

SEQ ID NO: 302287 - RNA, 18 nt, Bordetella pertussis
ccagcgcgucggccaggc

SEQ ID NO: 302288 - RNA, 19 nt, Bordetella pertussis
ccagcgcgucggccaggcg

SEQ ID NO: 302289 - RNA, 22 nt, Bordetella pertussis
ccagcgcgucgcguagcgcggc

SEQ ID NO: 302290 - RNA, 24 nt, Bordetella pertussis
ccagcgcgucgcguagcgcggccg

SEQ ID NO: 302291 - RNA, 14 nt, Bordetella pertussis
ccagcgcgucggcc

SEQ ID NO: 302292 - RNA, 16 nt, Bordetella pertussis
ccagcgcucgggcucg

SEQ ID NO: 302293 - RNA, 19 nt, Bordetella pertussis
ccagcgcucgggcucgcgc

SEQ ID NO: 302294 - RNA, 22 nt, Bordetella pertussis
ccagcgcucgggcucgcgcgcg

SEQ ID NO: 302295 - RNA, 18 nt, Bordetella pertussis
ccagcgcuguccaggccg

SEQ ID NO: 302296 - RNA, 17 nt, Bordetella pertussis
ccagcgcuucgggcagc

SEQ ID NO: 302297 - RNA, 23 nt, Bordetella pertussis
ccagcgcuucgggcagcucgcgc

SEQ ID NO: 302298 - RNA, 21 nt, Bordetella pertussis
ccagcgcuucgugcagcgcgu

SEQ ID NO: 302299 - RNA, 17 nt, Bordetella pertussis
ccagcgcuugcacgcca

SEQ ID NO: 302300 - RNA, 18 nt, Bordetella pertussis
ccagcgcuugcacgccau

SEQ ID NO: 302301 - RNA, 14 nt, Bordetella pertussis
ccaggccaccgcgg

SEQ ID NO: 302302 - RNA, 21 nt, Bordetella pertussis
ccaggccagcagcucggccac

SEQ ID NO: 302303 - RNA, 17 nt, Bordetella pertussis
ccaggccagccaggugc

SEQ ID NO: 302304 - RNA, 18 nt, Bordetella pertussis
ccaggccagcgccgcggc

SEQ ID NO: 302305 - RNA, 16 nt, Bordetella pertussis
ccaggccauggcgcga

SEQ ID NO: 302306 - RNA, 21 nt, Bordetella pertussis
ccaggcccaccgcaucgcgca

SEQ ID NO: 302307 - RNA, 16 nt, Bordetella pertussis
ccaggcccacgccgcg

SEQ ID NO: 302308 - RNA, 13 nt, Bordetella pertussis
ccaggcccagggc

SEQ ID NO: 302309 - RNA, 19 nt, Bordetella pertussis
ccaggcccaguucggcgcg

SEQ ID NO: 302310 - RNA, 21 nt, Bordetella pertussis
ccaggcccaguucggcgcgcg

SEQ ID NO: 302311 - RNA, 19 nt, Bordetella pertussis
ccaggcccaguugacgaug

SEQ ID NO: 302312 - RNA, 19 nt, Bordetella pertussis
ccaggcccauaugccgccg

SEQ ID NO: 302313 - RNA, 19 nt, Bordetella pertussis
ccaggcccaugccgcccgc

SEQ ID NO: 302314 - RNA, 22 nt, Bordetella pertussis
ccaggcccaugccgcccgccau

SEQ ID NO: 302315 - RNA, 15 nt, Bordetella pertussis
ccaggcccauggcgu

SEQ ID NO: 302316 - RNA, 20 nt, Bordetella pertussis
ccaggccccgccgggccgcg

SEQ ID NO: 302317 - RNA, 14 nt, Bordetella pertussis
ccaggcccgccagg

SEQ ID NO: 302318 - RNA, 16 nt, Bordetella pertussis
ccaggcccgccacggc

SEQ ID NO: 302319 - RNA, 15 nt, Bordetella pertussis
ccaggcccggcgcgc

SEQ ID NO: 302320 - RNA, 15 nt, Bordetella pertussis
ccaggcccucgcggc

SEQ ID NO: 302321 - RNA, 22 nt, Bordetella pertussis
ccaggcccuggcuggccagccg

SEQ ID NO: 302322 - RNA, 13 nt, Bordetella pertussis
ccaggccgaacgc

SEQ ID NO: 302323 - RNA, 21 nt, Bordetella pertussis
ccaggccgaacuucagcccgg

SEQ ID NO: 302324 - RNA, 19 nt, Bordetella pertussis
ccaggccgaagccaccguc

SEQ ID NO: 302325 - RNA, 22 nt, Bordetella pertussis
ccaggccgaugaauugcgccac

SEQ ID NO: 302326 - RNA, 23 nt, Bordetella pertussis
ccaggccgaugaauugcgccacg

SEQ ID NO: 302327 - RNA, 16 nt, Bordetella pertussis
ccaggccgaugccgaa

SEQ ID NO: 302328 - RNA, 14 nt, Bordetella pertussis
ccaggcgagcgccg

SEQ ID NO: 302329 - RNA, 21 nt, Bordetella pertussis
ccaggccgauuucggccgccg

SEQ ID NO: 302330 - RNA, 16 nt, Bordetella pertussis
ccaggcgaugcccagc

SEQ ID NO: 302331 - RNA, 23 nt, Bordetella pertussis
ccaggcgaugcccagcgccgccg

SEQ ID NO: 302332 - RNA, 15 nt, Bordetella pertussis
ccaggcgcagccgcg

SEQ ID NO: 302333 - RNA, 20 nt, Bordetella pertussis
ccaggcgcagccgcgcgccu

SEQ ID NO: 302334 - RNA, 15 nt, Bordetella pertussis
ccaggcgcaggcgcg

SEQ ID NO: 302335 - RNA, 16 nt, Bordetella pertussis
ccaggcgcaggcgcga

SEQ ID NO: 302336 - RNA, 21 nt, Bordetella pertussis
ccaggcgccccacccggguac

SEQ ID NO: 302337 - RNA, 16 nt, Bordetella pertussis
ccaggcgcccgccacc

SEQ ID NO: 302338 - RNA, 17 nt, Bordetella pertussis
ccaggcgcccgccacca

SEQ ID NO: 302339 - RNA, 12 nt, Bordetella pertussis
ccaggcgcccgg

SEQ ID NO: 302340 - RNA, 13 nt, Bordetella pertussis
ccaggcgccagcg

SEQ ID NO: 302341 - RNA, 17 nt, Bordetella pertussis
ccaggcgccgcacgccg

SEQ ID NO: 302342 - RNA, 13 nt, Bordetella pertussis
ccaggcggccacc

SEQ ID NO: 302343 - RNA, 15 nt, Bordetella pertussis
ccaggcggccaccac

SEQ ID NO: 302344 - RNA, 20 nt, Bordetella pertussis
ccaggcggccaccaccaggc

SEQ ID NO: 302345 - RNA, 14 nt, Bordetella pertussis
ccaggcggccgcgg

SEQ ID NO: 302346 - RNA, 15 nt, Bordetella pertussis
ccaggcggccgcgga

SEQ ID NO: 302347 - RNA, 12 nt, Bordetella pertussis
ccaggcgccgcg

SEQ ID NO: 302348 - RNA, 18 nt, Bordetella pertussis
ccaggcgccgcguccggc

SEQ ID NO: 302349 - RNA, 16 nt, Bordetella pertussis
ccaggcggcgcucgaa

SEQ ID NO: 302350 - RNA, 20 nt, Bordetella pertussis
ccaggcgguacaggccggcg

SEQ ID NO: 302351 - RNA, 22 nt, Bordetella pertussis
ccaggcgguacaggccggcggc

SEQ ID NO: 302352 - RNA, 16 nt, Bordetella pertussis
ccaggcgggcgugcug

SEQ ID NO: 302353 - RNA, 18 nt, Bordetella pertussis
ccaggcggugcguccagg

SEQ ID NO: 302354 - RNA, 16 nt, Bordetella pertussis
ccaggcgguuggccuu

SEQ ID NO: 302355 - RNA, 19 nt, Bordetella pertussis
ccaggcguccaggcugccg

SEQ ID NO: 302356 - RNA, 18 nt, Bordetella pertussis
ccaggcgugaacgccccg

SEQ ID NO: 302357 - RNA, 19 nt, Bordetella pertussis
ccaggcgugaacgccccgg

SEQ ID NO: 302358 - RNA, 20 nt, Bordetella pertussis
ccaggcgugaacgccccggc

SEQ ID NO: 302359 - RNA, 22 nt, Bordetella pertussis
ccaggcgugaacgccccggccg

SEQ ID NO: 302360 - RNA, 14 nt, Bordetella pertussis
ccaggcgucggcgg

SEQ ID NO: 302361 - RNA, 22 nt, Bordetella pertussis
ccaggcuggagucgggcugcug

SEQ ID NO: 302362 - RNA, 23 nt, Bordetella pertussis
ccaggcuggggccgagcgugccg

SEQ ID NO: 302363 - RNA, 22 nt, Bordetella pertussis
ccaggcugucccagauggcgcc

SEQ ID NO: 302364 - RNA, 17 nt, Bordetella pertussis
ccaggcuuugcgcgcca

SEQ ID NO: 302365 - RNA, 21 nt, Bordetella pertussis
ccaggcuuugcgcgccaugca

SEQ ID NO: 302366 - RNA, 18 nt, Bordetella pertussis
ccagggaaggggcggcuu

SEQ ID NO: 302367 - RNA, 16 nt, Bordetella pertussis
ccagggaccaauacgc

SEQ ID NO: 302368 - RNA, 21 nt, Bordetella pertussis
ccagggaggaacugggcgccg

SEQ ID NO: 302369 - RNA, 18 nt, Bordetella pertussis
ccagggcuugacgcgcgu

SEQ ID NO: 302370 - RNA, 22 nt, Bordetella pertussis
ccagggcuugcggcgcuggcug

SEQ ID NO: 302371 - RNA, 24 nt, Bordetella pertussis
ccaggggccggcgcgccgcgccgc

SEQ ID NO: 302372 - RNA, 16 nt, Bordetella pertussis
ccaggggcgcuggucg

SEQ ID NO: 302373 - RNA, 17 nt, Bordetella pertussis
ccaggggcggcgcggcg

SEQ ID NO: 302374 - RNA, 20 nt, Bordetella pertussis
ccagggggucagggccgccc

SEQ ID NO: 302375 - RNA, 14 nt, Bordetella pertussis
ccagggucaggggc

SEQ ID NO: 302376 - RNA, 17 nt, Bordetella pertussis
ccagggucugcuggucg

SEQ ID NO: 302377 - RNA, 18 nt, Bordetella pertussis
ccaggguggcgccggcca

SEQ ID NO: 302378 - RNA, 14 nt, Bordetella pertussis
ccaggguguccugg

SEQ ID NO: 302379 - RNA, 14 nt, Bordetella pertussis
ccagguccuggcgg

SEQ ID NO: 302380 - RNA, 23 nt, Bordetella pertussis
ccagguccuggcggccgcccagc

SEQ ID NO: 302381 - RNA, 24 nt, Bordetella pertussis
ccagguccuggcggccgcccagca

SEQ ID NO: 302382 - RNA, 20 nt, Bordetella pertussis
ccagguccuugagguaccac

SEQ ID NO: 302383 - RNA, 15 nt, Bordetella pertussis
ccagguccugcgcca

SEQ ID NO: 302384 - RNA, 21 nt, Bordetella pertussis
ccaggucguugcgcgaagcgg

SEQ ID NO: 302385 - RNA, 18 nt, Bordetella pertussis
ccaggucuacccgcgcga

SEQ ID NO: 302386 - RNA, 15 nt, Bordetella pertussis
ccaggugcgcaugua

SEQ ID NO: 302387 - RNA, 14 nt, Bordetella pertussis
ccaggugcgggccg

SEQ ID NO: 302388 - RNA, 17 nt, Bordetella pertussis
ccagguugcggccgcca

SEQ ID NO: 302389 - RNA, 19 nt, Bordetella pertussis
ccagguugcggccgccacc

SEQ ID NO: 302390 - RNA, 22 nt, Bordetella pertussis
ccagguugggugcgccgccggc

SEQ ID NO: 302391 - RNA, 16 nt, Bordetella pertussis
ccagguugucgcgcga

SEQ ID NO: 302392 - RNA, 14 nt, Bordetella pertussis
ccagguugucggcg

SEQ ID NO: 302393 - RNA, 19 nt, Bordetella pertussis
ccagguugucggcgccaca

SEQ ID NO: 302394 - RNA, 22 nt, Bordetella pertussis
ccagguugugguucaugacguc

SEQ ID NO: 302395 - RNA, 14 nt, Bordetella pertussis
ccaguaggcgcccc

SEQ ID NO: 302396 - RNA, 23 nt, Bordetella pertussis
ccaguaucguuuucgcgaccugc

SEQ ID NO: 302397 - RNA, 17 nt, Bordetella pertussis
ccaguccaggccggccu

SEQ ID NO: 302398 - RNA, 14 nt, Bordetella pertussis
ccaguccagggugu

SEQ ID NO: 302399 - RNA, 23 nt, Bordetella pertussis
ccaguccaggguguccuggucgg

SEQ ID NO: 302400 - RNA, 17 nt, Bordetella pertussis
ccaguccagcgucggcg

SEQ ID NO: 302401 - RNA, 20 nt, Bordetella pertussis
ccaguccccauguggggaca

SEQ ID NO: 302402 - RNA, 21 nt, Bordetella pertussis
ccaguccccauguggggacag

SEQ ID NO: 302403 - RNA, 19 nt, Bordetella pertussis
ccagucccccgcggggaca

SEQ ID NO: 302404 - RNA, 20 nt, Bordetella pertussis
ccagucccccgcggggacag

SEQ ID NO: 302405 - RNA, 18 nt, Bordetella pertussis
ccaguccccgcagggaca

SEQ ID NO: 302406 - RNA, 21 nt, Bordetella pertussis
ccaguccccgcauggggacug

SEQ ID NO: 302407 - RNA, 18 nt, Bordetella pertussis
ccaguccccgcggggaca

SEQ ID NO: 302408 - RNA, 21 nt, Bordetella pertussis
ccaguccccguucggggacag

SEQ ID NO: 302409 - RNA, 19 nt, Bordetella pertussis
ccaguccccugcggggaca

SEQ ID NO: 302410 - RNA, 20 nt, Bordetella pertussis
ccaguccccugcggggacag

SEQ ID NO: 302411 - RNA, 24 nt, Bordetella pertussis
ccaguccccugcggggacaggcac

SEQ ID NO: 302412 - RNA, 16 nt, Bordetella pertussis
ccagucccgcaccggg

SEQ ID NO: 302413 - RNA, 16 nt, Bordetella pertussis
ccagucuggauggcgu

SEQ ID NO: 302414 - RNA, 22 nt, Bordetella pertussis
ccagugaaacgcgacgcgccgg

SEQ ID NO: 302415 - RNA, 23 nt, Bordetella pertussis
ccagugaaacgcgacgcgccgga

SEQ ID NO: 302416 - RNA, 17 nt, Bordetella pertussis
ccagugccuggacgcgc

SEQ ID NO: 302417 - RNA, 18 nt, Bordetella pertussis
ccagugccuggacgcgcu

SEQ ID NO: 302418 - RNA, 20 nt, Bordetella pertussis
ccagugccuggacgcgcugg

SEQ ID NO: 302419 - RNA, 22 nt, Bordetella pertussis
ccagugcgccggcggcggucag

SEQ ID NO: 302420 - RNA, 22 nt, Bordetella pertussis
ccaguggcgcggcgucgaaggc

SEQ ID NO: 302421 - RNA, 17 nt, Bordetella pertussis
ccaguggugcucccagg

SEQ ID NO: 302422 - RNA, 17 nt, Bordetella pertussis
ccaguuccacgcggccg

SEQ ID NO: 302423 - RNA, 24 nt, Bordetella pertussis
ccaguuccagcacgacgacggccg

SEQ ID NO: 302424 - RNA, 18 nt, Bordetella pertussis
ccaguuccgugcgcgccc

SEQ ID NO: 302425 - RNA, 16 nt, Bordetella pertussis
ccaguucgacgcccau

SEQ ID NO: 302426 - RNA, 15 nt, Bordetella pertussis
ccaguucgcgcagca

SEQ ID NO: 302427 - RNA, 16 nt, Bordetella pertussis
ccaguucgcggccggc

SEQ ID NO: 302428 - RNA, 20 nt, Bordetella pertussis
ccaguucgcggccggccggg

SEQ ID NO: 302429 - RNA, 13 nt, Bordetella pertussis
ccaguucgcggcg

SEQ ID NO: 302430 - RNA, 17 nt, Bordetella pertussis
ccaguucggccgccagg

SEQ ID NO: 302431 - RNA, 17 nt, Bordetella pertussis
ccaguucggcgcgcgug

SEQ ID NO: 302432 - RNA, 23 nt, Bordetella pertussis
ccaguugagaaugcccaggaugc

SEQ ID NO: 302433 - RNA, 19 nt, Bordetella pertussis
ccaguugccgccgccggcg

SEQ ID NO: 302434 - RNA, 15 nt, Bordetella pertussis
ccaguugcgcgccgu

SEQ ID NO: 302435 - RNA, 21 nt, Bordetella pertussis
ccaguuuucucauggccgcgc

SEQ ID NO: 302436 - RNA, 19 nt, Bordetella pertussis
ccauacaacgaguaccugc

SEQ ID NO: 302437 - RNA, 20 nt, Bordetella pertussis
ccauacaacgaguaccugcu

SEQ ID NO: 302438 - RNA, 15 nt, Bordetella pertussis
ccauaccagcccggc

SEQ ID NO: 302439 - RNA, 14 nt, Bordetella pertussis
ccauacugcaugau

SEQ ID NO: 302440 - RNA, 16 nt, Bordetella pertussis
ccauagcugcgccaau

SEQ ID NO: 302441 - RNA, 17 nt, Bordetella pertussis
ccauaggcgcgcaccag

SEQ ID NO: 302442 - RNA, 18 nt, Bordetella pertussis
ccauaggcgcgcaccagc

SEQ ID NO: 302443 - RNA, 13 nt, Bordetella pertussis
ccauaucuggcaa

SEQ ID NO: 302444 - RNA, 14 nt, Bordetella pertussis
ccauaugcgcgaag

SEQ ID NO: 302445 - RNA, 23 nt, Bordetella pertussis
ccaucaacgggccgcuggucacc

SEQ ID NO: 302446 - RNA, 15 nt, Bordetella pertussis
ccaucacgagcaggu

SEQ ID NO: 302447 - RNA, 18 nt, Bordetella pertussis
ccaucacgagcagguugg

SEQ ID NO: 302448 - RNA, 22 nt, Bordetella pertussis
ccaucagcucgaccacggcggc

SEQ ID NO: 302449 - RNA, 18 nt, Bordetella pertussis
ccaucaggaacggcaugg

SEQ ID NO: 302450 - RNA, 19 nt, Bordetella pertussis
ccaucaucagcauggcgug

SEQ ID NO: 302451 - RNA, 20 nt, Bordetella pertussis
ccaucauccuggucgacgcg

SEQ ID NO: 302452 - RNA, 12 nt, Bordetella pertussis
ccaucaucgcga

SEQ ID NO: 302453 - RNA, 17 nt, Bordetella pertussis
ccaucaucugcggcacc

SEQ ID NO: 302454 - RNA, 16 nt, Bordetella pertussis
ccauccagccaggccg

SEQ ID NO: 302455 - RNA, 21 nt, Bordetella pertussis
ccauccagcggacgggccagg

SEQ ID NO: 302456 - RNA, 18 nt, Bordetella pertussis
ccauccagguacgaccac

SEQ ID NO: 302457 - RNA, 17 nt, Bordetella pertussis
ccaucccauccgcgcca

SEQ ID NO: 302458 - RNA, 13 nt, Bordetella pertussis
ccauccgcgccac

SEQ ID NO: 302459 - RNA, 15 nt, Bordetella pertussis
ccauccucgcccagc

SEQ ID NO: 302460 - RNA, 13 nt, Bordetella pertussis
ccauccuggccga

SEQ ID NO: 302461 - RNA, 22 nt, Bordetella pertussis
ccauccuggccgauuucgcgcg

SEQ ID NO: 302462 - RNA, 14 nt, Bordetella pertussis
ccauccuggccgcc

SEQ ID NO: 302463 - RNA, 14 nt, Bordetella pertussis
ccaucgacaagcgc

SEQ ID NO: 302464 - RNA, 18 nt, Bordetella pertussis
ccaucgauaugggcggcc

SEQ ID NO: 302465 - RNA, 14 nt, Bordetella pertussis
ccaucgccgccacg

SEQ ID NO: 302466 - RNA, 15 nt, Bordetella pertussis
ccaucgccgccgccg

SEQ ID NO: 302467 - RNA, 14 nt, Bordetella pertussis
ccaucgcgcacuug

SEQ ID NO: 302468 - RNA, 19 nt, Bordetella pertussis
ccaucgcggucaucggcga

SEQ ID NO: 302469 - RNA, 14 nt, Bordetella pertussis
ccaucgcguccagg

SEQ ID NO: 302470 - RNA, 19 nt, Bordetella pertussis
ccaucgcguccaggcccag

SEQ ID NO: 302471 - RNA, 23 nt, Bordetella pertussis
ccaucgcgucgacggugcgcgcc

SEQ ID NO: 302472 - RNA, 15 nt, Bordetella pertussis
ccaucgcgugcagcg

SEQ ID NO: 302473 - RNA, 19 nt, Bordetella pertussis
ccaucgcgugcagcgacuu

SEQ ID NO: 302474 - RNA, 13 nt, Bordetella pertussis
ccaucggcgcgcg

SEQ ID NO: 302475 - RNA, 15 nt, Bordetella pertussis
ccaucguacgcgugg

SEQ ID NO: 302476 - RNA, 21 nt, Bordetella pertussis
ccaucguugccugggugcugg

SEQ ID NO: 302477 - RNA, 15 nt, Bordetella pertussis
ccaucuacgugcugg

SEQ ID NO: 302478 - RNA, 12 nt, Bordetella pertussis
ccaucucgcgcg

SEQ ID NO: 302479 - RNA, 17 nt, Bordetella pertussis
ccaucuggaccgcgcgc

SEQ ID NO: 302480 - RNA, 12 nt, Bordetella pertussis
ccaucuggcccg

SEQ ID NO: 302481 - RNA, 16 nt, Bordetella pertussis
ccaucuguacggccgg

SEQ ID NO: 302482 - RNA, 17 nt, Bordetella pertussis
ccaucuguucggcgccg

SEQ ID NO: 302483 - RNA, 17 nt, Bordetella pertussis
ccaugaaagcgaacagg

SEQ ID NO: 302484 - RNA, 21 nt, Bordetella pertussis
ccaugaacucgcgcucggcga

SEQ ID NO: 302485 - RNA, 18 nt, Bordetella pertussis
ccaugaacuuggcaucca

SEQ ID NO: 302486 - RNA, 14 nt, Bordetella pertussis
ccaugaaggcggcc

SEQ ID NO: 302487 - RNA, 15 nt, Bordetella pertussis
ccaugaaggcggcca

SEQ ID NO: 302488 - RNA, 21 nt, Bordetella pertussis
ccaugacgggaauccgcugcg

SEQ ID NO: 302489 - RNA, 17 nt, Bordetella pertussis
ccaugacguccagcgcc

SEQ ID NO: 302490 - RNA, 19 nt, Bordetella pertussis
ccaugacguccagcgccac

SEQ ID NO: 302491 - RNA, 15 nt, Bordetella pertussis
ccaugacgaccuugc

SEQ ID NO: 302492 - RNA, 17 nt, Bordetella pertussis
ccaugauacccauggcc

SEQ ID NO: 302493 - RNA, 17 nt, Bordetella pertussis
ccaugauuuccaucgac

SEQ ID NO: 302494 - RNA, 23 nt, Bordetella pertussis
ccaugauuuccaucgacuuggcc

SEQ ID NO: 302495 - RNA, 14 nt, Bordetella pertussis
ccaugcaccagcac

SEQ ID NO: 302496 - RNA, 12 nt, Bordetella pertussis
ccaugcagcugg

SEQ ID NO: 302497 - RNA, 14 nt, Bordetella pertussis
ccaugcccaggccc

SEQ ID NO: 302498 - RNA, 18 nt, Bordetella pertussis
ccaugcccaggcccaguu

SEQ ID NO: 302499 - RNA, 22 nt, Bordetella pertussis
ccaugccgacggauucgcccag

SEQ ID NO: 302500 - RNA, 12 nt, Bordetella pertussis
ccaugccgccau

SEQ ID NO: 302501 - RNA, 14 nt, Bordetella pertussis
ccaugccgcgcccg

SEQ ID NO: 302502 - RNA, 14 nt, Bordetella pertussis
ccaugccgcgcgcc

SEQ ID NO: 302503 - RNA, 15 nt, Bordetella pertussis
ccaugccgcgcgccu

SEQ ID NO: 302504 - RNA, 23 nt, Bordetella pertussis
ccaugccgcggacccaggccucg

SEQ ID NO: 302505 - RNA, 22 nt, Bordetella pertussis
ccaugccgcgggcggcgccggc

SEQ ID NO: 302506 - RNA, 20 nt, Bordetella pertussis
ccaugccggccaugcucagc

SEQ ID NO: 302507 - RNA, 14 nt, Bordetella pertussis
ccaugccgggaugg

SEQ ID NO: 302508 - RNA, 15 nt, Bordetella pertussis
ccaugccgucgcgca

SEQ ID NO: 302509 - RNA, 15 nt, Bordetella pertussis
ccaugccgucuggcg

SEQ ID NO: 302510 - RNA, 17 nt, Bordetella pertussis
ccaugcgaaagcggcca

SEQ ID NO: 302511 - RNA, 19 nt, Bordetella pertussis
ccaugcgaaagcggccagc

SEQ ID NO: 302512 - RNA, 20 nt, Bordetella pertussis
ccaugcugaauugcgggccg

SEQ ID NO: 302513 - RNA, 21 nt, Bordetella pertussis
ccaugcugaauugcgggccgg

SEQ ID NO: 302514 - RNA, 23 nt, Bordetella pertussis
ccaugccuugcgcgacagcaggc

SEQ ID NO: 302515 - RNA, 12 nt, Bordetella pertussis
ccaugcugccaa

SEQ ID NO: 302516 - RNA, 21 nt, Bordetella pertussis
ccaugcuggccgccgcgcuca

SEQ ID NO: 302517 - RNA, 21 nt, Bordetella pertussis
ccaugcugggccaucagguug

SEQ ID NO: 302518 - RNA, 13 nt, Bordetella pertussis
ccauggaagcggu

SEQ ID NO: 302519 - RNA, 22 nt, Bordetella pertussis
ccauggacgagggccggcgcca

SEQ ID NO: 302520 - RNA, 14 nt, Bordetella pertussis
ccauggacgccggu

SEQ ID NO: 302521 - RNA, 21 nt, Bordetella pertussis
ccauggaggcgcagcgcggca

SEQ ID NO: 302522 - RNA, 21 nt, Bordetella pertussis
ccauggcacaggccaucggcg

SEQ ID NO: 302523 - RNA, 14 nt, Bordetella pertussis
ccauggcagggcgc

SEQ ID NO: 302524 - RNA, 21 nt, Bordetella pertussis
ccauggcaguacguacgcccg

SEQ ID NO: 302525 - RNA, 22 nt, Bordetella pertussis
ccauggcaguacguacgcccgg

SEQ ID NO: 302526 - RNA, 14 nt, Bordetella pertussis
ccauggaugcgcgc

SEQ ID NO: 302527 - RNA, 21 nt, Bordetella pertussis
ccauggccgugcgcccgacgc

SEQ ID NO: 302528 - RNA, 21 nt, Bordetella pertussis
ccauggccugcaaccugguca

SEQ ID NO: 302529 - RNA, 22 nt, Bordetella pertussis
ccauggccugcaaccuggucaa

SEQ ID NO: 302530 - RNA, 22 nt, Bordetella pertussis
ccauggcgcgauccuucgcggc

SEQ ID NO: 302531 - RNA, 14 nt, Bordetella pertussis
ccauggcgcgcagc

SEQ ID NO: 302532 - RNA, 15 nt, Bordetella pertussis
ccauggcggccgccg

SEQ ID NO: 302533 - RNA, 16 nt, Bordetella pertussis
ccauggcggccgccgc

SEQ ID NO: 302534 - RNA, 14 nt, Bordetella pertussis
ccauggcggccggc

SEQ ID NO: 302535 - RNA, 21 nt, Bordetella pertussis
ccauggcgcuguuggccggcg

SEQ ID NO: 302536 - RNA, 22 nt, Bordetella pertussis
ccauggcggggaauucgaccgg

SEQ ID NO: 302537 - RNA, 17 nt, Bordetella pertussis
ccauggcguaggccucg

SEQ ID NO: 302538 - RNA, 21 nt, Bordetella pertussis
ccaugggacgacuucgacggc

SEQ ID NO: 302539 - RNA, 12 nt, Bordetella pertussis
ccaugggcgucg

SEQ ID NO: 302540 - RNA, 21 nt, Bordetella pertussis
ccaugggcucgugcagcaggg

SEQ ID NO: 302541 - RNA, 18 nt, Bordetella pertussis
ccauggggugcuccugcc

SEQ ID NO: 302542 - RNA, 19 nt, Bordetella pertussis
ccauggggugcuccugcca

SEQ ID NO: 302543 - RNA, 12 nt, Bordetella pertussis
ccauggucgcga

SEQ ID NO: 302544 - RNA, 18 nt, Bordetella pertussis
ccauggugaacggccccg

SEQ ID NO: 302545 - RNA, 18 nt, Bordetella pertussis
ccauggugggcaggucgg

SEQ ID NO: 302546 - RNA, 16 nt, Bordetella pertussis
ccauguccgcgcccau

SEQ ID NO: 302547 - RNA, 14 nt, Bordetella pertussis
ccaugugcgccgcg

SEQ ID NO: 302548 - RNA, 23 nt, Bordetella pertussis
ccaugugcgccgcgccguacagg

SEQ ID NO: 302549 - RNA, 20 nt, Bordetella pertussis
ccaugugcguugccagccca

SEQ ID NO: 302550 - RNA, 15 nt, Bordetella pertussis
ccauguggcagaugg

SEQ ID NO: 302551 - RNA, 15 nt, Bordetella pertussis
ccauguggccagcuc

SEQ ID NO: 302552 - RNA, 19 nt, Bordetella pertussis
ccauguggcgacgcccagc

SEQ ID NO: 302553 - RNA, 22 nt, Bordetella pertussis
ccauguugaacugcaggccgcc

SEQ ID NO: 302554 - RNA, 15 nt, Bordetella pertussis
ccauguggggacagg

SEQ ID NO: 302555 - RNA, 20 nt, Bordetella pertussis
cccaauccgaucagcacgau

SEQ ID NO: 302556 - RNA, 14 nt, Bordetella pertussis
cccaauuggccgcc

SEQ ID NO: 302557 - RNA, 18 nt, Bordetella pertussis
cccacacuuggccggcga

SEQ ID NO: 302558 - RNA, 19 nt, Bordetella pertussis
cccacacuuggccggcgau

SEQ ID NO: 302559 - RNA, 21 nt, Bordetella pertussis
cccacagcagcgcgccgccga

SEQ ID NO: 302560 - RNA, 12 nt, Bordetella pertussis
cccacaggcgcg

SEQ ID NO: 302561 - RNA, 17 nt, Bordetella pertussis
cccacagggggacuggc

SEQ ID NO: 302562 - RNA, 19 nt, Bordetella pertussis
cccacagggggacuggcac

SEQ ID NO: 302563 - RNA, 18 nt, Bordetella pertussis
cccacagguuggccgcga

SEQ ID NO: 302564 - RNA, 20 nt, Bordetella pertussis
cccacagguuggccgcgacg

SEQ ID NO: 302565 - RNA, 16 nt, Bordetella pertussis
cccacauagcggccgg

SEQ ID NO: 302566 - RNA, 13 nt, Bordetella pertussis
cccaccggugcgg

SEQ ID NO: 302567 - RNA, 19 nt, Bordetella pertussis
cccaccuggcggugcgccg

SEQ ID NO: 302568 - RNA, 14 nt, Bordetella pertussis
cccaccuugcgcgc

SEQ ID NO: 302569 - RNA, 15 nt, Bordetella pertussis
cccacgaacgccacg

SEQ ID NO: 302570 - RNA, 20 nt, Bordetella pertussis
cccacgaucaccacgcccgc

SEQ ID NO: 302571 - RNA, 13 nt, Bordetella pertussis
cccacucaugcgc

SEQ ID NO: 302572 - RNA, 21 nt, Bordetella pertussis
cccacucggugcgcgcgccca

SEQ ID NO: 302573 - RNA, 16 nt, Bordetella pertussis
cccacuggaucgccga

SEQ ID NO: 302574 - RNA, 22 nt, Bordetella pertussis
cccacuggggacaugcaugaac

SEQ ID NO: 302575 - RNA, 17 nt, Bordetella pertussis
cccagaacccggccggc

SEQ ID NO: 302576 - RNA, 14 nt, Bordetella pertussis
cccagauccgcaag

SEQ ID NO: 302577 - RNA, 20 nt, Bordetella pertussis
cccagaaacuggcgcugccg

SEQ ID NO: 302578 - RNA, 14 nt, Bordetella pertussis
cccagaucgccugg

SEQ ID NO: 302579 - RNA, 18 nt, Bordetella pertussis
cccagaucugccgcaaug

SEQ ID NO: 302580 - RNA, 13 nt, Bordetella pertussis
cccagauggcgcc

SEQ ID NO: 302581 - RNA, 21 nt, Bordetella pertussis
cccagcaauuaugcguggccg

SEQ ID NO: 302582 - RNA, 22 nt, Bordetella pertussis
cccagcaauuaugcguggccgc

SEQ ID NO: 302583 - RNA, 22 nt, Bordetella pertussis
cccagcaauucguugaucuggc

SEQ ID NO: 302584 - RNA, 19 nt, Bordetella pertussis
cccagcacauagcgcaagc

SEQ ID NO: 302585 - RNA, 12 nt, Bordetella pertussis
cccagcaccacg

SEQ ID NO: 302586 - RNA, 19 nt, Bordetella pertussis
cccagcaccugcaggccgc

SEQ ID NO: 302587 - RNA, 18 nt, Bordetella pertussis
cccagccaaugccgcggu

SEQ ID NO: 302588 - RNA, 15 nt, Bordetella pertussis
cccagccaggcgcca

SEQ ID NO: 302589 - RNA, 16 nt, Bordetella pertussis
cccagccccgcggccg

SEQ ID NO: 302590 - RNA, 15 nt, Bordetella pertussis
cccagcccugcccgc

SEQ ID NO: 302591 - RNA, 13 nt, Bordetella pertussis
cccagccgcaugc

SEQ ID NO: 302592 - RNA, 13 nt, Bordetella pertussis
cccagccgccuga

SEQ ID NO: 302593 - RNA, 16 nt, Bordetella pertussis
cccagccgccugagca

SEQ ID NO: 302594 - RNA, 20 nt, Bordetella pertussis
cccagccgcucggccacgcg

SEQ ID NO: 302595 - RNA, 20 nt, Bordetella pertussis
cccagccggacccgcgccgc

SEQ ID NO: 302596 - RNA, 21 nt, Bordetella pertussis
cccagccggacccgcgccgca

SEQ ID NO: 302597 - RNA, 21 nt, Bordetella pertussis
cccagccggcggcaugcgcca

SEQ ID NO: 302598 - RNA, 23 nt, Bordetella pertussis
cccagccggcggcaugcgccagc

SEQ ID NO: 302599 - RNA, 13 nt, Bordetella pertussis
cccagccgucgcg

SEQ ID NO: 302600 - RNA, 13 nt, Bordetella pertussis
cccagccugccgg

SEQ ID NO: 302601 - RNA, 18 nt, Bordetella pertussis
cccagcgagcuggugaug

SEQ ID NO: 302602 - RNA, 20 nt, Bordetella pertussis
cccagcgcauagacccacag

SEQ ID NO: 302603 - RNA, 15 nt, Bordetella pertussis
cccagcgccagcagc

SEQ ID NO: 302604 - RNA, 14 nt, Bordetella pertussis
cccagcgcccaggc

SEQ ID NO: 302605 - RNA, 20 nt, Bordetella pertussis
cccagcgccgccauggcggc

SEQ ID NO: 302606 - RNA, 12 nt, Bordetella pertussis
cccagcgccgcg

SEQ ID NO: 302607 - RNA, 13 nt, Bordetella pertussis
cccagcgccgcga

SEQ ID NO: 302608 - RNA, 18 nt, Bordetella pertussis
cccagcgccggcacgcug

SEQ ID NO: 302609 - RNA, 18 nt, Bordetella pertussis
cccagcgccgucagcagc

SEQ ID NO: 302610 - RNA, 13 nt, Bordetella pertussis
cccagcgccgcca

SEQ ID NO: 302611 - RNA, 17 nt, Bordetella pertussis
cccaggaaaccgaccug

SEQ ID NO: 302612 - RNA, 17 nt, Bordetella pertussis
cccaggaaaucaggcgc

SEQ ID NO: 302613 - RNA, 21 nt, Bordetella pertussis
cccaggaacuugaacggcgcg

SEQ ID NO: 302614 - RNA, 20 nt, Bordetella pertussis
cccaggaugcccuuggcggc

SEQ ID NO: 302615 - RNA, 16 nt, Bordetella pertussis
cccaggaugcgcaccg

SEQ ID NO: 302616 - RNA, 18 nt, Bordetella pertussis
cccaggaugcgcaccggc

SEQ ID NO: 302617 - RNA, 17 nt, Bordetella pertussis
cccaggauggcgccagc

SEQ ID NO: 302618 - RNA, 20 nt, Bordetella pertussis
cccaggagcaacuggggcgc

SEQ ID NO: 302619 - RNA, 14 nt, Bordetella pertussis
cccaggaucaccgc

SEQ ID NO: 302620 - RNA, 19 nt, Bordetella pertussis
cccaggaucaccgccgcgc

SEQ ID NO: 302621 - RNA, 21 nt, Bordetella pertussis
cccaggaucaccgccgcgccg

SEQ ID NO: 302622 - RNA, 22 nt, Bordetella pertussis
cccaggaucaccgccgcgccgc

SEQ ID NO: 302623 - RNA, 17 nt, Bordetella pertussis
cccaggcaaugcgcagg

SEQ ID NO: 302624 - RNA, 23 nt, Bordetella pertussis
cccaggcaggcgggcccgcaucg

SEQ ID NO: 302625 - RNA, 21 nt, Bordetella pertussis
cccaggccagcgccgcggccg

SEQ ID NO: 302626 - RNA, 17 nt, Bordetella pertussis
cccaggcccaccgcauc

SEQ ID NO: 302627 - RNA, 18 nt, Bordetella pertussis
cccaggcccaccgcaucg

SEQ ID NO: 302628 - RNA, 14 nt, Bordetella pertussis
cccaggcccggccg

SEQ ID NO: 302629 - RNA, 19 nt, Bordetella pertussis
cccaggccgaaccacagca

SEQ ID NO: 302630 - RNA, 23 nt, Bordetella pertussis
cccaggccgcuuucgaccagcga

SEQ ID NO: 302631 - RNA, 14 nt, Bordetella pertussis
cccaggccggcgcg

SEQ ID NO: 302632 - RNA, 15 nt, Bordetella pertussis
cccaggccggcgcgc

SEQ ID NO: 302633 - RNA, 22 nt, Bordetella pertussis
cccaggccgggcgagccgaacg

SEQ ID NO: 302634 - RNA, 20 nt, Bordetella pertussis
cccaggcgacccagcaccga

SEQ ID NO: 302635 - RNA, 18 nt, Bordetella pertussis
cccaggcgaggcuggcgc

SEQ ID NO: 302636 - RNA, 22 nt, Bordetella pertussis
cccaggcgaggcuggcgcccac

SEQ ID NO: 302637 - RNA, 15 nt, Bordetella pertussis
cccaggccguggcgc

SEQ ID NO: 302638 - RNA, 21 nt, Bordetella pertussis
cccaggcgaugcccagcgccg

SEQ ID NO: 302639 - RNA, 13 nt, Bordetella pertussis
cccaggcgcagcc

SEQ ID NO: 302640 - RNA, 15 nt, Bordetella pertussis
cccaggcgcagccgc

SEQ ID NO: 302641 - RNA, 17 nt, Bordetella pertussis
cccaggcgcagccgcgc

SEQ ID NO: 302642 - RNA, 14 nt, Bordetella pertussis
cccaggcgcgcugg

SEQ ID NO: 302643 - RNA, 21 nt, Bordetella pertussis
cccaggcgcguuucggucagg

SEQ ID NO: 302644 - RNA, 14 nt, Bordetella pertussis
cccaggcgcucagc

SEQ ID NO: 302645 - RNA, 16 nt, Bordetella pertussis
cccaggcggcaggcgc

SEQ ID NO: 302646 - RNA, 16 nt, Bordetella pertussis
cccaggcggcccagcg

SEQ ID NO: 302647 - RNA, 14 nt, Bordetella pertussis
cccaggcgucggcg

SEQ ID NO: 302648 - RNA, 20 nt, Bordetella pertussis
ccccacgccgaugccgcgca

SEQ ID NO: 302649 - RNA, 12 nt, Bordetella pertussis
ccccacgccgcc

SEQ ID NO: 302650 - RNA, 12 nt, Bordetella pertussis
ccccacgccgcu

SEQ ID NO: 302651 - RNA, 13 nt, Bordetella pertussis
ccccagagcaccg

SEQ ID NO: 302652 - RNA, 22 nt, Bordetella pertussis
ccccagagcaccgagaccgggc

SEQ ID NO: 302653 - RNA, 15 nt, Bordetella pertussis
ccccagaugccgguc

SEQ ID NO: 302654 - RNA, 12 nt, Bordetella pertussis
ccccagcacgaa

SEQ ID NO: 302655 - RNA, 12 nt, Bordetella pertussis
ccccagcagcag

SEQ ID NO: 302656 - RNA, 14 nt, Bordetella pertussis
ccccagggcgcgcc

SEQ ID NO: 302657 - RNA, 21 nt, Bordetella pertussis
ccccagucgcugcucgacagc

SEQ ID NO: 302658 - RNA, 15 nt, Bordetella pertussis
cccccaugcggggac

SEQ ID NO: 302659 - RNA, 12 nt, Bordetella pertussis
cccccgcgccgc

SEQ ID NO: 302660 - RNA, 14 nt, Bordetella pertussis
cccccgcgccgcgc

SEQ ID NO: 302661 - RNA, 15 nt, Bordetella pertussis
cccccgcggcgcccc

SEQ ID NO: 302662 - RNA, 12 nt, Bordetella pertussis
cccccggcccgc

SEQ ID NO: 302663 - RNA, 21 nt, Bordetella pertussis
cccccguaggcggcccaggcg

SEQ ID NO: 302664 - RNA, 23 nt, Bordetella pertussis
cccccuacgaauccccgcucagg

SEQ ID NO: 302665 - RNA, 12 nt, Bordetella pertussis
cccccucggccu

SEQ ID NO: 302666 - RNA, 16 nt, Bordetella pertussis
cccccugaccggcggc

SEQ ID NO: 302667 - RNA, 19 nt, Bordetella pertussis
ccccgaaacucaccgccgc

SEQ ID NO: 302668 - RNA, 20 nt, Bordetella pertussis
ccccgaacggggacuggcac

SEQ ID NO: 302669 - RNA, 18 nt, Bordetella pertussis
ccccgagauaggcggcca

SEQ ID NO: 302670 - RNA, 20 nt, Bordetella pertussis
ccccgagauaggcggccagg

SEQ ID NO: 302671 - RNA, 23 nt, Bordetella pertussis
ccccgcggaggugucgccgccca

SEQ ID NO: 302672 - RNA, 12 nt, Bordetella pertussis
ccccgcggccgc

SEQ ID NO: 302673 - RNA, 12 nt, Bordetella pertussis
ccccgcggggac

SEQ ID NO: 302674 - RNA, 15 nt, Bordetella pertussis
ccccggcccggcggg

SEQ ID NO: 302675 - RNA, 14 nt, Bordetella pertussis
ccccggccgacggc

SEQ ID NO: 302676 - RNA, 11 nt, Bordetella pertussis
ccccggccggu

SEQ ID NO: 302677 - RNA, 12 nt, Bordetella pertussis
ccccggcgcgcc

SEQ ID NO: 302678 - RNA, 14 nt, Bordetella pertussis
ccccggcgccgcgu

SEQ ID NO: 302679 - RNA, 16 nt, Bordetella pertussis
ccccggcgcggccggg

SEQ ID NO: 302680 - RNA, 22 nt, Bordetella pertussis
ccccguugcagcccagcgcgau

SEQ ID NO: 302681 - RNA, 15 nt, Bordetella pertussis
ccccucauuggcgcg

SEQ ID NO: 302682 - RNA, 15 nt, Bordetella pertussis
ccccuccggcgccgc

SEQ ID NO: 302683 - RNA, 19 nt, Bordetella pertussis
ccccuccggcgccgccucg

SEQ ID NO: 302684 - RNA, 13 nt, Bordetella pertussis
ccccucggccugc

SEQ ID NO: 302685 - RNA, 13 nt, Bordetella pertussis
ccccucggcgggc

SEQ ID NO: 302686 - RNA, 16 nt, Bordetella pertussis
ccccucuucucguccg

SEQ ID NO: 302687 - RNA, 16 nt, Bordetella pertussis
cccgaacggggacugg

SEQ ID NO: 302688 - RNA, 14 nt, Bordetella pertussis
cccgaagcgcagca

SEQ ID NO: 302689 - RNA, 16 nt, Bordetella pertussis
cccgaaggcgcggccg

SEQ ID NO: 302690 - RNA, 18 nt, Bordetella pertussis
cccgaaggcgcggccggg

SEQ ID NO: 302691 - RNA, 21 nt, Bordetella pertussis
cccgaaggugggcgaaccgcg

SEQ ID NO: 302692 - RNA, 15 nt, Bordetella pertussis
cccgaccugcuggcg

SEQ ID NO: 302693 - RNA, 19 nt, Bordetella pertussis
cccgaccugcuggcgcgca

SEQ ID NO: 302694 - RNA, 17 nt, Bordetella pertussis
cccgacgacaacccgaa

SEQ ID NO: 302695 - RNA, 12 nt, Bordetella pertussis
cccgacgccaca

SEQ ID NO: 302696 - RNA, 14 nt, Bordetella pertussis
cccgacgcgaggca

SEQ ID NO: 302697 - RNA, 19 nt, Bordetella pertussis
cccgacggccagcgcgacg

SEQ ID NO: 302698 - RNA, 13 nt, Bordetella pertussis
cccgacggcgccg

SEQ ID NO: 302699 - RNA, 18 nt, Bordetella pertussis
cccgacggcgccgugcug

SEQ ID NO: 302700 - RNA, 14 nt, Bordetella pertussis
cccgacggcgcgcc

SEQ ID NO: 302701 - RNA, 22 nt, Bordetella pertussis
cccgauaugcagccgcaccagc

SEQ ID NO: 302702 - RNA, 18 nt, Bordetella pertussis
cccgauccccugcccgcc

SEQ ID NO: 302703 - RNA, 15 nt, Bordetella pertussis
cccgauccgcgggcg

SEQ ID NO: 302704 - RNA, 12 nt, Bordetella pertussis
cccgaucgacgg

SEQ ID NO: 302705 - RNA, 14 nt, Bordetella pertussis
cccgaucgacggcc

SEQ ID NO: 302706 - RNA, 21 nt, Bordetella pertussis
cccgcaaaccugaugccuguc

SEQ ID NO: 302707 - RNA, 23 nt, Bordetella pertussis
cccgcaaacuguccguggccaag

SEQ ID NO: 302708 - RNA, 18 nt, Bordetella pertussis
cccgcaacgggccggccg

SEQ ID NO: 302709 - RNA, 11 nt, Bordetella pertussis
cccgcacauac

SEQ ID NO: 302710 - RNA, 20 nt, Bordetella pertussis
cccgcaggccguuggccgcg

SEQ ID NO: 302711 - RNA, 20 nt, Bordetella pertussis
cccgcagggacaggcaccga

SEQ ID NO: 302712 - RNA, 21 nt, Bordetella pertussis
cccgcaguacccggugcagcg

SEQ ID NO: 302713 - RNA, 14 nt, Bordetella pertussis
cccgcaggcccaca

SEQ ID NO: 302714 - RNA, 19 nt, Bordetella pertussis
cccgccacgucgccggcgu

SEQ ID NO: 302715 - RNA, 12 nt, Bordetella pertussis
cccgccagcaag

SEQ ID NO: 302716 - RNA, 12 nt, Bordetella pertussis
cccgccaggcga

SEQ ID NO: 302717 - RNA, 22 nt, Bordetella pertussis
cccgccagggccauguggcgca

SEQ ID NO: 302718 - RNA, 11 nt, Bordetella pertussis
cccgccagguu

SEQ ID NO: 302719 - RNA, 17 nt, Bordetella pertussis
cccgccauccuggccgc

SEQ ID NO: 302720 - RNA, 18 nt, Bordetella pertussis
cccgccaucgccaggacc

SEQ ID NO: 302721 - RNA, 18 nt, Bordetella pertussis
cccgccagggcggggccg

SEQ ID NO: 302722 - RNA, 12 nt, Bordetella pertussis
cccgccaucgcg

SEQ ID NO: 302723 - RNA, 18 nt, Bordetella pertussis
cccgccauugcacgcgca

SEQ ID NO: 302724 - RNA, 20 nt, Bordetella pertussis
cccgccgacgaaaugccggc

SEQ ID NO: 302725 - RNA, 22 nt, Bordetella pertussis
cccgccgagucggcgauggcgc

SEQ ID NO: 302726 - RNA, 13 nt, Bordetella pertussis
cccgccgcccggc

SEQ ID NO: 302727 - RNA, 13 nt, Bordetella pertussis
cccgccgccggcg

SEQ ID NO: 302728 - RNA, 19 nt, Bordetella pertussis
cccgccgggacaggcaccc

SEQ ID NO: 302729 - RNA, 15 nt, Bordetella pertussis
cccgccgggccgcgc

SEQ ID NO: 302730 - RNA, 13 nt, Bordetella pertussis
cccgccgugccgg

SEQ ID NO: 302731 - RNA, 15 nt, Bordetella pertussis
cccgccgugccgggc

SEQ ID NO: 302732 - RNA, 15 nt, Bordetella pertussis
cccgccguggccaag

SEQ ID NO: 302733 - RNA, 13 nt, Bordetella pertussis
cccgccugccggc

SEQ ID NO: 302734 - RNA, 13 nt, Bordetella pertussis
cccgccugcgcca

SEQ ID NO: 302735 - RNA, 20 nt, Bordetella pertussis
cccgccugcgccagccgcgc

SEQ ID NO: 302736 - RNA, 15 nt, Bordetella pertussis
cccgcgccagcgcca

SEQ ID NO: 302737 - RNA, 23 nt, Bordetella pertussis
cccgcgcccuggcgccgcggccg

SEQ ID NO: 302738 - RNA, 21 nt, Bordetella pertussis
cccgcgccgaaguugcggccg

SEQ ID NO: 302739 - RNA, 20 nt, Bordetella pertussis
cccgcgccgagcggggccgc

SEQ ID NO: 302740 - RNA, 16 nt, Bordetella pertussis
cccgcgccgcaggccg

SEQ ID NO: 302741 - RNA, 11 nt, Bordetella pertussis
cccgcgccgcg

SEQ ID NO: 302742 - RNA, 15 nt, Bordetella pertussis
cccgcgccgcgcaga

SEQ ID NO: 302743 - RNA, 15 nt, Bordetella pertussis
cccgcgccggcggca

SEQ ID NO: 302744 - RNA, 18 nt, Bordetella pertussis
cccgcgcgagcgcaagca

SEQ ID NO: 302745 - RNA, 15 nt, Bordetella pertussis
cccgcgugcgugccg

SEQ ID NO: 302746 - RNA, 23 nt, Bordetella pertussis
cccgcguggaagguccacggcau

SEQ ID NO: 302747 - RNA, 18 nt, Bordetella pertussis
cccgcuaccccggcagcg

SEQ ID NO: 302748 - RNA, 23 nt, Bordetella pertussis
cccgcuacgcgggcuugcugccc

SEQ ID NO: 302749 - RNA, 23 nt, Bordetella pertussis
cccgcuaugcgggcuugcugccc

SEQ ID NO: 302750 - RNA, 13 nt, Bordetella pertussis
cccgcucaggucg

SEQ ID NO: 302751 - RNA, 14 nt, Bordetella pertussis
cccgcucaggucga

SEQ ID NO: 302752 - RNA, 13 nt, Bordetella pertussis
cccgcuccaggcg

SEQ ID NO: 302753 - RNA, 16 nt, Bordetella pertussis
cccgcugcguccacca

SEQ ID NO: 302754 - RNA, 19 nt, Bordetella pertussis
cccgcugcguccaccacca

SEQ ID NO: 302755 - RNA, 15 nt, Bordetella pertussis
cccgcuggccgucgc

SEQ ID NO: 302756 - RNA, 17 nt, Bordetella pertussis
cccgcugggacaggcac

SEQ ID NO: 302757 - RNA, 19 nt, Bordetella pertussis
cccgcugggacaggcacac

SEQ ID NO: 302758 - RNA, 21 nt, Bordetella pertussis
cccgcuuccugcugcgccugg

SEQ ID NO: 302759 - RNA, 14 nt, Bordetella pertussis
cccgcuucgggccg

SEQ ID NO: 302760 - RNA, 19 nt, Bordetella pertussis
cccgcuugcggccggcgcu

SEQ ID NO: 302761 - RNA, 15 nt, Bordetella pertussis
cccggcaccaucgcc

SEQ ID NO: 302762 - RNA, 16 nt, Bordetella pertussis
cccggcaccaugcgca

SEQ ID NO: 302763 - RNA, 14 nt, Bordetella pertussis
cccggcacgcgccg

SEQ ID NO: 302764 - RNA, 21 nt, Bordetella pertussis
cccggcacggagggugcgcaa

SEQ ID NO: 302765 - RNA, 13 nt, Bordetella pertussis
cccggcagccgaa

SEQ ID NO: 302766 - RNA, 21 nt, Bordetella pertussis
cccggcagggugacgggcugg

SEQ ID NO: 302767 - RNA, 22 nt, Bordetella pertussis
cccggccaagcuggagaagcgc

SEQ ID NO: 302768 - RNA, 16 nt, Bordetella pertussis
cccggccacggccggg

SEQ ID NO: 302769 - RNA, 17 nt, Bordetella pertussis
cccggccacggccgggc

SEQ ID NO: 302770 - RNA, 22 nt, Bordetella pertussis
cccggccacguguggcaggcca

SEQ ID NO: 302771 - RNA, 15 nt, Bordetella pertussis
cccggccaggcgccg

SEQ ID NO: 302772 - RNA, 19 nt, Bordetella pertussis
cccggccaggcgccggcgg

SEQ ID NO: 302773 - RNA, 17 nt, Bordetella pertussis
cccggcccaggccgggc

SEQ ID NO: 302774 - RNA, 14 nt, Bordetella pertussis
cccggcccgcgccg

SEQ ID NO: 302775 - RNA, 16 nt, Bordetella pertussis
cccggccgccagcaug

SEQ ID NO: 302776 - RNA, 17 nt, Bordetella pertussis
cccggccgccgccggca

SEQ ID NO: 302777 - RNA, 14 nt, Bordetella pertussis
cccggccgcccccg

SEQ ID NO: 302778 - RNA, 21 nt, Bordetella pertussis
cccggccgccucaccgcgccg

SEQ ID NO: 302779 - RNA, 12 nt, Bordetella pertussis
cccggccggcgc

SEQ ID NO: 302780 - RNA, 13 nt, Bordetella pertussis
cccggccggcgcc

SEQ ID NO: 302781 - RNA, 17 nt, Bordetella pertussis
cccggccucgcggcgcg

SEQ ID NO: 302782 - RNA, 15 nt, Bordetella pertussis
cccggccucgcugcg

SEQ ID NO: 302783 - RNA, 17 nt, Bordetella pertussis
cccggccucgcugcggg

SEQ ID NO: 302784 - RNA, 16 nt, Bordetella pertussis
cccggccugcgcgccg

SEQ ID NO: 302785 - RNA, 17 nt, Bordetella pertussis
cccggccggcacggccg

SEQ ID NO: 302786 - RNA, 16 nt, Bordetella pertussis
cccggccggcccgcgc

SEQ ID NO: 302787 - RNA, 17 nt, Bordetella pertussis
cccggcgaagccggcac

SEQ ID NO: 302788 - RNA, 19 nt, Bordetella pertussis
cccggcgacaccgcggccu

SEQ ID NO: 302789 - RNA, 20 nt, Bordetella pertussis
cccggcgagguugcaggcca

SEQ ID NO: 302790 - RNA, 24 nt, Bordetella pertussis
cccggcgcaucccagacagccacg

SEQ ID NO: 302791 - RNA, 13 nt, Bordetella pertussis
cccggcgccaccc

SEQ ID NO: 302792 - RNA, 15 nt, Bordetella pertussis
cccggcgcgccggcc

SEQ ID NO: 302793 - RNA, 16 nt, Bordetella pertussis
cccggcgcgccggccg

SEQ ID NO: 302794 - RNA, 18 nt, Bordetella pertussis
cccggcgcgccggccgcc

SEQ ID NO: 302795 - RNA, 19 nt, Bordetella pertussis
cccggcgcgccggccgcca

SEQ ID NO: 302796 - RNA, 12 nt, Bordetella pertussis
cccggcgcgccu

SEQ ID NO: 302797 - RNA, 11 nt, Bordetella pertussis
cccggcgcgcc

SEQ ID NO: 302798 - RNA, 12 nt, Bordetella pertussis
cccggcgcgcca

SEQ ID NO: 302799 - RNA, 15 nt, Bordetella pertussis
cccggcgcgccaccc

SEQ ID NO: 302800 - RNA, 12 nt, Bordetella pertussis
cccggcgcgccg

SEQ ID NO: 302801 - RNA, 19 nt, Bordetella pertussis
cccggcgcggcgcgcgccg

SEQ ID NO: 302802 - RNA, 13 nt, Bordetella pertussis
cccggcgcggccg

SEQ ID NO: 302803 - RNA, 21 nt, Bordetella pertussis
cccggcgcggugaggcggccg

SEQ ID NO: 302804 - RNA, 19 nt, Bordetella pertussis
cccggcgcucagcgcgccg

SEQ ID NO: 302805 - RNA, 13 nt, Bordetella pertussis
cccggcgugcuga

SEQ ID NO: 302806 - RNA, 16 nt, Bordetella pertussis
cccggcucccgcgcca

SEQ ID NO: 302807 - RNA, 21 nt, Bordetella pertussis
cccggcucgcugucgugccgc

SEQ ID NO: 302808 - RNA, 19 nt, Bordetella pertussis
cccgggcaccagguccugg

SEQ ID NO: 302809 - RNA, 14 nt, Bordetella pertussis
cccgggcaggcuca

SEQ ID NO: 302810 - RNA, 15 nt, Bordetella pertussis
cccggguggcgccau

SEQ ID NO: 302811 - RNA, 15 nt, Bordetella pertussis
cccgguucugcggcg

SEQ ID NO: 302812 - RNA, 16 nt, Bordetella pertussis
cccgguucugcggcgc

SEQ ID NO: 302813 - RNA, 22 nt, Bordetella pertussis
cccgguuggugcgaaucacuuc

SEQ ID NO: 302814 - RNA, 18 nt, Bordetella pertussis
cccgucgcgccaggccgg

SEQ ID NO: 302815 - RNA, 19 nt, Bordetella pertussis
cccgucgcgccaggccggc

SEQ ID NO: 302816 - RNA, 18 nt, Bordetella pertussis
cccgucggccgucugggc

SEQ ID NO: 302817 - RNA, 13 nt, Bordetella pertussis
cccgugccggccg

SEQ ID NO: 302818 - RNA, 22 nt, Bordetella pertussis
cccgugcggggaccggcacccg

SEQ ID NO: 302819 - RNA, 21 nt, Bordetella pertussis
cccgugcuccagaacgcgccg

SEQ ID NO: 302820 - RNA, 16 nt, Bordetella pertussis
cccgugcgggugccug

SEQ ID NO: 302821 - RNA, 18 nt, Bordetella pertussis
cccguggcccgggugccu

SEQ ID NO: 302822 - RNA, 13 nt, Bordetella pertussis
cccguggcgcuca

SEQ ID NO: 302823 - RNA, 14 nt, Bordetella pertussis
cccguggggacagg

SEQ ID NO: 302824 - RNA, 19 nt, Bordetella pertussis
cccguggggacaggcaccu

SEQ ID NO: 302825 - RNA, 14 nt, Bordetella pertussis
cccuagcgccgcgc

SEQ ID NO: 302826 - RNA, 13 nt, Bordetella pertussis
cccucgggcgaca

SEQ ID NO: 302827 - RNA, 23 nt, Bordetella pertussis
cccucgggugccuguccccacau

SEQ ID NO: 302828 - RNA, 13 nt, Bordetella pertussis
cccucggucagcg

SEQ ID NO: 302829 - RNA, 17 nt, Bordetella pertussis
cccucuucggcggccag

SEQ ID NO: 302830 - RNA, 14 nt, Bordetella pertussis
cccucuucggcgua

SEQ ID NO: 302831 - RNA, 18 nt, Bordetella pertussis
cccugaacuauggcgcgc

SEQ ID NO: 302832 - RNA, 14 nt, Bordetella pertussis
cccugacccgcugg

SEQ ID NO: 302833 - RNA, 15 nt, Bordetella pertussis
cccugaucccggcgc

SEQ ID NO: 302834 - RNA, 14 nt, Bordetella pertussis
cccugcagcggcca

SEQ ID NO: 302835 - RNA, 12 nt, Bordetella pertussis
cccugcaugacc

SEQ ID NO: 302836 - RNA, 21 nt, Bordetella pertussis
cccugcccauucccgcccuga

SEQ ID NO: 302837 - RNA, 16 nt, Bordetella pertussis
cccugcggcagcgacu

SEQ ID NO: 302838 - RNA, 16 nt, Bordetella pertussis
cccugcggcgcggcca

SEQ ID NO: 302839 - RNA, 18 nt, Bordetella pertussis
cccugcggcgcggccagc

SEQ ID NO: 302840 - RNA, 16 nt, Bordetella pertussis
cccugcgggccgcugg

SEQ ID NO: 302841 - RNA, 13 nt, Bordetella pertussis
cccugcggggaca

SEQ ID NO: 302842 - RNA, 19 nt, Bordetella pertussis
cccugcggggacaggcacc

SEQ ID NO: 302843 - RNA, 18 nt, Bordetella pertussis
cccugcgggggcaggcac

SEQ ID NO: 302844 - RNA, 22 nt, Bordetella pertussis
cccugcgggggcaggcacgcgg

SEQ ID NO: 302845 - RNA, 13 nt, Bordetella pertussis
cccugcguggcgc

SEQ ID NO: 302846 - RNA, 20 nt, Bordetella pertussis
cccugcucccacgaacgcca

SEQ ID NO: 302847 - RNA, 16 nt, Bordetella pertussis
cccugcucgcgcagcg

SEQ ID NO: 302848 - RNA, 15 nt, Bordetella pertussis
cccuggcgcaggccg

SEQ ID NO: 302849 - RNA, 22 nt, Bordetella pertussis
cccuggcgcaggccggcggcca

SEQ ID NO: 302850 - RNA, 17 nt, Bordetella pertussis
cccuggcgccgcggccg

SEQ ID NO: 302851 - RNA, 16 nt, Bordetella pertussis
cccuggcgcgaggcgg

SEQ ID NO: 302852 - RNA, 21 nt, Bordetella pertussis
cccuggcgcgaggcggcgacg

SEQ ID NO: 302853 - RNA, 13 nt, Bordetella pertussis
cccuggcgcugca

SEQ ID NO: 302854 - RNA, 13 nt, Bordetella pertussis
cccuggcgggccg

SEQ ID NO: 302855 - RNA, 16 nt, Bordetella pertussis
cccuggcuggcggccc

SEQ ID NO: 302856 - RNA, 16 nt, Bordetella pertussis
cccuggcguggcgcgc

SEQ ID NO: 302857 - RNA, 15 nt, Bordetella pertussis
cccugggccagcagc

SEQ ID NO: 302858 - RNA, 22 nt, Bordetella pertussis
cccugggcgagguagggcgcgg

SEQ ID NO: 302859 - RNA, 23 nt, Bordetella pertussis
cccugggcgagguagggcgcggc

SEQ ID NO: 302860 - RNA, 12 nt, Bordetella pertussis
cccugggcgcgg

SEQ ID NO: 302861 - RNA, 14 nt, Bordetella pertussis
cccugggcgcggcg

SEQ ID NO: 302862 - RNA, 12 nt, Bordetella pertussis
cccuggggccgc

SEQ ID NO: 302863 - RNA, 22 nt, Bordetella pertussis
cccuggguggcggggcgcauca

SEQ ID NO: 302864 - RNA, 14 nt, Bordetella pertussis
cccuggucaucgcc

SEQ ID NO: 302865 - RNA, 16 nt, Bordetella pertussis
cccuggucaucgccau

SEQ ID NO: 302866 - RNA, 17 nt, Bordetella pertussis
cccuggucgucgcggcc

SEQ ID NO: 302867 - RNA, 16 nt, Bordetella pertussis
cccugugggggacagg

SEQ ID NO: 302868 - RNA, 15 nt, Bordetella pertussis
cccuuccacccgcau

SEQ ID NO: 302869 - RNA, 23 nt, Bordetella pertussis
ccgaaaacaaaauugcccgcgaa

SEQ ID NO: 302870 - RNA, 12 nt, Bordetella pertussis
ccgaaacgcugg

SEQ ID NO: 302871 - RNA, 15 nt, Bordetella pertussis
ccgaaacucaccgcc

SEQ ID NO: 302872 - RNA, 22 nt, Bordetella pertussis
ccgaacaagguccaggcccggc

SEQ ID NO: 302873 - RNA, 12 nt, Bordetella pertussis
ccgaacagccag

SEQ ID NO: 302874 - RNA, 13 nt, Bordetella pertussis
ccgagcccgacgc

SEQ ID NO: 302875 - RNA, 21 nt, Bordetella pertussis
ccgagcccuggcuuggccgaa

SEQ ID NO: 302876 - RNA, 22 nt, Bordetella pertussis
ccgagccgaaguacacggccag

SEQ ID NO: 302877 - RNA, 20 nt, Bordetella pertussis
ccgagccgcugucgcaggcg

SEQ ID NO: 302878 - RNA, 13 nt, Bordetella pertussis
ccgagccggaugg

SEQ ID NO: 302879 - RNA, 13 nt, Bordetella pertussis
ccgagccggccag

SEQ ID NO: 302880 - RNA, 15 nt, Bordetella pertussis
ccgagcgcaccccgg

SEQ ID NO: 302881 - RNA, 21 nt, Bordetella pertussis
ccgagcgcaccccggccgacg

SEQ ID NO: 302882 - RNA, 12 nt, Bordetella pertussis
ccgagcgccaca

SEQ ID NO: 302883 - RNA, 21 nt, Bordetella pertussis
ccgagcgcgacagcaccaacu

SEQ ID NO: 302884 - RNA, 15 nt, Bordetella pertussis
ccgagcgcgccagca

SEQ ID NO: 302885 - RNA, 12 nt, Bordetella pertussis
ccgagcgcgccc

SEQ ID NO: 302886 - RNA, 14 nt, Bordetella pertussis
ccgagcgcggcaug

SEQ ID NO: 302887 - RNA, 11 nt, Bordetella pertussis
ccgagcgcugc

SEQ ID NO: 302888 - RNA, 15 nt, Bordetella pertussis
ccgagcgcugcgcca

SEQ ID NO: 302889 - RNA, 16 nt, Bordetella pertussis
ccgagcgggcaugggc

SEQ ID NO: 302890 - RNA, 15 nt, Bordetella pertussis
ccgagcgggccagcg

SEQ ID NO: 302891 - RNA, 14 nt, Bordetella pertussis
ccgagcgggcccga

SEQ ID NO: 302892 - RNA, 12 nt, Bordetella pertussis
ccgagcgugccg

SEQ ID NO: 302893 - RNA, 15 nt, Bordetella pertussis
ccgagcugagcacca

SEQ ID NO: 302894 - RNA, 17 nt, Bordetella pertussis
ccgagcugagcaccagc

SEQ ID NO: 302895 - RNA, 22 nt, Bordetella pertussis
ccgagcugccgccuucgucgcg

SEQ ID NO: 302896 - RNA, 14 nt, Bordetella pertussis
ccgaggaccugcug

SEQ ID NO: 302897 - RNA, 20 nt, Bordetella pertussis
ccgaggaucuggccggcgcu

SEQ ID NO: 302898 - RNA, 18 nt, Bordetella pertussis
ccgaggcacaaggccgag

SEQ ID NO: 302899 - RNA, 21 nt, Bordetella pertussis
ccgaggcgccccagagcaccg

SEQ ID NO: 302900 - RNA, 14 nt, Bordetella pertussis
ccgaggcgccgccg

SEQ ID NO: 302901 - RNA, 20 nt, Bordetella pertussis
ccgaggcgcgcagcacgccg

SEQ ID NO: 302902 - RNA, 15 nt, Bordetella pertussis
ccgaggcggcgcggg

SEQ ID NO: 302903 - RNA, 19 nt, Bordetella pertussis
ccgaggcgggcagcauggc

SEQ ID NO: 302904 - RNA, 12 nt, Bordetella pertussis
ccgaggcugcgc

SEQ ID NO: 302905 - RNA, 19 nt, Bordetella pertussis
ccgaggcuucgauggcggc

SEQ ID NO: 302906 - RNA, 19 nt, Bordetella pertussis
ccgagggccggaacagcgu

SEQ ID NO: 302907 - RNA, 15 nt, Bordetella pertussis
ccgagggcgcggcgc

SEQ ID NO: 302908 - RNA, 18 nt, Bordetella pertussis
ccgagggcgcguccaagc

SEQ ID NO: 302909 - RNA, 19 nt, Bordetella pertussis
ccgaggugcccaucaggcc

SEQ ID NO: 302910 - RNA, 12 nt, Bordetella pertussis
ccgagucggcga

SEQ ID NO: 302911 - RNA, 22 nt, Bordetella pertussis
ccgagucggcgauggcgcgcgc

SEQ ID NO: 302912 - RNA, 23 nt, Bordetella pertussis
ccgagucggcgauggcgcgcgcc

SEQ ID NO: 302913 - RNA, 24 nt, Bordetella pertussis
ccgaggucggcgguccacagcccg

SEQ ID NO: 302914 - RNA, 23 nt, Bordetella pertussis
ccgagugggcggccuugccggcc

SEQ ID NO: 302915 - RNA, 22 nt, Bordetella pertussis
ccgaguugaggaugcgcgcggc

SEQ ID NO: 302916 - RNA, 23 nt, Bordetella pertussis
ccgaguugaggaugcgcgcggcc

SEQ ID NO: 302917 - RNA, 21 nt, Bordetella pertussis
ccgauacaaggugccuguccc

SEQ ID NO: 302918 - RNA, 22 nt, Bordetella pertussis
ccgauacaggcgcucgcgcugc

SEQ ID NO: 302919 - RNA, 15 nt, Bordetella pertussis
ccgauaccacgcgcg

SEQ ID NO: 302920 - RNA, 16 nt, Bordetella pertussis
ccgauacgacacgccg

SEQ ID NO: 302921 - RNA, 22 nt, Bordetella pertussis
ccgauacgacacgccgcgcgau

SEQ ID NO: 302922 - RNA, 21 nt, Bordetella pertussis
ccgauacgcgugcgcggccgc

SEQ ID NO: 302923 - RNA, 23 nt, Bordetella pertussis
ccgauacgcgugcgcggccgcgc

SEQ ID NO: 302924 - RNA, 14 nt, Bordetella pertussis
ccgauacgucgcag

SEQ ID NO: 302925 - RNA, 16 nt, Bordetella pertussis
ccgauacgucgcagca

SEQ ID NO: 302926 - RNA, 15 nt, Bordetella pertussis
ccgauagccgugacc

SEQ ID NO: 302927 - RNA, 15 nt, Bordetella pertussis
ccgauagcggcgccg

SEQ ID NO: 302928 - RNA, 23 nt, Bordetella pertussis
ccgauagcggcgccgcuuccggc

SEQ ID NO: 302929 - RNA, 22 nt, Bordetella pertussis
ccgauaugcagccgcaccagcg

SEQ ID NO: 302930 - RNA, 20 nt, Bordetella pertussis
ccgaucagcaggucggcgcg

SEQ ID NO: 302931 - RNA, 13 nt, Bordetella pertussis
ccgaucagccggc

SEQ ID NO: 302932 - RNA, 19 nt, Bordetella pertussis
ccgaucagcgacagcaggg

SEQ ID NO: 302933 - RNA, 16 nt, Bordetella pertussis
ccgaucagcugcggcc

SEQ ID NO: 302934 - RNA, 12 nt, Bordetella pertussis
ccgauccagccc

SEQ ID NO: 302935 - RNA, 19 nt, Bordetella pertussis
ccgauccagcccaccgcga

SEQ ID NO: 302936 - RNA, 13 nt, Bordetella pertussis
ccgauccagcgcc

SEQ ID NO: 302937 - RNA, 14 nt, Bordetella pertussis
ccgauccagcgccu

SEQ ID NO: 302938 - RNA, 19 nt, Bordetella pertussis
ccgauccccugcccgccug

SEQ ID NO: 302939 - RNA, 20 nt, Bordetella pertussis
ccgaucccuugugcgcgcca

SEQ ID NO: 302940 - RNA, 15 nt, Bordetella pertussis
ccgauccgaugaugc

SEQ ID NO: 302941 - RNA, 20 nt, Bordetella pertussis
ccgauccgcgggcgggccgc

SEQ ID NO: 302942 - RNA, 21 nt, Bordetella pertussis
ccgauccgcgggcgggccgcg

SEQ ID NO: 302943 - RNA, 16 nt, Bordetella pertussis
ccgaucgagcaggccg

SEQ ID NO: 302944 - RNA, 21 nt, Bordetella pertussis
ccgaucgagcaggccgccggg

SEQ ID NO: 302945 - RNA, 13 nt, Bordetella pertussis
ccgaucgcgccgu

SEQ ID NO: 302946 - RNA, 15 nt, Bordetella pertussis
ccgaucggcgccgcg

SEQ ID NO: 302947 - RNA, 20 nt, Bordetella pertussis
ccgaucggcuugccgcgcgg

SEQ ID NO: 302948 - RNA, 12 nt, Bordetella pertussis
ccgaucggcguc

SEQ ID NO: 302949 - RNA, 17 nt, Bordetella pertussis
ccgaucgugcacgcccg

SEQ ID NO: 302950 - RNA, 21 nt, Bordetella pertussis
ccgaucuacgacgccuggacc

SEQ ID NO: 302951 - RNA, 21 nt, Bordetella pertussis
ccgaucugcugggccggguga

SEQ ID NO: 302952 - RNA, 22 nt, Bordetella pertussis
ccgaugaauugcgccacgccca

SEQ ID NO: 302953 - RNA, 15 nt, Bordetella pertussis
ccgaugacaucgccg

SEQ ID NO: 302954 - RNA, 18 nt, Bordetella pertussis
ccgaugaccagcagcgcc

SEQ ID NO: 302955 - RNA, 21 nt, Bordetella pertussis
ccgaugaccagcagcgccggg

SEQ ID NO: 302956 - RNA, 17 nt, Bordetella pertussis
ccgaugaccggccaggc

SEQ ID NO: 302957 - RNA, 21 nt, Bordetella pertussis
ccgaugauggauucgcgccgg

SEQ ID NO: 302958 - RNA, 15 nt, Bordetella pertussis
ccgaugcgccaggcc

SEQ ID NO: 302959 - RNA, 17 nt, Bordetella pertussis
ccgaugcgccggccugg

SEQ ID NO: 302960 - RNA, 19 nt, Bordetella pertussis
ccgaugcgguaggcccagc

SEQ ID NO: 302961 - RNA, 20 nt, Bordetella pertussis
ccgaugcucgccggcgccgc

SEQ ID NO: 302962 - RNA, 23 nt, Bordetella pertussis
ccgauggcauggggcaggcgcag

SEQ ID NO: 302963 - RNA, 18 nt, Bordetella pertussis
ccgauggcgcgcggcugg

SEQ ID NO: 302964 - RNA, 13 nt, Bordetella pertussis
ccgauggcgccgc

SEQ ID NO: 302965 - RNA, 16 nt, Bordetella pertussis
ccgauggucagcaugu

SEQ ID NO: 302966 - RNA, 13 nt, Bordetella pertussis
ccgauggucagcg

SEQ ID NO: 302967 - RNA, 17 nt, Bordetella pertussis
ccgaugucgaacagcug

SEQ ID NO: 302968 - RNA, 18 nt, Bordetella pertussis
ccgaugucgaacagcugc

SEQ ID NO: 302969 - RNA, 18 nt, Bordetella pertussis
ccgauguaugacuugacc

SEQ ID NO: 302970 - RNA, 19 nt, Bordetella pertussis
ccgauguugaacagcugga

SEQ ID NO: 302971 - RNA, 22 nt, Bordetella pertussis
ccgauguuguuggccgccagcc

SEQ ID NO: 302972 - RNA, 19 nt, Bordetella pertussis
ccgauuccaggacgacagg

SEQ ID NO: 302973 - RNA, 16 nt, Bordetella pertussis
ccgauucgcgcaccga

SEQ ID NO: 302974 - RNA, 18 nt, Bordetella pertussis
ccgauugaggccagcacg

SEQ ID NO: 302975 - RNA, 21 nt, Bordetella pertussis
ccgauugaggccagcacgccg

SEQ ID NO: 302976 - RNA, 16 nt, Bordetella pertussis
ccgauuucgcgcgcca

SEQ ID NO: 302977 - RNA, 13 nt, Bordetella pertussis
ccgauuucggccg

SEQ ID NO: 302978 - RNA, 19 nt, Bordetella pertussis
ccgauuucggccgccggcg

SEQ ID NO: 302979 - RNA, 20 nt, Bordetella pertussis
ccgcaaaccugaugccuguc

SEQ ID NO: 302980 - RNA, 21 nt, Bordetella pertussis
ccgcaaaccugaugccugucc

SEQ ID NO: 302981 - RNA, 17 nt, Bordetella pertussis
ccgcaacaggcagcugc

SEQ ID NO: 302982 - RNA, 17 nt, Bordetella pertussis
ccgcaacccacccccag

SEQ ID NO: 302983 - RNA, 16 nt, Bordetella pertussis
ccgcaaccgucgaccg

SEQ ID NO: 302984 - RNA, 12 nt, Bordetella pertussis
ccgcaacgccag

SEQ ID NO: 302985 - RNA, 17 nt, Bordetella pertussis
ccgcaacgccgcccguc

SEQ ID NO: 302986 - RNA, 16 nt, Bordetella pertussis
ccgcaacgccgccggc

SEQ ID NO: 302987 - RNA, 21 nt, Bordetella pertussis
ccgcaacgccgggccgcgccg

SEQ ID NO: 302988 - RNA, 20 nt, Bordetella pertussis
ccgcaacgggccggccgccg

SEQ ID NO: 302989 - RNA, 21 nt, Bordetella pertussis
ccgcaagauuucauggcgucu

SEQ ID NO: 302990 - RNA, 22 nt, Bordetella pertussis
ccgcaagcaagccccaggcagg

SEQ ID NO: 302991 - RNA, 22 nt, Bordetella pertussis
ccgcaagcauuugcgcgacggc

SEQ ID NO: 302992 - RNA, 22 nt, Bordetella pertussis
ccgcaagcuggcggcgcgcggc

SEQ ID NO: 302993 - RNA, 19 nt, Bordetella pertussis
ccgcaaggaaguggccgag

SEQ ID NO: 302994 - RNA, 15 nt, Bordetella pertussis
ccgcaaggggccggc

SEQ ID NO: 302995 - RNA, 19 nt, Bordetella pertussis
ccgcaaggggccggcgccg

SEQ ID NO: 302996 - RNA, 17 nt, Bordetella pertussis
ccgcaagggggacuggc

SEQ ID NO: 302997 - RNA, 19 nt, Bordetella pertussis
ccgcaauaccuucagcccg

SEQ ID NO: 302998 - RNA, 17 nt, Bordetella pertussis
ccgcacauacaaggcgc

SEQ ID NO: 302999 - RNA, 21 nt, Bordetella pertussis
ccgcacauacaaggcgcggca

SEQ ID NO: 303000 - RNA, 19 nt, Bordetella pertussis
ccgcaccagcgccgacggc

SEQ ID NO: 303001 - RNA, 13 nt, Bordetella pertussis
ccgcaccagcggc

SEQ ID NO: 303002 - RNA, 13 nt, Bordetella pertussis
ccgcaccaggccg

SEQ ID NO: 303003 - RNA, 17 nt, Bordetella pertussis
ccgcacccgguauccgc

SEQ ID NO: 303004 - RNA, 20 nt, Bordetella pertussis
ccgcacccgguauccgcgca

SEQ ID NO: 303005 - RNA, 23 nt, Bordetella pertussis
ccgcacccgguauccgcgcaugg

SEQ ID NO: 303006 - RNA, 12 nt, Bordetella pertussis
ccgcaccgacgg

SEQ ID NO: 303007 - RNA, 17 nt, Bordetella pertussis
ccgcaccgacgggcuga

SEQ ID NO: 303008 - RNA, 13 nt, Bordetella pertussis
ccgcaccgcccgc

SEQ ID NO: 303009 - RNA, 16 nt, Bordetella pertussis
ccgcaccgcccgcaag

SEQ ID NO: 303010 - RNA, 24 nt, Bordetella pertussis
ccgcaccgaccagcgcgcgccggc

SEQ ID NO: 303011 - RNA, 15 nt, Bordetella pertussis
ccgcaccggaggcgc

SEQ ID NO: 303012 - RNA, 12 nt, Bordetella pertussis
ccgcaccggcgu

SEQ ID NO: 303013 - RNA, 19 nt, Bordetella pertussis
ccgcaccgggcaaucggcg

SEQ ID NO: 303014 - RNA, 19 nt, Bordetella pertussis
ccgcaccgggcggcccggc

SEQ ID NO: 303015 - RNA, 19 nt, Bordetella pertussis
ccgcaccugaacaccggcg

SEQ ID NO: 303016 - RNA, 20 nt, Bordetella pertussis
ccgcaccugaacaccggcgc

SEQ ID NO: 303017 - RNA, 13 nt, Bordetella pertussis
ccgcacgaagcgg

SEQ ID NO: 303018 - RNA, 16 nt, Bordetella pertussis
ccgcacgaucgcgccg

SEQ ID NO: 303019 - RNA, 17 nt, Bordetella pertussis
ccgcacgaucgcgccgg

SEQ ID NO: 303020 - RNA, 16 nt, Bordetella pertussis
ccgcacgauggcgcgc

SEQ ID NO: 303021 - RNA, 11 nt, Bordetella pertussis
ccgcacgcccg

SEQ ID NO: 303022 - RNA, 14 nt, Bordetella pertussis
ccgcacgccgaccu

SEQ ID NO: 303023 - RNA, 12 nt, Bordetella pertussis
ccgcacgccggc

SEQ ID NO: 303024 - RNA, 12 nt, Bordetella pertussis
ccgcacgccgac

SEQ ID NO: 303025 - RNA, 13 nt, Bordetella pertussis
ccgcacgccggcc

SEQ ID NO: 303026 - RNA, 13 nt, Bordetella pertussis
ccgcacgcgcggc

SEQ ID NO: 303027 - RNA, 20 nt, Bordetella pertussis
ccgcacgcgcggcagcgccg

SEQ ID NO: 303028 - RNA, 13 nt, Bordetella pertussis
ccgcacgcggccg

SEQ ID NO: 303029 - RNA, 20 nt, Bordetella pertussis
ccgcacgcucuacacggccg

SEQ ID NO: 303030 - RNA, 17 nt, Bordetella pertussis
ccgcacggggacaggca

SEQ ID NO: 303031 - RNA, 22 nt, Bordetella pertussis
ccgcacggggacaggcacgcgc

SEQ ID NO: 303032 - RNA, 17 nt, Bordetella pertussis
ccgcacggggacuggca

SEQ ID NO: 303033 - RNA, 22 nt, Bordetella pertussis
ccgcacggggacuggcaccggc

SEQ ID NO: 303034 - RNA, 22 nt, Bordetella pertussis
ccgcacggggacuggcacgcgc

SEQ ID NO: 303035 - RNA, 23 nt, Bordetella pertussis
ccgcacggggacuggcacgcgcu

SEQ ID NO: 303036 - RNA, 17 nt, Bordetella pertussis
ccgcacggggagcgacc

SEQ ID NO: 303037 - RNA, 23 nt, Bordetella pertussis
ccgcacggggagcgacccguggc

SEQ ID NO: 303038 - RNA, 16 nt, Bordetella pertussis
ccgcacgguggcgccg

SEQ ID NO: 303039 - RNA, 23 nt, Bordetella pertussis
ccgcacuucgggccacccgccgc

SEQ ID NO: 303040 - RNA, 15 nt, Bordetella pertussis
ccgcagaacagcagc

SEQ ID NO: 303041 - RNA, 23 nt, Bordetella pertussis
ccgcagaagcagccgcgcggccg

SEQ ID NO: 303042 - RNA, 14 nt, Bordetella pertussis
ccgcagauggccag

SEQ ID NO: 303043 - RNA, 20 nt, Bordetella pertussis
ccgcagauggccagcagcgc

SEQ ID NO: 303044 - RNA, 21 nt, Bordetella pertussis
ccgcagauggccagcagcgcc

SEQ ID NO: 303045 - RNA, 18 nt, Bordetella pertussis
ccgcagauggcguaggcg

SEQ ID NO: 303046 - RNA, 16 nt, Bordetella pertussis
ccgcagcaccucggcg

SEQ ID NO: 303047 - RNA, 18 nt, Bordetella pertussis
ccgcagcaccucggcgug

SEQ ID NO: 303048 - RNA, 22 nt, Bordetella pertussis
ccgcagcaccucggcguggcgg

SEQ ID NO: 303049 - RNA, 23 nt, Bordetella pertussis
ccgcagcaccuugaccuggucgg

SEQ ID NO: 303050 - RNA, 14 nt, Bordetella pertussis
ccgcagcaggcgcu

SEQ ID NO: 303051 - RNA, 21 nt, Bordetella pertussis
ccgcagcaguucggucagcgc

SEQ ID NO: 303052 - RNA, 15 nt, Bordetella pertussis
ccgcagcggcagcgc

SEQ ID NO: 303053 - RNA, 22 nt, Bordetella pertussis
ccgcagcgggcccgucgcgcca

SEQ ID NO: 303054 - RNA, 19 nt, Bordetella pertussis
ccgcaucggcguaccaggc

SEQ ID NO: 303055 - RNA, 13 nt, Bordetella pertussis
ccgcaucugcggg

SEQ ID NO: 303056 - RNA, 13 nt, Bordetella pertussis
ccgcaugcggcac

SEQ ID NO: 303057 - RNA, 22 nt, Bordetella pertussis
ccgcaugcgugaagcccauggc

SEQ ID NO: 303058 - RNA, 15 nt, Bordetella pertussis
ccgcaugccggcgau

SEQ ID NO: 303059 - RNA, 16 nt, Bordetella pertussis
ccgcauggagaccggc

SEQ ID NO: 303060 - RNA, 17 nt, Bordetella pertussis
ccgcaugggcgcgcccg

SEQ ID NO: 303061 - RNA, 18 nt, Bordetella pertussis
ccgcaugggcgcgcccgg

SEQ ID NO: 303062 - RNA, 16 nt, Bordetella pertussis
ccgcauggggacuggc

SEQ ID NO: 303063 - RNA, 19 nt, Bordetella pertussis
ccgcauggggacuggcgcc

SEQ ID NO: 303064 - RNA, 15 nt, Bordetella pertussis
ccgcaugggggcugg

SEQ ID NO: 303065 - RNA, 17 nt, Bordetella pertussis
ccgcaugguggcgcagg

SEQ ID NO: 303066 - RNA, 18 nt, Bordetella pertussis
ccgcaugguggcgcaggc

SEQ ID NO: 303067 - RNA, 21 nt, Bordetella pertussis
ccgcauugaucgaucagccag

SEQ ID NO: 303068 - RNA, 22 nt, Bordetella pertussis
ccgccaacacgauccacggccg

SEQ ID NO: 303069 - RNA, 15 nt, Bordetella pertussis
ccgccaacgcggcgc

SEQ ID NO: 303070 - RNA, 20 nt, Bordetella pertussis
ccgccaacgcggcgcgugca

SEQ ID NO: 303071 - RNA, 17 nt, Bordetella pertussis
ccgccaagggcgcgcca

SEQ ID NO: 303072 - RNA, 19 nt, Bordetella pertussis
ccgccaagggcgcgccagc

SEQ ID NO: 303073 - RNA, 20 nt, Bordetella pertussis
ccgccaagggcgcgccagca

SEQ ID NO: 303074 - RNA, 21 nt, Bordetella pertussis
ccgccaauugcuugccugucc

SEQ ID NO: 303075 - RNA, 21 nt, Bordetella pertussis
ccgccacaggcugacgcccgg

SEQ ID NO: 303076 - RNA, 16 nt, Bordetella pertussis
ccgccaccucggcguc

SEQ ID NO: 303077 - RNA, 23 nt, Bordetella pertussis
ccgccaccugggccgccugcugg

SEQ ID NO: 303078 - RNA, 14 nt, Bordetella pertussis
ccgccacgcaggcg

SEQ ID NO: 303079 - RNA, 14 nt, Bordetella pertussis
ccgccacgcccugg

SEQ ID NO: 303080 - RNA, 17 nt, Bordetella pertussis
ccgccacgccggccacg

SEQ ID NO: 303081 - RNA, 21 nt, Bordetella pertussis
ccgccacgccuuguucgcgcg

SEQ ID NO: 303082 - RNA, 18 nt, Bordetella pertussis
ccgccacggcgcccgagg

SEQ ID NO: 303083 - RNA, 20 nt, Bordetella pertussis
ccgccacggcgcccgaggcc

SEQ ID NO: 303084 - RNA, 12 nt, Bordetella pertussis
ccgccacggucg

SEQ ID NO: 303085 - RNA, 15 nt, Bordetella pertussis
ccgccacgugcacga

SEQ ID NO: 303086 - RNA, 17 nt, Bordetella pertussis
ccgccacuugcggcagg

SEQ ID NO: 303087 - RNA, 14 nt, Bordetella pertussis
ccgccagcaccugc

SEQ ID NO: 303088 - RNA, 20 nt, Bordetella pertussis
ccgccagcaccugcuugacg

SEQ ID NO: 303089 - RNA, 13 nt, Bordetella pertussis
ccgccagcagcgc

SEQ ID NO: 303090 - RNA, 23 nt, Bordetella pertussis
ccgccagcagcucggcgaccagg

SEQ ID NO: 303091 - RNA, 13 nt, Bordetella pertussis
ccgccagcaggcc

SEQ ID NO: 303092 - RNA, 15 nt, Bordetella pertussis
ccgccagcaggcgcu

SEQ ID NO: 303093 - RNA, 23 nt, Bordetella pertussis
ccgccagcauggcggccaggcgc

SEQ ID NO: 303094 - RNA, 17 nt, Bordetella pertussis
ccgccagcccgaggcac

SEQ ID NO: 303095 - RNA, 20 nt, Bordetella pertussis
ccgccagcccgaggcacaag

SEQ ID NO: 303096 - RNA, 21 nt, Bordetella pertussis
ccgccagccgcuggcgcgccg

SEQ ID NO: 303097 - RNA, 15 nt, Bordetella pertussis
ccgccagccggccca

SEQ ID NO: 303098 - RNA, 14 nt, Bordetella pertussis
ccgccagcggcugg

SEQ ID NO: 303099 - RNA, 20 nt, Bordetella pertussis
ccgccagcguaucgccgccg

SEQ ID NO: 303100 - RNA, 16 nt, Bordetella pertussis
ccgccagcucggccug

SEQ ID NO: 303101 - RNA, 22 nt, Bordetella pertussis
ccgccaggaagaucggcccggc

SEQ ID NO: 303102 - RNA, 13 nt, Bordetella pertussis
ccgccaggccguc

SEQ ID NO: 303103 - RNA, 14 nt, Bordetella pertussis
ccgccaggccgucg

SEQ ID NO: 303104 - RNA, 22 nt, Bordetella pertussis
ccgccaucgucguagcgccagc

SEQ ID NO: 303105 - RNA, 23 nt, Bordetella pertussis
ccgccaucgucguagcgccagcg

SEQ ID NO: 303106 - RNA, 14 nt, Bordetella pertussis
ccgccaugcgcagg

SEQ ID NO: 303107 - RNA, 18 nt, Bordetella pertussis
ccgccaugcgcaggguuu

SEQ ID NO: 303108 - RNA, 16 nt, Bordetella pertussis
ccgccaugcgcauggc

SEQ ID NO: 303109 - RNA, 18 nt, Bordetella pertussis
ccgccaugcgccagcagg

SEQ ID NO: 303110 - RNA, 16 nt, Bordetella pertussis
ccgccaugcggcgcca

SEQ ID NO: 303111 - RNA, 17 nt, Bordetella pertussis
ccgccaugcacgggcca

SEQ ID NO: 303112 - RNA, 14 nt, Bordetella pertussis
ccgccauggaggcg

SEQ ID NO: 303113 - RNA, 15 nt, Bordetella pertussis
ccgccauggaggcgc

SEQ ID NO: 303114 - RNA, 16 nt, Bordetella pertussis
ccgccauggccggcgu

SEQ ID NO: 303115 - RNA, 18 nt, Bordetella pertussis
ccgccauggugccgcgca

SEQ ID NO: 303116 - RNA, 20 nt, Bordetella pertussis
ccgccauggugccgcgcagg

SEQ ID NO: 303117 - RNA, 22 nt, Bordetella pertussis
ccgccauggugccgcgcaggcc

SEQ ID NO: 303118 - RNA, 19 nt, Bordetella pertussis
ccgccauguauaacguggc

SEQ ID NO: 303119 - RNA, 21 nt, Bordetella pertussis
ccgccauguauaacguggcgc

SEQ ID NO: 303120 - RNA, 23 nt, Bordetella pertussis
ccgccauguauaacguggcgcgc

SEQ ID NO: 303121 - RNA, 15 nt, Bordetella pertussis
ccgccaugugcgccg

SEQ ID NO: 303122 - RNA, 19 nt, Bordetella pertussis
ccgccaugugcgccgcgcc

SEQ ID NO: 303123 - RNA, 20 nt, Bordetella pertussis
ccgccaugugcgccgcgccg

SEQ ID NO: 303124 - RNA, 16 nt, Bordetella pertussis
ccgccauggcggccgc

SEQ ID NO: 303125 - RNA, 17 nt, Bordetella pertussis
ccgccauggcggccgcc

SEQ ID NO: 303126 - RNA, 16 nt, Bordetella pertussis
ccgccauggcggcgcc

SEQ ID NO: 303127 - RNA, 22 nt, Bordetella pertussis
ccgccauggcgcuggcaggcgc

SEQ ID NO: 303128 - RNA, 15 nt, Bordetella pertussis
ccgccauugcacgcg

SEQ ID NO: 303129 - RNA, 17 nt, Bordetella pertussis
ccgccauugcacgcgca

SEQ ID NO: 303130 - RNA, 16 nt, Bordetella pertussis
ccgcccacauggcggc

SEQ ID NO: 303131 - RNA, 14 nt, Bordetella pertussis
ccgcccaccaccag

SEQ ID NO: 303132 - RNA, 20 nt, Bordetella pertussis
ccgcccaccaccagcgcggc

SEQ ID NO: 303133 - RNA, 22 nt, Bordetella pertussis
ccgcccacgaucaccacgcccg

SEQ ID NO: 303134 - RNA, 13 nt, Bordetella pertussis
ccgcccacgcggc

SEQ ID NO: 303135 - RNA, 18 nt, Bordetella pertussis
ccgcccacgcggcgcugc

SEQ ID NO: 303136 - RNA, 13 nt, Bordetella pertussis
ccgcccacggcga

SEQ ID NO: 303137 - RNA, 14 nt, Bordetella pertussis
ccgcccacgggcgc

SEQ ID NO: 303138 - RNA, 17 nt, Bordetella pertussis
ccgcccacugccaggcg

SEQ ID NO: 303139 - RNA, 21 nt, Bordetella pertussis
ccgcccagcauccgcgccagg

SEQ ID NO: 303140 - RNA, 15 nt, Bordetella pertussis
ccgcccagcaugcgc

SEQ ID NO: 303141 - RNA, 15 nt, Bordetella pertussis
ccgcccagccaggcg

SEQ ID NO: 303142 - RNA, 16 nt, Bordetella pertussis
ccgcccagccaggcgc

SEQ ID NO: 303143 - RNA, 15 nt, Bordetella pertussis
ccgcccagcgcauag

SEQ ID NO: 303144 - RNA, 18 nt, Bordetella pertussis
ccgcccagccgcgccagg

SEQ ID NO: 303145 - RNA, 13 nt, Bordetella pertussis
ccgcccagccggc

SEQ ID NO: 303146 - RNA, 13 nt, Bordetella pertussis
ccgcccaugccgc

SEQ ID NO: 303147 - RNA, 18 nt, Bordetella pertussis
ccgcccaugccgccgggc

SEQ ID NO: 303148 - RNA, 15 nt, Bordetella pertussis
ccgcccccgacgcca

SEQ ID NO: 303149 - RNA, 15 nt, Bordetella pertussis
ccgccccgugcacca

SEQ ID NO: 303150 - RNA, 15 nt, Bordetella pertussis
ccgcccgacagcacg

SEQ ID NO: 303151 - RNA, 17 nt, Bordetella pertussis
ccgcccgacagcacgcc

SEQ ID NO: 303152 - RNA, 17 nt, Bordetella pertussis
ccgcccgaauccagggc

SEQ ID NO: 303153 - RNA, 22 nt, Bordetella pertussis
ccgcccgaauccagggccacgc

SEQ ID NO: 303154 - RNA, 13 nt, Bordetella pertussis
ccgcccgcugcua

SEQ ID NO: 303155 - RNA, 12 nt, Bordetella pertussis
ccgcccggaugg

SEQ ID NO: 303156 - RNA, 19 nt, Bordetella pertussis
ccgcccggcggcgcgccgc

SEQ ID NO: 303157 - RNA, 15 nt, Bordetella pertussis
ccgccgcggcaggcc

SEQ ID NO: 303158 - RNA, 20 nt, Bordetella pertussis
ccgccgcggcaggccccggc

SEQ ID NO: 303159 - RNA, 12 nt, Bordetella pertussis
ccgccgcggcca

SEQ ID NO: 303160 - RNA, 15 nt, Bordetella pertussis
ccgccgcggccagcg

SEQ ID NO: 303161 - RNA, 16 nt, Bordetella pertussis
ccgccgcggccagcgc

SEQ ID NO: 303162 - RNA, 18 nt, Bordetella pertussis
ccgccgcggccagcgccg

SEQ ID NO: 303163 - RNA, 12 nt, Bordetella pertussis
ccgccgcggccu

SEQ ID NO: 303164 - RNA, 20 nt, Bordetella pertussis
ccgccgcgggauucugcugc

SEQ ID NO: 303165 - RNA, 15 nt, Bordetella pertussis
ccgccgcgggcgccg

SEQ ID NO: 303166 - RNA, 18 nt, Bordetella pertussis
ccgccgcgggcgccgcgc

SEQ ID NO: 303167 - RNA, 21 nt, Bordetella pertussis
ccgccgcguccucggccuggc

SEQ ID NO: 303168 - RNA, 15 nt, Bordetella pertussis
ccgccgcgugcgccg

SEQ ID NO: 303169 - RNA, 17 nt, Bordetella pertussis
ccgccgcguggcggcgc

SEQ ID NO: 303170 - RNA, 14 nt, Bordetella pertussis
ccgccgcuggucgu

SEQ ID NO: 303171 - RNA, 23 nt, Bordetella pertussis
ccgccggaggcacuccgucaugg

SEQ ID NO: 303172 - RNA, 15 nt, Bordetella pertussis
ccgccggcaccagcg

SEQ ID NO: 303173 - RNA, 17 nt, Bordetella pertussis
ccgccggcaccagcgcc

SEQ ID NO: 303174 - RNA, 20 nt, Bordetella pertussis
ccgccggcaccagcgccacg

SEQ ID NO: 303175 - RNA, 13 nt, Bordetella pertussis
ccgccggcacccg

SEQ ID NO: 303176 - RNA, 15 nt, Bordetella pertussis
ccgccggcagggcca

SEQ ID NO: 303177 - RNA, 12 nt, Bordetella pertussis
ccgccggccacc

SEQ ID NO: 303178 - RNA, 16 nt, Bordetella pertussis
ccgccggccagggcga

SEQ ID NO: 303179 - RNA, 12 nt, Bordetella pertussis
ccgccggccauc

SEQ ID NO: 303180 - RNA, 18 nt, Bordetella pertussis
ccgccggccaucacgccg

SEQ ID NO: 303181 - RNA, 14 nt, Bordetella pertussis
ccgccggcccagga

SEQ ID NO: 303182 - RNA, 22 nt, Bordetella pertussis
ccgccggcccaggauggcgcca

SEQ ID NO: 303183 - RNA, 14 nt, Bordetella pertussis
ccgccggcccgcca

SEQ ID NO: 303184 - RNA, 21 nt, Bordetella pertussis
ccgccggccucuucgucgccg

SEQ ID NO: 303185 - RNA, 17 nt, Bordetella pertussis
ccgccggccugcucgcc

SEQ ID NO: 303186 - RNA, 21 nt, Bordetella pertussis
ccgccggcgaugaucgccucg

SEQ ID NO: 303187 - RNA, 22 nt, Bordetella pertussis
ccgccgggcuggauccggcgcu

SEQ ID NO: 303188 - RNA, 17 nt, Bordetella pertussis
ccgccggugauaugcgc

SEQ ID NO: 303189 - RNA, 19 nt, Bordetella pertussis
ccgccggugcaccaggcca

SEQ ID NO: 303190 - RNA, 20 nt, Bordetella pertussis
ccgccggugcaccaggccac

SEQ ID NO: 303191 - RNA, 13 nt, Bordetella pertussis
ccgccggugucgg

SEQ ID NO: 303192 - RNA, 14 nt, Bordetella pertussis
ccgccgugacgcug

SEQ ID NO: 303193 - RNA, 17 nt, Bordetella pertussis
ccgccgugacgcugaug

SEQ ID NO: 303194 - RNA, 14 nt, Bordetella pertussis
ccgccgugacuucg

SEQ ID NO: 303195 - RNA, 18 nt, Bordetella pertussis
ccgccgugcaggcccggg

SEQ ID NO: 303196 - RNA, 18 nt, Bordetella pertussis
ccgccgugcgagcacggc

SEQ ID NO: 303197 - RNA, 14 nt, Bordetella pertussis
ccgccguggccggc

SEQ ID NO: 303198 - RNA, 22 nt, Bordetella pertussis
ccgccguggcguugacggccca

SEQ ID NO: 303199 - RNA, 23 nt, Bordetella pertussis
aaauggggcggccgggagccugu

SEQ ID NO: 303200 - RNA, 14 nt, Bordetella pertussis
ccgccucgaugccc

SEQ ID NO: 303201 - RNA, 14 nt, Bordetella pertussis
ccgccucgaccggc

SEQ ID NO: 303202 - RNA, 15 nt, Bordetella pertussis
ccgccucgacgcccg

SEQ ID NO: 303203 - RNA, 17 nt, Bordetella pertussis
ccgccucgacgcccggg

SEQ ID NO: 303204 - RNA, 17 nt, Bordetella pertussis
ccgccucgaucgccagg

SEQ ID NO: 303205 - RNA, 18 nt, Bordetella pertussis
ccgccucgaucgccaggu

SEQ ID NO: 303206 - RNA, 12 nt, Bordetella pertussis
ccgccucggcgg

SEQ ID NO: 303207 - RNA, 21 nt, Bordetella pertussis
ccgccucggcggccagcgcgc

SEQ ID NO: 303208 - RNA, 15 nt, Bordetella pertussis
ccgccugagcacaug

SEQ ID NO: 303209 - RNA, 16 nt, Bordetella pertussis
ccgccugagcacaugc

SEQ ID NO: 303210 - RNA, 16 nt, Bordetella pertussis
ccgccugcagcagcgc

SEQ ID NO: 303211 - RNA, 13 nt, Bordetella pertussis
ccgccugccaguu

SEQ ID NO: 303212 - RNA, 14 nt, Bordetella pertussis
ccgccugcgccagc

SEQ ID NO: 303213 - RNA, 15 nt, Bordetella pertussis
ccgccugcgccagcc

SEQ ID NO: 303214 - RNA, 19 nt, Bordetella pertussis
ccgccugcgccagccgcgc

SEQ ID NO: 303215 - RNA, 22 nt, Bordetella pertussis
ccgccugcgccgucugcgccgc

SEQ ID NO: 303216 - RNA, 23 nt, Bordetella pertussis
ccgccugcgccgucugcgccgcc

SEQ ID NO: 303217 - RNA, 15 nt, Bordetella pertussis
ccgcgaaucaugcgg

SEQ ID NO: 303218 - RNA, 14 nt, Bordetella pertussis
ccgcgacacaaggc

SEQ ID NO: 303219 - RNA, 19 nt, Bordetella pertussis
ccgcgacacaaggcggccg

SEQ ID NO: 303220 - RNA, 20 nt, Bordetella pertussis
ccgcgacacaaggcggccgc

SEQ ID NO: 303221 - RNA, 22 nt, Bordetella pertussis
ccgcgacacaaggcggccgcgc

SEQ ID NO: 303222 - RNA, 15 nt, Bordetella pertussis
ccgcgaccaugcggc

SEQ ID NO: 303223 - RNA, 19 nt, Bordetella pertussis
ccgcgaccaugcggccguc

SEQ ID NO: 303224 - RNA, 20 nt, Bordetella pertussis
ccgcgaccaugcggccgucg

SEQ ID NO: 303225 - RNA, 21 nt, Bordetella pertussis
ccgcgaccaugcggccgucgc

SEQ ID NO: 303226 - RNA, 23 nt, Bordetella pertussis
ccgcgaccaugcggccgucgccg

SEQ ID NO: 303227 - RNA, 24 nt, Bordetella pertussis
ccgcgaccacggucuggcgcgaca

SEQ ID NO: 303228 - RNA, 14 nt, Bordetella pertussis
ccgcgacccagaac

SEQ ID NO: 303229 - RNA, 19 nt, Bordetella pertussis
ccgcgacccagaacccggc

SEQ ID NO: 303230 - RNA, 19 nt, Bordetella pertussis
ccgcgacccgauagccgcg

SEQ ID NO: 303231 - RNA, 23 nt, Bordetella pertussis
ccgcgacgcauauccaggcggcg

SEQ ID NO: 303232 - RNA, 19 nt, Bordetella pertussis
ccgcgacgcccuggccuuc

SEQ ID NO: 303233 - RNA, 17 nt, Bordetella pertussis
ccgcgacgcuacagcgu

SEQ ID NO: 303234 - RNA, 12 nt, Bordetella pertussis
ccgcgacgcugu

SEQ ID NO: 303235 - RNA, 21 nt, Bordetella pertussis
ccgcgacgguccugcgcgccg

SEQ ID NO: 303236 - RNA, 14 nt, Bordetella pertussis
ccgcgagcaugcgc

SEQ ID NO: 303237 - RNA, 20 nt, Bordetella pertussis
ccgcgagcaugcgcagcgcg

SEQ ID NO: 303238 - RNA, 14 nt, Bordetella pertussis
ccgcgauggcgccg

SEQ ID NO: 303239 - RNA, 17 nt, Bordetella pertussis
ccgcgcaggaugacgug

SEQ ID NO: 303240 - RNA, 19 nt, Bordetella pertussis
ccgcgcaggauuucaucgc

SEQ ID NO: 303241 - RNA, 19 nt, Bordetella pertussis
ccgcgcaucgaucaggcug

SEQ ID NO: 303242 - RNA, 21 nt, Bordetella pertussis
ccgcgcaugauuccugucgcg

SEQ ID NO: 303243 - RNA, 23 nt, Bordetella pertussis
ccgcgcaugcaagacaggccgcu

SEQ ID NO: 303244 - RNA, 23 nt, Bordetella pertussis
ccgcgcaugccagcuugcaggcg

SEQ ID NO: 303245 - RNA, 18 nt, Bordetella pertussis
ccgcgcauuugccgcggc

SEQ ID NO: 303246 - RNA, 12 nt, Bordetella pertussis
ccgcgcccagca

SEQ ID NO: 303247 - RNA, 16 nt, Bordetella pertussis
ccgcgcccagcgcggc

SEQ ID NO: 303248 - RNA, 17 nt, Bordetella pertussis
ccgcgcccagcgugugg

SEQ ID NO: 303249 - RNA, 14 nt, Bordetella pertussis
ccgcgcccagcuug

SEQ ID NO: 303250 - RNA, 15 nt, Bordetella pertussis
ccgcgcccagguccu

SEQ ID NO: 303251 - RNA, 23 nt, Bordetella pertussis
ccgcgcccagguccugcgccagc

SEQ ID NO: 303252 - RNA, 17 nt, Bordetella pertussis
ccgcgcccagcagcgcc

SEQ ID NO: 303253 - RNA, 15 nt, Bordetella pertussis
ccgcgcccagcaugg

SEQ ID NO: 303254 - RNA, 14 nt, Bordetella pertussis
ccgcgcccaugcgc

SEQ ID NO: 303255 - RNA, 16 nt, Bordetella pertussis
ccgcgccccuagcgcc

SEQ ID NO: 303256 - RNA, 20 nt, Bordetella pertussis
ccgcgccccuagcgccgcgc

SEQ ID NO: 303257 - RNA, 22 nt, Bordetella pertussis
ccgcgccccuagcgccgcgcca

SEQ ID NO: 303258 - RNA, 17 nt, Bordetella pertussis
ccgcgcccgccgcgcca

SEQ ID NO: 303259 - RNA, 23 nt, Bordetella pertussis
ccgcgcccgccuucagcgggccg

SEQ ID NO: 303260 - RNA, 19 nt, Bordetella pertussis
ccgcgcccgcuugcggccg

SEQ ID NO: 303261 - RNA, 21 nt, Bordetella pertussis
ccgcgcccggcggccaggccg

SEQ ID NO: 303262 - RNA, 22 nt, Bordetella pertussis
ccgcgccgcccgcggccagcca

SEQ ID NO: 303263 - RNA, 14 nt, Bordetella pertussis
ccgcgccgcccacg

SEQ ID NO: 303264 - RNA, 15 nt, Bordetella pertussis
ccgcgccgcccacgc

SEQ ID NO: 303265 - RNA, 14 nt, Bordetella pertussis
ccgcgccgcccccg

SEQ ID NO: 303266 - RNA, 13 nt, Bordetella pertussis
ccgcgccgcccgc

SEQ ID NO: 303267 - RNA, 17 nt, Bordetella pertussis
ccgcgccgccgcccugg

SEQ ID NO: 303268 - RNA, 14 nt, Bordetella pertussis
ccgcgccgccgcgc

SEQ ID NO: 303269 - RNA, 19 nt, Bordetella pertussis
ccgcgccgccgcgcccugg

SEQ ID NO: 303270 - RNA, 15 nt, Bordetella pertussis
ccgcgccgcgccggu

SEQ ID NO: 303271 - RNA, 13 nt, Bordetella pertussis
ccgcgccgcggca

SEQ ID NO: 303272 - RNA, 16 nt, Bordetella pertussis
ccgcgccgcggcacgg

SEQ ID NO: 303273 - RNA, 14 nt, Bordetella pertussis
ccgcgccggcgcgc

SEQ ID NO: 303274 - RNA, 17 nt, Bordetella pertussis
ccgcgccggcggcaagg

SEQ ID NO: 303275 - RNA, 14 nt, Bordetella pertussis
ccgcgccggcucgu

SEQ ID NO: 303276 - RNA, 17 nt, Bordetella pertussis
ccgcgccggggcggcgc

SEQ ID NO: 303277 - RNA, 12 nt, Bordetella pertussis
ccgcgccggggu

SEQ ID NO: 303278 - RNA, 17 nt, Bordetella pertussis
ccgcgccgggcgcgccg

SEQ ID NO: 303279 - RNA, 21 nt, Bordetella pertussis
ccgcgccguaccugcagcagg

SEQ ID NO: 303280 - RNA, 16 nt, Bordetella pertussis
ccgcgcgaugcgcggc

SEQ ID NO: 303281 - RNA, 18 nt, Bordetella pertussis
ccgcgcgaugcgcggccc

SEQ ID NO: 303282 - RNA, 21 nt, Bordetella pertussis
ccgcgcgaugcgcggcccggc

SEQ ID NO: 303283 - RNA, 12 nt, Bordetella pertussis
ccgcgcgcagcg

SEQ ID NO: 303284 - RNA, 20 nt, Bordetella pertussis
ccgcgcgcagcgaggccucg

SEQ ID NO: 303285 - RNA, 13 nt, Bordetella pertussis
ccgcgcgcagcgc

SEQ ID NO: 303286 - RNA, 17 nt, Bordetella pertussis
ccgcgcgcagcgcgccg

SEQ ID NO: 303287 - RNA, 19 nt, Bordetella pertussis
ccgcgcgcacgaccaccag

SEQ ID NO: 303288 - RNA, 10 nt, Bordetella pertussis
ccgcgcgccg

SEQ ID NO: 303289 - RNA, 11 nt, Bordetella pertussis
ccgcgcgccgc

SEQ ID NO: 303290 - RNA, 12 nt, Bordetella pertussis
ccgcgcgccgcg

SEQ ID NO: 303291 - RNA, 16 nt, Bordetella pertussis
ccgcgcgccgcgccuu

SEQ ID NO: 303292 - RNA, 12 nt, Bordetella pertussis
ccgcgcgccgcu

SEQ ID NO: 303293 - RNA, 22 nt, Bordetella pertussis
ccgcgcgccgcuguggacgccg

SEQ ID NO: 303294 - RNA, 16 nt, Bordetella pertussis
ccgcgcgccggcgccg

SEQ ID NO: 303295 - RNA, 22 nt, Bordetella pertussis
ccgcgcgccggcgccggcgcgc

SEQ ID NO: 303296 - RNA, 13 nt, Bordetella pertussis
ccgcgcgccgggu

SEQ ID NO: 303297 - RNA, 20 nt, Bordetella pertussis
ccgcgcgccucgaugauggc

SEQ ID NO: 303298 - RNA, 21 nt, Bordetella pertussis
ccgcgcgccugcucguacagc

SEQ ID NO: 303299 - RNA, 22 nt, Bordetella pertussis
ccgcgcgccuuccugggcgccg

SEQ ID NO: 303300 - RNA, 17 nt, Bordetella pertussis
ccgcgcgcgagcugcgc

SEQ ID NO: 303301 - RNA, 15 nt, Bordetella pertussis
ccgcgcggccagcgc

SEQ ID NO: 303302 - RNA, 16 nt, Bordetella pertussis
ccgcgcggccagcgcc

SEQ ID NO: 303303 - RNA, 14 nt, Bordetella pertussis
ccgcgcggccgggc

SEQ ID NO: 303304 - RNA, 23 nt, Bordetella pertussis
ccgcgcggccgggcucaggcugc

SEQ ID NO: 303305 - RNA, 21 nt, Bordetella pertussis
ccgcgcggccgucaggcguug

SEQ ID NO: 303306 - RNA, 17 nt, Bordetella pertussis
ccgcgcggcgcugcacg

SEQ ID NO: 303307 - RNA, 16 nt, Bordetella pertussis
ccgcgcuucgucggcg

SEQ ID NO: 303308 - RNA, 18 nt, Bordetella pertussis
ccgcggaaagcuggcguu

SEQ ID NO: 303309 - RNA, 22 nt, Bordetella pertussis
ccgcggaagucgggcaccagca

SEQ ID NO: 303310 - RNA, 14 nt, Bordetella pertussis
ccgcggacccaggc

SEQ ID NO: 303311 - RNA, 19 nt, Bordetella pertussis
ccgcggacgaagccuaggc

SEQ ID NO: 303312 - RNA, 23 nt, Bordetella pertussis
ccgcggaggugucgccgcccaug

SEQ ID NO: 303313 - RNA, 14 nt, Bordetella pertussis
ccgcggaggcgaaa

SEQ ID NO: 303314 - RNA, 23 nt, Bordetella pertussis
ccgcggcaaauggggcggccggg

SEQ ID NO: 303315 - RNA, 15 nt, Bordetella pertussis
ccgcggcaagccgcg

SEQ ID NO: 303316 - RNA, 20 nt, Bordetella pertussis
ccgcggcaagccgcggcggu

SEQ ID NO: 303317 - RNA, 15 nt, Bordetella pertussis
ccgcggcaggccccg

SEQ ID NO: 303318 - RNA, 17 nt, Bordetella pertussis
ccgcggcaggccccggc

SEQ ID NO: 303319 - RNA, 19 nt, Bordetella pertussis
ccgcggcaggccccggccc

SEQ ID NO: 303320 - RNA, 22 nt, Bordetella pertussis
ccgcggcaggccccggcccggc

SEQ ID NO: 303321 - RNA, 14 nt, Bordetella pertussis
ccgcggccaccagg

SEQ ID NO: 303322 - RNA, 14 nt, Bordetella pertussis
ccgcggcaugcugg

SEQ ID NO: 303323 - RNA, 15 nt, Bordetella pertussis
ccgcggccagccacg

SEQ ID NO: 303324 - RNA, 19 nt, Bordetella pertussis
ccgcggccagccacgccgg

SEQ ID NO: 303325 - RNA, 17 nt, Bordetella pertussis
ccgcggccagcgccgcg

SEQ ID NO: 303326 - RNA, 18 nt, Bordetella pertussis
ccgcggcccagcgcggcg

SEQ ID NO: 303327 - RNA, 14 nt, Bordetella pertussis
ccgcggcccgcccg

SEQ ID NO: 303328 - RNA, 15 nt, Bordetella pertussis
ccgcggcccgcccgc

SEQ ID NO: 303329 - RNA, 21 nt, Bordetella pertussis
ccgcggcccuugcgcgaaggc

SEQ ID NO: 303330 - RNA, 12 nt, Bordetella pertussis
ccgcggccgcgc

SEQ ID NO: 303331 - RNA, 15 nt, Bordetella pertussis
ccgcggccgcgcugg

SEQ ID NO: 303332 - RNA, 11 nt, Bordetella pertussis
ccgcggccggc

SEQ ID NO: 303333 - RNA, 19 nt, Bordetella pertussis
ccgcggccggguggccgcg

SEQ ID NO: 303334 - RNA, 12 nt, Bordetella pertussis
ccgcggcgcagg

SEQ ID NO: 303335 - RNA, 16 nt, Bordetella pertussis
ccgcggcgcaggucca

SEQ ID NO: 303336 - RNA, 19 nt, Bordetella pertussis
ccgcggcgcagguccaccg

SEQ ID NO: 303337 - RNA, 14 nt, Bordetella pertussis
ccgcggcgccagcg

SEQ ID NO: 303338 - RNA, 13 nt, Bordetella pertussis
ccgcggcgccccg

SEQ ID NO: 303339 - RNA, 14 nt, Bordetella pertussis
ccgcggcgcgcgcg

SEQ ID NO: 303340 - RNA, 22 nt, Bordetella pertussis
ccgcggcgcgcgcggcgccugg

SEQ ID NO: 303341 - RNA, 16 nt, Bordetella pertussis
ccgcggcgcggccuuc

SEQ ID NO: 303342 - RNA, 16 nt, Bordetella pertussis
ccgcggcgcuggaugg

SEQ ID NO: 303343 - RNA, 23 nt, Bordetella pertussis
ccgcggcgcuggauggcucgggc

SEQ ID NO: 303344 - RNA, 20 nt, Bordetella pertussis
ccgcggcgggcucggcgccg

SEQ ID NO: 303345 - RNA, 18 nt, Bordetella pertussis
ccgcggcgguuucggccg

SEQ ID NO: 303346 - RNA, 23 nt, Bordetella pertussis
ccgcggcguccgaauacgccacg

SEQ ID NO: 303347 - RNA, 17 nt, Bordetella pertussis
ccgcggcuugccgcggc

SEQ ID NO: 303348 - RNA, 18 nt, Bordetella pertussis
ccgcgggcaaagcccagc

SEQ ID NO: 303349 - RNA, 19 nt, Bordetella pertussis
ccgcgggcaaagcccagca

SEQ ID NO: 303350 - RNA, 20 nt, Bordetella pertussis
ccgcgggcaaagcccagcaa

SEQ ID NO: 303351 - RNA, 13 nt, Bordetella pertussis
ccgcgggcauccu

SEQ ID NO: 303352 - RNA, 14 nt, Bordetella pertussis
ccgcgggccgcugg

SEQ ID NO: 303353 - RNA, 14 nt, Bordetella pertussis
ccgcgggcgcccgg

SEQ ID NO: 303354 - RNA, 19 nt, Bordetella pertussis
ccgcgggcgcccggccggc

SEQ ID NO: 303355 - RNA, 14 nt, Bordetella pertussis
ccgcgggcgccgcg

SEQ ID NO: 303356 - RNA, 16 nt, Bordetella pertussis
ccgcgggcgcgcgccc

SEQ ID NO: 303357 - RNA, 16 nt, Bordetella pertussis
ccgcggguucggcggu

SEQ ID NO: 303358 - RNA, 18 nt, Bordetella pertussis
ccgcgguaaugacgcagc

SEQ ID NO: 303359 - RNA, 19 nt, Bordetella pertussis
ccgcgucgaucagcgcggg

SEQ ID NO: 303360 - RNA, 14 nt, Bordetella pertussis
ccgcgucgccgccg

SEQ ID NO: 303361 - RNA, 12 nt, Bordetella pertussis
ccgcgucgagcg

SEQ ID NO: 303362 - RNA, 17 nt, Bordetella pertussis
ccgcgucggacgcgcgc

SEQ ID NO: 303363 - RNA, 19 nt, Bordetella pertussis
ccgcgucggacgcgcgccg

SEQ ID NO: 303364 - RNA, 14 nt, Bordetella pertussis
ccgcgucggccgcg

SEQ ID NO: 303365 - RNA, 13 nt, Bordetella pertussis
ccgcgugccuguc

SEQ ID NO: 303366 - RNA, 12 nt, Bordetella pertussis
ccgcguggauuu

SEQ ID NO: 303367 - RNA, 21 nt, Bordetella pertussis
ccgcguggauuuugcggaagg

SEQ ID NO: 303368 - RNA, 15 nt, Bordetella pertussis
ccgcguggcgcugcg

SEQ ID NO: 303369 - RNA, 19 nt, Bordetella pertussis
ccgcguggcggcgcagcgc

SEQ ID NO: 303370 - RNA, 14 nt, Bordetella pertussis
ccgcguucacgccg

SEQ ID NO: 303371 - RNA, 22 nt, Bordetella pertussis
ccgcguucacgccggcgcgccg

SEQ ID NO: 303372 - RNA, 23 nt, Bordetella pertussis
ccgcguucacgccggcgcgccgg

SEQ ID NO: 303373 - RNA, 20 nt, Bordetella pertussis
ccgcguugaaguccggaucc

SEQ ID NO: 303374 - RNA, 17 nt, Bordetella pertussis
ccgcguugaccggcugg

SEQ ID NO: 303375 - RNA, 22 nt, Bordetella pertussis
ccgcguugaccggcuggcgcac

SEQ ID NO: 303376 - RNA, 14 nt, Bordetella pertussis
ccgcguugagcgcc

SEQ ID NO: 303377 - RNA, 15 nt, Bordetella pertussis
ccgcguugagcgccg

SEQ ID NO: 303378 - RNA, 23 nt, Bordetella pertussis
ccgcguugcgcugcccgucgcug

SEQ ID NO: 303379 - RNA, 16 nt, Bordetella pertussis
ccgcguugcagccaca

SEQ ID NO: 303380 - RNA, 17 nt, Bordetella pertussis
ccgcuaucauccgcgca

SEQ ID NO: 303381 - RNA, 20 nt, Bordetella pertussis
ccgcuaucauccgcgcauga

SEQ ID NO: 303382 - RNA, 14 nt, Bordetella pertussis
ccgcuaugacgacc

SEQ ID NO: 303383 - RNA, 20 nt, Bordetella pertussis
ccgcuaugcgggcuugcugc

SEQ ID NO: 303384 - RNA, 22 nt, Bordetella pertussis
ccgcuaugcgggcuugcugccc

SEQ ID NO: 303385 - RNA, 17 nt, Bordetella pertussis
ccgcucaauucggccug

SEQ ID NO: 303386 - RNA, 20 nt, Bordetella pertussis
ccgcucaggauacgugcugc

SEQ ID NO: 303387 - RNA, 22 nt, Bordetella pertussis
ccgcucagguagaccacgcgcu

SEQ ID NO: 303388 - RNA, 14 nt, Bordetella pertussis
ccgcuccaccagca

SEQ ID NO: 303389 - RNA, 22 nt, Bordetella pertussis
ccgcucaugccggcaagcacga

SEQ ID NO: 303390 - RNA, 17 nt, Bordetella pertussis
ccgcuccaggcggccag

SEQ ID NO: 303391 - RNA, 14 nt, Bordetella pertussis
ccgcucguaucgcc

SEQ ID NO: 303392 - RNA, 16 nt, Bordetella pertussis
ccgcugccgcgcgccg

SEQ ID NO: 303393 - RNA, 18 nt, Bordetella pertussis
ccgcugccgcgcgccggc

SEQ ID NO: 303394 - RNA, 22 nt, Bordetella pertussis
ccgcugccggccgaccggcgcg

SEQ ID NO: 303395 - RNA, 15 nt, Bordetella pertussis
ccgcugcgcagcagc

SEQ ID NO: 303396 - RNA, 17 nt, Bordetella pertussis
ccgcugcgcagcagcgc

SEQ ID NO: 303397 - RNA, 15 nt, Bordetella pertussis
ccgcugcgccgaggc

SEQ ID NO: 303398 - RNA, 15 nt, Bordetella pertussis
ccgcugcgcuggccg

SEQ ID NO: 303399 - RNA, 23 nt, Bordetella pertussis
ccgcugcggcaagggugccuguc

SEQ ID NO: 303400 - RNA, 17 nt, Bordetella pertussis
ccgcuggccagccgcuc

SEQ ID NO: 303401 - RNA, 18 nt, Bordetella pertussis
ccgcuggccaugccgucg

SEQ ID NO: 303402 - RNA, 20 nt, Bordetella pertussis
ccgcuggccaugccgucgcg

SEQ ID NO: 303403 - RNA, 14 nt, Bordetella pertussis
ccgcuggccgucgc

SEQ ID NO: 303404 - RNA, 22 nt, Bordetella pertussis
ccgcuggccgucgccgcccugc

SEQ ID NO: 303405 - RNA, 12 nt, Bordetella pertussis
ccgcuggcggca

SEQ ID NO: 303406 - RNA, 18 nt, Bordetella pertussis
ccgcuggcggcacacgca

SEQ ID NO: 303407 - RNA, 14 nt, Bordetella pertussis
ccgcuggcgcgccg

SEQ ID NO: 303408 - RNA, 19 nt, Bordetella pertussis
ccgcuggcuggcagcgacc

SEQ ID NO: 303409 - RNA, 15 nt, Bordetella pertussis
ccgcugggacaggca

SEQ ID NO: 303410 - RNA, 18 nt, Bordetella pertussis
ccgcugggacaggcacac

SEQ ID NO: 303411 - RNA, 19 nt, Bordetella pertussis
ccgcugggacaggcacacc

SEQ ID NO: 303412 - RNA, 20 nt, Bordetella pertussis
ccgcugggacaggcacaccg

SEQ ID NO: 303413 - RNA, 17 nt, Bordetella pertussis
ccgcuggucaccgcccc

SEQ ID NO: 303414 - RNA, 22 nt, Bordetella pertussis
ccgcuggugaucugcugcgugg

SEQ ID NO: 303415 - RNA, 13 nt, Bordetella pertussis
ccgcugucgcagg

SEQ ID NO: 303416 - RNA, 21 nt, Bordetella pertussis
ccgcugucgcaggcgcugcag

SEQ ID NO: 303417 - RNA, 18 nt, Bordetella pertussis
ccgcuguggacgccgccg

SEQ ID NO: 303418 - RNA, 15 nt, Bordetella pertussis
ccgcuguggcgcgcc

SEQ ID NO: 303419 - RNA, 23 nt, Bordetella pertussis
ccgcuguugcccaccagccgggc

SEQ ID NO: 303420 - RNA, 21 nt, Bordetella pertussis
ccgcuuccgccaccgcgccgc

SEQ ID NO: 303421 - RNA, 21 nt, Bordetella pertussis
ccgcuucgaugcuggcggcau

SEQ ID NO: 303422 - RNA, 16 nt, Bordetella pertussis
ccgcuucggcggccgc

SEQ ID NO: 303423 - RNA, 17 nt, Bordetella pertussis
ccgcuucggucagcugc

SEQ ID NO: 303424 - RNA, 14 nt, Bordetella pertussis
ccgcuucgucgggc

SEQ ID NO: 303425 - RNA, 22 nt, Bordetella pertussis
ccgcuucgucgggcagcgcggc

SEQ ID NO: 303426 - RNA, 16 nt, Bordetella pertussis
ccgcuucuucgucgcg

SEQ ID NO: 303427 - RNA, 22 nt, Bordetella pertussis
ccgcuugaaguaaucgcccggc

SEQ ID NO: 303428 - RNA, 15 nt, Bordetella pertussis
ccgcuuucgaccagc

SEQ ID NO: 303429 - RNA, 15 nt, Bordetella pertussis
ccggcaugaccgcgg

SEQ ID NO: 303430 - RNA, 22 nt, Bordetella pertussis
ccggcaugccguccacgcccag

SEQ ID NO: 303431 - RNA, 23 nt, Bordetella pertussis
ccggcaugccguccacgcccagc

SEQ ID NO: 303432 - RNA, 14 nt, Bordetella pertussis
ccggcaugggcgug

SEQ ID NO: 303433 - RNA, 17 nt, Bordetella pertussis
ccggcaugggcgugccg

SEQ ID NO: 303434 - RNA, 23 nt, Bordetella pertussis
ccggcaugggcgugccgcgcugg

SEQ ID NO: 303435 - RNA, 17 nt, Bordetella pertussis
ccggcauguugccgcug

SEQ ID NO: 303436 - RNA, 18 nt, Bordetella pertussis
ccggcauguugccgcugg

SEQ ID NO: 303437 - RNA, 15 nt, Bordetella pertussis
ccggcauugcccacc

SEQ ID NO: 303438 - RNA, 21 nt, Bordetella pertussis
ccggcauuucgcugggcgcgc

SEQ ID NO: 303439 - RNA, 22 nt, Bordetella pertussis
ccggcauuucgcugggcgcgca

SEQ ID NO: 303440 - RNA, 22 nt, Bordetella pertussis
ccggccaacagcucgcgccagg

SEQ ID NO: 303441 - RNA, 12 nt, Bordetella pertussis
ccggccaccagc

SEQ ID NO: 303442 - RNA, 14 nt, Bordetella pertussis
ccggccaccgccug

SEQ ID NO: 303443 - RNA, 19 nt, Bordetella pertussis
ccggccaccucuucagccc

SEQ ID NO: 303444 - RNA, 15 nt, Bordetella pertussis
ccggccacggccggg

SEQ ID NO: 303445 - RNA, 14 nt, Bordetella pertussis
ccggccacgugugg

SEQ ID NO: 303446 - RNA, 18 nt, Bordetella pertussis
ccggccagagccuggaag

SEQ ID NO: 303447 - RNA, 16 nt, Bordetella pertussis
ccggccagcacgccgg

SEQ ID NO: 303448 - RNA, 13 nt, Bordetella pertussis
ccggccagcacgc

SEQ ID NO: 303449 - RNA, 18 nt, Bordetella pertussis
ccggccagccauugccgc

SEQ ID NO: 303450 - RNA, 14 nt, Bordetella pertussis
ccggccagccugcc

SEQ ID NO: 303451 - RNA, 15 nt, Bordetella pertussis
ccggccagccugccc

SEQ ID NO: 303452 - RNA, 17 nt, Bordetella pertussis
ccggccagcgcgccggc

SEQ ID NO: 303453 - RNA, 18 nt, Bordetella pertussis
ccggccagcgcggcaucg

SEQ ID NO: 303454 - RNA, 20 nt, Bordetella pertussis
ccggccagcgcggcaucggc

SEQ ID NO: 303455 - RNA, 14 nt, Bordetella pertussis
ccggccagcgcggu

SEQ ID NO: 303456 - RNA, 16 nt, Bordetella pertussis
ccggccaucacgccga

SEQ ID NO: 303457 - RNA, 17 nt, Bordetella pertussis
ccggccccgcaaggggc

SEQ ID NO: 303458 - RNA, 23 nt, Bordetella pertussis
ccggcccgaagauuuccucgcgc

SEQ ID NO: 303459 - RNA, 18 nt, Bordetella pertussis
ccggcccugccgcccugg

SEQ ID NO: 303460 - RNA, 18 nt, Bordetella pertussis
ccggccgaaaccgccgcg

SEQ ID NO: 303461 - RNA, 19 nt, Bordetella pertussis
ccggccgaaaccgccgcgg

SEQ ID NO: 303462 - RNA, 14 nt, Bordetella pertussis
ccggccgacaggug

SEQ ID NO: 303463 - RNA, 17 nt, Bordetella pertussis
ccggccgaccggcgcgc

SEQ ID NO: 303464 - RNA, 18 nt, Bordetella pertussis
ccggccgaccggcgcgcg

SEQ ID NO: 303465 - RNA, 13 nt, Bordetella pertussis
ccggccgacggca

SEQ ID NO: 303466 - RNA, 15 nt, Bordetella pertussis
ccggccgacggcgcu

SEQ ID NO: 303467 - RNA, 14 nt, Bordetella pertussis
ccggccgacccgcg

SEQ ID NO: 303468 - RNA, 16 nt, Bordetella pertussis
ccggccgauagccgcg

SEQ ID NO: 303469 - RNA, 22 nt, Bordetella pertussis
ccggccgauagccgcggcgccg

SEQ ID NO: 303470 - RNA, 15 nt, Bordetella pertussis
ccggccgcgcccaug

SEQ ID NO: 303471 - RNA, 14 nt, Bordetella pertussis
ccggccgcgcccga

SEQ ID NO: 303472 - RNA, 18 nt, Bordetella pertussis
ccggccgcgcgcgccagg

SEQ ID NO: 303473 - RNA, 15 nt, Bordetella pertussis
ccggccgcguggccg

SEQ ID NO: 303474 - RNA, 13 nt, Bordetella pertussis
ccggccggcacgg

SEQ ID NO: 303475 - RNA, 14 nt, Bordetella pertussis
ccggccggcacggc

SEQ ID NO: 303476 - RNA, 20 nt, Bordetella pertussis
ccggccggcacggccggcca

SEQ ID NO: 303477 - RNA, 22 nt, Bordetella pertussis
ccggccggcacggccggccagg

SEQ ID NO: 303478 - RNA, 15 nt, Bordetella pertussis
ccggccggccuuccg

SEQ ID NO: 303479 - RNA, 13 nt, Bordetella pertussis
ccggccggcgccg

SEQ ID NO: 303480 - RNA, 18 nt, Bordetella pertussis
ccggccggcgccggcaaa

SEQ ID NO: 303481 - RNA, 15 nt, Bordetella pertussis
ccggccgggccagcg

SEQ ID NO: 303482 - RNA, 16 nt, Bordetella pertussis
ccggccgggccagcgc

SEQ ID NO: 303483 - RNA, 23 nt, Bordetella pertussis
ccggccgggccagcgcgaucucg

SEQ ID NO: 303484 - RNA, 16 nt, Bordetella pertussis
ccggccguuucaggcc

SEQ ID NO: 303485 - RNA, 16 nt, Bordetella pertussis
ccggccucaaccgcgc

SEQ ID NO: 303486 - RNA, 14 nt, Bordetella pertussis
ccggccucagcggc

SEQ ID NO: 303487 - RNA, 17 nt, Bordetella pertussis
ccggccucagcggccgc

SEQ ID NO: 303488 - RNA, 18 nt, Bordetella pertussis
ccggccuccagcaucgcc

SEQ ID NO: 303489 - RNA, 15 nt, Bordetella pertussis
ccggccucgcggcgc

SEQ ID NO: 303490 - RNA, 23 nt, Bordetella pertussis
ccggccucuucgucgccggcgcu

SEQ ID NO: 303491 - RNA, 12 nt, Bordetella pertussis
ccggccugcagg

SEQ ID NO: 303492 - RNA, 17 nt, Bordetella pertussis
ccggcgaaagcgucggc

SEQ ID NO: 303493 - RNA, 14 nt, Bordetella pertussis
ccggcgaagccggc

SEQ ID NO: 303494 - RNA, 20 nt, Bordetella pertussis
ccggcgcacgccccgacgcg

SEQ ID NO: 303495 - RNA, 19 nt, Bordetella pertussis
ccggcgcaguuccggcggg

SEQ ID NO: 303496 - RNA, 22 nt, Bordetella pertussis
ccggcgcaguuccggcgggccg

SEQ ID NO: 303497 - RNA, 19 nt, Bordetella pertussis
ccggcgcaugauggccggc

SEQ ID NO: 303498 - RNA, 12 nt, Bordetella pertussis
ccggcgccagcc

SEQ ID NO: 303499 - RNA, 14 nt, Bordetella pertussis
ccggcgccagccag

SEQ ID NO: 303500 - RNA, 13 nt, Bordetella pertussis
ccggcgccagccg

SEQ ID NO: 303501 - RNA, 15 nt, Bordetella pertussis
ccggcgcccccagca

SEQ ID NO: 303502 - RNA, 13 nt, Bordetella pertussis
ccggcgcccgccg

SEQ ID NO: 303503 - RNA, 18 nt, Bordetella pertussis
ccggcgcccggcagccga

SEQ ID NO: 303504 - RNA, 21 nt, Bordetella pertussis
ccggcgcccucuuucgccgcg

SEQ ID NO: 303505 - RNA, 14 nt, Bordetella pertussis
ccggcgcccuugau

SEQ ID NO: 303506 - RNA, 14 nt, Bordetella pertussis
ccggcgccgccggg

SEQ ID NO: 303507 - RNA, 18 nt, Bordetella pertussis
ccggcgccgccucaggcc

SEQ ID NO: 303508 - RNA, 15 nt, Bordetella pertussis
ccggcgccgcgcgcu

SEQ ID NO: 303509 - RNA, 17 nt, Bordetella pertussis
ccggcgccgcgcgcugg

SEQ ID NO: 303510 - RNA, 13 nt, Bordetella pertussis
ccggcgccgcguu

SEQ ID NO: 303511 - RNA, 16 nt, Bordetella pertussis
ccggcgccggcaaacc

SEQ ID NO: 303512 - RNA, 15 nt, Bordetella pertussis
ccggcgccggcgcgc

SEQ ID NO: 303513 - RNA, 16 nt, Bordetella pertussis
ccggcgccggcgcgcc

SEQ ID NO: 303514 - RNA, 18 nt, Bordetella pertussis
ccggcgccggcgcgccgc

SEQ ID NO: 303515 - RNA, 12 nt, Bordetella pertussis
ccggcgccggcu

SEQ ID NO: 303516 - RNA, 14 nt, Bordetella pertussis
ccggcgccggcucc

SEQ ID NO: 303517 - RNA, 18 nt, Bordetella pertussis
ccggcgccgggcagcccg

SEQ ID NO: 303518 - RNA, 21 nt, Bordetella pertussis
ccggcgccgggcagcccgcgc

SEQ ID NO: 303519 - RNA, 14 nt, Bordetella pertussis
ccggcgccuggccc

SEQ ID NO: 303520 - RNA, 16 nt, Bordetella pertussis
ccggcgccuggccgua

SEQ ID NO: 303521 - RNA, 14 nt, Bordetella pertussis
ccggcgccuggggc

SEQ ID NO: 303522 - RNA, 18 nt, Bordetella pertussis
ccggcgccugcggcaugg

SEQ ID NO: 303523 - RNA, 20 nt, Bordetella pertussis
ccggcgcgaacaccggcagg

SEQ ID NO: 303524 - RNA, 23 nt, Bordetella pertussis
ccggcgcgaaccccuccggcguu

SEQ ID NO: 303525 - RNA, 19 nt, Bordetella pertussis
ccggcgcgaacggcuugau

SEQ ID NO: 303526 - RNA, 17 nt, Bordetella pertussis
ccggcgcgacaggcggu

SEQ ID NO: 303527 - RNA, 15 nt, Bordetella pertussis
ccggcgcgaccgccu

SEQ ID NO: 303528 - RNA, 23 nt, Bordetella pertussis
ccggcgcgauggucaccacccgc

SEQ ID NO: 303529 - RNA, 22 nt, Bordetella pertussis
ccggcgcgcaaaccgacgcggc

SEQ ID NO: 303530 - RNA, 16 nt, Bordetella pertussis
ccggcgcgccaggcca

SEQ ID NO: 303531 - RNA, 14 nt, Bordetella pertussis
ccggcgcgccaugg

SEQ ID NO: 303532 - RNA, 15 nt, Bordetella pertussis
ccggcgcgcagcgcc

SEQ ID NO: 303533 - RNA, 21 nt, Bordetella pertussis
ccggcgcgcagcgccugcagg

SEQ ID NO: 303534 - RNA, 19 nt, Bordetella pertussis
ccggcgcgcauccgguggu

SEQ ID NO: 303535 - RNA, 16 nt, Bordetella pertussis
ccggcgcgccacccug

SEQ ID NO: 303536 - RNA, 16 nt, Bordetella pertussis
ccggcgcgccgcccgc

SEQ ID NO: 303537 - RNA, 18 nt, Bordetella pertussis
ccggcgcgccgcgccgcc

SEQ ID NO: 303538 - RNA, 15 nt, Bordetella pertussis
ccggcgcgccggccg

SEQ ID NO: 303539 - RNA, 16 nt, Bordetella pertussis
ccggcgcgccggccgc

SEQ ID NO: 303540 - RNA, 17 nt, Bordetella pertussis
ccggcgcgccggccgcg

SEQ ID NO: 303541 - RNA, 13 nt, Bordetella pertussis
ccggcgcgccggg

SEQ ID NO: 303542 - RNA, 16 nt, Bordetella pertussis
ccggcgcgccuggcgc

SEQ ID NO: 303543 - RNA, 23 nt, Bordetella pertussis
ccggcgcgccuucggcaggcgcc

SEQ ID NO: 303544 - RNA, 10 nt, Bordetella pertussis
ccggcgcgcg

SEQ ID NO: 303545 - RNA, 14 nt, Bordetella pertussis
ccggcgcgcgcagg

SEQ ID NO: 303546 - RNA, 23 nt, Bordetella pertussis
ccggcgcgcgcaugcccgaccgc

SEQ ID NO: 303547 - RNA, 14 nt, Bordetella pertussis
ccggcgcgcgcgac

SEQ ID NO: 303548 - RNA, 16 nt, Bordetella pertussis
ccggcgcgcgcggcca

SEQ ID NO: 303549 - RNA, 14 nt, Bordetella pertussis
ccggcgcgcgcgua

SEQ ID NO: 303550 - RNA, 11 nt, Bordetella pertussis
ccggcgcgccu

SEQ ID NO: 303551 - RNA, 17 nt, Bordetella pertussis
ccggcgcggcagccugg

SEQ ID NO: 303552 - RNA, 20 nt, Bordetella pertussis
ccggcgcggcagccuggggc

SEQ ID NO: 303553 - RNA, 14 nt, Bordetella pertussis
ccggcgcggcgcgc

SEQ ID NO: 303554 - RNA, 18 nt, Bordetella pertussis
ccggcgcggcgcgcgccg

SEQ ID NO: 303555 - RNA, 17 nt, Bordetella pertussis
ccggcgcggccgggggu

SEQ ID NO: 303556 - RNA, 16 nt, Bordetella pertussis
ccggcgcggcugcugg

SEQ ID NO: 303557 - RNA, 22 nt, Bordetella pertussis
ccggcgcggcugcugggcaugg

SEQ ID NO: 303558 - RNA, 22 nt, Bordetella pertussis
ccggcgcggugaggcggccggg

SEQ ID NO: 303559 - RNA, 23 nt, Bordetella pertussis
ccggcgcggugaggcggccgggc

SEQ ID NO: 303560 - RNA, 14 nt, Bordetella pertussis
ccggcgcgggcgca

SEQ ID NO: 303561 - RNA, 21 nt, Bordetella pertussis
ccggcgcgguugguuugcggc

SEQ ID NO: 303562 - RNA, 18 nt, Bordetella pertussis
ccggcgcguccacgccgu

SEQ ID NO: 303563 - RNA, 21 nt, Bordetella pertussis
ccggcgcgugcuggcgcagca

SEQ ID NO: 303564 - RNA, 19 nt, Bordetella pertussis
ccggcgcgucgccggcgau

SEQ ID NO: 303565 - RNA, 17 nt, Bordetella pertussis
ccggcgcgucgcgcggc

SEQ ID NO: 303566 - RNA, 22 nt, Bordetella pertussis
ccggcgcuacagggugccgcgc

SEQ ID NO: 303567 - RNA, 21 nt, Bordetella pertussis
ccggcgcucgccccggcgcgc

SEQ ID NO: 303568 - RNA, 23 nt, Bordetella pertussis
ccggcgcucgccccggcgcgcag

SEQ ID NO: 303569 - RNA, 15 nt, Bordetella pertussis
ccggcgcugcgcagc

SEQ ID NO: 303570 - RNA, 14 nt, Bordetella pertussis
ccggcgcuggcgca

SEQ ID NO: 303571 - RNA, 20 nt, Bordetella pertussis
ccggcgcuggcuucggcgua

SEQ ID NO: 303572 - RNA, 13 nt, Bordetella pertussis
ccggcgcuggccg

SEQ ID NO: 303573 - RNA, 13 nt, Bordetella pertussis
ccggcggaucacc

SEQ ID NO: 303574 - RNA, 22 nt, Bordetella pertussis
ccggcggcaccgcgcagcccgg

SEQ ID NO: 303575 - RNA, 13 nt, Bordetella pertussis
ccggcggcagcgc

SEQ ID NO: 303576 - RNA, 21 nt, Bordetella pertussis
ccggcggcacggccggccugc

SEQ ID NO: 303577 - RNA, 12 nt, Bordetella pertussis
ccggcggccaug

SEQ ID NO: 303578 - RNA, 18 nt, Bordetella pertussis
ccggcggccagcgcgccg

SEQ ID NO: 303579 - RNA, 12 nt, Bordetella pertussis
ccggcggccggu

SEQ ID NO: 303580 - RNA, 21 nt, Bordetella pertussis
ccggcggccuaugugcaggcc

SEQ ID NO: 303581 - RNA, 16 nt, Bordetella pertussis
ccggcggccugcacgg

SEQ ID NO: 303582 - RNA, 15 nt, Bordetella pertussis
ccggcggccugcagg

SEQ ID NO: 303583 - RNA, 17 nt, Bordetella pertussis
ccggcggccuggaccug

SEQ ID NO: 303584 - RNA, 17 nt, Bordetella pertussis
ccggcggcgagcgcggc

SEQ ID NO: 303585 - RNA, 16 nt, Bordetella pertussis
ccggcggcgaucacau

SEQ ID NO: 303586 - RNA, 13 nt, Bordetella pertussis
ccggcggcgcggc

SEQ ID NO: 303587 - RNA, 15 nt, Bordetella pertussis
ccggcggcgcgccgc

SEQ ID NO: 303588 - RNA, 18 nt, Bordetella pertussis
ccggcggcgcgccgccgg

SEQ ID NO: 303589 - RNA, 14 nt, Bordetella pertussis
ccggcggcgcggcg

SEQ ID NO: 303590 - RNA, 15 nt, Bordetella pertussis
ccggcggcgcggcga

SEQ ID NO: 303591 - RNA, 20 nt, Bordetella pertussis
ccggcggcgcucaucaucgc

SEQ ID NO: 303592 - RNA, 14 nt, Bordetella pertussis
ccggcggcgucugg

SEQ ID NO: 303593 - RNA, 16 nt, Bordetella pertussis
ccggcggcgucuggua

SEQ ID NO: 303594 - RNA, 14 nt, Bordetella pertussis
ccggcggcgugccc

SEQ ID NO: 303595 - RNA, 20 nt, Bordetella pertussis
ccggcggcgugcgccugcug

SEQ ID NO: 303596 - RNA, 21 nt, Bordetella pertussis
ccggcggcgugcgccugcugg

SEQ ID NO: 303597 - RNA, 18 nt, Bordetella pertussis
ccggcggcguggccgugc

SEQ ID NO: 303598 - RNA, 20 nt, Bordetella pertussis
ccggcggcguggccgugcug

SEQ ID NO: 303599 - RNA, 21 nt, Bordetella pertussis
ccggcggcguggccgugcugg

SEQ ID NO: 303600 - RNA, 17 nt, Bordetella pertussis
ccggcggcgucggcgcc

SEQ ID NO: 303601 - RNA, 20 nt, Bordetella pertussis
ccggcggcgucggcgcccgg

SEQ ID NO: 303602 - RNA, 23 nt, Bordetella pertussis
ccggcgggcaacuucaccgucga

SEQ ID NO: 303603 - RNA, 18 nt, Bordetella pertussis
ccggcgggcaugacgacc

SEQ ID NO: 303604 - RNA, 14 nt, Bordetella pertussis
ccggcgggccgcac

SEQ ID NO: 303605 - RNA, 17 nt, Bordetella pertussis
ccggcgggccgcuguug

SEQ ID NO: 303606 - RNA, 13 nt, Bordetella pertussis
ccggcgggccggc

SEQ ID NO: 303607 - RNA, 17 nt, Bordetella pertussis
ccggcgggcaggcucca

SEQ ID NO: 303608 - RNA, 14 nt, Bordetella pertussis
ccggcgggggcggg

SEQ ID NO: 303609 - RNA, 17 nt, Bordetella pertussis
ccggcggucccgagcgc

SEQ ID NO: 303610 - RNA, 14 nt, Bordetella pertussis
ccggcggucgcgcu

SEQ ID NO: 303611 - RNA, 16 nt, Bordetella pertussis
ccggcggucgcgcugg

SEQ ID NO: 303612 - RNA, 19 nt, Bordetella pertussis
ccggcggucgcgcuggccc

SEQ ID NO: 303613 - RNA, 13 nt, Bordetella pertussis
ccggcggugaccu

SEQ ID NO: 303614 - RNA, 17 nt, Bordetella pertussis
ccggcguagcugcgccg

SEQ ID NO: 303615 - RNA, 20 nt, Bordetella pertussis
ccggcguagucguugccggc

SEQ ID NO: 303616 - RNA, 21 nt, Bordetella pertussis
ccggcgucaccuugggaucgu

SEQ ID NO: 303617 - RNA, 23 nt, Bordetella pertussis
ccggcgucaccuugggaucgucc

SEQ ID NO: 303618 - RNA, 17 nt, Bordetella pertussis
ccggcgucacgcggccg

SEQ ID NO: 303619 - RNA, 20 nt, Bordetella pertussis
ccggcgucacgcggccgggc

SEQ ID NO: 303620 - RNA, 16 nt, Bordetella pertussis
ccggcguauggcccgc

SEQ ID NO: 303621 - RNA, 20 nt, Bordetella pertussis
ccggcguauggcccgccacc

SEQ ID NO: 303622 - RNA, 16 nt, Bordetella pertussis
ccggcguccacggcau

SEQ ID NO: 303623 - RNA, 17 nt, Bordetella pertussis
ccggcguccacggcauc

SEQ ID NO: 303624 - RNA, 23 nt, Bordetella pertussis
ccggcguccugcggcggcagcuu

SEQ ID NO: 303625 - RNA, 21 nt, Bordetella pertussis
ccggcgucuggagcggccugg

SEQ ID NO: 303626 - RNA, 21 nt, Bordetella pertussis
ccggcgugacgcgcgggucca

SEQ ID NO: 303627 - RNA, 19 nt, Bordetella pertussis
ccggcgugacguggcccac

SEQ ID NO: 303628 - RNA, 19 nt, Bordetella pertussis
ccggcgugauggacgccgg

SEQ ID NO: 303629 - RNA, 20 nt, Bordetella pertussis
ccggcgugauggacgccggg

SEQ ID NO: 303630 - RNA, 17 nt, Bordetella pertussis
ccggcgugccauggacg

SEQ ID NO: 303631 - RNA, 23 nt, Bordetella pertussis
ccggcgugccauggacgccggua

SEQ ID NO: 303632 - RNA, 21 nt, Bordetella pertussis
ccggcgugcuguccgucucgg

SEQ ID NO: 303633 - RNA, 15 nt, Bordetella pertussis
ccggcguggccugcc

SEQ ID NO: 303634 - RNA, 13 nt, Bordetella pertussis
ccggcguggcgcg

SEQ ID NO: 303635 - RNA, 22 nt, Bordetella pertussis
ccggcgugguaucgcgccagcg

SEQ ID NO: 303636 - RNA, 19 nt, Bordetella pertussis
ccggcguguucagcgcgcg

SEQ ID NO: 303637 - RNA, 24 nt, Bordetella pertussis
ccggcguguucagcgcgcgcgccg

SEQ ID NO: 303638 - RNA, 16 nt, Bordetella pertussis
ccggcguucaccagga

SEQ ID NO: 303639 - RNA, 24 nt, Bordetella pertussis
ccggcguucaccaggaagcgcgcc

SEQ ID NO: 303640 - RNA, 18 nt, Bordetella pertussis
ccggcguucuggucagcc

SEQ ID NO: 303641 - RNA, 21 nt, Bordetella pertussis
ccggcguucuggucagccgug

SEQ ID NO: 303642 - RNA, 18 nt, Bordetella pertussis
ccggcguugccgaagcgu

SEQ ID NO: 303643 - RNA, 15 nt, Bordetella pertussis
ccggcguuggccggg

SEQ ID NO: 303644 - RNA, 18 nt, Bordetella pertussis
ccggcguuggccgggucg

SEQ ID NO: 303645 - RNA, 21 nt, Bordetella pertussis
ccggcguuggccgggucgcgc

SEQ ID NO: 303646 - RNA, 23 nt, Bordetella pertussis
ccggcucagccucgagguggcgc

SEQ ID NO: 303647 - RNA, 16 nt, Bordetella pertussis
ccggcuccaggccgcc

SEQ ID NO: 303648 - RNA, 15 nt, Bordetella pertussis
ccggcucccgcgcca

SEQ ID NO: 303649 - RNA, 15 nt, Bordetella pertussis
ccggcucccgcgcug

SEQ ID NO: 303650 - RNA, 23 nt, Bordetella pertussis
ccggcucgaacaggcuggcaugg

SEQ ID NO: 303651 - RNA, 17 nt, Bordetella pertussis
ccggcucgaucgccgcc

SEQ ID NO: 303652 - RNA, 18 nt, Bordetella pertussis
ccggcucgaucgccgccg

SEQ ID NO: 303653 - RNA, 19 nt, Bordetella pertussis
ccggcucgaucgccgccgg

SEQ ID NO: 303654 - RNA, 20 nt, Bordetella pertussis
ccggcugcaccagcgcgccg

SEQ ID NO: 303655 - RNA, 21 nt, Bordetella pertussis
ccggcugcaccagcgcgccgc

SEQ ID NO: 303656 - RNA, 22 nt, Bordetella pertussis
ccggcugcaccagcgcgccgcg

SEQ ID NO: 303657 - RNA, 14 nt, Bordetella pertussis
ccggcugcaugcgc

SEQ ID NO: 303658 - RNA, 22 nt, Bordetella pertussis
ccggcugcaugcgcgaacgcgc

SEQ ID NO: 303659 - RNA, 16 nt, Bordetella pertussis
ccggcugcaagacgcc

SEQ ID NO: 303660 - RNA, 14 nt, Bordetella pertussis
ccggcuuccagcag

SEQ ID NO: 303661 - RNA, 23 nt, Bordetella pertussis
ccggcuuccagcagcaugccgcg

SEQ ID NO: 303662 - RNA, 17 nt, Bordetella pertussis
ccgggagccuguccccg

SEQ ID NO: 303663 - RNA, 18 nt, Bordetella pertussis
ccgggauccacgccgccg

SEQ ID NO: 303664 - RNA, 19 nt, Bordetella pertussis
ccgggauccacgccgccgg

SEQ ID NO: 303665 - RNA, 20 nt, Bordetella pertussis
ccgggauccacgccgccggc

SEQ ID NO: 303666 - RNA, 19 nt, Bordetella pertussis
ccgggaugcugcucggcca

SEQ ID NO: 303667 - RNA, 13 nt, Bordetella pertussis
ccgggcagcgaga

SEQ ID NO: 303668 - RNA, 16 nt, Bordetella pertussis
ccgggcaggccgcgcu

SEQ ID NO: 303669 - RNA, 18 nt, Bordetella pertussis
ccgggcaggccgcgcugg

SEQ ID NO: 303670 - RNA, 19 nt, Bordetella pertussis
ccgggcaggcucagcccgg

SEQ ID NO: 303671 - RNA, 23 nt, Bordetella pertussis
ccgggcaggcucagcccggcgag

SEQ ID NO: 303672 - RNA, 11 nt, Bordetella pertussis
ccgggccggcc

SEQ ID NO: 303673 - RNA, 24 nt, Bordetella pertussis
ccgggccguggcgauccagggccg

SEQ ID NO: 303674 - RNA, 16 nt, Bordetella pertussis
ccgggccuagcccggc

SEQ ID NO: 303675 - RNA, 14 nt, Bordetella pertussis
ccgggccugcccgc

SEQ ID NO: 303676 - RNA, 17 nt, Bordetella pertussis
ccgggccuggccugcgc

SEQ ID NO: 303677 - RNA, 20 nt, Bordetella pertussis
ccgggcgaaccgguggccau

SEQ ID NO: 303678 - RNA, 13 nt, Bordetella pertussis
ccgggccuggccu

SEQ ID NO: 303679 - RNA, 16 nt, Bordetella pertussis
ccgggcgagccgaacg

SEQ ID NO: 303680 - RNA, 17 nt, Bordetella pertussis
ccgggcgcaagcgcgcc

SEQ ID NO: 303681 - RNA, 13 nt, Bordetella pertussis
ccgggcucggcca

SEQ ID NO: 303682 - RNA, 15 nt, Bordetella pertussis
ccgggcucggccacc

SEQ ID NO: 303683 - RNA, 15 nt, Bordetella pertussis
ccgggcugcaugcuc

SEQ ID NO: 303684 - RNA, 15 nt, Bordetella pertussis
ccgggcugcugcacg

SEQ ID NO: 303685 - RNA, 14 nt, Bordetella pertussis
ccgggcuggccgcc

SEQ ID NO: 303686 - RNA, 13 nt, Bordetella pertussis
ccgggcuggucag

SEQ ID NO: 303687 - RNA, 18 nt, Bordetella pertussis
ccgggcuggucagccugg

SEQ ID NO: 303688 - RNA, 18 nt, Bordetella pertussis
ccgggcuugcgcaccccg

SEQ ID NO: 303689 - RNA, 23 nt, Bordetella pertussis
ccgggcuuuuuccuguucggcca

SEQ ID NO: 303690 - RNA, 16 nt, Bordetella pertussis
ccggggaagccgccgg

SEQ ID NO: 303691 - RNA, 17 nt, Bordetella pertussis
ccggggaagccgccggc

SEQ ID NO: 303692 - RNA, 14 nt, Bordetella pertussis
ccggggagccugcc

SEQ ID NO: 303693 - RNA, 21 nt, Bordetella pertussis
ccggggcccgcgggcgcccgg

SEQ ID NO: 303694 - RNA, 15 nt, Bordetella pertussis
ccggggcgcaccggc

SEQ ID NO: 303695 - RNA, 21 nt, Bordetella pertussis
ccggggcgcaccggcacgcgc

SEQ ID NO: 303696 - RNA, 20 nt, Bordetella pertussis
ccggggcggucaaugcggcg

SEQ ID NO: 303697 - RNA, 21 nt, Bordetella pertussis
ccggguacggcagaugaucua

SEQ ID NO: 303698 - RNA, 13 nt, Bordetella pertussis
ccggguacguggc

SEQ ID NO: 303699 - RNA, 19 nt, Bordetella pertussis
ccggucgaucagggcgcgg

SEQ ID NO: 303700 - RNA, 15 nt, Bordetella pertussis
ccggucgccagcgau

SEQ ID NO: 303701 - RNA, 16 nt, Bordetella pertussis
ccggucgccgcgggca

SEQ ID NO: 303702 - RNA, 22 nt, Bordetella pertussis
ccggucgcgcgugcaggccgcg

SEQ ID NO: 303703 - RNA, 15 nt, Bordetella pertussis
ccggucggcccaggu

SEQ ID NO: 303704 - RNA, 21 nt, Bordetella pertussis
ccggucggcccaggucaucgc

SEQ ID NO: 303705 - RNA, 22 nt, Bordetella pertussis
ccggucggcccaggucaucgcc

SEQ ID NO: 303706 - RNA, 14 nt, Bordetella pertussis
ccggucggccgcuc

SEQ ID NO: 303707 - RNA, 15 nt, Bordetella pertussis
ccggucggccgcucc

SEQ ID NO: 303708 - RNA, 17 nt, Bordetella pertussis
ccggucggccgcuccgc

SEQ ID NO: 303709 - RNA, 13 nt, Bordetella pertussis
ccggucggccggc

SEQ ID NO: 303710 - RNA, 14 nt, Bordetella pertussis
ccggucggccggca

SEQ ID NO: 303711 - RNA, 20 nt, Bordetella pertussis
ccggucuccagcgcgucggc

SEQ ID NO: 303712 - RNA, 15 nt, Bordetella pertussis
ccggucuggucggcg

SEQ ID NO: 303713 - RNA, 18 nt, Bordetella pertussis
ccggucuggucggcgaug

SEQ ID NO: 303714 - RNA, 15 nt, Bordetella pertussis
ccggucugggcgcgg

SEQ ID NO: 303715 - RNA, 19 nt, Bordetella pertussis
ccggugaacaccagggugg

SEQ ID NO: 303716 - RNA, 17 nt, Bordetella pertussis
ccggugauguacgcauc

SEQ ID NO: 303717 - RNA, 16 nt, Bordetella pertussis
ccggugcagcguggcg

SEQ ID NO: 303718 - RNA, 20 nt, Bordetella pertussis
ccggugcaggucaucgcgcu

SEQ ID NO: 303719 - RNA, 17 nt, Bordetella pertussis
ccggugcaucggccggc

SEQ ID NO: 303720 - RNA, 21 nt, Bordetella pertussis
ccgguggaaauacagaucgcc

SEQ ID NO: 303721 - RNA, 13 nt, Bordetella pertussis
ccgguggacggcc

SEQ ID NO: 303722 - RNA, 20 nt, Bordetella pertussis
ccgguggccagcagcuguuc

SEQ ID NO: 303723 - RNA, 20 nt, Bordetella pertussis
ccgguggugcccaucgcgcu

SEQ ID NO: 303724 - RNA, 16 nt, Bordetella pertussis
ccgguggugcugcugg

SEQ ID NO: 303725 - RNA, 15 nt, Bordetella pertussis
ccgguguucucgcug

SEQ ID NO: 303726 - RNA, 17 nt, Bordetella pertussis
ccgguuccugcaaggcc

SEQ ID NO: 303727 - RNA, 23 nt, Bordetella pertussis
ccgguucgaugaccugggccugg

SEQ ID NO: 303728 - RNA, 18 nt, Bordetella pertussis
ccgguuggggucgcgcug

SEQ ID NO: 303729 - RNA, 15 nt, Bordetella pertussis
ccgguugguggcgau

SEQ ID NO: 303730 - RNA, 18 nt, Bordetella pertussis
ccguaaucggcgucggca

SEQ ID NO: 303731 - RNA, 15 nt, Bordetella pertussis
ccguacagggccgcg

SEQ ID NO: 303732 - RNA, 16 nt, Bordetella pertussis
ccguacagccgcggca

SEQ ID NO: 303733 - RNA, 17 nt, Bordetella pertussis
ccguaccagcgcgaacg

SEQ ID NO: 303734 - RNA, 21 nt, Bordetella pertussis
ccguaccaguacaccggcgug

SEQ ID NO: 303735 - RNA, 18 nt, Bordetella pertussis
ccguaccccagcaugugc

SEQ ID NO: 303736 - RNA, 16 nt, Bordetella pertussis
ccguaccgccacaccg

SEQ ID NO: 303737 - RNA, 20 nt, Bordetella pertussis
ccguacgccacuuccuugcc

SEQ ID NO: 303738 - RNA, 20 nt, Bordetella pertussis
ccguacucgccggucgcggc

SEQ ID NO: 303739 - RNA, 14 nt, Bordetella pertussis
ccguacuuggcgau

SEQ ID NO: 303740 - RNA, 20 nt, Bordetella pertussis
ccgucagcucgaucaggcgc

SEQ ID NO: 303741 - RNA, 21 nt, Bordetella pertussis
ccgucagcucgaucaggcgcu

SEQ ID NO: 303742 - RNA, 15 nt, Bordetella pertussis
ccgucaggaagcccg

SEQ ID NO: 303743 - RNA, 22 nt, Bordetella pertussis
ccgucaggaucaggccggcgau

SEQ ID NO: 303744 - RNA, 17 nt, Bordetella pertussis
ccgucaggcagcaaccg

SEQ ID NO: 303745 - RNA, 23 nt, Bordetella pertussis
ccguccagcauuucucgggcgca

SEQ ID NO: 303746 - RNA, 19 nt, Bordetella pertussis
ccguccaugcggaggcuuu

SEQ ID NO: 303747 - RNA, 16 nt, Bordetella pertussis
ccguccauggcgugcc

SEQ ID NO: 303748 - RNA, 15 nt, Bordetella pertussis
ccguccucaggcccg

SEQ ID NO: 303749 - RNA, 15 nt, Bordetella pertussis
ccguccugcugcggc

SEQ ID NO: 303750 - RNA, 17 nt, Bordetella pertussis
ccguccuggccgucaag

SEQ ID NO: 303751 - RNA, 18 nt, Bordetella pertussis
ccguccuggugcacgccg

SEQ ID NO: 303752 - RNA, 21 nt, Bordetella pertussis
ccguccuuacuugcgcacggc

SEQ ID NO: 303753 - RNA, 17 nt, Bordetella pertussis
ccguccuuggcgccggc

SEQ ID NO: 303754 - RNA, 23 nt, Bordetella pertussis
ccguccuugagggcgcgggccag

SEQ ID NO: 303755 - RNA, 16 nt, Bordetella pertussis
ccgucgaagccggcgc

SEQ ID NO: 303756 - RNA, 15 nt, Bordetella pertussis
ccgucgaaggccgca

SEQ ID NO: 303757 - RNA, 21 nt, Bordetella pertussis
ccgucgaaggccgcaaccagg

SEQ ID NO: 303758 - RNA, 19 nt, Bordetella pertussis
ccgucgaccccgucgaccg

SEQ ID NO: 303759 - RNA, 14 nt, Bordetella pertussis
ccgucgaccgcggc

SEQ ID NO: 303760 - RNA, 13 nt, Bordetella pertussis
ccgucgacgcagc

SEQ ID NO: 303761 - RNA, 13 nt, Bordetella pertussis
ccgucgagccggg

SEQ ID NO: 303762 - RNA, 16 nt, Bordetella pertussis
ccgucgagcgcgaaau

SEQ ID NO: 303763 - RNA, 18 nt, Bordetella pertussis
ccgucgagcgcggccagg

SEQ ID NO: 303764 - RNA, 22 nt, Bordetella pertussis
ccgucgagcgcggccaggcgcg

SEQ ID NO: 303765 - RNA, 15 nt, Bordetella pertussis
ccgucggccgucugg

SEQ ID NO: 303766 - RNA, 16 nt, Bordetella pertussis
ccgucggcggcaagca

SEQ ID NO: 303767 - RNA, 21 nt, Bordetella pertussis
ccgucggcggcaagcagccgg

SEQ ID NO: 303768 - RNA, 19 nt, Bordetella pertussis
ccgucggcgcuggcgcgcu

SEQ ID NO: 303769 - RNA, 22 nt, Bordetella pertussis
ccgucggcguugugccggcgca

SEQ ID NO: 303770 - RNA, 16 nt, Bordetella pertussis
ccgucgucaucgccau

SEQ ID NO: 303771 - RNA, 21 nt, Bordetella pertussis
ccgucgucaucgccaucgacc

SEQ ID NO: 303772 - RNA, 17 nt, Bordetella pertussis
ccgucguccucggcacg

SEQ ID NO: 303773 - RNA, 19 nt, Bordetella pertussis
ccgucguccucggcacggc

SEQ ID NO: 303774 - RNA, 21 nt, Bordetella pertussis
ccgucguccucggcacggcca

SEQ ID NO: 303775 - RNA, 21 nt, Bordetella pertussis
ccgucgucguccacgcccggu

SEQ ID NO: 303776 - RNA, 21 nt, Bordetella pertussis
ccgugacgcugauggccgcca

SEQ ID NO: 303777 - RNA, 19 nt, Bordetella pertussis
ccgugacguugagcgccgg

SEQ ID NO: 303778 - RNA, 13 nt, Bordetella pertussis
ccgugcaggcccg

SEQ ID NO: 303779 - RNA, 16 nt, Bordetella pertussis
ccgugcaggcccgggc

SEQ ID NO: 303780 - RNA, 22 nt, Bordetella pertussis
ccgugcaucccaauuggccgcc

SEQ ID NO: 303781 - RNA, 21 nt, Bordetella pertussis
ccgugcccgagggcgcgucga

SEQ ID NO: 303782 - RNA, 14 nt, Bordetella pertussis
ccgugcccggcggg

SEQ ID NO: 303783 - RNA, 17 nt, Bordetella pertussis
ccgugcccggcgggccg

SEQ ID NO: 303784 - RNA, 13 nt, Bordetella pertussis
ccgugccgcccgg

SEQ ID NO: 303785 - RNA, 19 nt, Bordetella pertussis
ccgugccgcgcgcaccggc

SEQ ID NO: 303786 - RNA, 22 nt, Bordetella pertussis
ccgugccgcgcgcaccggcuug

SEQ ID NO: 303787 - RNA, 19 nt, Bordetella pertussis
ccguguucgagcaggcgcg

SEQ ID NO: 303788 - RNA, 23 nt, Bordetella pertussis
ccguucaucagcgcgcgcagccg

SEQ ID NO: 303789 - RNA, 13 nt, Bordetella pertussis
ccguuccagcaug

SEQ ID NO: 303790 - RNA, 13 nt, Bordetella pertussis
ccguucgcgcugc

SEQ ID NO: 303791 - RNA, 14 nt, Bordetella pertussis
ccguucggggacag

SEQ ID NO: 303792 - RNA, 14 nt, Bordetella pertussis
ccguucucaggccg

SEQ ID NO: 303793 - RNA, 20 nt, Bordetella pertussis
ccguugccgcuguggcgcgc

SEQ ID NO: 303794 - RNA, 16 nt, Bordetella pertussis
ccguugcgggcugcgc

SEQ ID NO: 303795 - RNA, 14 nt, Bordetella pertussis
ccguugcggcccgc

SEQ ID NO: 303796 - RNA, 20 nt, Bordetella pertussis
ccguuggcaggccagcaugg

SEQ ID NO: 303797 - RNA, 18 nt, Bordetella pertussis
ccguuggccaaugcgccg

SEQ ID NO: 303798 - RNA, 20 nt, Bordetella pertussis
ccguuggccaaugcgccgcg

SEQ ID NO: 303799 - RNA, 15 nt, Bordetella pertussis
ccguuggccagcgcc

SEQ ID NO: 303800 - RNA, 13 nt, Bordetella pertussis
ccguuggccgcga

SEQ ID NO: 303801 - RNA, 18 nt, Bordetella pertussis
ccguuggcgauggcgcgg

SEQ ID NO: 303802 - RNA, 19 nt, Bordetella pertussis
ccguuucguaaggcugcgu

SEQ ID NO: 303803 - RNA, 19 nt, Bordetella pertussis
ccguuuugcaggaccgucc

SEQ ID NO: 303804 - RNA, 14 nt, Bordetella pertussis
ccuacccgccgggc

SEQ ID NO: 303805 - RNA, 15 nt, Bordetella pertussis
ccuaccucagcaugg

SEQ ID NO: 303806 - RNA, 17 nt, Bordetella pertussis
ccuacgaguaccgccgc

SEQ ID NO: 303807 - RNA, 15 nt, Bordetella pertussis
ccuacgccaugacau

SEQ ID NO: 303808 - RNA, 16 nt, Bordetella pertussis
ccuacggcggcggcca

SEQ ID NO: 303809 - RNA, 20 nt, Bordetella pertussis
ccuacuugcgggacuggacg

SEQ ID NO: 303810 - RNA, 14 nt, Bordetella pertussis
ccuagcccggcgcc

SEQ ID NO: 303811 - RNA, 12 nt, Bordetella pertussis
ccuagcgccgcg

SEQ ID NO: 303812 - RNA, 14 nt, Bordetella pertussis
ccuaucaggccucg

SEQ ID NO: 303813 - RNA, 17 nt, Bordetella pertussis
ccuauguaggcgccgcg

SEQ ID NO: 303814 - RNA, 16 nt, Bordetella pertussis
ccuauugcgacgccgc

SEQ ID NO: 303815 - RNA, 21 nt, Bordetella pertussis
ccuauuuggcggccuggccgc

SEQ ID NO: 303816 - RNA, 19 nt, Bordetella pertussis
ccucaugcgggacaggcgc

SEQ ID NO: 303817 - RNA, 19 nt, Bordetella pertussis
ccuccgagacguagggcac

SEQ ID NO: 303818 - RNA, 20 nt, Bordetella pertussis
ccuccgagacguagggcaca

SEQ ID NO: 303819 - RNA, 14 nt, Bordetella pertussis
ccuccgcauggacg

SEQ ID NO: 303820 - RNA, 22 nt, Bordetella pertussis
ccuccgcguugcgcugcccguc

SEQ ID NO: 303821 - RNA, 18 nt, Bordetella pertussis
ccuccggcgccagcaugc

SEQ ID NO: 303822 - RNA, 22 nt, Bordetella pertussis
ccuccggcgccagcaugcgcgc

SEQ ID NO: 303823 - RNA, 15 nt, Bordetella pertussis
ccuccgggucgcggc

SEQ ID NO: 303824 - RNA, 14 nt, Bordetella pertussis
ccuccucggccagg

SEQ ID NO: 303825 - RNA, 19 nt, Bordetella pertussis
ccucgaagcggcucaggcg

SEQ ID NO: 303826 - RNA, 15 nt, Bordetella pertussis
ccucgaccagcccgg

SEQ ID NO: 303827 - RNA, 16 nt, Bordetella pertussis
ccucgaccagcgcgcg

SEQ ID NO: 303828 - RNA, 20 nt, Bordetella pertussis
ccucgacccgaaggcgcggc

SEQ ID NO: 303829 - RNA, 16 nt, Bordetella pertussis
ccucgacccgcgccuc

SEQ ID NO: 303830 - RNA, 15 nt, Bordetella pertussis
ccucgaccaggucca

SEQ ID NO: 303831 - RNA, 23 nt, Bordetella pertussis
ccucgaucgccaggucggccagc

SEQ ID NO: 303832 - RNA, 16 nt, Bordetella pertussis
ccucgccagcggcagc

SEQ ID NO: 303833 - RNA, 17 nt, Bordetella pertussis
ccucgccagcggcagcg

SEQ ID NO: 303834 - RNA, 12 nt, Bordetella pertussis
ccucgcccagcg

SEQ ID NO: 303835 - RNA, 19 nt, Bordetella pertussis
ccucgcccagcgagccggc

SEQ ID NO: 303836 - RNA, 15 nt, Bordetella pertussis
ccucgcccaggccgg

SEQ ID NO: 303837 - RNA, 18 nt, Bordetella pertussis
ccucgcccccgaaggccg

SEQ ID NO: 303838 - RNA, 21 nt, Bordetella pertussis
ccucgcccccgaaggccgcgc

SEQ ID NO: 303839 - RNA, 16 nt, Bordetella pertussis
ccucgcccgaucggcc

SEQ ID NO: 303840 - RNA, 19 nt, Bordetella pertussis
ccucgcccgaucggccggc

SEQ ID NO: 303841 - RNA, 14 nt, Bordetella pertussis
ccucgccgcgccag

SEQ ID NO: 303842 - RNA, 23 nt, Bordetella pertussis
ccucgccgcgccagcugcgcagc

SEQ ID NO: 303843 - RNA, 15 nt, Bordetella pertussis
ccucgccgcccagcc

SEQ ID NO: 303844 - RNA, 17 nt, Bordetella pertussis
ccucgccgcccagccgg

SEQ ID NO: 303845 - RNA, 19 nt, Bordetella pertussis
ccucgccggccuggcgcgc

SEQ ID NO: 303846 - RNA, 13 nt, Bordetella pertussis
ccucgcggggccc

SEQ ID NO: 303847 - RNA, 23 nt, Bordetella pertussis
ccucgcguagugguaugaccggc

SEQ ID NO: 303848 - RNA, 13 nt, Bordetella pertussis
ccucgcugccggc

SEQ ID NO: 303849 - RNA, 16 nt, Bordetella pertussis
ccucgcugccggcgcc

SEQ ID NO: 303850 - RNA, 16 nt, Bordetella pertussis
ccucgcugcgggcggc

SEQ ID NO: 303851 - RNA, 18 nt, Bordetella pertussis
ccucggacgagacaggcg

SEQ ID NO: 303852 - RNA, 22 nt, Bordetella pertussis
ccucggacgagacaggcgcgcc

SEQ ID NO: 303853 - RNA, 18 nt, Bordetella pertussis
ccucggccggcaggucga

SEQ ID NO: 303854 - RNA, 14 nt, Bordetella pertussis
ccucggccuggccc

SEQ ID NO: 303855 - RNA, 22 nt, Bordetella pertussis
ccucggcgaagugcccgcuggc

SEQ ID NO: 303856 - RNA, 18 nt, Bordetella pertussis
ccucggcgagcgccucgc

SEQ ID NO: 303857 - RNA, 12 nt, Bordetella pertussis
ccucggcgccgc

SEQ ID NO: 303858 - RNA, 14 nt, Bordetella pertussis
ccucggcgcgcgcg

SEQ ID NO: 303859 - RNA, 20 nt, Bordetella pertussis
ccucggcgcgcgcggcgccg

SEQ ID NO: 303860 - RNA, 22 nt, Bordetella pertussis
ccucgggcgacuccagcccgau

SEQ ID NO: 303861 - RNA, 16 nt, Bordetella pertussis
ccucggggcgcggccg

SEQ ID NO: 303862 - RNA, 17 nt, Bordetella pertussis
ccucggggcgcggccgg

SEQ ID NO: 303863 - RNA, 17 nt, Bordetella pertussis
ccucggucagcgccagg

SEQ ID NO: 303864 - RNA, 22 nt, Bordetella pertussis
ccucggucagcgccagggugcc

SEQ ID NO: 303865 - RNA, 17 nt, Bordetella pertussis
ccucgucggccaugcgc

SEQ ID NO: 303866 - RNA, 21 nt, Bordetella pertussis
ccuguccccacagggggacug

SEQ ID NO: 303867 - RNA, 24 nt, Bordetella pertussis
ccuguccccacagggggacuggca

SEQ ID NO: 303868 - RNA, 20 nt, Bordetella pertussis
ccuguccccacauggggacu

SEQ ID NO: 303869 - RNA, 21 nt, Bordetella pertussis
ccuguccccacauggggacug

SEQ ID NO: 303870 - RNA, 19 nt, Bordetella pertussis
ccuguccccaccgggacag

SEQ ID NO: 303871 - RNA, 18 nt, Bordetella pertussis
ccuguccccacggggaca

SEQ ID NO: 303872 - RNA, 18 nt, Bordetella pertussis
ccuguccccacguggaca

SEQ ID NO: 303873 - RNA, 19 nt, Bordetella pertussis
ccuguccccacguggacag

SEQ ID NO: 303874 - RNA, 20 nt, Bordetella pertussis
ccuguccccccauggggacu

SEQ ID NO: 303875 - RNA, 21 nt, Bordetella pertussis
ccuguccccgaacggggacug

SEQ ID NO: 303876 - RNA, 19 nt, Bordetella pertussis
ccuguccccgaaggggacu

SEQ ID NO: 303877 - RNA, 20 nt, Bordetella pertussis
ccuguccccgaaggggacug

SEQ ID NO: 303878 - RNA, 21 nt, Bordetella pertussis
ccuguccccgcacggggacug

SEQ ID NO: 303879 - RNA, 18 nt, Bordetella pertussis
ccuguccccgcagggaca

SEQ ID NO: 303880 - RNA, 14 nt, Bordetella pertussis
ccuguccccgcaug

SEQ ID NO: 303881 - RNA, 20 nt, Bordetella pertussis
ccuguccccgcaugggggcu

SEQ ID NO: 303882 - RNA, 21 nt, Bordetella pertussis
ccuguccccgcaugggggcug

SEQ ID NO: 303883 - RNA, 18 nt, Bordetella pertussis
ccuguccccgccggggca

SEQ ID NO: 303884 - RNA, 18 nt, Bordetella pertussis
ccuguccccgcggggaca

SEQ ID NO: 303885 - RNA, 19 nt, Bordetella pertussis
ccuguccccgcggggacag

SEQ ID NO: 303886 - RNA, 19 nt, Bordetella pertussis
ccuguccccgcggggacug

SEQ ID NO: 303887 - RNA, 18 nt, Bordetella pertussis
ccuguccccgcugcggca

SEQ ID NO: 303888 - RNA, 19 nt, Bordetella pertussis
ccuguccccgcugggacag

SEQ ID NO: 303889 - RNA, 18 nt, Bordetella pertussis
ccuguccccgucgggaca

SEQ ID NO: 303890 - RNA, 19 nt, Bordetella pertussis
ccuguccccgucgggacag

SEQ ID NO: 303891 - RNA, 15 nt, Bordetella pertussis
ccugucccaaccggg

SEQ ID NO: 303892 - RNA, 18 nt, Bordetella pertussis
ccugucccaaccgggaca

SEQ ID NO: 303893 - RNA, 14 nt, Bordetella pertussis
ccugucccagcggg

SEQ ID NO: 303894 - RNA, 15 nt, Bordetella pertussis
ccugucccaggcgcu

SEQ ID NO: 303895 - RNA, 18 nt, Bordetella pertussis
ccugucccggcugggaca

SEQ ID NO: 303896 - RNA, 14 nt, Bordetella pertussis
ccugucccugaacg

SEQ ID NO: 303897 - RNA, 15 nt, Bordetella pertussis
ccugucccugccggg

SEQ ID NO: 303898 - RNA, 19 nt, Bordetella pertussis
ccugucccugcggggacug

SEQ ID NO: 303899 - RNA, 18 nt, Bordetella pertussis
ccugucccugcgggggca

SEQ ID NO: 303900 - RNA, 19 nt, Bordetella pertussis
ccugucccgacggggacag

SEQ ID NO: 303901 - RNA, 13 nt, Bordetella pertussis
ccugucgcgcugc

SEQ ID NO: 303902 - RNA, 22 nt, Bordetella pertussis
ccugucggccgaaccgcgcagc

SEQ ID NO: 303903 - RNA, 23 nt, Bordetella pertussis
ccugucggugaugauccugcugg

SEQ ID NO: 303904 - RNA, 17 nt, Bordetella pertussis
ccugugccagcuggccc

SEQ ID NO: 303905 - RNA, 13 nt, Bordetella pertussis
ccuguggcgcacc

SEQ ID NO: 303906 - RNA, 15 nt, Bordetella pertussis
ccuguucccgccggg

SEQ ID NO: 303907 - RNA, 14 nt, Bordetella pertussis
ccuguucgcgcggc

SEQ ID NO: 303908 - RNA, 17 nt, Bordetella pertussis
ccuuacgcggcgcgcgc

SEQ ID NO: 303909 - RNA, 19 nt, Bordetella pertussis
ccuucacgacacgcccagc

SEQ ID NO: 303910 - RNA, 14 nt, Bordetella pertussis
ccuucagcacgcuc

SEQ ID NO: 303911 - RNA, 21 nt, Bordetella pertussis
ccuucaugaucuggccgacca

SEQ ID NO: 303912 - RNA, 13 nt, Bordetella pertussis
ccuuccugcugga

SEQ ID NO: 303913 - RNA, 18 nt, Bordetella pertussis
ccuucgacgcggcggccg

SEQ ID NO: 303914 - RNA, 18 nt, Bordetella pertussis
ccuucgacguccagcccg

SEQ ID NO: 303915 - RNA, 17 nt, Bordetella pertussis
ccuucgagcaccaugcc

SEQ ID NO: 303916 - RNA, 20 nt, Bordetella pertussis
ccuucgaucuucucgccgcg

SEQ ID NO: 303917 - RNA, 22 nt, Bordetella pertussis
ccuucgcccgcauagacgccga

SEQ ID NO: 303918 - RNA, 13 nt, Bordetella pertussis
ccuucgcgcagca

SEQ ID NO: 303919 - RNA, 16 nt, Bordetella pertussis
ccuucgcgcagcggcg

SEQ ID NO: 303920 - RNA, 20 nt, Bordetella pertussis
ccuucgcgcagcggcgcgcg

SEQ ID NO: 303921 - RNA, 21 nt, Bordetella pertussis
ccuucgcgcagcggcgcgcgc

SEQ ID NO: 303922 - RNA, 14 nt, Bordetella pertussis
ccuucgcugacgcg

SEQ ID NO: 303923 - RNA, 13 nt, Bordetella pertussis
ccuucggcgcgca

SEQ ID NO: 303924 - RNA, 17 nt, Bordetella pertussis
ccuucggcgcgcgccgg

SEQ ID NO: 303925 - RNA, 21 nt, Bordetella pertussis
ccuucggccggcugcgcgccg

SEQ ID NO: 303926 - RNA, 16 nt, Bordetella pertussis
ccuucggcggcgcgcu

SEQ ID NO: 303927 - RNA, 19 nt, Bordetella pertussis
ccuucggucgucgugcccu

SEQ ID NO: 303928 - RNA, 23 nt, Bordetella pertussis
ccuucguccugccauugcgcggc

SEQ ID NO: 303929 - RNA, 24 nt, Bordetella pertussis
ccuucgucgcgcacccgcaggccg

SEQ ID NO: 303930 - RNA, 23 nt, Bordetella pertussis
ccuucgucggcgggacgcaggcc

SEQ ID NO: 303931 - RNA, 19 nt, Bordetella pertussis
ccuucucgaugcgcgccac

SEQ ID NO: 303932 - RNA, 20 nt, Bordetella pertussis
ccuucugccgccaggcauug

SEQ ID NO: 303933 - RNA, 19 nt, Bordetella pertussis
ccuucuuccaggcgcccgc

SEQ ID NO: 303934 - RNA, 21 nt, Bordetella pertussis
ccuucuuccaggcgcccgcca

SEQ ID NO: 303935 - RNA, 18 nt, Bordetella pertussis
ccuugaccuggucggccu

SEQ ID NO: 303936 - RNA, 21 nt, Bordetella pertussis
ccuugacgaauuucucggcca

SEQ ID NO: 303937 - RNA, 14 nt, Bordetella pertussis
ccuugacgcgcgcg

SEQ ID NO: 303938 - RNA, 18 nt, Bordetella pertussis
ccuugagcacguccagcg

SEQ ID NO: 303939 - RNA, 15 nt, Bordetella pertussis
ccuugagcacgcugg

SEQ ID NO: 303940 - RNA, 17 nt, Bordetella pertussis
ccuugagcaucugcggc

SEQ ID NO: 303941 - RNA, 18 nt, Bordetella pertussis
ccuugagcgccagcucgg

SEQ ID NO: 303942 - RNA, 14 nt, Bordetella pertussis
ccuugagggcgcgg

SEQ ID NO: 303943 - RNA, 17 nt, Bordetella pertussis
ccuugaucagcggcggc

SEQ ID NO: 303944 - RNA, 17 nt, Bordetella pertussis
ccuugaugccgucggcg

SEQ ID NO: 303945 - RNA, 18 nt, Bordetella pertussis
ccuugaugccgucggcga

SEQ ID NO: 303946 - RNA, 17 nt, Bordetella pertussis
ccuugauggccucggcg

SEQ ID NO: 303947 - RNA, 16 nt, Bordetella pertussis
ccuugcccacgccauc

SEQ ID NO: 303948 - RNA, 11 nt, Bordetella pertussis
ccuugcccggg

SEQ ID NO: 303949 - RNA, 14 nt, Bordetella pertussis
ccuugcccaggcug

SEQ ID NO: 303950 - RNA, 16 nt, Bordetella pertussis
ccuugccgccgccgcg

SEQ ID NO: 303951 - RNA, 13 nt, Bordetella pertussis
ccuugccgccgug

SEQ ID NO: 303952 - RNA, 21 nt, Bordetella pertussis
ccuugccgccgugcgagcacg

SEQ ID NO: 303953 - RNA, 21 nt, Bordetella pertussis
ccuugccgguggacggccagc

SEQ ID NO: 303954 - RNA, 22 nt, Bordetella pertussis
ccuugccgguggacggccagca

SEQ ID NO: 303955 - RNA, 11 nt, Bordetella pertussis
ccuugccguag

SEQ ID NO: 303956 - RNA, 15 nt, Bordetella pertussis
ccuugcgaggcccgg

SEQ ID NO: 303957 - RNA, 21 nt, Bordetella pertussis
ccuugcgcgacagcaggccgg

SEQ ID NO: 303958 - RNA, 15 nt, Bordetella pertussis
ccuugcgcgcgaacu

SEQ ID NO: 303959 - RNA, 15 nt, Bordetella pertussis
ccuugcgcggccagc

SEQ ID NO: 303960 - RNA, 22 nt, Bordetella pertussis
ccuugcgcggcgagcgccgcca

SEQ ID NO: 303961 - RNA, 15 nt, Bordetella pertussis
ccuugcgcucgccca

SEQ ID NO: 303962 - RNA, 23 nt, Bordetella pertussis
ccuugcgcucgcccagcaccucg

SEQ ID NO: 303963 - RNA, 21 nt, Bordetella pertussis
ccuugcgguugaaggcgaacg

SEQ ID NO: 303964 - RNA, 17 nt, Bordetella pertussis
ccuugcucgaccagguc

SEQ ID NO: 303965 - RNA, 14 nt, Bordetella pertussis
ccuugcugcccgac

SEQ ID NO: 303966 - RNA, 16 nt, Bordetella pertussis
ccuuggcggcuggcgc

SEQ ID NO: 303967 - RNA, 13 nt, Bordetella pertussis
ccuuggcggcccc

SEQ ID NO: 303968 - RNA, 15 nt, Bordetella pertussis
ccuuggcuucgguca

SEQ ID NO: 303969 - RNA, 23 nt, Bordetella pertussis
ccuugggauuggcgaaaggcacc

SEQ ID NO: 303970 - RNA, 19 nt, Bordetella pertussis
ccuugggcucgucgacgcg

SEQ ID NO: 303971 - RNA, 21 nt, Bordetella pertussis
ccuugggcucgucgacgcggc

SEQ ID NO: 303972 - RNA, 18 nt, Bordetella pertussis
ccuuggggcggcccggcg

SEQ ID NO: 303973 - RNA, 15 nt, Bordetella pertussis
ccuuggucugcaggc

SEQ ID NO: 303974 - RNA, 19 nt, Bordetella pertussis
ccuuggucugcaggcucug

SEQ ID NO: 303975 - RNA, 15 nt, Bordetella pertussis
ccuugucgcgcagcg

SEQ ID NO: 303976 - RNA, 18 nt, Bordetella pertussis
ccuugucgcgcagcgccg

SEQ ID NO: 303977 - RNA, 21 nt, Bordetella pertussis
ccuugucgcgcagcgccgcca

SEQ ID NO: 303978 - RNA, 17 nt, Bordetella pertussis
ccuugugcggcagguug

SEQ ID NO: 303979 - RNA, 18 nt, Bordetella pertussis
ccuugugcguuggcgcgg

SEQ ID NO: 303980 - RNA, 20 nt, Bordetella pertussis
ccuugugcugccaugccgcg

SEQ ID NO: 303981 - RNA, 14 nt, Bordetella pertussis
ccuuguggccgccg

SEQ ID NO: 303982 - RNA, 17 nt, Bordetella pertussis
ccuugugcgccagcgcg

SEQ ID NO: 303983 - RNA, 20 nt, Bordetella pertussis
ccuugugcgccagcgcgaaa

SEQ ID NO: 303984 - RNA, 16 nt, Bordetella pertussis
ccuuguuggcgccggc

SEQ ID NO: 303985 - RNA, 17 nt, Bordetella pertussis
ccuuguuggcgccggcc

SEQ ID NO: 303986 - RNA, 20 nt, Bordetella pertussis
ccuuucaccggcaccagcca

SEQ ID NO: 303987 - RNA, 14 nt, Bordetella pertussis
ccuuucccgcgccg

SEQ ID NO: 303988 - RNA, 15 nt, Bordetella pertussis
ccuuuuccaggcgug

SEQ ID NO: 303989 - RNA, 19 nt, Bordetella pertussis
cgaaacauaagucugcgcc

SEQ ID NO: 303990 - RNA, 14 nt, Bordetella pertussis
cgaaaccaggccgg

SEQ ID NO: 303991 - RNA, 21 nt, Bordetella pertussis
cgaaaccggugaucagcaggc

SEQ ID NO: 303992 - RNA, 12 nt, Bordetella pertussis
cgaaaccggcgc

SEQ ID NO: 303993 - RNA, 21 nt, Bordetella pertussis
cgaaaccggcgcgcgcggcca

SEQ ID NO: 303994 - RNA, 14 nt, Bordetella pertussis
cgaaacgcgcagca

SEQ ID NO: 303995 - RNA, 17 nt, Bordetella pertussis
cgaaacgcgcagcaccg

SEQ ID NO: 303996 - RNA, 13 nt, Bordetella pertussis
cgaaacgcgcguc

SEQ ID NO: 303997 - RNA, 13 nt, Bordetella pertussis
cgaaacggccagc

SEQ ID NO: 303998 - RNA, 18 nt, Bordetella pertussis
cgaaacggcgggcgcgca

SEQ ID NO: 303999 - RNA, 17 nt, Bordetella pertussis
cgaaacgggcggcgucg

SEQ ID NO: 304000 - RNA, 14 nt, Bordetella pertussis
cgaaacucaccgcc

SEQ ID NO: 304001 - RNA, 15 nt, Bordetella pertussis
cgaaacucaccgccg

SEQ ID NO: 304002 - RNA, 19 nt, Bordetella pertussis
cgaaacucaccgccgcccg

SEQ ID NO: 304003 - RNA, 21 nt, Bordetella pertussis
cgaaagcacgccauggucucg

SEQ ID NO: 304004 - RNA, 15 nt, Bordetella pertussis
cgaaagccagcgccu

SEQ ID NO: 304005 - RNA, 13 nt, Bordetella pertussis
cgaaagccggccu

SEQ ID NO: 304006 - RNA, 15 nt, Bordetella pertussis
cgaaagccgucggcc

SEQ ID NO: 304007 - RNA, 22 nt, Bordetella pertussis
cgaaagcgcgucgagcaggccg

SEQ ID NO: 304008 - RNA, 22 nt, Bordetella pertussis
cgaaagcggcgugugcccagca

SEQ ID NO: 304009 - RNA, 14 nt, Bordetella pertussis
cgaaagcgcccagg

SEQ ID NO: 304010 - RNA, 20 nt, Bordetella pertussis
cgaaauaggaucccggcgcc

SEQ ID NO: 304011 - RNA, 21 nt, Bordetella pertussis
cgaaaucuucugcgccacggc

SEQ ID NO: 304012 - RNA, 18 nt, Bordetella pertussis
cgaaaugccgaagcgcgc

SEQ ID NO: 304013 - RNA, 14 nt, Bordetella pertussis
cgaaaugccgcagc

SEQ ID NO: 304014 - RNA, 12 nt, Bordetella pertussis
cgaaaugcgcgu

SEQ ID NO: 304015 - RNA, 22 nt, Bordetella pertussis
cgaaaugcgcguuggccugacc

SEQ ID NO: 304016 - RNA, 15 nt, Bordetella pertussis
cgaacaacagcgccu

SEQ ID NO: 304017 - RNA, 19 nt, Bordetella pertussis
cgaacaaggcgguggccag

SEQ ID NO: 304018 - RNA, 16 nt, Bordetella pertussis
cgaacacaucgagggc

SEQ ID NO: 304019 - RNA, 14 nt, Bordetella pertussis
cgaacaccggcagg

SEQ ID NO: 304020 - RNA, 15 nt, Bordetella pertussis
cgaacaccggcaggc

SEQ ID NO: 304021 - RNA, 17 nt, Bordetella pertussis
cgaacaccggcaggccg

SEQ ID NO: 304022 - RNA, 19 nt, Bordetella pertussis
cgaacaccggcaggccgcg

SEQ ID NO: 304023 - RNA, 20 nt, Bordetella pertussis
cgaacaccggcuuggccucg

SEQ ID NO: 304024 - RNA, 24 nt, Bordetella pertussis
cgaacaccggcuuggccucggccg

SEQ ID NO: 304025 - RNA, 15 nt, Bordetella pertussis
cgaacacgcgcgccg

SEQ ID NO: 304026 - RNA, 21 nt, Bordetella pertussis
cgaacacuggaagaacaccgu

SEQ ID NO: 304027 - RNA, 22 nt, Bordetella pertussis
cgaacagauccacgcccgcgcc

SEQ ID NO: 304028 - RNA, 16 nt, Bordetella pertussis
cgaacagcauggcggc

SEQ ID NO: 304029 - RNA, 13 nt, Bordetella pertussis
cgaacaggccauc

SEQ ID NO: 304030 - RNA, 20 nt, Bordetella pertussis
cgaacaggccaucgccgccg

SEQ ID NO: 304031 - RNA, 20 nt, Bordetella pertussis
cgaacauguuguuggucgcc

SEQ ID NO: 304032 - RNA, 20 nt, Bordetella pertussis
cgaaccaggccaccgcggug

SEQ ID NO: 304033 - RNA, 13 nt, Bordetella pertussis
cgaacccgggcgu

SEQ ID NO: 304034 - RNA, 19 nt, Bordetella pertussis
cgaacccugccucagacca

SEQ ID NO: 304035 - RNA, 16 nt, Bordetella pertussis
cgaaccgaccgccacg

SEQ ID NO: 304036 - RNA, 17 nt, Bordetella pertussis
cgaaccgcgcagccgcu

SEQ ID NO: 304037 - RNA, 13 nt, Bordetella pertussis
cgaaccuggcggg

SEQ ID NO: 304038 - RNA, 19 nt, Bordetella pertussis
cgaaccuuccuccgacagg

SEQ ID NO: 304039 - RNA, 20 nt, Bordetella pertussis
cgaaccuuccuccgacaggc

SEQ ID NO: 304040 - RNA, 23 nt, Bordetella pertussis
cgaaccuuccuccgacaggcgcc

SEQ ID NO: 304041 - RNA, 15 nt, Bordetella pertussis
cgaacgacucgucga

SEQ ID NO: 304042 - RNA, 14 nt, Bordetella pertussis
cgaacgaggcgcgg

SEQ ID NO: 304043 - RNA, 21 nt, Bordetella pertussis
cgaacgauucggagucgugca

SEQ ID NO: 304044 - RNA, 23 nt, Bordetella pertussis
cgaacgauucggagucgugcagg

SEQ ID NO: 304045 - RNA, 15 nt, Bordetella pertussis
cgaacgccacgcccg

SEQ ID NO: 304046 - RNA, 21 nt, Bordetella pertussis
cgaacgcccggcccaggccgg

SEQ ID NO: 304047 - RNA, 16 nt, Bordetella pertussis
cgaacgccgccgcagc

SEQ ID NO: 304048 - RNA, 21 nt, Bordetella pertussis
cgaacgccgccgcagccgcca

SEQ ID NO: 304049 - RNA, 21 nt, Bordetella pertussis
cgaacgccgcgucgcuggccg

SEQ ID NO: 304050 - RNA, 22 nt, Bordetella pertussis
cgaacgccgcgucgcuggccgg

SEQ ID NO: 304051 - RNA, 17 nt, Bordetella pertussis
cgaacgcgacagcgcug

SEQ ID NO: 304052 - RNA, 15 nt, Bordetella pertussis
cgaacgcgccggccc

SEQ ID NO: 304053 - RNA, 18 nt, Bordetella pertussis
cgaacgcgccggcccagg

SEQ ID NO: 304054 - RNA, 21 nt, Bordetella pertussis
cgaacgcgccggcccaggcgc

SEQ ID NO: 304055 - RNA, 22 nt, Bordetella pertussis
cgaacgcgcgccggccagcggc

SEQ ID NO: 304056 - RNA, 13 nt, Bordetella pertussis
cgaacgcggccag

SEQ ID NO: 304057 - RNA, 23 nt, Bordetella pertussis
cgaacggaaacccuucgcgcagc

SEQ ID NO: 304058 - RNA, 17 nt, Bordetella pertussis
cgaacggcccauccauc

SEQ ID NO: 304059 - RNA, 16 nt, Bordetella pertussis
cgaacggccgcccggc

SEQ ID NO: 304060 - RNA, 17 nt, Bordetella pertussis
cgaacggccgcccggca

SEQ ID NO: 304061 - RNA, 13 nt, Bordetella pertussis
cgaacggccgggc

SEQ ID NO: 304062 - RNA, 21 nt, Bordetella pertussis
cgaacgggaauggcggacacg

SEQ ID NO: 304063 - RNA, 19 nt, Bordetella pertussis
cgaacgggcguggcgcagg

SEQ ID NO: 304064 - RNA, 22 nt, Bordetella pertussis
cgaacggggccgccucggcggc

SEQ ID NO: 304065 - RNA, 20 nt, Bordetella pertussis
cgaacgggguggccggcgcg

SEQ ID NO: 304066 - RNA, 21 nt, Bordetella pertussis
cgaacgggguggccggcgcgc

SEQ ID NO: 304067 - RNA, 15 nt, Bordetella pertussis
cgaacuccugcagca

SEQ ID NO: 304068 - RNA, 19 nt, Bordetella pertussis
cgaacucgauggccucggc

SEQ ID NO: 304069 - RNA, 22 nt, Bordetella pertussis
cgaacucgauggccucggcaug

SEQ ID NO: 304070 - RNA, 18 nt, Bordetella pertussis
cgaacucgcgcucggcca

SEQ ID NO: 304071 - RNA, 19 nt, Bordetella pertussis
cgaacucgcgcucggccag

SEQ ID NO: 304072 - RNA, 22 nt, Bordetella pertussis
cgaagaauuggccguccacgaa

SEQ ID NO: 304073 - RNA, 20 nt, Bordetella pertussis
cgaagacaugcugcgacagc

SEQ ID NO: 304074 - RNA, 18 nt, Bordetella pertussis
cgaagccacggcccgcca

SEQ ID NO: 304075 - RNA, 21 nt, Bordetella pertussis
cgaagccagauaaaggccgca

SEQ ID NO: 304076 - RNA, 15 nt, Bordetella pertussis
cgaagcccaguucgg

SEQ ID NO: 304077 - RNA, 12 nt, Bordetella pertussis
cgaagcccggca

SEQ ID NO: 304078 - RNA, 16 nt, Bordetella pertussis
cgaagccgcagcggca

SEQ ID NO: 304079 - RNA, 14 nt, Bordetella pertussis
cgaagccgccccac

SEQ ID NO: 304080 - RNA, 12 nt, Bordetella pertussis
cgaagccggcac

SEQ ID NO: 304081 - RNA, 17 nt, Bordetella pertussis
cgaagccggcacgccug

SEQ ID NO: 304082 - RNA, 14 nt, Bordetella pertussis
cgaagccggcgcca

SEQ ID NO: 304083 - RNA, 14 nt, Bordetella pertussis
cgaagccgggcggc

SEQ ID NO: 304084 - RNA, 22 nt, Bordetella pertussis
cgaagccuaggcugcagccagu

SEQ ID NO: 304085 - RNA, 17 nt, Bordetella pertussis
cgaagccuugcgcggcc

SEQ ID NO: 304086 - RNA, 20 nt, Bordetella pertussis
cgaagccuugcgcggccagc

SEQ ID NO: 304087 - RNA, 21 nt, Bordetella pertussis
cgaagccuugcgcggccagca

SEQ ID NO: 304088 - RNA, 14 nt, Bordetella pertussis
cgaagcgcaagccc

SEQ ID NO: 304089 - RNA, 12 nt, Bordetella pertussis
cgaagcgcagca

SEQ ID NO: 304090 - RNA, 20 nt, Bordetella pertussis
cgaagcgcagcaccaggucg

SEQ ID NO: 304091 - RNA, 14 nt, Bordetella pertussis
cgaagcgucggccu

SEQ ID NO: 304092 - RNA, 22 nt, Bordetella pertussis
cgaagcugccgugguacgugga

SEQ ID NO: 304093 - RNA, 21 nt, Bordetella pertussis
cgaagcuguccuucguggcgc

SEQ ID NO: 304094 - RNA, 21 nt, Bordetella pertussis
cgaaggucuuggcgugcaggc

SEQ ID NO: 304095 - RNA, 22 nt, Bordetella pertussis
cgaaggugggcgaaccgcggcg

SEQ ID NO: 304096 - RNA, 17 nt, Bordetella pertussis
cgaagguuuccucgcga

SEQ ID NO: 304097 - RNA, 22 nt, Bordetella pertussis
cgaagguuucgcugcgcacgcu

SEQ ID NO: 304098 - RNA, 17 nt, Bordetella pertussis
cgaagguuucguagccg

SEQ ID NO: 304099 - RNA, 17 nt, Bordetella pertussis
cgaaguacacggccagc

SEQ ID NO: 304100 - RNA, 18 nt, Bordetella pertussis
cgaaguacacggccagca

SEQ ID NO: 304101 - RNA, 14 nt, Bordetella pertussis
cgaaguacucgccg

SEQ ID NO: 304102 - RNA, 21 nt, Bordetella pertussis
cgaaguacucgccggcgcugc

SEQ ID NO: 304103 - RNA, 18 nt, Bordetella pertussis
cgaaguagaacgccggcu

SEQ ID NO: 304104 - RNA, 16 nt, Bordetella pertussis
cgaaguugcggccgug

SEQ ID NO: 304105 - RNA, 22 nt, Bordetella pertussis
cgaaucggucacgaucuggccg

SEQ ID NO: 304106 - RNA, 17 nt, Bordetella pertussis
cgaaucucccggcgccc

SEQ ID NO: 304107 - RNA, 22 nt, Bordetella pertussis
cgaaugcacgggcgcugcccag

SEQ ID NO: 304108 - RNA, 19 nt, Bordetella pertussis
cgaauugcuggagcgccac

SEQ ID NO: 304109 - RNA, 20 nt, Bordetella pertussis
cgaauuuuucuuccaguucg

SEQ ID NO: 304110 - RNA, 16 nt, Bordetella pertussis
cgacaaauagccgacc

SEQ ID NO: 304111 - RNA, 21 nt, Bordetella pertussis
cgacaacagcuugcccggcgu

SEQ ID NO: 304112 - RNA, 23 nt, Bordetella pertussis
cgacauacgcgaugccgaucgcc

SEQ ID NO: 304113 - RNA, 18 nt, Bordetella pertussis
cgacauagacgcgcagcg

SEQ ID NO: 304114 - RNA, 23 nt, Bordetella pertussis
cgacauagagauuguccagcggc

SEQ ID NO: 304115 - RNA, 20 nt, Bordetella pertussis
cgacauagaucuccggcgcc

SEQ ID NO: 304116 - RNA, 17 nt, Bordetella pertussis
cgacaugaccgcguccg

SEQ ID NO: 304117 - RNA, 20 nt, Bordetella pertussis
cgacaugccgccccaggcgu

SEQ ID NO: 304118 - RNA, 20 nt, Bordetella pertussis
cgacaugcuggcccagcugg

SEQ ID NO: 304119 - RNA, 15 nt, Bordetella pertussis
cgaccaaccugaccg

SEQ ID NO: 304120 - RNA, 18 nt, Bordetella pertussis
cgaccaacucgaggcggc

SEQ ID NO: 304121 - RNA, 21 nt, Bordetella pertussis
cgaccaacucgaggcggcgca

SEQ ID NO: 304122 - RNA, 23 nt, Bordetella pertussis
cgaccaacucgaggcggcgcagg

SEQ ID NO: 304123 - RNA, 19 nt, Bordetella pertussis
cgaccacaucugccgguaa

SEQ ID NO: 304124 - RNA, 16 nt, Bordetella pertussis
cgaccaccagcaccau

SEQ ID NO: 304125 - RNA, 22 nt, Bordetella pertussis
cgaccaccagcaccgaugcgcc

SEQ ID NO: 304126 - RNA, 22 nt, Bordetella pertussis
cgaccaccaggucguacagcgc

SEQ ID NO: 304127 - RNA, 23 nt, Bordetella pertussis
cgaccaccaggucguacagcgcc

SEQ ID NO: 304128 - RNA, 14 nt, Bordetella pertussis
cgaccacccgcgcc

SEQ ID NO: 304129 - RNA, 17 nt, Bordetella pertussis
cgaccacccgcgccagg

SEQ ID NO: 304130 - RNA, 18 nt, Bordetella pertussis
cgaccacccgcgccagga

SEQ ID NO: 304131 - RNA, 12 nt, Bordetella pertussis
cgaccaccagcg

SEQ ID NO: 304132 - RNA, 14 nt, Bordetella pertussis
cgaccaccagcgca

SEQ ID NO: 304133 - RNA, 17 nt, Bordetella pertussis
cgaccaccugcaccgcc

SEQ ID NO: 304134 - RNA, 21 nt, Bordetella pertussis
cgaccaccugcaccgccgcgu

SEQ ID NO: 304135 - RNA, 21 nt, Bordetella pertussis
cgaccacgaccuuggcggccg

SEQ ID NO: 304136 - RNA, 16 nt, Bordetella pertussis
cgaccacgccggcggc

SEQ ID NO: 304137 - RNA, 20 nt, Bordetella pertussis
cgaccacgccggcggccaug

SEQ ID NO: 304138 - RNA, 14 nt, Bordetella pertussis
cgaccacgcgcgcg

SEQ ID NO: 304139 - RNA, 15 nt, Bordetella pertussis
cgaccacgcgcgcgc

SEQ ID NO: 304140 - RNA, 22 nt, Bordetella pertussis
cgaccacgcgcgcgccgccggc

SEQ ID NO: 304141 - RNA, 15 nt, Bordetella pertussis
cgaccacgcggcggu

SEQ ID NO: 304142 - RNA, 16 nt, Bordetella pertussis
cgaccacgcggcggug

SEQ ID NO: 304143 - RNA, 15 nt, Bordetella pertussis
cgaccacgcugggcc

SEQ ID NO: 304144 - RNA, 13 nt, Bordetella pertussis
cgaccacggcggc

SEQ ID NO: 304145 - RNA, 22 nt, Bordetella pertussis
cgaccacuggaagcugcggccg

SEQ ID NO: 304146 - RNA, 16 nt, Bordetella pertussis
cgaccacuggcagacc

SEQ ID NO: 304147 - RNA, 22 nt, Bordetella pertussis
cgaccacuggcagaccgagcgc

SEQ ID NO: 304148 - RNA, 22 nt, Bordetella pertussis
cgaccacggucuggcgcgacag

SEQ ID NO: 304149 - RNA, 13 nt, Bordetella pertussis
cgaccagcgcgcg

SEQ ID NO: 304150 - RNA, 18 nt, Bordetella pertussis
cgaccagcgcgcgccggc

SEQ ID NO: 304151 - RNA, 12 nt, Bordetella pertussis
cgaccagcgcgc

SEQ ID NO: 304152 - RNA, 21 nt, Bordetella pertussis
cgaccagcuucugcgccugcu

SEQ ID NO: 304153 - RNA, 14 nt, Bordetella pertussis
cgaccaugcggccg

SEQ ID NO: 304154 - RNA, 18 nt, Bordetella pertussis
cgaccauguccgcgccca

SEQ ID NO: 304155 - RNA, 20 nt, Bordetella pertussis
cgaccauguggcagauggcg

SEQ ID NO: 304156 - RNA, 22 nt, Bordetella pertussis
cgaccauuucgauuucggcggc

SEQ ID NO: 304157 - RNA, 21 nt, Bordetella pertussis
cgacccacuugagcagcgccu

SEQ ID NO: 304158 - RNA, 18 nt, Bordetella pertussis
cgacccagaacccggccg

SEQ ID NO: 304159 - RNA, 23 nt, Bordetella pertussis
cgacccagaacccggccggcgcc

SEQ ID NO: 304160 - RNA, 15 nt, Bordetella pertussis
cgacccgagcccugg

SEQ ID NO: 304161 - RNA, 18 nt, Bordetella pertussis
cgacccgauagccgcgcg

SEQ ID NO: 304162 - RNA, 22 nt, Bordetella pertussis
cgacccgaaggcgcggccgggc

SEQ ID NO: 304163 - RNA, 14 nt, Bordetella pertussis
cgacccgcaccgac

SEQ ID NO: 304164 - RNA, 12 nt, Bordetella pertussis
cgacccguggcc

SEQ ID NO: 304165 - RNA, 15 nt, Bordetella pertussis
cgacccguggcccgg

SEQ ID NO: 304166 - RNA, 16 nt, Bordetella pertussis
cgacccguggcccggg

SEQ ID NO: 304167 - RNA, 13 nt, Bordetella pertussis
cgaccgccggccg

SEQ ID NO: 304168 - RNA, 15 nt, Bordetella pertussis
cgaccgccggccggu

SEQ ID NO: 304169 - RNA, 16 nt, Bordetella pertussis
cgaccgccgggacagg

SEQ ID NO: 304170 - RNA, 17 nt, Bordetella pertussis
cgaccgccgggacaggc

SEQ ID NO: 304171 - RNA, 15 nt, Bordetella pertussis
cgaccgccucgacgc

SEQ ID NO: 304172 - RNA, 16 nt, Bordetella pertussis
cgaccgccucgacgcc

SEQ ID NO: 304173 - RNA, 18 nt, Bordetella pertussis
cgaccgccucgacgcccg

SEQ ID NO: 304174 - RNA, 20 nt, Bordetella pertussis
cgaccgcgaaccggugcugg

SEQ ID NO: 304175 - RNA, 18 nt, Bordetella pertussis
cgaccgcgaagccgcccg

SEQ ID NO: 304176 - RNA, 16 nt, Bordetella pertussis
cgaccgcgaagcgcgc

SEQ ID NO: 304177 - RNA, 17 nt, Bordetella pertussis
cgaccgcuuccgccacc

SEQ ID NO: 304178 - RNA, 21 nt, Bordetella pertussis
cgaccggaaucaccgccgcga

SEQ ID NO: 304179 - RNA, 19 nt, Bordetella pertussis
cgaccggccccaccuggcg

SEQ ID NO: 304180 - RNA, 17 nt, Bordetella pertussis
cgaccucggcggcgucg

SEQ ID NO: 304181 - RNA, 17 nt, Bordetella pertussis
cgaccucgggacggccc

SEQ ID NO: 304182 - RNA, 21 nt, Bordetella pertussis
cgaccugcccgagaccgcccg

SEQ ID NO: 304183 - RNA, 20 nt, Bordetella pertussis
cgaccugccgcccgagcugg

SEQ ID NO: 304184 - RNA, 23 nt, Bordetella pertussis
cgaccugccgcccgagcuggccg

SEQ ID NO: 304185 - RNA, 19 nt, Bordetella pertussis
cgaccugcgcaccggccgg

SEQ ID NO: 304186 - RNA, 20 nt, Bordetella pertussis
cgaccugcgcaccggccggc

SEQ ID NO: 304187 - RNA, 17 nt, Bordetella pertussis
cgaccugcgcaugcgcc

SEQ ID NO: 304188 - RNA, 15 nt, Bordetella pertussis
cgaccugcgcgaccg

SEQ ID NO: 304189 - RNA, 17 nt, Bordetella pertussis
cgaccugcgcgaccgcc

SEQ ID NO: 304190 - RNA, 19 nt, Bordetella pertussis
cgaccugcgcgaccgccgc

SEQ ID NO: 304191 - RNA, 20 nt, Bordetella pertussis
cgaccugcgggcgcagcgcc

SEQ ID NO: 304192 - RNA, 23 nt, Bordetella pertussis
cgaccugcgggcgcagcgccgcu

SEQ ID NO: 304193 - RNA, 17 nt, Bordetella pertussis
cgaccugcuggcgcgca

SEQ ID NO: 304194 - RNA, 20 nt, Bordetella pertussis
cgaccugcuggcgcgcacca

SEQ ID NO: 304195 - RNA, 14 nt, Bordetella pertussis
cgaccugcuugccc

SEQ ID NO: 304196 - RNA, 18 nt, Bordetella pertussis
cgaccugcuugcccagca

SEQ ID NO: 304197 - RNA, 13 nt, Bordetella pertussis
cgaccuggcgccc

SEQ ID NO: 304198 - RNA, 20 nt, Bordetella pertussis
cgaccuggcgcccgacggcg

SEQ ID NO: 304199 - RNA, 21 nt, Bordetella pertussis
cgaccuggcgcccgacggcgc

SEQ ID NO: 304200 - RNA, 22 nt, Bordetella pertussis
cgaccuugcccgucagcggcgc

SEQ ID NO: 304201 - RNA, 12 nt, Bordetella pertussis
cgaccuugcggc

SEQ ID NO: 304202 - RNA, 16 nt, Bordetella pertussis
cgaccuugcggccgcg

SEQ ID NO: 304203 - RNA, 17 nt, Bordetella pertussis
cgaccuugcggccgcgc

SEQ ID NO: 304204 - RNA, 20 nt, Bordetella pertussis
cgaccuugcuggaccgcgcc

SEQ ID NO: 304205 - RNA, 13 nt, Bordetella pertussis
cgaccuuggcggc

SEQ ID NO: 304206 - RNA, 15 nt, Bordetella pertussis
cgaccuuggcggccg

SEQ ID NO: 304207 - RNA, 18 nt, Bordetella pertussis
cgaccuuggcggccgaca

SEQ ID NO: 304208 - RNA, 22 nt, Bordetella pertussis
cgacgaacaacacgaugaucgc

SEQ ID NO: 304209 - RNA, 18 nt, Bordetella pertussis
cgacgaaauagccgacca

SEQ ID NO: 304210 - RNA, 19 nt, Bordetella pertussis
cgacgaaauagccgaccac

SEQ ID NO: 304211 - RNA, 18 nt, Bordetella pertussis
cgacgacaaacccgacga

SEQ ID NO: 304212 - RNA, 17 nt, Bordetella pertussis
cgacgacagcggcgagc

SEQ ID NO: 304213 - RNA, 15 nt, Bordetella pertussis
cgacgacggccggcg

SEQ ID NO: 304214 - RNA, 16 nt, Bordetella pertussis
cgacgacggccggcgc

SEQ ID NO: 304215 - RNA, 23 nt, Bordetella pertussis
cgacgacggccggcgcgugcugg

SEQ ID NO: 304216 - RNA, 21 nt, Bordetella pertussis
cgacgacuacgcgcuggcgca

SEQ ID NO: 304217 - RNA, 20 nt, Bordetella pertussis
cgacgagaguuucggcgacg

SEQ ID NO: 304218 - RNA, 17 nt, Bordetella pertussis
cgacgagaugccgauga

SEQ ID NO: 304219 - RNA, 20 nt, Bordetella pertussis
cgacgaucaggaggaacagg

SEQ ID NO: 304220 - RNA, 21 nt, Bordetella pertussis
cgacgaugccggucuccagcg

SEQ ID NO: 304221 - RNA, 22 nt, Bordetella pertussis
cgacgaugccggucuccagcgc

SEQ ID NO: 304222 - RNA, 19 nt, Bordetella pertussis
cgacgauggccggaucgua

SEQ ID NO: 304223 - RNA, 23 nt, Bordetella pertussis
cgacgauggccggaucguagugc

SEQ ID NO: 304224 - RNA, 22 nt, Bordetella pertussis
cgacgauggcgggguuggccgc

SEQ ID NO: 304225 - RNA, 14 nt, Bordetella pertussis
cgacgcaaucggcg

SEQ ID NO: 304226 - RNA, 20 nt, Bordetella pertussis
cgacgcaacagacccgggcc

SEQ ID NO: 304227 - RNA, 23 nt, Bordetella pertussis
cgacgcaacagacccgggccgcu

SEQ ID NO: 304228 - RNA, 19 nt, Bordetella pertussis
cgacgccaucucgcgcgcu

SEQ ID NO: 304229 - RNA, 18 nt, Bordetella pertussis
cgacgcugaucggccgac

SEQ ID NO: 304230 - RNA, 19 nt, Bordetella pertussis
cgacgcugaucggccgacu

SEQ ID NO: 304231 - RNA, 16 nt, Bordetella pertussis
cgacgcugaucucggc

SEQ ID NO: 304232 - RNA, 21 nt, Bordetella pertussis
cgacgcugaugcccagcccgg

SEQ ID NO: 304233 - RNA, 18 nt, Bordetella pertussis
cgacgcuguuggucaggu

SEQ ID NO: 304234 - RNA, 21 nt, Bordetella pertussis
cgacgcuguuggucaggucga

SEQ ID NO: 304235 - RNA, 20 nt, Bordetella pertussis
cgacgcuguagaggcgcggc

SEQ ID NO: 304236 - RNA, 16 nt, Bordetella pertussis
cgacgcuugccggcga

SEQ ID NO: 304237 - RNA, 17 nt, Bordetella pertussis
cgacgcuugccggcgau

SEQ ID NO: 304238 - RNA, 17 nt, Bordetella pertussis
cgacggauucgcccagg

SEQ ID NO: 304239 - RNA, 19 nt, Bordetella pertussis
cgacggcaagucgacgcug

SEQ ID NO: 304240 - RNA, 18 nt, Bordetella pertussis
cgacggcaaugccugcgc

SEQ ID NO: 304241 - RNA, 16 nt, Bordetella pertussis
cgacggcauggccggc

SEQ ID NO: 304242 - RNA, 17 nt, Bordetella pertussis
cgacggcauggcggcca

SEQ ID NO: 304243 - RNA, 19 nt, Bordetella pertussis
cgacggcauggcggccagc

SEQ ID NO: 304244 - RNA, 20 nt, Bordetella pertussis
cgacggcauggcggccagcu

SEQ ID NO: 304245 - RNA, 21 nt, Bordetella pertussis
cgacggcauggcggccagcuu

SEQ ID NO: 304246 - RNA, 22 nt, Bordetella pertussis
cgacggcaucgauuucucgcug

SEQ ID NO: 304247 - RNA, 18 nt, Bordetella pertussis
cgacggccccagcgccgc

SEQ ID NO: 304248 - RNA, 19 nt, Bordetella pertussis
cgacggccccagcgccgcg

SEQ ID NO: 304249 - RNA, 20 nt, Bordetella pertussis
cgacggccccagcgccgcga

SEQ ID NO: 304250 - RNA, 19 nt, Bordetella pertussis
cgacggccggcgcgugcug

SEQ ID NO: 304251 - RNA, 22 nt, Bordetella pertussis
cgacggccucccgccgcccggc

SEQ ID NO: 304252 - RNA, 21 nt, Bordetella pertussis
cgacggccuccgcgccgacca

SEQ ID NO: 304253 - RNA, 22 nt, Bordetella pertussis
cgacggccuccgcgccgaccac

SEQ ID NO: 304254 - RNA, 11 nt, Bordetella pertussis
cgacggccucg

SEQ ID NO: 304255 - RNA, 18 nt, Bordetella pertussis
cgacggccucggccagga

SEQ ID NO: 304256 - RNA, 23 nt, Bordetella pertussis
cgacggccucguccucgucggcg

SEQ ID NO: 304257 - RNA, 22 nt, Bordetella pertussis
cgacggccugccaccgacaagc

SEQ ID NO: 304258 - RNA, 19 nt, Bordetella pertussis
cgacggccuggaggccgag

SEQ ID NO: 304259 - RNA, 20 nt, Bordetella pertussis
cgacggccuggaggccgagc

SEQ ID NO: 304260 - RNA, 22 nt, Bordetella pertussis
cgacggccuggaggccgagcgc

SEQ ID NO: 304261 - RNA, 23 nt, Bordetella pertussis
cgacggcgcccugcagggcaugg

SEQ ID NO: 304262 - RNA, 13 nt, Bordetella pertussis
cgacggcgccugg

SEQ ID NO: 304263 - RNA, 15 nt, Bordetella pertussis
cgacggcgccuggcg

SEQ ID NO: 304264 - RNA, 14 nt, Bordetella pertussis
cgacggcgcgcccg

SEQ ID NO: 304265 - RNA, 13 nt, Bordetella pertussis
cgacggcgcggcg

SEQ ID NO: 304266 - RNA, 21 nt, Bordetella pertussis
cgacggcggcgcggcgccagc

SEQ ID NO: 304267 - RNA, 16 nt, Bordetella pertussis
cgacggcgucggccug

SEQ ID NO: 304268 - RNA, 16 nt, Bordetella pertussis
cgacgggauccucgcu

SEQ ID NO: 304269 - RNA, 17 nt, Bordetella pertussis
cgacgggcaggcccagc

SEQ ID NO: 304270 - RNA, 18 nt, Bordetella pertussis
cgacgggcaggcccagcc

SEQ ID NO: 304271 - RNA, 19 nt, Bordetella pertussis
cgacgggcaggcccagcca

SEQ ID NO: 304272 - RNA, 22 nt, Bordetella pertussis
cgacgggcaggcccagccagcg

SEQ ID NO: 304273 - RNA, 16 nt, Bordetella pertussis
cgacgggcggcugcug

SEQ ID NO: 304274 - RNA, 14 nt, Bordetella pertussis
cgacggggugccug

SEQ ID NO: 304275 - RNA, 20 nt, Bordetella pertussis
cgacggggugccugucccug

SEQ ID NO: 304276 - RNA, 15 nt, Bordetella pertussis
cgacgggugaggcga

SEQ ID NO: 304277 - RNA, 23 nt, Bordetella pertussis
cgacgguagccgggucuggccgg

SEQ ID NO: 304278 - RNA, 21 nt, Bordetella pertussis
cgacgguaucucagcgcgccg

SEQ ID NO: 304279 - RNA, 15 nt, Bordetella pertussis
cgacggucugggcca

SEQ ID NO: 304280 - RNA, 15 nt, Bordetella pertussis
cgacggugcgcgcca

SEQ ID NO: 304281 - RNA, 20 nt, Bordetella pertussis
cgacggugcgcgccacggcg

SEQ ID NO: 304282 - RNA, 19 nt, Bordetella pertussis
cgacgguggcuggggcugg

SEQ ID NO: 304283 - RNA, 18 nt, Bordetella pertussis
cgacgguuaacgaaucgc

SEQ ID NO: 304284 - RNA, 18 nt, Bordetella pertussis
cgacguaaaaucccgcgu

SEQ ID NO: 304285 - RNA, 17 nt, Bordetella pertussis
cgacguaagugcccagg

SEQ ID NO: 304286 - RNA, 16 nt, Bordetella pertussis
cgacguagucgcgcca

SEQ ID NO: 304287 - RNA, 18 nt, Bordetella pertussis
cgacguagucgcgccagc

SEQ ID NO: 304288 - RNA, 19 nt, Bordetella pertussis
cgacguagucgcgccagcg

SEQ ID NO: 304289 - RNA, 13 nt, Bordetella pertussis
cgacguccagccc

SEQ ID NO: 304290 - RNA, 14 nt, Bordetella pertussis
cgacgucccaggcc

SEQ ID NO: 304291 - RNA, 21 nt, Bordetella pertussis
cgacgucccaggccgaagcca

SEQ ID NO: 304292 - RNA, 14 nt, Bordetella pertussis
cgacguccgcccgg

SEQ ID NO: 304293 - RNA, 15 nt, Bordetella pertussis
cgacguccgcccggu

SEQ ID NO: 304294 - RNA, 20 nt, Bordetella pertussis
aacaagguacccgcgccggc

SEQ ID NO: 304295 - RNA, 22 nt, Bordetella pertussis
aacaaggugaaauagccaugcg

SEQ ID NO: 304296 - RNA, 16 nt, Bordetella pertussis
cgacguggaccgcgcg

SEQ ID NO: 304297 - RNA, 21 nt, Bordetella pertussis
cgacguugcgcgacaggcccg

SEQ ID NO: 304298 - RNA, 14 nt, Bordetella pertussis
cgacguuguucagg

SEQ ID NO: 304299 - RNA, 15 nt, Bordetella pertussis
cgacuacgcgcuggc

SEQ ID NO: 304300 - RNA, 17 nt, Bordetella pertussis
cgacucgaacaccggcu

SEQ ID NO: 304301 - RNA, 12 nt, Bordetella pertussis
cgacucgaagaa

SEQ ID NO: 304302 - RNA, 14 nt, Bordetella pertussis
cgacucggccgaga

SEQ ID NO: 304303 - RNA, 15 nt, Bordetella pertussis
cgacucgucgaccac

SEQ ID NO: 304304 - RNA, 19 nt, Bordetella pertussis
cgacugcagcaggcugggc

SEQ ID NO: 304305 - RNA, 21 nt, Bordetella pertussis
cgacugccccagcggcuggcg

SEQ ID NO: 304306 - RNA, 16 nt, Bordetella pertussis
cgacuggcccaggcgg

SEQ ID NO: 304307 - RNA, 21 nt, Bordetella pertussis
cgacuucaccgugaugggcgc

SEQ ID NO: 304308 - RNA, 21 nt, Bordetella pertussis
cgagaagauuucccagagcug

SEQ ID NO: 304309 - RNA, 19 nt, Bordetella pertussis
cgagaaguuggcgggcgcu

SEQ ID NO: 304310 - RNA, 23 nt, Bordetella pertussis
cgagaaugacgguggugucggcg

SEQ ID NO: 304311 - RNA, 22 nt, Bordetella pertussis
cgagaauggcgcgauccagucg

SEQ ID NO: 304312 - RNA, 18 nt, Bordetella pertussis
cgagacaggcgcgccauc

SEQ ID NO: 304313 - RNA, 16 nt, Bordetella pertussis
cgagaccacgauggcc

SEQ ID NO: 304314 - RNA, 23 nt, Bordetella pertussis
cgagacgucggcgauggcccggu

SEQ ID NO: 304315 - RNA, 16 nt, Bordetella pertussis
cgagagauagcccagc

SEQ ID NO: 304316 - RNA, 17 nt, Bordetella pertussis
cgagagauagcccagca

SEQ ID NO: 304317 - RNA, 20 nt, Bordetella pertussis
cgagagccugggcgcgcgcc

SEQ ID NO: 304318 - RNA, 22 nt, Bordetella pertussis
cgagagccugggcgcgcgccca

SEQ ID NO: 304319 - RNA, 14 nt, Bordetella pertussis
cgagagcgccacgc

SEQ ID NO: 304320 - RNA, 23 nt, Bordetella pertussis
cgagaucagcaccgcgaccaugc

SEQ ID NO: 304321 - RNA, 14 nt, Bordetella pertussis
cgagauccgccggc

SEQ ID NO: 304322 - RNA, 15 nt, Bordetella pertussis
cgagauccgccggcg

SEQ ID NO: 304323 - RNA, 17 nt, Bordetella pertussis
cgagaucgccuggggca

SEQ ID NO: 304324 - RNA, 23 nt, Bordetella pertussis
cgagaucgcgccuaccggcgccg

SEQ ID NO: 304325 - RNA, 15 nt, Bordetella pertussis
cgagcacccgcaggc

SEQ ID NO: 304326 - RNA, 17 nt, Bordetella pertussis
cgagcggggccgcgccg

SEQ ID NO: 304327 - RNA, 20 nt, Bordetella pertussis
cgagcggggccgcgccggcu

SEQ ID NO: 304328 - RNA, 14 nt, Bordetella pertussis
cgagcaccgcgcgg

SEQ ID NO: 304329 - RNA, 17 nt, Bordetella pertussis
cgagcgggugaugcugc

SEQ ID NO: 304330 - RNA, 19 nt, Bordetella pertussis
cgagcugagcaccagcagc

SEQ ID NO: 304331 - RNA, 22 nt, Bordetella pertussis
cgagcuggugauggugucgaag

SEQ ID NO: 304332 - RNA, 23 nt, Bordetella pertussis
cgaggacgguacauacguggugg

SEQ ID NO: 304333 - RNA, 15 nt, Bordetella pertussis
cgaggagccggcggg

SEQ ID NO: 304334 - RNA, 20 nt, Bordetella pertussis
cgaggagcugcugugcgccg

SEQ ID NO: 304335 - RNA, 21 nt, Bordetella pertussis
cgaggagcugcugugcgccgg

SEQ ID NO: 304336 - RNA, 15 nt, Bordetella pertussis
cgaggaggugcgccg

SEQ ID NO: 304337 - RNA, 19 nt, Bordetella pertussis
cgaggaggugcgccgcucg

SEQ ID NO: 304338 - RNA, 22 nt, Bordetella pertussis
cgaggaucaugucguccucggc

SEQ ID NO: 304339 - RNA, 20 nt, Bordetella pertussis
cgaggccaggcugaccagcg

SEQ ID NO: 304340 - RNA, 11 nt, Bordetella pertussis
cgaggccaggu

SEQ ID NO: 304341 - RNA, 23 nt, Bordetella pertussis
cgaggccagguugggugcgccgc

SEQ ID NO: 304342 - RNA, 20 nt, Bordetella pertussis
cgaggccgcccgccccggcg

SEQ ID NO: 304343 - RNA, 22 nt, Bordetella pertussis
cgaggccgcccgccccggcgca

SEQ ID NO: 304344 - RNA, 19 nt, Bordetella pertussis
cgaggccgcuucgugcggc

SEQ ID NO: 304345 - RNA, 22 nt, Bordetella pertussis
cgaggccggcgucuggagcggc

SEQ ID NO: 304346 - RNA, 15 nt, Bordetella pertussis
cgaggccucgugcug

SEQ ID NO: 304347 - RNA, 22 nt, Bordetella pertussis
cgaggccucgugcugcugcagg

SEQ ID NO: 304348 - RNA, 15 nt, Bordetella pertussis
cgaggcgaacaggca

SEQ ID NO: 304349 - RNA, 20 nt, Bordetella pertussis
cgaggcgaacauggccgaga

SEQ ID NO: 304350 - RNA, 14 nt, Bordetella pertussis
cgaggcgcaggccg

SEQ ID NO: 304351 - RNA, 16 nt, Bordetella pertussis
cgaggcgcaggccgac

SEQ ID NO: 304352 - RNA, 19 nt, Bordetella pertussis
cgaggcgauggucggccgg

SEQ ID NO: 304353 - RNA, 12 nt, Bordetella pertussis
cgaggcgccgcc

SEQ ID NO: 304354 - RNA, 13 nt, Bordetella pertussis
cgaggcgccgccg

SEQ ID NO: 304355 - RNA, 17 nt, Bordetella pertussis
cgaggcgcgcagcacgc

SEQ ID NO: 304356 - RNA, 19 nt, Bordetella pertussis
cgaggcgcgcagcacgccg

SEQ ID NO: 304357 - RNA, 20 nt, Bordetella pertussis
cgaggcgcgcagcacgccga

SEQ ID NO: 304358 - RNA, 16 nt, Bordetella pertussis
cgaggcgcuggccggc

SEQ ID NO: 304359 - RNA, 19 nt, Bordetella pertussis
cgaggcggcaagcggcgug

SEQ ID NO: 304360 - RNA, 15 nt, Bordetella pertussis
cgaggcggcgcagga

SEQ ID NO: 304361 - RNA, 20 nt, Bordetella pertussis
cgaggcggggcuggcgcggc

SEQ ID NO: 304362 - RNA, 22 nt, Bordetella pertussis
cgaggcggggcuggcgcggcug

SEQ ID NO: 304363 - RNA, 14 nt, Bordetella pertussis
cgaggcgggcagca

SEQ ID NO: 304364 - RNA, 18 nt, Bordetella pertussis
cgaggcggugggcagggc

SEQ ID NO: 304365 - RNA, 15 nt, Bordetella pertussis
cgagggcaucagcgc

SEQ ID NO: 304366 - RNA, 16 nt, Bordetella pertussis
cgagggcaucagcgcg

SEQ ID NO: 304367 - RNA, 18 nt, Bordetella pertussis
cgagggcaucagcgcgaa

SEQ ID NO: 304368 - RNA, 14 nt, Bordetella pertussis
cgagggccgcgcga

SEQ ID NO: 304369 - RNA, 14 nt, Bordetella pertussis
cgagggccgcggcg

SEQ ID NO: 304370 - RNA, 18 nt, Bordetella pertussis
cgagggccggcgccagca

SEQ ID NO: 304371 - RNA, 19 nt, Bordetella pertussis
cgagggcgcgucgaccuug

SEQ ID NO: 304372 - RNA, 17 nt, Bordetella pertussis
cgagggcgcggcgccgc

SEQ ID NO: 304373 - RNA, 24 nt, Bordetella pertussis
cgagggcgucaucggcgcgcagca

SEQ ID NO: 304374 - RNA, 13 nt, Bordetella pertussis
cgaggggcccuug

SEQ ID NO: 304375 - RNA, 21 nt, Bordetella pertussis
cgaggggcccuugugcugcca

SEQ ID NO: 304376 - RNA, 21 nt, Bordetella pertussis
cgagggggcuuuuugccuugg

SEQ ID NO: 304377 - RNA, 22 nt, Bordetella pertussis
cgagggggcuuuuuugccuugg

SEQ ID NO: 304378 - RNA, 20 nt, Bordetella pertussis
cgaggucuugccgaucggcg

SEQ ID NO: 304379 - RNA, 19 nt, Bordetella pertussis
cgaggugccggacgccgac

SEQ ID NO: 304380 - RNA, 13 nt, Bordetella pertussis
cgaggugccggcg

SEQ ID NO: 304381 - RNA, 22 nt, Bordetella pertussis
cgaggugccggcggugaugacg

SEQ ID NO: 304382 - RNA, 22 nt, Bordetella pertussis
cgaggugcacgugggcacgccg

SEQ ID NO: 304383 - RNA, 19 nt, Bordetella pertussis
cgaggugcccaucaggccg

SEQ ID NO: 304384 - RNA, 15 nt, Bordetella pertussis
cgaguaccgccgccu

SEQ ID NO: 304385 - RNA, 14 nt, Bordetella pertussis
cgaguaggccggca

SEQ ID NO: 304386 - RNA, 23 nt, Bordetella pertussis
cgagucggcgauggcgcgcgcca

SEQ ID NO: 304387 - RNA, 14 nt, Bordetella pertussis
cgagugcaggcccg

SEQ ID NO: 304388 - RNA, 19 nt, Bordetella pertussis
cgagugcaggcccgacagg

SEQ ID NO: 304389 - RNA, 13 nt, Bordetella pertussis
cgauacgcgccgc

SEQ ID NO: 304390 - RNA, 20 nt, Bordetella pertussis
cgauacgcgccgccuggccc

SEQ ID NO: 304391 - RNA, 14 nt, Bordetella pertussis
cgauacgcgugcgc

SEQ ID NO: 304392 - RNA, 18 nt, Bordetella pertussis
cgauacgcgugcgcggcc

SEQ ID NO: 304393 - RNA, 14 nt, Bordetella pertussis
cgauacugcgcaug

SEQ ID NO: 304394 - RNA, 17 nt, Bordetella pertussis
cgauacugcgcaugggc

SEQ ID NO: 304395 - RNA, 23 nt, Bordetella pertussis
cgauagauggccagguggcggcg

SEQ ID NO: 304396 - RNA, 15 nt, Bordetella pertussis
cgauagccgcgcgcc

SEQ ID NO: 304397 - RNA, 22 nt, Bordetella pertussis
cgauagccgcgcgccugcagca

SEQ ID NO: 304398 - RNA, 19 nt, Bordetella pertussis
cgauagccgcggcgccgca

SEQ ID NO: 304399 - RNA, 19 nt, Bordetella pertussis
cgauagccgugaccugcuc

SEQ ID NO: 304400 - RNA, 16 nt, Bordetella pertussis
cgauagcggcgccgcu

SEQ ID NO: 304401 - RNA, 16 nt, Bordetella pertussis
cgauagcgggccugca

SEQ ID NO: 304402 - RNA, 21 nt, Bordetella pertussis
cgaucaacgugcgccaggcaa

SEQ ID NO: 304403 - RNA, 17 nt, Bordetella pertussis
cgaucaagggguggcug

SEQ ID NO: 304404 - RNA, 18 nt, Bordetella pertussis
cgaucaccacgggcacga

SEQ ID NO: 304405 - RNA, 19 nt, Bordetella pertussis
cgaucaccgacagcgccag

SEQ ID NO: 304406 - RNA, 18 nt, Bordetella pertussis
cgaucaccugcaggccca

SEQ ID NO: 304407 - RNA, 18 nt, Bordetella pertussis
cgaucaccugcguggccg

SEQ ID NO: 304408 - RNA, 18 nt, Bordetella pertussis
cgaucacgaacagcgcca

SEQ ID NO: 304409 - RNA, 20 nt, Bordetella pertussis
cgaucacgaacagcgccagg

SEQ ID NO: 304410 - RNA, 21 nt, Bordetella pertussis
cgaucacgaacagcgccaggc

SEQ ID NO: 304411 - RNA, 23 nt, Bordetella pertussis
cgaucacgccgaaggcgugaggc

SEQ ID NO: 304412 - RNA, 13 nt, Bordetella pertussis
cgaucacggcgcg

SEQ ID NO: 304413 - RNA, 15 nt, Bordetella pertussis
cgaucacggcgcgcg

SEQ ID NO: 304414 - RNA, 17 nt, Bordetella pertussis
cgaucacggcgcgcgcc

SEQ ID NO: 304415 - RNA, 22 nt, Bordetella pertussis
cgaucacgggcuguucgcgcag

SEQ ID NO: 304416 - RNA, 23 nt, Bordetella pertussis
cgaucacgggcuguucgcgcagc

SEQ ID NO: 304417 - RNA, 24 nt, Bordetella pertussis
cgaucacgggcuguucgcgcagca

SEQ ID NO: 304418 - RNA, 12 nt, Bordetella pertussis
cgaucagcacca

SEQ ID NO: 304419 - RNA, 20 nt, Bordetella pertussis
cgaucagcaccacggcggcc

SEQ ID NO: 304420 - RNA, 23 nt, Bordetella pertussis
cgaucagcaccacggcggccagg

SEQ ID NO: 304421 - RNA, 15 nt, Bordetella pertussis
cgaucagcaggucgg

SEQ ID NO: 304422 - RNA, 22 nt, Bordetella pertussis
cgaucagcaggucggcgcggcc

SEQ ID NO: 304423 - RNA, 14 nt, Bordetella pertussis
cgaucagccagccg

SEQ ID NO: 304424 - RNA, 15 nt, Bordetella pertussis
cgaucagccagccgg

SEQ ID NO: 304425 - RNA, 20 nt, Bordetella pertussis
cgaucagccagccggcggcc

SEQ ID NO: 304426 - RNA, 14 nt, Bordetella pertussis
cgaucagccggcca

SEQ ID NO: 304427 - RNA, 16 nt, Bordetella pertussis
cgaucagccggccaug

SEQ ID NO: 304428 - RNA, 22 nt, Bordetella pertussis
cgaucagcgaaugcgacagcga

SEQ ID NO: 304429 - RNA, 13 nt, Bordetella pertussis
cgaucagcgccca

SEQ ID NO: 304430 - RNA, 15 nt, Bordetella pertussis
cgaucagcgcccagg

SEQ ID NO: 304431 - RNA, 13 nt, Bordetella pertussis
cgaucagcgcggg

SEQ ID NO: 304432 - RNA, 17 nt, Bordetella pertussis
cgaucagcgcggccgcu

SEQ ID NO: 304433 - RNA, 18 nt, Bordetella pertussis
cgaucagcgggcuggcca

SEQ ID NO: 304434 - RNA, 15 nt, Bordetella pertussis
cgaucaggcccagca

SEQ ID NO: 304435 - RNA, 12 nt, Bordetella pertussis
cgaucaggcccu

SEQ ID NO: 304436 - RNA, 13 nt, Bordetella pertussis
cgaucaggccgcc

SEQ ID NO: 304437 - RNA, 12 nt, Bordetella pertussis
cgaucaggcggc

SEQ ID NO: 304438 - RNA, 18 nt, Bordetella pertussis
cgaucaggcggcgcggcg

SEQ ID NO: 304439 - RNA, 18 nt, Bordetella pertussis
cgaucaggcggugccccg

SEQ ID NO: 304440 - RNA, 15 nt, Bordetella pertussis
cgaucagggcgcgga

SEQ ID NO: 304441 - RNA, 19 nt, Bordetella pertussis
cgaucaguaucucggcgcc

SEQ ID NO: 304442 - RNA, 18 nt, Bordetella pertussis
cgaucaucagguccacuu

SEQ ID NO: 304443 - RNA, 14 nt, Bordetella pertussis
cgaucauccaggcc

SEQ ID NO: 304444 - RNA, 21 nt, Bordetella pertussis
cgaucaugaugcgcugggcca

SEQ ID NO: 304445 - RNA, 14 nt, Bordetella pertussis
cgaucauggccagc

SEQ ID NO: 304446 - RNA, 13 nt, Bordetella pertussis
cgaucauggcgcc

SEQ ID NO: 304447 - RNA, 15 nt, Bordetella pertussis
cgaucaugccgccga

SEQ ID NO: 304448 - RNA, 18 nt, Bordetella pertussis
cgauccacggccggcgca

SEQ ID NO: 304449 - RNA, 17 nt, Bordetella pertussis
cgauccacucggccagc

SEQ ID NO: 304450 - RNA, 18 nt, Bordetella pertussis
cgauccacucggccagcg

SEQ ID NO: 304451 - RNA, 19 nt, Bordetella pertussis
cgauccagcagcguggcca

SEQ ID NO: 304452 - RNA, 15 nt, Bordetella pertussis
cgauccagcccgcgg

SEQ ID NO: 304453 - RNA, 21 nt, Bordetella pertussis
cgauccagccguuggcgccca

SEQ ID NO: 304454 - RNA, 15 nt, Bordetella pertussis
cgauccagcgccugg

SEQ ID NO: 304455 - RNA, 14 nt, Bordetella pertussis
cgauccagggccgc

SEQ ID NO: 304456 - RNA, 16 nt, Bordetella pertussis
cgauccagggccgcca

SEQ ID NO: 304457 - RNA, 22 nt, Bordetella pertussis
cgauccagggccgccagcaccu

SEQ ID NO: 304458 - RNA, 17 nt, Bordetella pertussis
cgauccauguggccagc

SEQ ID NO: 304459 - RNA, 20 nt, Bordetella pertussis
cgauccauguggccagcucc

SEQ ID NO: 304460 - RNA, 14 nt, Bordetella pertussis
cgauccccugcccg

SEQ ID NO: 304461 - RNA, 15 nt, Bordetella pertussis
cgauccccugcccgc

SEQ ID NO: 304462 - RNA, 14 nt, Bordetella pertussis
cgaucccggccacg

SEQ ID NO: 304463 - RNA, 22 nt, Bordetella pertussis
cgaucccgucauggcggcaggc

SEQ ID NO: 304464 - RNA, 18 nt, Bordetella pertussis
cgaucccuugugcgcgcc

SEQ ID NO: 304465 - RNA, 17 nt, Bordetella pertussis
cgauccgaugaugccca

SEQ ID NO: 304466 - RNA, 17 nt, Bordetella pertussis
cgauccgcgggcgggcc

SEQ ID NO: 304467 - RNA, 12 nt, Bordetella pertussis
cgauccggcagc

SEQ ID NO: 304468 - RNA, 14 nt, Bordetella pertussis
cgauccggcagcag

SEQ ID NO: 304469 - RNA, 14 nt, Bordetella pertussis
cgauccggcgaccg

SEQ ID NO: 304470 - RNA, 21 nt, Bordetella pertussis
cgauccggcgcagauccucga

SEQ ID NO: 304471 - RNA, 16 nt, Bordetella pertussis
cgauccgguugacgau

SEQ ID NO: 304472 - RNA, 16 nt, Bordetella pertussis
cgaucgaacgcggcca

SEQ ID NO: 304473 - RNA, 20 nt, Bordetella pertussis
cgaucgaauggucggccucg

SEQ ID NO: 304474 - RNA, 13 nt, Bordetella pertussis
cgaucgagcaggc

SEQ ID NO: 304475 - RNA, 15 nt, Bordetella pertussis
cgaucgagcaggccg

SEQ ID NO: 304476 - RNA, 17 nt, Bordetella pertussis
cgaucgagcaggccgcc

SEQ ID NO: 304477 - RNA, 16 nt, Bordetella pertussis
cgaucgcaucgcggca

SEQ ID NO: 304478 - RNA, 14 nt, Bordetella pertussis
cgaucgccaccagc

SEQ ID NO: 304479 - RNA, 15 nt, Bordetella pertussis
cgaucgccaccagcg

SEQ ID NO: 304480 - RNA, 15 nt, Bordetella pertussis
cgaucgccagcaggc

SEQ ID NO: 304481 - RNA, 17 nt, Bordetella pertussis
cgaucgccagcaggcgc

SEQ ID NO: 304482 - RNA, 14 nt, Bordetella pertussis
cgaucgccaggucg

SEQ ID NO: 304483 - RNA, 15 nt, Bordetella pertussis
cgaucgccaggucgg

SEQ ID NO: 304484 - RNA, 16 nt, Bordetella pertussis
cgaucgccaggucggc

SEQ ID NO: 304485 - RNA, 17 nt, Bordetella pertussis
cgaucgccaugacgcug

SEQ ID NO: 304486 - RNA, 14 nt, Bordetella pertussis
cgaucgccgacagg

SEQ ID NO: 304487 - RNA, 14 nt, Bordetella pertussis
cgaucgccgccggc

SEQ ID NO: 304488 - RNA, 15 nt, Bordetella pertussis
cgaucgccgccggca

SEQ ID NO: 304489 - RNA, 15 nt, Bordetella pertussis
cgaucgcgcacagca

SEQ ID NO: 304490 - RNA, 12 nt, Bordetella pertussis
cgaucgcgccgg

SEQ ID NO: 304491 - RNA, 13 nt, Bordetella pertussis
cgaucgcgccggc

SEQ ID NO: 304492 - RNA, 16 nt, Bordetella pertussis
cgaucgcgccggccug

SEQ ID NO: 304493 - RNA, 19 nt, Bordetella pertussis
cgaucgcgccggccugggc

SEQ ID NO: 304494 - RNA, 20 nt, Bordetella pertussis
cgaucgcgccggccugggcg

SEQ ID NO: 304495 - RNA, 16 nt, Bordetella pertussis
cgaucgcgucggccaa

SEQ ID NO: 304496 - RNA, 17 nt, Bordetella pertussis
cgaucgcgucggccaag

SEQ ID NO: 304497 - RNA, 22 nt, Bordetella pertussis
cgaucggagaaaucgccgccgg

SEQ ID NO: 304498 - RNA, 14 nt, Bordetella pertussis
cgaucggccggccg

SEQ ID NO: 304499 - RNA, 21 nt, Bordetella pertussis
cgaucggccugaaccaggccg

SEQ ID NO: 304500 - RNA, 18 nt, Bordetella pertussis
cgaucggcgccgcgcgcg

SEQ ID NO: 304501 - RNA, 21 nt, Bordetella pertussis
cgaucggcgccuggccgccca

SEQ ID NO: 304502 - RNA, 18 nt, Bordetella pertussis
cgaucggcuugccgcgcg

SEQ ID NO: 304503 - RNA, 21 nt, Bordetella pertussis
cgaucggcuugccgcgcggcg

SEQ ID NO: 304504 - RNA, 13 nt, Bordetella pertussis
cgaucgucgaccg

SEQ ID NO: 304505 - RNA, 14 nt, Bordetella pertussis
cgaucgucgaccgc

SEQ ID NO: 304506 - RNA, 21 nt, Bordetella pertussis
cgaucuacgacgccuggaccg

SEQ ID NO: 304507 - RNA, 18 nt, Bordetella pertussis
cgaucucgcccugcucgc

SEQ ID NO: 304508 - RNA, 14 nt, Bordetella pertussis
cgaucucgcgcagg

SEQ ID NO: 304509 - RNA, 23 nt, Bordetella pertussis
cgaucucgcggcugguggugccg

SEQ ID NO: 304510 - RNA, 15 nt, Bordetella pertussis
cgaucucggccucgg

SEQ ID NO: 304511 - RNA, 19 nt, Bordetella pertussis
cgaucucgggcaggucggc

SEQ ID NO: 304512 - RNA, 20 nt, Bordetella pertussis
cgaucucgucgaccgccucg

SEQ ID NO: 304513 - RNA, 21 nt, Bordetella pertussis
cgaucucgucgaccgccucga

SEQ ID NO: 304514 - RNA, 14 nt, Bordetella pertussis
cgaucugcgcggcg

SEQ ID NO: 304515 - RNA, 21 nt, Bordetella pertussis
cgaucugcgcggcggugccgc

SEQ ID NO: 304516 - RNA, 14 nt, Bordetella pertussis
cgaucugcggcgug

SEQ ID NO: 304517 - RNA, 18 nt, Bordetella pertussis
cgaugaagaucaggcggc

SEQ ID NO: 304518 - RNA, 14 nt, Bordetella pertussis
cgaugaaggcgccg

SEQ ID NO: 304519 - RNA, 17 nt, Bordetella pertussis
cgaugaaggcgccgacu

SEQ ID NO: 304520 - RNA, 20 nt, Bordetella pertussis
cgaugaaggugcgcagcagg

SEQ ID NO: 304521 - RNA, 16 nt, Bordetella pertussis
cgaugaagucgcggcc

SEQ ID NO: 304522 - RNA, 20 nt, Bordetella pertussis
cgaugaagucgcggcccgcc

SEQ ID NO: 304523 - RNA, 16 nt, Bordetella pertussis
cgaugaauugcgccac

SEQ ID NO: 304524 - RNA, 17 nt, Bordetella pertussis
cgaugaauugcgccacg

SEQ ID NO: 304525 - RNA, 21 nt, Bordetella pertussis
cgaugaccagcagcgaaucgc

SEQ ID NO: 304526 - RNA, 16 nt, Bordetella pertussis
cgaugaccagcgccgg

SEQ ID NO: 304527 - RNA, 19 nt, Bordetella pertussis
cgaugaccaucacgagcag

SEQ ID NO: 304528 - RNA, 15 nt, Bordetella pertussis
cgaugacgcgccgcg

SEQ ID NO: 304529 - RNA, 17 nt, Bordetella pertussis
cgaugacggcuucgacc

SEQ ID NO: 304530 - RNA, 18 nt, Bordetella pertussis
cgaugacggggcggcgcc

SEQ ID NO: 304531 - RNA, 19 nt, Bordetella pertussis
cgaugacggggcggcgccu

SEQ ID NO: 304532 - RNA, 15 nt, Bordetella pertussis
cgaugaugagcgcgc

SEQ ID NO: 304533 - RNA, 16 nt, Bordetella pertussis
cgaugaugagcgcgcc

SEQ ID NO: 304534 - RNA, 19 nt, Bordetella pertussis
cgaugauggauucgcgccg

SEQ ID NO: 304535 - RNA, 22 nt, Bordetella pertussis
cgaugauggggucgccgggcag

SEQ ID NO: 304536 - RNA, 19 nt, Bordetella pertussis
cgaugauggugaacgccac

SEQ ID NO: 304537 - RNA, 21 nt, Bordetella pertussis
cgaugccagugaaacgcgacg

SEQ ID NO: 304538 - RNA, 16 nt, Bordetella pertussis
cgaugcccaccagccg

SEQ ID NO: 304539 - RNA, 18 nt, Bordetella pertussis
cgaugcccaccagccgcc

SEQ ID NO: 304540 - RNA, 19 nt, Bordetella pertussis
cgaugcccaccagccgccc

SEQ ID NO: 304541 - RNA, 20 nt, Bordetella pertussis
cgaugcccaccagccgcccg

SEQ ID NO: 304542 - RNA, 14 nt, Bordetella pertussis
cgaugcccagcgcc

SEQ ID NO: 304543 - RNA, 16 nt, Bordetella pertussis
cgaugcccagcgccgc

SEQ ID NO: 304544 - RNA, 17 nt, Bordetella pertussis
cgaugcccaggcccgcc

SEQ ID NO: 304545 - RNA, 21 nt, Bordetella pertussis
cgaugcccaggcccgccaggg

SEQ ID NO: 304546 - RNA, 16 nt, Bordetella pertussis
cgaugcccagggccgc

SEQ ID NO: 304547 - RNA, 21 nt, Bordetella pertussis
cgaugcccagggccgcgccgg

SEQ ID NO: 304548 - RNA, 14 nt, Bordetella pertussis
cgaugcccaggucg

SEQ ID NO: 304549 - RNA, 20 nt, Bordetella pertussis
cgaugccccaguccaggccg

SEQ ID NO: 304550 - RNA, 13 nt, Bordetella pertussis
cgaugcccgacga

SEQ ID NO: 304551 - RNA, 21 nt, Bordetella pertussis
cgaugcccgcgcaccaggcgc

SEQ ID NO: 304552 - RNA, 15 nt, Bordetella pertussis
cgaugccgccgccga

SEQ ID NO: 304553 - RNA, 13 nt, Bordetella pertussis
cgaugccgcgcac

SEQ ID NO: 304554 - RNA, 14 nt, Bordetella pertussis
cgaugccgcgcacc

SEQ ID NO: 304555 - RNA, 21 nt, Bordetella pertussis
cgaugccgcgcaccugggcgu

SEQ ID NO: 304556 - RNA, 15 nt, Bordetella pertussis
cgaugccggccagca

SEQ ID NO: 304557 - RNA, 18 nt, Bordetella pertussis
cgaugccggccucggcca

SEQ ID NO: 304558 - RNA, 20 nt, Bordetella pertussis
cgaugcccucgcgcacggug

SEQ ID NO: 304559 - RNA, 18 nt, Bordetella pertussis
cgaugccggcggccugca

SEQ ID NO: 304560 - RNA, 18 nt, Bordetella pertussis
cgaugccgucgccgccca

SEQ ID NO: 304561 - RNA, 16 nt, Bordetella pertussis
cgaugcgaucgucgcu

SEQ ID NO: 304562 - RNA, 17 nt, Bordetella pertussis
cgaugcggcgcaugcug

SEQ ID NO: 304563 - RNA, 14 nt, Bordetella pertussis
cgaugcgggcaucg

SEQ ID NO: 304564 - RNA, 14 nt, Bordetella pertussis
cgaugcgggccacg

SEQ ID NO: 304565 - RNA, 17 nt, Bordetella pertussis
cgaugcgggccacgccg

SEQ ID NO: 304566 - RNA, 18 nt, Bordetella pertussis
cgaugcgggccacgccgg

SEQ ID NO: 304567 - RNA, 20 nt, Bordetella pertussis
cgaugcgggccacgccggcc

SEQ ID NO: 304568 - RNA, 18 nt, Bordetella pertussis
cgaugcggguacuggccg

SEQ ID NO: 304569 - RNA, 21 nt, Bordetella pertussis
cgaugcgguaccacgcgaaca

SEQ ID NO: 304570 - RNA, 15 nt, Bordetella pertussis
cgaugcggucggccg

SEQ ID NO: 304571 - RNA, 18 nt, Bordetella pertussis
cgaugcggucggccgcgc

SEQ ID NO: 304572 - RNA, 20 nt, Bordetella pertussis
cgaugcgguugagcacauug

SEQ ID NO: 304573 - RNA, 21 nt, Bordetella pertussis
cgaugcgucaggggcaugccg

SEQ ID NO: 304574 - RNA, 16 nt, Bordetella pertussis
cgaugcguccgccgug

SEQ ID NO: 304575 - RNA, 18 nt, Bordetella pertussis
cgaugcguccgccgugca

SEQ ID NO: 304576 - RNA, 21 nt, Bordetella pertussis
cgaugcguccgccgugcaggc

SEQ ID NO: 304577 - RNA, 16 nt, Bordetella pertussis
cgaugcguucgcccgu

SEQ ID NO: 304578 - RNA, 15 nt, Bordetella pertussis
cgaugcucacgccca

SEQ ID NO: 304579 - RNA, 18 nt, Bordetella pertussis
cgaugcucgccggcgccg

SEQ ID NO: 304580 - RNA, 16 nt, Bordetella pertussis
cgaugcugaccaccgg

SEQ ID NO: 304581 - RNA, 17 nt, Bordetella pertussis
cgaugcugaccaccggg

SEQ ID NO: 304582 - RNA, 14 nt, Bordetella pertussis
cgaugcugcagggc

SEQ ID NO: 304583 - RNA, 15 nt, Bordetella pertussis
cgauggcacggcacg

SEQ ID NO: 304584 - RNA, 16 nt, Bordetella pertussis
cgauggcacggcacgc

SEQ ID NO: 304585 - RNA, 23 nt, Bordetella pertussis
cgauggcacggcacgccucgccg

SEQ ID NO: 304586 - RNA, 19 nt, Bordetella pertussis
cgauggcaucgggcagggc

SEQ ID NO: 304587 - RNA, 20 nt, Bordetella pertussis
cgauggcauggggcaggcgc

SEQ ID NO: 304588 - RNA, 13 nt, Bordetella pertussis
cgauggccaggug

SEQ ID NO: 304589 - RNA, 17 nt, Bordetella pertussis
cgauggcccgcaggugg

SEQ ID NO: 304590 - RNA, 12 nt, Bordetella pertussis
cgauggcccggu

SEQ ID NO: 304591 - RNA, 19 nt, Bordetella pertussis
cgauggcccgguaggccac

SEQ ID NO: 304592 - RNA, 12 nt, Bordetella pertussis
cgauggccgaca

SEQ ID NO: 304593 - RNA, 12 nt, Bordetella pertussis
cgauggccgcca

SEQ ID NO: 304594 - RNA, 15 nt, Bordetella pertussis
cgauuucgcgcgcca

SEQ ID NO: 304595 - RNA, 17 nt, Bordetella pertussis
cgauuucgcgcgccagc

SEQ ID NO: 304596 - RNA, 17 nt, Bordetella pertussis
cgauuucggcggccagg

SEQ ID NO: 304597 - RNA, 18 nt, Bordetella pertussis
cgauuucggggcgcgaga

SEQ ID NO: 304598 - RNA, 20 nt, Bordetella pertussis
cgauuucuucgccuggccgg

SEQ ID NO: 304599 - RNA, 23 nt, Bordetella pertussis
cgauuugccgcagcccgcgcgcc

SEQ ID NO: 304600 - RNA, 14 nt, Bordetella pertussis
cgauuucggccgcc

SEQ ID NO: 304601 - RNA, 22 nt, Bordetella pertussis
cgcaacagacccgggccgcugg

SEQ ID NO: 304602 - RNA, 13 nt, Bordetella pertussis
cgcaacacgcgcg

SEQ ID NO: 304603 - RNA, 14 nt, Bordetella pertussis
cgcaacacgcgcga

SEQ ID NO: 304604 - RNA, 15 nt, Bordetella pertussis
cgcaagcaagcccca

SEQ ID NO: 304605 - RNA, 22 nt, Bordetella pertussis
cgcaagcaagccccaggcaggc

SEQ ID NO: 304606 - RNA, 19 nt, Bordetella pertussis
cgcaagcaccgccugcugc

SEQ ID NO: 304607 - RNA, 22 nt, Bordetella pertussis
cgcaagagcgugugucccggcg

SEQ ID NO: 304608 - RNA, 15 nt, Bordetella pertussis
cgcaagcccaggcgg

SEQ ID NO: 304609 - RNA, 21 nt, Bordetella pertussis
cgcaagcccaggcggcccagc

SEQ ID NO: 304610 - RNA, 14 nt, Bordetella pertussis
cgcaagccgcccgc

SEQ ID NO: 304611 - RNA, 16 nt, Bordetella pertussis
cgcaagccgcccgcgg

SEQ ID NO: 304612 - RNA, 13 nt, Bordetella pertussis
cgcaagccgcugg

SEQ ID NO: 304613 - RNA, 13 nt, Bordetella pertussis
cgcaagccggccg

SEQ ID NO: 304614 - RNA, 13 nt, Bordetella pertussis
cgcaagcgcgccg

SEQ ID NO: 304615 - RNA, 14 nt, Bordetella pertussis
cgcaagcuggccga

SEQ ID NO: 304616 - RNA, 15 nt, Bordetella pertussis
cgcaagcuggccgau

SEQ ID NO: 304617 - RNA, 22 nt, Bordetella pertussis
cgcaagcuggccgaugucgccg

SEQ ID NO: 304618 - RNA, 21 nt, Bordetella pertussis
cgcaagcuggcggcgcgcggc

SEQ ID NO: 304619 - RNA, 19 nt, Bordetella pertussis
cgcaaggccgacuggauga

SEQ ID NO: 304620 - RNA, 16 nt, Bordetella pertussis
cgcaaggcggcccggc

SEQ ID NO: 304621 - RNA, 22 nt, Bordetella pertussis
cgcaaggcgucgggcacguccg

SEQ ID NO: 304622 - RNA, 20 nt, Bordetella pertussis
cgcaagggccccccggcgcg

SEQ ID NO: 304623 - RNA, 22 nt, Bordetella pertussis
cgcaagggccccccggcgcggc

SEQ ID NO: 304624 - RNA, 15 nt, Bordetella pertussis
cgcaaggggccggcg

SEQ ID NO: 304625 - RNA, 16 nt, Bordetella pertussis
cgcaagggggacuggc

SEQ ID NO: 304626 - RNA, 22 nt, Bordetella pertussis
cgcaagggggacuggcaccggc

SEQ ID NO: 304627 - RNA, 19 nt, Bordetella pertussis
cgcaaggguuguggccgug

SEQ ID NO: 304628 - RNA, 21 nt, Bordetella pertussis
cgcaagugcuggcccgccagc

SEQ ID NO: 304629 - RNA, 22 nt, Bordetella pertussis
cgcaagugcuggcccgccagca

SEQ ID NO: 304630 - RNA, 18 nt, Bordetella pertussis
cgcaaguguggcgcaccg

SEQ ID NO: 304631 - RNA, 15 nt, Bordetella pertussis
cgcaauacgccgccg

SEQ ID NO: 304632 - RNA, 19 nt, Bordetella pertussis
cgcaauacgccgccggcgc

SEQ ID NO: 304633 - RNA, 18 nt, Bordetella pertussis
cgcaauacgugcgcgacg

SEQ ID NO: 304634 - RNA, 23 nt, Bordetella pertussis
cgcaauccccgcuuccugcugcg

SEQ ID NO: 304635 - RNA, 15 nt, Bordetella pertussis
cgcaauugcguggug

SEQ ID NO: 304636 - RNA, 16 nt, Bordetella pertussis
cgcacaagggccccgc

SEQ ID NO: 304637 - RNA, 23 nt, Bordetella pertussis
cgcacaagggccccgcgaggggc

SEQ ID NO: 304638 - RNA, 17 nt, Bordetella pertussis
cgcacaaucugcgucgc

SEQ ID NO: 304639 - RNA, 22 nt, Bordetella pertussis
cgcacacgcgcugggcguggcg

SEQ ID NO: 304640 - RNA, 16 nt, Bordetella pertussis
cgcacacuggccagca

SEQ ID NO: 304641 - RNA, 22 nt, Bordetella pertussis
cgcacacuggccagcaagcgcu

SEQ ID NO: 304642 - RNA, 14 nt, Bordetella pertussis
cgcacagcauggcc

SEQ ID NO: 304643 - RNA, 22 nt, Bordetella pertussis
cgcacagcccgaucgacggccg

SEQ ID NO: 304644 - RNA, 20 nt, Bordetella pertussis
cgcacagccggggcgagcgc

SEQ ID NO: 304645 - RNA, 12 nt, Bordetella pertussis
cgcacagcucgu

SEQ ID NO: 304646 - RNA, 20 nt, Bordetella pertussis
cgcacagcgcggcgaugccc

SEQ ID NO: 304647 - RNA, 20 nt, Bordetella pertussis
cgcacaggcgcucgcccucg

SEQ ID NO: 304648 - RNA, 18 nt, Bordetella pertussis
cgcacaggcggcgccggc

SEQ ID NO: 304649 - RNA, 23 nt, Bordetella pertussis
cgcacagggcgucgcgaugcgcc

SEQ ID NO: 304650 - RNA, 19 nt, Bordetella pertussis
cgcacaguucgugcaccag

SEQ ID NO: 304651 - RNA, 21 nt, Bordetella pertussis
cgcacaguucgugcaccagcc

SEQ ID NO: 304652 - RNA, 19 nt, Bordetella pertussis
cgcacauacaaggcgcggc

SEQ ID NO: 304653 - RNA, 13 nt, Bordetella pertussis
cgcacaucgcccg

SEQ ID NO: 304654 - RNA, 13 nt, Bordetella pertussis
cgcacaucgucga

SEQ ID NO: 304655 - RNA, 19 nt, Bordetella pertussis
cgcacauccagccgaugcc

SEQ ID NO: 304656 - RNA, 16 nt, Bordetella pertussis
cgcacaugaugcccag

SEQ ID NO: 304657 - RNA, 20 nt, Bordetella pertussis
cgcacaugaugcccagcgcc

SEQ ID NO: 304658 - RNA, 21 nt, Bordetella pertussis
cgcacaugaugcccagcgcca

SEQ ID NO: 304659 - RNA, 23 nt, Bordetella pertussis
cgcaccagcccgcccgcgcccag

SEQ ID NO: 304660 - RNA, 13 nt, Bordetella pertussis
cgcaccagcgcau

SEQ ID NO: 304661 - RNA, 14 nt, Bordetella pertussis
cgcaccagcgccga

SEQ ID NO: 304662 - RNA, 13 nt, Bordetella pertussis
cgcaccagcggcg

SEQ ID NO: 304663 - RNA, 13 nt, Bordetella pertussis
cgcaccaggccgc

SEQ ID NO: 304664 - RNA, 14 nt, Bordetella pertussis
cgcaccaggccgcg

SEQ ID NO: 304665 - RNA, 16 nt, Bordetella pertussis
cgcaccaggccgcggc

SEQ ID NO: 304666 - RNA, 16 nt, Bordetella pertussis
cgcaccaggcgcggcg

SEQ ID NO: 304667 - RNA, 24 nt, Bordetella pertussis
cgcaccaggcgcucgcgcgccagc

SEQ ID NO: 304668 - RNA, 15 nt, Bordetella pertussis
cgcaccaggcccaug

SEQ ID NO: 304669 - RNA, 12 nt, Bordetella pertussis
cgcaccaggccg

SEQ ID NO: 304670 - RNA, 19 nt, Bordetella pertussis
cgcaccggcacgcgccagc

SEQ ID NO: 304671 - RNA, 12 nt, Bordetella pertussis
cgcaccggccag

SEQ ID NO: 304672 - RNA, 16 nt, Bordetella pertussis
cgcaccggccaggggc

SEQ ID NO: 304673 - RNA, 18 nt, Bordetella pertussis
cgcaccggccaggggcgc

SEQ ID NO: 304674 - RNA, 18 nt, Bordetella pertussis
cgcaccggcgugcgcugg

SEQ ID NO: 304675 - RNA, 19 nt, Bordetella pertussis
cgcaccggcgugcgcuggc

SEQ ID NO: 304676 - RNA, 20 nt, Bordetella pertussis
cgcaccggcuuggggcgcgc

SEQ ID NO: 304677 - RNA, 12 nt, Bordetella pertussis
cgcaccgggcgg

SEQ ID NO: 304678 - RNA, 14 nt, Bordetella pertussis
cgcaccgggcggcc

SEQ ID NO: 304679 - RNA, 16 nt, Bordetella pertussis
cgcaccgggcggcccg

SEQ ID NO: 304680 - RNA, 20 nt, Bordetella pertussis
cgcaccgggcggcccggcgg

SEQ ID NO: 304681 - RNA, 14 nt, Bordetella pertussis
cgcaccgucacgcg

SEQ ID NO: 304682 - RNA, 18 nt, Bordetella pertussis
cgcaccucguaaguggcg

SEQ ID NO: 304683 - RNA, 20 nt, Bordetella pertussis
cgcaccucguaaguggcggc

SEQ ID NO: 304684 - RNA, 21 nt, Bordetella pertussis
cgcaccugaacaccggcgcgc

SEQ ID NO: 304685 - RNA, 20 nt, Bordetella pertussis
cgcaccugcugcggcacggc

SEQ ID NO: 304686 - RNA, 22 nt, Bordetella pertussis
cgcaccugcugcggcacggcca

SEQ ID NO: 304687 - RNA, 16 nt, Bordetella pertussis
cgcaccuuucugcugc

SEQ ID NO: 304688 - RNA, 17 nt, Bordetella pertussis
cgcaccuuucugcugcu

SEQ ID NO: 304689 - RNA, 13 nt, Bordetella pertussis
cgcacggcgcccu

SEQ ID NO: 304690 - RNA, 15 nt, Bordetella pertussis
cgcacggcgcccugc

SEQ ID NO: 304691 - RNA, 20 nt, Bordetella pertussis
cgcacggcggcgaucacgcc

SEQ ID NO: 304692 - RNA, 17 nt, Bordetella pertussis
cgcacgggcgaggcggg

SEQ ID NO: 304693 - RNA, 22 nt, Bordetella pertussis
cgcacgggcgaggcggggcugg

SEQ ID NO: 304694 - RNA, 12 nt, Bordetella pertussis
cgcacgggcgcc

SEQ ID NO: 304695 - RNA, 19 nt, Bordetella pertussis
cgcacggggacaggcacgc

SEQ ID NO: 304696 - RNA, 23 nt, Bordetella pertussis
cgcacggggacaggcacgcgccg

SEQ ID NO: 304697 - RNA, 19 nt, Bordetella pertussis
cgcacggggacuggcacgc

SEQ ID NO: 304698 - RNA, 22 nt, Bordetella pertussis
cgcacggggacuggcacgcgcu

SEQ ID NO: 304699 - RNA, 20 nt, Bordetella pertussis
cgcacgggccgacggccucg

SEQ ID NO: 304700 - RNA, 15 nt, Bordetella pertussis
cgcacgguccaggcg

SEQ ID NO: 304701 - RNA, 19 nt, Bordetella pertussis
cgcacgguccaggcggccg

SEQ ID NO: 304702 - RNA, 21 nt, Bordetella pertussis
cgcacgguccaggcggccgcg

SEQ ID NO: 304703 - RNA, 20 nt, Bordetella pertussis
cgcacugagaaaggccgcca

SEQ ID NO: 304704 - RNA, 16 nt, Bordetella pertussis
cgcacugauagaccga

SEQ ID NO: 304705 - RNA, 20 nt, Bordetella pertussis
cgcagacgcgcucaggcggu

SEQ ID NO: 304706 - RNA, 16 nt, Bordetella pertussis
cgcagauccucgaaca

SEQ ID NO: 304707 - RNA, 19 nt, Bordetella pertussis
cgcagauccucgaacaggc

SEQ ID NO: 304708 - RNA, 14 nt, Bordetella pertussis
cgcagauggccagc

SEQ ID NO: 304709 - RNA, 19 nt, Bordetella pertussis
cgcagauggccagcagcgc

SEQ ID NO: 304710 - RNA, 13 nt, Bordetella pertussis
cgcagauggcggc

SEQ ID NO: 304711 - RNA, 19 nt, Bordetella pertussis
cgcagaugggcggcgacga

SEQ ID NO: 304712 - RNA, 17 nt, Bordetella pertussis
cgcagauuuccagcgcg

SEQ ID NO: 304713 - RNA, 16 nt, Bordetella pertussis
cgcagcaacccgcccg

SEQ ID NO: 304714 - RNA, 17 nt, Bordetella pertussis
cgcagcaacccgcccgg

SEQ ID NO: 304715 - RNA, 20 nt, Bordetella pertussis
cgcagcaacggugagccggc

SEQ ID NO: 304716 - RNA, 18 nt, Bordetella pertussis
cgcagcaagcugcugcug

SEQ ID NO: 304717 - RNA, 14 nt, Bordetella pertussis
cgcagcaaggcgcg

SEQ ID NO: 304718 - RNA, 16 nt, Bordetella pertussis
cgcagcaaggcgcgcc

SEQ ID NO: 304719 - RNA, 17 nt, Bordetella pertussis
cgcagcaaggcgcgcca

SEQ ID NO: 304720 - RNA, 20 nt, Bordetella pertussis
cgcagcaaggcgcgccaccg

SEQ ID NO: 304721 - RNA, 19 nt, Bordetella pertussis
cgcagcaagucagcccgcg

SEQ ID NO: 304722 - RNA, 20 nt, Bordetella pertussis
cgcagcaagucagcccgcgu

SEQ ID NO: 304723 - RNA, 20 nt, Bordetella pertussis
cgcagcaauucaagccgcac

SEQ ID NO: 304724 - RNA, 23 nt, Bordetella pertussis
cgcagcaauucaagccgcaccau

SEQ ID NO: 304725 - RNA, 11 nt, Bordetella pertussis
cgcagcaccag

SEQ ID NO: 304726 - RNA, 18 nt, Bordetella pertussis
cgcagcaccgccagcgcg

SEQ ID NO: 304727 - RNA, 20 nt, Bordetella pertussis
cgcagcaccgcgcgcacgac

SEQ ID NO: 304728 - RNA, 14 nt, Bordetella pertussis
cgcagcaccggcgu

SEQ ID NO: 304729 - RNA, 21 nt, Bordetella pertussis
cgcagcaccggcgugagcgcc

SEQ ID NO: 304730 - RNA, 22 nt, Bordetella pertussis
cgcagcaccggcgugagcgcca

SEQ ID NO: 304731 - RNA, 13 nt, Bordetella pertussis
cgcagcaccucgg

SEQ ID NO: 304732 - RNA, 16 nt, Bordetella pertussis
cgcagcaccucggcgu

SEQ ID NO: 304733 - RNA, 23 nt, Bordetella pertussis
cgcagcaccucggggcgcggccg

SEQ ID NO: 304734 - RNA, 19 nt, Bordetella pertussis
cgcagcaccuugaccuggu

SEQ ID NO: 304735 - RNA, 16 nt, Bordetella pertussis
cgcagcacgcccgcgc

SEQ ID NO: 304736 - RNA, 17 nt, Bordetella pertussis
cgcagcacgcccgcgcg

SEQ ID NO: 304737 - RNA, 19 nt, Bordetella pertussis
cgcagcacgccgcgccagg

SEQ ID NO: 304738 - RNA, 13 nt, Bordetella pertussis
cgcagcacgcugc

SEQ ID NO: 304739 - RNA, 19 nt, Bordetella pertussis
cgcagcacgcugcgcggcg

SEQ ID NO: 304740 - RNA, 19 nt, Bordetella pertussis
cgcagcacggcuugcgcgc

SEQ ID NO: 304741 - RNA, 18 nt, Bordetella pertussis
cgcagcagauugccgcgc

SEQ ID NO: 304742 - RNA, 21 nt, Bordetella pertussis
cgcagcagauugccgcgcggc

SEQ ID NO: 304743 - RNA, 22 nt, Bordetella pertussis
cgcagcagauugccgcgcggcg

SEQ ID NO: 304744 - RNA, 17 nt, Bordetella pertussis
cgcagcagcagcgcauc

SEQ ID NO: 304745 - RNA, 11 nt, Bordetella pertussis
cgcagcagcga

SEQ ID NO: 304746 - RNA, 13 nt, Bordetella pertussis
cgcagcagcgaca

SEQ ID NO: 304747 - RNA, 13 nt, Bordetella pertussis
cgcagcagcgccg

SEQ ID NO: 304748 - RNA, 15 nt, Bordetella pertussis
cgcagcagcgccggc

SEQ ID NO: 304749 - RNA, 13 nt, Bordetella pertussis
cgcagcagcgcgg

SEQ ID NO: 304750 - RNA, 15 nt, Bordetella pertussis
cgcagcaggccagga

SEQ ID NO: 304751 - RNA, 13 nt, Bordetella pertussis
cgcagcaggccca

SEQ ID NO: 304752 - RNA, 14 nt, Bordetella pertussis
cgcagcaggcccau

SEQ ID NO: 304753 - RNA, 13 nt, Bordetella pertussis
cgcagcaggcgcg

SEQ ID NO: 304754 - RNA, 16 nt, Bordetella pertussis
cgcagcaggcgcgcgg

SEQ ID NO: 304755 - RNA, 17 nt, Bordetella pertussis
cgcagcaggcgcgcggc

SEQ ID NO: 304756 - RNA, 21 nt, Bordetella pertussis
cgcagcaggcgcgcggccucg

SEQ ID NO: 304757 - RNA, 16 nt, Bordetella pertussis
cgcagcaggcgcucgg

SEQ ID NO: 304758 - RNA, 19 nt, Bordetella pertussis
cgcagcaggcgcucggcca

SEQ ID NO: 304759 - RNA, 17 nt, Bordetella pertussis
cgcagcagggccuggca

SEQ ID NO: 304760 - RNA, 23 nt, Bordetella pertussis
cgcagcaguucggucagcgcggc

SEQ ID NO: 304761 - RNA, 20 nt, Bordetella pertussis
cgcagccagguaagcuggcg

SEQ ID NO: 304762 - RNA, 22 nt, Bordetella pertussis
cgcagccagguaagcuggcgcu

SEQ ID NO: 304763 - RNA, 14 nt, Bordetella pertussis
cgcagcccagcgcg

SEQ ID NO: 304764 - RNA, 13 nt, Bordetella pertussis
cgcagcccgcgcg

SEQ ID NO: 304765 - RNA, 15 nt, Bordetella pertussis
cgcagcccgcgcgcc

SEQ ID NO: 304766 - RNA, 16 nt, Bordetella pertussis
cgcagcccgcgcgccu

SEQ ID NO: 304767 - RNA, 12 nt, Bordetella pertussis
cgcagcccggcg

SEQ ID NO: 304768 - RNA, 19 nt, Bordetella pertussis
cgcagcccggcgugcccag

SEQ ID NO: 304769 - RNA, 16 nt, Bordetella pertussis
cgcagccgacaggcgc

SEQ ID NO: 304770 - RNA, 17 nt, Bordetella pertussis
cgcagccgacaggcgcg

SEQ ID NO: 304771 - RNA, 16 nt, Bordetella pertussis
cgcagccgcuucacgc

SEQ ID NO: 304772 - RNA, 13 nt, Bordetella pertussis
cgcagccggccgg

SEQ ID NO: 304773 - RNA, 17 nt, Bordetella pertussis
cgcagccgggcugccgg

SEQ ID NO: 304774 - RNA, 19 nt, Bordetella pertussis
cgcagccgggcugccggca

SEQ ID NO: 304775 - RNA, 13 nt, Bordetella pertussis
cgcaggacggcgc

SEQ ID NO: 304776 - RNA, 18 nt, Bordetella pertussis
cgcaggaugcgcuggccg

SEQ ID NO: 304777 - RNA, 22 nt, Bordetella pertussis
cgcaggauuuccucgccguagg

SEQ ID NO: 304778 - RNA, 17 nt, Bordetella pertussis
cgcaggcaaagccugac

SEQ ID NO: 304779 - RNA, 14 nt, Bordetella pertussis
cgcaggccagcgcc

SEQ ID NO: 304780 - RNA, 14 nt, Bordetella pertussis
cgcaggccagcccg

SEQ ID NO: 304781 - RNA, 15 nt, Bordetella pertussis
cgcaggcccagccag

SEQ ID NO: 304782 - RNA, 16 nt, Bordetella pertussis
cgcaggcccagccagc

SEQ ID NO: 304783 - RNA, 16 nt, Bordetella pertussis
cgcaggcccaugacga

SEQ ID NO: 304784 - RNA, 14 nt, Bordetella pertussis
cgcaggcccacaau

SEQ ID NO: 304785 - RNA, 13 nt, Bordetella pertussis
cgcaggcccgaca

SEQ ID NO: 304786 - RNA, 21 nt, Bordetella pertussis
cgcaggcccuugaucaggcgc

SEQ ID NO: 304787 - RNA, 14 nt, Bordetella pertussis
cgcaggccgacgcg

SEQ ID NO: 304788 - RNA, 15 nt, Bordetella pertussis
cgcaggccgacgcgc

SEQ ID NO: 304789 - RNA, 18 nt, Bordetella pertussis
cgcaggccgacgcgcugu

SEQ ID NO: 304790 - RNA, 21 nt, Bordetella pertussis
cgcagggacaggcaccccggc

SEQ ID NO: 304791 - RNA, 14 nt, Bordetella pertussis
cgcagggacaggcu

SEQ ID NO: 304792 - RNA, 14 nt, Bordetella pertussis
cgcagggcauacau

SEQ ID NO: 304793 - RNA, 17 nt, Bordetella pertussis
cgcaggcugucgaugcg

SEQ ID NO: 304794 - RNA, 18 nt, Bordetella pertussis
cgcagggcccgcaucggc

SEQ ID NO: 304795 - RNA, 22 nt, Bordetella pertussis
cgcagggcgaacguggccugcu

SEQ ID NO: 304796 - RNA, 17 nt, Bordetella pertussis
cgcagggcggccggcac

SEQ ID NO: 304797 - RNA, 19 nt, Bordetella pertussis
cgcagggcggccucgacgg

SEQ ID NO: 304798 - RNA, 15 nt, Bordetella pertussis
cgcagggcgggcggu

SEQ ID NO: 304799 - RNA, 13 nt, Bordetella pertussis
cgcaggucggcca

SEQ ID NO: 304800 - RNA, 15 nt, Bordetella pertussis
cgcaggucguggccg

SEQ ID NO: 304801 - RNA, 21 nt, Bordetella pertussis
cgcagguggggcagcaggccg

SEQ ID NO: 304802 - RNA, 22 nt, Bordetella pertussis
cgcagguggggcagcaggccgg

SEQ ID NO: 304803 - RNA, 17 nt, Bordetella pertussis
cgcaguacccggugcag

SEQ ID NO: 304804 - RNA, 21 nt, Bordetella pertussis
cgcaguagcguugcaguucgg

SEQ ID NO: 304805 - RNA, 23 nt, Bordetella pertussis
cgcaguaucccggccaggcgccg

SEQ ID NO: 304806 - RNA, 22 nt, Bordetella pertussis
cgcaguccaaggaaagcccggc

SEQ ID NO: 304807 - RNA, 17 nt, Bordetella pertussis
cgcagucccaguccggc

SEQ ID NO: 304808 - RNA, 16 nt, Bordetella pertussis
cgcagugcgcgcgccc

SEQ ID NO: 304809 - RNA, 13 nt, Bordetella pertussis
cgcaguggcgagg

SEQ ID NO: 304810 - RNA, 23 nt, Bordetella pertussis
cgcaguuccggcgggccgcauga

SEQ ID NO: 304811 - RNA, 21 nt, Bordetella pertussis
cgcaguucggccucaucccga

SEQ ID NO: 304812 - RNA, 21 nt, Bordetella pertussis
cgcaguugcgucuccagcgcg

SEQ ID NO: 304813 - RNA, 23 nt, Bordetella pertussis
cgcaguugcgucuccagcgcggc

SEQ ID NO: 304814 - RNA, 23 nt, Bordetella pertussis
cgcaguuugacgucauggccgau

SEQ ID NO: 304815 - RNA, 20 nt, Bordetella pertussis
cgcauaccggccgcgggugg

SEQ ID NO: 304816 - RNA, 16 nt, Bordetella pertussis
cgcauacucgaugccc

SEQ ID NO: 304817 - RNA, 22 nt, Bordetella pertussis
cgcauagcgcaugaugcugccg

SEQ ID NO: 304818 - RNA, 14 nt, Bordetella pertussis
cgcauaggacgcca

SEQ ID NO: 304819 - RNA, 14 nt, Bordetella pertussis
cgcaucacgcuggc

SEQ ID NO: 304820 - RNA, 22 nt, Bordetella pertussis
cgcaucacgcuggccgcgcccg

SEQ ID NO: 304821 - RNA, 16 nt, Bordetella pertussis
cgcaucagcuuggcca

SEQ ID NO: 304822 - RNA, 16 nt, Bordetella pertussis
cgcaucccgcccccgc

SEQ ID NO: 304823 - RNA, 13 nt, Bordetella pertussis
cgcaucgacagcg

SEQ ID NO: 304824 - RNA, 17 nt, Bordetella pertussis
cgcaucgacagcgcgcc

SEQ ID NO: 304825 - RNA, 23 nt, Bordetella pertussis
cgcaucgagcuccugcaggaugg

SEQ ID NO: 304826 - RNA, 14 nt, Bordetella pertussis
cgcaucgaucagcg

SEQ ID NO: 304827 - RNA, 22 nt, Bordetella pertussis
cgcaucgaucagcgcgccgucg

SEQ ID NO: 304828 - RNA, 19 nt, Bordetella pertussis
cgcaucgaucucggccucg

SEQ ID NO: 304829 - RNA, 19 nt, Bordetella pertussis
cgcaucgaugcggccuucg

SEQ ID NO: 304830 - RNA, 14 nt, Bordetella pertussis
cgcaucgccgaaca

SEQ ID NO: 304831 - RNA, 14 nt, Bordetella pertussis
cgcaucgccgcagg

SEQ ID NO: 304832 - RNA, 18 nt, Bordetella pertussis
cgcaucgccgcaggcgug

SEQ ID NO: 304833 - RNA, 19 nt, Bordetella pertussis
cgcaucgcgaugcgcagca

SEQ ID NO: 304834 - RNA, 14 nt, Bordetella pertussis
cgcaucgcgcaccc

SEQ ID NO: 304835 - RNA, 13 nt, Bordetella pertussis
cgcaucgcgcgcc

SEQ ID NO: 304836 - RNA, 14 nt, Bordetella pertussis
cgcaucgcgcgccg

SEQ ID NO: 304837 - RNA, 16 nt, Bordetella pertussis
cgcaucgcgcgccgcc

SEQ ID NO: 304838 - RNA, 22 nt, Bordetella pertussis
cgcaucgcgcgcgccggcaucg

SEQ ID NO: 304839 - RNA, 12 nt, Bordetella pertussis
cgcaucgcggca

SEQ ID NO: 304840 - RNA, 22 nt, Bordetella pertussis
cgcaucgcggcagcccggcacg

SEQ ID NO: 304841 - RNA, 24 nt, Bordetella pertussis
cgcaucggccaggcgccugagccg

SEQ ID NO: 304842 - RNA, 22 nt, Bordetella pertussis
cgcaucggcgccaguagcgccg

SEQ ID NO: 304843 - RNA, 15 nt, Bordetella pertussis
cgcaucggcgccggc

SEQ ID NO: 304844 - RNA, 21 nt, Bordetella pertussis
cgcaucggcguaccaggcagc

SEQ ID NO: 304845 - RNA, 14 nt, Bordetella pertussis
cgcaucggcuggcg

SEQ ID NO: 304846 - RNA, 15 nt, Bordetella pertussis
cgcaucggcggcagg

SEQ ID NO: 304847 - RNA, 17 nt, Bordetella pertussis
cgcaucgucaggcaggc

SEQ ID NO: 304848 - RNA, 20 nt, Bordetella pertussis
cgcaugaccugcgacagcac

SEQ ID NO: 304849 - RNA, 21 nt, Bordetella pertussis
cgcaugacggcgucgagcacg

SEQ ID NO: 304850 - RNA, 22 nt, Bordetella pertussis
cgcaugacggcgucgagcacgc

SEQ ID NO: 304851 - RNA, 16 nt, Bordetella pertussis
cgcaugaugcugccgg

SEQ ID NO: 304852 - RNA, 23 nt, Bordetella pertussis
cgcaugauggccggccugccggc

SEQ ID NO: 304853 - RNA, 16 nt, Bordetella pertussis
cgcaugcagccgcaau

SEQ ID NO: 304854 - RNA, 21 nt, Bordetella pertussis
cgcaugccagcuugcaggcgc

SEQ ID NO: 304855 - RNA, 23 nt, Bordetella pertussis
cgcaugccauggccgcgcggcgc

SEQ ID NO: 304856 - RNA, 16 nt, Bordetella pertussis
cgcaugcccgaccgca

SEQ ID NO: 304857 - RNA, 18 nt, Bordetella pertussis
cgcaugcccgaccgcaug

SEQ ID NO: 304858 - RNA, 19 nt, Bordetella pertussis
cgcaugcgacaugagcugc

SEQ ID NO: 304859 - RNA, 15 nt, Bordetella pertussis
cgcaugcgcacgcgc

SEQ ID NO: 304860 - RNA, 13 nt, Bordetella pertussis
cgcaugcgccugu

SEQ ID NO: 304861 - RNA, 23 nt, Bordetella pertussis
cgcaugcgccugucccaggcgcu

SEQ ID NO: 304862 - RNA, 21 nt, Bordetella pertussis
cgcaugcggcacaaccuggcg

SEQ ID NO: 304863 - RNA, 18 nt, Bordetella pertussis
cgcaugcggcggcugugg

SEQ ID NO: 304864 - RNA, 22 nt, Bordetella pertussis
cgcaugcgguuucucagcgcgc

SEQ ID NO: 304865 - RNA, 17 nt, Bordetella pertussis
cgcaugcgugaagccca

SEQ ID NO: 304866 - RNA, 17 nt, Bordetella pertussis
cgcaugcgugcgcauca

SEQ ID NO: 304867 - RNA, 22 nt, Bordetella pertussis
cgcauggaaccgguuggccagc

SEQ ID NO: 304868 - RNA, 15 nt, Bordetella pertussis
cgcauggaccgccgc

SEQ ID NO: 304869 - RNA, 17 nt, Bordetella pertussis
cgcauggaccgccgccg

SEQ ID NO: 304870 - RNA, 21 nt, Bordetella pertussis
cgcauggaccgccgccgucgc

SEQ ID NO: 304871 - RNA, 18 nt, Bordetella pertussis
cgcauggacugcaggcgc

SEQ ID NO: 304872 - RNA, 18 nt, Bordetella pertussis
cgcauggagaccggcgcc

SEQ ID NO: 304873 - RNA, 18 nt, Bordetella pertussis
cgcauggccagcgcgcag

SEQ ID NO: 304874 - RNA, 19 nt, Bordetella pertussis
cgcauggccagcgcgcagg

SEQ ID NO: 304875 - RNA, 16 nt, Bordetella pertussis
cgcauggccggcgugu

SEQ ID NO: 304876 - RNA, 15 nt, Bordetella pertussis
cgcauggcgaugacc

SEQ ID NO: 304877 - RNA, 20 nt, Bordetella pertussis
cgcauggcgaugaccucggc

SEQ ID NO: 304878 - RNA, 20 nt, Bordetella pertussis
cgcaugggaaauccgccggg

SEQ ID NO: 304879 - RNA, 13 nt, Bordetella pertussis
cgcaugggccagg

SEQ ID NO: 304880 - RNA, 17 nt, Bordetella pertussis
cgcaugggcgcaggccg

SEQ ID NO: 304881 - RNA, 20 nt, Bordetella pertussis
cgcaugggcgcaggccgcca

SEQ ID NO: 304882 - RNA, 21 nt, Bordetella pertussis
cgcaugggcgccgagggccgc

SEQ ID NO: 304883 - RNA, 15 nt, Bordetella pertussis
cgcaugggcgcgccc

SEQ ID NO: 304884 - RNA, 16 nt, Bordetella pertussis
cgcaugggcgcgcccg

SEQ ID NO: 304885 - RNA, 18 nt, Bordetella pertussis
cgcaugggcgcgcccggc

SEQ ID NO: 304886 - RNA, 19 nt, Bordetella pertussis
cgcaugggcgcgcccggcg

SEQ ID NO: 304887 - RNA, 19 nt, Bordetella pertussis
cgcauggggacuggcgccu

SEQ ID NO: 304888 - RNA, 15 nt, Bordetella pertussis
cgcaugguggcgcag

SEQ ID NO: 304889 - RNA, 16 nt, Bordetella pertussis
cgcaugucgaagcagg

SEQ ID NO: 304890 - RNA, 20 nt, Bordetella pertussis
cgcaugucgaagcaggcggu

SEQ ID NO: 304891 - RNA, 14 nt, Bordetella pertussis
cgcaugucagcgcc

SEQ ID NO: 304892 - RNA, 18 nt, Bordetella pertussis
cgcaugucagcgccuggc

SEQ ID NO: 304893 - RNA, 15 nt, Bordetella pertussis
cgcaugucccgcaug

SEQ ID NO: 304894 - RNA, 19 nt, Bordetella pertussis
cgcauguccgccacgccgg

SEQ ID NO: 304895 - RNA, 22 nt, Bordetella pertussis
cgcauguccgccacgccggcca

SEQ ID NO: 304896 - RNA, 17 nt, Bordetella pertussis
cgccaacacgauccacg

SEQ ID NO: 304897 - RNA, 22 nt, Bordetella pertussis
cgccaacacgauccacggccgg

SEQ ID NO: 304898 - RNA, 23 nt, Bordetella pertussis
cgccaacacgauccacggccggc

SEQ ID NO: 304899 - RNA, 20 nt, Bordetella pertussis
cgccaauugcuugccugucc

SEQ ID NO: 304900 - RNA, 15 nt, Bordetella pertussis
cgccacaaagccucc

SEQ ID NO: 304901 - RNA, 16 nt, Bordetella pertussis
cgccacaccgcugcgg

SEQ ID NO: 304902 - RNA, 13 nt, Bordetella pertussis
cgccacacgggcg

SEQ ID NO: 304903 - RNA, 15 nt, Bordetella pertussis
cgccacacgggcgcc

SEQ ID NO: 304904 - RNA, 15 nt, Bordetella pertussis
cgccacagcaugacc

SEQ ID NO: 304905 - RNA, 20 nt, Bordetella pertussis
cgccacagcaugaccucggc

SEQ ID NO: 304906 - RNA, 22 nt, Bordetella pertussis
cgccacagcaugaccucggccu

SEQ ID NO: 304907 - RNA, 18 nt, Bordetella pertussis
cgccacagcgccaucgcg

SEQ ID NO: 304908 - RNA, 21 nt, Bordetella pertussis
cgccacaggcugacgcccggc

SEQ ID NO: 304909 - RNA, 16 nt, Bordetella pertussis
cgccacagggccugac

SEQ ID NO: 304910 - RNA, 17 nt, Bordetella pertussis
cgccacaggugcgcggc

SEQ ID NO: 304911 - RNA, 18 nt, Bordetella pertussis
cgccacaggugcgcggcg

SEQ ID NO: 304912 - RNA, 23 nt, Bordetella pertussis
cgccacaggugcgcggcgcgccg

SEQ ID NO: 304913 - RNA, 17 nt, Bordetella pertussis
cgccaccccgccgcuga

SEQ ID NO: 304914 - RNA, 16 nt, Bordetella pertussis
cgccacccuggcacgc

SEQ ID NO: 304915 - RNA, 20 nt, Bordetella pertussis
cgccacccuggcacgcugga

SEQ ID NO: 304916 - RNA, 21 nt, Bordetella pertussis
cgccaccgcauggggcgaggu

SEQ ID NO: 304917 - RNA, 14 nt, Bordetella pertussis
cgccaccgcccccg

SEQ ID NO: 304918 - RNA, 16 nt, Bordetella pertussis
cgccaccgcgccgccc

SEQ ID NO: 304919 - RNA, 16 nt, Bordetella pertussis
cgcccagcauccgcgc

SEQ ID NO: 304920 - RNA, 13 nt, Bordetella pertussis
cgcccagccaggc

SEQ ID NO: 304921 - RNA, 17 nt, Bordetella pertussis
cgcccagccaggcgcca

SEQ ID NO: 304922 - RNA, 18 nt, Bordetella pertussis
cgcccagccaggcgccag

SEQ ID NO: 304923 - RNA, 14 nt, Bordetella pertussis
cgcccagccccgcg

SEQ ID NO: 304924 - RNA, 14 nt, Bordetella pertussis
cgcccagcaugcgc

SEQ ID NO: 304925 - RNA, 19 nt, Bordetella pertussis
cgcccagccgcagcaggcg

SEQ ID NO: 304926 - RNA, 14 nt, Bordetella pertussis
cgcccagccggccg

SEQ ID NO: 304927 - RNA, 19 nt, Bordetella pertussis
cgcccagccugccggcggc

SEQ ID NO: 304928 - RNA, 14 nt, Bordetella pertussis
cgcccagcgagccg

SEQ ID NO: 304929 - RNA, 16 nt, Bordetella pertussis
cgcccagcgagccggc

SEQ ID NO: 304930 - RNA, 17 nt, Bordetella pertussis
cgcccagcgagccggcc

SEQ ID NO: 304931 - RNA, 13 nt, Bordetella pertussis
cgcccagcgacga

SEQ ID NO: 304932 - RNA, 22 nt, Bordetella pertussis
cgcccagcgacgagggcgccau

SEQ ID NO: 304933 - RNA, 22 nt, Bordetella pertussis
cgcccagcgcauaggacgccac

SEQ ID NO: 304934 - RNA, 15 nt, Bordetella pertussis
cgcccagcgccauca

SEQ ID NO: 304935 - RNA, 14 nt, Bordetella pertussis
cgcccagcgccggc

SEQ ID NO: 304936 - RNA, 18 nt, Bordetella pertussis
cgcccagcgccggcacgc

SEQ ID NO: 304937 - RNA, 11 nt, Bordetella pertussis
cgcccagcgcg

SEQ ID NO: 304938 - RNA, 15 nt, Bordetella pertussis
cgcccagcgcgucgg

SEQ ID NO: 304939 - RNA, 20 nt, Bordetella pertussis
cgcccagcgcgucggccagc

SEQ ID NO: 304940 - RNA, 21 nt, Bordetella pertussis
cgcccagcgcgucggccagcg

SEQ ID NO: 304941 - RNA, 18 nt, Bordetella pertussis
cgcccagcgcgugggcca

SEQ ID NO: 304942 - RNA, 22 nt, Bordetella pertussis
cgcccagcgcgugggccagcaa

SEQ ID NO: 304943 - RNA, 14 nt, Bordetella pertussis
cgcccagcggcagg

SEQ ID NO: 304944 - RNA, 17 nt, Bordetella pertussis
cgcccagcggcaggcug

SEQ ID NO: 304945 - RNA, 19 nt, Bordetella pertussis
cgcccagcggcaggcuggc

SEQ ID NO: 304946 - RNA, 12 nt, Bordetella pertussis
cgcccagcggcg

SEQ ID NO: 304947 - RNA, 13 nt, Bordetella pertussis
cgcccagcggcgc

SEQ ID NO: 304948 - RNA, 15 nt, Bordetella pertussis
cgcccagcggcgccg

SEQ ID NO: 304949 - RNA, 17 nt, Bordetella pertussis
cgcccagcggcgccgac

SEQ ID NO: 304950 - RNA, 14 nt, Bordetella pertussis
cgcccagcugggcc

SEQ ID NO: 304951 - RNA, 15 nt, Bordetella pertussis
cgcccagcugggcca

SEQ ID NO: 304952 - RNA, 16 nt, Bordetella pertussis
cgcccagcuggcgccc

SEQ ID NO: 304953 - RNA, 17 nt, Bordetella pertussis
cgcccagcuguccaagc

SEQ ID NO: 304954 - RNA, 12 nt, Bordetella pertussis
cgcccagcuuga

SEQ ID NO: 304955 - RNA, 15 nt, Bordetella pertussis
cgcccaggaaggcga

SEQ ID NO: 304956 - RNA, 14 nt, Bordetella pertussis
cgcccaggccagcc

SEQ ID NO: 304957 - RNA, 19 nt, Bordetella pertussis
cgcccaggcccaccgcauc

SEQ ID NO: 304958 - RNA, 14 nt, Bordetella pertussis
cgcccaggcccagc

SEQ ID NO: 304959 - RNA, 15 nt, Bordetella pertussis
cgcccaggcccagca

SEQ ID NO: 304960 - RNA, 22 nt, Bordetella pertussis
cgcccaggcccagcaucaggcc

SEQ ID NO: 304961 - RNA, 17 nt, Bordetella pertussis
cgcccaggcccagcgcg

SEQ ID NO: 304962 - RNA, 18 nt, Bordetella pertussis
cgcccaggcccagcgcgc

SEQ ID NO: 304963 - RNA, 19 nt, Bordetella pertussis
cgcccaggcccagcgcgcc

SEQ ID NO: 304964 - RNA, 16 nt, Bordetella pertussis
cgcccaggccgaucag

SEQ ID NO: 304965 - RNA, 14 nt, Bordetella pertussis
cgcccaggccgggc

SEQ ID NO: 304966 - RNA, 21 nt, Bordetella pertussis
cgcccaggccgggcgagccga

SEQ ID NO: 304967 - RNA, 18 nt, Bordetella pertussis
cgcccaggccguggcgca

SEQ ID NO: 304968 - RNA, 19 nt, Bordetella pertussis
cgcccaggccguggcgcac

SEQ ID NO: 304969 - RNA, 18 nt, Bordetella pertussis
cgcccaggcgaugcccag

SEQ ID NO: 304970 - RNA, 12 nt, Bordetella pertussis
cgcccaggcgca

SEQ ID NO: 304971 - RNA, 14 nt, Bordetella pertussis
cgcccaggcgcagc

SEQ ID NO: 304972 - RNA, 19 nt, Bordetella pertussis
cgcccaggcgcagccgcgc

SEQ ID NO: 304973 - RNA, 15 nt, Bordetella pertussis
cgcccaggggccggc

SEQ ID NO: 304974 - RNA, 17 nt, Bordetella pertussis
cgcccaggggccggcgc

SEQ ID NO: 304975 - RNA, 18 nt, Bordetella pertussis
cgcccaggggccggcgcg

SEQ ID NO: 304976 - RNA, 19 nt, Bordetella pertussis
cgcccaggggccggcgcgc

SEQ ID NO: 304977 - RNA, 23 nt, Bordetella pertussis
cgcccagguccgaaccgaccgcc

SEQ ID NO: 304978 - RNA, 18 nt, Bordetella pertussis
cgcccagguccugcgcca

SEQ ID NO: 304979 - RNA, 20 nt, Bordetella pertussis
cgcccagguccugcgccagc

SEQ ID NO: 304980 - RNA, 17 nt, Bordetella pertussis
cgcccaggucggacgcg

SEQ ID NO: 304981 - RNA, 21 nt, Bordetella pertussis
cgcccaggucggacgcgccgg

SEQ ID NO: 304982 - RNA, 23 nt, Bordetella pertussis
cgcccaggucggacgcgccgggc

SEQ ID NO: 304983 - RNA, 20 nt, Bordetella pertussis
cgcccagguugcggccgcca

SEQ ID NO: 304984 - RNA, 22 nt, Bordetella pertussis
cgcccagguugcggccgccacc

SEQ ID NO: 304985 - RNA, 20 nt, Bordetella pertussis
cgcccaguauggugaccggc

SEQ ID NO: 304986 - RNA, 23 nt, Bordetella pertussis
cgcccaguauggugaccggcgug

SEQ ID NO: 304987 - RNA, 15 nt, Bordetella pertussis
cgcccagucccaggc

SEQ ID NO: 304988 - RNA, 21 nt, Bordetella pertussis
cgcccagucguccagcacgcg

SEQ ID NO: 304989 - RNA, 22 nt, Bordetella pertussis
cgcccaguuccacgcggccgug

SEQ ID NO: 304990 - RNA, 15 nt, Bordetella pertussis
cgcccaugccgccca

SEQ ID NO: 304991 - RNA, 17 nt, Bordetella pertussis
cgcccaugccgcccaug

SEQ ID NO: 304992 - RNA, 23 nt, Bordetella pertussis
cgcccaugccgcccaugccgccg

SEQ ID NO: 304993 - RNA, 14 nt, Bordetella pertussis
cgcccaugccgccg

SEQ ID NO: 304994 - RNA, 17 nt, Bordetella pertussis
cgcccaugcgcauggcc

SEQ ID NO: 304995 - RNA, 14 nt, Bordetella pertussis
cgcccaugcgcugg

SEQ ID NO: 304996 - RNA, 18 nt, Bordetella pertussis
cgcccaugcgcuggcgca

SEQ ID NO: 304997 - RNA, 19 nt, Bordetella pertussis
cgcccaugcgcuggcgcaa

SEQ ID NO: 304998 - RNA, 21 nt, Bordetella pertussis
cgcccaugcugaauugcgggc

SEQ ID NO: 304999 - RNA, 15 nt, Bordetella pertussis
cgcccauggcgcgca

SEQ ID NO: 305000 - RNA, 17 nt, Bordetella pertussis
cgcccauggcgcgcagc

SEQ ID NO: 305001 - RNA, 23 nt, Bordetella pertussis
cgcccaugggaaucugcuugccg

SEQ ID NO: 305002 - RNA, 14 nt, Bordetella pertussis
cgcccauggucagg

SEQ ID NO: 305003 - RNA, 17 nt, Bordetella pertussis
cgcccauuccgagcggg

SEQ ID NO: 305004 - RNA, 14 nt, Bordetella pertussis
cgcccauugcggcg

SEQ ID NO: 305005 - RNA, 16 nt, Bordetella pertussis
cgcccauugcggcggg

SEQ ID NO: 305006 - RNA, 16 nt, Bordetella pertussis
cgcccauuucgauggc

SEQ ID NO: 305007 - RNA, 13 nt, Bordetella pertussis
cgccccaacggcc

SEQ ID NO: 305008 - RNA, 20 nt, Bordetella pertussis
cgccccaacggccuucggcg

SEQ ID NO: 305009 - RNA, 19 nt, Bordetella pertussis
cgccccaggcgucggcggc

SEQ ID NO: 305010 - RNA, 21 nt, Bordetella pertussis
cgccccaguugcgcguccagg

SEQ ID NO: 305011 - RNA, 22 nt, Bordetella pertussis
cgccccaguugcgcguccaggc

SEQ ID NO: 305012 - RNA, 17 nt, Bordetella pertussis
cgccccauccacggcgc

SEQ ID NO: 305013 - RNA, 19 nt, Bordetella pertussis
cgccccauccacggcgcca

SEQ ID NO: 305014 - RNA, 15 nt, Bordetella pertussis
cgcccccacgccgcu

SEQ ID NO: 305015 - RNA, 16 nt, Bordetella pertussis
cgcccccacgccgcug

SEQ ID NO: 305016 - RNA, 12 nt, Bordetella pertussis
cgcccccagcac

SEQ ID NO: 305017 - RNA, 22 nt, Bordetella pertussis
cgcccccagcagcgaggacacg

SEQ ID NO: 305018 - RNA, 18 nt, Bordetella pertussis
cgccccauugggacgcca

SEQ ID NO: 305019 - RNA, 14 nt, Bordetella pertussis
cgcccccagcgcgc

SEQ ID NO: 305020 - RNA, 14 nt, Bordetella pertussis
cgcccccgaaggcc

SEQ ID NO: 305021 - RNA, 14 nt, Bordetella pertussis
cgcccccgacgcca

SEQ ID NO: 305022 - RNA, 21 nt, Bordetella pertussis
cgcccccgccgcacgggcgcc

SEQ ID NO: 305023 - RNA, 16 nt, Bordetella pertussis
cgcccccgcgccgcgc

SEQ ID NO: 305024 - RNA, 13 nt, Bordetella pertussis
cgcccccgcggcg

SEQ ID NO: 305025 - RNA, 14 nt, Bordetella pertussis
cgccccgacgcgcu

SEQ ID NO: 305026 - RNA, 16 nt, Bordetella pertussis
cgccccgacccuguac

SEQ ID NO: 305027 - RNA, 22 nt, Bordetella pertussis
cgccccgacccuguacaagcgc

SEQ ID NO: 305028 - RNA, 12 nt, Bordetella pertussis
cgccccgaucag

SEQ ID NO: 305029 - RNA, 20 nt, Bordetella pertussis
cgccccgaucggcgccgcgc

SEQ ID NO: 305030 - RNA, 15 nt, Bordetella pertussis
cgccccgccaugcgc

SEQ ID NO: 305031 - RNA, 16 nt, Bordetella pertussis
cgccccgcacgaucag

SEQ ID NO: 305032 - RNA, 18 nt, Bordetella pertussis
cgccccgcacgaucagca

SEQ ID NO: 305033 - RNA, 13 nt, Bordetella pertussis
cgccccgccucga

SEQ ID NO: 305034 - RNA, 12 nt, Bordetella pertussis
cgccccggccga

SEQ ID NO: 305035 - RNA, 16 nt, Bordetella pertussis
cgccccggcgcauccc

SEQ ID NO: 305036 - RNA, 16 nt, Bordetella pertussis
cgccccggcgcgcagc

SEQ ID NO: 305037 - RNA, 19 nt, Bordetella pertussis
cgccccggcgcggcgcgcg

SEQ ID NO: 305038 - RNA, 23 nt, Bordetella pertussis
cgccccgucaucgggugcggcgc

SEQ ID NO: 305039 - RNA, 22 nt, Bordetella pertussis
cgccccgucggccgucugggcg

SEQ ID NO: 305040 - RNA, 19 nt, Bordetella pertussis
cgccccuagcgccgcgcca

SEQ ID NO: 305041 - RNA, 20 nt, Bordetella pertussis
cgccccuagcgccgcgccag

SEQ ID NO: 305042 - RNA, 18 nt, Bordetella pertussis
cgcccgaauccagggcca

SEQ ID NO: 305043 - RNA, 12 nt, Bordetella pertussis
cgcccgaccugc

SEQ ID NO: 305044 - RNA, 15 nt, Bordetella pertussis
cgcccgaccugcugg

SEQ ID NO: 305045 - RNA, 17 nt, Bordetella pertussis
cgcccgaccugcuggcg

SEQ ID NO: 305046 - RNA, 19 nt, Bordetella pertussis
cgcccgaccugcuggcgcg

SEQ ID NO: 305047 - RNA, 13 nt, Bordetella pertussis
cgcccgacagcac

SEQ ID NO: 305048 - RNA, 19 nt, Bordetella pertussis
cgcccgacgaggagccggc

SEQ ID NO: 305049 - RNA, 14 nt, Bordetella pertussis
cgcccgacggcgcg

SEQ ID NO: 305050 - RNA, 15 nt, Bordetella pertussis
cgcccgacggcgcgc

SEQ ID NO: 305051 - RNA, 17 nt, Bordetella pertussis
cgcccgacggcgcgccc

SEQ ID NO: 305052 - RNA, 24 nt, Bordetella pertussis
cgcccgacgguaucucagcgcgcc

SEQ ID NO: 305053 - RNA, 15 nt, Bordetella pertussis
cgcccgagauggcgc

SEQ ID NO: 305054 - RNA, 18 nt, Bordetella pertussis
cgcccgagauggcgcagg

SEQ ID NO: 305055 - RNA, 23 nt, Bordetella pertussis
cgcccgagauggcgcaggcgcgc

SEQ ID NO: 305056 - RNA, 13 nt, Bordetella pertussis
cgcccgagcuggc

SEQ ID NO: 305057 - RNA, 19 nt, Bordetella pertussis
cgcccgagcuggccggcga

SEQ ID NO: 305058 - RNA, 14 nt, Bordetella pertussis
cgcccgaggcgcgc

SEQ ID NO: 305059 - RNA, 15 nt, Bordetella pertussis
cgcccgaucggccgg

SEQ ID NO: 305060 - RNA, 17 nt, Bordetella pertussis
cgcccgaucggccggcc

SEQ ID NO: 305061 - RNA, 17 nt, Bordetella pertussis
cgcccgaugcucgccgg

SEQ ID NO: 305062 - RNA, 21 nt, Bordetella pertussis
cgcccgaugcucgccggcgcc

SEQ ID NO: 305063 - RNA, 18 nt, Bordetella pertussis
cgcccgcaacgggccggc

SEQ ID NO: 305064 - RNA, 22 nt, Bordetella pertussis
cgcccgcaacgggccggccgcc

SEQ ID NO: 305065 - RNA, 13 nt, Bordetella pertussis
cgcccgaugccga

SEQ ID NO: 305066 - RNA, 15 nt, Bordetella pertussis
cgcccgcacgaugcc

SEQ ID NO: 305067 - RNA, 18 nt, Bordetella pertussis
cgcccgcacgaugccgac

SEQ ID NO: 305068 - RNA, 13 nt, Bordetella pertussis
cgcccgcaucggc

SEQ ID NO: 305069 - RNA, 22 nt, Bordetella pertussis
cgcccgcauggaccgccgccgu

SEQ ID NO: 305070 - RNA, 15 nt, Bordetella pertussis
cgcccgccaccagga

SEQ ID NO: 305071 - RNA, 17 nt, Bordetella pertussis
cgcccgccaccaggaac

SEQ ID NO: 305072 - RNA, 18 nt, Bordetella pertussis
cgcccgccaccaggaacg

SEQ ID NO: 305073 - RNA, 21 nt, Bordetella pertussis
cgcccgccagcagcucggcga

SEQ ID NO: 305074 - RNA, 23 nt, Bordetella pertussis
cgcccgccagcagcucggcgacc

SEQ ID NO: 305075 - RNA, 12 nt, Bordetella pertussis
cgcccgccaggc

SEQ ID NO: 305076 - RNA, 13 nt, Bordetella pertussis
cgcccgccaggcc

SEQ ID NO: 305077 - RNA, 14 nt, Bordetella pertussis
cgcccgccaggcca

SEQ ID NO: 305078 - RNA, 18 nt, Bordetella pertussis
cgcccgccaggccaggua

SEQ ID NO: 305079 - RNA, 19 nt, Bordetella pertussis
cgcccgccaugcacgggcc

SEQ ID NO: 305080 - RNA, 15 nt, Bordetella pertussis
cgcccgccccggcgc

SEQ ID NO: 305081 - RNA, 16 nt, Bordetella pertussis
cgcccgcccgcugacc

SEQ ID NO: 305082 - RNA, 15 nt, Bordetella pertussis
cgcccgcccugggca

SEQ ID NO: 305083 - RNA, 18 nt, Bordetella pertussis
cgcccgcccugggcagca

SEQ ID NO: 305084 - RNA, 14 nt, Bordetella pertussis
cgcccgccgacgaa

SEQ ID NO: 305085 - RNA, 14 nt, Bordetella pertussis
cgcccgccgccggg

SEQ ID NO: 305086 - RNA, 15 nt, Bordetella pertussis
cgcccgccgccgggc

SEQ ID NO: 305087 - RNA, 19 nt, Bordetella pertussis
cgcccgccgccgggcgcgc

SEQ ID NO: 305088 - RNA, 14 nt, Bordetella pertussis
cgcccgccgcgcca

SEQ ID NO: 305089 - RNA, 21 nt, Bordetella pertussis
cgcccgccgcgucggcgccga

SEQ ID NO: 305090 - RNA, 14 nt, Bordetella pertussis
cgcccgccguggcc

SEQ ID NO: 305091 - RNA, 16 nt, Bordetella pertussis
cgcccgccucaggccg

SEQ ID NO: 305092 - RNA, 16 nt, Bordetella pertussis
cgcccgccugccggcc

SEQ ID NO: 305093 - RNA, 17 nt, Bordetella pertussis
cgcccgccugcgccagc

SEQ ID NO: 305094 - RNA, 18 nt, Bordetella pertussis
cgcccgccugcgccagcc

SEQ ID NO: 305095 - RNA, 15 nt, Bordetella pertussis
cgcccgccugcgugg

SEQ ID NO: 305096 - RNA, 21 nt, Bordetella pertussis
cgcccgccugcguggcgggcc

SEQ ID NO: 305097 - RNA, 20 nt, Bordetella pertussis
cgcccgccuucggcggcggg

SEQ ID NO: 305098 - RNA, 21 nt, Bordetella pertussis
cgcccgccuucuugaacagcu

SEQ ID NO: 305099 - RNA, 16 nt, Bordetella pertussis
cgcccgcgagcggcca

SEQ ID NO: 305100 - RNA, 18 nt, Bordetella pertussis
cgcccgcgagcggccagc

SEQ ID NO: 305101 - RNA, 21 nt, Bordetella pertussis
cgcccgcgagcggccagccug

SEQ ID NO: 305102 - RNA, 12 nt, Bordetella pertussis
cgcccgcgccga

SEQ ID NO: 305103 - RNA, 15 nt, Bordetella pertussis
cgcccgcgcccagcu

SEQ ID NO: 305104 - RNA, 14 nt, Bordetella pertussis
cgcccgcgcccagu

SEQ ID NO: 305105 - RNA, 13 nt, Bordetella pertussis
cgcccgcgcgcga

SEQ ID NO: 305106 - RNA, 17 nt, Bordetella pertussis
cgcccgcgcgcgagcug

SEQ ID NO: 305107 - RNA, 22 nt, Bordetella pertussis
cgcccgcgcgguauugcgccac

SEQ ID NO: 305108 - RNA, 21 nt, Bordetella pertussis
cgcccgcggccagccacgccg

SEQ ID NO: 305109 - RNA, 12 nt, Bordetella pertussis
cgcccgcggccu

SEQ ID NO: 305110 - RNA, 13 nt, Bordetella pertussis
cgcccgcggcgcc

SEQ ID NO: 305111 - RNA, 14 nt, Bordetella pertussis
cgcccgcggcggcc

SEQ ID NO: 305112 - RNA, 17 nt, Bordetella pertussis
cgcccgcggcggcccgg

SEQ ID NO: 305113 - RNA, 22 nt, Bordetella pertussis
cgcccgcgggugauauuggcga

SEQ ID NO: 305114 - RNA, 17 nt, Bordetella pertussis
cgcccgcguacagcccg

SEQ ID NO: 305115 - RNA, 19 nt, Bordetella pertussis
cgcccgcgugcgugccgac

SEQ ID NO: 305116 - RNA, 16 nt, Bordetella pertussis
cgcccgcugaccggcc

SEQ ID NO: 305117 - RNA, 19 nt, Bordetella pertussis
cgcccgcugaccggccugg

SEQ ID NO: 305118 - RNA, 16 nt, Bordetella pertussis
cgcccgcuuccuuggg

SEQ ID NO: 305119 - RNA, 18 nt, Bordetella pertussis
cgcccgcuugcggccggc

SEQ ID NO: 305120 - RNA, 15 nt, Bordetella pertussis
cgcccgcuugggccg

SEQ ID NO: 305121 - RNA, 17 nt, Bordetella pertussis
cgcccggaugggcggcc

SEQ ID NO: 305122 - RNA, 15 nt, Bordetella pertussis
cgcccggcaugggcg

SEQ ID NO: 305123 - RNA, 12 nt, Bordetella pertussis
cgcccggccggc

SEQ ID NO: 305124 - RNA, 13 nt, Bordetella pertussis
cgcccggccggca

SEQ ID NO: 305125 - RNA, 18 nt, Bordetella pertussis
cgcccggccggcacggcc

SEQ ID NO: 305126 - RNA, 20 nt, Bordetella pertussis
cgcccggccggcacggccgg

SEQ ID NO: 305127 - RNA, 14 nt, Bordetella pertussis
cgcccggccggccc

SEQ ID NO: 305128 - RNA, 14 nt, Bordetella pertussis
cgcccggccggccu

SEQ ID NO: 305129 - RNA, 22 nt, Bordetella pertussis
cgcccggccugcgggcgccgcg

SEQ ID NO: 305130 - RNA, 12 nt, Bordetella pertussis
cgcccggccgcc

SEQ ID NO: 305131 - RNA, 11 nt, Bordetella pertussis
cgcccggcgcc

SEQ ID NO: 305132 - RNA, 12 nt, Bordetella pertussis
cgcccggcgcca

SEQ ID NO: 305133 - RNA, 13 nt, Bordetella pertussis
cgcccggcgccau

SEQ ID NO: 305134 - RNA, 15 nt, Bordetella pertussis
cgcccggcgccgcgc

SEQ ID NO: 305135 - RNA, 22 nt, Bordetella pertussis
cgcccggcgcggugaggcggcc

SEQ ID NO: 305136 - RNA, 12 nt, Bordetella pertussis
cgcccggcggcc

SEQ ID NO: 305137 - RNA, 15 nt, Bordetella pertussis
cgcccggcggccagg

SEQ ID NO: 305138 - RNA, 16 nt, Bordetella pertussis
cgcccggcggccaggc

SEQ ID NO: 305139 - RNA, 17 nt, Bordetella pertussis
cgcccggcggccaggcc

SEQ ID NO: 305140 - RNA, 18 nt, Bordetella pertussis
cgcccggcggccaggccg

SEQ ID NO: 305141 - RNA, 17 nt, Bordetella pertussis
cgcccggcggcgcgccg

SEQ ID NO: 305142 - RNA, 19 nt, Bordetella pertussis
cgcccggcggcgcggcgag

SEQ ID NO: 305143 - RNA, 12 nt, Bordetella pertussis
cgcccggcguga

SEQ ID NO: 305144 - RNA, 20 nt, Bordetella pertussis
cgcccggcgugacgcugacc

SEQ ID NO: 305145 - RNA, 15 nt, Bordetella pertussis
cgcccggcuccaggc

SEQ ID NO: 305146 - RNA, 18 nt, Bordetella pertussis
cgcccggcuccaggccgc

SEQ ID NO: 305147 - RNA, 21 nt, Bordetella pertussis
cgcccggcuccaggccgccca

SEQ ID NO: 305148 - RNA, 15 nt, Bordetella pertussis
cgcccggcucgcugu

SEQ ID NO: 305149 - RNA, 15 nt, Bordetella pertussis
cgcccgggccgucua

SEQ ID NO: 305150 - RNA, 21 nt, Bordetella pertussis
cgcccgggccgucuacaggcc

SEQ ID NO: 305151 - RNA, 17 nt, Bordetella pertussis
cgcccgggcgccggcac

SEQ ID NO: 305152 - RNA, 18 nt, Bordetella pertussis
cgcccgggcugauccgca

SEQ ID NO: 305153 - RNA, 20 nt, Bordetella pertussis
cgcccgggcugauccgcacc

SEQ ID NO: 305154 - RNA, 23 nt, Bordetella pertussis
cgcccgggcugauccgcaccggc

SEQ ID NO: 305155 - RNA, 14 nt, Bordetella pertussis
cgcccgggcugccg

SEQ ID NO: 305156 - RNA, 13 nt, Bordetella pertussis
cgcccggggcggc

SEQ ID NO: 305157 - RNA, 18 nt, Bordetella pertussis
cgcccggggcggcgucga

SEQ ID NO: 305158 - RNA, 23 nt, Bordetella pertussis
cgcccgggguugggaucgcgcca

SEQ ID NO: 305159 - RNA, 21 nt, Bordetella pertussis
cgcccggguuggcguccaggc

SEQ ID NO: 305160 - RNA, 22 nt, Bordetella pertussis
cgcccggucugccacacgcggu

SEQ ID NO: 305161 - RNA, 14 nt, Bordetella pertussis
cgcccggugccugc

SEQ ID NO: 305162 - RNA, 19 nt, Bordetella pertussis
cgcccggugcguaccagcc

SEQ ID NO: 305163 - RNA, 16 nt, Bordetella pertussis
cgcccguccacggccu

SEQ ID NO: 305164 - RNA, 21 nt, Bordetella pertussis
cgcccguccacggccugcgcg

SEQ ID NO: 305165 - RNA, 23 nt, Bordetella pertussis
cgcccguccacggccugcgcgcc

SEQ ID NO: 305166 - RNA, 16 nt, Bordetella pertussis
cgcccguccgggcggc

SEQ ID NO: 305167 - RNA, 20 nt, Bordetella pertussis
cgcccguccgggcggcguug

SEQ ID NO: 305168 - RNA, 15 nt, Bordetella pertussis
cgcccgucucgcgcg

SEQ ID NO: 305169 - RNA, 17 nt, Bordetella pertussis
cgcccgucucgcgcgcc

SEQ ID NO: 305170 - RNA, 22 nt, Bordetella pertussis
cgcccgucucgcgcgccaggug

SEQ ID NO: 305171 - RNA, 18 nt, Bordetella pertussis
cgcccgugcagaagcuga

SEQ ID NO: 305172 - RNA, 19 nt, Bordetella pertussis
cgcccgugcgcggcgagcc

SEQ ID NO: 305173 - RNA, 20 nt, Bordetella pertussis
cgcccgugucgccgucggua

SEQ ID NO: 305174 - RNA, 15 nt, Bordetella pertussis
cgcccguugcggcgc

SEQ ID NO: 305175 - RNA, 16 nt, Bordetella pertussis
cgcccguugcggcgcc

SEQ ID NO: 305176 - RNA, 18 nt, Bordetella pertussis
cgcccguugcggcgccuc

SEQ ID NO: 305177 - RNA, 14 nt, Bordetella pertussis
cgcccucgcccccg

SEQ ID NO: 305178 - RNA, 16 nt, Bordetella pertussis
cgcccucgcgccacca

SEQ ID NO: 305179 - RNA, 17 nt, Bordetella pertussis
cgcccucuuucgccgcg

SEQ ID NO: 305180 - RNA, 18 nt, Bordetella pertussis
cgcccucuuucgccgcgc

SEQ ID NO: 305181 - RNA, 18 nt, Bordetella pertussis
cgcccugaacuauggcgc

SEQ ID NO: 305182 - RNA, 20 nt, Bordetella pertussis
cgcccugaacuauggcgcgc

SEQ ID NO: 305183 - RNA, 21 nt, Bordetella pertussis
cgcccugaacuauggcgcgcg

SEQ ID NO: 305184 - RNA, 16 nt, Bordetella pertussis
cgcccucguugacgcc

SEQ ID NO: 305185 - RNA, 17 nt, Bordetella pertussis
cgcccucguugacgccg

SEQ ID NO: 305186 - RNA, 14 nt, Bordetella pertussis
cgcccucuucggcg

SEQ ID NO: 305187 - RNA, 15 nt, Bordetella pertussis
cgcccugacgaccaa

SEQ ID NO: 305188 - RNA, 20 nt, Bordetella pertussis
cgcccugacgccugcgccgg

SEQ ID NO: 305189 - RNA, 15 nt, Bordetella pertussis
cgcccugcacgcgcg

SEQ ID NO: 305190 - RNA, 23 nt, Bordetella pertussis
cgcccugcacgcgcgcgugcagg

SEQ ID NO: 305191 - RNA, 19 nt, Bordetella pertussis
cgcccugcaccgucacgcg

SEQ ID NO: 305192 - RNA, 20 nt, Bordetella pertussis
cgcccugccauucggacacg

SEQ ID NO: 305193 - RNA, 15 nt, Bordetella pertussis
cgcccugcccggcga

SEQ ID NO: 305194 - RNA, 21 nt, Bordetella pertussis
cgcccugcgcguacguggcgc

SEQ ID NO: 305195 - RNA, 14 nt, Bordetella pertussis
cgcccugcucgcgc

SEQ ID NO: 305196 - RNA, 12 nt, Bordetella pertussis
cgcccugcuggc

SEQ ID NO: 305197 - RNA, 14 nt, Bordetella pertussis
cgcccugcuggcgc

SEQ ID NO: 305198 - RNA, 16 nt, Bordetella pertussis
cgcccugcuggcgcag

SEQ ID NO: 305199 - RNA, 14 nt, Bordetella pertussis
cgcccuggcagcug

SEQ ID NO: 305200 - RNA, 18 nt, Bordetella pertussis
cgcccuggauggcggccg

SEQ ID NO: 305201 - RNA, 21 nt, Bordetella pertussis
cgcccuggauggcggccgcca

SEQ ID NO: 305202 - RNA, 18 nt, Bordetella pertussis
cgcccuggcgccgcggcc

SEQ ID NO: 305203 - RNA, 19 nt, Bordetella pertussis
cgcccuggcgcgaggcggc

SEQ ID NO: 305204 - RNA, 22 nt, Bordetella pertussis
cgcccuggcgcgaggcggcgac

SEQ ID NO: 305205 - RNA, 23 nt, Bordetella pertussis
cgcccuggcgcgaggcggcgacg

SEQ ID NO: 305206 - RNA, 15 nt, Bordetella pertussis
cgcccuggcgcggcg

SEQ ID NO: 305207 - RNA, 22 nt, Bordetella pertussis
cgcccuggcguggcgcgcgccg

SEQ ID NO: 305208 - RNA, 12 nt, Bordetella pertussis
cgcccuggccuu

SEQ ID NO: 305209 - RNA, 13 nt, Bordetella pertussis
cgcccuggcgcag

SEQ ID NO: 305210 - RNA, 19 nt, Bordetella pertussis
cgcccuggcgcaggccggc

SEQ ID NO: 305211 - RNA, 23 nt, Bordetella pertussis
cgcccuggcgcaggccggcggcc

SEQ ID NO: 305212 - RNA, 17 nt, Bordetella pertussis
cgcccuggcgcagggca

SEQ ID NO: 305213 - RNA, 15 nt, Bordetella pertussis
cgcccuggccgcgcc

SEQ ID NO: 305214 - RNA, 17 nt, Bordetella pertussis
cgcccuggcuggcggcc

SEQ ID NO: 305215 - RNA, 12 nt, Bordetella pertussis
cgcccugggcag

SEQ ID NO: 305216 - RNA, 14 nt, Bordetella pertussis
cgcccugggcagca

SEQ ID NO: 305217 - RNA, 22 nt, Bordetella pertussis
cgcccuggucaucgccaugcug

SEQ ID NO: 305218 - RNA, 18 nt, Bordetella pertussis
cgcccuugagcacggcgc

SEQ ID NO: 305219 - RNA, 21 nt, Bordetella pertussis
cgcccuugagcacggcgcggc

SEQ ID NO: 305220 - RNA, 22 nt, Bordetella pertussis
cgcccuugagcacggcgcggcu

SEQ ID NO: 305221 - RNA, 14 nt, Bordetella pertussis
cgcccuugaugccg

SEQ ID NO: 305222 - RNA, 18 nt, Bordetella pertussis
cgcccuugaugccgucgg

SEQ ID NO: 305223 - RNA, 20 nt, Bordetella pertussis
cgcccuugauggccucggcg

SEQ ID NO: 305224 - RNA, 16 nt, Bordetella pertussis
cgcccuugccagggcc

SEQ ID NO: 305225 - RNA, 13 nt, Bordetella pertussis
cgcccuugcggcg

SEQ ID NO: 305226 - RNA, 15 nt, Bordetella pertussis
cgcccuugcggcgag

SEQ ID NO: 305227 - RNA, 19 nt, Bordetella pertussis
cgcccuugggcucgucgac

SEQ ID NO: 305228 - RNA, 18 nt, Bordetella pertussis
cgcccuuugcauugcggc

SEQ ID NO: 305229 - RNA, 20 nt, Bordetella pertussis
cgccgaacaagguccaggcc

SEQ ID NO: 305230 - RNA, 13 nt, Bordetella pertussis
cgccgaacaccag

SEQ ID NO: 305231 - RNA, 18 nt, Bordetella pertussis
cgccgaacgacuuggcgc

SEQ ID NO: 305232 - RNA, 22 nt, Bordetella pertussis
cgccgaacaggguauugacccc

SEQ ID NO: 305233 - RNA, 18 nt, Bordetella pertussis
cgccgaaccagcgcacca

SEQ ID NO: 305234 - RNA, 15 nt, Bordetella pertussis
cgccgaacgcgcagc

SEQ ID NO: 305235 - RNA, 18 nt, Bordetella pertussis
cgccgaacgcgcagcgaa

SEQ ID NO: 305236 - RNA, 18 nt, Bordetella pertussis
cgccgaacggcagcagcg

SEQ ID NO: 305237 - RNA, 23 nt, Bordetella pertussis
cgccgaacggcagcagcgcgccg

SEQ ID NO: 305238 - RNA, 15 nt, Bordetella pertussis
cgccgaacugccggc

SEQ ID NO: 305239 - RNA, 18 nt, Bordetella pertussis
cgccgaacugccggcgcg

SEQ ID NO: 305240 - RNA, 19 nt, Bordetella pertussis
cgccgaagcaaugcagcgc

SEQ ID NO: 305241 - RNA, 21 nt, Bordetella pertussis
cgccgaagccgccgccgucaa

SEQ ID NO: 305242 - RNA, 19 nt, Bordetella pertussis
cgccgaagcgcaggccuuc

SEQ ID NO: 305243 - RNA, 22 nt, Bordetella pertussis
cgccgaaggcggcgccggugac

SEQ ID NO: 305244 - RNA, 14 nt, Bordetella pertussis
cgccgaagggcagg

SEQ ID NO: 305245 - RNA, 22 nt, Bordetella pertussis
cgccgaaguaguuggucgagcg

SEQ ID NO: 305246 - RNA, 15 nt, Bordetella pertussis
cgccgaaguggcuca

SEQ ID NO: 305247 - RNA, 20 nt, Bordetella pertussis
cgccgaaguugcggccgugc

SEQ ID NO: 305248 - RNA, 15 nt, Bordetella pertussis
cgccgacaacggcgu

SEQ ID NO: 305249 - RNA, 17 nt, Bordetella pertussis
cgccgacaacggcgugc

SEQ ID NO: 305250 - RNA, 20 nt, Bordetella pertussis
cgccgacaacggcgugcugc

SEQ ID NO: 305251 - RNA, 17 nt, Bordetella pertussis
cgccgacaggaaggcga

SEQ ID NO: 305252 - RNA, 19 nt, Bordetella pertussis
cgccgacagguaggcgccg

SEQ ID NO: 305253 - RNA, 24 nt, Bordetella pertussis
cgccgacagguaggcgccggucca

SEQ ID NO: 305254 - RNA, 21 nt, Bordetella pertussis
cgccgaccaccugcaccgccg

SEQ ID NO: 305255 - RNA, 14 nt, Bordetella pertussis
cgccgaccacgcug

SEQ ID NO: 305256 - RNA, 19 nt, Bordetella pertussis
cgccgaccacgcugggcca

SEQ ID NO: 305257 - RNA, 15 nt, Bordetella pertussis
cgccgaccagcucga

SEQ ID NO: 305258 - RNA, 20 nt, Bordetella pertussis
cgccgaccagcucgacgcca

SEQ ID NO: 305259 - RNA, 22 nt, Bordetella pertussis
cgccgaccagguaucgacccag

SEQ ID NO: 305260 - RNA, 14 nt, Bordetella pertussis
cgccgacccgggcg

SEQ ID NO: 305261 - RNA, 16 nt, Bordetella pertussis
cgccgacccugcccgg

SEQ ID NO: 305262 - RNA, 21 nt, Bordetella pertussis
cgccgaccgcacgauggcgcg

SEQ ID NO: 305263 - RNA, 22 nt, Bordetella pertussis
cgccgaccgcacgauggcgcgc

SEQ ID NO: 305264 - RNA, 20 nt, Bordetella pertussis
cgccgaccggccccaccugg

SEQ ID NO: 305265 - RNA, 19 nt, Bordetella pertussis
cgccgaccgggccgaccag

SEQ ID NO: 305266 - RNA, 22 nt, Bordetella pertussis
cgccgaccgggccgaccaggcc

SEQ ID NO: 305267 - RNA, 17 nt, Bordetella pertussis
cgccgaccucgucgggc

SEQ ID NO: 305268 - RNA, 23 nt, Bordetella pertussis
cgccgaccucuucguugucgcgc

SEQ ID NO: 305269 - RNA, 14 nt, Bordetella pertussis
cgccgaccuggcgc

SEQ ID NO: 305270 - RNA, 18 nt, Bordetella pertussis
cgccgacgaaaugccggc

SEQ ID NO: 305271 - RNA, 21 nt, Bordetella pertussis
cgccgacgaaagcggcaaagc

SEQ ID NO: 305272 - RNA, 15 nt, Bordetella pertussis
cgccgacgaccgaac

SEQ ID NO: 305273 - RNA, 23 nt, Bordetella pertussis
cgccgacgaccgaaccgauccag

SEQ ID NO: 305274 - RNA, 13 nt, Bordetella pertussis
cgccgacgaugcc

SEQ ID NO: 305275 - RNA, 13 nt, Bordetella pertussis
cgccgacgcgccg

SEQ ID NO: 305276 - RNA, 18 nt, Bordetella pertussis
cgccgacgcgccgggcca

SEQ ID NO: 305277 - RNA, 15 nt, Bordetella pertussis
cgccgacgcgcuggc

SEQ ID NO: 305278 - RNA, 14 nt, Bordetella pertussis
cgccgacggcaugg

SEQ ID NO: 305279 - RNA, 16 nt, Bordetella pertussis
cgccgacggcauggcc

SEQ ID NO: 305280 - RNA, 19 nt, Bordetella pertussis
cgccgacggcauggccggc

SEQ ID NO: 305281 - RNA, 12 nt, Bordetella pertussis
cgccgacggcgc

SEQ ID NO: 305282 - RNA, 18 nt, Bordetella pertussis
cgccgacggcgcccugca

SEQ ID NO: 305283 - RNA, 17 nt, Bordetella pertussis
cgccgacggcggcgcgg

SEQ ID NO: 305284 - RNA, 13 nt, Bordetella pertussis
cgccgacgggccg

SEQ ID NO: 305285 - RNA, 15 nt, Bordetella pertussis
cgccgacgggccggu

SEQ ID NO: 305286 - RNA, 18 nt, Bordetella pertussis
cgccgacguagucgcgcc

SEQ ID NO: 305287 - RNA, 19 nt, Bordetella pertussis
cgccgacguagucgcgcca

SEQ ID NO: 305288 - RNA, 13 nt, Bordetella pertussis
cgccgagccgcug

SEQ ID NO: 305289 - RNA, 14 nt, Bordetella pertussis
cgccgagcgccagu

SEQ ID NO: 305290 - RNA, 19 nt, Bordetella pertussis
cgccgagcggcaucugcag

SEQ ID NO: 305291 - RNA, 14 nt, Bordetella pertussis
cgccgagcggggcc

SEQ ID NO: 305292 - RNA, 18 nt, Bordetella pertussis
cgccgagcggggccgcgc

SEQ ID NO: 305293 - RNA, 22 nt, Bordetella pertussis
cgccgagcggggccgcgccggc

SEQ ID NO: 305294 - RNA, 21 nt, Bordetella pertussis
cgccgaggaucuggccggcgc

SEQ ID NO: 305295 - RNA, 14 nt, Bordetella pertussis
cgccgagucggcga

SEQ ID NO: 305296 - RNA, 20 nt, Bordetella pertussis
cgccgagucggcgauggcgc

SEQ ID NO: 305297 - RNA, 21 nt, Bordetella pertussis
cgccgagucggcgauggcgcg

SEQ ID NO: 305298 - RNA, 22 nt, Bordetella pertussis
cgccgagucggcgauggcgcgc

SEQ ID NO: 305299 - RNA, 14 nt, Bordetella pertussis
cgccgauccggcgc

SEQ ID NO: 305300 - RNA, 21 nt, Bordetella pertussis
cgccgaucgagcaggccgccg

SEQ ID NO: 305301 - RNA, 13 nt, Bordetella pertussis
cgccgaucgcggc

SEQ ID NO: 305302 - RNA, 21 nt, Bordetella pertussis
cgccgaucggcuugccgcgcg

SEQ ID NO: 305303 - RNA, 14 nt, Bordetella pertussis
cgccgaugaccagg

SEQ ID NO: 305304 - RNA, 20 nt, Bordetella pertussis
cgccgaugaccagggcgccg

SEQ ID NO: 305305 - RNA, 14 nt, Bordetella pertussis
cgccgaugccgcca

SEQ ID NO: 305306 - RNA, 13 nt, Bordetella pertussis
cgccgaugccgcc

SEQ ID NO: 305307 - RNA, 18 nt, Bordetella pertussis
cgccgaugcgcucggucc

SEQ ID NO: 305308 - RNA, 20 nt, Bordetella pertussis
cgccgaugcggguacuggcc

SEQ ID NO: 305309 - RNA, 21 nt, Bordetella pertussis
cgccgaugcggguacuggccg

SEQ ID NO: 305310 - RNA, 12 nt, Bordetella pertussis
cgccgauggcgc

SEQ ID NO: 305311 - RNA, 14 nt, Bordetella pertussis
cgccgauggcgcca

SEQ ID NO: 305312 - RNA, 14 nt, Bordetella pertussis
cgccgauggcgccg

SEQ ID NO: 305313 - RNA, 13 nt, Bordetella pertussis
cgccgauggcgcg

SEQ ID NO: 305314 - RNA, 15 nt, Bordetella pertussis
cgccgauggcgcgcg

SEQ ID NO: 305315 - RNA, 17 nt, Bordetella pertussis
cgccgauggcgcgcggc

SEQ ID NO: 305316 - RNA, 18 nt, Bordetella pertussis
cgccgauggcgcgcggcu

SEQ ID NO: 305317 - RNA, 19 nt, Bordetella pertussis
cgccgauggcgcgcggcug

SEQ ID NO: 305318 - RNA, 15 nt, Bordetella pertussis
cgccgauggcgcggc

SEQ ID NO: 305319 - RNA, 17 nt, Bordetella pertussis
cgccgauggcgcggccg

SEQ ID NO: 305320 - RNA, 15 nt, Bordetella pertussis
cgccgccgcccuggc

SEQ ID NO: 305321 - RNA, 12 nt, Bordetella pertussis
cgccgccgccgg

SEQ ID NO: 305322 - RNA, 12 nt, Bordetella pertussis
cgccgccgcgca

SEQ ID NO: 305323 - RNA, 14 nt, Bordetella pertussis
cgccgccgcgcacc

SEQ ID NO: 305324 - RNA, 15 nt, Bordetella pertussis
cgccgccgcgcacca

SEQ ID NO: 305325 - RNA, 16 nt, Bordetella pertussis
cgccgccgcgcaccac

SEQ ID NO: 305326 - RNA, 13 nt, Bordetella pertussis
cgccgccgcgccg

SEQ ID NO: 305327 - RNA, 17 nt, Bordetella pertussis
cgccgccgcgccgaacg

SEQ ID NO: 305328 - RNA, 14 nt, Bordetella pertussis
cgccgccgcgccgc

SEQ ID NO: 305329 - RNA, 14 nt, Bordetella pertussis
cgccgccgcgcgcg

SEQ ID NO: 305330 - RNA, 15 nt, Bordetella pertussis
cgccgccgcgcgcug

SEQ ID NO: 305331 - RNA, 14 nt, Bordetella pertussis
cgccgccgcgcugu

SEQ ID NO: 305332 - RNA, 21 nt, Bordetella pertussis
cgccgccgcgcugugcgacga

SEQ ID NO: 305333 - RNA, 14 nt, Bordetella pertussis
cgccgccgcggccu

SEQ ID NO: 305334 - RNA, 16 nt, Bordetella pertussis
cgccgccgcggccugg

SEQ ID NO: 305335 - RNA, 17 nt, Bordetella pertussis
cgccgccgcggccuggc

SEQ ID NO: 305336 - RNA, 12 nt, Bordetella pertussis
cgccgccgggcc

SEQ ID NO: 305337 - RNA, 14 nt, Bordetella pertussis
cgccgccgggccug

SEQ ID NO: 305338 - RNA, 16 nt, Bordetella pertussis
cgccgccgggccugcc

SEQ ID NO: 305339 - RNA, 14 nt, Bordetella pertussis
cgccgccgggcugg

SEQ ID NO: 305340 - RNA, 22 nt, Bordetella pertussis
cgccgccggguuucucgacgca

SEQ ID NO: 305341 - RNA, 21 nt, Bordetella pertussis
cgccgccggugcaccaggcca

SEQ ID NO: 305342 - RNA, 18 nt, Bordetella pertussis
cgccgccguagccgcugc

SEQ ID NO: 305343 - RNA, 22 nt, Bordetella pertussis
cgccgccguagccgcugcgcgc

SEQ ID NO: 305344 - RNA, 21 nt, Bordetella pertussis
cgccgccguaggacagcccca

SEQ ID NO: 305345 - RNA, 16 nt, Bordetella pertussis
cgccgccgucaacgcc

SEQ ID NO: 305346 - RNA, 14 nt, Bordetella pertussis
cgccgccgugcgcg

SEQ ID NO: 305347 - RNA, 22 nt, Bordetella pertussis
cgccgccgugcgcgggcgcggc

SEQ ID NO: 305348 - RNA, 20 nt, Bordetella pertussis
cgccgccguuuucgcccgcc

SEQ ID NO: 305349 - RNA, 18 nt, Bordetella pertussis
cgccgccucagcccgcgu

SEQ ID NO: 305350 - RNA, 20 nt, Bordetella pertussis
cgccgccucaggccggcgcc

SEQ ID NO: 305351 - RNA, 21 nt, Bordetella pertussis
cgccgccucgauugaccagca

SEQ ID NO: 305352 - RNA, 16 nt, Bordetella pertussis
cgccgccucgcgcucc

SEQ ID NO: 305353 - RNA, 20 nt, Bordetella pertussis
cgccgccucgggcacggcca

SEQ ID NO: 305354 - RNA, 22 nt, Bordetella pertussis
cgccgccucgggcacggccagc

SEQ ID NO: 305355 - RNA, 14 nt, Bordetella pertussis
cgccgcgauggcgc

SEQ ID NO: 305356 - RNA, 15 nt, Bordetella pertussis
cgccgcgauggcgcc

SEQ ID NO: 305357 - RNA, 20 nt, Bordetella pertussis
cgccgcgauggcgccggcca

SEQ ID NO: 305358 - RNA, 22 nt, Bordetella pertussis
cgccgcgauggcgccggccagc

SEQ ID NO: 305359 - RNA, 17 nt, Bordetella pertussis
cgccgcgauugcaggug

SEQ ID NO: 305360 - RNA, 22 nt, Bordetella pertussis
cgccgcgauugcagguggccag

SEQ ID NO: 305361 - RNA, 14 nt, Bordetella pertussis
cgccgcgcacagcc

SEQ ID NO: 305362 - RNA, 14 nt, Bordetella pertussis
cgccgcgcacgaug

SEQ ID NO: 305363 - RNA, 13 nt, Bordetella pertussis
cgccgcgcacgca

SEQ ID NO: 305364 - RNA, 15 nt, Bordetella pertussis
cgccgcgcacgggcg

SEQ ID NO: 305365 - RNA, 17 nt, Bordetella pertussis
cgccgcgcacgggcgcc

SEQ ID NO: 305366 - RNA, 21 nt, Bordetella pertussis
cgccgcgcacgggcgccuguc

SEQ ID NO: 305367 - RNA, 21 nt, Bordetella pertussis
cgccgcgcagaaaccgccaca

SEQ ID NO: 305368 - RNA, 22 nt, Bordetella pertussis
cgccgcgcagccgacaggcgcg

SEQ ID NO: 305369 - RNA, 14 nt, Bordetella pertussis
cgccgcgcccagca

SEQ ID NO: 305370 - RNA, 15 nt, Bordetella pertussis
cgccgcgcccagcag

SEQ ID NO: 305371 - RNA, 13 nt, Bordetella pertussis
cgccgcgcccgcc

SEQ ID NO: 305372 - RNA, 20 nt, Bordetella pertussis
cgccgcgcccagcagcgcca

SEQ ID NO: 305373 - RNA, 15 nt, Bordetella pertussis
cgccgcgcccagccg

SEQ ID NO: 305374 - RNA, 13 nt, Bordetella pertussis
cgccgcgcccggc

SEQ ID NO: 305375 - RNA, 15 nt, Bordetella pertussis
cgccgcgcccggccg

SEQ ID NO: 305376 - RNA, 16 nt, Bordetella pertussis
cgccgcgcccggccgg

SEQ ID NO: 305377 - RNA, 17 nt, Bordetella pertussis
cgccgcgcccggccggc

SEQ ID NO: 305378 - RNA, 16 nt, Bordetella pertussis
cgccgcgcccguccac

SEQ ID NO: 305379 - RNA, 13 nt, Bordetella pertussis
cgccgcgcccugg

SEQ ID NO: 305380 - RNA, 16 nt, Bordetella pertussis
cgccgcgcccuggcgc

SEQ ID NO: 305381 - RNA, 18 nt, Bordetella pertussis
cgccgcgcgcggccccgg

SEQ ID NO: 305382 - RNA, 20 nt, Bordetella pertussis
cgccgcgcgcgucgccgcug

SEQ ID NO: 305383 - RNA, 13 nt, Bordetella pertussis
cgccgcgcgcugg

SEQ ID NO: 305384 - RNA, 11 nt, Bordetella pertussis
cgccgcgcgua

SEQ ID NO: 305385 - RNA, 17 nt, Bordetella pertussis
cgccgcgcgugcugacg

SEQ ID NO: 305386 - RNA, 19 nt, Bordetella pertussis
cgccgcgcucagcaccagg

SEQ ID NO: 305387 - RNA, 18 nt, Bordetella pertussis
cgccgcgcucgcgccagg

SEQ ID NO: 305388 - RNA, 18 nt, Bordetella pertussis
cgccgcgcugauccuggc

SEQ ID NO: 305389 - RNA, 12 nt, Bordetella pertussis
cgccgcggccgg

SEQ ID NO: 305390 - RNA, 13 nt, Bordetella pertussis
cgccgcggccggc

SEQ ID NO: 305391 - RNA, 16 nt, Bordetella pertussis
cgccgcggccggcgca

SEQ ID NO: 305392 - RNA, 15 nt, Bordetella pertussis
cgccgcggccggcgg

SEQ ID NO: 305393 - RNA, 13 nt, Bordetella pertussis
cgccgcggccugg

SEQ ID NO: 305394 - RNA, 14 nt, Bordetella pertussis
cgccgcggccuguc

SEQ ID NO: 305395 - RNA, 14 nt, Bordetella pertussis
cgccgcggccggcg

SEQ ID NO: 305396 - RNA, 18 nt, Bordetella pertussis
cgccgcggcgaugccggc

SEQ ID NO: 305397 - RNA, 20 nt, Bordetella pertussis
cgccgcggcgaugccggcca

SEQ ID NO: 305398 - RNA, 14 nt, Bordetella pertussis
cgccgcggcgcugg

SEQ ID NO: 305399 - RNA, 13 nt, Bordetella pertussis
cgccgcggcggcg

SEQ ID NO: 305400 - RNA, 16 nt, Bordetella pertussis
cgccgcggcgggcgau

SEQ ID NO: 305401 - RNA, 23 nt, Bordetella pertussis
cgccgcggcgggcgauugcucga

SEQ ID NO: 305402 - RNA, 14 nt, Bordetella pertussis
cgccgcggcgggcu

SEQ ID NO: 305403 - RNA, 14 nt, Bordetella pertussis
cgccgcggcggcga

SEQ ID NO: 305404 - RNA, 15 nt, Bordetella pertussis
cgccgcggcuugccg

SEQ ID NO: 305405 - RNA, 19 nt, Bordetella pertussis
cgccgcgggauucugcugc

SEQ ID NO: 305406 - RNA, 15 nt, Bordetella pertussis
cgccgcgggcaaagc

SEQ ID NO: 305407 - RNA, 21 nt, Bordetella pertussis
cgccgcgggccuacuugccgg

SEQ ID NO: 305408 - RNA, 15 nt, Bordetella pertussis
cgccgcgggccugcu

SEQ ID NO: 305409 - RNA, 16 nt, Bordetella pertussis
cgccgcgggcgaagca

SEQ ID NO: 305410 - RNA, 15 nt, Bordetella pertussis
cgccgcgggcgccgc

SEQ ID NO: 305411 - RNA, 17 nt, Bordetella pertussis
cgccgcgggcgccgcgc

SEQ ID NO: 305412 - RNA, 21 nt, Bordetella pertussis
cgccgcgggcggccacgcgcc

SEQ ID NO: 305413 - RNA, 19 nt, Bordetella pertussis
cgccgcggggguggacgcc

SEQ ID NO: 305414 - RNA, 20 nt, Bordetella pertussis
cgccgcggggguggacgcca

SEQ ID NO: 305415 - RNA, 14 nt, Bordetella pertussis
cgccgcggugcugg

SEQ ID NO: 305416 - RNA, 14 nt, Bordetella pertussis
cgccgcggugaugc

SEQ ID NO: 305417 - RNA, 21 nt, Bordetella pertussis
cgccgcgucauggcgugcgcg

SEQ ID NO: 305418 - RNA, 18 nt, Bordetella pertussis
cgccgcguccgcccgcuc

SEQ ID NO: 305419 - RNA, 23 nt, Bordetella pertussis
cgccgcguccgcccgcuccacca

SEQ ID NO: 305420 - RNA, 20 nt, Bordetella pertussis
cgccgcguccucggccuggc

SEQ ID NO: 305421 - RNA, 14 nt, Bordetella pertussis
cgccgcgucgagcg

SEQ ID NO: 305422 - RNA, 18 nt, Bordetella pertussis
cgccgcgucgagcgcgac

SEQ ID NO: 305423 - RNA, 19 nt, Bordetella pertussis
cgccgcgucgagcgcgacg

SEQ ID NO: 305424 - RNA, 20 nt, Bordetella pertussis
cgccgcguccggcgcccgcc

SEQ ID NO: 305425 - RNA, 23 nt, Bordetella pertussis
cgccgcgucgcuggccggacgca

SEQ ID NO: 305426 - RNA, 21 nt, Bordetella pertussis
cgccgcgucggcgccgaucag

SEQ ID NO: 305427 - RNA, 17 nt, Bordetella pertussis
cgccgcgucgguggcca

SEQ ID NO: 305428 - RNA, 18 nt, Bordetella pertussis
cgccgcgucgguggccag

SEQ ID NO: 305429 - RNA, 20 nt, Bordetella pertussis
cgccgcgucgguggccagcc

SEQ ID NO: 305430 - RNA, 21 nt, Bordetella pertussis
cgccgcgucgguggccagcca

SEQ ID NO: 305431 - RNA, 21 nt, Bordetella pertussis
cgccgcgucuucggcgcggcg

SEQ ID NO: 305432 - RNA, 14 nt, Bordetella pertussis
cgccgcguggcggc

SEQ ID NO: 305433 - RNA, 20 nt, Bordetella pertussis
cgccgcguggcggcgcagcg

SEQ ID NO: 305434 - RNA, 21 nt, Bordetella pertussis
cgccgcguggcggcgcagcgc

SEQ ID NO: 305435 - RNA, 23 nt, Bordetella pertussis
cgccgcguggcggcgcagcgccc

SEQ ID NO: 305436 - RNA, 15 nt, Bordetella pertussis
cgccgcgugguggcg

SEQ ID NO: 305437 - RNA, 17 nt, Bordetella pertussis
cgccgcgugguggcgca

SEQ ID NO: 305438 - RNA, 18 nt, Bordetella pertussis
cgccgcgugguggcgcag

SEQ ID NO: 305439 - RNA, 19 nt, Bordetella pertussis
cgccgcgugguggcgcaga

SEQ ID NO: 305440 - RNA, 16 nt, Bordetella pertussis
cgccgcguucacgccg

SEQ ID NO: 305441 - RNA, 20 nt, Bordetella pertussis
cgccgcguucacgccggcgc

SEQ ID NO: 305442 - RNA, 22 nt, Bordetella pertussis
cgccgcguucacgccggcgcgc

SEQ ID NO: 305443 - RNA, 16 nt, Bordetella pertussis
cgccgcguugcagcca

SEQ ID NO: 305444 - RNA, 19 nt, Bordetella pertussis
cgccgcguugcagccacag

SEQ ID NO: 305445 - RNA, 12 nt, Bordetella pertussis
cgccgcugucga

SEQ ID NO: 305446 - RNA, 16 nt, Bordetella pertussis
cgccgcugucgaccuc

SEQ ID NO: 305447 - RNA, 17 nt, Bordetella pertussis
cgccgcugucgaccucg

SEQ ID NO: 305448 - RNA, 21 nt, Bordetella pertussis
cgccgcugucggucagcacuu

SEQ ID NO: 305449 - RNA, 16 nt, Bordetella pertussis
cgccgcuguggacgcc

SEQ ID NO: 305450 - RNA, 21 nt, Bordetella pertussis
cgccgcuguggacgccgccgg

SEQ ID NO: 305451 - RNA, 20 nt, Bordetella pertussis
cgccgcuguugcccaccagc

SEQ ID NO: 305452 - RNA, 15 nt, Bordetella pertussis
cgccgcuuccggcau

SEQ ID NO: 305453 - RNA, 21 nt, Bordetella pertussis
cgccgcuuccggcaugaccgc

SEQ ID NO: 305454 - RNA, 22 nt, Bordetella pertussis
cgccgcuuccggcaugaccgcg

SEQ ID NO: 305455 - RNA, 15 nt, Bordetella pertussis
cgccgcuuccggccg

SEQ ID NO: 305456 - RNA, 22 nt, Bordetella pertussis
cgccgcuuucagcacauccgac

SEQ ID NO: 305457 - RNA, 21 nt, Bordetella pertussis
cgccgcuugcguucaugccgg

SEQ ID NO: 305458 - RNA, 13 nt, Bordetella pertussis
cgccggacggcgc

SEQ ID NO: 305459 - RNA, 19 nt, Bordetella pertussis
cgccggacguagucgcacg

SEQ ID NO: 305460 - RNA, 22 nt, Bordetella pertussis
cgccggacguagucgcacgcgg

SEQ ID NO: 305461 - RNA, 23 nt, Bordetella pertussis
cgccggacguagucgcacgcggc

SEQ ID NO: 305462 - RNA, 13 nt, Bordetella pertussis
cgccggacugggc

SEQ ID NO: 305463 - RNA, 16 nt, Bordetella pertussis
cgccggcaaacccggc

SEQ ID NO: 305464 - RNA, 14 nt, Bordetella pertussis
cgccggcaccagcg

SEQ ID NO: 305465 - RNA, 15 nt, Bordetella pertussis
cgccggcaccagcgc

SEQ ID NO: 305466 - RNA, 18 nt, Bordetella pertussis
cgccggcaccagcgccac

SEQ ID NO: 305467 - RNA, 17 nt, Bordetella pertussis
cgccggcacccggcuca

SEQ ID NO: 305468 - RNA, 20 nt, Bordetella pertussis
cgccggcaugaagcgcagca

SEQ ID NO: 305469 - RNA, 21 nt, Bordetella pertussis
cgccggcaugaagcgcagcag

SEQ ID NO: 305470 - RNA, 17 nt, Bordetella pertussis
cgccggcauguugccgc

SEQ ID NO: 305471 - RNA, 19 nt, Bordetella pertussis
cgccggcauuucgcugggc

SEQ ID NO: 305472 - RNA, 20 nt, Bordetella pertussis
cgccggcauuucgcugggcg

SEQ ID NO: 305473 - RNA, 21 nt, Bordetella pertussis
cgccggcauuucgcugggcgc

SEQ ID NO: 305474 - RNA, 18 nt, Bordetella pertussis
cgccggccaccagcggcg

SEQ ID NO: 305475 - RNA, 14 nt, Bordetella pertussis
cgccggccaccgcc

SEQ ID NO: 305476 - RNA, 14 nt, Bordetella pertussis
cgccggccagccug

SEQ ID NO: 305477 - RNA, 21 nt, Bordetella pertussis
cgccggccagccugugcgcca

SEQ ID NO: 305478 - RNA, 12 nt, Bordetella pertussis
cgccggccagcg

SEQ ID NO: 305479 - RNA, 15 nt, Bordetella pertussis
cgccggccagcgcca

SEQ ID NO: 305480 - RNA, 16 nt, Bordetella pertussis
cgccggccagcgccag

SEQ ID NO: 305481 - RNA, 17 nt, Bordetella pertussis
cgccggccagcgcggca

SEQ ID NO: 305482 - RNA, 23 nt, Bordetella pertussis
cgccggccagcgcggcaucggcc

SEQ ID NO: 305483 - RNA, 12 nt, Bordetella pertussis
cgccggccagcu

SEQ ID NO: 305484 - RNA, 12 nt, Bordetella pertussis
cgccggccagga

SEQ ID NO: 305485 - RNA, 21 nt, Bordetella pertussis
cgccggccaggaugagggcga

SEQ ID NO: 305486 - RNA, 14 nt, Bordetella pertussis
cgccggccaggccc

SEQ ID NO: 305487 - RNA, 12 nt, Bordetella pertussis
cgccggccaggg

SEQ ID NO: 305488 - RNA, 15 nt, Bordetella pertussis
cgccggccagggcca

SEQ ID NO: 305489 - RNA, 22 nt, Bordetella pertussis
cgccggccagggccaccacgcc

SEQ ID NO: 305490 - RNA, 22 nt, Bordetella pertussis
cgccggccagggcgaugcggcg

SEQ ID NO: 305491 - RNA, 11 nt, Bordetella pertussis
cgccggccacc

SEQ ID NO: 305492 - RNA, 21 nt, Bordetella pertussis
cgccggccaggucggcggcca

SEQ ID NO: 305493 - RNA, 16 nt, Bordetella pertussis
cgccggccaucacgcc

SEQ ID NO: 305494 - RNA, 18 nt, Bordetella pertussis
cgccggccaucaggugca

SEQ ID NO: 305495 - RNA, 15 nt, Bordetella pertussis
cgccggcccugccgc

SEQ ID NO: 305496 - RNA, 17 nt, Bordetella pertussis
cgccggccgcgcccagc

SEQ ID NO: 305497 - RNA, 20 nt, Bordetella pertussis
cgccggccgcgcgcgccaug

SEQ ID NO: 305498 - RNA, 14 nt, Bordetella pertussis
cgccggccgccugg

SEQ ID NO: 305499 - RNA, 18 nt, Bordetella pertussis
cgccggccgcggggcugg

SEQ ID NO: 305500 - RNA, 13 nt, Bordetella pertussis
cgccggcgcaacg

SEQ ID NO: 305501 - RNA, 15 nt, Bordetella pertussis
cgccggcgcaugagc

SEQ ID NO: 305502 - RNA, 19 nt, Bordetella pertussis
cgccggcgcaugagccggc

SEQ ID NO: 305503 - RNA, 18 nt, Bordetella pertussis
cgccggcgcccccagcag

SEQ ID NO: 305504 - RNA, 21 nt, Bordetella pertussis
cgccggcgcccccagcagcga

SEQ ID NO: 305505 - RNA, 14 nt, Bordetella pertussis
cgccggcgcccggc

SEQ ID NO: 305506 - RNA, 15 nt, Bordetella pertussis
cgccggcgccggcga

SEQ ID NO: 305507 - RNA, 18 nt, Bordetella pertussis
cgccggcgccggcgacgc

SEQ ID NO: 305508 - RNA, 22 nt, Bordetella pertussis
cgccggcggcaauaucggcacc

SEQ ID NO: 305509 - RNA, 13 nt, Bordetella pertussis
cgccggcggcacc

SEQ ID NO: 305510 - RNA, 15 nt, Bordetella pertussis
cgccggcggcaccgc

SEQ ID NO: 305511 - RNA, 21 nt, Bordetella pertussis
cgccggcggcaccgcgcagcc

SEQ ID NO: 305512 - RNA, 20 nt, Bordetella pertussis
cgccggcggccugcaggccg

SEQ ID NO: 305513 - RNA, 22 nt, Bordetella pertussis
cgccggcggccuggaccugagc

SEQ ID NO: 305514 - RNA, 13 nt, Bordetella pertussis
cgccggcggcgca

SEQ ID NO: 305515 - RNA, 16 nt, Bordetella pertussis
cgccggcggcgccggc

SEQ ID NO: 305516 - RNA, 17 nt, Bordetella pertussis
cgccggcggcgccggcc

SEQ ID NO: 305517 - RNA, 14 nt, Bordetella pertussis
cgccggcggcgcgg

SEQ ID NO: 305518 - RNA, 21 nt, Bordetella pertussis
cgccggcggcgcggaugaucu

SEQ ID NO: 305519 - RNA, 13 nt, Bordetella pertussis
cgccggcggcgcu

SEQ ID NO: 305520 - RNA, 23 nt, Bordetella pertussis
cgccggcggcgugcccugcggcg

SEQ ID NO: 305521 - RNA, 14 nt, Bordetella pertussis
cgccggcggcgugg

SEQ ID NO: 305522 - RNA, 17 nt, Bordetella pertussis
cgccggcggcguggccg

SEQ ID NO: 305523 - RNA, 19 nt, Bordetella pertussis
cgccggcgggcaacuucac

SEQ ID NO: 305524 - RNA, 13 nt, Bordetella pertussis
cgccggcgggcag

SEQ ID NO: 305525 - RNA, 17 nt, Bordetella pertussis
cgccggcgggcaggcgg

SEQ ID NO: 305526 - RNA, 21 nt, Bordetella pertussis
cgccggcgggcaggcgggcca

SEQ ID NO: 305527 - RNA, 22 nt, Bordetella pertussis
cgccggcgggcgcugccugccg

SEQ ID NO: 305528 - RNA, 15 nt, Bordetella pertussis
cgccggcgguaagcg

SEQ ID NO: 305529 - RNA, 22 nt, Bordetella pertussis
cgccggcgguaagcguccgcgc

SEQ ID NO: 305530 - RNA, 15 nt, Bordetella pertussis
cgccggcggucacgc

SEQ ID NO: 305531 - RNA, 23 nt, Bordetella pertussis
cgccggcguagucguugccggcc

SEQ ID NO: 305532 - RNA, 22 nt, Bordetella pertussis
cgccggcguccacggcaucggc

SEQ ID NO: 305533 - RNA, 15 nt, Bordetella pertussis
cgccggcuaccgcgc

SEQ ID NO: 305534 - RNA, 17 nt, Bordetella pertussis
cgccggcuaccgcgcca

SEQ ID NO: 305535 - RNA, 17 nt, Bordetella pertussis
cgccggcucaggccagc

SEQ ID NO: 305536 - RNA, 18 nt, Bordetella pertussis
cgccggcucaggccagcg

SEQ ID NO: 305537 - RNA, 20 nt, Bordetella pertussis
cgccggcucaggccagcgac

SEQ ID NO: 305538 - RNA, 21 nt, Bordetella pertussis
cgccggcucaggccagcgacc

SEQ ID NO: 305539 - RNA, 20 nt, Bordetella pertussis
cgccggcucgaacaggcugg

SEQ ID NO: 305540 - RNA, 16 nt, Bordetella pertussis
cgccggcucguacggc

SEQ ID NO: 305541 - RNA, 20 nt, Bordetella pertussis
cgccggcugaauuggcgccc

SEQ ID NO: 305542 - RNA, 17 nt, Bordetella pertussis
cgccggcuucagccgca

SEQ ID NO: 305543 - RNA, 19 nt, Bordetella pertussis
cgccggcuucagccgcaag

SEQ ID NO: 305544 - RNA, 16 nt, Bordetella pertussis
cgccggcuuccagcag

SEQ ID NO: 305545 - RNA, 21 nt, Bordetella pertussis
cgccggcuucgucauggucga

SEQ ID NO: 305546 - RNA, 19 nt, Bordetella pertussis
cgccggcuugcgccagcca

SEQ ID NO: 305547 - RNA, 20 nt, Bordetella pertussis
cgccggcuugcgccagccac

SEQ ID NO: 305548 - RNA, 21 nt, Bordetella pertussis
cgccgggaaaaagagccuguc

SEQ ID NO: 305549 - RNA, 19 nt, Bordetella pertussis
cgccggcuuucagcgccga

SEQ ID NO: 305550 - RNA, 23 nt, Bordetella pertussis
cgccggcuuucagcgccgagcgc

SEQ ID NO: 305551 - RNA, 23 nt, Bordetella pertussis
cgccgggacacacgcucuugcgc

SEQ ID NO: 305552 - RNA, 19 nt, Bordetella pertussis
cgccgggcagcccgcgcac

SEQ ID NO: 305553 - RNA, 18 nt, Bordetella pertussis
cgccgggcaugcaccagg

SEQ ID NO: 305554 - RNA, 15 nt, Bordetella pertussis
cgccgggccaaggug

SEQ ID NO: 305555 - RNA, 21 nt, Bordetella pertussis
cgccgggccaaggugccuguc

SEQ ID NO: 305556 - RNA, 17 nt, Bordetella pertussis
cgccgggcccggccacg

SEQ ID NO: 305557 - RNA, 22 nt, Bordetella pertussis
cgccgggcccggccacggccgg

SEQ ID NO: 305558 - RNA, 12 nt, Bordetella pertussis
cgccggucgcgg

SEQ ID NO: 305559 - RNA, 13 nt, Bordetella pertussis
cgccggucgcggc

SEQ ID NO: 305560 - RNA, 14 nt, Bordetella pertussis
cgccggucggccgc

SEQ ID NO: 305561 - RNA, 15 nt, Bordetella pertussis
cgccggugaccgcca

SEQ ID NO: 305562 - RNA, 18 nt, Bordetella pertussis
cgccggugaccgccagca

SEQ ID NO: 305563 - RNA, 23 nt, Bordetella pertussis
cgccggugaccgccagcaggcgc

SEQ ID NO: 305564 - RNA, 14 nt, Bordetella pertussis
cgccggucugggcg

SEQ ID NO: 305565 - RNA, 15 nt, Bordetella pertussis
cgccggugcgcggcg

SEQ ID NO: 305566 - RNA, 13 nt, Bordetella pertussis
cgccgguggccag

SEQ ID NO: 305567 - RNA, 15 nt, Bordetella pertussis
cgccgguggugucga

SEQ ID NO: 305568 - RNA, 23 nt, Bordetella pertussis
cgccgguguagcugcccgcgaua

SEQ ID NO: 305569 - RNA, 16 nt, Bordetella pertussis
cgccgguucgacgcug

SEQ ID NO: 305570 - RNA, 21 nt, Bordetella pertussis
cgccgguucggucgacgacgg

SEQ ID NO: 305571 - RNA, 23 nt, Bordetella pertussis
cgccgguucggucgacgacggca

SEQ ID NO: 305572 - RNA, 17 nt, Bordetella pertussis
cgccgucaacgcccagg

SEQ ID NO: 305573 - RNA, 13 nt, Bordetella pertussis
cgccgucagcagc

SEQ ID NO: 305574 - RNA, 15 nt, Bordetella pertussis
cgccgucagcagcgc

SEQ ID NO: 305575 - RNA, 22 nt, Bordetella pertussis
cgccgucagcagcgcggcgccg

SEQ ID NO: 305576 - RNA, 21 nt, Bordetella pertussis
cgccgucaggaucaggccggc

SEQ ID NO: 305577 - RNA, 23 nt, Bordetella pertussis
cgccgucaggaucaggccggcga

SEQ ID NO: 305578 - RNA, 15 nt, Bordetella pertussis
cgccguccgagcccg

SEQ ID NO: 305579 - RNA, 16 nt, Bordetella pertussis
cgccguccgcaucgcg

SEQ ID NO: 305580 - RNA, 22 nt, Bordetella pertussis
cgccguccgugagugcagcgcu

SEQ ID NO: 305581 - RNA, 20 nt, Bordetella pertussis
cgccguccucaggcccgcgg

SEQ ID NO: 305582 - RNA, 22 nt, Bordetella pertussis
cgccguccucaggcccgcggcg

SEQ ID NO: 305583 - RNA, 14 nt, Bordetella pertussis
cgccgucgaacucc

SEQ ID NO: 305584 - RNA, 16 nt, Bordetella pertussis
cgccgucgaagccggc

SEQ ID NO: 305585 - RNA, 12 nt, Bordetella pertussis
cgccgucgaccc

SEQ ID NO: 305586 - RNA, 14 nt, Bordetella pertussis
cgccgucgacgccg

SEQ ID NO: 305587 - RNA, 15 nt, Bordetella pertussis
cgccgucgacgccga

SEQ ID NO: 305588 - RNA, 15 nt, Bordetella pertussis
cgccgucggcauagc

SEQ ID NO: 305589 - RNA, 19 nt, Bordetella pertussis
cgccgucggcauagcaguu

SEQ ID NO: 305590 - RNA, 15 nt, Bordetella pertussis
cgccgucgcuggggc

SEQ ID NO: 305591 - RNA, 16 nt, Bordetella pertussis
cgccgucgcuggggcg

SEQ ID NO: 305592 - RNA, 18 nt, Bordetella pertussis
cgccgucgggggccggcu

SEQ ID NO: 305593 - RNA, 14 nt, Bordetella pertussis
cgccgucggggugg

SEQ ID NO: 305594 - RNA, 16 nt, Bordetella pertussis
cgccgucguugacggg

SEQ ID NO: 305595 - RNA, 20 nt, Bordetella pertussis
cgccgucguugacggggacg

SEQ ID NO: 305596 - RNA, 18 nt, Bordetella pertussis
cgccgucugugcgccccg

SEQ ID NO: 305597 - RNA, 23 nt, Bordetella pertussis
cgccgucugugcgccccgcuggc

SEQ ID NO: 305598 - RNA, 18 nt, Bordetella pertussis
cgccgugaaugcgccugg

SEQ ID NO: 305599 - RNA, 19 nt, Bordetella pertussis
cgccgugaaugcgccuggc

SEQ ID NO: 305600 - RNA, 18 nt, Bordetella pertussis
cgccgugacgcugauggc

SEQ ID NO: 305601 - RNA, 24 nt, Bordetella pertussis
cgccgugacuucggccgccagccg

SEQ ID NO: 305602 - RNA, 21 nt, Bordetella pertussis
cgccgugacguugagcgccgg

SEQ ID NO: 305603 - RNA, 17 nt, Bordetella pertussis
cgccgugaugccgcccg

SEQ ID NO: 305604 - RNA, 17 nt, Bordetella pertussis
cgccgugcagacggcgg

SEQ ID NO: 305605 - RNA, 21 nt, Bordetella pertussis
cgccgugcagacggcggcugg

SEQ ID NO: 305606 - RNA, 15 nt, Bordetella pertussis
cgccgugcagggcca

SEQ ID NO: 305607 - RNA, 19 nt, Bordetella pertussis
cgccgugcccggcgggccg

SEQ ID NO: 305608 - RNA, 14 nt, Bordetella pertussis
cgccgugcccggcg

SEQ ID NO: 305609 - RNA, 16 nt, Bordetella pertussis
cgccgugccgggccug

SEQ ID NO: 305610 - RNA, 23 nt, Bordetella pertussis
cgccgugcgcgggcgcggcaggc

SEQ ID NO: 305611 - RNA, 23 nt, Bordetella pertussis
cgccgugcgguucgucagggccg

SEQ ID NO: 305612 - RNA, 16 nt, Bordetella pertussis
cgccgugcugaucgac

SEQ ID NO: 305613 - RNA, 17 nt, Bordetella pertussis
cgccgugcugaucgaca

SEQ ID NO: 305614 - RNA, 20 nt, Bordetella pertussis
cgccgugcuggaggugccgu

SEQ ID NO: 305615 - RNA, 14 nt, Bordetella pertussis
cgccgugcugggcg

SEQ ID NO: 305616 - RNA, 16 nt, Bordetella pertussis
cgccgugcugggcggc

SEQ ID NO: 305617 - RNA, 18 nt, Bordetella pertussis
cgccgugcugggcggcca

SEQ ID NO: 305618 - RNA, 24 nt, Bordetella pertussis
cgccgugcuguaccucagccugcu

SEQ ID NO: 305619 - RNA, 21 nt, Bordetella pertussis
cgccguggccaagggcgccgc

SEQ ID NO: 305620 - RNA, 14 nt, Bordetella pertussis
cgccguggccggca

SEQ ID NO: 305621 - RNA, 20 nt, Bordetella pertussis
cgccguggcggguccacgug

SEQ ID NO: 305622 - RNA, 23 nt, Bordetella pertussis
cgccguggcguugacggcccagc

SEQ ID NO: 305623 - RNA, 21 nt, Bordetella pertussis
cgccguggcuggucacgucca

SEQ ID NO: 305624 - RNA, 22 nt, Bordetella pertussis
cgccguggcuggucacguccag

SEQ ID NO: 305625 - RNA, 14 nt, Bordetella pertussis
cgccguggugcuga

SEQ ID NO: 305626 - RNA, 18 nt, Bordetella pertussis
cgccguggugcugaccgg

SEQ ID NO: 305627 - RNA, 20 nt, Bordetella pertussis
cgccguggugcugaccggcu

SEQ ID NO: 305628 - RNA, 16 nt, Bordetella pertussis
cgccguguuguccugg

SEQ ID NO: 305629 - RNA, 19 nt, Bordetella pertussis
cgccguguuguccuggaca

SEQ ID NO: 305630 - RNA, 19 nt, Bordetella pertussis
cgccguuccugcagcgugc

SEQ ID NO: 305631 - RNA, 16 nt, Bordetella pertussis
cgccguucgucgcgca

SEQ ID NO: 305632 - RNA, 20 nt, Bordetella pertussis
cgccguucgucgcgcagcag

SEQ ID NO: 305633 - RNA, 23 nt, Bordetella pertussis
cgccguucuggcugcgcgccugg

SEQ ID NO: 305634 - RNA, 21 nt, Bordetella pertussis
cgccguucuucgaucgccugg

SEQ ID NO: 305635 - RNA, 14 nt, Bordetella pertussis
cgccguugcggccc

SEQ ID NO: 305636 - RNA, 18 nt, Bordetella pertussis
cgccguugcggcccgccg

SEQ ID NO: 305637 - RNA, 20 nt, Bordetella pertussis
cgccguugcggcccgccgac

SEQ ID NO: 305638 - RNA, 23 nt, Bordetella pertussis
cgccguugcggcccgccgacugg

SEQ ID NO: 305639 - RNA, 16 nt, Bordetella pertussis
cgccguugcucgcgcg

SEQ ID NO: 305640 - RNA, 19 nt, Bordetella pertussis
cgccguugcucgcgcgcag

SEQ ID NO: 305641 - RNA, 15 nt, Bordetella pertussis
cgccguugucgacga

SEQ ID NO: 305642 - RNA, 19 nt, Bordetella pertussis
cgccguugucgacgaucag

SEQ ID NO: 305643 - RNA, 16 nt, Bordetella pertussis
cgccguuuucagcgca

SEQ ID NO: 305644 - RNA, 14 nt, Bordetella pertussis
cgccuacacggugg

SEQ ID NO: 305645 - RNA, 16 nt, Bordetella pertussis
cgccuacacgguggcg

SEQ ID NO: 305646 - RNA, 17 nt, Bordetella pertussis
cgccuaccaggugggcg

SEQ ID NO: 305647 - RNA, 18 nt, Bordetella pertussis
cgccuaccaggugggcgc

SEQ ID NO: 305648 - RNA, 15 nt, Bordetella pertussis
cgccuaccggcgccg

SEQ ID NO: 305649 - RNA, 11 nt, Bordetella pertussis
aacacgcgcga

SEQ ID NO: 305650 - RNA, 15 nt, Bordetella pertussis
aacacgcgcgacgcc

SEQ ID NO: 305651 - RNA, 23 nt, Bordetella pertussis
aacacgcgcgccgcgggcugcga

SEQ ID NO: 305652 - RNA, 13 nt, Bordetella pertussis
aacacgcggugca

SEQ ID NO: 305653 - RNA, 21 nt, Bordetella pertussis
aacacuuucaucaaacgcggc

SEQ ID NO: 305654 - RNA, 13 nt, Bordetella pertussis
cgccuacuggcgc

SEQ ID NO: 305655 - RNA, 15 nt, Bordetella pertussis
cgccuacuggcgcgc

SEQ ID NO: 305656 - RNA, 14 nt, Bordetella pertussis
cgccuauaucgacg

SEQ ID NO: 305657 - RNA, 16 nt, Bordetella pertussis
cgccuauguaggcgcc

SEQ ID NO: 305658 - RNA, 17 nt, Bordetella pertussis
cgccuauguaggcgccg

SEQ ID NO: 305659 - RNA, 23 nt, Bordetella pertussis
cgccuauguaggcgccgcgcccg

SEQ ID NO: 305660 - RNA, 18 nt, Bordetella pertussis
cgccuauugcgacgccgc

SEQ ID NO: 305661 - RNA, 20 nt, Bordetella pertussis
cgccuauuuccagggcgucg

SEQ ID NO: 305662 - RNA, 22 nt, Bordetella pertussis
cgccuauuuccagggcgucgcg

SEQ ID NO: 305663 - RNA, 20 nt, Bordetella pertussis
cgccucaggccggcgccugg

SEQ ID NO: 305664 - RNA, 20 nt, Bordetella pertussis
cgccucgaguuugcggucca

SEQ ID NO: 305665 - RNA, 19 nt, Bordetella pertussis
cgccucgaugaaggugcgc

SEQ ID NO: 305666 - RNA, 22 nt, Bordetella pertussis
cgccucgaugcccucgcgcacg

SEQ ID NO: 305667 - RNA, 15 nt, Bordetella pertussis
cgccucgaucgccag

SEQ ID NO: 305668 - RNA, 17 nt, Bordetella pertussis
cgccucgauugaccagc

SEQ ID NO: 305669 - RNA, 17 nt, Bordetella pertussis
cgccucgcaucggccug

SEQ ID NO: 305670 - RNA, 14 nt, Bordetella pertussis
cgccucgcgacggc

SEQ ID NO: 305671 - RNA, 23 nt, Bordetella pertussis
cgccucgcgcuccaugggcgugg

SEQ ID NO: 305672 - RNA, 19 nt, Bordetella pertussis
cgccucgcgcucgagcgcg

SEQ ID NO: 305673 - RNA, 22 nt, Bordetella pertussis
cgccucgcgcucgagcgcggcg

SEQ ID NO: 305674 - RNA, 19 nt, Bordetella pertussis
cgccucggacgccuggcgc

SEQ ID NO: 305675 - RNA, 20 nt, Bordetella pertussis
cgccucggacgccuggcgcg

SEQ ID NO: 305676 - RNA, 23 nt, Bordetella pertussis
cgccucggcauccagcucggcga

SEQ ID NO: 305677 - RNA, 19 nt, Bordetella pertussis
cgccucggcgcgcgcggcg

SEQ ID NO: 305678 - RNA, 15 nt, Bordetella pertussis
cgccucggcggccag

SEQ ID NO: 305679 - RNA, 16 nt, Bordetella pertussis
cgccucggcggccagc

SEQ ID NO: 305680 - RNA, 18 nt, Bordetella pertussis
cgccugcagcacggccac

SEQ ID NO: 305681 - RNA, 19 nt, Bordetella pertussis
cgccugcagcacggccacg

SEQ ID NO: 305682 - RNA, 23 nt, Bordetella pertussis
cgccugcagcacggccacggccg

SEQ ID NO: 305683 - RNA, 13 nt, Bordetella pertussis
cgccugcagcagc

SEQ ID NO: 305684 - RNA, 15 nt, Bordetella pertussis
cgccugcagcagcgc

SEQ ID NO: 305685 - RNA, 20 nt, Bordetella pertussis
cgccugcagcagcguggccg

SEQ ID NO: 305686 - RNA, 22 nt, Bordetella pertussis
cgccugcagcagcguggccgcc

SEQ ID NO: 305687 - RNA, 23 nt, Bordetella pertussis
cgccugcagcagcguggccgcca

SEQ ID NO: 305688 - RNA, 22 nt, Bordetella pertussis
cgccugcaggcggucggugaca

SEQ ID NO: 305689 - RNA, 13 nt, Bordetella pertussis
cgccugcaucacg

SEQ ID NO: 305690 - RNA, 19 nt, Bordetella pertussis
cgccugcauccggcccagc

SEQ ID NO: 305691 - RNA, 20 nt, Bordetella pertussis
cgccugcauccggcccagcg

SEQ ID NO: 305692 - RNA, 18 nt, Bordetella pertussis
cgccugcauggugggcau

SEQ ID NO: 305693 - RNA, 19 nt, Bordetella pertussis
cgccugcauguccagcggc

SEQ ID NO: 305694 - RNA, 12 nt, Bordetella pertussis
cgccugcagcgc

SEQ ID NO: 305695 - RNA, 14 nt, Bordetella pertussis
cgccugcagcgccg

SEQ ID NO: 305696 - RNA, 13 nt, Bordetella pertussis
cgccugcccaggc

SEQ ID NO: 305697 - RNA, 15 nt, Bordetella pertussis
cgccugcccaggcca

SEQ ID NO: 305698 - RNA, 22 nt, Bordetella pertussis
cgccugccccgccugcgccagg

SEQ ID NO: 305699 - RNA, 14 nt, Bordetella pertussis
cgccugccccggca

SEQ ID NO: 305700 - RNA, 19 nt, Bordetella pertussis
cgccugcccgcaacgccgc

SEQ ID NO: 305701 - RNA, 14 nt, Bordetella pertussis
cgccugcgcgccgc

SEQ ID NO: 305702 - RNA, 19 nt, Bordetella pertussis
cgccugcgcgccgccucga

SEQ ID NO: 305703 - RNA, 12 nt, Bordetella pertussis
cgccugcgcgcg

SEQ ID NO: 305704 - RNA, 15 nt, Bordetella pertussis
cgccugcgcgcgcug

SEQ ID NO: 305705 - RNA, 19 nt, Bordetella pertussis
cgccugcgcgcgguguucg

SEQ ID NO: 305706 - RNA, 14 nt, Bordetella pertussis
cgccugcgcggccu

SEQ ID NO: 305707 - RNA, 16 nt, Bordetella pertussis
cgccugcgcggccucg

SEQ ID NO: 305708 - RNA, 13 nt, Bordetella pertussis
cgccugcgcggcg

SEQ ID NO: 305709 - RNA, 17 nt, Bordetella pertussis
cgccugcgcggcgaucg

SEQ ID NO: 305710 - RNA, 21 nt, Bordetella pertussis
cgccugcggacggcgggcgcc

SEQ ID NO: 305711 - RNA, 13 nt, Bordetella pertussis
cgccugcggcagg

SEQ ID NO: 305712 - RNA, 17 nt, Bordetella pertussis
cgccugcggcaggccgc

SEQ ID NO: 305713 - RNA, 13 nt, Bordetella pertussis
cgccugcggcaug

SEQ ID NO: 305714 - RNA, 14 nt, Bordetella pertussis
cgccugcggcaugg

SEQ ID NO: 305715 - RNA, 17 nt, Bordetella pertussis
cgccugcgucguugccc

SEQ ID NO: 305716 - RNA, 16 nt, Bordetella pertussis
cgccugcucacgcccc

SEQ ID NO: 305717 - RNA, 15 nt, Bordetella pertussis
cgccugcucgaccug

SEQ ID NO: 305718 - RNA, 16 nt, Bordetella pertussis
cgccugcucgaccugc

SEQ ID NO: 305719 - RNA, 16 nt, Bordetella pertussis
cgccugcugcgccugg

SEQ ID NO: 305720 - RNA, 17 nt, Bordetella pertussis
cgccugcugcgccuggc

SEQ ID NO: 305721 - RNA, 20 nt, Bordetella pertussis
cgccugcugcgccuggccgc

SEQ ID NO: 305722 - RNA, 23 nt, Bordetella pertussis
cgcgacgcuguuggucaggucga

SEQ ID NO: 305723 - RNA, 17 nt, Bordetella pertussis
cgcgacggccucccgcc

SEQ ID NO: 305724 - RNA, 19 nt, Bordetella pertussis
cgcgacgugucggccacca

SEQ ID NO: 305725 - RNA, 19 nt, Bordetella pertussis
cgcgacuggcccaggcggg

SEQ ID NO: 305726 - RNA, 21 nt, Bordetella pertussis
cgcgacuuccucgacccgcgc

SEQ ID NO: 305727 - RNA, 19 nt, Bordetella pertussis
cgcgacuucgccgaucgag

SEQ ID NO: 305728 - RNA, 21 nt, Bordetella pertussis
cgcgacuucgccgaucgagca

SEQ ID NO: 305729 - RNA, 24 nt, Bordetella pertussis
cgcgacuucgccgaucgagcaggc

SEQ ID NO: 305730 - RNA, 16 nt, Bordetella pertussis
cgcgagaaccaggcca

SEQ ID NO: 305731 - RNA, 13 nt, Bordetella pertussis
cgcgagaccacga

SEQ ID NO: 305732 - RNA, 18 nt, Bordetella pertussis
cgcgauagauggccaggu

SEQ ID NO: 305733 - RNA, 19 nt, Bordetella pertussis
cgcgauagauggccaggug

SEQ ID NO: 305734 - RNA, 13 nt, Bordetella pertussis
cgcgauccgcgcc

SEQ ID NO: 305735 - RNA, 16 nt, Bordetella pertussis
cgcgauccgcgccagg

SEQ ID NO: 305736 - RNA, 13 nt, Bordetella pertussis
cgcgauccggcgu

SEQ ID NO: 305737 - RNA, 15 nt, Bordetella pertussis
cgcgauccggcgugg

SEQ ID NO: 305738 - RNA, 16 nt, Bordetella pertussis
cgcgauccucgacccg

SEQ ID NO: 305739 - RNA, 18 nt, Bordetella pertussis
cgcgauccggugaucauc

SEQ ID NO: 305740 - RNA, 15 nt, Bordetella pertussis
cgcgaucgccagcag

SEQ ID NO: 305741 - RNA, 21 nt, Bordetella pertussis
cgcgaucgccagcaggcgcug

SEQ ID NO: 305742 - RNA, 15 nt, Bordetella pertussis
cgcgaucgccgcaug

SEQ ID NO: 305743 - RNA, 18 nt, Bordetella pertussis
cgcgaugagcuggcgcag

SEQ ID NO: 305744 - RNA, 14 nt, Bordetella pertussis
cgcgaugcaugaac

SEQ ID NO: 305745 - RNA, 18 nt, Bordetella pertussis
cgcgaugcccgcgcacca

SEQ ID NO: 305746 - RNA, 22 nt, Bordetella pertussis
cgcgaugccgaucgccgacagg

SEQ ID NO: 305747 - RNA, 12 nt, Bordetella pertussis
cgcgaugcgcag

SEQ ID NO: 305748 - RNA, 13 nt, Bordetella pertussis
cgcgaugcgcagc

SEQ ID NO: 305749 - RNA, 16 nt, Bordetella pertussis
cgcgaugcgcagcagc

SEQ ID NO: 305750 - RNA, 17 nt, Bordetella pertussis
cgcgaugcgcagcagca

SEQ ID NO: 305751 - RNA, 21 nt, Bordetella pertussis
cgcgaugcgcagcagcagcgc

SEQ ID NO: 305752 - RNA, 14 nt, Bordetella pertussis
cgcgaugcgccagg

SEQ ID NO: 305753 - RNA, 18 nt, Bordetella pertussis
cgcgaugcgccaggcgcu

SEQ ID NO: 305754 - RNA, 21 nt, Bordetella pertussis
cgcgaugcgcgcgugcagcgc

SEQ ID NO: 305755 - RNA, 22 nt, Bordetella pertussis
cgcgaugcgcgcgugcagcgcc

SEQ ID NO: 305756 - RNA, 15 nt, Bordetella pertussis
cgcgaugcgcggccc

SEQ ID NO: 305757 - RNA, 16 nt, Bordetella pertussis
cgcgaugcgcggcccg

SEQ ID NO: 305758 - RNA, 17 nt, Bordetella pertussis
cgcgaugcgcggcccgg

SEQ ID NO: 305759 - RNA, 18 nt, Bordetella pertussis
cgcgaugcgucaggggca

SEQ ID NO: 305760 - RNA, 22 nt, Bordetella pertussis
cgcgaugcgucaggggcaugcc

SEQ ID NO: 305761 - RNA, 18 nt, Bordetella pertussis
cgcgauggcgccggccag

SEQ ID NO: 305762 - RNA, 21 nt, Bordetella pertussis
cgcgauggcgccggccagcgc

SEQ ID NO: 305763 - RNA, 13 nt, Bordetella pertussis
cgcgcaagccgcc

SEQ ID NO: 305764 - RNA, 15 nt, Bordetella pertussis
cgcgcaagccgccgc

SEQ ID NO: 305765 - RNA, 15 nt, Bordetella pertussis
cgcgcaaggccugcu

SEQ ID NO: 305766 - RNA, 23 nt, Bordetella pertussis
cgcgcaaggccugcucgggcgcc

SEQ ID NO: 305767 - RNA, 13 nt, Bordetella pertussis
cgcgcaaggcggg

SEQ ID NO: 305768 - RNA, 15 nt, Bordetella pertussis
cgcgcaaggcgggcu

SEQ ID NO: 305769 - RNA, 12 nt, Bordetella pertussis
cgcgcaagggcc

SEQ ID NO: 305770 - RNA, 23 nt, Bordetella pertussis
cgcgcaagagcgugugucccggc

SEQ ID NO: 305771 - RNA, 20 nt, Bordetella pertussis
cgcgcaauacgugcgcgacg

SEQ ID NO: 305772 - RNA, 13 nt, Bordetella pertussis
cgcgcaaugcgcg

SEQ ID NO: 305773 - RNA, 15 nt, Bordetella pertussis
cgcgcaaugcgcggc

SEQ ID NO: 305774 - RNA, 15 nt, Bordetella pertussis
cgcgcacacuggcca

SEQ ID NO: 305775 - RNA, 16 nt, Bordetella pertussis
cgcgcacacuggccag

SEQ ID NO: 305776 - RNA, 16 nt, Bordetella pertussis
cgcgcacagcauggcc

SEQ ID NO: 305777 - RNA, 13 nt, Bordetella pertussis
cgcgcacagcccg

SEQ ID NO: 305778 - RNA, 14 nt, Bordetella pertussis
cgcgcacagcccga

SEQ ID NO: 305779 - RNA, 22 nt, Bordetella pertussis
cgcgcacagcccgaucgacggc

SEQ ID NO: 305780 - RNA, 15 nt, Bordetella pertussis
cgcgcacagcgcggc

SEQ ID NO: 305781 - RNA, 14 nt, Bordetella pertussis
cgcgcacaggcgcu

SEQ ID NO: 305782 - RNA, 15 nt, Bordetella pertussis
cgcgcacauccagcc

SEQ ID NO: 305783 - RNA, 18 nt, Bordetella pertussis
cgcgcacauccagccgau

SEQ ID NO: 305784 - RNA, 23 nt, Bordetella pertussis
cgcgcacauuggaguaguggccc

SEQ ID NO: 305785 - RNA, 14 nt, Bordetella pertussis
cgcgcaccagcccg

SEQ ID NO: 305786 - RNA, 12 nt, Bordetella pertussis
cgcgcaccagcg

SEQ ID NO: 305787 - RNA, 12 nt, Bordetella pertussis
cgcgcaccagcu

SEQ ID NO: 305788 - RNA, 14 nt, Bordetella pertussis
cgcgcaccagcuug

SEQ ID NO: 305789 - RNA, 12 nt, Bordetella pertussis
cgcgcaccaggc

SEQ ID NO: 305790 - RNA, 14 nt, Bordetella pertussis
cgcgcaccaggcgc

SEQ ID NO: 305791 - RNA, 16 nt, Bordetella pertussis
cgcgcaccaggcgcgg

SEQ ID NO: 305792 - RNA, 17 nt, Bordetella pertussis
cgcgcaccaucgccgag

SEQ ID NO: 305793 - RNA, 21 nt, Bordetella pertussis
cgcgcaccaucgccgagccgc

SEQ ID NO: 305794 - RNA, 17 nt, Bordetella pertussis
cgcgcaccaugggcguc

SEQ ID NO: 305795 - RNA, 14 nt, Bordetella pertussis
cgcgcacccaggcc

SEQ ID NO: 305796 - RNA, 21 nt, Bordetella pertussis
cgcgcacgaagccgaugcgcc

SEQ ID NO: 305797 - RNA, 19 nt, Bordetella pertussis
cgcgcacgacgucgcgcgg

SEQ ID NO: 305798 - RNA, 15 nt, Bordetella pertussis
cgcgcacgcgcuugc

SEQ ID NO: 305799 - RNA, 13 nt, Bordetella pertussis
cgcgcacgcuggg

SEQ ID NO: 305800 - RNA, 16 nt, Bordetella pertussis
cgcgcacgcccgcgac

SEQ ID NO: 305801 - RNA, 14 nt, Bordetella pertussis
cgcgcacggccagc

SEQ ID NO: 305802 - RNA, 14 nt, Bordetella pertussis
cgcgcacgggcgcc

SEQ ID NO: 305803 - RNA, 22 nt, Bordetella pertussis
cgcgcacuuguggaccgcgaag

SEQ ID NO: 305804 - RNA, 19 nt, Bordetella pertussis
cgcgcagaaaccgccacag

SEQ ID NO: 305805 - RNA, 20 nt, Bordetella pertussis
cgcgcagaaaccgccacagc

SEQ ID NO: 305806 - RNA, 13 nt, Bordetella pertussis
cgcgcagccgcgc

SEQ ID NO: 305807 - RNA, 14 nt, Bordetella pertussis
cgcgcagcccggcg

SEQ ID NO: 305808 - RNA, 12 nt, Bordetella pertussis
cgcgcagcgccg

SEQ ID NO: 305809 - RNA, 13 nt, Bordetella pertussis
cgcgcagcgccgc

SEQ ID NO: 305810 - RNA, 14 nt, Bordetella pertussis
cgcgcagcgccgcc

SEQ ID NO: 305811 - RNA, 17 nt, Bordetella pertussis
cgcgcagcgccgccacc

SEQ ID NO: 305812 - RNA, 19 nt, Bordetella pertussis
cgcgcagcgccugcaggcg

SEQ ID NO: 305813 - RNA, 14 nt, Bordetella pertussis
cgcgcagcgccugg

SEQ ID NO: 305814 - RNA, 15 nt, Bordetella pertussis
cgcgcagcgccuggc

SEQ ID NO: 305815 - RNA, 22 nt, Bordetella pertussis
cgcgcagcgccuggccgagcgc

SEQ ID NO: 305816 - RNA, 15 nt, Bordetella pertussis
cgcgcagcggcaggc

SEQ ID NO: 305817 - RNA, 13 nt, Bordetella pertussis
cgcgcagcggcgc

SEQ ID NO: 305818 - RNA, 15 nt, Bordetella pertussis
cgcgcagcgcgaccg

SEQ ID NO: 305819 - RNA, 14 nt, Bordetella pertussis
cgcgcaggcgggcc

SEQ ID NO: 305820 - RNA, 17 nt, Bordetella pertussis
cgcgcaggcgggccucg

SEQ ID NO: 305821 - RNA, 14 nt, Bordetella pertussis
cgcgcaggcgugcg

SEQ ID NO: 305822 - RNA, 14 nt, Bordetella pertussis
cgcgcagggcaucg

SEQ ID NO: 305823 - RNA, 16 nt, Bordetella pertussis
cgcgcagggcggccgg

SEQ ID NO: 305824 - RNA, 21 nt, Bordetella pertussis
cgcgcagggcggccggcacgc

SEQ ID NO: 305825 - RNA, 22 nt, Bordetella pertussis
cgcgcagggcggccggcacgcc

SEQ ID NO: 305826 - RNA, 17 nt, Bordetella pertussis
cgcgcagggcggccucg

SEQ ID NO: 305827 - RNA, 21 nt, Bordetella pertussis
cgcgcagggcggccucgacgg

SEQ ID NO: 305828 - RNA, 16 nt, Bordetella pertussis
cgcgcaggugugccag

SEQ ID NO: 305829 - RNA, 22 nt, Bordetella pertussis
cgcgcaggugugccagccgcug

SEQ ID NO: 305830 - RNA, 15 nt, Bordetella pertussis
cgcgcaguccgcaca

SEQ ID NO: 305831 - RNA, 22 nt, Bordetella pertussis
cgcgcaguccaaggaaagcccg

SEQ ID NO: 305832 - RNA, 18 nt, Bordetella pertussis
cgcgcaucgucaggcagg

SEQ ID NO: 305833 - RNA, 19 nt, Bordetella pertussis
cgcgcaugauuccugucgc

SEQ ID NO: 305834 - RNA, 20 nt, Bordetella pertussis
cgcgcaugcaagacaggccg

SEQ ID NO: 305835 - RNA, 14 nt, Bordetella pertussis
cgcgcaugccagcu

SEQ ID NO: 305836 - RNA, 16 nt, Bordetella pertussis
cgcgcaugccagcuug

SEQ ID NO: 305837 - RNA, 16 nt, Bordetella pertussis
cgcgcaugcccgaccg

SEQ ID NO: 305838 - RNA, 14 nt, Bordetella pertussis
cgcgcauggcgaug

SEQ ID NO: 305839 - RNA, 17 nt, Bordetella pertussis
cgcgcauucgucgcugc

SEQ ID NO: 305840 - RNA, 22 nt, Bordetella pertussis
cgcgcauucgucgcugccgcgc

SEQ ID NO: 305841 - RNA, 16 nt, Bordetella pertussis
cgcgcauuucgaccug

SEQ ID NO: 305842 - RNA, 20 nt, Bordetella pertussis
cgcgcauuucgaccugcgca

SEQ ID NO: 305843 - RNA, 19 nt, Bordetella pertussis
cgcgccaagggcgugcgcu

SEQ ID NO: 305844 - RNA, 20 nt, Bordetella pertussis
cgcgccacacgggcgccugc

SEQ ID NO: 305845 - RNA, 22 nt, Bordetella pertussis
cgcgccacacgggcgccugccg

SEQ ID NO: 305846 - RNA, 23 nt, Bordetella pertussis
cgcgccaaucagauggcgcagcg

SEQ ID NO: 305847 - RNA, 15 nt, Bordetella pertussis
cgcgccacaggcgcu

SEQ ID NO: 305848 - RNA, 15 nt, Bordetella pertussis
cgcgccagcgccgcg

SEQ ID NO: 305849 - RNA, 20 nt, Bordetella pertussis
cgcgccagcgccggcgcguc

SEQ ID NO: 305850 - RNA, 14 nt, Bordetella pertussis
cgcgccagcgcgcg

SEQ ID NO: 305851 - RNA, 15 nt, Bordetella pertussis
cgcgccagcgcggcc

SEQ ID NO: 305852 - RNA, 19 nt, Bordetella pertussis
cgcgccagcgcggccagcg

SEQ ID NO: 305853 - RNA, 21 nt, Bordetella pertussis
cgcgccagcgccacgcccugg

SEQ ID NO: 305854 - RNA, 12 nt, Bordetella pertussis
cgcgccagcuga

SEQ ID NO: 305855 - RNA, 17 nt, Bordetella pertussis
cgcgccaggaagcgcgc

SEQ ID NO: 305856 - RNA, 16 nt, Bordetella pertussis
cgcgccaggauggcca

SEQ ID NO: 305857 - RNA, 22 nt, Bordetella pertussis
cgcgccaggauggccacgacca

SEQ ID NO: 305858 - RNA, 15 nt, Bordetella pertussis
cgcgccaggccggcg

SEQ ID NO: 305859 - RNA, 17 nt, Bordetella pertussis
cgcgccaggccggcggc

SEQ ID NO: 305860 - RNA, 13 nt, Bordetella pertussis
cgcgccaggcgca

SEQ ID NO: 305861 - RNA, 19 nt, Bordetella pertussis
cgcgccagcucgcgcagca

SEQ ID NO: 305862 - RNA, 17 nt, Bordetella pertussis
cgcgccaggcgccgggc

SEQ ID NO: 305863 - RNA, 14 nt, Bordetella pertussis
cgcgccaggcgcgc

SEQ ID NO: 305864 - RNA, 14 nt, Bordetella pertussis
cgcgccagggcgcc

SEQ ID NO: 305865 - RNA, 21 nt, Bordetella pertussis
cgcgccagguaggccggcgcg

SEQ ID NO: 305866 - RNA, 19 nt, Bordetella pertussis
cgcgccaggucgcgcacca

SEQ ID NO: 305867 - RNA, 21 nt, Bordetella pertussis
cgcgccaggucgcgcaccagg

SEQ ID NO: 305868 - RNA, 21 nt, Bordetella pertussis
cgcgccaggggaugacgggcg

SEQ ID NO: 305869 - RNA, 19 nt, Bordetella pertussis
cgcgccaguugcgcaccgc

SEQ ID NO: 305870 - RNA, 18 nt, Bordetella pertussis
cgcgcccagaucgaucca

SEQ ID NO: 305871 - RNA, 19 nt, Bordetella pertussis
cgcgcccagaucgauccag

SEQ ID NO: 305872 - RNA, 15 nt, Bordetella pertussis
cgcgcccagcagcgc

SEQ ID NO: 305873 - RNA, 16 nt, Bordetella pertussis
cgcgcccagcagcgcc

SEQ ID NO: 305874 - RNA, 22 nt, Bordetella pertussis
cgcgcccagcauggucggcaug

SEQ ID NO: 305875 - RNA, 16 nt, Bordetella pertussis
cgcgcccagccgcgcc

SEQ ID NO: 305876 - RNA, 13 nt, Bordetella pertussis
cgcgcccagcgcg

SEQ ID NO: 305877 - RNA, 15 nt, Bordetella pertussis
cgcgcccagcgcggc

SEQ ID NO: 305878 - RNA, 16 nt, Bordetella pertussis
cgcgcccagcgcggcc

SEQ ID NO: 305879 - RNA, 13 nt, Bordetella pertussis
cgcgcccagcggc

SEQ ID NO: 305880 - RNA, 14 nt, Bordetella pertussis
cgcgcccagcggca

SEQ ID NO: 305881 - RNA, 12 nt, Bordetella pertussis
cgcgcccagcug

SEQ ID NO: 305882 - RNA, 22 nt, Bordetella pertussis
cgcgcccagcuugaugccgccg

SEQ ID NO: 305883 - RNA, 21 nt, Bordetella pertussis
cgcgccaucacggugucgaug

SEQ ID NO: 305884 - RNA, 18 nt, Bordetella pertussis
cgcgccauccggcgcaug

SEQ ID NO: 305885 - RNA, 21 nt, Bordetella pertussis
cgcgccauccugaacgccgcg

SEQ ID NO: 305886 - RNA, 13 nt, Bordetella pertussis
cgcgcccaggcca

SEQ ID NO: 305887 - RNA, 20 nt, Bordetella pertussis
cgcgcccaggccagccaggu

SEQ ID NO: 305888 - RNA, 19 nt, Bordetella pertussis
cgcgcccaggggccggcgc

SEQ ID NO: 305889 - RNA, 22 nt, Bordetella pertussis
cgcgcccaguuccacgcggccg

SEQ ID NO: 305890 - RNA, 17 nt, Bordetella pertussis
cgcgcccaucucggccg

SEQ ID NO: 305891 - RNA, 17 nt, Bordetella pertussis
cgcgcccccacgccgcu

SEQ ID NO: 305892 - RNA, 18 nt, Bordetella pertussis
cgcgcccccacgccgcug

SEQ ID NO: 305893 - RNA, 15 nt, Bordetella pertussis
cgcgcccccagcgcc

SEQ ID NO: 305894 - RNA, 16 nt, Bordetella pertussis
cgcgcccccagcgccg

SEQ ID NO: 305895 - RNA, 21 nt, Bordetella pertussis
cgcgcccgccuucagcgggcc

SEQ ID NO: 305896 - RNA, 20 nt, Bordetella pertussis
cgcgcccgcuugggccgcgc

SEQ ID NO: 305897 - RNA, 21 nt, Bordetella pertussis
cgcgcccgcuugggccgcgcc

SEQ ID NO: 305898 - RNA, 15 nt, Bordetella pertussis
cgcgcccggccggcc

SEQ ID NO: 305899 - RNA, 17 nt, Bordetella pertussis
cgcgcccggccggcccu

SEQ ID NO: 305900 - RNA, 12 nt, Bordetella pertussis
cgcgcccggcga

SEQ ID NO: 305901 - RNA, 13 nt, Bordetella pertussis
cgcgcccggcgaa

SEQ ID NO: 305902 - RNA, 15 nt, Bordetella pertussis
cgcgcccggcggcca

SEQ ID NO: 305903 - RNA, 18 nt, Bordetella pertussis
cgcgcccggcggccaggc

SEQ ID NO: 305904 - RNA, 18 nt, Bordetella pertussis
cgcgcccguccacggccu

SEQ ID NO: 305905 - RNA, 22 nt, Bordetella pertussis
cgcgcccguccacggccugcgc

SEQ ID NO: 305906 - RNA, 16 nt, Bordetella pertussis
cgcgcccgggccgucu

SEQ ID NO: 305907 - RNA, 15 nt, Bordetella pertussis
cgcgcccgggcugau

SEQ ID NO: 305908 - RNA, 16 nt, Bordetella pertussis
cgcgccgaccaggucg

SEQ ID NO: 305909 - RNA, 13 nt, Bordetella pertussis
cgcgccgaccggc

SEQ ID NO: 305910 - RNA, 22 nt, Bordetella pertussis
cgcgccgaggugaucuggucca

SEQ ID NO: 305911 - RNA, 21 nt, Bordetella pertussis
cgcgccgagcggggccgcgcc

SEQ ID NO: 305912 - RNA, 23 nt, Bordetella pertussis
cgcgccgaggaucuggccggcgc

SEQ ID NO: 305913 - RNA, 16 nt, Bordetella pertussis
cgcgccgaguuuccgc

SEQ ID NO: 305914 - RNA, 19 nt, Bordetella pertussis
cgcgccgaguuuccgcacc

SEQ ID NO: 305915 - RNA, 22 nt, Bordetella pertussis
cgcgccgaguuuccgcacccgg

SEQ ID NO: 305916 - RNA, 14 nt, Bordetella pertussis
cgcgccgccagcgc

SEQ ID NO: 305917 - RNA, 19 nt, Bordetella pertussis
cgcgccgcccaccaccagc

SEQ ID NO: 305918 - RNA, 20 nt, Bordetella pertussis
cgcgccgcccaccaccagcg

SEQ ID NO: 305919 - RNA, 19 nt, Bordetella pertussis
cgcgccgcccccgcccagc

SEQ ID NO: 305920 - RNA, 16 nt, Bordetella pertussis
cgcgccgcccgcggcc

SEQ ID NO: 305921 - RNA, 13 nt, Bordetella pertussis
cgcgccgccgaug

SEQ ID NO: 305922 - RNA, 23 nt, Bordetella pertussis
cgcgccgccgauguugaacagcu

SEQ ID NO: 305923 - RNA, 16 nt, Bordetella pertussis
cgcgccgccgcccugg

SEQ ID NO: 305924 - RNA, 14 nt, Bordetella pertussis
cgcgccgccgcgcc

SEQ ID NO: 305925 - RNA, 16 nt, Bordetella pertussis
cgcgccgccgcgcccu

SEQ ID NO: 305926 - RNA, 14 nt, Bordetella pertussis
cgcgccgccgccug

SEQ ID NO: 305927 - RNA, 17 nt, Bordetella pertussis
cgcgccgccggcgucgc

SEQ ID NO: 305928 - RNA, 13 nt, Bordetella pertussis
cgcgccgcgucgg

SEQ ID NO: 305929 - RNA, 16 nt, Bordetella pertussis
cgcgccgcucuuggcg

SEQ ID NO: 305930 - RNA, 16 nt, Bordetella pertussis
cgcgccgcugcagcgc

SEQ ID NO: 305931 - RNA, 19 nt, Bordetella pertussis
cgcgccgcuggcguccagg

SEQ ID NO: 305932 - RNA, 22 nt, Bordetella pertussis
cgcgccgcgucuucggcgcggc

SEQ ID NO: 305933 - RNA, 13 nt, Bordetella pertussis
cgcgccgcuguac

SEQ ID NO: 305934 - RNA, 20 nt, Bordetella pertussis
cgcgccgcuguugcccacca

SEQ ID NO: 305935 - RNA, 13 nt, Bordetella pertussis
cgcgccggaucgc

SEQ ID NO: 305936 - RNA, 17 nt, Bordetella pertussis
cgcgccggaucgcacac

SEQ ID NO: 305937 - RNA, 12 nt, Bordetella pertussis
cgcgccggcagg

SEQ ID NO: 305938 - RNA, 17 nt, Bordetella pertussis
cgcgccggcagggcggc

SEQ ID NO: 305939 - RNA, 18 nt, Bordetella pertussis
cgcgccggcagggcggcc

SEQ ID NO: 305940 - RNA, 18 nt, Bordetella pertussis
cgcgccggcaucggcggc

SEQ ID NO: 305941 - RNA, 12 nt, Bordetella pertussis
cgcgccggaucg

SEQ ID NO: 305942 - RNA, 14 nt, Bordetella pertussis
cgcgccggccagcg

SEQ ID NO: 305943 - RNA, 17 nt, Bordetella pertussis
cgcgccggccagcggca

SEQ ID NO: 305944 - RNA, 14 nt, Bordetella pertussis
cgcgccggccaggg

SEQ ID NO: 305945 - RNA, 13 nt, Bordetella pertussis
cgcgccggcccaa

SEQ ID NO: 305946 - RNA, 15 nt, Bordetella pertussis
cgcgccggcccaagg

SEQ ID NO: 305947 - RNA, 16 nt, Bordetella pertussis
cgcgccggcccaaggc

SEQ ID NO: 305948 - RNA, 21 nt, Bordetella pertussis
cgcgccggcccaaggccccgc

SEQ ID NO: 305949 - RNA, 22 nt, Bordetella pertussis
cgcgccggcccaaggccccgcg

SEQ ID NO: 305950 - RNA, 14 nt, Bordetella pertussis
cgcgccggcccagg

SEQ ID NO: 305951 - RNA, 15 nt, Bordetella pertussis
cgcgccggcccaggc

SEQ ID NO: 305952 - RNA, 20 nt, Bordetella pertussis
cgcgccggucacgcuggugg

SEQ ID NO: 305953 - RNA, 19 nt, Bordetella pertussis
cgcgccgguggccagcagc

SEQ ID NO: 305954 - RNA, 15 nt, Bordetella pertussis
cgcgccguacagccg

SEQ ID NO: 305955 - RNA, 20 nt, Bordetella pertussis
cgcgccguacagccgcggca

SEQ ID NO: 305956 - RNA, 16 nt, Bordetella pertussis
cgcgccguacagggcc

SEQ ID NO: 305957 - RNA, 17 nt, Bordetella pertussis
cgcgccguaccccagca

SEQ ID NO: 305958 - RNA, 21 nt, Bordetella pertussis
cgcgccguaccugcagcaggc

SEQ ID NO: 305959 - RNA, 22 nt, Bordetella pertussis
cgcgccguauucagugcgacgg

SEQ ID NO: 305960 - RNA, 18 nt, Bordetella pertussis
cgcgccguccgagcccga

SEQ ID NO: 305961 - RNA, 22 nt, Bordetella pertussis
cgcgccguccgagcccgacgcg

SEQ ID NO: 305962 - RNA, 17 nt, Bordetella pertussis
cgcgccgucgaacuccu

SEQ ID NO: 305963 - RNA, 20 nt, Bordetella pertussis
cgcgccgucgaacuccugca

SEQ ID NO: 305964 - RNA, 23 nt, Bordetella pertussis
cgcgccgucgaacuccugcagca

SEQ ID NO: 305965 - RNA, 19 nt, Bordetella pertussis
cgcgccgucgggggccggc

SEQ ID NO: 305966 - RNA, 20 nt, Bordetella pertussis
cgcgccgugcagacggcggc

SEQ ID NO: 305967 - RNA, 22 nt, Bordetella pertussis
cgcgccguggugcugaccggcu

SEQ ID NO: 305968 - RNA, 18 nt, Bordetella pertussis
cgcgccguucucaggccg

SEQ ID NO: 305969 - RNA, 19 nt, Bordetella pertussis
cgcgccguucucaggccga

SEQ ID NO: 305970 - RNA, 16 nt, Bordetella pertussis
cgcgccuaccggcgcc

SEQ ID NO: 305971 - RNA, 17 nt, Bordetella pertussis
cgcgccuaccggcgccg

SEQ ID NO: 305972 - RNA, 20 nt, Bordetella pertussis
cgcgccuaccggcgccgacg

SEQ ID NO: 305973 - RNA, 17 nt, Bordetella pertussis
cgcgccuauaucgacgg

SEQ ID NO: 305974 - RNA, 21 nt, Bordetella pertussis
cgcgccuauaucgacggcgcc

SEQ ID NO: 305975 - RNA, 15 nt, Bordetella pertussis
cgcgccuaucaggcc

SEQ ID NO: 305976 - RNA, 22 nt, Bordetella pertussis
cgcgccuaucaggccucgaaga

SEQ ID NO: 305977 - RNA, 21 nt, Bordetella pertussis
cgcgccuccagcuccagcgcg

SEQ ID NO: 305978 - RNA, 22 nt, Bordetella pertussis
cgcgccuccagcuccagcgcgc

SEQ ID NO: 305979 - RNA, 14 nt, Bordetella pertussis
cgcgccucggcgcg

SEQ ID NO: 305980 - RNA, 19 nt, Bordetella pertussis
cgcgccucggcgcgcgcgg

SEQ ID NO: 305981 - RNA, 20 nt, Bordetella pertussis
cgcgccucggcgcgcgcggc

SEQ ID NO: 305982 - RNA, 19 nt, Bordetella pertussis
cgcgccugcagcacggcca

SEQ ID NO: 305983 - RNA, 18 nt, Bordetella pertussis
cgcgccugcagcagcggc

SEQ ID NO: 305984 - RNA, 21 nt, Bordetella pertussis
cgcgccugcagcagcggcagc

SEQ ID NO: 305985 - RNA, 14 nt, Bordetella pertussis
cgcgccugcaugcc

SEQ ID NO: 305986 - RNA, 15 nt, Bordetella pertussis
cgcgccugcaugcca

SEQ ID NO: 305987 - RNA, 13 nt, Bordetella pertussis
cgcgccugcccag

SEQ ID NO: 305988 - RNA, 15 nt, Bordetella pertussis
cgcgccugcccaggc

SEQ ID NO: 305989 - RNA, 13 nt, Bordetella pertussis
cgcgccugcccgc

SEQ ID NO: 305990 - RNA, 14 nt, Bordetella pertussis
cgcgccugcccgca

SEQ ID NO: 305991 - RNA, 15 nt, Bordetella pertussis
cgcgccugagcugcc

SEQ ID NO: 305992 - RNA, 11 nt, Bordetella pertussis
cgcgccugcgc

SEQ ID NO: 305993 - RNA, 15 nt, Bordetella pertussis
cgcgccugcgcgccg

SEQ ID NO: 305994 - RNA, 15 nt, Bordetella pertussis
cgcgccugcucguac

SEQ ID NO: 305995 - RNA, 22 nt, Bordetella pertussis
cgcgccugcucguacagcggca

SEQ ID NO: 305996 - RNA, 22 nt, Bordetella pertussis
cgcgccuuacgcggcgcgcgcc

SEQ ID NO: 305997 - RNA, 18 nt, Bordetella pertussis
cgcgccuucgaggccggc

SEQ ID NO: 305998 - RNA, 15 nt, Bordetella pertussis
cgcgccuucggcagg

SEQ ID NO: 305999 - RNA, 22 nt, Bordetella pertussis
cgcgccuucggcaggcgccggc

SEQ ID NO: 306000 - RNA, 17 nt, Bordetella pertussis
cgcgccuucggcgcgca

SEQ ID NO: 306001 - RNA, 21 nt, Bordetella pertussis
cgcgccuugcgcggcgagcgc

SEQ ID NO: 306002 - RNA, 13 nt, Bordetella pertussis
cgcgcgacagccg

SEQ ID NO: 306003 - RNA, 16 nt, Bordetella pertussis
cgcgcgacagccgcgc

SEQ ID NO: 306004 - RNA, 19 nt, Bordetella pertussis
cgcgcgacagccgcgccag

SEQ ID NO: 306005 - RNA, 13 nt, Bordetella pertussis
cgcgcgacgccgu

SEQ ID NO: 306006 - RNA, 14 nt, Bordetella pertussis
cgcgcgacggcgcc

SEQ ID NO: 306007 - RNA, 19 nt, Bordetella pertussis
cgcgcgacgugucggccac

SEQ ID NO: 306008 - RNA, 21 nt, Bordetella pertussis
cgcgcgacgugucggccacca

SEQ ID NO: 306009 - RNA, 19 nt, Bordetella pertussis
cgcgcgacuccaccggcgu

SEQ ID NO: 306010 - RNA, 14 nt, Bordetella pertussis
cgcgcgacuggccc

SEQ ID NO: 306011 - RNA, 20 nt, Bordetella pertussis
cgcgcgacuuccucgacccg

SEQ ID NO: 306012 - RNA, 23 nt, Bordetella pertussis
cgcgcgacuuccucgacccgcgc

SEQ ID NO: 306013 - RNA, 20 nt, Bordetella pertussis
cgcgcgacuucgccgaucga

SEQ ID NO: 306014 - RNA, 20 nt, Bordetella pertussis
cgcgcgagaccagcggaucg

SEQ ID NO: 306015 - RNA, 12 nt, Bordetella pertussis
cgcgcgagcagu

SEQ ID NO: 306016 - RNA, 24 nt, Bordetella pertussis
cgcgcgagcagucgaccacgcguc

SEQ ID NO: 306017 - RNA, 16 nt, Bordetella pertussis
cgcgcgagcgcaagca

SEQ ID NO: 306018 - RNA, 12 nt, Bordetella pertussis
cgcgcgagcggc

SEQ ID NO: 306019 - RNA, 20 nt, Bordetella pertussis
cgcgcgagcggcggccgcgu

SEQ ID NO: 306020 - RNA, 14 nt, Bordetella pertussis
cgcgcgagcggcgu

SEQ ID NO: 306021 - RNA, 14 nt, Bordetella pertussis
cgcgcgagcugcgc

SEQ ID NO: 306022 - RNA, 18 nt, Bordetella pertussis
cgcgcgagcugcgcggcu

SEQ ID NO: 306023 - RNA, 13 nt, Bordetella pertussis
cgcgcgaggcggc

SEQ ID NO: 306024 - RNA, 15 nt, Bordetella pertussis
cgcgcgagggugccu

SEQ ID NO: 306025 - RNA, 15 nt, Bordetella pertussis
cgcgcgaucgccagc

SEQ ID NO: 306026 - RNA, 16 nt, Bordetella pertussis
cgcgcgaucgccagca

SEQ ID NO: 306027 - RNA, 22 nt, Bordetella pertussis
cgcgcgaucgccagcaggcgcu

SEQ ID NO: 306028 - RNA, 14 nt, Bordetella pertussis
cgcgcgaucgccgc

SEQ ID NO: 306029 - RNA, 13 nt, Bordetella pertussis
cgcgcgaucaggc

SEQ ID NO: 306030 - RNA, 15 nt, Bordetella pertussis
cgcgcgaucucgggc

SEQ ID NO: 306031 - RNA, 16 nt, Bordetella pertussis
cgcgcgaucucgggca

SEQ ID NO: 306032 - RNA, 17 nt, Bordetella pertussis
cgcgcgaugcgcaggcu

SEQ ID NO: 306033 - RNA, 15 nt, Bordetella pertussis
cgcgcgaugcgcggc

SEQ ID NO: 306034 - RNA, 19 nt, Bordetella pertussis
cgcgcgauguucaggccgg

SEQ ID NO: 306035 - RNA, 15 nt, Bordetella pertussis
cgcgcgcacaggcgc

SEQ ID NO: 306036 - RNA, 20 nt, Bordetella pertussis
cgcgcgcacaggcgcucgcc

SEQ ID NO: 306037 - RNA, 19 nt, Bordetella pertussis
cgcgcgcacgaccaccagc

SEQ ID NO: 306038 - RNA, 20 nt, Bordetella pertussis
cgcgcgcacgaccaccagcg

SEQ ID NO: 306039 - RNA, 21 nt, Bordetella pertussis
cgcgcgcacgaccaccagcgc

SEQ ID NO: 306040 - RNA, 13 nt, Bordetella pertussis
cgcgcgcacgcgc

SEQ ID NO: 306041 - RNA, 14 nt, Bordetella pertussis
cgcgcgcacgcugg

SEQ ID NO: 306042 - RNA, 14 nt, Bordetella pertussis
cgcgcgcagcgcgc

SEQ ID NO: 306043 - RNA, 15 nt, Bordetella pertussis
cgcgcgcaucggccg

SEQ ID NO: 306044 - RNA, 18 nt, Bordetella pertussis
cgcgcgcaugcgccuuac

SEQ ID NO: 306045 - RNA, 11 nt, Bordetella pertussis
cgcgcgccacc

SEQ ID NO: 306046 - RNA, 12 nt, Bordetella pertussis
cgcgcgccaccg

SEQ ID NO: 306047 - RNA, 13 nt, Bordetella pertussis
cgcgcgccaccgc

SEQ ID NO: 306048 - RNA, 15 nt, Bordetella pertussis
cgcgcgccaccgcca

SEQ ID NO: 306049 - RNA, 11 nt, Bordetella pertussis
cgcgcgccagc

SEQ ID NO: 306050 - RNA, 20 nt, Bordetella pertussis
cgcgcgcaggucguggccgu

SEQ ID NO: 306051 - RNA, 20 nt, Bordetella pertussis
cgcgcgcaucacgcuggccg

SEQ ID NO: 306052 - RNA, 12 nt, Bordetella pertussis
cgcgcgccagcg

SEQ ID NO: 306053 - RNA, 20 nt, Bordetella pertussis
cgcgcgccagcugggcguug

SEQ ID NO: 306054 - RNA, 14 nt, Bordetella pertussis
cgcgcgccaggccc

SEQ ID NO: 306055 - RNA, 18 nt, Bordetella pertussis
cgcgcgccaggcccaggg

SEQ ID NO: 306056 - RNA, 19 nt, Bordetella pertussis
cgcgcgcccccagcgccgu

SEQ ID NO: 306057 - RNA, 21 nt, Bordetella pertussis
cgcgcgcccccagcgccguca

SEQ ID NO: 306058 - RNA, 24 nt, Bordetella pertussis
cgcgcgcccccagcgccgucagca

SEQ ID NO: 306059 - RNA, 12 nt, Bordetella pertussis
cgcgcgcccagg

SEQ ID NO: 306060 - RNA, 13 nt, Bordetella pertussis
cgcgcgccgacgc

SEQ ID NO: 306061 - RNA, 17 nt, Bordetella pertussis
cgcgcgccgaugcgcca

SEQ ID NO: 306062 - RNA, 20 nt, Bordetella pertussis
cgcgcgccgccucagcccgc

SEQ ID NO: 306063 - RNA, 14 nt, Bordetella pertussis
cgcgcgccggcauc

SEQ ID NO: 306064 - RNA, 13 nt, Bordetella pertussis
cgcgcgccggcca

SEQ ID NO: 306065 - RNA, 13 nt, Bordetella pertussis
cgcgcgccgcauc

SEQ ID NO: 306066 - RNA, 15 nt, Bordetella pertussis
cgcgcgccggcgccg

SEQ ID NO: 306067 - RNA, 14 nt, Bordetella pertussis
cgcgcgccggcgcu

SEQ ID NO: 306068 - RNA, 14 nt, Bordetella pertussis
cgcgcgccggcggc

SEQ ID NO: 306069 - RNA, 21 nt, Bordetella pertussis
cgcgcgccugcauguccagcg

SEQ ID NO: 306070 - RNA, 13 nt, Bordetella pertussis
cgcgcgccugcgc

SEQ ID NO: 306071 - RNA, 17 nt, Bordetella pertussis
cgcgcgccugcgcgccg

SEQ ID NO: 306072 - RNA, 20 nt, Bordetella pertussis
cgcgcgcgacgacagcggcg

SEQ ID NO: 306073 - RNA, 15 nt, Bordetella pertussis
cgcgcgcgaggcggc

SEQ ID NO: 306074 - RNA, 14 nt, Bordetella pertussis
cgcgcgcgcacagg

SEQ ID NO: 306075 - RNA, 15 nt, Bordetella pertussis
cgcgcgcgcacaggc

SEQ ID NO: 306076 - RNA, 13 nt, Bordetella pertussis
cgcgcgcgccagg

SEQ ID NO: 306077 - RNA, 12 nt, Bordetella pertussis
cgcgcgcgcccu

SEQ ID NO: 306078 - RNA, 14 nt, Bordetella pertussis
cgcgcgcgcccugc

SEQ ID NO: 306079 - RNA, 11 nt, Bordetella pertussis
cgcgcgcgccg

SEQ ID NO: 306080 - RNA, 12 nt, Bordetella pertussis
cgcgcgcgccgc

SEQ ID NO: 306081 - RNA, 13 nt, Bordetella pertussis
cgcgcgcgccgca

SEQ ID NO: 306082 - RNA, 13 nt, Bordetella pertussis
cgcgcgcgccggc

SEQ ID NO: 306083 - RNA, 14 nt, Bordetella pertussis
cgcgcgcgcgccgc

SEQ ID NO: 306084 - RNA, 14 nt, Bordetella pertussis
cgcgcgcgcucagg

SEQ ID NO: 306085 - RNA, 13 nt, Bordetella pertussis
cgcgcgcggaucg

SEQ ID NO: 306086 - RNA, 14 nt, Bordetella pertussis
cgcgcgcggaucga

SEQ ID NO: 306087 - RNA, 15 nt, Bordetella pertussis
cgcgcgcggcgccgc

SEQ ID NO: 306088 - RNA, 14 nt, Bordetella pertussis
cgcgcgcgggcgcg

SEQ ID NO: 306089 - RNA, 15 nt, Bordetella pertussis
cgcgcgcgggcgcgc

SEQ ID NO: 306090 - RNA, 17 nt, Bordetella pertussis
cgcgcgcgggcgcgccg

SEQ ID NO: 306091 - RNA, 21 nt, Bordetella pertussis
cgcgcgcgguugagcgccagg

SEQ ID NO: 306092 - RNA, 17 nt, Bordetella pertussis
cgcgcgcguacagccgg

SEQ ID NO: 306093 - RNA, 21 nt, Bordetella pertussis
cgcgcgcguauggcggcgccg

SEQ ID NO: 306094 - RNA, 21 nt, Bordetella pertussis
cgcgcgcgucgccgcuggcca

SEQ ID NO: 306095 - RNA, 16 nt, Bordetella pertussis
cgcgcggauccuugac

SEQ ID NO: 306096 - RNA, 20 nt, Bordetella pertussis
cgcgcggaucgaaaccggcg

SEQ ID NO: 306097 - RNA, 21 nt, Bordetella pertussis
cgcgcggaucgaaaccggcgc

SEQ ID NO: 306098 - RNA, 21 nt, Bordetella pertussis
cgcgcggaugaucgcgcagca

SEQ ID NO: 306099 - RNA, 12 nt, Bordetella pertussis
cgcgcggcaugg

SEQ ID NO: 306100 - RNA, 15 nt, Bordetella pertussis
cgcgcggcagcgccg

SEQ ID NO: 306101 - RNA, 17 nt, Bordetella pertussis
cgcgcggcagggcgucg

SEQ ID NO: 306102 - RNA, 21 nt, Bordetella pertussis
cgcgcggcagggcgucggccg

SEQ ID NO: 306103 - RNA, 13 nt, Bordetella pertussis
cgcgcggccagcg

SEQ ID NO: 306104 - RNA, 19 nt, Bordetella pertussis
cgcgcggccauguccagca

SEQ ID NO: 306105 - RNA, 12 nt, Bordetella pertussis
cgcgcggccgcg

SEQ ID NO: 306106 - RNA, 13 nt, Bordetella pertussis
cgcgcggccggcc

SEQ ID NO: 306107 - RNA, 14 nt, Bordetella pertussis
cgcgcggccgggcu

SEQ ID NO: 306108 - RNA, 19 nt, Bordetella pertussis
cgcgcggccgggcucaggc

SEQ ID NO: 306109 - RNA, 18 nt, Bordetella pertussis
cgcgcggccucgacgaug

SEQ ID NO: 306110 - RNA, 16 nt, Bordetella pertussis
cgcgcggccuggcggu

SEQ ID NO: 306111 - RNA, 20 nt, Bordetella pertussis
cgcgcggcgacacccccagg

SEQ ID NO: 306112 - RNA, 16 nt, Bordetella pertussis
cgcgcggcgaccgcga

SEQ ID NO: 306113 - RNA, 20 nt, Bordetella pertussis
cgcgcggcgaggcguccagc

SEQ ID NO: 306114 - RNA, 14 nt, Bordetella pertussis
cgcgcggcgccugc

SEQ ID NO: 306115 - RNA, 14 nt, Bordetella pertussis
cgcgcggcggcgga

SEQ ID NO: 306116 - RNA, 14 nt, Bordetella pertussis
cgcgcggcgcggcu

SEQ ID NO: 306117 - RNA, 13 nt, Bordetella pertussis
cgcgcggcgcugc

SEQ ID NO: 306118 - RNA, 22 nt, Bordetella pertussis
cgcgcggcggcaccagcaggcc

SEQ ID NO: 306119 - RNA, 17 nt, Bordetella pertussis
cgcgcggcguugcggcg

SEQ ID NO: 306120 - RNA, 16 nt, Bordetella pertussis
cgcgcggcucgccgcg

SEQ ID NO: 306121 - RNA, 18 nt, Bordetella pertussis
cgcgcggcucgccgcgca

SEQ ID NO: 306122 - RNA, 18 nt, Bordetella pertussis
cgcgcggcuggcuguucg

SEQ ID NO: 306123 - RNA, 21 nt, Bordetella pertussis
cgcgcggcuggggcugcuggg

SEQ ID NO: 306124 - RNA, 17 nt, Bordetella pertussis
cgcgcggcugggucggc

SEQ ID NO: 306125 - RNA, 14 nt, Bordetella pertussis
cgcgcgggccagca

SEQ ID NO: 306126 - RNA, 20 nt, Bordetella pertussis
cgcgcgggccuggcucaggc

SEQ ID NO: 306127 - RNA, 22 nt, Bordetella pertussis
cgcgcgggcgauggccacgcgc

SEQ ID NO: 306128 - RNA, 15 nt, Bordetella pertussis
cgcgcgggcgcccgc

SEQ ID NO: 306129 - RNA, 17 nt, Bordetella pertussis
cgcgcgggcgcccgcgc

SEQ ID NO: 306130 - RNA, 17 nt, Bordetella pertussis
cgcgcgggcgcgcagcg

SEQ ID NO: 306131 - RNA, 19 nt, Bordetella pertussis
cgcgcgggcgcgcagcgcg

SEQ ID NO: 306132 - RNA, 15 nt, Bordetella pertussis
cgcgcgggcggcccg

SEQ ID NO: 306133 - RNA, 14 nt, Bordetella pertussis
cgcgcggggcaggc

SEQ ID NO: 306134 - RNA, 14 nt, Bordetella pertussis
cgcgcgggggugcg

SEQ ID NO: 306135 - RNA, 15 nt, Bordetella pertussis
cgcgcggguccaggc

SEQ ID NO: 306136 - RNA, 20 nt, Bordetella pertussis
cgcgcggguccuugccgggc

SEQ ID NO: 306137 - RNA, 17 nt, Bordetella pertussis
cgcgcgguacgcaccgc

SEQ ID NO: 306138 - RNA, 23 nt, Bordetella pertussis
cgcgcgguacgcaccgccgccgg

SEQ ID NO: 306139 - RNA, 20 nt, Bordetella pertussis
cgcgcgguauugcgccaccc

SEQ ID NO: 306140 - RNA, 13 nt, Bordetella pertussis
cgcgcggugacgu

SEQ ID NO: 306141 - RNA, 17 nt, Bordetella pertussis
cgcgcggugcucggcga

SEQ ID NO: 306142 - RNA, 15 nt, Bordetella pertussis
cgcgcgguggccgcc

SEQ ID NO: 306143 - RNA, 19 nt, Bordetella pertussis
cgcgcgguggccgccgcgc

SEQ ID NO: 306144 - RNA, 22 nt, Bordetella pertussis
cgcgcgguggccgccgcgcgcc

SEQ ID NO: 306145 - RNA, 18 nt, Bordetella pertussis
cgcgcggugucgccgccg

SEQ ID NO: 306146 - RNA, 16 nt, Bordetella pertussis
cgcgcgguucaucgcc

SEQ ID NO: 306147 - RNA, 21 nt, Bordetella pertussis
cgcgcgguucgccgugcaggg

SEQ ID NO: 306148 - RNA, 14 nt, Bordetella pertussis
cgcgcggugccgcc

SEQ ID NO: 306149 - RNA, 20 nt, Bordetella pertussis
cgcgcgguugagcgccaggg

SEQ ID NO: 306150 - RNA, 16 nt, Bordetella pertussis
cgcgcguacagccggg

SEQ ID NO: 306151 - RNA, 12 nt, Bordetella pertussis
cgcgcguaucgg

SEQ ID NO: 306152 - RNA, 20 nt, Bordetella pertussis
cgcgcguaucggcgcgagcg

SEQ ID NO: 306153 - RNA, 23 nt, Bordetella pertussis
cgcgcguauggcggcgccgagau

SEQ ID NO: 306154 - RNA, 16 nt, Bordetella pertussis
cgcgcguagcgauccg

SEQ ID NO: 306155 - RNA, 17 nt, Bordetella pertussis
cgcgcguagcgauccga

SEQ ID NO: 306156 - RNA, 16 nt, Bordetella pertussis
cgcgcguccugcgcca

SEQ ID NO: 306157 - RNA, 15 nt, Bordetella pertussis
cgcgcguccuuggcg

SEQ ID NO: 306158 - RNA, 14 nt, Bordetella pertussis
cgcgcgucgccgcu

SEQ ID NO: 306159 - RNA, 14 nt, Bordetella pertussis
cgcgcgucgugccc

SEQ ID NO: 306160 - RNA, 17 nt, Bordetella pertussis
cgcgcgucgugcccgcc

SEQ ID NO: 306161 - RNA, 15 nt, Bordetella pertussis
cgcgcgugauggaga

SEQ ID NO: 306162 - RNA, 13 nt, Bordetella pertussis
cgcgcgugcagcg

SEQ ID NO: 306163 - RNA, 14 nt, Bordetella pertussis
cgcgcgugcagcgc

SEQ ID NO: 306164 - RNA, 15 nt, Bordetella pertussis
cgcgcgugcagcgcc

SEQ ID NO: 306165 - RNA, 16 nt, Bordetella pertussis
cgcgcgugcagcgccg

SEQ ID NO: 306166 - RNA, 15 nt, Bordetella pertussis
cgcgcgugcaggccg

SEQ ID NO: 306167 - RNA, 14 nt, Bordetella pertussis
cgcgcgugcaggua

SEQ ID NO: 306168 - RNA, 16 nt, Bordetella pertussis
cgcgcgugccgcaggc

SEQ ID NO: 306169 - RNA, 17 nt, Bordetella pertussis
cgcgcgugccgcaggcc

SEQ ID NO: 306170 - RNA, 14 nt, Bordetella pertussis
cgcgcgugccgcgc

SEQ ID NO: 306171 - RNA, 12 nt, Bordetella pertussis
cgcgcgugcugg

SEQ ID NO: 306172 - RNA, 13 nt, Bordetella pertussis
cgcgcguugaccg

SEQ ID NO: 306173 - RNA, 19 nt, Bordetella pertussis
cgcgcguugaccgccucga

SEQ ID NO: 306174 - RNA, 19 nt, Bordetella pertussis
cgcgcucaccgagggccgg

SEQ ID NO: 306175 - RNA, 19 nt, Bordetella pertussis
cgcgcucagcaccaggccg

SEQ ID NO: 306176 - RNA, 13 nt, Bordetella pertussis
cgcgcucaggccg

SEQ ID NO: 306177 - RNA, 15 nt, Bordetella pertussis
cgcgcucaggccgcc

SEQ ID NO: 306178 - RNA, 15 nt, Bordetella pertussis
cgcgcucaggccgcu

SEQ ID NO: 306179 - RNA, 20 nt, Bordetella pertussis
cgcgcucaggccgcugggca

SEQ ID NO: 306180 - RNA, 13 nt, Bordetella pertussis
cgcgcucaggggg

SEQ ID NO: 306181 - RNA, 17 nt, Bordetella pertussis
cgcgcuccagcauguac

SEQ ID NO: 306182 - RNA, 16 nt, Bordetella pertussis
cgcgcuccggcugcgc

SEQ ID NO: 306183 - RNA, 21 nt, Bordetella pertussis
cgcgcuccggcugcgcgcgca

SEQ ID NO: 306184 - RNA, 17 nt, Bordetella pertussis
cgcgcuccugcucggcg

SEQ ID NO: 306185 - RNA, 13 nt, Bordetella pertussis
cgcgcucgagcau

SEQ ID NO: 306186 - RNA, 21 nt, Bordetella pertussis
cgcgcucgagcaucuggcgca

SEQ ID NO: 306187 - RNA, 22 nt, Bordetella pertussis
cgcgcucgagcaucuggcgcau

SEQ ID NO: 306188 - RNA, 17 nt, Bordetella pertussis
cgcgcucgagcgcggcg

SEQ ID NO: 306189 - RNA, 14 nt, Bordetella pertussis
cgcgcucgcccagc

SEQ ID NO: 306190 - RNA, 18 nt, Bordetella pertussis
cgcgcucgcccagccgcc

SEQ ID NO: 306191 - RNA, 13 nt, Bordetella pertussis
cgcgcucgcccgg

SEQ ID NO: 306192 - RNA, 15 nt, Bordetella pertussis
cgcgcucgcgccagg

SEQ ID NO: 306193 - RNA, 17 nt, Bordetella pertussis
cgcgcucgcgccaggcc

SEQ ID NO: 306194 - RNA, 14 nt, Bordetella pertussis
cgcgcucgcgcgcg

SEQ ID NO: 306195 - RNA, 14 nt, Bordetella pertussis
cgcgcucgcgcucg

SEQ ID NO: 306196 - RNA, 14 nt, Bordetella pertussis
cgcgcucgcugccg

SEQ ID NO: 306197 - RNA, 16 nt, Bordetella pertussis
cgcgcucgcugccggc

SEQ ID NO: 306198 - RNA, 17 nt, Bordetella pertussis
cgcgcucgcugccggcg

SEQ ID NO: 306199 - RNA, 18 nt, Bordetella pertussis
cgcgcucgcugccggcgu

SEQ ID NO: 306200 - RNA, 18 nt, Bordetella pertussis
cgcgcucggagggcucca

SEQ ID NO: 306201 - RNA, 16 nt, Bordetella pertussis
cgcgcucggccagcgc

SEQ ID NO: 306202 - RNA, 17 nt, Bordetella pertussis
cgcgcucggccagcgcg

SEQ ID NO: 306203 - RNA, 21 nt, Bordetella pertussis
cgcgcucggccagcgcgcggc

SEQ ID NO: 306204 - RNA, 12 nt, Bordetella pertussis
cgcgcucggcca

SEQ ID NO: 306205 - RNA, 15 nt, Bordetella pertussis
cgcgcucggccagca

SEQ ID NO: 306206 - RNA, 15 nt, Bordetella pertussis
cgcgcucggcgacgg

SEQ ID NO: 306207 - RNA, 23 nt, Bordetella pertussis
cgcgcucgggcagcucgcggucg

SEQ ID NO: 306208 - RNA, 18 nt, Bordetella pertussis
cgcgcucuccgaacaggc

SEQ ID NO: 306209 - RNA, 15 nt, Bordetella pertussis
cgcgcugacgaaaug

SEQ ID NO: 306210 - RNA, 16 nt, Bordetella pertussis
cgcgcugaugcgcggc

SEQ ID NO: 306211 - RNA, 19 nt, Bordetella pertussis
cgcgcugaugcgcggcggg

SEQ ID NO: 306212 - RNA, 12 nt, Bordetella pertussis
cgcgcugcagca

SEQ ID NO: 306213 - RNA, 14 nt, Bordetella pertussis
cgcgcugcagcaug

SEQ ID NO: 306214 - RNA, 17 nt, Bordetella pertussis
cgcgcugcccaccgccg

SEQ ID NO: 306215 - RNA, 13 nt, Bordetella pertussis
cgcgcugcccagc

SEQ ID NO: 306216 - RNA, 16 nt, Bordetella pertussis
cgcgcugcccagccac

SEQ ID NO: 306217 - RNA, 13 nt, Bordetella pertussis
cgcgcugccgcug

SEQ ID NO: 306218 - RNA, 14 nt, Bordetella pertussis
cgcgcugccgcugc

SEQ ID NO: 306219 - RNA, 16 nt, Bordetella pertussis
cgcgcugcgacagcag

SEQ ID NO: 306220 - RNA, 17 nt, Bordetella pertussis
cgcgcugcgacagcagc

SEQ ID NO: 306221 - RNA, 18 nt, Bordetella pertussis
cgcgcugcgacagcagca

SEQ ID NO: 306222 - RNA, 13 nt, Bordetella pertussis
cgcgcugcgcccg

SEQ ID NO: 306223 - RNA, 14 nt, Bordetella pertussis
cgcgcugcgcccgc

SEQ ID NO: 306224 - RNA, 12 nt, Bordetella pertussis
cgcgcugcgcgc

SEQ ID NO: 306225 - RNA, 13 nt, Bordetella pertussis
cgcgcugcgcgcc

SEQ ID NO: 306226 - RNA, 13 nt, Bordetella pertussis
cgcgcugcgguca

SEQ ID NO: 306227 - RNA, 18 nt, Bordetella pertussis
cgcgcugcugcaggccgg

SEQ ID NO: 306228 - RNA, 13 nt, Bordetella pertussis
cgcgcuggccgac

SEQ ID NO: 306229 - RNA, 12 nt, Bordetella pertussis
cgcgcuggcgca

SEQ ID NO: 306230 - RNA, 13 nt, Bordetella pertussis
cgcgcuggcgccc

SEQ ID NO: 306231 - RNA, 12 nt, Bordetella pertussis
cgcgcuggcgcg

SEQ ID NO: 306232 - RNA, 13 nt, Bordetella pertussis
cgcgcuggcgcgc

SEQ ID NO: 306233 - RNA, 22 nt, Bordetella pertussis
cgcgcuggcgcuggccgcccgc

SEQ ID NO: 306234 - RNA, 15 nt, Bordetella pertussis
cgcgcuggcgcagca

SEQ ID NO: 306235 - RNA, 15 nt, Bordetella pertussis
cgcgcuggcggcgca

SEQ ID NO: 306236 - RNA, 21 nt, Bordetella pertussis
cgcgcuggcgguggccgcgca

SEQ ID NO: 306237 - RNA, 14 nt, Bordetella pertussis
cgcgcuggcugugc

SEQ ID NO: 306238 - RNA, 23 nt, Bordetella pertussis
cgcgcugggaaacagcgaaagca

SEQ ID NO: 306239 - RNA, 13 nt, Bordetella pertussis
cgcgcugggcgcu

SEQ ID NO: 306240 - RNA, 15 nt, Bordetella pertussis
cgcgcugggcgcugc

SEQ ID NO: 306241 - RNA, 14 nt, Bordetella pertussis
cgcgcugggcgugg

SEQ ID NO: 306242 - RNA, 19 nt, Bordetella pertussis
cgcgcugggcguggcgcgc

SEQ ID NO: 306243 - RNA, 12 nt, Bordetella pertussis
cgcgcugggcgc

SEQ ID NO: 306244 - RNA, 16 nt, Bordetella pertussis
cgcgcuggggcagcag

SEQ ID NO: 306245 - RNA, 22 nt, Bordetella pertussis
cgcgcuggggcaggacgccggc

SEQ ID NO: 306246 - RNA, 21 nt, Bordetella pertussis
cgcgcugggucaggucgcugc

SEQ ID NO: 306247 - RNA, 22 nt, Bordetella pertussis
cgcgcuuuuccccgcccagcga

SEQ ID NO: 306248 - RNA, 16 nt, Bordetella pertussis
cgcggacccaggccuc

SEQ ID NO: 306249 - RNA, 16 nt, Bordetella pertussis
cgcggcccgccacgca

SEQ ID NO: 306250 - RNA, 17 nt, Bordetella pertussis
cgcggcccgccacgcag

SEQ ID NO: 306251 - RNA, 21 nt, Bordetella pertussis
cgcggcccgccacgcaggcgg

SEQ ID NO: 306252 - RNA, 14 nt, Bordetella pertussis
cgcggcccgccagg

SEQ ID NO: 306253 - RNA, 16 nt, Bordetella pertussis
cgcggcccgcccgcgg

SEQ ID NO: 306254 - RNA, 15 nt, Bordetella pertussis
cgcggcccggccgca

SEQ ID NO: 306255 - RNA, 18 nt, Bordetella pertussis
cgcggcccggccgcauug

SEQ ID NO: 306256 - RNA, 16 nt, Bordetella pertussis
cgcggcccggcgucgg

SEQ ID NO: 306257 - RNA, 18 nt, Bordetella pertussis
cgcggcccgugccacggc

SEQ ID NO: 306258 - RNA, 18 nt, Bordetella pertussis
cgcggcccuugcgcgaag

SEQ ID NO: 306259 - RNA, 19 nt, Bordetella pertussis
cgcggccgcgucggccuca

SEQ ID NO: 306260 - RNA, 20 nt, Bordetella pertussis
cgcggccgcgucggccucau

SEQ ID NO: 306261 - RNA, 14 nt, Bordetella pertussis
cgcggccgcgguca

SEQ ID NO: 306262 - RNA, 20 nt, Bordetella pertussis
cgcggccgcggucagccaga

SEQ ID NO: 306263 - RNA, 16 nt, Bordetella pertussis
cgcggcccguagcugg

SEQ ID NO: 306264 - RNA, 22 nt, Bordetella pertussis
cgcggccgcuugucgaugacgc

SEQ ID NO: 306265 - RNA, 14 nt, Bordetella pertussis
cgcggccggacagg

SEQ ID NO: 306266 - RNA, 19 nt, Bordetella pertussis
cgcggccggacagggccgc

SEQ ID NO: 306267 - RNA, 12 nt, Bordetella pertussis
cgcggccggcaa

SEQ ID NO: 306268 - RNA, 16 nt, Bordetella pertussis
cgcggccggcaaggug

SEQ ID NO: 306269 - RNA, 16 nt, Bordetella pertussis
cgcggccggcaccagg

SEQ ID NO: 306270 - RNA, 17 nt, Bordetella pertussis
cgcggccggcacgccca

SEQ ID NO: 306271 - RNA, 20 nt, Bordetella pertussis
cgcggccggccgcgcccaug

SEQ ID NO: 306272 - RNA, 15 nt, Bordetella pertussis
cgcggccggccugcu

SEQ ID NO: 306273 - RNA, 15 nt, Bordetella pertussis
cgcggccggcgcgcc

SEQ ID NO: 306274 - RNA, 16 nt, Bordetella pertussis
cgcggccggcgcgccg

SEQ ID NO: 306275 - RNA, 13 nt, Bordetella pertussis
cgcggccggcggc

SEQ ID NO: 306276 - RNA, 23 nt, Bordetella pertussis
cgcggccggcuugcgcaagccgg

SEQ ID NO: 306277 - RNA, 14 nt, Bordetella pertussis
cgcggccggcggcg

SEQ ID NO: 306278 - RNA, 21 nt, Bordetella pertussis
cgcggccgggucggccugcca

SEQ ID NO: 306279 - RNA, 16 nt, Bordetella pertussis
cgcggccgucaccgcc

SEQ ID NO: 306280 - RNA, 20 nt, Bordetella pertussis
cgcggccgucaccgccgccg

SEQ ID NO: 306281 - RNA, 15 nt, Bordetella pertussis
cgcggccgucaggcg

SEQ ID NO: 306282 - RNA, 12 nt, Bordetella pertussis
cgcggccgucgg

SEQ ID NO: 306283 - RNA, 21 nt, Bordetella pertussis
cgcggccgucggcgcuggcgc

SEQ ID NO: 306284 - RNA, 23 nt, Bordetella pertussis
cgcggccgucggcgcuggcgcgc

SEQ ID NO: 306285 - RNA, 12 nt, Bordetella pertussis
cgcggccgucgu

SEQ ID NO: 306286 - RNA, 21 nt, Bordetella pertussis
cgcggccguggcggccugcgc

SEQ ID NO: 306287 - RNA, 18 nt, Bordetella pertussis
cgcggccguguucgagca

SEQ ID NO: 306288 - RNA, 15 nt, Bordetella pertussis
cgcggccguuggcga

SEQ ID NO: 306289 - RNA, 22 nt, Bordetella pertussis
cgcggccguuugccccucggcg

SEQ ID NO: 306290 - RNA, 22 nt, Bordetella pertussis
cgcggccuauuuggcggccugg

SEQ ID NO: 306291 - RNA, 20 nt, Bordetella pertussis
cgcggccucgccggccuggc

SEQ ID NO: 306292 - RNA, 19 nt, Bordetella pertussis
cgcggcgagcgccgccagg

SEQ ID NO: 306293 - RNA, 21 nt, Bordetella pertussis
cgcggcgauacgcgccgccug

SEQ ID NO: 306294 - RNA, 15 nt, Bordetella pertussis
cgcggcgccaugccg

SEQ ID NO: 306295 - RNA, 16 nt, Bordetella pertussis
cgcggcgccaugccgc

SEQ ID NO: 306296 - RNA, 19 nt, Bordetella pertussis
cgcggcgccaugccgcgcc

SEQ ID NO: 306297 - RNA, 15 nt, Bordetella pertussis
cgcggcgcccagcug

SEQ ID NO: 306298 - RNA, 14 nt, Bordetella pertussis
cgcggcgccccgug

SEQ ID NO: 306299 - RNA, 13 nt, Bordetella pertussis
cgcggcgcccgcc

SEQ ID NO: 306300 - RNA, 20 nt, Bordetella pertussis
cgcggcgcccgccugcgugg

SEQ ID NO: 306301 - RNA, 17 nt, Bordetella pertussis
cgcggcgcccgcgcaug

SEQ ID NO: 306302 - RNA, 13 nt, Bordetella pertussis
cgcggcgcccccg

SEQ ID NO: 306303 - RNA, 15 nt, Bordetella pertussis
cgcggcgcccccgcg

SEQ ID NO: 306304 - RNA, 14 nt, Bordetella pertussis
cgcggcgcccggug

SEQ ID NO: 306305 - RNA, 13 nt, Bordetella pertussis
cgcggcgccugcg

SEQ ID NO: 306306 - RNA, 14 nt, Bordetella pertussis
cgcggcgccugcgc

SEQ ID NO: 306307 - RNA, 19 nt, Bordetella pertussis
cgcggcgcgccagcgcggc

SEQ ID NO: 306308 - RNA, 11 nt, Bordetella pertussis
cgcggcgcgcg

SEQ ID NO: 306309 - RNA, 14 nt, Bordetella pertussis
cgcggcgcgcgcca

SEQ ID NO: 306310 - RNA, 15 nt, Bordetella pertussis
cgcggcgcgcgccga

SEQ ID NO: 306311 - RNA, 14 nt, Bordetella pertussis
cgcggcgcgcgccu

SEQ ID NO: 306312 - RNA, 17 nt, Bordetella pertussis
cgcggcgcgcgccugca

SEQ ID NO: 306313 - RNA, 20 nt, Bordetella pertussis
cgcggcgcgcgcgcgcagca

SEQ ID NO: 306314 - RNA, 14 nt, Bordetella pertussis
cgcggcgcgcgcgg

SEQ ID NO: 306315 - RNA, 15 nt, Bordetella pertussis
cgcggcgcgcgcggc

SEQ ID NO: 306316 - RNA, 16 nt, Bordetella pertussis
cgcggcgcgcgcggcg

SEQ ID NO: 306317 - RNA, 12 nt, Bordetella pertussis
cgcggcgcggcg

SEQ ID NO: 306318 - RNA, 16 nt, Bordetella pertussis
cgcggcgcggcgcagg

SEQ ID NO: 306319 - RNA, 17 nt, Bordetella pertussis
cgcggcgcggcgcaggc

SEQ ID NO: 306320 - RNA, 13 nt, Bordetella pertussis
cgcggcgcggcug

SEQ ID NO: 306321 - RNA, 13 nt, Bordetella pertussis
cgcggcgcgucgc

SEQ ID NO: 306322 - RNA, 16 nt, Bordetella pertussis
cgcggcgcgucgcgcg

SEQ ID NO: 306323 - RNA, 18 nt, Bordetella pertussis
cgcggcgcgucgcgcgcc

SEQ ID NO: 306324 - RNA, 22 nt, Bordetella pertussis
cgcggcgcguucagcagcaggc

SEQ ID NO: 306325 - RNA, 21 nt, Bordetella pertussis
cgcggcgcgcgauacgucgaa

SEQ ID NO: 306326 - RNA, 14 nt, Bordetella pertussis
cgcggcgcggcagg

SEQ ID NO: 306327 - RNA, 16 nt, Bordetella pertussis
cgcggcgcggccagca

SEQ ID NO: 306328 - RNA, 21 nt, Bordetella pertussis
cgcggcgcguucucagccgcc

SEQ ID NO: 306329 - RNA, 12 nt, Bordetella pertussis
cgcggcgcugcu

SEQ ID NO: 306330 - RNA, 15 nt, Bordetella pertussis
cgcggcgcugcuggc

SEQ ID NO: 306331 - RNA, 19 nt, Bordetella pertussis
cgcggcgcugcuggccggc

SEQ ID NO: 306332 - RNA, 14 nt, Bordetella pertussis
cgcggcgcuacgcc

SEQ ID NO: 306333 - RNA, 13 nt, Bordetella pertussis
cgcggcggcacca

SEQ ID NO: 306334 - RNA, 19 nt, Bordetella pertussis
cgcggcggcaccagcaggc

SEQ ID NO: 306335 - RNA, 16 nt, Bordetella pertussis
cgcggcggaucggcgu

SEQ ID NO: 306336 - RNA, 22 nt, Bordetella pertussis
cgcggcggcuugccgucgaccg

SEQ ID NO: 306337 - RNA, 19 nt, Bordetella pertussis
cgcggcgggaccgugccgc

SEQ ID NO: 306338 - RNA, 20 nt, Bordetella pertussis
cgcggcgggaccgugccgcc

SEQ ID NO: 306339 - RNA, 16 nt, Bordetella pertussis
cgcggcgggacggcca

SEQ ID NO: 306340 - RNA, 20 nt, Bordetella pertussis
cgcggcgggcucagcccgcc

SEQ ID NO: 306341 - RNA, 19 nt, Bordetella pertussis
cgcggcgggcucgagcugg

SEQ ID NO: 306342 - RNA, 20 nt, Bordetella pertussis
cgcggcgggcucgagcuggc

SEQ ID NO: 306343 - RNA, 14 nt, Bordetella pertussis
cgcggcgggcuugg

SEQ ID NO: 306344 - RNA, 19 nt, Bordetella pertussis
cgcggcgggugccgcgaga

SEQ ID NO: 306345 - RNA, 20 nt, Bordetella pertussis
cgcggcggguggccucgccc

SEQ ID NO: 306346 - RNA, 21 nt, Bordetella pertussis
cgcggcgguccucgccgguca

SEQ ID NO: 306347 - RNA, 20 nt, Bordetella pertussis
cgcggcgucguccaucgacg

SEQ ID NO: 306348 - RNA, 24 nt, Bordetella pertussis
cgcggcgucguccaucgacgcggc

SEQ ID NO: 306349 - RNA, 15 nt, Bordetella pertussis
cgcggcgugcugccc

SEQ ID NO: 306350 - RNA, 17 nt, Bordetella pertussis
cgcggcgugcugcccgc

SEQ ID NO: 306351 - RNA, 22 nt, Bordetella pertussis
cgcggcggguucgcagggcgca

SEQ ID NO: 306352 - RNA, 18 nt, Bordetella pertussis
cgcggcguguagagcugc

SEQ ID NO: 306353 - RNA, 23 nt, Bordetella pertussis
cgcggcguugcggcagcggccca

SEQ ID NO: 306354 - RNA, 15 nt, Bordetella pertussis
cgcggcguugcggcg

SEQ ID NO: 306355 - RNA, 23 nt, Bordetella pertussis
cgcggcuuucgccggaggcgcgc

SEQ ID NO: 306356 - RNA, 21 nt, Bordetella pertussis
cgcgggaagcgcucgcgcagg

SEQ ID NO: 306357 - RNA, 18 nt, Bordetella pertussis
cgcgggaagcugucggcg

SEQ ID NO: 306358 - RNA, 22 nt, Bordetella pertussis
cgcgggagaucuguaccgccgg

SEQ ID NO: 306359 - RNA, 13 nt, Bordetella pertussis
cgcgggagcccgc

SEQ ID NO: 306360 - RNA, 12 nt, Bordetella pertussis
cgcgggccacug

SEQ ID NO: 306361 - RNA, 19 nt, Bordetella pertussis
cgcgggccacugcgccugg

SEQ ID NO: 306362 - RNA, 22 nt, Bordetella pertussis
cgcgggccacugcgccugggcg

SEQ ID NO: 306363 - RNA, 14 nt, Bordetella pertussis
cgcgggccaggccg

SEQ ID NO: 306364 - RNA, 13 nt, Bordetella pertussis
cgcgggccaguug

SEQ ID NO: 306365 - RNA, 15 nt, Bordetella pertussis
cgcgggccaggccgg

SEQ ID NO: 306366 - RNA, 13 nt, Bordetella pertussis
cgcgggccggccg

SEQ ID NO: 306367 - RNA, 18 nt, Bordetella pertussis
cgcgggccuacuugccgg

SEQ ID NO: 306368 - RNA, 14 nt, Bordetella pertussis
cgcgggccugcucg

SEQ ID NO: 306369 - RNA, 15 nt, Bordetella pertussis
cgcgggcggcgccgg

SEQ ID NO: 306370 - RNA, 18 nt, Bordetella pertussis
cgcgggcggcgccggccg

SEQ ID NO: 306371 - RNA, 17 nt, Bordetella pertussis
cgcgggcggcgcgccca

SEQ ID NO: 306372 - RNA, 19 nt, Bordetella pertussis
cgcgggcggccacgcgccg

SEQ ID NO: 306373 - RNA, 20 nt, Bordetella pertussis
cgcgggcggccacgcgccgc

SEQ ID NO: 306374 - RNA, 18 nt, Bordetella pertussis
cgcgggcggcuaggcgca

SEQ ID NO: 306375 - RNA, 21 nt, Bordetella pertussis
cgcgggcggcuaggcgcagca

SEQ ID NO: 306376 - RNA, 14 nt, Bordetella pertussis
cgcgggcgugcugg

SEQ ID NO: 306377 - RNA, 20 nt, Bordetella pertussis
cgcgggcugucgcagucggg

SEQ ID NO: 306378 - RNA, 15 nt, Bordetella pertussis
cgcggggacaggcac

SEQ ID NO: 306379 - RNA, 17 nt, Bordetella pertussis
cgcggggacaggcacac

SEQ ID NO: 306380 - RNA, 17 nt, Bordetella pertussis
cgcggggacaggcaccu

SEQ ID NO: 306381 - RNA, 20 nt, Bordetella pertussis
cgcgggcugcgacaggcgca

SEQ ID NO: 306382 - RNA, 13 nt, Bordetella pertussis
cgcggggcccuug

SEQ ID NO: 306383 - RNA, 12 nt, Bordetella pertussis
cgcggggccagg

SEQ ID NO: 306384 - RNA, 20 nt, Bordetella pertussis
cgcgggggugcgcgacagcu

SEQ ID NO: 306385 - RNA, 22 nt, Bordetella pertussis
cgcggguaggcaaagcgcagca

SEQ ID NO: 306386 - RNA, 19 nt, Bordetella pertussis
aacagcgccugcauccggc

SEQ ID NO: 306387 - RNA, 13 nt, Bordetella pertussis
aacagcuucucca

SEQ ID NO: 306388 - RNA, 17 nt, Bordetella pertussis
aacagcuucuccaugcg

SEQ ID NO: 306389 - RNA, 16 nt, Bordetella pertussis
cgcggguccuugccgg

SEQ ID NO: 306390 - RNA, 19 nt, Bordetella pertussis
cgcgggucuugagcggccc

SEQ ID NO: 306391 - RNA, 13 nt, Bordetella pertussis
cgcggguggccgc

SEQ ID NO: 306392 - RNA, 15 nt, Bordetella pertussis
cgcggguggccggau

SEQ ID NO: 306393 - RNA, 14 nt, Bordetella pertussis
cgcgguagcgcccc

SEQ ID NO: 306394 - RNA, 18 nt, Bordetella pertussis
cgcgguaggacggcagca

SEQ ID NO: 306395 - RNA, 17 nt, Bordetella pertussis
cgcgguagguagcgcgc

SEQ ID NO: 306396 - RNA, 22 nt, Bordetella pertussis
cgcgguagguaugguuggccac

SEQ ID NO: 306397 - RNA, 16 nt, Bordetella pertussis
cgcgguauggccgccc

SEQ ID NO: 306398 - RNA, 19 nt, Bordetella pertussis
cgcgguauggccgcccagc

SEQ ID NO: 306399 - RNA, 20 nt, Bordetella pertussis
cgcgguauggccgcccagca

SEQ ID NO: 306400 - RNA, 22 nt, Bordetella pertussis
cgcgguauucgcgcuggcgcga

SEQ ID NO: 306401 - RNA, 16 nt, Bordetella pertussis
cgcgguauucggcgac

SEQ ID NO: 306402 - RNA, 20 nt, Bordetella pertussis
cgcgguauucggcgaccagg

SEQ ID NO: 306403 - RNA, 21 nt, Bordetella pertussis
cgcgguauucggcgaccaggu

SEQ ID NO: 306404 - RNA, 22 nt, Bordetella pertussis
cgcgguauucggcgaccaggug

SEQ ID NO: 306405 - RNA, 16 nt, Bordetella pertussis
cgcgguauugccggau

SEQ ID NO: 306406 - RNA, 19 nt, Bordetella pertussis
cgcggucaccgagcugagc

SEQ ID NO: 306407 - RNA, 18 nt, Bordetella pertussis
cgcggucgaugaccagcc

SEQ ID NO: 306408 - RNA, 16 nt, Bordetella pertussis
cgcggucgaugcgcac

SEQ ID NO: 306409 - RNA, 22 nt, Bordetella pertussis
cgcggucgcccaacccggcgag

SEQ ID NO: 306410 - RNA, 17 nt, Bordetella pertussis
cgcggucgggaucaucc

SEQ ID NO: 306411 - RNA, 19 nt, Bordetella pertussis
cgcggugccgccuggccag

SEQ ID NO: 306412 - RNA, 20 nt, Bordetella pertussis
cgcggugccgcgcgcggccg

SEQ ID NO: 306413 - RNA, 16 nt, Bordetella pertussis
cgcggugcgcaccagg

SEQ ID NO: 306414 - RNA, 18 nt, Bordetella pertussis
cgcggugcgcaccaggcc

SEQ ID NO: 306415 - RNA, 17 nt, Bordetella pertussis
cgcggugcgccacgaug

SEQ ID NO: 306416 - RNA, 18 nt, Bordetella pertussis
cgcggugcgggugggcgc

SEQ ID NO: 306417 - RNA, 22 nt, Bordetella pertussis
cgcggugcgggugggcgcgccg

SEQ ID NO: 306418 - RNA, 17 nt, Bordetella pertussis
cgcggugcucggcgaac

SEQ ID NO: 306419 - RNA, 22 nt, Bordetella pertussis
cgcggugcucggcgaacugggc

SEQ ID NO: 306420 - RNA, 14 nt, Bordetella pertussis
cgcgguggcacgac

SEQ ID NO: 306421 - RNA, 20 nt, Bordetella pertussis
cgcgguggccagcgaaccga

SEQ ID NO: 306422 - RNA, 16 nt, Bordetella pertussis
cgcgguggccaugcug

SEQ ID NO: 306423 - RNA, 19 nt, Bordetella pertussis
cgcgguggccaugcugggc

SEQ ID NO: 306424 - RNA, 22 nt, Bordetella pertussis
cgcgguggccaugcugggcggg

SEQ ID NO: 306425 - RNA, 12 nt, Bordetella pertussis
cgcgguggccgc

SEQ ID NO: 306426 - RNA, 21 nt, Bordetella pertussis
cgcgguggccgccgcgcgccg

SEQ ID NO: 306427 - RNA, 19 nt, Bordetella pertussis
cgcgguggccgcuucggcg

SEQ ID NO: 306428 - RNA, 14 nt, Bordetella pertussis
cgcgguucaucgcc

SEQ ID NO: 306429 - RNA, 17 nt, Bordetella pertussis
cgcgguugagcgccagg

SEQ ID NO: 306430 - RNA, 17 nt, Bordetella pertussis
cgcgguugcgucucggc

SEQ ID NO: 306431 - RNA, 14 nt, Bordetella pertussis
cgcgguugggcgga

SEQ ID NO: 306432 - RNA, 15 nt, Bordetella pertussis
cgcguacaacgccgc

SEQ ID NO: 306433 - RNA, 16 nt, Bordetella pertussis
cgcguacaacgccgcg

SEQ ID NO: 306434 - RNA, 20 nt, Bordetella pertussis
cgcguacaacgccgcguccg

SEQ ID NO: 306435 - RNA, 18 nt, Bordetella pertussis
cgcguacagcccgaacag

SEQ ID NO: 306436 - RNA, 22 nt, Bordetella pertussis
cgcguaguccgaaucuucgaug

SEQ ID NO: 306437 - RNA, 17 nt, Bordetella pertussis
cgcguaguccgagcccg

SEQ ID NO: 306438 - RNA, 18 nt, Bordetella pertussis
cgcguaugacgcgcugau

SEQ ID NO: 306439 - RNA, 17 nt, Bordetella pertussis
cgcguaugcaccgggcc

SEQ ID NO: 306440 - RNA, 14 nt, Bordetella pertussis
cgcguaugcccugc

SEQ ID NO: 306441 - RNA, 22 nt, Bordetella pertussis
cgcguaugcggcagcagggcca

SEQ ID NO: 306442 - RNA, 14 nt, Bordetella pertussis
cgcguauggcggcg

SEQ ID NO: 306443 - RNA, 14 nt, Bordetella pertussis
cgcgucaaggggcu

SEQ ID NO: 306444 - RNA, 20 nt, Bordetella pertussis
cgcgucacaaagacggcuug

SEQ ID NO: 306445 - RNA, 20 nt, Bordetella pertussis
cgcgucgccgccguuuucgc

SEQ ID NO: 306446 - RNA, 13 nt, Bordetella pertussis
cgcgucgccgcgc

SEQ ID NO: 306447 - RNA, 14 nt, Bordetella pertussis
cgcgucgccgcgcc

SEQ ID NO: 306448 - RNA, 15 nt, Bordetella pertussis
cgcgucgccgcuggc

SEQ ID NO: 306449 - RNA, 18 nt, Bordetella pertussis
cgcgucgccgcuggccag

SEQ ID NO: 306450 - RNA, 14 nt, Bordetella pertussis
cgcgucgcgcgcca

SEQ ID NO: 306451 - RNA, 16 nt, Bordetella pertussis
cgcgucgcgcgccagg

SEQ ID NO: 306452 - RNA, 17 nt, Bordetella pertussis
cgcgucgcgcggcggca

SEQ ID NO: 306453 - RNA, 19 nt, Bordetella pertussis
cgcgucgcguagcgcggcc

SEQ ID NO: 306454 - RNA, 23 nt, Bordetella pertussis
cgcgucgcguagcgcggccgggu

SEQ ID NO: 306455 - RNA, 16 nt, Bordetella pertussis
cgcgucgcugucggcg

SEQ ID NO: 306456 - RNA, 24 nt, Bordetella pertussis
cgcgucggacgcgcgccgcaucau

SEQ ID NO: 306457 - RNA, 20 nt, Bordetella pertussis
cgcgucgguggccagccagg

SEQ ID NO: 306458 - RNA, 22 nt, Bordetella pertussis
cgcgucgucguuucccagcaag

SEQ ID NO: 306459 - RNA, 13 nt, Bordetella pertussis
cgcgucgugcccg

SEQ ID NO: 306460 - RNA, 18 nt, Bordetella pertussis
cgcgucgugcccgccacc

SEQ ID NO: 306461 - RNA, 17 nt, Bordetella pertussis
cgcgucuccagcgccgg

SEQ ID NO: 306462 - RNA, 13 nt, Bordetella pertussis
cgcgucugggccg

SEQ ID NO: 306463 - RNA, 18 nt, Bordetella pertussis
cgcgucuucggcgcggcg

SEQ ID NO: 306464 - RNA, 16 nt, Bordetella pertussis
cgcgucuuggcgggca

SEQ ID NO: 306465 - RNA, 16 nt, Bordetella pertussis
cgcgugaacggcucga

SEQ ID NO: 306466 - RNA, 23 nt, Bordetella pertussis
cgcguggaagguccacggcaugg

SEQ ID NO: 306467 - RNA, 18 nt, Bordetella pertussis
cgcguggccacggcgucg

SEQ ID NO: 306468 - RNA, 19 nt, Bordetella pertussis
cgcguggccacggcgucga

SEQ ID NO: 306469 - RNA, 16 nt, Bordetella pertussis
cgcguggccagcacgg

SEQ ID NO: 306470 - RNA, 16 nt, Bordetella pertussis
cgcguggccaucaacg

SEQ ID NO: 306471 - RNA, 17 nt, Bordetella pertussis
cgcguggcccgcgccgc

SEQ ID NO: 306472 - RNA, 13 nt, Bordetella pertussis
cgcguggccggcg

SEQ ID NO: 306473 - RNA, 14 nt, Bordetella pertussis
cgcguggccggcga

SEQ ID NO: 306474 - RNA, 15 nt, Bordetella pertussis
cgcguggccggcgac

SEQ ID NO: 306475 - RNA, 21 nt, Bordetella pertussis
cgcguggccggcgacggcauc

SEQ ID NO: 306476 - RNA, 15 nt, Bordetella pertussis
cgcguggcgcccagc

SEQ ID NO: 306477 - RNA, 17 nt, Bordetella pertussis
cgcguggcgcgccagcg

SEQ ID NO: 306478 - RNA, 18 nt, Bordetella pertussis
cgcguggcgcgccagcgc

SEQ ID NO: 306479 - RNA, 20 nt, Bordetella pertussis
cgcguggcgcgccagcgcca

SEQ ID NO: 306480 - RNA, 19 nt, Bordetella pertussis
cgcguggcgcugcguccgg

SEQ ID NO: 306481 - RNA, 17 nt, Bordetella pertussis
cgcguggcggcgcagcg

SEQ ID NO: 306482 - RNA, 18 nt, Bordetella pertussis
cgcgugggcacccggccg

SEQ ID NO: 306483 - RNA, 21 nt, Bordetella pertussis
cgcgugggcacccggccgcug

SEQ ID NO: 306484 - RNA, 23 nt, Bordetella pertussis
cgcgugggcaggugcuuggcggu

SEQ ID NO: 306485 - RNA, 16 nt, Bordetella pertussis
cgcgugggcauggugg

SEQ ID NO: 306486 - RNA, 15 nt, Bordetella pertussis
cgcgugggccagcaa

SEQ ID NO: 306487 - RNA, 15 nt, Bordetella pertussis
cgcgugguggcgcag

SEQ ID NO: 306488 - RNA, 17 nt, Bordetella pertussis
cgcgugucaugcugucg

SEQ ID NO: 306489 - RNA, 19 nt, Bordetella pertussis
cgcgugucccagccggcgg

SEQ ID NO: 306490 - RNA, 20 nt, Bordetella pertussis
cgcgugucccagccggcggc

SEQ ID NO: 306491 - RNA, 18 nt, Bordetella pertussis
cgcguucaagucgcccug

SEQ ID NO: 306492 - RNA, 16 nt, Bordetella pertussis
cgcguucagcagcagg

SEQ ID NO: 306493 - RNA, 17 nt, Bordetella pertussis
cgcguucaggcgcggcu

SEQ ID NO: 306494 - RNA, 16 nt, Bordetella pertussis
cgcguucagggcgccg

SEQ ID NO: 306495 - RNA, 15 nt, Bordetella pertussis
cgcguucacgccggc

SEQ ID NO: 306496 - RNA, 15 nt, Bordetella pertussis
cgcguugagcagcau

SEQ ID NO: 306497 - RNA, 16 nt, Bordetella pertussis
cgcguugagcagcaug

SEQ ID NO: 306498 - RNA, 22 nt, Bordetella pertussis
cgcguugagcgccgacgggccg

SEQ ID NO: 306499 - RNA, 19 nt, Bordetella pertussis
cgcguugaucaucggcccg

SEQ ID NO: 306500 - RNA, 22 nt, Bordetella pertussis
cgcguugcgcaucgcgcacccg

SEQ ID NO: 306501 - RNA, 17 nt, Bordetella pertussis
cgcuacgcggcgucagg

SEQ ID NO: 306502 - RNA, 19 nt, Bordetella pertussis
cgcuacgggcgcugcacgc

SEQ ID NO: 306503 - RNA, 17 nt, Bordetella pertussis
cgcuacguguccugccg

SEQ ID NO: 306504 - RNA, 18 nt, Bordetella pertussis
cgcuacguguccugccgg

SEQ ID NO: 306505 - RNA, 13 nt, Bordetella pertussis
cgcuaggaucgcg

SEQ ID NO: 306506 - RNA, 14 nt, Bordetella pertussis
cgcuaggaucgcga

SEQ ID NO: 306507 - RNA, 18 nt, Bordetella pertussis
cgcuaggccuugccgccg

SEQ ID NO: 306508 - RNA, 17 nt, Bordetella pertussis
cgcuagggcguggcgcg

SEQ ID NO: 306509 - RNA, 16 nt, Bordetella pertussis
cgcuaucauccgcgca

SEQ ID NO: 306510 - RNA, 21 nt, Bordetella pertussis
cgcucaacagcuugcccacgc

SEQ ID NO: 306511 - RNA, 19 nt, Bordetella pertussis
cgcucaauucggccugacg

SEQ ID NO: 306512 - RNA, 19 nt, Bordetella pertussis
cgcucaucaucgcgcuggc

SEQ ID NO: 306513 - RNA, 16 nt, Bordetella pertussis
cgcucauccaggcgcg

SEQ ID NO: 306514 - RNA, 18 nt, Bordetella pertussis
cgcucaugaccagcggcg

SEQ ID NO: 306515 - RNA, 14 nt, Bordetella pertussis
cgcucaugccggca

SEQ ID NO: 306516 - RNA, 15 nt, Bordetella pertussis
cgcuccagagcgcgc

SEQ ID NO: 306517 - RNA, 18 nt, Bordetella pertussis
cgcuccagcgucauggcc

SEQ ID NO: 306518 - RNA, 22 nt, Bordetella pertussis
cgcuccagcgucauggccuggc

SEQ ID NO: 306519 - RNA, 17 nt, Bordetella pertussis
cgcuccaggcggccagu

SEQ ID NO: 306520 - RNA, 19 nt, Bordetella pertussis
cgcucgaccuugucgcccg

SEQ ID NO: 306521 - RNA, 21 nt, Bordetella pertussis
cgcucgaccuugucgcccgau

SEQ ID NO: 306522 - RNA, 18 nt, Bordetella pertussis
cgcucgacgaagcccgug

SEQ ID NO: 306523 - RNA, 23 nt, Bordetella pertussis
cgcucgacgaagcccgugucggc

SEQ ID NO: 306524 - RNA, 18 nt, Bordetella pertussis
cgcucgagcgcggcgcgc

SEQ ID NO: 306525 - RNA, 16 nt, Bordetella pertussis
cgcucgaggccaggcu

SEQ ID NO: 306526 - RNA, 16 nt, Bordetella pertussis
cgcucgaggcgcuggc

SEQ ID NO: 306527 - RNA, 23 nt, Bordetella pertussis
cgcucgaggcgcuggcguccagc

SEQ ID NO: 306528 - RNA, 17 nt, Bordetella pertussis
cgcucgaugcgccaguc

SEQ ID NO: 306529 - RNA, 16 nt, Bordetella pertussis
cgcucgcccggccacg

SEQ ID NO: 306530 - RNA, 17 nt, Bordetella pertussis
cgcucgcccggccacgu

SEQ ID NO: 306531 - RNA, 13 nt, Bordetella pertussis
cgcucgcccucgc

SEQ ID NO: 306532 - RNA, 13 nt, Bordetella pertussis
cgcucgccggcgc

SEQ ID NO: 306533 - RNA, 15 nt, Bordetella pertussis
cgcucgccggcgcgc

SEQ ID NO: 306534 - RNA, 16 nt, Bordetella pertussis
cgcucgccggcgcgca

SEQ ID NO: 306535 - RNA, 19 nt, Bordetella pertussis
cgcucgccggcgcgcaggc

SEQ ID NO: 306536 - RNA, 17 nt, Bordetella pertussis
cgcucgccgucgacgcc

SEQ ID NO: 306537 - RNA, 18 nt, Bordetella pertussis
cgcucgccgucgacgccg

SEQ ID NO: 306538 - RNA, 20 nt, Bordetella pertussis
cgcucgcgcaccgcaugggc

SEQ ID NO: 306539 - RNA, 17 nt, Bordetella pertussis
cgcucgcgccaggcccc

SEQ ID NO: 306540 - RNA, 16 nt, Bordetella pertussis
cgcucgcgcucggcca

SEQ ID NO: 306541 - RNA, 14 nt, Bordetella pertussis
cgcucgcgggugcg

SEQ ID NO: 306542 - RNA, 18 nt, Bordetella pertussis
cgcucgcgggugcgcagc

SEQ ID NO: 306543 - RNA, 17 nt, Bordetella pertussis
cgcucgcucacggggcu

SEQ ID NO: 306544 - RNA, 14 nt, Bordetella pertussis
cgcucgcugccggc

SEQ ID NO: 306545 - RNA, 12 nt, Bordetella pertussis
cgcucggccacg

SEQ ID NO: 306546 - RNA, 19 nt, Bordetella pertussis
cgcucggccacgcgcugcu

SEQ ID NO: 306547 - RNA, 12 nt, Bordetella pertussis
cgcucggccagc

SEQ ID NO: 306548 - RNA, 17 nt, Bordetella pertussis
cgcucggccagcaugcg

SEQ ID NO: 306549 - RNA, 13 nt, Bordetella pertussis
cgcucggccagcg

SEQ ID NO: 306550 - RNA, 18 nt, Bordetella pertussis
cgcucggccagcgaggcc

SEQ ID NO: 306551 - RNA, 14 nt, Bordetella pertussis
cgcucggccagcgc

SEQ ID NO: 306552 - RNA, 16 nt, Bordetella pertussis
cgcucggccagcgcgc

SEQ ID NO: 306553 - RNA, 14 nt, Bordetella pertussis
cgcucggccucccg

SEQ ID NO: 306554 - RNA, 18 nt, Bordetella pertussis
cgcucggccucggucagg

SEQ ID NO: 306555 - RNA, 15 nt, Bordetella pertussis
cgcucggccuugccg

SEQ ID NO: 306556 - RNA, 18 nt, Bordetella pertussis
cgcucggcgacggucagg

SEQ ID NO: 306557 - RNA, 15 nt, Bordetella pertussis
cgcucggcgccgggc

SEQ ID NO: 306558 - RNA, 16 nt, Bordetella pertussis
cgcucggcgccgggcu

SEQ ID NO: 306559 - RNA, 15 nt, Bordetella pertussis
cgcucggcgcugccg

SEQ ID NO: 306560 - RNA, 17 nt, Bordetella pertussis
cgcucggcuuccugccg

SEQ ID NO: 306561 - RNA, 13 nt, Bordetella pertussis
cgcucgggcgcgg

SEQ ID NO: 306562 - RNA, 14 nt, Bordetella pertussis
cgcucgguccagac

SEQ ID NO: 306563 - RNA, 19 nt, Bordetella pertussis
cgcucgguguggauggcgg

SEQ ID NO: 306564 - RNA, 16 nt, Bordetella pertussis
cgcucguugcgcguga

SEQ ID NO: 306565 - RNA, 17 nt, Bordetella pertussis
cgcucuacacggccgcc

SEQ ID NO: 306566 - RNA, 18 nt, Bordetella pertussis
cgcucuacacggccgcca

SEQ ID NO: 306567 - RNA, 19 nt, Bordetella pertussis
cgcucuccgaacaggcggu

SEQ ID NO: 306568 - RNA, 14 nt, Bordetella pertussis
cgcucugcgcggca

SEQ ID NO: 306569 - RNA, 16 nt, Bordetella pertussis
cgcucuugagcgcggc

SEQ ID NO: 306570 - RNA, 18 nt, Bordetella pertussis
cgcucuugagcgcggccu

SEQ ID NO: 306571 - RNA, 23 nt, Bordetella pertussis
cgcucuuggcgugcuugccgccg

SEQ ID NO: 306572 - RNA, 17 nt, Bordetella pertussis
cgcucuugcgcgcgccg

SEQ ID NO: 306573 - RNA, 18 nt, Bordetella pertussis
cgcugaagcgccgccaca

SEQ ID NO: 306574 - RNA, 16 nt, Bordetella pertussis
cgcugacccuggccga

SEQ ID NO: 306575 - RNA, 19 nt, Bordetella pertussis
cgcugacccuggccgaacg

SEQ ID NO: 306576 - RNA, 12 nt, Bordetella pertussis
cgcugaccggcg

SEQ ID NO: 306577 - RNA, 14 nt, Bordetella pertussis
cgcugaccggcggc

SEQ ID NO: 306578 - RNA, 17 nt, Bordetella pertussis
cgcugaccggcggcacg

SEQ ID NO: 306579 - RNA, 21 nt, Bordetella pertussis
cgcugaccggcggcacggccg

SEQ ID NO: 306580 - RNA, 22 nt, Bordetella pertussis
cgcugaccggcguauggcccgc

SEQ ID NO: 306581 - RNA, 23 nt, Bordetella pertussis
cgcugaccugcacgauggcgccg

SEQ ID NO: 306582 - RNA, 19 nt, Bordetella pertussis
cgcugaccuggugugccug

SEQ ID NO: 306583 - RNA, 19 nt, Bordetella pertussis
cgcugacugcggugccugu

SEQ ID NO: 306584 - RNA, 20 nt, Bordetella pertussis
cgcugacugcggugccuguc

SEQ ID NO: 306585 - RNA, 14 nt, Bordetella pertussis
cgcugacugggcgg

SEQ ID NO: 306586 - RNA, 20 nt, Bordetella pertussis
cggacagggccgcgagcaug

SEQ ID NO: 306587 - RNA, 23 nt, Bordetella pertussis
cggacagggccgcgagcaugcgc

SEQ ID NO: 306588 - RNA, 16 nt, Bordetella pertussis
cggacaggucggcgcc

SEQ ID NO: 306589 - RNA, 18 nt, Bordetella pertussis
cggaccagcgguugcgcc

SEQ ID NO: 306590 - RNA, 23 nt, Bordetella pertussis
cggaccagcgguugcgccagcuu

SEQ ID NO: 306591 - RNA, 17 nt, Bordetella pertussis
cggacccaggccucggc

SEQ ID NO: 306592 - RNA, 17 nt, Bordetella pertussis
cggacccgcgccgcagg

SEQ ID NO: 306593 - RNA, 15 nt, Bordetella pertussis
cggaccguuccagac

SEQ ID NO: 306594 - RNA, 18 nt, Bordetella pertussis
cggaccuggccagcgugg

SEQ ID NO: 306595 - RNA, 16 nt, Bordetella pertussis
cggaccuugcgaggcc

SEQ ID NO: 306596 - RNA, 13 nt, Bordetella pertussis
cggacgaagccua

SEQ ID NO: 306597 - RNA, 14 nt, Bordetella pertussis
cggacgaagccuag

SEQ ID NO: 306598 - RNA, 16 nt, Bordetella pertussis
cggacgagacaggcgc

SEQ ID NO: 306599 - RNA, 17 nt, Bordetella pertussis
cggacgagacaggcgcg

SEQ ID NO: 306600 - RNA, 20 nt, Bordetella pertussis
cggacgagacaggcgcgcca

SEQ ID NO: 306601 - RNA, 15 nt, Bordetella pertussis
cggacgagcgcagca

SEQ ID NO: 306602 - RNA, 21 nt, Bordetella pertussis
cggacgagcgcagcaagcugc

SEQ ID NO: 306603 - RNA, 12 nt, Bordetella pertussis
cggacgauggcc

SEQ ID NO: 306604 - RNA, 16 nt, Bordetella pertussis
cggacgauggccugug

SEQ ID NO: 306605 - RNA, 21 nt, Bordetella pertussis
cggacgauggccugugcggcc

SEQ ID NO: 306606 - RNA, 19 nt, Bordetella pertussis
cggacgauguagaucuggc

SEQ ID NO: 306607 - RNA, 23 nt, Bordetella pertussis
cggacgauguagaucuggcgcgu

SEQ ID NO: 306608 - RNA, 19 nt, Bordetella pertussis
cggacgccauggcggcggc

SEQ ID NO: 306609 - RNA, 21 nt, Bordetella pertussis
cggacgcccugaacuauggcg

SEQ ID NO: 306610 - RNA, 14 nt, Bordetella pertussis
cggacgccucgccg

SEQ ID NO: 306611 - RNA, 13 nt, Bordetella pertussis
cggacgccuggcg

SEQ ID NO: 306612 - RNA, 14 nt, Bordetella pertussis
cggacgcgccgggc

SEQ ID NO: 306613 - RNA, 13 nt, Bordetella pertussis
cggacgcgcgccg

SEQ ID NO: 306614 - RNA, 14 nt, Bordetella pertussis
cggacgcgcgccgc

SEQ ID NO: 306615 - RNA, 16 nt, Bordetella pertussis
cggacgcggggauggc

SEQ ID NO: 306616 - RNA, 23 nt, Bordetella pertussis
cggacggauagugguucaugcgu

SEQ ID NO: 306617 - RNA, 21 nt, Bordetella pertussis
cggacggguaucgucgaccug

SEQ ID NO: 306618 - RNA, 21 nt, Bordetella pertussis
cggacgguagcgcacgcaccg

SEQ ID NO: 306619 - RNA, 16 nt, Bordetella pertussis
cggacgggccaggccg

SEQ ID NO: 306620 - RNA, 17 nt, Bordetella pertussis
cggacgggccaggccga

SEQ ID NO: 306621 - RNA, 18 nt, Bordetella pertussis
cggacguagucgcacgcg

SEQ ID NO: 306622 - RNA, 23 nt, Bordetella pertussis
cggacgugggcgccuacggcggc

SEQ ID NO: 306623 - RNA, 19 nt, Bordetella pertussis
cggacuggauauggcgccg

SEQ ID NO: 306624 - RNA, 21 nt, Bordetella pertussis
cggacuggauauggcgccgca

SEQ ID NO: 306625 - RNA, 14 nt, Bordetella pertussis
cggacuggccgcgc

SEQ ID NO: 306626 - RNA, 16 nt, Bordetella pertussis
cggacuggccgcgccg

SEQ ID NO: 306627 - RNA, 14 nt, Bordetella pertussis
cggacuggcgcgca

SEQ ID NO: 306628 - RNA, 21 nt, Bordetella pertussis
cggacuggcuggucaggcggu

SEQ ID NO: 306629 - RNA, 21 nt, Bordetella pertussis
cggacuucgcuuucgguggcg

SEQ ID NO: 306630 - RNA, 22 nt, Bordetella pertussis
cggacuucgcuuucgguggcgu

SEQ ID NO: 306631 - RNA, 15 nt, Bordetella pertussis
cggagcagcagcggg

SEQ ID NO: 306632 - RNA, 12 nt, Bordetella pertussis
cggagccgcgca

SEQ ID NO: 306633 - RNA, 14 nt, Bordetella pertussis
cggagccgcgcaca

SEQ ID NO: 306634 - RNA, 15 nt, Bordetella pertussis
cggagccugucccug

SEQ ID NO: 306635 - RNA, 20 nt, Bordetella pertussis
cggagcggcucuggaucgug

SEQ ID NO: 306636 - RNA, 14 nt, Bordetella pertussis
cggagcgacggcag

SEQ ID NO: 306637 - RNA, 16 nt, Bordetella pertussis
cggagcugccgaaucg

SEQ ID NO: 306638 - RNA, 11 nt, Bordetella pertussis
cggaggcgcgc

SEQ ID NO: 306639 - RNA, 18 nt, Bordetella pertussis
cggaggcgcgcagcuccg

SEQ ID NO: 306640 - RNA, 15 nt, Bordetella pertussis
cggaggcggccgcgg

SEQ ID NO: 306641 - RNA, 20 nt, Bordetella pertussis
cggaggcggccgcgggcggc

SEQ ID NO: 306642 - RNA, 22 nt, Bordetella pertussis
cggagucgccccgacgcgcuuc

SEQ ID NO: 306643 - RNA, 14 nt, Bordetella pertussis
cggagucggcgccg

SEQ ID NO: 306644 - RNA, 17 nt, Bordetella pertussis
cggauaacaucaugggc

SEQ ID NO: 306645 - RNA, 17 nt, Bordetella pertussis
cggauaauugggcggca

SEQ ID NO: 306646 - RNA, 20 nt, Bordetella pertussis
cggauaauugggcggcaucu

SEQ ID NO: 306647 - RNA, 14 nt, Bordetella pertussis
cggauaccgccgcc

SEQ ID NO: 306648 - RNA, 17 nt, Bordetella pertussis
cggauaccgccgccgcu

SEQ ID NO: 306649 - RNA, 20 nt, Bordetella pertussis
cggauacgaaaccaggccgg

SEQ ID NO: 306650 - RNA, 15 nt, Bordetella pertussis
cggauagcggugcag

SEQ ID NO: 306651 - RNA, 15 nt, Bordetella pertussis
cggauauucgucggc

SEQ ID NO: 306652 - RNA, 19 nt, Bordetella pertussis
cggauauucgucggccgcc

SEQ ID NO: 306653 - RNA, 24 nt, Bordetella pertussis
cggauauucgucggccgccgccgu

SEQ ID NO: 306654 - RNA, 13 nt, Bordetella pertussis
cggaucaagcggc

SEQ ID NO: 306655 - RNA, 16 nt, Bordetella pertussis
cggaucaagcggcccg

SEQ ID NO: 306656 - RNA, 19 nt, Bordetella pertussis
cggaucaagcggcccgcgc

SEQ ID NO: 306657 - RNA, 16 nt, Bordetella pertussis
cggaucacccagcggc

SEQ ID NO: 306658 - RNA, 22 nt, Bordetella pertussis
cggaucacccagcggcuggcca

SEQ ID NO: 306659 - RNA, 21 nt, Bordetella pertussis
cggaucagcgccucaucguuc

SEQ ID NO: 306660 - RNA, 15 nt, Bordetella pertussis
cggaucaguccgggc

SEQ ID NO: 306661 - RNA, 15 nt, Bordetella pertussis
cggaucauccgggcc

SEQ ID NO: 306662 - RNA, 17 nt, Bordetella pertussis
cggaucauccgggcccg

SEQ ID NO: 306663 - RNA, 22 nt, Bordetella pertussis
cggaucaugggcucgcgcgagc

SEQ ID NO: 306664 - RNA, 18 nt, Bordetella pertussis
cggaucauugggucugcg

SEQ ID NO: 306665 - RNA, 22 nt, Bordetella pertussis
cggauccagccauggaagcggc

SEQ ID NO: 306666 - RNA, 19 nt, Bordetella pertussis
cggauccagcgaggcaucg

SEQ ID NO: 306667 - RNA, 15 nt, Bordetella pertussis
cggaucccaggccgg

SEQ ID NO: 306668 - RNA, 16 nt, Bordetella pertussis
cggaucgaacgccucg

SEQ ID NO: 306669 - RNA, 16 nt, Bordetella pertussis
cggaucgccgggcagg

SEQ ID NO: 306670 - RNA, 20 nt, Bordetella pertussis
cggaucgcacacaccgcguc

SEQ ID NO: 306671 - RNA, 17 nt, Bordetella pertussis
cggaucgcggcgcggcu

SEQ ID NO: 306672 - RNA, 14 nt, Bordetella pertussis
cggaucggccacga

SEQ ID NO: 306673 - RNA, 14 nt, Bordetella pertussis
cggaucggccggca

SEQ ID NO: 306674 - RNA, 16 nt, Bordetella pertussis
cggaucggccggcagc

SEQ ID NO: 306675 - RNA, 16 nt, Bordetella pertussis
cggaucggggcaacga

SEQ ID NO: 306676 - RNA, 14 nt, Bordetella pertussis
cggaucucggccag

SEQ ID NO: 306677 - RNA, 22 nt, Bordetella pertussis
cggaucucggccagcagcgccu

SEQ ID NO: 306678 - RNA, 17 nt, Bordetella pertussis
cggaucuuccuugaagc

SEQ ID NO: 306679 - RNA, 17 nt, Bordetella pertussis
cggaugaacgaccagca

SEQ ID NO: 306680 - RNA, 17 nt, Bordetella pertussis
cggaugaagggcuggcc

SEQ ID NO: 306681 - RNA, 15 nt, Bordetella pertussis
cggaugaccugcgcc

SEQ ID NO: 306682 - RNA, 23 nt, Bordetella pertussis
cggaugaccuggugcaccacgcg

SEQ ID NO: 306683 - RNA, 15 nt, Bordetella pertussis
cggaugagcaggccg

SEQ ID NO: 306684 - RNA, 17 nt, Bordetella pertussis
cggaugagcaggccggg

SEQ ID NO: 306685 - RNA, 21 nt, Bordetella pertussis
cggaugaugcggcgccacgca

SEQ ID NO: 306686 - RNA, 20 nt, Bordetella pertussis
cggaugcacguagcgcagca

SEQ ID NO: 306687 - RNA, 16 nt, Bordetella pertussis
cggaugaugggcaucg

SEQ ID NO: 306688 - RNA, 11 nt, Bordetella pertussis
cggaugccacc

SEQ ID NO: 306689 - RNA, 14 nt, Bordetella pertussis
cggaugccgcccgu

SEQ ID NO: 306690 - RNA, 18 nt, Bordetella pertussis
cggaugccguccacgccg

SEQ ID NO: 306691 - RNA, 21 nt, Bordetella pertussis
cggaugccguccacgccgcgc

SEQ ID NO: 306692 - RNA, 17 nt, Bordetella pertussis
cggaugcgcaggacggc

SEQ ID NO: 306693 - RNA, 22 nt, Bordetella pertussis
cggaugcgcaggacggcgccgu

SEQ ID NO: 306694 - RNA, 23 nt, Bordetella pertussis
cggaugcgcguugccggugcgcg

SEQ ID NO: 306695 - RNA, 21 nt, Bordetella pertussis
cggaugcgguacugcggcgcc

SEQ ID NO: 306696 - RNA, 17 nt, Bordetella pertussis
cggaugcuugcggggca

SEQ ID NO: 306697 - RNA, 13 nt, Bordetella pertussis
cggauggcgcgga

SEQ ID NO: 306698 - RNA, 16 nt, Bordetella pertussis
cggauggugcucggcg

SEQ ID NO: 306699 - RNA, 18 nt, Bordetella pertussis
cggauugaccagcgcggc

SEQ ID NO: 306700 - RNA, 19 nt, Bordetella pertussis
cggauugaccagcgcggcc

SEQ ID NO: 306701 - RNA, 21 nt, Bordetella pertussis
cggauugaccagcgcggccgu

SEQ ID NO: 306702 - RNA, 17 nt, Bordetella pertussis
cggauugcuugacgccg

SEQ ID NO: 306703 - RNA, 19 nt, Bordetella pertussis
cggauugcuugacgccgcc

SEQ ID NO: 306704 - RNA, 16 nt, Bordetella pertussis
cggauuggacagcagu

SEQ ID NO: 306705 - RNA, 19 nt, Bordetella pertussis
cggcaaaaaaaaccgcgcg

SEQ ID NO: 306706 - RNA, 22 nt, Bordetella pertussis
cggcaaaaaaaaccgcgcgccg

SEQ ID NO: 306707 - RNA, 13 nt, Bordetella pertussis
cggcaaacccggc

SEQ ID NO: 306708 - RNA, 17 nt, Bordetella pertussis
cggcaaacuuccccgcg

SEQ ID NO: 306709 - RNA, 20 nt, Bordetella pertussis
cggcaaagccgcugcgcugg

SEQ ID NO: 306710 - RNA, 18 nt, Bordetella pertussis
cggcaacccgcccacgcg

SEQ ID NO: 306711 - RNA, 22 nt, Bordetella pertussis
cggcaacccgcccacgcggcgc

SEQ ID NO: 306712 - RNA, 13 nt, Bordetella pertussis
cggcaaccgcgcc

SEQ ID NO: 306713 - RNA, 15 nt, Bordetella pertussis
cggcaaccgucgcca

SEQ ID NO: 306714 - RNA, 18 nt, Bordetella pertussis
cggcaaccgucgccagcg

SEQ ID NO: 306715 - RNA, 19 nt, Bordetella pertussis
cggcaaccgucgccagcgc

SEQ ID NO: 306716 - RNA, 18 nt, Bordetella pertussis
cggcaacguggugcucag

SEQ ID NO: 306717 - RNA, 16 nt, Bordetella pertussis
cggcaacgugcaggcc

SEQ ID NO: 306718 - RNA, 15 nt, Bordetella pertussis
cggcaagacggcgcu

SEQ ID NO: 306719 - RNA, 17 nt, Bordetella pertussis
cggcaagaucgccggcu

SEQ ID NO: 306720 - RNA, 16 nt, Bordetella pertussis
cggcaagcagccggaa

SEQ ID NO: 306721 - RNA, 15 nt, Bordetella pertussis
cggcaagccgcggcg

SEQ ID NO: 306722 - RNA, 18 nt, Bordetella pertussis
cggcaagccuugcggccc

SEQ ID NO: 306723 - RNA, 19 nt, Bordetella pertussis
cggcaagccuugcggcuug

SEQ ID NO: 306724 - RNA, 20 nt, Bordetella pertussis
cggcaagcgcucgccggcgc

SEQ ID NO: 306725 - RNA, 21 nt, Bordetella pertussis
cggcaagcgcucgccggcgcg

SEQ ID NO: 306726 - RNA, 14 nt, Bordetella pertussis
cggcaagcggcgug

SEQ ID NO: 306727 - RNA, 15 nt, Bordetella pertussis
cggcaagcggcgugg

SEQ ID NO: 306728 - RNA, 21 nt, Bordetella pertussis
cggcaagggugccuguccccg

SEQ ID NO: 306729 - RNA, 17 nt, Bordetella pertussis
cggcaaggucagcagca

SEQ ID NO: 306730 - RNA, 17 nt, Bordetella pertussis
cggcaagguccaggcgc

SEQ ID NO: 306731 - RNA, 17 nt, Bordetella pertussis
cggcaaguucgcugccg

SEQ ID NO: 306732 - RNA, 14 nt, Bordetella pertussis
cggcaaucccggcg

SEQ ID NO: 306733 - RNA, 17 nt, Bordetella pertussis
cggcaaucuugccgccg

SEQ ID NO: 306734 - RNA, 20 nt, Bordetella pertussis
cggcaaucuugccgccgggc

SEQ ID NO: 306735 - RNA, 16 nt, Bordetella pertussis
cggcaaugccugcgcg

SEQ ID NO: 306736 - RNA, 22 nt, Bordetella pertussis
cggcaaugccugcgcgaugcgc

SEQ ID NO: 306737 - RNA, 14 nt, Bordetella pertussis
cggcaaugcgcgcg

SEQ ID NO: 306738 - RNA, 15 nt, Bordetella pertussis
cggcaauguccgggg

SEQ ID NO: 306739 - RNA, 17 nt, Bordetella pertussis
cggcaauguccggggcg

SEQ ID NO: 306740 - RNA, 17 nt, Bordetella pertussis
cggcaaugucgcaggcc

SEQ ID NO: 306741 - RNA, 19 nt, Bordetella pertussis
cggcaaugucgcaggccgc

SEQ ID NO: 306742 - RNA, 13 nt, Bordetella pertussis
cggcacaaccugg

SEQ ID NO: 306743 - RNA, 15 nt, Bordetella pertussis
cggcacaaccuggcg

SEQ ID NO: 306744 - RNA, 18 nt, Bordetella pertussis
cggcacaaccuggcgcgc

SEQ ID NO: 306745 - RNA, 14 nt, Bordetella pertussis
cggcaccacgaccg

SEQ ID NO: 306746 - RNA, 19 nt, Bordetella pertussis
cggcaccacgaccggcucg

SEQ ID NO: 306747 - RNA, 20 nt, Bordetella pertussis
cggcaccacgaccggcucgg

SEQ ID NO: 306748 - RNA, 14 nt, Bordetella pertussis
cggcaccagccggg

SEQ ID NO: 306749 - RNA, 15 nt, Bordetella pertussis
cggcaccagccgggc

SEQ ID NO: 306750 - RNA, 16 nt, Bordetella pertussis
cggcaccagccgggcu

SEQ ID NO: 306751 - RNA, 13 nt, Bordetella pertussis
cggcaccagcgcc

SEQ ID NO: 306752 - RNA, 14 nt, Bordetella pertussis
cggcaccagcgcca

SEQ ID NO: 306753 - RNA, 16 nt, Bordetella pertussis
cggcaccagcaggccg

SEQ ID NO: 306754 - RNA, 11 nt, Bordetella pertussis
cggcaccagcc

SEQ ID NO: 306755 - RNA, 14 nt, Bordetella pertussis
cggcaccaucgccg

SEQ ID NO: 306756 - RNA, 13 nt, Bordetella pertussis
cggcaccaugcgc

SEQ ID NO: 306757 - RNA, 15 nt, Bordetella pertussis
cggcaccaugcgcac

SEQ ID NO: 306758 - RNA, 17 nt, Bordetella pertussis
cggcaccaugcgcacca

SEQ ID NO: 306759 - RNA, 14 nt, Bordetella pertussis
cggcacccagccgg

SEQ ID NO: 306760 - RNA, 12 nt, Bordetella pertussis
cggcaccgcgca

SEQ ID NO: 306761 - RNA, 19 nt, Bordetella pertussis
cggcaccgcgcagcccggc

SEQ ID NO: 306762 - RNA, 21 nt, Bordetella pertussis
cggcaccgcgcagcccggcgu

SEQ ID NO: 306763 - RNA, 22 nt, Bordetella pertussis
cggcacgacgaucggccugaac

SEQ ID NO: 306764 - RNA, 14 nt, Bordetella pertussis
cggcacgacgcuga

SEQ ID NO: 306765 - RNA, 12 nt, Bordetella pertussis
cggcacgacggc

SEQ ID NO: 306766 - RNA, 23 nt, Bordetella pertussis
cggcacgacggccuccgcgccga

SEQ ID NO: 306767 - RNA, 14 nt, Bordetella pertussis
cggcacgacgucgu

SEQ ID NO: 306768 - RNA, 16 nt, Bordetella pertussis
cggcacgaucggcgcc

SEQ ID NO: 306769 - RNA, 16 nt, Bordetella pertussis
cggcagcucgcgcugc

SEQ ID NO: 306770 - RNA, 20 nt, Bordetella pertussis
cggcagcucgcgcugcgcgc

SEQ ID NO: 306771 - RNA, 22 nt, Bordetella pertussis
cggcagcucgcgcugcgcgccg

SEQ ID NO: 306772 - RNA, 12 nt, Bordetella pertussis
cggcagcugacg

SEQ ID NO: 306773 - RNA, 22 nt, Bordetella pertussis
cggcagcugacgggucuccacg

SEQ ID NO: 306774 - RNA, 20 nt, Bordetella pertussis
cggcagcuugaccgccucca

SEQ ID NO: 306775 - RNA, 19 nt, Bordetella pertussis
cggcagcuugucgaucgcc

SEQ ID NO: 306776 - RNA, 22 nt, Bordetella pertussis
cggcaggacggggaacaggcgc

SEQ ID NO: 306777 - RNA, 14 nt, Bordetella pertussis
cggcaggcacacga

SEQ ID NO: 306778 - RNA, 17 nt, Bordetella pertussis
cggcaggccccggcccg

SEQ ID NO: 306779 - RNA, 12 nt, Bordetella pertussis
cggcaggccgcg

SEQ ID NO: 306780 - RNA, 15 nt, Bordetella pertussis
cggcaggccgcgcca

SEQ ID NO: 306781 - RNA, 17 nt, Bordetella pertussis
cggcaggccgcgcugcc

SEQ ID NO: 306782 - RNA, 15 nt, Bordetella pertussis
cggcagggccagcgc

SEQ ID NO: 306783 - RNA, 18 nt, Bordetella pertussis
cggcagggccagcgccag

SEQ ID NO: 306784 - RNA, 12 nt, Bordetella pertussis
cggcagggcggc

SEQ ID NO: 306785 - RNA, 14 nt, Bordetella pertussis
cggcagggcggcca

SEQ ID NO: 306786 - RNA, 16 nt, Bordetella pertussis
cggcagggcggccagg

SEQ ID NO: 306787 - RNA, 17 nt, Bordetella pertussis
cggcagggcggccaggc

SEQ ID NO: 306788 - RNA, 17 nt, Bordetella pertussis
cggcagggcgucggccg

SEQ ID NO: 306789 - RNA, 18 nt, Bordetella pertussis
cggcaggggcucgcgccc

SEQ ID NO: 306790 - RNA, 22 nt, Bordetella pertussis
cggcaggggcucgcgcccgagc

SEQ ID NO: 306791 - RNA, 15 nt, Bordetella pertussis
cggcagggugcccag

SEQ ID NO: 306792 - RNA, 16 nt, Bordetella pertussis
cggcaggucgaugccc

SEQ ID NO: 306793 - RNA, 22 nt, Bordetella pertussis
cggcaggucgauggggucgggc

SEQ ID NO: 306794 - RNA, 14 nt, Bordetella pertussis
cggcaggucgcgcg

SEQ ID NO: 306795 - RNA, 18 nt, Bordetella pertussis
cggcaggucgcgcgacgu

SEQ ID NO: 306796 - RNA, 22 nt, Bordetella pertussis
cggcaggucggguagcugcuga

SEQ ID NO: 306797 - RNA, 14 nt, Bordetella pertussis
cggcaggugcacgc

SEQ ID NO: 306798 - RNA, 20 nt, Bordetella pertussis
cggcaggugcacgcacggua

SEQ ID NO: 306799 - RNA, 16 nt, Bordetella pertussis
cggcauagcccaggcc

SEQ ID NO: 306800 - RNA, 18 nt, Bordetella pertussis
cggcauagcccaggccgc

SEQ ID NO: 306801 - RNA, 20 nt, Bordetella pertussis
cggcauagcccaggccgccg

SEQ ID NO: 306802 - RNA, 21 nt, Bordetella pertussis
cggcauagcccaggccgccgg

SEQ ID NO: 306803 - RNA, 21 nt, Bordetella pertussis
cggcaucaguucaggcuggcg

SEQ ID NO: 306804 - RNA, 20 nt, Bordetella pertussis
cggcaucgacaugcccgccg

SEQ ID NO: 306805 - RNA, 21 nt, Bordetella pertussis
cggcaucgacaugcccgccgg

SEQ ID NO: 306806 - RNA, 18 nt, Bordetella pertussis
cggcaucgauuucucgcu

SEQ ID NO: 306807 - RNA, 12 nt, Bordetella pertussis
cggcauggccag

SEQ ID NO: 306808 - RNA, 13 nt, Bordetella pertussis
cggcauggccagc

SEQ ID NO: 306809 - RNA, 16 nt, Bordetella pertussis
cggcauggccaucgcg

SEQ ID NO: 306810 - RNA, 12 nt, Bordetella pertussis
cggcauggccgg

SEQ ID NO: 306811 - RNA, 16 nt, Bordetella pertussis
cggcauggccggcagg

SEQ ID NO: 306812 - RNA, 16 nt, Bordetella pertussis
cggcauggcgccgcgc

SEQ ID NO: 306813 - RNA, 17 nt, Bordetella pertussis
cggcauggcgccgcgcc

SEQ ID NO: 306814 - RNA, 17 nt, Bordetella pertussis
cggcauggcgcgcgcgg

SEQ ID NO: 306815 - RNA, 15 nt, Bordetella pertussis
cggcauggcggccag

SEQ ID NO: 306816 - RNA, 22 nt, Bordetella pertussis
cggcauggcggccagcuugacc

SEQ ID NO: 306817 - RNA, 22 nt, Bordetella pertussis
cggcauggcgaucgaacgcggc

SEQ ID NO: 306818 - RNA, 19 nt, Bordetella pertussis
cggcauggucggcauggcc

SEQ ID NO: 306819 - RNA, 18 nt, Bordetella pertussis
cggcaugguguaccgggc

SEQ ID NO: 306820 - RNA, 20 nt, Bordetella pertussis
cggcaugguguaccgggccg

SEQ ID NO: 306821 - RNA, 20 nt, Bordetella pertussis
cggcauugccgccacgggcc

SEQ ID NO: 306822 - RNA, 22 nt, Bordetella pertussis
cggcauugccgccacgggcccg

SEQ ID NO: 306823 - RNA, 13 nt, Bordetella pertussis
cggccaccaccag

SEQ ID NO: 306824 - RNA, 14 nt, Bordetella pertussis
cggccaccaccagg

SEQ ID NO: 306825 - RNA, 15 nt, Bordetella pertussis
cggccaccaccaggu

SEQ ID NO: 306826 - RNA, 18 nt, Bordetella pertussis
cggccaccaugcggucga

SEQ ID NO: 306827 - RNA, 21 nt, Bordetella pertussis
cggccacccggaucgacagga

SEQ ID NO: 306828 - RNA, 17 nt, Bordetella pertussis
cggccaccgccguggca

SEQ ID NO: 306829 - RNA, 19 nt, Bordetella pertussis
cggccaccucuucagcccg

SEQ ID NO: 306830 - RNA, 21 nt, Bordetella pertussis
cggccaccucuucagcccggc

SEQ ID NO: 306831 - RNA, 22 nt, Bordetella pertussis
cggccaccucuucagcccggcg

SEQ ID NO: 306832 - RNA, 14 nt, Bordetella pertussis
cggccaccuggcgc

SEQ ID NO: 306833 - RNA, 17 nt, Bordetella pertussis
cggccacgaccggcucg

SEQ ID NO: 306834 - RNA, 23 nt, Bordetella pertussis
cggccacgaccggcucgaucgcc

SEQ ID NO: 306835 - RNA, 18 nt, Bordetella pertussis
cggccacgcgcaacgccg

SEQ ID NO: 306836 - RNA, 21 nt, Bordetella pertussis
cggccacgcgcaacgccgcca

SEQ ID NO: 306837 - RNA, 13 nt, Bordetella pertussis
cggccacgcgccg

SEQ ID NO: 306838 - RNA, 14 nt, Bordetella pertussis
cggccacgcgccgc

SEQ ID NO: 306839 - RNA, 21 nt, Bordetella pertussis
cggccacgcgccgcccgggcc

SEQ ID NO: 306840 - RNA, 15 nt, Bordetella pertussis
cggccacgcgcugca

SEQ ID NO: 306841 - RNA, 18 nt, Bordetella pertussis
cggccacgcgcugcagca

SEQ ID NO: 306842 - RNA, 18 nt, Bordetella pertussis
cggccaccuggucgucgg

SEQ ID NO: 306843 - RNA, 14 nt, Bordetella pertussis
cggccacggccggc

SEQ ID NO: 306844 - RNA, 18 nt, Bordetella pertussis
cggccacggccggcagcg

SEQ ID NO: 306845 - RNA, 17 nt, Bordetella pertussis
cggccacggccgggccu

SEQ ID NO: 306846 - RNA, 16 nt, Bordetella pertussis
cggccacggccugccc

SEQ ID NO: 306847 - RNA, 20 nt, Bordetella pertussis
cggccacggccugcccgggc

SEQ ID NO: 306848 - RNA, 22 nt, Bordetella pertussis
cggccacggccugcccgggcgg

SEQ ID NO: 306849 - RNA, 17 nt, Bordetella pertussis
cggccacggcggugacc

SEQ ID NO: 306850 - RNA, 16 nt, Bordetella pertussis
cggccacgggaccgcu

SEQ ID NO: 306851 - RNA, 13 nt, Bordetella pertussis
cggccacgcugcc

SEQ ID NO: 306852 - RNA, 13 nt, Bordetella pertussis
cggccacgucgcc

SEQ ID NO: 306853 - RNA, 14 nt, Bordetella pertussis
cggccacgucgccc

SEQ ID NO: 306854 - RNA, 22 nt, Bordetella pertussis
cggccacguguggcaggccagc

SEQ ID NO: 306855 - RNA, 15 nt, Bordetella pertussis
cggccacgucggcgg

SEQ ID NO: 306856 - RNA, 21 nt, Bordetella pertussis
cggccacgucggcggccgccu

SEQ ID NO: 306857 - RNA, 17 nt, Bordetella pertussis
cggccacuuccuggugg

SEQ ID NO: 306858 - RNA, 18 nt, Bordetella pertussis
cggccacuuccugguggg

SEQ ID NO: 306859 - RNA, 20 nt, Bordetella pertussis
cggccacuuccuggugggcg

SEQ ID NO: 306860 - RNA, 23 nt, Bordetella pertussis
cggccacuuccuggugggcggca

SEQ ID NO: 306861 - RNA, 17 nt, Bordetella pertussis
cggccacuucgcggccg

SEQ ID NO: 306862 - RNA, 18 nt, Bordetella pertussis
cggccacuucgcggccga

SEQ ID NO: 306863 - RNA, 18 nt, Bordetella pertussis
cggccacuuucgcgcgcg

SEQ ID NO: 306864 - RNA, 21 nt, Bordetella pertussis
cggccacuuucgcgcgcgccu

SEQ ID NO: 306865 - RNA, 23 nt, Bordetella pertussis
cggccacuuucgcgcgcgccugc

SEQ ID NO: 306866 - RNA, 19 nt, Bordetella pertussis
cggccagaccuugcgcgac

SEQ ID NO: 306867 - RNA, 21 nt, Bordetella pertussis
cggccagaccuugcgcgacgg

SEQ ID NO: 306868 - RNA, 15 nt, Bordetella pertussis
cggccagcacgucau

SEQ ID NO: 306869 - RNA, 24 nt, Bordetella pertussis
cggccagcagcacgaucgcggcgc

SEQ ID NO: 306870 - RNA, 14 nt, Bordetella pertussis
cggccagcagcgac

SEQ ID NO: 306871 - RNA, 21 nt, Bordetella pertussis
cggccagcagcgacggcccca

SEQ ID NO: 306872 - RNA, 23 nt, Bordetella pertussis
cggccagcagcgacggccccagc

SEQ ID NO: 306873 - RNA, 15 nt, Bordetella pertussis
cggccagcagcuugg

SEQ ID NO: 306874 - RNA, 18 nt, Bordetella pertussis
cggccagcaggagcccgc

SEQ ID NO: 306875 - RNA, 19 nt, Bordetella pertussis
cggccagcaggagcccgcu

SEQ ID NO: 306876 - RNA, 20 nt, Bordetella pertussis
cggccagcaggagcccgcug

SEQ ID NO: 306877 - RNA, 22 nt, Bordetella pertussis
cggccagcaggagcccgcugcc

SEQ ID NO: 306878 - RNA, 15 nt, Bordetella pertussis
cggccagcagcgccu

SEQ ID NO: 306879 - RNA, 17 nt, Bordetella pertussis
cggccagcagcgccugg

SEQ ID NO: 306880 - RNA, 14 nt, Bordetella pertussis
cggccagcagcgcg

SEQ ID NO: 306881 - RNA, 14 nt, Bordetella pertussis
cggccagcagcggc

SEQ ID NO: 306882 - RNA, 14 nt, Bordetella pertussis
cggccagcauaccc

SEQ ID NO: 306883 - RNA, 20 nt, Bordetella pertussis
cggccagcauacccugcgcg

SEQ ID NO: 306884 - RNA, 23 nt, Bordetella pertussis
cggccagcauacccugcgcgccg

SEQ ID NO: 306885 - RNA, 15 nt, Bordetella pertussis
cggccagcaugcugg

SEQ ID NO: 306886 - RNA, 15 nt, Bordetella pertussis
cggccagccacgccg

SEQ ID NO: 306887 - RNA, 17 nt, Bordetella pertussis
cggccagccacgccggc

SEQ ID NO: 306888 - RNA, 20 nt, Bordetella pertussis
cggccagccacgccggcgcg

SEQ ID NO: 306889 - RNA, 12 nt, Bordetella pertussis
cggccagccggc

SEQ ID NO: 306890 - RNA, 14 nt, Bordetella pertussis
cggccagcgcggug

SEQ ID NO: 306891 - RNA, 20 nt, Bordetella pertussis
cggccagcgcgucgagcagc

SEQ ID NO: 306892 - RNA, 23 nt, Bordetella pertussis
cggccagcgcgucgagcagcgca

SEQ ID NO: 306893 - RNA, 23 nt, Bordetella pertussis
cggccagcggaugaugcggcgcc

SEQ ID NO: 306894 - RNA, 12 nt, Bordetella pertussis
cggccagcggca

SEQ ID NO: 306895 - RNA, 14 nt, Bordetella pertussis
cggccagcggcagg

SEQ ID NO: 306896 - RNA, 15 nt, Bordetella pertussis
cggccagcggcaggc

SEQ ID NO: 306897 - RNA, 18 nt, Bordetella pertussis
cggccagcggcaggccca

SEQ ID NO: 306898 - RNA, 17 nt, Bordetella pertussis
cggccagcggcaggggc

SEQ ID NO: 306899 - RNA, 13 nt, Bordetella pertussis
cggccagcggcga

SEQ ID NO: 306900 - RNA, 15 nt, Bordetella pertussis
cggccagcggcgaaa

SEQ ID NO: 306901 - RNA, 14 nt, Bordetella pertussis
cggccagcggcgcu

SEQ ID NO: 306902 - RNA, 17 nt, Bordetella pertussis
cggccagcgucagcgca

SEQ ID NO: 306903 - RNA, 11 nt, Bordetella pertussis
cggccaggccg

SEQ ID NO: 306904 - RNA, 19 nt, Bordetella pertussis
cggccaggccgaacgcggu

SEQ ID NO: 306905 - RNA, 15 nt, Bordetella pertussis
cggccaggccgauga

SEQ ID NO: 306906 - RNA, 12 nt, Bordetella pertussis
cggccaggccgg

SEQ ID NO: 306907 - RNA, 17 nt, Bordetella pertussis
cggccaggccggccugc

SEQ ID NO: 306908 - RNA, 17 nt, Bordetella pertussis
cggccaggccggcgaaa

SEQ ID NO: 306909 - RNA, 16 nt, Bordetella pertussis
cggccaggccggcgcg

SEQ ID NO: 306910 - RNA, 19 nt, Bordetella pertussis
cggccaggccggcgcgccg

SEQ ID NO: 306911 - RNA, 13 nt, Bordetella pertussis
cggccaggccggg

SEQ ID NO: 306912 - RNA, 14 nt, Bordetella pertussis
cggccaggccggug

SEQ ID NO: 306913 - RNA, 15 nt, Bordetella pertussis
cggccaggccggcgc

SEQ ID NO: 306914 - RNA, 15 nt, Bordetella pertussis
cggccaggcgccgcu

SEQ ID NO: 306915 - RNA, 21 nt, Bordetella pertussis
cggccaggcgccgcucagcgc

SEQ ID NO: 306916 - RNA, 17 nt, Bordetella pertussis
cggccaggcgccugagc

SEQ ID NO: 306917 - RNA, 12 nt, Bordetella pertussis
cggccaggcgcg

SEQ ID NO: 306918 - RNA, 15 nt, Bordetella pertussis
cggccaggcgcgccg

SEQ ID NO: 306919 - RNA, 22 nt, Bordetella pertussis
cggccaggcgcgccgcgauggc

SEQ ID NO: 306920 - RNA, 15 nt, Bordetella pertussis
cggccaggcgcugcg

SEQ ID NO: 306921 - RNA, 16 nt, Bordetella pertussis
cggccaggcggggugg

SEQ ID NO: 306922 - RNA, 15 nt, Bordetella pertussis
cggccagggaggcga

SEQ ID NO: 306923 - RNA, 23 nt, Bordetella pertussis
cggccagggcaagcgcgucgaug

SEQ ID NO: 306924 - RNA, 14 nt, Bordetella pertussis
cggccaggcucugg

SEQ ID NO: 306925 - RNA, 15 nt, Bordetella pertussis
cggccagggccacca

SEQ ID NO: 306926 - RNA, 18 nt, Bordetella pertussis
cggccagggccacgccgg

SEQ ID NO: 306927 - RNA, 19 nt, Bordetella pertussis
cggccagggccacgccggc

SEQ ID NO: 306928 - RNA, 20 nt, Bordetella pertussis
cggccagggccugcgggccg

SEQ ID NO: 306929 - RNA, 21 nt, Bordetella pertussis
cggccagggcgaugcggcggc

SEQ ID NO: 306930 - RNA, 19 nt, Bordetella pertussis
cggccagggcggcgacuuc

SEQ ID NO: 306931 - RNA, 23 nt, Bordetella pertussis
cggccagggcggcgacuucgccg

SEQ ID NO: 306932 - RNA, 17 nt, Bordetella pertussis
cggccagggcugcggcg

SEQ ID NO: 306933 - RNA, 18 nt, Bordetella pertussis
cggccaggggcagcucgg

SEQ ID NO: 306934 - RNA, 17 nt, Bordetella pertussis
cggccagggugccccgc

SEQ ID NO: 306935 - RNA, 19 nt, Bordetella pertussis
cggccagggugccccgccg

SEQ ID NO: 306936 - RNA, 16 nt, Bordetella pertussis
cggccaguggcgcggc

SEQ ID NO: 306937 - RNA, 17 nt, Bordetella pertussis
cggccaguucguccgcu

SEQ ID NO: 306938 - RNA, 15 nt, Bordetella pertussis
cggccaucacgccga

SEQ ID NO: 306939 - RNA, 21 nt, Bordetella pertussis
cggccaucuuggugcgcgcca

SEQ ID NO: 306940 - RNA, 22 nt, Bordetella pertussis
cggccaugacgggaauccgcug

SEQ ID NO: 306941 - RNA, 20 nt, Bordetella pertussis
cggccaugauacccauggcc

SEQ ID NO: 306942 - RNA, 14 nt, Bordetella pertussis
cggccaugcccagg

SEQ ID NO: 306943 - RNA, 16 nt, Bordetella pertussis
cggccaugcccaggcc

SEQ ID NO: 306944 - RNA, 19 nt, Bordetella pertussis
cggccaugcccaggcccag

SEQ ID NO: 306945 - RNA, 15 nt, Bordetella pertussis
cggccaugcgccgcu

SEQ ID NO: 306946 - RNA, 16 nt, Bordetella pertussis
cggccaugcgcgccag

SEQ ID NO: 306947 - RNA, 16 nt, Bordetella pertussis
cggccaugcggugcgc

SEQ ID NO: 306948 - RNA, 18 nt, Bordetella pertussis
cggccaugcggugcgccg

SEQ ID NO: 306949 - RNA, 18 nt, Bordetella pertussis
cggccaugcucagcagca

SEQ ID NO: 306950 - RNA, 21 nt, Bordetella pertussis
cggccaugcucagcagcaccg

SEQ ID NO: 306951 - RNA, 20 nt, Bordetella pertussis
cggccauggcccuugccgcc

SEQ ID NO: 306952 - RNA, 23 nt, Bordetella pertussis
cggccauggcgcuguuggccggc

SEQ ID NO: 306953 - RNA, 20 nt, Bordetella pertussis
cggcccacccggcacgcgcc

SEQ ID NO: 306954 - RNA, 21 nt, Bordetella pertussis
cggcccacccggcacgcgccg

SEQ ID NO: 306955 - RNA, 20 nt, Bordetella pertussis
cggcccacgcugucggggug

SEQ ID NO: 306956 - RNA, 15 nt, Bordetella pertussis
cggcccagcacgccg

SEQ ID NO: 306957 - RNA, 18 nt, Bordetella pertussis
cggcccagcacgccgcgc

SEQ ID NO: 306958 - RNA, 19 nt, Bordetella pertussis
cggcccagcacgccgcgcu

SEQ ID NO: 306959 - RNA, 21 nt, Bordetella pertussis
cggcccagcacgccgcgcucg

SEQ ID NO: 306960 - RNA, 18 nt, Bordetella pertussis
cggcccagcaugccgaug

SEQ ID NO: 306961 - RNA, 16 nt, Bordetella pertussis
cggcccagccgcucgg

SEQ ID NO: 306962 - RNA, 20 nt, Bordetella pertussis
cggcccauccaucugguggu

SEQ ID NO: 306963 - RNA, 22 nt, Bordetella pertussis
cggcccaucuguacggccggcu

SEQ ID NO: 306964 - RNA, 18 nt, Bordetella pertussis
cggcccauucgcgcaccg

SEQ ID NO: 306965 - RNA, 19 nt, Bordetella pertussis
cggcccauucgcgcaccga

SEQ ID NO: 306966 - RNA, 21 nt, Bordetella pertussis
cggcccauugcggcaccugcu

SEQ ID NO: 306967 - RNA, 15 nt, Bordetella pertussis
cggccccaccuggcg

SEQ ID NO: 306968 - RNA, 17 nt, Bordetella pertussis
cggccccaccuggcggu

SEQ ID NO: 306969 - RNA, 14 nt, Bordetella pertussis
cggccccagcgccg

SEQ ID NO: 306970 - RNA, 24 nt, Bordetella pertussis
cggccccaggaugcgcaccggcca

SEQ ID NO: 306971 - RNA, 14 nt, Bordetella pertussis
cggccccagguaga

SEQ ID NO: 306972 - RNA, 17 nt, Bordetella pertussis
cggccccagucgcugcu

SEQ ID NO: 306973 - RNA, 18 nt, Bordetella pertussis
cggccccauccucaucgu

SEQ ID NO: 306974 - RNA, 16 nt, Bordetella pertussis
cggccccaugucgauc

SEQ ID NO: 306975 - RNA, 14 nt, Bordetella pertussis
cggcccggccgcau

SEQ ID NO: 306976 - RNA, 14 nt, Bordetella pertussis
cggcccggccgccg

SEQ ID NO: 306977 - RNA, 16 nt, Bordetella pertussis
cggcccggcgccggug

SEQ ID NO: 306978 - RNA, 14 nt, Bordetella pertussis
cggcccggcgggcc

SEQ ID NO: 306979 - RNA, 12 nt, Bordetella pertussis
cggcccggcggc

SEQ ID NO: 306980 - RNA, 13 nt, Bordetella pertussis
cggcccggcgucg

SEQ ID NO: 306981 - RNA, 12 nt, Bordetella pertussis
cggcccgggcga

SEQ ID NO: 306982 - RNA, 19 nt, Bordetella pertussis
cggcccgggcgagauggcg

SEQ ID NO: 306983 - RNA, 16 nt, Bordetella pertussis
cggcccugggccagcc

SEQ ID NO: 306984 - RNA, 22 nt, Bordetella pertussis
cggcccugggccagccagcgcc

SEQ ID NO: 306985 - RNA, 23 nt, Bordetella pertussis
cggcccugggccagccagcgccg

SEQ ID NO: 306986 - RNA, 17 nt, Bordetella pertussis
cggcccugggcgcggcg

SEQ ID NO: 306987 - RNA, 22 nt, Bordetella pertussis
cggcccugggcgcggcgguggc

SEQ ID NO: 306988 - RNA, 19 nt, Bordetella pertussis
cggcccuggucgucgcggc

SEQ ID NO: 306989 - RNA, 18 nt, Bordetella pertussis
cggcccuguucgcgcggc

SEQ ID NO: 306990 - RNA, 13 nt, Bordetella pertussis
cggccgacagcuu

SEQ ID NO: 306991 - RNA, 18 nt, Bordetella pertussis
cggccgaccacuggaagc

SEQ ID NO: 306992 - RNA, 13 nt, Bordetella pertussis
cggccgaccagca

SEQ ID NO: 306993 - RNA, 14 nt, Bordetella pertussis
cggccgacccgcgg

SEQ ID NO: 306994 - RNA, 15 nt, Bordetella pertussis
cggccgacagguggu

SEQ ID NO: 306995 - RNA, 11 nt, Bordetella pertussis
cggccgaccgg

SEQ ID NO: 306996 - RNA, 13 nt, Bordetella pertussis
cggccgacggcgc

SEQ ID NO: 306997 - RNA, 16 nt, Bordetella pertussis
cggccgacgggcggcu

SEQ ID NO: 306998 - RNA, 22 nt, Bordetella pertussis
cggccgacgggcggcugcuggc

SEQ ID NO: 306999 - RNA, 22 nt, Bordetella pertussis
cggccgacucgaaacgggcggc

SEQ ID NO: 307000 - RNA, 14 nt, Bordetella pertussis
cggccgagcgggcc

SEQ ID NO: 307001 - RNA, 21 nt, Bordetella pertussis
cggccgagcgggccagcgcgg

SEQ ID NO: 307002 - RNA, 22 nt, Bordetella pertussis
cggccgagcgggccagcgcggc

SEQ ID NO: 307003 - RNA, 13 nt, Bordetella pertussis
cggccgagcuccu

SEQ ID NO: 307004 - RNA, 19 nt, Bordetella pertussis
cggccgagcuccucgagcg

SEQ ID NO: 307005 - RNA, 14 nt, Bordetella pertussis
cggccgaggccagc

SEQ ID NO: 307006 - RNA, 15 nt, Bordetella pertussis
cggccgaggccagcg

SEQ ID NO: 307007 - RNA, 20 nt, Bordetella pertussis
cggccgaggccagcgugccc

SEQ ID NO: 307008 - RNA, 14 nt, Bordetella pertussis
cggccgaggucggc

SEQ ID NO: 307009 - RNA, 17 nt, Bordetella pertussis
cggccgauagccgcggc

SEQ ID NO: 307010 - RNA, 18 nt, Bordetella pertussis
cggccgauagccgugacc

SEQ ID NO: 307011 - RNA, 21 nt, Bordetella pertussis
cggccgauagccgugaccugc

SEQ ID NO: 307012 - RNA, 20 nt, Bordetella pertussis
cggccgaucgcgccguccga

SEQ ID NO: 307013 - RNA, 22 nt, Bordetella pertussis
cggccgaucgcgccguccgagc

SEQ ID NO: 307014 - RNA, 14 nt, Bordetella pertussis
cggccgcacgcggc

SEQ ID NO: 307015 - RNA, 16 nt, Bordetella pertussis
cggccgcacgcggccg

SEQ ID NO: 307016 - RNA, 22 nt, Bordetella pertussis
cggccgcacgcggccgcgggcc

SEQ ID NO: 307017 - RNA, 12 nt, Bordetella pertussis
cggccgcagcag

SEQ ID NO: 307018 - RNA, 14 nt, Bordetella pertussis
cggccgcagcaguu

SEQ ID NO: 307019 - RNA, 17 nt, Bordetella pertussis
cggccgcagggcgugcg

SEQ ID NO: 307020 - RNA, 19 nt, Bordetella pertussis
cggccgcagggcgugcggg

SEQ ID NO: 307021 - RNA, 13 nt, Bordetella pertussis
cggccgcagcgga

SEQ ID NO: 307022 - RNA, 17 nt, Bordetella pertussis
cggccgcauugggacgc

SEQ ID NO: 307023 - RNA, 20 nt, Bordetella pertussis
cggccgcauugggacgcggc

SEQ ID NO: 307024 - RNA, 20 nt, Bordetella pertussis
cggccgccacccaggcggca

SEQ ID NO: 307025 - RNA, 14 nt, Bordetella pertussis
cggccgcccgccug

SEQ ID NO: 307026 - RNA, 13 nt, Bordetella pertussis
cggccgccgaacg

SEQ ID NO: 307027 - RNA, 15 nt, Bordetella pertussis
cggccgccgaacgag

SEQ ID NO: 307028 - RNA, 20 nt, Bordetella pertussis
cggccgccgaacggcacgug

SEQ ID NO: 307029 - RNA, 15 nt, Bordetella pertussis
cggccgccgacgccg

SEQ ID NO: 307030 - RNA, 16 nt, Bordetella pertussis
cggccgccgccagcgc

SEQ ID NO: 307031 - RNA, 17 nt, Bordetella pertussis
cggccgccgccagcgcg

SEQ ID NO: 307032 - RNA, 19 nt, Bordetella pertussis
cggccgccgccagcgcgcc

SEQ ID NO: 307033 - RNA, 15 nt, Bordetella pertussis
cggccgccgcccgcc

SEQ ID NO: 307034 - RNA, 13 nt, Bordetella pertussis
cggccgccgccgg

SEQ ID NO: 307035 - RNA, 20 nt, Bordetella pertussis
cggccgccggauugacgucc

SEQ ID NO: 307036 - RNA, 13 nt, Bordetella pertussis
cggccgccggcgg

SEQ ID NO: 307037 - RNA, 14 nt, Bordetella pertussis
cggccgccggcggc

SEQ ID NO: 307038 - RNA, 17 nt, Bordetella pertussis
cggccgccggcggcgcc

SEQ ID NO: 307039 - RNA, 18 nt, Bordetella pertussis
cggccgccggcggcgccg

SEQ ID NO: 307040 - RNA, 18 nt, Bordetella pertussis
cggccgccuccaggcggc

SEQ ID NO: 307041 - RNA, 19 nt, Bordetella pertussis
cggccgccuccaggcggcg

SEQ ID NO: 307042 - RNA, 23 nt, Bordetella pertussis
cggccgccugcgccgaggcgggc

SEQ ID NO: 307043 - RNA, 14 nt, Bordetella pertussis
cggccgccuggccc

SEQ ID NO: 307044 - RNA, 15 nt, Bordetella pertussis
cggccgccuggccca

SEQ ID NO: 307045 - RNA, 14 nt, Bordetella pertussis
cggccgcggcguug

SEQ ID NO: 307046 - RNA, 15 nt, Bordetella pertussis
cggccgcgggcagca

SEQ ID NO: 307047 - RNA, 15 nt, Bordetella pertussis
cggccgcgggccgcu

SEQ ID NO: 307048 - RNA, 19 nt, Bordetella pertussis
cggccgcgggcggcgcgcc

SEQ ID NO: 307049 - RNA, 20 nt, Bordetella pertussis
cggccgcgggcggcgcgccc

SEQ ID NO: 307050 - RNA, 20 nt, Bordetella pertussis
cggccgcggggcuggccagc

SEQ ID NO: 307051 - RNA, 22 nt, Bordetella pertussis
cggccgcggggcuggccagcug

SEQ ID NO: 307052 - RNA, 14 nt, Bordetella pertussis
cggccgcggguggc

SEQ ID NO: 307053 - RNA, 15 nt, Bordetella pertussis
cggccgcggucagcc

SEQ ID NO: 307054 - RNA, 22 nt, Bordetella pertussis
cggccgcgucauacgacgcggc

SEQ ID NO: 307055 - RNA, 15 nt, Bordetella pertussis
cggccgcguccagcg

SEQ ID NO: 307056 - RNA, 19 nt, Bordetella pertussis
cggccgcguccagcgcgcg

SEQ ID NO: 307057 - RNA, 19 nt, Bordetella pertussis
cggccgcgucgaucagcgc

SEQ ID NO: 307058 - RNA, 20 nt, Bordetella pertussis
cggccgcgucgaucagcgcg

SEQ ID NO: 307059 - RNA, 21 nt, Bordetella pertussis
cggccgcgucgaucagcgcgg

SEQ ID NO: 307060 - RNA, 16 nt, Bordetella pertussis
cggccgcuugucgaug

SEQ ID NO: 307061 - RNA, 19 nt, Bordetella pertussis
cggccggacagggccgcga

SEQ ID NO: 307062 - RNA, 22 nt, Bordetella pertussis
cggccggacagggccgcgagca

SEQ ID NO: 307063 - RNA, 21 nt, Bordetella pertussis
cggccggauccagcugcgaaa

SEQ ID NO: 307064 - RNA, 23 nt, Bordetella pertussis
cggccggaugcgcaggacggcgc

SEQ ID NO: 307065 - RNA, 15 nt, Bordetella pertussis
cggccggcgcgccgg

SEQ ID NO: 307066 - RNA, 13 nt, Bordetella pertussis
cggccggcgcgcg

SEQ ID NO: 307067 - RNA, 15 nt, Bordetella pertussis
cggccggcgcgcgcg

SEQ ID NO: 307068 - RNA, 16 nt, Bordetella pertussis
cggccggcgcgcgcga

SEQ ID NO: 307069 - RNA, 20 nt, Bordetella pertussis
cggccggcgcgugcuggcgc

SEQ ID NO: 307070 - RNA, 14 nt, Bordetella pertussis
cggccggcggcgcc

SEQ ID NO: 307071 - RNA, 15 nt, Bordetella pertussis
cggccggcggcgccg

SEQ ID NO: 307072 - RNA, 19 nt, Bordetella pertussis
cggccggcggucgcgcugg

SEQ ID NO: 307073 - RNA, 22 nt, Bordetella pertussis
cggccggcggucgcgcuggccc

SEQ ID NO: 307074 - RNA, 18 nt, Bordetella pertussis
cggccggcugcaccagcg

SEQ ID NO: 307075 - RNA, 17 nt, Bordetella pertussis
cggccggcugcgcgccg

SEQ ID NO: 307076 - RNA, 20 nt, Bordetella pertussis
cggccggcugcgcgccgacc

SEQ ID NO: 307077 - RNA, 21 nt, Bordetella pertussis
cggccggcuugcgcaagccgg

SEQ ID NO: 307078 - RNA, 23 nt, Bordetella pertussis
cggccgggaccuuggcggcuggc

SEQ ID NO: 307079 - RNA, 15 nt, Bordetella pertussis
cggccgggcacaccg

SEQ ID NO: 307080 - RNA, 22 nt, Bordetella pertussis
cggccgggcacaccgucacgcg

SEQ ID NO: 307081 - RNA, 13 nt, Bordetella pertussis
cggccgggccagc

SEQ ID NO: 307082 - RNA, 16 nt, Bordetella pertussis
cggccgggccagcgcg

SEQ ID NO: 307083 - RNA, 17 nt, Bordetella pertussis
cggccgggccagcgcga

SEQ ID NO: 307084 - RNA, 16 nt, Bordetella pertussis
cggccgggccaguacc

SEQ ID NO: 307085 - RNA, 14 nt, Bordetella pertussis
cggccgggccgggc

SEQ ID NO: 307086 - RNA, 18 nt, Bordetella pertussis
cggccgggccgggcacga

SEQ ID NO: 307087 - RNA, 20 nt, Bordetella pertussis
cggccgggccgggcacgaug

SEQ ID NO: 307088 - RNA, 14 nt, Bordetella pertussis
cggccgggcgcggc

SEQ ID NO: 307089 - RNA, 15 nt, Bordetella pertussis
cggccgggcucaggc

SEQ ID NO: 307090 - RNA, 18 nt, Bordetella pertussis
cggccgggcucaggcugc

SEQ ID NO: 307091 - RNA, 21 nt, Bordetella pertussis
cggccggggcccgcgggcgcc

SEQ ID NO: 307092 - RNA, 15 nt, Bordetella pertussis
cggccggggccgccc

SEQ ID NO: 307093 - RNA, 18 nt, Bordetella pertussis
cggccggggccgcccugg

SEQ ID NO: 307094 - RNA, 19 nt, Bordetella pertussis
cggccgggucggccugcca

SEQ ID NO: 307095 - RNA, 19 nt, Bordetella pertussis
cggccggguugucgcccac

SEQ ID NO: 307096 - RNA, 15 nt, Bordetella pertussis
cggccggucagccca

SEQ ID NO: 307097 - RNA, 22 nt, Bordetella pertussis
cggccggucugcauguaguuca

SEQ ID NO: 307098 - RNA, 15 nt, Bordetella pertussis
cggccggugcaucgg

SEQ ID NO: 307099 - RNA, 23 nt, Bordetella pertussis
cggccgguggguguggccaugca

SEQ ID NO: 307100 - RNA, 23 nt, Bordetella pertussis
cggccgguuccugcaaggccggc

SEQ ID NO: 307101 - RNA, 20 nt, Bordetella pertussis
cggccguauggccguuggcc

SEQ ID NO: 307102 - RNA, 18 nt, Bordetella pertussis
cggccgucaacggcuugg

SEQ ID NO: 307103 - RNA, 15 nt, Bordetella pertussis
cggccgucaccgccg

SEQ ID NO: 307104 - RNA, 21 nt, Bordetella pertussis
cggccgucaccgccgccgcgc

SEQ ID NO: 307105 - RNA, 13 nt, Bordetella pertussis
cggccgucagcag

SEQ ID NO: 307106 - RNA, 22 nt, Bordetella pertussis
cggccgucagcagcaggcuggc

SEQ ID NO: 307107 - RNA, 18 nt, Bordetella pertussis
cggccguaguucggcggg

SEQ ID NO: 307108 - RNA, 13 nt, Bordetella pertussis
cggccgucgaccg

SEQ ID NO: 307109 - RNA, 19 nt, Bordetella pertussis
cggccgucgaccgacagca

SEQ ID NO: 307110 - RNA, 12 nt, Bordetella pertussis
cggccgucgccu

SEQ ID NO: 307111 - RNA, 19 nt, Bordetella pertussis
cggccgucgccuucggcgg

SEQ ID NO: 307112 - RNA, 16 nt, Bordetella pertussis
cggccgucggcgcugg

SEQ ID NO: 307113 - RNA, 19 nt, Bordetella pertussis
cggccgucggcgcuggcgc

SEQ ID NO: 307114 - RNA, 17 nt, Bordetella pertussis
cggccgucgugcagcgu

SEQ ID NO: 307115 - RNA, 16 nt, Bordetella pertussis
cggccgucugggcgug

SEQ ID NO: 307116 - RNA, 14 nt, Bordetella pertussis
cggccgucgguggu

SEQ ID NO: 307117 - RNA, 21 nt, Bordetella pertussis
cggccgugccucaacuggccg

SEQ ID NO: 307118 - RNA, 16 nt, Bordetella pertussis
cggccguggaggcggc

SEQ ID NO: 307119 - RNA, 19 nt, Bordetella pertussis
cggccguggaggcggcggc

SEQ ID NO: 307120 - RNA, 18 nt, Bordetella pertussis
cggccguggccgggcccg

SEQ ID NO: 307121 - RNA, 17 nt, Bordetella pertussis
cggccguggcggccugc

SEQ ID NO: 307122 - RNA, 19 nt, Bordetella pertussis
cggccguggcggccugcgc

SEQ ID NO: 307123 - RNA, 20 nt, Bordetella pertussis
cggccguggcggccugcgcc

SEQ ID NO: 307124 - RNA, 19 nt, Bordetella pertussis
cggccguguucgagcaggc

SEQ ID NO: 307125 - RNA, 23 nt, Bordetella pertussis
cggccguguucgagcaggcgcgc

SEQ ID NO: 307126 - RNA, 23 nt, Bordetella pertussis
cggccguuaugguucggccucgc

SEQ ID NO: 307127 - RNA, 16 nt, Bordetella pertussis
cggccguugcuccagc

SEQ ID NO: 307128 - RNA, 23 nt, Bordetella pertussis
cggccguugcuccagccaggcgc

SEQ ID NO: 307129 - RNA, 14 nt, Bordetella pertussis
cggccguuggcgau

SEQ ID NO: 307130 - RNA, 24 nt, Bordetella pertussis
cggccguuggcgauggcgcggccg

SEQ ID NO: 307131 - RNA, 14 nt, Bordetella pertussis
cggccguuggcgug

SEQ ID NO: 307132 - RNA, 20 nt, Bordetella pertussis
cggccguuucaggccugcgg

SEQ ID NO: 307133 - RNA, 15 nt, Bordetella pertussis
cggccuaucaccugg

SEQ ID NO: 307134 - RNA, 18 nt, Bordetella pertussis
cggccuaucaccugggca

SEQ ID NO: 307135 - RNA, 20 nt, Bordetella pertussis
cggccuaucaccugggcaac

SEQ ID NO: 307136 - RNA, 17 nt, Bordetella pertussis
cggccuaugugcaggcc

SEQ ID NO: 307137 - RNA, 16 nt, Bordetella pertussis
cggccuauuuggcggc

SEQ ID NO: 307138 - RNA, 20 nt, Bordetella pertussis
cggccuauuuggcggccugg

SEQ ID NO: 307139 - RNA, 22 nt, Bordetella pertussis
cggccuauuuggcggccuggcc

SEQ ID NO: 307140 - RNA, 15 nt, Bordetella pertussis
cggccucagcggccg

SEQ ID NO: 307141 - RNA, 21 nt, Bordetella pertussis
cggccucagcggccgcugccg

SEQ ID NO: 307142 - RNA, 13 nt, Bordetella pertussis
cggccucaucccg

SEQ ID NO: 307143 - RNA, 20 nt, Bordetella pertussis
cggccucaucgagcgccugg

SEQ ID NO: 307144 - RNA, 18 nt, Bordetella pertussis
cggccucccggaccagca

SEQ ID NO: 307145 - RNA, 12 nt, Bordetella pertussis
cggccuccgcgc

SEQ ID NO: 307146 - RNA, 15 nt, Bordetella pertussis
cggccuccgcgcaca

SEQ ID NO: 307147 - RNA, 18 nt, Bordetella pertussis
cggccuccgcgcacagcg

SEQ ID NO: 307148 - RNA, 14 nt, Bordetella pertussis
cggccuccgcgccg

SEQ ID NO: 307149 - RNA, 14 nt, Bordetella pertussis
cggccucgacggcc

SEQ ID NO: 307150 - RNA, 15 nt, Bordetella pertussis
cggccucgacggccg

SEQ ID NO: 307151 - RNA, 18 nt, Bordetella pertussis
cggccucgacggccgccg

SEQ ID NO: 307152 - RNA, 19 nt, Bordetella pertussis
cggccucgacggccgccgg

SEQ ID NO: 307153 - RNA, 19 nt, Bordetella pertussis
cggccucgacgauggccgg

SEQ ID NO: 307154 - RNA, 22 nt, Bordetella pertussis
cggccucgacgauggccggggc

SEQ ID NO: 307155 - RNA, 21 nt, Bordetella pertussis
cggccucgcccaugcgggcgu

SEQ ID NO: 307156 - RNA, 15 nt, Bordetella pertussis
cggccucgccggccu

SEQ ID NO: 307157 - RNA, 17 nt, Bordetella pertussis
cggccucgccggccugg

SEQ ID NO: 307158 - RNA, 15 nt, Bordetella pertussis
cggccucgcggcgca

SEQ ID NO: 307159 - RNA, 21 nt, Bordetella pertussis
cggccucgcggcgcagcauga

SEQ ID NO: 307160 - RNA, 23 nt, Bordetella pertussis
cggccucgcugcgggcggccugg

SEQ ID NO: 307161 - RNA, 17 nt, Bordetella pertussis
cggccucggccagcugg

SEQ ID NO: 307162 - RNA, 14 nt, Bordetella pertussis
cggccucggccagg

SEQ ID NO: 307163 - RNA, 20 nt, Bordetella pertussis
cggccucggcgggcggcgcc

SEQ ID NO: 307164 - RNA, 21 nt, Bordetella pertussis
cggccucggcgggcggcgcca

SEQ ID NO: 307165 - RNA, 18 nt, Bordetella pertussis
cggccucgguacuccuug

SEQ ID NO: 307166 - RNA, 20 nt, Bordetella pertussis
cggccucguaguguucgaug

SEQ ID NO: 307167 - RNA, 14 nt, Bordetella pertussis
cggccucuucgucg

SEQ ID NO: 307168 - RNA, 22 nt, Bordetella pertussis
cggccucuucgucgccggcgcu

SEQ ID NO: 307169 - RNA, 20 nt, Bordetella pertussis
cggccugaaccaggccgcca

SEQ ID NO: 307170 - RNA, 20 nt, Bordetella pertussis
cggccugacgcgcaagcggc

SEQ ID NO: 307171 - RNA, 16 nt, Bordetella pertussis
cggccugcaaugcggc

SEQ ID NO: 307172 - RNA, 17 nt, Bordetella pertussis
cggccugcaaugcggcc

SEQ ID NO: 307173 - RNA, 21 nt, Bordetella pertussis
cggccugcaaugcggccaggc

SEQ ID NO: 307174 - RNA, 17 nt, Bordetella pertussis
cggccugcaccggcgcg

SEQ ID NO: 307175 - RNA, 18 nt, Bordetella pertussis
cggccugcaccggcgcga

SEQ ID NO: 307176 - RNA, 22 nt, Bordetella pertussis
cggccugcacggugggcagcag

SEQ ID NO: 307177 - RNA, 23 nt, Bordetella pertussis
cggccugcacggugggcagcagc

SEQ ID NO: 307178 - RNA, 20 nt, Bordetella pertussis
cggccugcagaccagcaccg

SEQ ID NO: 307179 - RNA, 12 nt, Bordetella pertussis
cggccugcaggc

SEQ ID NO: 307180 - RNA, 22 nt, Bordetella pertussis
cggccugcaggcccagcacgcg

SEQ ID NO: 307181 - RNA, 13 nt, Bordetella pertussis
cggccugcaggcu

SEQ ID NO: 307182 - RNA, 18 nt, Bordetella pertussis
cggccugcaggugccgcc

SEQ ID NO: 307183 - RNA, 19 nt, Bordetella pertussis
cggccugcaggugccgccg

SEQ ID NO: 307184 - RNA, 20 nt, Bordetella pertussis
cggccugcaugucguacagg

SEQ ID NO: 307185 - RNA, 22 nt, Bordetella pertussis
cggccugcaugucguacaggcc

SEQ ID NO: 307186 - RNA, 18 nt, Bordetella pertussis
cggccugccaccagcgcg

SEQ ID NO: 307187 - RNA, 15 nt, Bordetella pertussis
cggccugccagccug

SEQ ID NO: 307188 - RNA, 21 nt, Bordetella pertussis
cggccugccagccugccacau

SEQ ID NO: 307189 - RNA, 14 nt, Bordetella pertussis
cggccugcccgggc

SEQ ID NO: 307190 - RNA, 16 nt, Bordetella pertussis
cggccugcccgggcgg

SEQ ID NO: 307191 - RNA, 18 nt, Bordetella pertussis
cggccugcccgggcggga

SEQ ID NO: 307192 - RNA, 19 nt, Bordetella pertussis
cggccugcccguucacgcg

SEQ ID NO: 307193 - RNA, 19 nt, Bordetella pertussis
cggccuggcgcgcaucggc

SEQ ID NO: 307194 - RNA, 22 nt, Bordetella pertussis
cggccuggcgcgcaucggcgcc

SEQ ID NO: 307195 - RNA, 14 nt, Bordetella pertussis
cggccuggcgcgcg

SEQ ID NO: 307196 - RNA, 15 nt, Bordetella pertussis
cggccuggcgcgcgg

SEQ ID NO: 307197 - RNA, 17 nt, Bordetella pertussis
cggccuggcgcgcggcc

SEQ ID NO: 307198 - RNA, 20 nt, Bordetella pertussis
cggccuggcgcgcggccugg

SEQ ID NO: 307199 - RNA, 19 nt, Bordetella pertussis
cggccuggcgcuccucgcg

SEQ ID NO: 307200 - RNA, 21 nt, Bordetella pertussis
cggccuggcgcuccucgcgcg

SEQ ID NO: 307201 - RNA, 15 nt, Bordetella pertussis
cggccuggcgggccg

SEQ ID NO: 307202 - RNA, 17 nt, Bordetella pertussis
cggccuggcgguaugcg

SEQ ID NO: 307203 - RNA, 21 nt, Bordetella pertussis
cggccuggcgguaugcggcgc

SEQ ID NO: 307204 - RNA, 22 nt, Bordetella pertussis
cggccuggcgguaugcggcgcc

SEQ ID NO: 307205 - RNA, 12 nt, Bordetella pertussis
cggccugccggc

SEQ ID NO: 307206 - RNA, 17 nt, Bordetella pertussis
cggccugggcggcgcgc

SEQ ID NO: 307207 - RNA, 18 nt, Bordetella pertussis
cggccugggcggcgcgcu

SEQ ID NO: 307208 - RNA, 15 nt, Bordetella pertussis
cggccugggcgggcc

SEQ ID NO: 307209 - RNA, 17 nt, Bordetella pertussis
cggccuggggacgggcg

SEQ ID NO: 307210 - RNA, 21 nt, Bordetella pertussis
cggccuggggacgggcgcaca

SEQ ID NO: 307211 - RNA, 22 nt, Bordetella pertussis
cggccuggggacgggcgcacag

SEQ ID NO: 307212 - RNA, 16 nt, Bordetella pertussis
cggccugggaggcgcu

SEQ ID NO: 307213 - RNA, 17 nt, Bordetella pertussis
cggccugggaggcgcug

SEQ ID NO: 307214 - RNA, 18 nt, Bordetella pertussis
cggccugggaggcgcuga

SEQ ID NO: 307215 - RNA, 17 nt, Bordetella pertussis
cggccugggccauggcc

SEQ ID NO: 307216 - RNA, 19 nt, Bordetella pertussis
cggccuguucgcggugucg

SEQ ID NO: 307217 - RNA, 19 nt, Bordetella pertussis
cggccuguucggacgcacc

SEQ ID NO: 307218 - RNA, 19 nt, Bordetella pertussis
cggccuucaccccgccacc

SEQ ID NO: 307219 - RNA, 24 nt, Bordetella pertussis
cggccuucaugaucuggccgacca

SEQ ID NO: 307220 - RNA, 14 nt, Bordetella pertussis
cggccuucggcggc

SEQ ID NO: 307221 - RNA, 16 nt, Bordetella pertussis
cggccuucggcggcgc

SEQ ID NO: 307222 - RNA, 20 nt, Bordetella pertussis
cggccuucggcggcgcgcug

SEQ ID NO: 307223 - RNA, 21 nt, Bordetella pertussis
cggccuucggcggcgcgcugg

SEQ ID NO: 307224 - RNA, 15 nt, Bordetella pertussis
cggccuucugcgcca

SEQ ID NO: 307225 - RNA, 17 nt, Bordetella pertussis
cggccuucugcgccagc

SEQ ID NO: 307226 - RNA, 22 nt, Bordetella pertussis
cggccuugcugaaccugcuggc

SEQ ID NO: 307227 - RNA, 20 nt, Bordetella pertussis
cggccuuggccauguccugg

SEQ ID NO: 307228 - RNA, 19 nt, Bordetella pertussis
cggccuuggccgcagccgg

SEQ ID NO: 307229 - RNA, 22 nt, Bordetella pertussis
cggccuuggccgcagccggcug

SEQ ID NO: 307230 - RNA, 13 nt, Bordetella pertussis
cggccuugggcgc

SEQ ID NO: 307231 - RNA, 17 nt, Bordetella pertussis
cggccuugggcgcggcg

SEQ ID NO: 307232 - RNA, 18 nt, Bordetella pertussis
cggccuugucgcgcccga

SEQ ID NO: 307233 - RNA, 15 nt, Bordetella pertussis
cggccuugugcgcca

SEQ ID NO: 307234 - RNA, 22 nt, Bordetella pertussis
cggccuuuuuuugcggcacggc

SEQ ID NO: 307235 - RNA, 14 nt, Bordetella pertussis
cggcgaucugcgcg

SEQ ID NO: 307236 - RNA, 17 nt, Bordetella pertussis
cggcgaucugcgcggcg

SEQ ID NO: 307237 - RNA, 19 nt, Bordetella pertussis
cggcgaucugggccucggc

SEQ ID NO: 307238 - RNA, 23 nt, Bordetella pertussis
cggcgaucugggccucggccagc

SEQ ID NO: 307239 - RNA, 14 nt, Bordetella pertussis
cggcgaucuuguag

SEQ ID NO: 307240 - RNA, 20 nt, Bordetella pertussis
cggcgaugaacagcggcacg

SEQ ID NO: 307241 - RNA, 17 nt, Bordetella pertussis
cggcgaugacggcuucg

SEQ ID NO: 307242 - RNA, 20 nt, Bordetella pertussis
cggcgaugccccaguccagg

SEQ ID NO: 307243 - RNA, 22 nt, Bordetella pertussis
cggcgaugccccaguccaggcc

SEQ ID NO: 307244 - RNA, 21 nt, Bordetella pertussis
cggcgaugccggcgcugcgca

SEQ ID NO: 307245 - RNA, 23 nt, Bordetella pertussis
cggcgaugccggcgcugcgcagc

SEQ ID NO: 307246 - RNA, 15 nt, Bordetella pertussis
cggcgaugccguacu

SEQ ID NO: 307247 - RNA, 16 nt, Bordetella pertussis
cggcgaugcacccagg

SEQ ID NO: 307248 - RNA, 14 nt, Bordetella pertussis
cggcgauggcgcgc

SEQ ID NO: 307249 - RNA, 14 nt, Bordetella pertussis
cggcgauggcguug

SEQ ID NO: 307250 - RNA, 21 nt, Bordetella pertussis
cggcgauggcguugcgcacca

SEQ ID NO: 307251 - RNA, 15 nt, Bordetella pertussis
cggcgauggcgcgcg

SEQ ID NO: 307252 - RNA, 18 nt, Bordetella pertussis
cggcgauguggcgcgcca

SEQ ID NO: 307253 - RNA, 17 nt, Bordetella pertussis
cggcgcacaccaucagc

SEQ ID NO: 307254 - RNA, 13 nt, Bordetella pertussis
cggcgcaccagcg

SEQ ID NO: 307255 - RNA, 16 nt, Bordetella pertussis
cggcgcaccagcgagg

SEQ ID NO: 307256 - RNA, 13 nt, Bordetella pertussis
cggcgcacccgcg

SEQ ID NO: 307257 - RNA, 14 nt, Bordetella pertussis
cggcgcacccgcgg

SEQ ID NO: 307258 - RNA, 16 nt, Bordetella pertussis
cggcgcaccgacagca

SEQ ID NO: 307259 - RNA, 22 nt, Bordetella pertussis
cggcgcaccgacagcaagggca

SEQ ID NO: 307260 - RNA, 14 nt, Bordetella pertussis
cggcgcagccggcc

SEQ ID NO: 307261 - RNA, 17 nt, Bordetella pertussis
cggcgcaccgucacgcg

SEQ ID NO: 307262 - RNA, 14 nt, Bordetella pertussis
cggcgcagcgccca

SEQ ID NO: 307263 - RNA, 16 nt, Bordetella pertussis
cggcgcagcgcccagg

SEQ ID NO: 307264 - RNA, 15 nt, Bordetella pertussis
cggcgcagcgcacga

SEQ ID NO: 307265 - RNA, 16 nt, Bordetella pertussis
cggcgcagcgcacgau

SEQ ID NO: 307266 - RNA, 12 nt, Bordetella pertussis
cggcgcagcgcg

SEQ ID NO: 307267 - RNA, 15 nt, Bordetella pertussis
cggcgcagcgcgucc

SEQ ID NO: 307268 - RNA, 20 nt, Bordetella pertussis
cggcgcaggaugcgcuggcc

SEQ ID NO: 307269 - RNA, 22 nt, Bordetella pertussis
cggcgcaggaugcgcuggccgg

SEQ ID NO: 307270 - RNA, 13 nt, Bordetella pertussis
cggcgcaggccgc

SEQ ID NO: 307271 - RNA, 15 nt, Bordetella pertussis
cggcgcaggccgcgc

SEQ ID NO: 307272 - RNA, 17 nt, Bordetella pertussis
cggcgcaggccgcgccg

SEQ ID NO: 307273 - RNA, 18 nt, Bordetella pertussis
cggcgcaggccgcgccgg

SEQ ID NO: 307274 - RNA, 19 nt, Bordetella pertussis
cggcgcaggccgcgccggc

SEQ ID NO: 307275 - RNA, 14 nt, Bordetella pertussis
cggcgcaggccugc

SEQ ID NO: 307276 - RNA, 13 nt, Bordetella pertussis
cggcgcaggccag

SEQ ID NO: 307277 - RNA, 14 nt, Bordetella pertussis
cggcgcaggccagc

SEQ ID NO: 307278 - RNA, 17 nt, Bordetella pertussis
cggcgccaguagcgccg

SEQ ID NO: 307279 - RNA, 16 nt, Bordetella pertussis
cggcgccagucgcgca

SEQ ID NO: 307280 - RNA, 20 nt, Bordetella pertussis
cggcgccaugaucgccggca

SEQ ID NO: 307281 - RNA, 22 nt, Bordetella pertussis
cggcgccaugaucgccggcaac

SEQ ID NO: 307282 - RNA, 14 nt, Bordetella pertussis
cggcgccaugccgc

SEQ ID NO: 307283 - RNA, 16 nt, Bordetella pertussis
cggcgccaugccgcgc

SEQ ID NO: 307284 - RNA, 19 nt, Bordetella pertussis
cggcgccaugccgcgcccg

SEQ ID NO: 307285 - RNA, 19 nt, Bordetella pertussis
cggcgccaugcgcaccacc

SEQ ID NO: 307286 - RNA, 22 nt, Bordetella pertussis
cggcgccaugcgcaccaccgcc

SEQ ID NO: 307287 - RNA, 19 nt, Bordetella pertussis
cggcgccaugcuggccgcc

SEQ ID NO: 307288 - RNA, 12 nt, Bordetella pertussis
cggcgcccacgc

SEQ ID NO: 307289 - RNA, 19 nt, Bordetella pertussis
cggcgcccagcuccacccc

SEQ ID NO: 307290 - RNA, 18 nt, Bordetella pertussis
cggcgcccagcuggcgcc

SEQ ID NO: 307291 - RNA, 11 nt, Bordetella pertussis
cggcgcccagg

SEQ ID NO: 307292 - RNA, 14 nt, Bordetella pertussis
cggcgcccaggccc

SEQ ID NO: 307293 - RNA, 18 nt, Bordetella pertussis
cggcgcccaggcccagcg

SEQ ID NO: 307294 - RNA, 19 nt, Bordetella pertussis
cggcgcccaggcccagcgc

SEQ ID NO: 307295 - RNA, 13 nt, Bordetella pertussis
cggcgcccccgcg

SEQ ID NO: 307296 - RNA, 14 nt, Bordetella pertussis
cggcgcccgaggcc

SEQ ID NO: 307297 - RNA, 16 nt, Bordetella pertussis
cggcgcccgccgccgg

SEQ ID NO: 307298 - RNA, 21 nt, Bordetella pertussis
cggcgcccgccgccgggcgcg

SEQ ID NO: 307299 - RNA, 14 nt, Bordetella pertussis
cggcgcccgcggcc

SEQ ID NO: 307300 - RNA, 18 nt, Bordetella pertussis
cggcgcccggcgccgcgc

SEQ ID NO: 307301 - RNA, 13 nt, Bordetella pertussis
cggcgcccgcgca

SEQ ID NO: 307302 - RNA, 17 nt, Bordetella pertussis
cggcgcccgcgcaugca

SEQ ID NO: 307303 - RNA, 12 nt, Bordetella pertussis
cggcgccgccgg

SEQ ID NO: 307304 - RNA, 15 nt, Bordetella pertussis
cggcgccgccggcca

SEQ ID NO: 307305 - RNA, 16 nt, Bordetella pertussis
cggcgccgccggcggc

SEQ ID NO: 307306 - RNA, 17 nt, Bordetella pertussis
cggcgccgccggcggcc

SEQ ID NO: 307307 - RNA, 22 nt, Bordetella pertussis
cggcgccgccggcggccuggac

SEQ ID NO: 307308 - RNA, 20 nt, Bordetella pertussis
cggcgccgccucaggccggc

SEQ ID NO: 307309 - RNA, 21 nt, Bordetella pertussis
cggcgccgccucgggcacggc

SEQ ID NO: 307310 - RNA, 22 nt, Bordetella pertussis
cggcgccgccucgggcacggcc

SEQ ID NO: 307311 - RNA, 17 nt, Bordetella pertussis
cggcgccgcggcgcuuc

SEQ ID NO: 307312 - RNA, 16 nt, Bordetella pertussis
cggcgccgcgcgcggc

SEQ ID NO: 307313 - RNA, 20 nt, Bordetella pertussis
cggcgccgcguucacgccgg

SEQ ID NO: 307314 - RNA, 14 nt, Bordetella pertussis
cggcgccgcuggcc

SEQ ID NO: 307315 - RNA, 13 nt, Bordetella pertussis
cggcgccgcuucc

SEQ ID NO: 307316 - RNA, 18 nt, Bordetella pertussis
cggcgccgcuuccggcau

SEQ ID NO: 307317 - RNA, 21 nt, Bordetella pertussis
cggcgccgcuuccggcaugac

SEQ ID NO: 307318 - RNA, 13 nt, Bordetella pertussis
cggcgccggaucg

SEQ ID NO: 307319 - RNA, 15 nt, Bordetella pertussis
cggcgccggaucggc

SEQ ID NO: 307320 - RNA, 19 nt, Bordetella pertussis
cggcgccggaucggccggc

SEQ ID NO: 307321 - RNA, 20 nt, Bordetella pertussis
cggcgccggaucggccggca

SEQ ID NO: 307322 - RNA, 12 nt, Bordetella pertussis
cggcgccggcaa

SEQ ID NO: 307323 - RNA, 14 nt, Bordetella pertussis
cggcgccggccgcc

SEQ ID NO: 307324 - RNA, 16 nt, Bordetella pertussis
cggcgccggccgcccg

SEQ ID NO: 307325 - RNA, 15 nt, Bordetella pertussis
cggcgccguccagcg

SEQ ID NO: 307326 - RNA, 18 nt, Bordetella pertussis
cggcgccguccagcgcgg

SEQ ID NO: 307327 - RNA, 20 nt, Bordetella pertussis
cggcgccguccagcgcggca

SEQ ID NO: 307328 - RNA, 22 nt, Bordetella pertussis
cggcgccguccagcgcggcaug

SEQ ID NO: 307329 - RNA, 14 nt, Bordetella pertussis
cggcgccguccgca

SEQ ID NO: 307330 - RNA, 14 nt, Bordetella pertussis
cggcgcgaccgccu

SEQ ID NO: 307331 - RNA, 22 nt, Bordetella pertussis
cggcgcgaccgccuccagcgcg

SEQ ID NO: 307332 - RNA, 23 nt, Bordetella pertussis
cggcgcgaccgccuccagcgcgg

SEQ ID NO: 307333 - RNA, 12 nt, Bordetella pertussis
cggcgcgaccug

SEQ ID NO: 307334 - RNA, 16 nt, Bordetella pertussis
cggcgcgaccugcgcg

SEQ ID NO: 307335 - RNA, 18 nt, Bordetella pertussis
cggcgcgaccugcgcgac

SEQ ID NO: 307336 - RNA, 20 nt, Bordetella pertussis
cggcgcgaccugcgcgaccg

SEQ ID NO: 307337 - RNA, 13 nt, Bordetella pertussis
cggcgccgugcug

SEQ ID NO: 307338 - RNA, 15 nt, Bordetella pertussis
cggcgcgacgcgcuu

SEQ ID NO: 307339 - RNA, 16 nt, Bordetella pertussis
cggcgcgagcgaugcc

SEQ ID NO: 307340 - RNA, 15 nt, Bordetella pertussis
cggcgcgagcgcaca

SEQ ID NO: 307341 - RNA, 19 nt, Bordetella pertussis
cggcgcgauggucaccacc

SEQ ID NO: 307342 - RNA, 18 nt, Bordetella pertussis
cggcgcgcaaaccgacgc

SEQ ID NO: 307343 - RNA, 22 nt, Bordetella pertussis
cggcgcgcaaaccgacgcggcc

SEQ ID NO: 307344 - RNA, 19 nt, Bordetella pertussis
cggcgcgcccgcaggcggc

SEQ ID NO: 307345 - RNA, 21 nt, Bordetella pertussis
cggcgcgcccgccgcgucggc

SEQ ID NO: 307346 - RNA, 15 nt, Bordetella pertussis
cggcgcgcccgccuu

SEQ ID NO: 307347 - RNA, 14 nt, Bordetella pertussis
cggcgcgcacgcuc

SEQ ID NO: 307348 - RNA, 14 nt, Bordetella pertussis
cggcgcgcccuugc

SEQ ID NO: 307349 - RNA, 16 nt, Bordetella pertussis
cggcgcgccgcgccgc

SEQ ID NO: 307350 - RNA, 16 nt, Bordetella pertussis
cggcgcgccgcgucgg

SEQ ID NO: 307351 - RNA, 21 nt, Bordetella pertussis
cggcgcgccgcgucgguggcc

SEQ ID NO: 307352 - RNA, 15 nt, Bordetella pertussis
cggcgcgccggccgc

SEQ ID NO: 307353 - RNA, 21 nt, Bordetella pertussis
cggcgcgccggccgcggggcu

SEQ ID NO: 307354 - RNA, 11 nt, Bordetella pertussis
cggcgcgccgg

SEQ ID NO: 307355 - RNA, 13 nt, Bordetella pertussis
cggcgcgccggcc

SEQ ID NO: 307356 - RNA, 14 nt, Bordetella pertussis
cggcgcgccggccg

SEQ ID NO: 307357 - RNA, 23 nt, Bordetella pertussis
cggcgcgccucggcgcgcgcggc

SEQ ID NO: 307358 - RNA, 15 nt, Bordetella pertussis
cggcgcgccuggcgc

SEQ ID NO: 307359 - RNA, 19 nt, Bordetella pertussis
cggcgcgccuuacgcggcg

SEQ ID NO: 307360 - RNA, 21 nt, Bordetella pertussis
cggcgcgccuucggcaggcgc

SEQ ID NO: 307361 - RNA, 22 nt, Bordetella pertussis
cggcgcgccuucggcaggcgcc

SEQ ID NO: 307362 - RNA, 23 nt, Bordetella pertussis
cggcgcgccuucggcaggcgccg

SEQ ID NO: 307363 - RNA, 13 nt, Bordetella pertussis
cggcgcggccaac

SEQ ID NO: 307364 - RNA, 13 nt, Bordetella pertussis
cggcgcggccagc

SEQ ID NO: 307365 - RNA, 14 nt, Bordetella pertussis
cggcgcggccagca

SEQ ID NO: 307366 - RNA, 13 nt, Bordetella pertussis
cggcgcggcccgc

SEQ ID NO: 307367 - RNA, 17 nt, Bordetella pertussis
cggcgcggcccgccacg

SEQ ID NO: 307368 - RNA, 21 nt, Bordetella pertussis
cggcgcggcccgccacgcagg

SEQ ID NO: 307369 - RNA, 14 nt, Bordetella pertussis
cggcgcggccuucc

SEQ ID NO: 307370 - RNA, 22 nt, Bordetella pertussis
cggcgcggccuugcaugcgccg

SEQ ID NO: 307371 - RNA, 14 nt, Bordetella pertussis
cggcgcggcgagca

SEQ ID NO: 307372 - RNA, 23 nt, Bordetella pertussis
cggcgcggcgagcacggccugcu

SEQ ID NO: 307373 - RNA, 16 nt, Bordetella pertussis
cggcgcggcgaucggc

SEQ ID NO: 307374 - RNA, 17 nt, Bordetella pertussis
cggcgcggcgaucggcc

SEQ ID NO: 307375 - RNA, 13 nt, Bordetella pertussis
cggcgcggccggg

SEQ ID NO: 307376 - RNA, 12 nt, Bordetella pertussis
cggcgcggcgcc

SEQ ID NO: 307377 - RNA, 13 nt, Bordetella pertussis
cggcgcggcgccg

SEQ ID NO: 307378 - RNA, 14 nt, Bordetella pertussis
cggcgcggcgcgcu

SEQ ID NO: 307379 - RNA, 15 nt, Bordetella pertussis
cggcgcggcgcgcug

SEQ ID NO: 307380 - RNA, 14 nt, Bordetella pertussis
cggcgcggcgcugg

SEQ ID NO: 307381 - RNA, 20 nt, Bordetella pertussis
cggcgcgggucuugagcggc

SEQ ID NO: 307382 - RNA, 23 nt, Bordetella pertussis
cggcgcgguauggccgcccagca

SEQ ID NO: 307383 - RNA, 16 nt, Bordetella pertussis
cggcgcgguggccaug

SEQ ID NO: 307384 - RNA, 18 nt, Bordetella pertussis
cggcgcgguggccaugcu

SEQ ID NO: 307385 - RNA, 18 nt, Bordetella pertussis
cggcgcgguugguuugcg

SEQ ID NO: 307386 - RNA, 16 nt, Bordetella pertussis
cggcgcguccacgccg

SEQ ID NO: 307387 - RNA, 18 nt, Bordetella pertussis
cggcgcgucgccggcgau

SEQ ID NO: 307388 - RNA, 18 nt, Bordetella pertussis
cggcgcgucgcgcgccag

SEQ ID NO: 307389 - RNA, 15 nt, Bordetella pertussis
cggcgcgucgcgcgg

SEQ ID NO: 307390 - RNA, 14 nt, Bordetella pertussis
cggcgcgucgcggu

SEQ ID NO: 307391 - RNA, 16 nt, Bordetella pertussis
cggcgcgugaugucga

SEQ ID NO: 307392 - RNA, 12 nt, Bordetella pertussis
cggcgcgugcgg

SEQ ID NO: 307393 - RNA, 13 nt, Bordetella pertussis
cggcgcgugcgga

SEQ ID NO: 307394 - RNA, 17 nt, Bordetella pertussis
cggcgcgugcuggcgca

SEQ ID NO: 307395 - RNA, 18 nt, Bordetella pertussis
cggcgcgugcuggcgcag

SEQ ID NO: 307396 - RNA, 20 nt, Bordetella pertussis
cggcgcgugcuggcgcagca

SEQ ID NO: 307397 - RNA, 20 nt, Bordetella pertussis
cggcgcguucagcagcaggc

SEQ ID NO: 307398 - RNA, 23 nt, Bordetella pertussis
cggcgcguucagcagcaggcccu

SEQ ID NO: 307399 - RNA, 19 nt, Bordetella pertussis
cggcgcguucgccgcagcc

SEQ ID NO: 307400 - RNA, 15 nt, Bordetella pertussis
cggcgcugcacgcgg

SEQ ID NO: 307401 - RNA, 17 nt, Bordetella pertussis
cggcgcugcacgcggcc

SEQ ID NO: 307402 - RNA, 12 nt, Bordetella pertussis
cggcgcugcagc

SEQ ID NO: 307403 - RNA, 16 nt, Bordetella pertussis
cggcgcugcagcgcag

SEQ ID NO: 307404 - RNA, 19 nt, Bordetella pertussis
cggcgcugcgcagcagggc

SEQ ID NO: 307405 - RNA, 15 nt, Bordetella pertussis
cggcgcuuaccgcgc

SEQ ID NO: 307406 - RNA, 16 nt, Bordetella pertussis
cggcgcuuaccgcgcc

SEQ ID NO: 307407 - RNA, 17 nt, Bordetella pertussis
cggcgcuuaccgcgccg

SEQ ID NO: 307408 - RNA, 20 nt, Bordetella pertussis
cggcgcuuaccgcgccggcu

SEQ ID NO: 307409 - RNA, 22 nt, Bordetella pertussis
cggcgcuuaccgcgccggcucg

SEQ ID NO: 307410 - RNA, 20 nt, Bordetella pertussis
cggcggaaauuggggccgcc

SEQ ID NO: 307411 - RNA, 15 nt, Bordetella pertussis
cggcggaaugcggcg

SEQ ID NO: 307412 - RNA, 16 nt, Bordetella pertussis
cggcggaaugcggcga

SEQ ID NO: 307413 - RNA, 17 nt, Bordetella pertussis
cggcggcaccagcaggc

SEQ ID NO: 307414 - RNA, 19 nt, Bordetella pertussis
cggcggcaccagcaggccg

SEQ ID NO: 307415 - RNA, 21 nt, Bordetella pertussis
cggcggcaccagcaggccggu

SEQ ID NO: 307416 - RNA, 19 nt, Bordetella pertussis
cggcggcaccauugccggc

SEQ ID NO: 307417 - RNA, 22 nt, Bordetella pertussis
cggcggcaccauugccggcgcg

SEQ ID NO: 307418 - RNA, 22 nt, Bordetella pertussis
cggcggcaccgcgcagcccggc

SEQ ID NO: 307419 - RNA, 18 nt, Bordetella pertussis
cggcggcacgcgcgccgg

SEQ ID NO: 307420 - RNA, 13 nt, Bordetella pertussis
cggcggcacgcug

SEQ ID NO: 307421 - RNA, 14 nt, Bordetella pertussis
cggcggcacggccg

SEQ ID NO: 307422 - RNA, 17 nt, Bordetella pertussis
cggcggcacggccggcc

SEQ ID NO: 307423 - RNA, 16 nt, Bordetella pertussis
cggcggcacgguggcg

SEQ ID NO: 307424 - RNA, 13 nt, Bordetella pertussis
cggcggcagccgg

SEQ ID NO: 307425 - RNA, 16 nt, Bordetella pertussis
cggcggcagccggcca

SEQ ID NO: 307426 - RNA, 14 nt, Bordetella pertussis
cggcggcagcgcga

SEQ ID NO: 307427 - RNA, 17 nt, Bordetella pertussis
cggcggcagcgcgaacg

SEQ ID NO: 307428 - RNA, 18 nt, Bordetella pertussis
cggcggcagcuugaccgc

SEQ ID NO: 307429 - RNA, 14 nt, Bordetella pertussis
cggcggcaggccgc

SEQ ID NO: 307430 - RNA, 14 nt, Bordetella pertussis
cggcggcaggucgg

SEQ ID NO: 307431 - RNA, 18 nt, Bordetella pertussis
cggcggccagcagcggca

SEQ ID NO: 307432 - RNA, 20 nt, Bordetella pertussis
cggcggccagcagcggcagg

SEQ ID NO: 307433 - RNA, 14 nt, Bordetella pertussis
cggcggccagccgg

SEQ ID NO: 307434 - RNA, 18 nt, Bordetella pertussis
cggcggccagccggcgcg

SEQ ID NO: 307435 - RNA, 16 nt, Bordetella pertussis
cggcggccagcgcgca

SEQ ID NO: 307436 - RNA, 18 nt, Bordetella pertussis
cggcggccagcgcgcccu

SEQ ID NO: 307437 - RNA, 19 nt, Bordetella pertussis
cggcggccagcgcgccgcc

SEQ ID NO: 307438 - RNA, 14 nt, Bordetella pertussis
cggcggccagcgcg

SEQ ID NO: 307439 - RNA, 12 nt, Bordetella pertussis
cggcggccagcu

SEQ ID NO: 307440 - RNA, 15 nt, Bordetella pertussis
cggcggccaggcccu

SEQ ID NO: 307441 - RNA, 19 nt, Bordetella pertussis
cggcggccaggcccugcgc

SEQ ID NO: 307442 - RNA, 14 nt, Bordetella pertussis
cggcggccaggccg

SEQ ID NO: 307443 - RNA, 16 nt, Bordetella pertussis
cggcggccaggccggc

SEQ ID NO: 307444 - RNA, 14 nt, Bordetella pertussis
cggcggccaucgcc

SEQ ID NO: 307445 - RNA, 15 nt, Bordetella pertussis
cggcggccaucgcca

SEQ ID NO: 307446 - RNA, 14 nt, Bordetella pertussis
cggcggccaugccc

SEQ ID NO: 307447 - RNA, 15 nt, Bordetella pertussis
cggcggccaugccca

SEQ ID NO: 307448 - RNA, 16 nt, Bordetella pertussis
cggcggccaugcccag

SEQ ID NO: 307449 - RNA, 17 nt, Bordetella pertussis
cggcggccaugcccagg

SEQ ID NO: 307450 - RNA, 18 nt, Bordetella pertussis
cggcggccaugcccaggc

SEQ ID NO: 307451 - RNA, 16 nt, Bordetella pertussis
cggcggccaugccgac

SEQ ID NO: 307452 - RNA, 11 nt, Bordetella pertussis
cggcggccagg

SEQ ID NO: 307453 - RNA, 14 nt, Bordetella pertussis
cggcggccgccugc

SEQ ID NO: 307454 - RNA, 16 nt, Bordetella pertussis
cggcggccgccugcgc

SEQ ID NO: 307455 - RNA, 13 nt, Bordetella pertussis
cggcggccgccuu

SEQ ID NO: 307456 - RNA, 18 nt, Bordetella pertussis
cggcggccgcguccagcg

SEQ ID NO: 307457 - RNA, 15 nt, Bordetella pertussis
cggcggccgguaucg

SEQ ID NO: 307458 - RNA, 19 nt, Bordetella pertussis
cggcggccuccgcgcacag

SEQ ID NO: 307459 - RNA, 15 nt, Bordetella pertussis
cggcggccuccggca

SEQ ID NO: 307460 - RNA, 17 nt, Bordetella pertussis
cggcggccugcaggccg

SEQ ID NO: 307461 - RNA, 14 nt, Bordetella pertussis
cggcggccugggcg

SEQ ID NO: 307462 - RNA, 16 nt, Bordetella pertussis
cggcggccugggcggg

SEQ ID NO: 307463 - RNA, 18 nt, Bordetella pertussis
cggcggccuugugcgcca

SEQ ID NO: 307464 - RNA, 19 nt, Bordetella pertussis
cggcggccuugugcgccag

SEQ ID NO: 307465 - RNA, 19 nt, Bordetella pertussis
cggcggcgacucggcaucg

SEQ ID NO: 307466 - RNA, 23 nt, Bordetella pertussis
cggcggcgcauugccgucggccg

SEQ ID NO: 307467 - RNA, 17 nt, Bordetella pertussis
cggcggcgcccgcaugg

SEQ ID NO: 307468 - RNA, 13 nt, Bordetella pertussis
cggcggcgcgccg

SEQ ID NO: 307469 - RNA, 14 nt, Bordetella pertussis
cggcggcgcgccgc

SEQ ID NO: 307470 - RNA, 15 nt, Bordetella pertussis
cggcggcgcgcgcgc

SEQ ID NO: 307471 - RNA, 17 nt, Bordetella pertussis
cggcggcgcgcgcgccg

SEQ ID NO: 307472 - RNA, 12 nt, Bordetella pertussis
cggcggcgcgcu

SEQ ID NO: 307473 - RNA, 13 nt, Bordetella pertussis
cggcggcgcgcug

SEQ ID NO: 307474 - RNA, 14 nt, Bordetella pertussis
cggcggcgcgcugg

SEQ ID NO: 307475 - RNA, 16 nt, Bordetella pertussis
cggcggcgcggcgcca

SEQ ID NO: 307476 - RNA, 17 nt, Bordetella pertussis
cggcggcgcggucagca

SEQ ID NO: 307477 - RNA, 18 nt, Bordetella pertussis
cggcggcgcggucagcau

SEQ ID NO: 307478 - RNA, 13 nt, Bordetella pertussis
cggcggcggaucg

SEQ ID NO: 307479 - RNA, 21 nt, Bordetella pertussis
cggcggcgggcggccggcgcg

SEQ ID NO: 307480 - RNA, 12 nt, Bordetella pertussis
cggcggcgucgg

SEQ ID NO: 307481 - RNA, 19 nt, Bordetella pertussis
cggcggcgucggcgcccgg

SEQ ID NO: 307482 - RNA, 20 nt, Bordetella pertussis
cggcggcgucggcgcccggc

SEQ ID NO: 307483 - RNA, 13 nt, Bordetella pertussis
cggcggcgugccc

SEQ ID NO: 307484 - RNA, 16 nt, Bordetella pertussis
cggcggcgugcccugc

SEQ ID NO: 307485 - RNA, 20 nt, Bordetella pertussis
cggcggcguggccgugcugg

SEQ ID NO: 307486 - RNA, 23 nt, Bordetella pertussis
cggcggcguuccugggcacgccg

SEQ ID NO: 307487 - RNA, 14 nt, Bordetella pertussis
cggcggcuggacgc

SEQ ID NO: 307488 - RNA, 21 nt, Bordetella pertussis
cggcggcuucgcgcagcaagu

SEQ ID NO: 307489 - RNA, 15 nt, Bordetella pertussis
cggcggcuucggccg

SEQ ID NO: 307490 - RNA, 21 nt, Bordetella pertussis
cggcggcuucggccgucagca

SEQ ID NO: 307491 - RNA, 18 nt, Bordetella pertussis
cggcggcuugccgucgac

SEQ ID NO: 307492 - RNA, 20 nt, Bordetella pertussis
cggcggcuugccgucgaccg

SEQ ID NO: 307493 - RNA, 17 nt, Bordetella pertussis
cggcgggacgcaggccc

SEQ ID NO: 307494 - RNA, 18 nt, Bordetella pertussis
cggcgggacgcaggccca

SEQ ID NO: 307495 - RNA, 22 nt, Bordetella pertussis
cggcgggacgcaggcccagcca

SEQ ID NO: 307496 - RNA, 16 nt, Bordetella pertussis
cggcgggacggccauu

SEQ ID NO: 307497 - RNA, 18 nt, Bordetella pertussis
cggcgggaucgggcagcu

SEQ ID NO: 307498 - RNA, 22 nt, Bordetella pertussis
cggcgggaucugcaugccgacc

SEQ ID NO: 307499 - RNA, 23 nt, Bordetella pertussis
cggcgggcaacuucaccgucgac

SEQ ID NO: 307500 - RNA, 22 nt, Bordetella pertussis
cggcgggcaugacgaccgcgac

SEQ ID NO: 307501 - RNA, 13 nt, Bordetella pertussis
cggcgggccccgc

SEQ ID NO: 307502 - RNA, 12 nt, Bordetella pertussis
cggcgggccgca

SEQ ID NO: 307503 - RNA, 14 nt, Bordetella pertussis
cggcgggccgcaug

SEQ ID NO: 307504 - RNA, 13 nt, Bordetella pertussis
cggcgggccgcug

SEQ ID NO: 307505 - RNA, 13 nt, Bordetella pertussis
cggcgggccggcu

SEQ ID NO: 307506 - RNA, 21 nt, Bordetella pertussis
cggcgggcgccccgaucggcg

SEQ ID NO: 307507 - RNA, 23 nt, Bordetella pertussis
cggcgggcgccccgaucggcgcc

SEQ ID NO: 307508 - RNA, 20 nt, Bordetella pertussis
cggcgggcgcgcaggccucg

SEQ ID NO: 307509 - RNA, 13 nt, Bordetella pertussis
cggcgggcgcugg

SEQ ID NO: 307510 - RNA, 16 nt, Bordetella pertussis
cggcgggcgcuggcgc

SEQ ID NO: 307511 - RNA, 15 nt, Bordetella pertussis
cggcgggcggcgcca

SEQ ID NO: 307512 - RNA, 15 nt, Bordetella pertussis
cggcgggcucagccc

SEQ ID NO: 307513 - RNA, 17 nt, Bordetella pertussis
cggcgggcucgagcugg

SEQ ID NO: 307514 - RNA, 16 nt, Bordetella pertussis
cggcgggcucggcgcc

SEQ ID NO: 307515 - RNA, 18 nt, Bordetella pertussis
cggcgggcucggcgccgg

SEQ ID NO: 307516 - RNA, 15 nt, Bordetella pertussis
cggcggggcaggcgc

SEQ ID NO: 307517 - RNA, 18 nt, Bordetella pertussis
cggcgggucaaguccggc

SEQ ID NO: 307518 - RNA, 15 nt, Bordetella pertussis
cggcggguggccucg

SEQ ID NO: 307519 - RNA, 19 nt, Bordetella pertussis
cggcggguucgcagggcgc

SEQ ID NO: 307520 - RNA, 19 nt, Bordetella pertussis
cggcggguuucucggccuu

SEQ ID NO: 307521 - RNA, 17 nt, Bordetella pertussis
cggcgguaagcguccgc

SEQ ID NO: 307522 - RNA, 23 nt, Bordetella pertussis
cggcgguaagcguccgcgcgccg

SEQ ID NO: 307523 - RNA, 15 nt, Bordetella pertussis
cggcgguaccaggcc

SEQ ID NO: 307524 - RNA, 16 nt, Bordetella pertussis
cggcgguaccaggccg

SEQ ID NO: 307525 - RNA, 17 nt, Bordetella pertussis
cggcgguaccaggccga

SEQ ID NO: 307526 - RNA, 19 nt, Bordetella pertussis
cggcggucacgccgaugac

SEQ ID NO: 307527 - RNA, 12 nt, Bordetella pertussis
cggcggucagcg

SEQ ID NO: 307528 - RNA, 16 nt, Bordetella pertussis
cggcggucagcgcggc

SEQ ID NO: 307529 - RNA, 17 nt, Bordetella pertussis
cggcggucagcgcggcg

SEQ ID NO: 307530 - RNA, 17 nt, Bordetella pertussis
cggcgguccacagcccg

SEQ ID NO: 307531 - RNA, 17 nt, Bordetella pertussis
cggcggugaccaccagg

SEQ ID NO: 307532 - RNA, 20 nt, Bordetella pertussis
cggcggugaucugcucgccg

SEQ ID NO: 307533 - RNA, 16 nt, Bordetella pertussis
cggcggugccagcgca

SEQ ID NO: 307534 - RNA, 20 nt, Bordetella pertussis
cggcggugccgcccaccgug

SEQ ID NO: 307535 - RNA, 14 nt, Bordetella pertussis
cggcggugccgcgc

SEQ ID NO: 307536 - RNA, 15 nt, Bordetella pertussis
cggcggugccgcgca

SEQ ID NO: 307537 - RNA, 17 nt, Bordetella pertussis
cggcggugccgcgcacc

SEQ ID NO: 307538 - RNA, 20 nt, Bordetella pertussis
cggcggugccgcgcacccag

SEQ ID NO: 307539 - RNA, 14 nt, Bordetella pertussis
cggcgguugcccgc

SEQ ID NO: 307540 - RNA, 21 nt, Bordetella pertussis
cggcgguuucguagaugggca

SEQ ID NO: 307541 - RNA, 18 nt, Bordetella pertussis
cggcgguuucuuccagca

SEQ ID NO: 307542 - RNA, 17 nt, Bordetella pertussis
cggcgguuucggccggg

SEQ ID NO: 307543 - RNA, 13 nt, Bordetella pertussis
cggcguaaggccg

SEQ ID NO: 307544 - RNA, 14 nt, Bordetella pertussis
cggcguaaggccgc

SEQ ID NO: 307545 - RNA, 16 nt, Bordetella pertussis
cggcguaaggccgccg

SEQ ID NO: 307546 - RNA, 17 nt, Bordetella pertussis
cggcguaaggccgccgg

SEQ ID NO: 307547 - RNA, 21 nt, Bordetella pertussis
cggcguaaggccgccggccac

SEQ ID NO: 307548 - RNA, 17 nt, Bordetella pertussis
cggcguaaggcugcagc

SEQ ID NO: 307549 - RNA, 15 nt, Bordetella pertussis
cggcguagagcgccg

SEQ ID NO: 307550 - RNA, 13 nt, Bordetella pertussis
cggcguagccgau

SEQ ID NO: 307551 - RNA, 17 nt, Bordetella pertussis
cggcguagcugcgccgc

SEQ ID NO: 307552 - RNA, 14 nt, Bordetella pertussis
cggcguauggcccg

SEQ ID NO: 307553 - RNA, 19 nt, Bordetella pertussis
cggcguauggcccgccacc

SEQ ID NO: 307554 - RNA, 15 nt, Bordetella pertussis
cggcguauggcgcgg

SEQ ID NO: 307555 - RNA, 21 nt, Bordetella pertussis
cggcguauugcuccacaggcc

SEQ ID NO: 307556 - RNA, 23 nt, Bordetella pertussis
cggcguccauuagggcccagcug

SEQ ID NO: 307557 - RNA, 14 nt, Bordetella pertussis
cggcgucgagcacg

SEQ ID NO: 307558 - RNA, 15 nt, Bordetella pertussis
cggcgucgagcacgc

SEQ ID NO: 307559 - RNA, 17 nt, Bordetella pertussis
cggcgucgagcacgcgg

SEQ ID NO: 307560 - RNA, 19 nt, Bordetella pertussis
cggcgucgagcacgcggcg

SEQ ID NO: 307561 - RNA, 21 nt, Bordetella pertussis
cggcgucgaucggcgcgcccg

SEQ ID NO: 307562 - RNA, 13 nt, Bordetella pertussis
cggcgucgaugcg

SEQ ID NO: 307563 - RNA, 15 nt, Bordetella pertussis
cggcgucgaugcgcg

SEQ ID NO: 307564 - RNA, 19 nt, Bordetella pertussis
cggcgucgaugcgcgcgcg

SEQ ID NO: 307565 - RNA, 11 nt, Bordetella pertussis
cggcgucgccc

SEQ ID NO: 307566 - RNA, 23 nt, Bordetella pertussis
cggcgucggugccguccagcgcg

SEQ ID NO: 307567 - RNA, 21 nt, Bordetella pertussis
cggcgucgggucagccuugcu

SEQ ID NO: 307568 - RNA, 15 nt, Bordetella pertussis
cggcgugaccgcgac

SEQ ID NO: 307569 - RNA, 14 nt, Bordetella pertussis
cggcgugacgcuga

SEQ ID NO: 307570 - RNA, 16 nt, Bordetella pertussis
cggcgugacgcugacc

SEQ ID NO: 307571 - RNA, 23 nt, Bordetella pertussis
cggcgugacgcugacccuggccg

SEQ ID NO: 307572 - RNA, 18 nt, Bordetella pertussis
cggcgugacguugccgcg

SEQ ID NO: 307573 - RNA, 20 nt, Bordetella pertussis
cggcgugacguugccgcgcg

SEQ ID NO: 307574 - RNA, 16 nt, Bordetella pertussis
cggcgugagcacgacg

SEQ ID NO: 307575 - RNA, 14 nt, Bordetella pertussis
cggcgugagcgcca

SEQ ID NO: 307576 - RNA, 15 nt, Bordetella pertussis
cggcgugagcgccac

SEQ ID NO: 307577 - RNA, 13 nt, Bordetella pertussis
cggcgugaugccc

SEQ ID NO: 307578 - RNA, 15 nt, Bordetella pertussis
cggcgugaugcccag

SEQ ID NO: 307579 - RNA, 22 nt, Bordetella pertussis
cggcgugaugcccaggcccugg

SEQ ID NO: 307580 - RNA, 18 nt, Bordetella pertussis
cggcgugauggacgccgg

SEQ ID NO: 307581 - RNA, 20 nt, Bordetella pertussis
cggcgugcagagcaccacgg

SEQ ID NO: 307582 - RNA, 15 nt, Bordetella pertussis
cggcguggccugccc

SEQ ID NO: 307583 - RNA, 16 nt, Bordetella pertussis
cggcguggcggccagg

SEQ ID NO: 307584 - RNA, 19 nt, Bordetella pertussis
cggcguggcggccaggccg

SEQ ID NO: 307585 - RNA, 15 nt, Bordetella pertussis
cggcguggcggcggg

SEQ ID NO: 307586 - RNA, 18 nt, Bordetella pertussis
cggcguggcggggauggc

SEQ ID NO: 307587 - RNA, 13 nt, Bordetella pertussis
cggcguggcgcgc

SEQ ID NO: 307588 - RNA, 16 nt, Bordetella pertussis
cggcguggcgcgcaac

SEQ ID NO: 307589 - RNA, 17 nt, Bordetella pertussis
cggcguggcgcgcaacc

SEQ ID NO: 307590 - RNA, 16 nt, Bordetella pertussis
cggcguggcgcgcaca

SEQ ID NO: 307591 - RNA, 22 nt, Bordetella pertussis
cggcguggcgcgcacacuggcc

SEQ ID NO: 307592 - RNA, 16 nt, Bordetella pertussis
cggcguggcgcgcccg

SEQ ID NO: 307593 - RNA, 15 nt, Bordetella pertussis
cggcguggggccggc

SEQ ID NO: 307594 - RNA, 19 nt, Bordetella pertussis
cggcgugguaucgcgccag

SEQ ID NO: 307595 - RNA, 19 nt, Bordetella pertussis
cggcugaagaagcccggcu

SEQ ID NO: 307596 - RNA, 15 nt, Bordetella pertussis
cggcugaauuggcgc

SEQ ID NO: 307597 - RNA, 16 nt, Bordetella pertussis
cggcugaauuggcgcc

SEQ ID NO: 307598 - RNA, 15 nt, Bordetella pertussis
cggcugaucaccgcc

SEQ ID NO: 307599 - RNA, 17 nt, Bordetella pertussis
cggcugaucaccgccgg

SEQ ID NO: 307600 - RNA, 19 nt, Bordetella pertussis
cggcugaugcccuucggca

SEQ ID NO: 307601 - RNA, 21 nt, Bordetella pertussis
cggcugaugcccuucggcaug

SEQ ID NO: 307602 - RNA, 18 nt, Bordetella pertussis
cggcugcaagacgcccag

SEQ ID NO: 307603 - RNA, 20 nt, Bordetella pertussis
cggcugcaagacgcccaggc

SEQ ID NO: 307604 - RNA, 16 nt, Bordetella pertussis
cggcugcaccagcgcg

SEQ ID NO: 307605 - RNA, 14 nt, Bordetella pertussis
cggcugcaugcgcg

SEQ ID NO: 307606 - RNA, 13 nt, Bordetella pertussis
cggcugcgcggcc

SEQ ID NO: 307607 - RNA, 14 nt, Bordetella pertussis
cggcugcgcggccg

SEQ ID NO: 307608 - RNA, 18 nt, Bordetella pertussis
cggcugcgcggccgagcg

SEQ ID NO: 307609 - RNA, 22 nt, Bordetella pertussis
cggcugcgcggccgagcgggcc

SEQ ID NO: 307610 - RNA, 15 nt, Bordetella pertussis
cggcugcgggccggc

SEQ ID NO: 307611 - RNA, 16 nt, Bordetella pertussis
cggcugcgggccggcg

SEQ ID NO: 307612 - RNA, 17 nt, Bordetella pertussis
cggcugcgggccggcgc

SEQ ID NO: 307613 - RNA, 15 nt, Bordetella pertussis
cggcugcgggcgcaa

SEQ ID NO: 307614 - RNA, 12 nt, Bordetella pertussis
cggcugcgggcc

SEQ ID NO: 307615 - RNA, 14 nt, Bordetella pertussis
cggcugcuggaacg

SEQ ID NO: 307616 - RNA, 18 nt, Bordetella pertussis
cggcuggcgaucaccgac

SEQ ID NO: 307617 - RNA, 19 nt, Bordetella pertussis
cggcuggcgcacguccaga

SEQ ID NO: 307618 - RNA, 14 nt, Bordetella pertussis
cggcuggcgcggcc

SEQ ID NO: 307619 - RNA, 15 nt, Bordetella pertussis
cggcuggcugggcgc

SEQ ID NO: 307620 - RNA, 12 nt, Bordetella pertussis
cggcugggcggc

SEQ ID NO: 307621 - RNA, 15 nt, Bordetella pertussis
cggcugggucggcgu

SEQ ID NO: 307622 - RNA, 21 nt, Bordetella pertussis
cggcugggugcggucagucgg

SEQ ID NO: 307623 - RNA, 21 nt, Bordetella pertussis
cggcugucgggcggcgccugg

SEQ ID NO: 307624 - RNA, 19 nt, Bordetella pertussis
cggcugugggccucgcugg

SEQ ID NO: 307625 - RNA, 23 nt, Bordetella pertussis
cggcuguugggcaaggugaacau

SEQ ID NO: 307626 - RNA, 19 nt, Bordetella pertussis
cggcuucagccgcaagcug

SEQ ID NO: 307627 - RNA, 14 nt, Bordetella pertussis
cggcuucaggcgcg

SEQ ID NO: 307628 - RNA, 15 nt, Bordetella pertussis
cggcuucaggcgcgc

SEQ ID NO: 307629 - RNA, 13 nt, Bordetella pertussis
cggcuugccgcgc

SEQ ID NO: 307630 - RNA, 19 nt, Bordetella pertussis
cggcuugccgcgcggcgua

SEQ ID NO: 307631 - RNA, 22 nt, Bordetella pertussis
cggcuugccgcgcggcguaugg

SEQ ID NO: 307632 - RNA, 18 nt, Bordetella pertussis
cggcuugcgcaagccggc

SEQ ID NO: 307633 - RNA, 21 nt, Bordetella pertussis
cggcuugcgcaagccggccgc

SEQ ID NO: 307634 - RNA, 17 nt, Bordetella pertussis
cggcuugcgccagccac

SEQ ID NO: 307635 - RNA, 14 nt, Bordetella pertussis
cggcuugcgcgccu

SEQ ID NO: 307636 - RNA, 15 nt, Bordetella pertussis
cggcuugcgcgccug

SEQ ID NO: 307637 - RNA, 18 nt, Bordetella pertussis
cggcuuggccucggccgg

SEQ ID NO: 307638 - RNA, 20 nt, Bordetella pertussis
cggcuuggccucggccggca

SEQ ID NO: 307639 - RNA, 22 nt, Bordetella pertussis
cggcuuggcgugcgcgagcugg

SEQ ID NO: 307640 - RNA, 14 nt, Bordetella pertussis
cggcuugggcgugc

SEQ ID NO: 307641 - RNA, 16 nt, Bordetella pertussis
cggcuugggcgugccc

SEQ ID NO: 307642 - RNA, 18 nt, Bordetella pertussis
cggcuuguucgagcgcgc

SEQ ID NO: 307643 - RNA, 19 nt, Bordetella pertussis
cggcuuguucgagcgcgcg

SEQ ID NO: 307644 - RNA, 20 nt, Bordetella pertussis
cggcuuuggacaggcgugcg

SEQ ID NO: 307645 - RNA, 19 nt, Bordetella pertussis
cggcuuuuucucggccucg

SEQ ID NO: 307646 - RNA, 22 nt, Bordetella pertussis
cggcuuuuuugcguucgcgccg

SEQ ID NO: 307647 - RNA, 23 nt, Bordetella pertussis
cggcuuuuuugcguucgcgccgc

SEQ ID NO: 307648 - RNA, 20 nt, Bordetella pertussis
cgggaaacucgcgcagcgug

SEQ ID NO: 307649 - RNA, 17 nt, Bordetella pertussis
cgggaagcgcucgcgca

SEQ ID NO: 307650 - RNA, 20 nt, Bordetella pertussis
cgggaagcugucggcgcugg

SEQ ID NO: 307651 - RNA, 16 nt, Bordetella pertussis
cgggaaugaagcgcga

SEQ ID NO: 307652 - RNA, 20 nt, Bordetella pertussis
cgggaaugauuccgcuggcg

SEQ ID NO: 307653 - RNA, 23 nt, Bordetella pertussis
cgggacacacgcucuugcgcgcg

SEQ ID NO: 307654 - RNA, 18 nt, Bordetella pertussis
cgggaccuuggcggcugg

SEQ ID NO: 307655 - RNA, 17 nt, Bordetella pertussis
cgggacgcaggcccaug

SEQ ID NO: 307656 - RNA, 22 nt, Bordetella pertussis
cgggacggaaguccugcaucgc

SEQ ID NO: 307657 - RNA, 13 nt, Bordetella pertussis
cgggacggccagg

SEQ ID NO: 307658 - RNA, 16 nt, Bordetella pertussis
cgggacugagucguca

SEQ ID NO: 307659 - RNA, 12 nt, Bordetella pertussis
cgggacuggcga

SEQ ID NO: 307660 - RNA, 19 nt, Bordetella pertussis
cgggauaccgcuggccagg

SEQ ID NO: 307661 - RNA, 17 nt, Bordetella pertussis
cgggauaguccagcacc

SEQ ID NO: 307662 - RNA, 13 nt, Bordetella pertussis
cgggauccacgcc

SEQ ID NO: 307663 - RNA, 14 nt, Bordetella pertussis
cgggauccacgccg

SEQ ID NO: 307664 - RNA, 15 nt, Bordetella pertussis
cgggauccacgccgc

SEQ ID NO: 307665 - RNA, 19 nt, Bordetella pertussis
cgggauccacgccgccggc

SEQ ID NO: 307666 - RNA, 23 nt, Bordetella pertussis
cgggauccacgccgccggccagc

SEQ ID NO: 307667 - RNA, 21 nt, Bordetella pertussis
aacauguccaccagccggccg

SEQ ID NO: 307668 - RNA, 22 nt, Bordetella pertussis
cgggaugccguaggugcgcgcc

SEQ ID NO: 307669 - RNA, 18 nt, Bordetella pertussis
cgggaugggccacccagc

SEQ ID NO: 307670 - RNA, 17 nt, Bordetella pertussis
cgggauggucgcggccg

SEQ ID NO: 307671 - RNA, 13 nt, Bordetella pertussis
cgggauguccgcg

SEQ ID NO: 307672 - RNA, 15 nt, Bordetella pertussis
cgggauucugcugca

SEQ ID NO: 307673 - RNA, 18 nt, Bordetella pertussis
cgggauugccgucacgcg

SEQ ID NO: 307674 - RNA, 18 nt, Bordetella pertussis
cgggcaagcggcguaucg

SEQ ID NO: 307675 - RNA, 17 nt, Bordetella pertussis
cgggcacaacccgcccg

SEQ ID NO: 307676 - RNA, 18 nt, Bordetella pertussis
cgggcacaacccgcccgg

SEQ ID NO: 307677 - RNA, 17 nt, Bordetella pertussis
cgggcaaucggcgugca

SEQ ID NO: 307678 - RNA, 19 nt, Bordetella pertussis
cgggcacguaguacagcag

SEQ ID NO: 307679 - RNA, 12 nt, Bordetella pertussis
cgggcagcacgc

SEQ ID NO: 307680 - RNA, 20 nt, Bordetella pertussis
cgggcagcacgcgcaccagg

SEQ ID NO: 307681 - RNA, 13 nt, Bordetella pertussis
cgggcagcagcag

SEQ ID NO: 307682 - RNA, 15 nt, Bordetella pertussis
cgggcagcagcaggg

SEQ ID NO: 307683 - RNA, 16 nt, Bordetella pertussis
cgggcagcagcagggc

SEQ ID NO: 307684 - RNA, 20 nt, Bordetella pertussis
cgggcagcagcagggccagg

SEQ ID NO: 307685 - RNA, 15 nt, Bordetella pertussis
cgggcagcaggcgca

SEQ ID NO: 307686 - RNA, 17 nt, Bordetella pertussis
cgggcagcauggcgcca

SEQ ID NO: 307687 - RNA, 14 nt, Bordetella pertussis
cgggcagcgcccgc

SEQ ID NO: 307688 - RNA, 16 nt, Bordetella pertussis
cgggcagcgcccgcgc

SEQ ID NO: 307689 - RNA, 17 nt, Bordetella pertussis
cgggcagcgcccgcgcc

SEQ ID NO: 307690 - RNA, 23 nt, Bordetella pertussis
cgggcagcgcccgcgccaucgcg

SEQ ID NO: 307691 - RNA, 22 nt, Bordetella pertussis
cgggcagcgcggcggcgaccgg

SEQ ID NO: 307692 - RNA, 17 nt, Bordetella pertussis
cgggcagcggcgacggc

SEQ ID NO: 307693 - RNA, 19 nt, Bordetella pertussis
cgggcagcgggccgcagca

SEQ ID NO: 307694 - RNA, 16 nt, Bordetella pertussis
cgggcaguugcuggcg

SEQ ID NO: 307695 - RNA, 18 nt, Bordetella pertussis
cgggcaguugcuggcggc

SEQ ID NO: 307696 - RNA, 23 nt, Bordetella pertussis
cgggcaguugcuggcggccgugc

SEQ ID NO: 307697 - RNA, 22 nt, Bordetella pertussis
cgggcaucgggguuccacagcg

SEQ ID NO: 307698 - RNA, 21 nt, Bordetella pertussis
cgggccagccccggcgcgccg

SEQ ID NO: 307699 - RNA, 12 nt, Bordetella pertussis
cgggccagcgcg

SEQ ID NO: 307700 - RNA, 17 nt, Bordetella pertussis
cgggccaggccgaugcc

SEQ ID NO: 307701 - RNA, 13 nt, Bordetella pertussis
cgggccaggccgg

SEQ ID NO: 307702 - RNA, 14 nt, Bordetella pertussis
cgggccaggccggu

SEQ ID NO: 307703 - RNA, 15 nt, Bordetella pertussis
cgggccaggccggug

SEQ ID NO: 307704 - RNA, 20 nt, Bordetella pertussis
cgggccaugcgggucaggcc

SEQ ID NO: 307705 - RNA, 21 nt, Bordetella pertussis
cgggccaugcgggucaggccg

SEQ ID NO: 307706 - RNA, 22 nt, Bordetella pertussis
cgggccaugcgggucaggccgc

SEQ ID NO: 307707 - RNA, 20 nt, Bordetella pertussis
cgggccaugucagucguccu

SEQ ID NO: 307708 - RNA, 20 nt, Bordetella pertussis
cgggccccgcagggcccgca

SEQ ID NO: 307709 - RNA, 23 nt, Bordetella pertussis
cgggccccgcagggcccgcaucg

SEQ ID NO: 307710 - RNA, 13 nt, Bordetella pertussis
cgggcccgcaucg

SEQ ID NO: 307711 - RNA, 20 nt, Bordetella pertussis
cgggccgaacaugacguucu

SEQ ID NO: 307712 - RNA, 14 nt, Bordetella pertussis
cgggccgaccaggc

SEQ ID NO: 307713 - RNA, 19 nt, Bordetella pertussis
cgggccgaccaggccggcg

SEQ ID NO: 307714 - RNA, 16 nt, Bordetella pertussis
cgggccgacggccucg

SEQ ID NO: 307715 - RNA, 18 nt, Bordetella pertussis
cgggccgacggccucggc

SEQ ID NO: 307716 - RNA, 20 nt, Bordetella pertussis
cgggccgacggccucggcca

SEQ ID NO: 307717 - RNA, 23 nt, Bordetella pertussis
cgggccgacggccucggccagga

SEQ ID NO: 307718 - RNA, 15 nt, Bordetella pertussis
cgggccgaggcuucg

SEQ ID NO: 307719 - RNA, 22 nt, Bordetella pertussis
cgggccgaguggaugcgcuugc

SEQ ID NO: 307720 - RNA, 15 nt, Bordetella pertussis
cgggccuggccugcg

SEQ ID NO: 307721 - RNA, 18 nt, Bordetella pertussis
cgggccuggccugcgccg

SEQ ID NO: 307722 - RNA, 20 nt, Bordetella pertussis
cgggccuggcggaucucggc

SEQ ID NO: 307723 - RNA, 17 nt, Bordetella pertussis
cgggccuggugcccgac

SEQ ID NO: 307724 - RNA, 16 nt, Bordetella pertussis
cgggccuuggccagca

SEQ ID NO: 307725 - RNA, 18 nt, Bordetella pertussis
cgggcgagccgaacgauu

SEQ ID NO: 307726 - RNA, 17 nt, Bordetella pertussis
cgggcgaaccgguggcc

SEQ ID NO: 307727 - RNA, 19 nt, Bordetella pertussis
cgggcgaggacuacgcggu

SEQ ID NO: 307728 - RNA, 20 nt, Bordetella pertussis
cgggcgaggacuacgcggug

SEQ ID NO: 307729 - RNA, 16 nt, Bordetella pertussis
cgggcgaggcggggcu

SEQ ID NO: 307730 - RNA, 17 nt, Bordetella pertussis
cgggcgaggucagcccg

SEQ ID NO: 307731 - RNA, 17 nt, Bordetella pertussis
cgggcgaucgcgucggc

SEQ ID NO: 307732 - RNA, 16 nt, Bordetella pertussis
cgggcgcgcagcgcga

SEQ ID NO: 307733 - RNA, 23 nt, Bordetella pertussis
cgggcgccuguccccgcugcggc

SEQ ID NO: 307734 - RNA, 14 nt, Bordetella pertussis
cgggcgcgcccggc

SEQ ID NO: 307735 - RNA, 18 nt, Bordetella pertussis
cgggcgcgcccggcgcgc

SEQ ID NO: 307736 - RNA, 20 nt, Bordetella pertussis
cgggcgcgccggcgggcgcu

SEQ ID NO: 307737 - RNA, 14 nt, Bordetella pertussis
cgggcgcgccgucg

SEQ ID NO: 307738 - RNA, 18 nt, Bordetella pertussis
cgggcgcgccgucgcugg

SEQ ID NO: 307739 - RNA, 14 nt, Bordetella pertussis
cgggcgcgcgcccc

SEQ ID NO: 307740 - RNA, 14 nt, Bordetella pertussis
cgggcgcgcgccgg

SEQ ID NO: 307741 - RNA, 18 nt, Bordetella pertussis
cgggcgcgcgccggcggc

SEQ ID NO: 307742 - RNA, 14 nt, Bordetella pertussis
cgggcgcgcugccc

SEQ ID NO: 307743 - RNA, 21 nt, Bordetella pertussis
cgggcgcgcugcccagccaca

SEQ ID NO: 307744 - RNA, 18 nt, Bordetella pertussis
cgggcgcggcauggcgcc

SEQ ID NO: 307745 - RNA, 22 nt, Bordetella pertussis
cgggcgcggcauggcgccgcgc

SEQ ID NO: 307746 - RNA, 14 nt, Bordetella pertussis
cgggcgcggccagg

SEQ ID NO: 307747 - RNA, 16 nt, Bordetella pertussis
cgggcgcggcccggcg

SEQ ID NO: 307748 - RNA, 14 nt, Bordetella pertussis
cgggcgcggcgucg

SEQ ID NO: 307749 - RNA, 22 nt, Bordetella pertussis
cgggcgcgucaguugggcgcgc

SEQ ID NO: 307750 - RNA, 23 nt, Bordetella pertussis
cgggcgcgguauucgcugcuggc

SEQ ID NO: 307751 - RNA, 14 nt, Bordetella pertussis
cgggcgcguggccc

SEQ ID NO: 307752 - RNA, 16 nt, Bordetella pertussis
cgggcgcguggcccgc

SEQ ID NO: 307753 - RNA, 19 nt, Bordetella pertussis
cgggcgcguggcccgcgcc

SEQ ID NO: 307754 - RNA, 14 nt, Bordetella pertussis
cgggcgcugacgcc

SEQ ID NO: 307755 - RNA, 16 nt, Bordetella pertussis
cgggcgcugcacgcag

SEQ ID NO: 307756 - RNA, 20 nt, Bordetella pertussis
cgggcgcugcacgcagcgca

SEQ ID NO: 307757 - RNA, 21 nt, Bordetella pertussis
cgggcgcugcacgcagcgcag

SEQ ID NO: 307758 - RNA, 15 nt, Bordetella pertussis
cgggcgcugcccagg

SEQ ID NO: 307759 - RNA, 23 nt, Bordetella pertussis
cgggcgcugcgccggcggcaccg

SEQ ID NO: 307760 - RNA, 19 nt, Bordetella pertussis
cgggcgcugcgcgaacgcg

SEQ ID NO: 307761 - RNA, 19 nt, Bordetella pertussis
cgggcgcuggcgcgcggcu

SEQ ID NO: 307762 - RNA, 17 nt, Bordetella pertussis
cgggcggccacgcgccg

SEQ ID NO: 307763 - RNA, 13 nt, Bordetella pertussis
cgggcggcccgca

SEQ ID NO: 307764 - RNA, 14 nt, Bordetella pertussis
cgggcggcccggcg

SEQ ID NO: 307765 - RNA, 15 nt, Bordetella pertussis
cgggcggccggcgcg

SEQ ID NO: 307766 - RNA, 12 nt, Bordetella pertussis
cgggcggccugg

SEQ ID NO: 307767 - RNA, 16 nt, Bordetella pertussis
cgggcggcgccagcgg

SEQ ID NO: 307768 - RNA, 15 nt, Bordetella pertussis
cgggcggcgccgucg

SEQ ID NO: 307769 - RNA, 22 nt, Bordetella pertussis
cgggcggcgccgucgaucccau

SEQ ID NO: 307770 - RNA, 17 nt, Bordetella pertussis
cgggcggcgcgggcggc

SEQ ID NO: 307771 - RNA, 14 nt, Bordetella pertussis
cgggcgucaugcgc

SEQ ID NO: 307772 - RNA, 18 nt, Bordetella pertussis
cgggcgugagcgccucga

SEQ ID NO: 307773 - RNA, 20 nt, Bordetella pertussis
cgggcgugaugccgaccagg

SEQ ID NO: 307774 - RNA, 15 nt, Bordetella pertussis
cgggcuccucgcccg

SEQ ID NO: 307775 - RNA, 17 nt, Bordetella pertussis
cgggcuccucgcccgac

SEQ ID NO: 307776 - RNA, 22 nt, Bordetella pertussis
cgggcuccucgcccgaccugcu

SEQ ID NO: 307777 - RNA, 23 nt, Bordetella pertussis
cgggcucgacuucggccgacaug

SEQ ID NO: 307778 - RNA, 18 nt, Bordetella pertussis
cgggcucgaugaccagca

SEQ ID NO: 307779 - RNA, 16 nt, Bordetella pertussis
cgggcugaacauccug

SEQ ID NO: 307780 - RNA, 23 nt, Bordetella pertussis
cgggcugaacauccugaccggcu

SEQ ID NO: 307781 - RNA, 18 nt, Bordetella pertussis
cgggcugaugcaggccug

SEQ ID NO: 307782 - RNA, 19 nt, Bordetella pertussis
cgggcugaugcaggccugc

SEQ ID NO: 307783 - RNA, 14 nt, Bordetella pertussis
cgggcugauccgca

SEQ ID NO: 307784 - RNA, 18 nt, Bordetella pertussis
cgggcugauccgcaccgg

SEQ ID NO: 307785 - RNA, 20 nt, Bordetella pertussis
cgggcugcacuucgaaaaug

SEQ ID NO: 307786 - RNA, 13 nt, Bordetella pertussis
cgggcugcgcggg

SEQ ID NO: 307787 - RNA, 13 nt, Bordetella pertussis
cgggcugcugccc

SEQ ID NO: 307788 - RNA, 20 nt, Bordetella pertussis
cgggcugcugcacgcgcgcg

SEQ ID NO: 307789 - RNA, 20 nt, Bordetella pertussis
cgggcuggagaacgagccgg

SEQ ID NO: 307790 - RNA, 23 nt, Bordetella pertussis
cgggcuggauccggcgcuggcgc

SEQ ID NO: 307791 - RNA, 14 nt, Bordetella pertussis
cgggcuggccagcg

SEQ ID NO: 307792 - RNA, 14 nt, Bordetella pertussis
cgggcuggccgccu

SEQ ID NO: 307793 - RNA, 19 nt, Bordetella pertussis
cgggcugggugaagccaag

SEQ ID NO: 307794 - RNA, 20 nt, Bordetella pertussis
cgggcuggucagccuggggc

SEQ ID NO: 307795 - RNA, 15 nt, Bordetella pertussis
cgggcuggucgcgcc

SEQ ID NO: 307796 - RNA, 16 nt, Bordetella pertussis
cgggcuggucgcgccg

SEQ ID NO: 307797 - RNA, 18 nt, Bordetella pertussis
cgggcuggucgcgccggu

SEQ ID NO: 307798 - RNA, 16 nt, Bordetella pertussis
cgggcugggccgaggc

SEQ ID NO: 307799 - RNA, 23 nt, Bordetella pertussis
cgggcuggggcaggcacuggcgc

SEQ ID NO: 307800 - RNA, 21 nt, Bordetella pertussis
cgggcuggugcgccgugcccg

SEQ ID NO: 307801 - RNA, 18 nt, Bordetella pertussis
cgggcuguccgccaccag

SEQ ID NO: 307802 - RNA, 18 nt, Bordetella pertussis
cgggcuguucgcgcagca

SEQ ID NO: 307803 - RNA, 20 nt, Bordetella pertussis
cgggcuguucgcgcagcagg

SEQ ID NO: 307804 - RNA, 18 nt, Bordetella pertussis
cgggcuuucggucucgcg

SEQ ID NO: 307805 - RNA, 23 nt, Bordetella pertussis
cggggaaacggccaagcagcgcc

SEQ ID NO: 307806 - RNA, 23 nt, Bordetella pertussis
cggggaagauguggucggcgccg

SEQ ID NO: 307807 - RNA, 18 nt, Bordetella pertussis
cggggacaggcacccggg

SEQ ID NO: 307808 - RNA, 15 nt, Bordetella pertussis
cggggacaggcaccg

SEQ ID NO: 307809 - RNA, 18 nt, Bordetella pertussis
cggggacaggcaccgccg

SEQ ID NO: 307810 - RNA, 19 nt, Bordetella pertussis
cggggacaggcacgcgccg

SEQ ID NO: 307811 - RNA, 18 nt, Bordetella pertussis
cggggacuggcaccggcc

SEQ ID NO: 307812 - RNA, 14 nt, Bordetella pertussis
cggggauggcuucc

SEQ ID NO: 307813 - RNA, 20 nt, Bordetella pertussis
cggggauggcuuccugcggc

SEQ ID NO: 307814 - RNA, 21 nt, Bordetella pertussis
cggggauggcuuccugcggca

SEQ ID NO: 307815 - RNA, 19 nt, Bordetella pertussis
cggggcaacgacgcaggcg

SEQ ID NO: 307816 - RNA, 17 nt, Bordetella pertussis
cggggcacccaggcggg

SEQ ID NO: 307817 - RNA, 23 nt, Bordetella pertussis
cggggcacccaggcgggcuggcg

SEQ ID NO: 307818 - RNA, 12 nt, Bordetella pertussis
cggggcaggccg

SEQ ID NO: 307819 - RNA, 13 nt, Bordetella pertussis
cggggcaggccga

SEQ ID NO: 307820 - RNA, 13 nt, Bordetella pertussis
cggggcaggccug

SEQ ID NO: 307821 - RNA, 14 nt, Bordetella pertussis
cggggcaggccugg

SEQ ID NO: 307822 - RNA, 22 nt, Bordetella pertussis
cggggcaggcgccugcucacgc

SEQ ID NO: 307823 - RNA, 13 nt, Bordetella pertussis
cggggcagggcgg

SEQ ID NO: 307824 - RNA, 16 nt, Bordetella pertussis
cggggccaagauccag

SEQ ID NO: 307825 - RNA, 17 nt, Bordetella pertussis
cggggccaagauccagc

SEQ ID NO: 307826 - RNA, 18 nt, Bordetella pertussis
cggggccaagauccagcu

SEQ ID NO: 307827 - RNA, 23 nt, Bordetella pertussis
cggggccacauggucgcccagca

SEQ ID NO: 307828 - RNA, 17 nt, Bordetella pertussis
cggggcccgcgggcgcc

SEQ ID NO: 307829 - RNA, 18 nt, Bordetella pertussis
cggggcccgcgggcgccc

SEQ ID NO: 307830 - RNA, 15 nt, Bordetella pertussis
cggggccgcccagca

SEQ ID NO: 307831 - RNA, 17 nt, Bordetella pertussis
cggggccgcccugguca

SEQ ID NO: 307832 - RNA, 12 nt, Bordetella pertussis
cggggccgcagc

SEQ ID NO: 307833 - RNA, 17 nt, Bordetella pertussis
cggggccgccucggcgg

SEQ ID NO: 307834 - RNA, 18 nt, Bordetella pertussis
cggggccgccucggcggc

SEQ ID NO: 307835 - RNA, 20 nt, Bordetella pertussis
cggggccgccucggcggcca

SEQ ID NO: 307836 - RNA, 14 nt, Bordetella pertussis
cggggccgcgccgg

SEQ ID NO: 307837 - RNA, 14 nt, Bordetella pertussis
cggggccgggccgg

SEQ ID NO: 307838 - RNA, 21 nt, Bordetella pertussis
cggggccgcuucggccugcgc

SEQ ID NO: 307839 - RNA, 21 nt, Bordetella pertussis
cggggcgcccagcgcgucggc

SEQ ID NO: 307840 - RNA, 14 nt, Bordetella pertussis
cggggcgcggccgg

SEQ ID NO: 307841 - RNA, 21 nt, Bordetella pertussis
cggggcgcucgagcgccugca

SEQ ID NO: 307842 - RNA, 14 nt, Bordetella pertussis
cggggcgcuugcca

SEQ ID NO: 307843 - RNA, 18 nt, Bordetella pertussis
cggggcggcaggucgcgc

SEQ ID NO: 307844 - RNA, 16 nt, Bordetella pertussis
cggggcguccaccgcc

SEQ ID NO: 307845 - RNA, 16 nt, Bordetella pertussis
cggggcgucgcugcug

SEQ ID NO: 307846 - RNA, 11 nt, Bordetella pertussis
cggggcuggcc

SEQ ID NO: 307847 - RNA, 15 nt, Bordetella pertussis
cggggcuggccagcu

SEQ ID NO: 307848 - RNA, 16 nt, Bordetella pertussis
cggggcuggccagcug

SEQ ID NO: 307849 - RNA, 12 nt, Bordetella pertussis
cggggcuggcgc

SEQ ID NO: 307850 - RNA, 16 nt, Bordetella pertussis
cggggcuggcgcggcu

SEQ ID NO: 307851 - RNA, 23 nt, Bordetella pertussis
cggggcugucgcgcgcaucgccg

SEQ ID NO: 307852 - RNA, 13 nt, Bordetella pertussis
cgggggcaggccg

SEQ ID NO: 307853 - RNA, 16 nt, Bordetella pertussis
cgggggcaggccgcgg

SEQ ID NO: 307854 - RNA, 14 nt, Bordetella pertussis
cgggggccggcucg

SEQ ID NO: 307855 - RNA, 13 nt, Bordetella pertussis
cgggggcggccgg

SEQ ID NO: 307856 - RNA, 14 nt, Bordetella pertussis
cgggggcggccggg

SEQ ID NO: 307857 - RNA, 19 nt, Bordetella pertussis
cggggucgucggcgcugca

SEQ ID NO: 307858 - RNA, 17 nt, Bordetella pertussis
cggggugaucugcgcca

SEQ ID NO: 307859 - RNA, 17 nt, Bordetella pertussis
cgggguuccacagcgcc

SEQ ID NO: 307860 - RNA, 18 nt, Bordetella pertussis
cgggguuccacagcgccg

SEQ ID NO: 307861 - RNA, 19 nt, Bordetella pertussis
cgggguuccacagcgccga

SEQ ID NO: 307862 - RNA, 15 nt, Bordetella pertussis
cgggguuggccgcca

SEQ ID NO: 307863 - RNA, 20 nt, Bordetella pertussis
cgggguugggaucgcgccag

SEQ ID NO: 307864 - RNA, 21 nt, Bordetella pertussis
cgggguugggaucgcgccagg

SEQ ID NO: 307865 - RNA, 22 nt, Bordetella pertussis
cgggguuuugcuuugcgggcgc

SEQ ID NO: 307866 - RNA, 15 nt, Bordetella pertussis
cggucgccgcgggca

SEQ ID NO: 307867 - RNA, 12 nt, Bordetella pertussis
cggucgccggca

SEQ ID NO: 307868 - RNA, 22 nt, Bordetella pertussis
cggucgccguccaggcgccgca

SEQ ID NO: 307869 - RNA, 16 nt, Bordetella pertussis
cggucgcgagcugcgc

SEQ ID NO: 307870 - RNA, 14 nt, Bordetella pertussis
cggucgcgcgugca

SEQ ID NO: 307871 - RNA, 13 nt, Bordetella pertussis
cggucgcgcuggc

SEQ ID NO: 307872 - RNA, 14 nt, Bordetella pertussis
cggucgcggcguug

SEQ ID NO: 307873 - RNA, 20 nt, Bordetella pertussis
cggucggaaacacguccagc

SEQ ID NO: 307874 - RNA, 23 nt, Bordetella pertussis
cggucggaaacacguccagcgcc

SEQ ID NO: 307875 - RNA, 15 nt, Bordetella pertussis
cggucggccgcgccg

SEQ ID NO: 307876 - RNA, 17 nt, Bordetella pertussis
cggucggccgcgccgcc

SEQ ID NO: 307877 - RNA, 18 nt, Bordetella pertussis
cggucggccgcgccgccg

SEQ ID NO: 307878 - RNA, 12 nt, Bordetella pertussis
cggucggccgcu

SEQ ID NO: 307879 - RNA, 21 nt, Bordetella pertussis
cggucggccgcuccgccaugg

SEQ ID NO: 307880 - RNA, 18 nt, Bordetella pertussis
cggucggccggcagcggc

SEQ ID NO: 307881 - RNA, 15 nt, Bordetella pertussis
cggucgggaucaucc

SEQ ID NO: 307882 - RNA, 15 nt, Bordetella pertussis
cggucgucagcacgc

SEQ ID NO: 307883 - RNA, 21 nt, Bordetella pertussis
cggucguuccagaacggcgcg

SEQ ID NO: 307884 - RNA, 14 nt, Bordetella pertussis
cggucuccagcgcg

SEQ ID NO: 307885 - RNA, 22 nt, Bordetella pertussis
cggucuccgguucggcgcggcg

SEQ ID NO: 307886 - RNA, 20 nt, Bordetella pertussis
cggucugcaccugcguggcc

SEQ ID NO: 307887 - RNA, 14 nt, Bordetella pertussis
cggucugcacgccg

SEQ ID NO: 307888 - RNA, 13 nt, Bordetella pertussis
cggucugccgcug

SEQ ID NO: 307889 - RNA, 17 nt, Bordetella pertussis
cggucugcgguccgaug

SEQ ID NO: 307890 - RNA, 16 nt, Bordetella pertussis
cggucuggcccacgcg

SEQ ID NO: 307891 - RNA, 15 nt, Bordetella pertussis
cggucugggcgcgga

SEQ ID NO: 307892 - RNA, 17 nt, Bordetella pertussis
cggucuggucggcgaug

SEQ ID NO: 307893 - RNA, 21 nt, Bordetella pertussis
cggucuguuuuuuugggggcc

SEQ ID NO: 307894 - RNA, 18 nt, Bordetella pertussis
cggucuucacauagcccg

SEQ ID NO: 307895 - RNA, 20 nt, Bordetella pertussis
cggucuucacauagcccggc

SEQ ID NO: 307896 - RNA, 17 nt, Bordetella pertussis
cggucuucgaugcuggc

SEQ ID NO: 307897 - RNA, 16 nt, Bordetella pertussis
cggugaaaucgacgug

SEQ ID NO: 307898 - RNA, 18 nt, Bordetella pertussis
cggugacaugcguggccg

SEQ ID NO: 307899 - RNA, 20 nt, Bordetella pertussis
cggugacaugcguggccgcg

SEQ ID NO: 307900 - RNA, 19 nt, Bordetella pertussis
cggugaccaugcgcaccga

SEQ ID NO: 307901 - RNA, 14 nt, Bordetella pertussis
cggugaccgccagc

SEQ ID NO: 307902 - RNA, 15 nt, Bordetella pertussis
cggugaccgccagca

SEQ ID NO: 307903 - RNA, 18 nt, Bordetella pertussis
cggugaccgccagcaggc

SEQ ID NO: 307904 - RNA, 23 nt, Bordetella pertussis
cggugaccgccagcaggcgcucg

SEQ ID NO: 307905 - RNA, 17 nt, Bordetella pertussis
cggugagcaagcgcugg

SEQ ID NO: 307906 - RNA, 20 nt, Bordetella pertussis
cggugaggauuuccagcucg

SEQ ID NO: 307907 - RNA, 19 nt, Bordetella pertussis
cggugaggcggccgggcgu

SEQ ID NO: 307908 - RNA, 22 nt, Bordetella pertussis
cggugagcggcacgacgucguc

SEQ ID NO: 307909 - RNA, 14 nt, Bordetella pertussis
cggugaucaucgug

SEQ ID NO: 307910 - RNA, 17 nt, Bordetella pertussis
cggugaucaucgugccg

SEQ ID NO: 307911 - RNA, 23 nt, Bordetella pertussis
cggugaucaugccgcugaccagc

SEQ ID NO: 307912 - RNA, 19 nt, Bordetella pertussis
cggugaucgaguaggccgg

SEQ ID NO: 307913 - RNA, 17 nt, Bordetella pertussis
cggugaucuugccgaug

SEQ ID NO: 307914 - RNA, 22 nt, Bordetella pertussis
cggugaucuugccgaugcggcg

SEQ ID NO: 307915 - RNA, 15 nt, Bordetella pertussis
cggugaucugcucgc

SEQ ID NO: 307916 - RNA, 19 nt, Bordetella pertussis
cggugaucugcucgccgcg

SEQ ID NO: 307917 - RNA, 19 nt, Bordetella pertussis
cggugaugauccugcuggu

SEQ ID NO: 307918 - RNA, 22 nt, Bordetella pertussis
cggugaugauccugcugguggc

SEQ ID NO: 307919 - RNA, 19 nt, Bordetella pertussis
cggugaugcccgaggcggc

SEQ ID NO: 307920 - RNA, 21 nt, Bordetella pertussis
cggugaugauggccaggucca

SEQ ID NO: 307921 - RNA, 14 nt, Bordetella pertussis
cggugaugcgaugg

SEQ ID NO: 307922 - RNA, 19 nt, Bordetella pertussis
cggugaugcggcgcgccgc

SEQ ID NO: 307923 - RNA, 18 nt, Bordetella pertussis
cggugauguacgcaucgg

SEQ ID NO: 307924 - RNA, 20 nt, Bordetella pertussis
cggugauguacgcaucggcg

SEQ ID NO: 307925 - RNA, 22 nt, Bordetella pertussis
cggugauuucggcgcaucggcg

SEQ ID NO: 307926 - RNA, 15 nt, Bordetella pertussis
cggugcaagcggccg

SEQ ID NO: 307927 - RNA, 18 nt, Bordetella pertussis
cggugcaagcggccggcc

SEQ ID NO: 307928 - RNA, 13 nt, Bordetella pertussis
cggugcaaugccc

SEQ ID NO: 307929 - RNA, 16 nt, Bordetella pertussis
cggugcaccaggccac

SEQ ID NO: 307930 - RNA, 16 nt, Bordetella pertussis
cggugcagccgccgca

SEQ ID NO: 307931 - RNA, 16 nt, Bordetella pertussis
cggugcaggggccgca

SEQ ID NO: 307932 - RNA, 17 nt, Bordetella pertussis
cggugcaggggccgcac

SEQ ID NO: 307933 - RNA, 21 nt, Bordetella pertussis
cggugcaggggccgcacgcgc

SEQ ID NO: 307934 - RNA, 21 nt, Bordetella pertussis
cggugcaggucaucgcgcugg

SEQ ID NO: 307935 - RNA, 16 nt, Bordetella pertussis
cggugcaucucggcau

SEQ ID NO: 307936 - RNA, 22 nt, Bordetella pertussis
cggugcaucucggcaucggcca

SEQ ID NO: 307937 - RNA, 14 nt, Bordetella pertussis
cggugccagucccc

SEQ ID NO: 307938 - RNA, 23 nt, Bordetella pertussis
cggugccaguccccaugcggccc

SEQ ID NO: 307939 - RNA, 16 nt, Bordetella pertussis
cggugccccggccucg

SEQ ID NO: 307940 - RNA, 17 nt, Bordetella pertussis
cggugccccggccucgc

SEQ ID NO: 307941 - RNA, 14 nt, Bordetella pertussis
cggugccgagcaga

SEQ ID NO: 307942 - RNA, 19 nt, Bordetella pertussis
cggugccgagcagaugcga

SEQ ID NO: 307943 - RNA, 13 nt, Bordetella pertussis
cggugccgcccac

SEQ ID NO: 307944 - RNA, 16 nt, Bordetella pertussis
cggugccgccuggcca

SEQ ID NO: 307945 - RNA, 17 nt, Bordetella pertussis
cggugccgcgcgcggcc

SEQ ID NO: 307946 - RNA, 17 nt, Bordetella pertussis
cggugccgcgcgcuucc

SEQ ID NO: 307947 - RNA, 15 nt, Bordetella pertussis
cggugccguccagcg

SEQ ID NO: 307948 - RNA, 19 nt, Bordetella pertussis
cggugccguccagcgcggc

SEQ ID NO: 307949 - RNA, 13 nt, Bordetella pertussis
cggugccgugggc

SEQ ID NO: 307950 - RNA, 16 nt, Bordetella pertussis
cggugccugugcccgc

SEQ ID NO: 307951 - RNA, 18 nt, Bordetella pertussis
cggugccuguucccgccg

SEQ ID NO: 307952 - RNA, 13 nt, Bordetella pertussis
cggugccuugcgg

SEQ ID NO: 307953 - RNA, 19 nt, Bordetella pertussis
cggugcgagaucucgaugc

SEQ ID NO: 307954 - RNA, 20 nt, Bordetella pertussis
cggugcgagaucucgaugcg

SEQ ID NO: 307955 - RNA, 19 nt, Bordetella pertussis
cggugcgauagcgccgcgc

SEQ ID NO: 307956 - RNA, 16 nt, Bordetella pertussis
cggugcgcacauggcg

SEQ ID NO: 307957 - RNA, 20 nt, Bordetella pertussis
cggugcgcaccaggcccaug

SEQ ID NO: 307958 - RNA, 15 nt, Bordetella pertussis
cggugcgcacgaugg

SEQ ID NO: 307959 - RNA, 15 nt, Bordetella pertussis
cggugcgcagcggca

SEQ ID NO: 307960 - RNA, 22 nt, Bordetella pertussis
cggugcgcagcggcaggcggcu

SEQ ID NO: 307961 - RNA, 14 nt, Bordetella pertussis
cggugcgccgccgc

SEQ ID NO: 307962 - RNA, 12 nt, Bordetella pertussis
cggugcgccgcg

SEQ ID NO: 307963 - RNA, 15 nt, Bordetella pertussis
cggugcgcgcagggc

SEQ ID NO: 307964 - RNA, 17 nt, Bordetella pertussis
cggugcgcgcagggcgg

SEQ ID NO: 307965 - RNA, 13 nt, Bordetella pertussis
cggugcgcgcggc

SEQ ID NO: 307966 - RNA, 21 nt, Bordetella pertussis
cggugcggaucaagcggcccg

SEQ ID NO: 307967 - RNA, 16 nt, Bordetella pertussis
cggugcggccucggcg

SEQ ID NO: 307968 - RNA, 14 nt, Bordetella pertussis
cggugcgggccggc

SEQ ID NO: 307969 - RNA, 19 nt, Bordetella pertussis
cggugcgggccggcgcgcc

SEQ ID NO: 307970 - RNA, 15 nt, Bordetella pertussis
cggugcgggugaccu

SEQ ID NO: 307971 - RNA, 22 nt, Bordetella pertussis
cggugcgggugaccuuggucgg

SEQ ID NO: 307972 - RNA, 18 nt, Bordetella pertussis
cggugcgggugggcgcgc

SEQ ID NO: 307973 - RNA, 19 nt, Bordetella pertussis
cggugcgggugggcgcgcc

SEQ ID NO: 307974 - RNA, 12 nt, Bordetella pertussis
cggugcgugcgc

SEQ ID NO: 307975 - RNA, 18 nt, Bordetella pertussis
cggugcguuccaugacgu

SEQ ID NO: 307976 - RNA, 22 nt, Bordetella pertussis
cggugcucggcgaacugggcgu

SEQ ID NO: 307977 - RNA, 15 nt, Bordetella pertussis
cggugcucuggcccg

SEQ ID NO: 307978 - RNA, 16 nt, Bordetella pertussis
cggugcucuggcccgc

SEQ ID NO: 307979 - RNA, 17 nt, Bordetella pertussis
cggugcugaacgccucg

SEQ ID NO: 307980 - RNA, 23 nt, Bordetella pertussis
cggugcugaacgccucgggcuug

SEQ ID NO: 307981 - RNA, 22 nt, Bordetella pertussis
cgguggaaauacagaucgccgc

SEQ ID NO: 307982 - RNA, 16 nt, Bordetella pertussis
cgguggaccagggcac

SEQ ID NO: 307983 - RNA, 15 nt, Bordetella pertussis
cgguggacggccagc

SEQ ID NO: 307984 - RNA, 17 nt, Bordetella pertussis
cgguggaggacgccgac

SEQ ID NO: 307985 - RNA, 19 nt, Bordetella pertussis
cgguggccagccaggcggu

SEQ ID NO: 307986 - RNA, 14 nt, Bordetella pertussis
cgguggccagcgcc

SEQ ID NO: 307987 - RNA, 14 nt, Bordetella pertussis
cgguggccagcgug

SEQ ID NO: 307988 - RNA, 22 nt, Bordetella pertussis
cgguggccaugcugggcgggcu

SEQ ID NO: 307989 - RNA, 21 nt, Bordetella pertussis
cgguggccauggacagcaccg

SEQ ID NO: 307990 - RNA, 14 nt, Bordetella pertussis
cgguggccgccgcg

SEQ ID NO: 307991 - RNA, 18 nt, Bordetella pertussis
cgguggccgccgcgcgcc

SEQ ID NO: 307992 - RNA, 20 nt, Bordetella pertussis
cgguggccgccgcgcgccgc

SEQ ID NO: 307993 - RNA, 18 nt, Bordetella pertussis
cgguggccgcgcaugcca

SEQ ID NO: 307994 - RNA, 23 nt, Bordetella pertussis
cgguggccucguccacgucgucg

SEQ ID NO: 307995 - RNA, 15 nt, Bordetella pertussis
cgguggcgaaggccg

SEQ ID NO: 307996 - RNA, 18 nt, Bordetella pertussis
cgguggcgccgucgcgcu

SEQ ID NO: 307997 - RNA, 21 nt, Bordetella pertussis
cgguggcgggccagcuccccg

SEQ ID NO: 307998 - RNA, 16 nt, Bordetella pertussis
cgguggcgggcgugcg

SEQ ID NO: 307999 - RNA, 18 nt, Bordetella pertussis
cgguggcgggcgugcgga

SEQ ID NO: 308000 - RNA, 20 nt, Bordetella pertussis
cgguggcguaguagcccagg

SEQ ID NO: 308001 - RNA, 21 nt, Bordetella pertussis
cgguggcguaguagcccaggc

SEQ ID NO: 308002 - RNA, 22 nt, Bordetella pertussis
cgguggcuggggcuggcauggc

SEQ ID NO: 308003 - RNA, 21 nt, Bordetella pertussis
cggugggcagcagcacgccca

SEQ ID NO: 308004 - RNA, 17 nt, Bordetella pertussis
cggugggcagcgcgucg

SEQ ID NO: 308005 - RNA, 17 nt, Bordetella pertussis
cggugggcgacgcggcg

SEQ ID NO: 308006 - RNA, 19 nt, Bordetella pertussis
cggugggcgacgcggcgua

SEQ ID NO: 308007 - RNA, 16 nt, Bordetella pertussis
cgguggggcaggucgc

SEQ ID NO: 308008 - RNA, 18 nt, Bordetella pertussis
cgguggggcaggucgcca

SEQ ID NO: 308009 - RNA, 19 nt, Bordetella pertussis
cgguggggcaguugaccau

SEQ ID NO: 308010 - RNA, 15 nt, Bordetella pertussis
cgguggguguggcca

SEQ ID NO: 308011 - RNA, 16 nt, Bordetella pertussis
cgguggucaucgaugc

SEQ ID NO: 308012 - RNA, 20 nt, Bordetella pertussis
cgguggucaucgaugcgccg

SEQ ID NO: 308013 - RNA, 23 nt, Bordetella pertussis
cgguggugaccacggcgcgcccg

SEQ ID NO: 308014 - RNA, 16 nt, Bordetella pertussis
cgguggugcugcuggg

SEQ ID NO: 308015 - RNA, 18 nt, Bordetella pertussis
cgguggugcugcugggcg

SEQ ID NO: 308016 - RNA, 15 nt, Bordetella pertussis
cgguggugcugggcg

SEQ ID NO: 308017 - RNA, 16 nt, Bordetella pertussis
cgguggugcugggcgg

SEQ ID NO: 308018 - RNA, 17 nt, Bordetella pertussis
cggugguggccaacgac

SEQ ID NO: 308019 - RNA, 16 nt, Bordetella pertussis
cgguggugucggcggc

SEQ ID NO: 308020 - RNA, 22 nt, Bordetella pertussis
cgguggugucggcggccagcag

SEQ ID NO: 308021 - RNA, 17 nt, Bordetella pertussis
cgguguagaccaccagc

SEQ ID NO: 308022 - RNA, 20 nt, Bordetella pertussis
cgguguaggcgggcagcggc

SEQ ID NO: 308023 - RNA, 20 nt, Bordetella pertussis
cggugucgcaccgcaaggaa

SEQ ID NO: 308024 - RNA, 13 nt, Bordetella pertussis
cggugucggcguc

SEQ ID NO: 308025 - RNA, 20 nt, Bordetella pertussis
cggugucggggccgggccgg

SEQ ID NO: 308026 - RNA, 19 nt, Bordetella pertussis
cgguguggugcugcgccgc

SEQ ID NO: 308027 - RNA, 15 nt, Bordetella pertussis
cgguguucgcgucgu

SEQ ID NO: 308028 - RNA, 16 nt, Bordetella pertussis
cgguguugcucgugcu

SEQ ID NO: 308029 - RNA, 20 nt, Bordetella pertussis
cgguguugcucgugcuggcc

SEQ ID NO: 308030 - RNA, 16 nt, Bordetella pertussis
cgguuccagccuggca

SEQ ID NO: 308031 - RNA, 22 nt, Bordetella pertussis
cgguuccugcaaggccggcggc

SEQ ID NO: 308032 - RNA, 18 nt, Bordetella pertussis
cgguucgugccgggcagc

SEQ ID NO: 308033 - RNA, 18 nt, Bordetella pertussis
cgguucuggaucgcgccc

SEQ ID NO: 308034 - RNA, 19 nt, Bordetella pertussis
cgguucuggaucgcgccca

SEQ ID NO: 308035 - RNA, 14 nt, Bordetella pertussis
cgguugacugcagc

SEQ ID NO: 308036 - RNA, 19 nt, Bordetella pertussis
cgguuggugucgcgcagcg

SEQ ID NO: 308037 - RNA, 16 nt, Bordetella pertussis
cgguugguuugcggcg

SEQ ID NO: 308038 - RNA, 18 nt, Bordetella pertussis
cgguuuuuuugcgccgcu

SEQ ID NO: 308039 - RNA, 19 nt, Bordetella pertussis
cguaaagccgcacgcccgc

SEQ ID NO: 308040 - RNA, 16 nt, Bordetella pertussis
cguaaagaugcgcgcc

SEQ ID NO: 308041 - RNA, 16 nt, Bordetella pertussis
cguaagcgcuggacgc

SEQ ID NO: 308042 - RNA, 14 nt, Bordetella pertussis
cguaaggccgccgg

SEQ ID NO: 308043 - RNA, 19 nt, Bordetella pertussis
cguaaggccgccggccacc

SEQ ID NO: 308044 - RNA, 17 nt, Bordetella pertussis
cguaauagcuggcggcg

SEQ ID NO: 308045 - RNA, 21 nt, Bordetella pertussis
cguaauagcuggcggcgcgcu

SEQ ID NO: 308046 - RNA, 16 nt, Bordetella pertussis
cguaauaguggucgcc

SEQ ID NO: 308047 - RNA, 17 nt, Bordetella pertussis
cguaauaguggucgccg

SEQ ID NO: 308048 - RNA, 14 nt, Bordetella pertussis
cguaaucggcgucg

SEQ ID NO: 308049 - RNA, 17 nt, Bordetella pertussis
cguaaucggcgucggca

SEQ ID NO: 308050 - RNA, 20 nt, Bordetella pertussis
cguaaucgaagccgggcggc

SEQ ID NO: 308051 - RNA, 19 nt, Bordetella pertussis
cguaggcgcgcgcaucggc

SEQ ID NO: 308052 - RNA, 20 nt, Bordetella pertussis
cguagggcacaucggccacc

SEQ ID NO: 308053 - RNA, 19 nt, Bordetella pertussis
cguaggucaggcccacgcc

SEQ ID NO: 308054 - RNA, 15 nt, Bordetella pertussis
cguaggugcgcgcca

SEQ ID NO: 308055 - RNA, 17 nt, Bordetella pertussis
cguaggugcgcgccaca

SEQ ID NO: 308056 - RNA, 21 nt, Bordetella pertussis
cguaguguucgauggcggcca

SEQ ID NO: 308057 - RNA, 16 nt, Bordetella pertussis
cguaugcggcagcagg

SEQ ID NO: 308058 - RNA, 18 nt, Bordetella pertussis
cguaugcggcagcagggc

SEQ ID NO: 308059 - RNA, 20 nt, Bordetella pertussis
cguauggcccgccaccacgg

SEQ ID NO: 308060 - RNA, 22 nt, Bordetella pertussis
cguauggccguuggccagcgcc

SEQ ID NO: 308061 - RNA, 19 nt, Bordetella pertussis
cguauggcggggugccugu

SEQ ID NO: 308062 - RNA, 23 nt, Bordetella pertussis
cguauuccccuucucggccguca

SEQ ID NO: 308063 - RNA, 18 nt, Bordetella pertussis
cguauuccggguccagcc

SEQ ID NO: 308064 - RNA, 19 nt, Bordetella pertussis
cguauuccggguccagccc

SEQ ID NO: 308065 - RNA, 18 nt, Bordetella pertussis
cguauucgguggcgcgca

SEQ ID NO: 308066 - RNA, 14 nt, Bordetella pertussis
cguauugcugcugc

SEQ ID NO: 308067 - RNA, 15 nt, Bordetella pertussis
cguauugcugcugcu

SEQ ID NO: 308068 - RNA, 18 nt, Bordetella pertussis
cguauugugcaugcgcgc

SEQ ID NO: 308069 - RNA, 16 nt, Bordetella pertussis
cgucaagccagcggcg

SEQ ID NO: 308070 - RNA, 22 nt, Bordetella pertussis
cgucaagccagcggcgcggcgc

SEQ ID NO: 308071 - RNA, 19 nt, Bordetella pertussis
cgucacggaucagccgcuu

SEQ ID NO: 308072 - RNA, 13 nt, Bordetella pertussis
cgucacggcaaga

SEQ ID NO: 308073 - RNA, 20 nt, Bordetella pertussis
cgucacggcaagacggcgcu

SEQ ID NO: 308074 - RNA, 23 nt, Bordetella pertussis
cgucagagcccuucgacgcggcg

SEQ ID NO: 308075 - RNA, 14 nt, Bordetella pertussis
cgucagcacgcccu

SEQ ID NO: 308076 - RNA, 22 nt, Bordetella pertussis
cgucagcacggucggcgcguaa

SEQ ID NO: 308077 - RNA, 17 nt, Bordetella pertussis
cgucagcagcaggcugg

SEQ ID NO: 308078 - RNA, 16 nt, Bordetella pertussis
cgucagcagcgcggcg

SEQ ID NO: 308079 - RNA, 17 nt, Bordetella pertussis
cgucagcagcacgccuu

SEQ ID NO: 308080 - RNA, 16 nt, Bordetella pertussis
cgucagcgacaucgug

SEQ ID NO: 308081 - RNA, 13 nt, Bordetella pertussis
cgucagcgccgcg

SEQ ID NO: 308082 - RNA, 16 nt, Bordetella pertussis
cgucagcggcgcgccc

SEQ ID NO: 308083 - RNA, 17 nt, Bordetella pertussis
cgucagcgugcgccccg

SEQ ID NO: 308084 - RNA, 18 nt, Bordetella pertussis
cgucagcgugcgccccgc

SEQ ID NO: 308085 - RNA, 16 nt, Bordetella pertussis
cgucagcucgaucagg

SEQ ID NO: 308086 - RNA, 22 nt, Bordetella pertussis
cgucaggaucaggccggcgaug

SEQ ID NO: 308087 - RNA, 18 nt, Bordetella pertussis
cgucaggcaggcgcgccg

SEQ ID NO: 308088 - RNA, 21 nt, Bordetella pertussis
cgucaggcaggcgcgccgggc

SEQ ID NO: 308089 - RNA, 13 nt, Bordetella pertussis
cgucaggccgggc

SEQ ID NO: 308090 - RNA, 13 nt, Bordetella pertussis
cgucaggccgucg

SEQ ID NO: 308091 - RNA, 19 nt, Bordetella pertussis
cgucaggcguugcgccgca

SEQ ID NO: 308092 - RNA, 21 nt, Bordetella pertussis
cgucaggcugggagagccggc

SEQ ID NO: 308093 - RNA, 22 nt, Bordetella pertussis
cgucaggcugggagagccggcc

SEQ ID NO: 308094 - RNA, 15 nt, Bordetella pertussis
cgucaggugcagcga

SEQ ID NO: 308095 - RNA, 17 nt, Bordetella pertussis
cgucaguugggcgcgcc

SEQ ID NO: 308096 - RNA, 19 nt, Bordetella pertussis
cgucauaggcuucgcccgc

SEQ ID NO: 308097 - RNA, 18 nt, Bordetella pertussis
cgucauccugggcgcgcg

SEQ ID NO: 308098 - RNA, 21 nt, Bordetella pertussis
cguccaauucgagcaggcgca

SEQ ID NO: 308099 - RNA, 24 nt, Bordetella pertussis
cguccaauucgagcaggcgcaggc

SEQ ID NO: 308100 - RNA, 15 nt, Bordetella pertussis
cguccaccaccaggc

SEQ ID NO: 308101 - RNA, 16 nt, Bordetella pertussis
cguccaccaccaggcc

SEQ ID NO: 308102 - RNA, 21 nt, Bordetella pertussis
cguccaccaccaggccggcca

SEQ ID NO: 308103 - RNA, 13 nt, Bordetella pertussis
cguccaccgccga

SEQ ID NO: 308104 - RNA, 17 nt, Bordetella pertussis
cguccaccuugacgcgc

SEQ ID NO: 308105 - RNA, 20 nt, Bordetella pertussis
cguccacgaaggcagcaccu

SEQ ID NO: 308106 - RNA, 20 nt, Bordetella pertussis
cguccacgcccagcgccggc

SEQ ID NO: 308107 - RNA, 15 nt, Bordetella pertussis
cguccacgccgcgcg

SEQ ID NO: 308108 - RNA, 16 nt, Bordetella pertussis
cguccacgccgcgcgc

SEQ ID NO: 308109 - RNA, 16 nt, Bordetella pertussis
cguccacgccguggcg

SEQ ID NO: 308110 - RNA, 22 nt, Bordetella pertussis
cguccacgccguggcgcaaggc

SEQ ID NO: 308111 - RNA, 19 nt, Bordetella pertussis
cguccacggccugcgcgcc

SEQ ID NO: 308112 - RNA, 20 nt, Bordetella pertussis
cguccacggccugcgcgccg

SEQ ID NO: 308113 - RNA, 17 nt, Bordetella pertussis
cguccacgcccagcgcc

SEQ ID NO: 308114 - RNA, 15 nt, Bordetella pertussis
cguccagcacgcggc

SEQ ID NO: 308115 - RNA, 20 nt, Bordetella pertussis
cguccagcacgcggcgcagc

SEQ ID NO: 308116 - RNA, 13 nt, Bordetella pertussis
cguccagcacggc

SEQ ID NO: 308117 - RNA, 21 nt, Bordetella pertussis
cguccagcacggccgcggccg

SEQ ID NO: 308118 - RNA, 22 nt, Bordetella pertussis
cguccagcacggccgcggccgg

SEQ ID NO: 308119 - RNA, 19 nt, Bordetella pertussis
cguccagguugcccgagcg

SEQ ID NO: 308120 - RNA, 21 nt, Bordetella pertussis
cguccagguugcccgagcgcg

SEQ ID NO: 308121 - RNA, 21 nt, Bordetella pertussis
cguccagguugucggccaugc

SEQ ID NO: 308122 - RNA, 18 nt, Bordetella pertussis
cguccaggugcggcggcg

SEQ ID NO: 308123 - RNA, 20 nt, Bordetella pertussis
cguccaggugcggcggcgac

SEQ ID NO: 308124 - RNA, 18 nt, Bordetella pertussis
cgucccagucgccgcgcc

SEQ ID NO: 308125 - RNA, 20 nt, Bordetella pertussis
cguccccaccuccaccucga

SEQ ID NO: 308126 - RNA, 16 nt, Bordetella pertussis
cguccccacggggacu

SEQ ID NO: 308127 - RNA, 19 nt, Bordetella pertussis
cguccccacggggacuggc

SEQ ID NO: 308128 - RNA, 23 nt, Bordetella pertussis
cgucccgacccccggcccgcgcc

SEQ ID NO: 308129 - RNA, 17 nt, Bordetella pertussis
cgucccggugaucgucc

SEQ ID NO: 308130 - RNA, 15 nt, Bordetella pertussis
cgucccgugccggcc

SEQ ID NO: 308131 - RNA, 16 nt, Bordetella pertussis
cgucccgugccggccg

SEQ ID NO: 308132 - RNA, 16 nt, Bordetella pertussis
cgucccugguccagca

SEQ ID NO: 308133 - RNA, 18 nt, Bordetella pertussis
cguccgaauacgccacgu

SEQ ID NO: 308134 - RNA, 17 nt, Bordetella pertussis
cguccgcaucgcgcaag

SEQ ID NO: 308135 - RNA, 16 nt, Bordetella pertussis
cguccgccccauccac

SEQ ID NO: 308136 - RNA, 23 nt, Bordetella pertussis
cguccgccccauccacggcgcca

SEQ ID NO: 308137 - RNA, 17 nt, Bordetella pertussis
cguccgccaggacggga

SEQ ID NO: 308138 - RNA, 18 nt, Bordetella pertussis
cguccggggucagguuga

SEQ ID NO: 308139 - RNA, 16 nt, Bordetella pertussis
cguccggguuggcgau

SEQ ID NO: 308140 - RNA, 20 nt, Bordetella pertussis
cguccguccuggccacugcc

SEQ ID NO: 308141 - RNA, 21 nt, Bordetella pertussis
cguccgugagugcagcgcuca

SEQ ID NO: 308142 - RNA, 21 nt, Bordetella pertussis
cguccguuucgucggcgcgcg

SEQ ID NO: 308143 - RNA, 22 nt, Bordetella pertussis
cguccguuucgucggcgcgcgc

SEQ ID NO: 308144 - RNA, 23 nt, Bordetella pertussis
cguccguuucgucggcgcgcgcc

SEQ ID NO: 308145 - RNA, 21 nt, Bordetella pertussis
cguccugcaggaaggccgccg

SEQ ID NO: 308146 - RNA, 19 nt, Bordetella pertussis
cguccugccaguugccgcc

SEQ ID NO: 308147 - RNA, 20 nt, Bordetella pertussis
cguccugccaguugccgccg

SEQ ID NO: 308148 - RNA, 16 nt, Bordetella pertussis
cguccugcgccaguug

SEQ ID NO: 308149 - RNA, 12 nt, Bordetella pertussis
cguccugcggcg

SEQ ID NO: 308150 - RNA, 19 nt, Bordetella pertussis
cguccugcggcggcagcuu

SEQ ID NO: 308151 - RNA, 18 nt, Bordetella pertussis
cguccugccauugcgcgg

SEQ ID NO: 308152 - RNA, 13 nt, Bordetella pertussis
cguccuggccguc

SEQ ID NO: 308153 - RNA, 14 nt, Bordetella pertussis
cguccuggccguca

SEQ ID NO: 308154 - RNA, 12 nt, Bordetella pertussis
cguccuggcgcg

SEQ ID NO: 308155 - RNA, 16 nt, Bordetella pertussis
cguccuggggcgcggu

SEQ ID NO: 308156 - RNA, 17 nt, Bordetella pertussis
cguccuggugcacgccg

SEQ ID NO: 308157 - RNA, 23 nt, Bordetella pertussis
cguccuuacuugcgcacggcggc

SEQ ID NO: 308158 - RNA, 16 nt, Bordetella pertussis
cguccuucgucggcgg

SEQ ID NO: 308159 - RNA, 17 nt, Bordetella pertussis
cguccuuggcggccuug

SEQ ID NO: 308160 - RNA, 21 nt, Bordetella pertussis
cguccuuggcguccggcccca

SEQ ID NO: 308161 - RNA, 17 nt, Bordetella pertussis
cguccuugagcgccagc

SEQ ID NO: 308162 - RNA, 16 nt, Bordetella pertussis
cguccuugugccaggu

SEQ ID NO: 308163 - RNA, 19 nt, Bordetella pertussis
cgucgaaacgcugcgcgau

SEQ ID NO: 308164 - RNA, 23 nt, Bordetella pertussis
cgucgaaauaggaucccggcgcc

SEQ ID NO: 308165 - RNA, 15 nt, Bordetella pertussis
cgucgaccaccagca

SEQ ID NO: 308166 - RNA, 23 nt, Bordetella pertussis
cgucgaccaccagcaucgcgccu

SEQ ID NO: 308167 - RNA, 17 nt, Bordetella pertussis
cgucgaccacgccggcg

SEQ ID NO: 308168 - RNA, 21 nt, Bordetella pertussis
cgucgaccacgccggcggcca

SEQ ID NO: 308169 - RNA, 13 nt, Bordetella pertussis
cgucgaccccguc

SEQ ID NO: 308170 - RNA, 18 nt, Bordetella pertussis
cgucgacgcagcagccgc

SEQ ID NO: 308171 - RNA, 22 nt, Bordetella pertussis
cgucgacgcagcagccgcuagg

SEQ ID NO: 308172 - RNA, 14 nt, Bordetella pertussis
cgucgacgcggccg

SEQ ID NO: 308173 - RNA, 15 nt, Bordetella pertussis
cgucgaugccgacca

SEQ ID NO: 308174 - RNA, 14 nt, Bordetella pertussis
cgucgaugcgcgcg

SEQ ID NO: 308175 - RNA, 16 nt, Bordetella pertussis
cgucgaugcgcgcgcg

SEQ ID NO: 308176 - RNA, 15 nt, Bordetella pertussis
cgucgauggcccgca

SEQ ID NO: 308177 - RNA, 20 nt, Bordetella pertussis
cgucgauggcguacagcagg

SEQ ID NO: 308178 - RNA, 22 nt, Bordetella pertussis
cgucgcacuggguggccagcgc

SEQ ID NO: 308179 - RNA, 16 nt, Bordetella pertussis
cgucgcagcacgccca

SEQ ID NO: 308180 - RNA, 18 nt, Bordetella pertussis
cgucgccaaagcgcagcg

SEQ ID NO: 308181 - RNA, 21 nt, Bordetella pertussis
cgucgccaaagcgcagcguga

SEQ ID NO: 308182 - RNA, 16 nt, Bordetella pertussis
cgucgcccggggcggc

SEQ ID NO: 308183 - RNA, 20 nt, Bordetella pertussis
cgucgcccggggcggcgucg

SEQ ID NO: 308184 - RNA, 15 nt, Bordetella pertussis
cgucgcccuggcggc

SEQ ID NO: 308185 - RNA, 18 nt, Bordetella pertussis
cgucgcccuggcggcggu

SEQ ID NO: 308186 - RNA, 15 nt, Bordetella pertussis
cgucgccgcccaugc

SEQ ID NO: 308187 - RNA, 16 nt, Bordetella pertussis
cgucgccgcccaugcg

SEQ ID NO: 308188 - RNA, 15 nt, Bordetella pertussis
cgucgccgcccugcu

SEQ ID NO: 308189 - RNA, 16 nt, Bordetella pertussis
cgucgccuggucgacg

SEQ ID NO: 308190 - RNA, 15 nt, Bordetella pertussis
cgucgcgaccgccgc

SEQ ID NO: 308191 - RNA, 14 nt, Bordetella pertussis
cgucgcgguccagc

SEQ ID NO: 308192 - RNA, 20 nt, Bordetella pertussis
cgucgcgguccagcaccagg

SEQ ID NO: 308193 - RNA, 14 nt, Bordetella pertussis
cgucgcguagcgcg

SEQ ID NO: 308194 - RNA, 22 nt, Bordetella pertussis
cgucgcguagcgcggccggguc

SEQ ID NO: 308195 - RNA, 15 nt, Bordetella pertussis
cgucggacaacgcca

SEQ ID NO: 308196 - RNA, 13 nt, Bordetella pertussis
cgucggacgcgcg

SEQ ID NO: 308197 - RNA, 18 nt, Bordetella pertussis
cgucggacgcgcgccgca

SEQ ID NO: 308198 - RNA, 11 nt, Bordetella pertussis
cgucggccagc

SEQ ID NO: 308199 - RNA, 15 nt, Bordetella pertussis
cgucggccagcgcga

SEQ ID NO: 308200 - RNA, 17 nt, Bordetella pertussis
cgucggccagcgcgaag

SEQ ID NO: 308201 - RNA, 12 nt, Bordetella pertussis
cgucggccagcg

SEQ ID NO: 308202 - RNA, 13 nt, Bordetella pertussis
cgucggccagcgc

SEQ ID NO: 308203 - RNA, 21 nt, Bordetella pertussis
cgucggccagcuugccgcuca

SEQ ID NO: 308204 - RNA, 14 nt, Bordetella pertussis
cgucggccaggccg

SEQ ID NO: 308205 - RNA, 14 nt, Bordetella pertussis
cgucggccaggcgc

SEQ ID NO: 308206 - RNA, 17 nt, Bordetella pertussis
cgucggccaugcgcgcc

SEQ ID NO: 308207 - RNA, 20 nt, Bordetella pertussis
cgucggccaugcgcgccagc

SEQ ID NO: 308208 - RNA, 15 nt, Bordetella pertussis
cgucggccgccagcc

SEQ ID NO: 308209 - RNA, 16 nt, Bordetella pertussis
cgucggccgccgccgu

SEQ ID NO: 308210 - RNA, 17 nt, Bordetella pertussis
cgucggccgcgcccagg

SEQ ID NO: 308211 - RNA, 18 nt, Bordetella pertussis
cgucggccgcgcccaggu

SEQ ID NO: 308212 - RNA, 12 nt, Bordetella pertussis
cgucggccgcgu

SEQ ID NO: 308213 - RNA, 12 nt, Bordetella pertussis
cgucggccgucu

SEQ ID NO: 308214 - RNA, 23 nt, Bordetella pertussis
cgucggccucaucgagcgccugg

SEQ ID NO: 308215 - RNA, 19 nt, Bordetella pertussis
cgucggccucgcgcagggc

SEQ ID NO: 308216 - RNA, 17 nt, Bordetella pertussis
cgucggccugcacgcuc

SEQ ID NO: 308217 - RNA, 18 nt, Bordetella pertussis
cgucggccugccagccug

SEQ ID NO: 308218 - RNA, 14 nt, Bordetella pertussis
cgucggcgacguga

SEQ ID NO: 308219 - RNA, 20 nt, Bordetella pertussis
cgucggcgacgugaugcucg

SEQ ID NO: 308220 - RNA, 12 nt, Bordetella pertussis
cgucggcgccau

SEQ ID NO: 308221 - RNA, 14 nt, Bordetella pertussis
cgucggcgccaugc

SEQ ID NO: 308222 - RNA, 18 nt, Bordetella pertussis
cgucggcgccaugcuggc

SEQ ID NO: 308223 - RNA, 18 nt, Bordetella pertussis
cgucggcgccgaucagca

SEQ ID NO: 308224 - RNA, 19 nt, Bordetella pertussis
cgucggcgcccggcgccgc

SEQ ID NO: 308225 - RNA, 20 nt, Bordetella pertussis
cgucggcgcccggcgccgcg

SEQ ID NO: 308226 - RNA, 12 nt, Bordetella pertussis
cgucggcgcgcg

SEQ ID NO: 308227 - RNA, 16 nt, Bordetella pertussis
cgucggcgcgcgccag

SEQ ID NO: 308228 - RNA, 21 nt, Bordetella pertussis
cgucggcgcgcgccaggccca

SEQ ID NO: 308229 - RNA, 14 nt, Bordetella pertussis
cgucggcgcgguau

SEQ ID NO: 308230 - RNA, 20 nt, Bordetella pertussis
cgucggcggcccacagcgcc

SEQ ID NO: 308231 - RNA, 22 nt, Bordetella pertussis
cgucggcggcaagcagccggaa

SEQ ID NO: 308232 - RNA, 21 nt, Bordetella pertussis
cgucggcgggacgcaggccca

SEQ ID NO: 308233 - RNA, 22 nt, Bordetella pertussis
cgucggcgucgaaugcacgggc

SEQ ID NO: 308234 - RNA, 14 nt, Bordetella pertussis
cgucggcguugugc

SEQ ID NO: 308235 - RNA, 21 nt, Bordetella pertussis
cgucggcucaguccaagguca

SEQ ID NO: 308236 - RNA, 15 nt, Bordetella pertussis
cgucgggaccggcgc

SEQ ID NO: 308237 - RNA, 15 nt, Bordetella pertussis
cgucgggcaagcggc

SEQ ID NO: 308238 - RNA, 14 nt, Bordetella pertussis
cgucgggcagcagg

SEQ ID NO: 308239 - RNA, 22 nt, Bordetella pertussis
cgucgggcagcgcggcggcgac

SEQ ID NO: 308240 - RNA, 18 nt, Bordetella pertussis
cgucgggcaguugcuggc

SEQ ID NO: 308241 - RNA, 23 nt, Bordetella pertussis
cgucgggcaguugcuggcggccg

SEQ ID NO: 308242 - RNA, 14 nt, Bordetella pertussis
cgucgggcgccgca

SEQ ID NO: 308243 - RNA, 14 nt, Bordetella pertussis
cgucggggucgucg

SEQ ID NO: 308244 - RNA, 17 nt, Bordetella pertussis
cgucggugccguccagc

SEQ ID NO: 308245 - RNA, 18 nt, Bordetella pertussis
cgucggugccguccagcg

SEQ ID NO: 308246 - RNA, 18 nt, Bordetella pertussis
cgucggugggaaucggca

SEQ ID NO: 308247 - RNA, 22 nt, Bordetella pertussis
cgucguacuggugggccgacgg

SEQ ID NO: 308248 - RNA, 13 nt, Bordetella pertussis
cgucguagcgcca

SEQ ID NO: 308249 - RNA, 16 nt, Bordetella pertussis
cgucguagcgccagcg

SEQ ID NO: 308250 - RNA, 14 nt, Bordetella pertussis
cgucguagcgcugc

SEQ ID NO: 308251 - RNA, 15 nt, Bordetella pertussis
cgucguagcgcugca

SEQ ID NO: 308252 - RNA, 16 nt, Bordetella pertussis
cgucguagcgggcggc

SEQ ID NO: 308253 - RNA, 20 nt, Bordetella pertussis
cgucguagcgggcggcggcg

SEQ ID NO: 308254 - RNA, 14 nt, Bordetella pertussis
cgucguagccgccg

SEQ ID NO: 308255 - RNA, 17 nt, Bordetella pertussis
cgucguagugcgcgccg

SEQ ID NO: 308256 - RNA, 19 nt, Bordetella pertussis
cgucguagugcgcgccgcu

SEQ ID NO: 308257 - RNA, 18 nt, Bordetella pertussis
cgucgucaacccgucgac

SEQ ID NO: 308258 - RNA, 15 nt, Bordetella pertussis
cgucguccacgcccg

SEQ ID NO: 308259 - RNA, 18 nt, Bordetella pertussis
cgucguccagcgucaugc

SEQ ID NO: 308260 - RNA, 18 nt, Bordetella pertussis
cgucguccaucgacgcgg

SEQ ID NO: 308261 - RNA, 22 nt, Bordetella pertussis
cgucguccaucgacgcggcgac

SEQ ID NO: 308262 - RNA, 14 nt, Bordetella pertussis
cgucguccagcuug

SEQ ID NO: 308263 - RNA, 17 nt, Bordetella pertussis
cgucguccguggccggc

SEQ ID NO: 308264 - RNA, 16 nt, Bordetella pertussis
cgucguccucggcacg

SEQ ID NO: 308265 - RNA, 20 nt, Bordetella pertussis
cgucguuucccagcaagccg

SEQ ID NO: 308266 - RNA, 22 nt, Bordetella pertussis
cgucuacaggcccagcgccagc

SEQ ID NO: 308267 - RNA, 14 nt, Bordetella pertussis
cgucuacgcgaacc

SEQ ID NO: 308268 - RNA, 15 nt, Bordetella pertussis
cgucuauggccugca

SEQ ID NO: 308269 - RNA, 22 nt, Bordetella pertussis
cgucuccacgccgccgaccucg

SEQ ID NO: 308270 - RNA, 13 nt, Bordetella pertussis
cgucuccagcgcg

SEQ ID NO: 308271 - RNA, 16 nt, Bordetella pertussis
cgucuccagcgcggcg

SEQ ID NO: 308272 - RNA, 11 nt, Bordetella pertussis
cgucucgccca

SEQ ID NO: 308273 - RNA, 20 nt, Bordetella pertussis
cgucucgcccacccccggca

SEQ ID NO: 308274 - RNA, 20 nt, Bordetella pertussis
cgucucgcccaggcccagca

SEQ ID NO: 308275 - RNA, 14 nt, Bordetella pertussis
cgucucgcgcgcca

SEQ ID NO: 308276 - RNA, 16 nt, Bordetella pertussis
cgucucgcgcgccagg

SEQ ID NO: 308277 - RNA, 17 nt, Bordetella pertussis
cgucucgcgcgccaggu

SEQ ID NO: 308278 - RNA, 14 nt, Bordetella pertussis
cgugcgcggccgcg

SEQ ID NO: 308279 - RNA, 15 nt, Bordetella pertussis
cgugcgcggccgcgc

SEQ ID NO: 308280 - RNA, 18 nt, Bordetella pertussis
cgugcgcggccgcgcgcu

SEQ ID NO: 308281 - RNA, 13 nt, Bordetella pertussis
cgugcgcgcgcca

SEQ ID NO: 308282 - RNA, 15 nt, Bordetella pertussis
cgugcgcgggcgcca

SEQ ID NO: 308283 - RNA, 16 nt, Bordetella pertussis
cgugcgcgggcgcggc

SEQ ID NO: 308284 - RNA, 16 nt, Bordetella pertussis
cgugcgcuggcugggc

SEQ ID NO: 308285 - RNA, 18 nt, Bordetella pertussis
cgugcgcuggcugggccu

SEQ ID NO: 308286 - RNA, 22 nt, Bordetella pertussis
cgugcgcuugcgcauggccggu

SEQ ID NO: 308287 - RNA, 19 nt, Bordetella pertussis
cgugcggacacugacgugg

SEQ ID NO: 308288 - RNA, 14 nt, Bordetella pertussis
cgugcggaccagcg

SEQ ID NO: 308289 - RNA, 20 nt, Bordetella pertussis
cgugcggaccagcgguugcg

SEQ ID NO: 308290 - RNA, 17 nt, Bordetella pertussis
cgugcggaugcagcagc

SEQ ID NO: 308291 - RNA, 21 nt, Bordetella pertussis
cgugcggcacgcacagcaugc

SEQ ID NO: 308292 - RNA, 23 nt, Bordetella pertussis
cgugcggcacgcacagcaugcgc

SEQ ID NO: 308293 - RNA, 20 nt, Bordetella pertussis
cgugcgguucgucagggccg

SEQ ID NO: 308294 - RNA, 23 nt, Bordetella pertussis
cgugcguauucgguggcgcgcag

SEQ ID NO: 308295 - RNA, 19 nt, Bordetella pertussis
cgugcgugaccacgaucau

SEQ ID NO: 308296 - RNA, 15 nt, Bordetella pertussis
cgugcgugccgacga

SEQ ID NO: 308297 - RNA, 15 nt, Bordetella pertussis
cgugcgugcgccugu

SEQ ID NO: 308298 - RNA, 16 nt, Bordetella pertussis
cgugcucaucggcagg

SEQ ID NO: 308299 - RNA, 17 nt, Bordetella pertussis
cgugcucaucggcaggc

SEQ ID NO: 308300 - RNA, 20 nt, Bordetella pertussis
cgugcucaucggcaggccgg

SEQ ID NO: 308301 - RNA, 21 nt, Bordetella pertussis
cgugcucaucggcaggccggc

SEQ ID NO: 308302 - RNA, 19 nt, Bordetella pertussis
cgugcuccagaacgcgccg

SEQ ID NO: 308303 - RNA, 20 nt, Bordetella pertussis
cgugcuccagaacgcgccgu

SEQ ID NO: 308304 - RNA, 15 nt, Bordetella pertussis
cgugcuggccggaua

SEQ ID NO: 308305 - RNA, 15 nt, Bordetella pertussis
cgugcuggcgcagca

SEQ ID NO: 308306 - RNA, 19 nt, Bordetella pertussis
cgugcuggcgcagcagcgc

SEQ ID NO: 308307 - RNA, 20 nt, Bordetella pertussis
cgugcuggcgcagcagcgcc

SEQ ID NO: 308308 - RNA, 21 nt, Bordetella pertussis
cgugcuggcgcagcagcgccg

SEQ ID NO: 308309 - RNA, 13 nt, Bordetella pertussis
cgugcuggcgcgu

SEQ ID NO: 308310 - RNA, 15 nt, Bordetella pertussis
cgugcugggcggcca

SEQ ID NO: 308311 - RNA, 16 nt, Bordetella pertussis
cgugcugggcggccag

SEQ ID NO: 308312 - RNA, 21 nt, Bordetella pertussis
cgugcuguaccucagccugcu

SEQ ID NO: 308313 - RNA, 23 nt, Bordetella pertussis
cgugcuugccgccggacggcgcc

SEQ ID NO: 308314 - RNA, 20 nt, Bordetella pertussis
aaccgcaccggaggcgccgc

SEQ ID NO: 308315 - RNA, 20 nt, Bordetella pertussis
cguggaugaugcgcgagccg

SEQ ID NO: 308316 - RNA, 21 nt, Bordetella pertussis
cguggaugggcuuugacgccg

SEQ ID NO: 308317 - RNA, 17 nt, Bordetella pertussis
cguggcaggugcggccg

SEQ ID NO: 308318 - RNA, 21 nt, Bordetella pertussis
cguggcaggugcggccgcagc

SEQ ID NO: 308319 - RNA, 19 nt, Bordetella pertussis
cguggccaagggcgccgcg

SEQ ID NO: 308320 - RNA, 20 nt, Bordetella pertussis
cguggccaagggcgccgcgc

SEQ ID NO: 308321 - RNA, 22 nt, Bordetella pertussis
cguggccaagggcgccgcgccg

SEQ ID NO: 308322 - RNA, 17 nt, Bordetella pertussis
cguggccaccaggcgcg

SEQ ID NO: 308323 - RNA, 14 nt, Bordetella pertussis
cguggccagcacgg

SEQ ID NO: 308324 - RNA, 15 nt, Bordetella pertussis
cguggcccagcaccg

SEQ ID NO: 308325 - RNA, 14 nt, Bordetella pertussis
cguggcccagccgg

SEQ ID NO: 308326 - RNA, 16 nt, Bordetella pertussis
cguggccccaggcgug

SEQ ID NO: 308327 - RNA, 16 nt, Bordetella pertussis
cguggcccgcgccgcg

SEQ ID NO: 308328 - RNA, 18 nt, Bordetella pertussis
cguggcccgcgugacggc

SEQ ID NO: 308329 - RNA, 14 nt, Bordetella pertussis
cguggccgccacca

SEQ ID NO: 308330 - RNA, 16 nt, Bordetella pertussis
cguggccgccaccagc

SEQ ID NO: 308331 - RNA, 17 nt, Bordetella pertussis
cguggccgccaccagcg

SEQ ID NO: 308332 - RNA, 11 nt, Bordetella pertussis
cguggccgccg

SEQ ID NO: 308333 - RNA, 21 nt, Bordetella pertussis
cguggccgcgcaaggccugcu

SEQ ID NO: 308334 - RNA, 12 nt, Bordetella pertussis
cguggccgcgcu

SEQ ID NO: 308335 - RNA, 20 nt, Bordetella pertussis
cguggccgcgcugcugcagg

SEQ ID NO: 308336 - RNA, 18 nt, Bordetella pertussis
cguggccgcuucggcggc

SEQ ID NO: 308337 - RNA, 20 nt, Bordetella pertussis
cguggccgcuucggcggcca

SEQ ID NO: 308338 - RNA, 14 nt, Bordetella pertussis
cguggccggcaucg

SEQ ID NO: 308339 - RNA, 18 nt, Bordetella pertussis
cguggccggcaucgcgcu

SEQ ID NO: 308340 - RNA, 19 nt, Bordetella pertussis
cguggccggcaucgcgcug

SEQ ID NO: 308341 - RNA, 16 nt, Bordetella pertussis
cguggccggcgcggca

SEQ ID NO: 308342 - RNA, 16 nt, Bordetella pertussis
cguggccgggcccggc

SEQ ID NO: 308343 - RNA, 17 nt, Bordetella pertussis
cguggccgggcccggcg

SEQ ID NO: 308344 - RNA, 17 nt, Bordetella pertussis
cguggccggcgacggca

SEQ ID NO: 308345 - RNA, 17 nt, Bordetella pertussis
cguggccgugcugguca

SEQ ID NO: 308346 - RNA, 23 nt, Bordetella pertussis
cguggccugcccgucgggcaggu

SEQ ID NO: 308347 - RNA, 22 nt, Bordetella pertussis
cguggccguucggugcgcagcg

SEQ ID NO: 308348 - RNA, 19 nt, Bordetella pertussis
cguggcggggcguucgacg

SEQ ID NO: 308349 - RNA, 16 nt, Bordetella pertussis
cguggcguccaugcug

SEQ ID NO: 308350 - RNA, 17 nt, Bordetella pertussis
cguggcggguccacgug

SEQ ID NO: 308351 - RNA, 19 nt, Bordetella pertussis
cguggcggguccacguggc

SEQ ID NO: 308352 - RNA, 17 nt, Bordetella pertussis
cguggcgugcaggccgg

SEQ ID NO: 308353 - RNA, 18 nt, Bordetella pertussis
cguggcgugcaggccggc

SEQ ID NO: 308354 - RNA, 14 nt, Bordetella pertussis
cguggcugaccagc

SEQ ID NO: 308355 - RNA, 15 nt, Bordetella pertussis
cguggcugaccagca

SEQ ID NO: 308356 - RNA, 23 nt, Bordetella pertussis
cgugggcgaacuggucgaacucg

SEQ ID NO: 308357 - RNA, 17 nt, Bordetella pertussis
cgugggcggcggcaugc

SEQ ID NO: 308358 - RNA, 15 nt, Bordetella pertussis
cguggggagcgcggc

SEQ ID NO: 308359 - RNA, 15 nt, Bordetella pertussis
cgugguacgacgagc

SEQ ID NO: 308360 - RNA, 15 nt, Bordetella pertussis
cgugguaucgcgcca

SEQ ID NO: 308361 - RNA, 17 nt, Bordetella pertussis
cgugguaucgcgccagc

SEQ ID NO: 308362 - RNA, 19 nt, Bordetella pertussis
cgugguaucgcgccagcgc

SEQ ID NO: 308363 - RNA, 21 nt, Bordetella pertussis
cgugguaucgcgccagcgccg

SEQ ID NO: 308364 - RNA, 16 nt, Bordetella pertussis
cgugguccacgaagca

SEQ ID NO: 308365 - RNA, 17 nt, Bordetella pertussis
cguggucgccagcacgc

SEQ ID NO: 308366 - RNA, 18 nt, Bordetella pertussis
cguguagagcaggccgcc

SEQ ID NO: 308367 - RNA, 17 nt, Bordetella pertussis
cguguaggucagcgccu

SEQ ID NO: 308368 - RNA, 14 nt, Bordetella pertussis
cguguagggccugg

SEQ ID NO: 308369 - RNA, 22 nt, Bordetella pertussis
cgugucaggcggagucgccccg

SEQ ID NO: 308370 - RNA, 21 nt, Bordetella pertussis
cguguccgccguagcgcgcca

SEQ ID NO: 308371 - RNA, 17 nt, Bordetella pertussis
cguguccagcggcgcca

SEQ ID NO: 308372 - RNA, 19 nt, Bordetella pertussis
cguguccagcggcgccagc

SEQ ID NO: 308373 - RNA, 16 nt, Bordetella pertussis
cgugucgaacaccagg

SEQ ID NO: 308374 - RNA, 14 nt, Bordetella pertussis
cgugucggccacca

SEQ ID NO: 308375 - RNA, 13 nt, Bordetella pertussis
cgugucgccgucg

SEQ ID NO: 308376 - RNA, 22 nt, Bordetella pertussis
cgugugaucgccgacgaugucg

SEQ ID NO: 308377 - RNA, 22 nt, Bordetella pertussis
cgugugcaggacgaacaggccg

SEQ ID NO: 308378 - RNA, 21 nt, Bordetella pertussis
cgugugcccagcaccaggccg

SEQ ID NO: 308379 - RNA, 23 nt, Bordetella pertussis
cgugugcccagcaccaggccgaa

SEQ ID NO: 308380 - RNA, 20 nt, Bordetella pertussis
cguguggcaggccagcgcca

SEQ ID NO: 308381 - RNA, 20 nt, Bordetella pertussis
cguguggugaaagccgccgg

SEQ ID NO: 308382 - RNA, 16 nt, Bordetella pertussis
cgugugguuggcgcug

SEQ ID NO: 308383 - RNA, 19 nt, Bordetella pertussis
cgugugguuggcgcugcug

SEQ ID NO: 308384 - RNA, 20 nt, Bordetella pertussis
cguguucagcgcgcgcgccg

SEQ ID NO: 308385 - RNA, 22 nt, Bordetella pertussis
cguucaugucgcgggugcgggc

SEQ ID NO: 308386 - RNA, 19 nt, Bordetella pertussis
cguuccagaugcgcagcag

SEQ ID NO: 308387 - RNA, 20 nt, Bordetella pertussis
cguuccagaugcgcagcagg

SEQ ID NO: 308388 - RNA, 13 nt, Bordetella pertussis
cguuccuggcgcu

SEQ ID NO: 308389 - RNA, 22 nt, Bordetella pertussis
cguuccuggucuuccgguacgc

SEQ ID NO: 308390 - RNA, 17 nt, Bordetella pertussis
cguucgaaagccagcgc

SEQ ID NO: 308391 - RNA, 19 nt, Bordetella pertussis
cguucgaaagccagcgccu

SEQ ID NO: 308392 - RNA, 18 nt, Bordetella pertussis
cguucgacuucguccggc

SEQ ID NO: 308393 - RNA, 19 nt, Bordetella pertussis
cguucgcaccagucccgca

SEQ ID NO: 308394 - RNA, 21 nt, Bordetella pertussis
cguucgcgccaggcgccgggc

SEQ ID NO: 308395 - RNA, 13 nt, Bordetella pertussis
cguucgcgccgcg

SEQ ID NO: 308396 - RNA, 14 nt, Bordetella pertussis
cguucgcgccgcgu

SEQ ID NO: 308397 - RNA, 12 nt, Bordetella pertussis
cguucgcggccc

SEQ ID NO: 308398 - RNA, 21 nt, Bordetella pertussis
cguucgcggugggcagcggca

SEQ ID NO: 308399 - RNA, 16 nt, Bordetella pertussis
cguucggcaccggcag

SEQ ID NO: 308400 - RNA, 12 nt, Bordetella pertussis
cguucggccacu

SEQ ID NO: 308401 - RNA, 13 nt, Bordetella pertussis
cguucggccagcc

SEQ ID NO: 308402 - RNA, 15 nt, Bordetella pertussis
cguucuccagcgccg

SEQ ID NO: 308403 - RNA, 16 nt, Bordetella pertussis
cguucucgacccgcuc

SEQ ID NO: 308404 - RNA, 14 nt, Bordetella pertussis
cguucugcgcgccc

SEQ ID NO: 308405 - RNA, 20 nt, Bordetella pertussis
cguucugcguggcggcgucg

SEQ ID NO: 308406 - RNA, 16 nt, Bordetella pertussis
cguugagcgccgacgg

SEQ ID NO: 308407 - RNA, 18 nt, Bordetella pertussis
cguugaucucgcccagca

SEQ ID NO: 308408 - RNA, 17 nt, Bordetella pertussis
cguugcaccgcgucggc

SEQ ID NO: 308409 - RNA, 15 nt, Bordetella pertussis
cguugcagcccagcg

SEQ ID NO: 308410 - RNA, 16 nt, Bordetella pertussis
cguugcagcccagcgc

SEQ ID NO: 308411 - RNA, 18 nt, Bordetella pertussis
cguugcagcccagcgcga

SEQ ID NO: 308412 - RNA, 20 nt, Bordetella pertussis
cguugcauaccucgauggcg

SEQ ID NO: 308413 - RNA, 21 nt, Bordetella pertussis
cguugcauaccucgauggcgg

SEQ ID NO: 308414 - RNA, 22 nt, Bordetella pertussis
cguugcauaccucgauggcggu

SEQ ID NO: 308415 - RNA, 23 nt, Bordetella pertussis
cguugcauaccucgauggcggug

SEQ ID NO: 308416 - RNA, 18 nt, Bordetella pertussis
cguugcgcgacaggcccg

SEQ ID NO: 308417 - RNA, 20 nt, Bordetella pertussis
cguugcgcgacaggcccgcg

SEQ ID NO: 308418 - RNA, 18 nt, Bordetella pertussis
cguugcgccgcaacgccg

SEQ ID NO: 308419 - RNA, 14 nt, Bordetella pertussis
cguugcggcccgcc

SEQ ID NO: 308420 - RNA, 23 nt, Bordetella pertussis
cguugcggcgccucgguccagcg

SEQ ID NO: 308421 - RNA, 14 nt, Bordetella pertussis
cguugcgguagcgc

SEQ ID NO: 308422 - RNA, 17 nt, Bordetella pertussis
cguugcuccagccaggc

SEQ ID NO: 308423 - RNA, 13 nt, Bordetella pertussis
cguugcucgcgcg

SEQ ID NO: 308424 - RNA, 19 nt, Bordetella pertussis
cguugcuggcaaagcgcgc

SEQ ID NO: 308425 - RNA, 21 nt, Bordetella pertussis
cguuggaccccaguuccagca

SEQ ID NO: 308426 - RNA, 14 nt, Bordetella pertussis
cguuggagccggag

SEQ ID NO: 308427 - RNA, 17 nt, Bordetella pertussis
cguuggccaaugcgccg

SEQ ID NO: 308428 - RNA, 20 nt, Bordetella pertussis
cguuggccacuuccagcgcc

SEQ ID NO: 308429 - RNA, 13 nt, Bordetella pertussis
cguuggcaggcca

SEQ ID NO: 308430 - RNA, 20 nt, Bordetella pertussis
cguuggcauggcgcgugcgc

SEQ ID NO: 308431 - RNA, 16 nt, Bordetella pertussis
cguuggccagcgccgc

SEQ ID NO: 308432 - RNA, 17 nt, Bordetella pertussis
cguuggccagcgccgcc

SEQ ID NO: 308433 - RNA, 19 nt, Bordetella pertussis
cguuggccgcgcgguacgc

SEQ ID NO: 308434 - RNA, 17 nt, Bordetella pertussis
cguuggccgcguagccc

SEQ ID NO: 308435 - RNA, 23 nt, Bordetella pertussis
cguuggccgggucgcgcagcagg

SEQ ID NO: 308436 - RNA, 19 nt, Bordetella pertussis
cguuggcgaggacaggcca

SEQ ID NO: 308437 - RNA, 14 nt, Bordetella pertussis
cguuggcgcccagc

SEQ ID NO: 308438 - RNA, 15 nt, Bordetella pertussis
cguuggcgcccagcg

SEQ ID NO: 308439 - RNA, 17 nt, Bordetella pertussis
cguuggcggccggccag

SEQ ID NO: 308440 - RNA, 16 nt, Bordetella pertussis
cguuggucaccacgcc

SEQ ID NO: 308441 - RNA, 20 nt, Bordetella pertussis
cguuggucagcaccucggcg

SEQ ID NO: 308442 - RNA, 21 nt, Bordetella pertussis
cguuggugccgaguucgacuc

SEQ ID NO: 308443 - RNA, 15 nt, Bordetella pertussis
cguuggugucggcgg

SEQ ID NO: 308444 - RNA, 15 nt, Bordetella pertussis
cguuguccaggccga

SEQ ID NO: 308445 - RNA, 15 nt, Bordetella pertussis
cguuguccgccugcg

SEQ ID NO: 308446 - RNA, 14 nt, Bordetella pertussis
cguugucgcgccgc

SEQ ID NO: 308447 - RNA, 19 nt, Bordetella pertussis
cguugucgcgccgcgaugc

SEQ ID NO: 308448 - RNA, 17 nt, Bordetella pertussis
cguuuacuccccagacg

SEQ ID NO: 308449 - RNA, 20 nt, Bordetella pertussis
cguuucuacugggugcuggc

SEQ ID NO: 308450 - RNA, 17 nt, Bordetella pertussis
cguuugccccucggcgg

SEQ ID NO: 308451 - RNA, 19 nt, Bordetella pertussis
cguuugcggacgggccagu

SEQ ID NO: 308452 - RNA, 14 nt, Bordetella pertussis
cguuuggccugccc

SEQ ID NO: 308453 - RNA, 17 nt, Bordetella pertussis
cguuuggccugcccugg

SEQ ID NO: 308454 - RNA, 14 nt, Bordetella pertussis
cuacacggccgcca

SEQ ID NO: 308455 - RNA, 15 nt, Bordetella pertussis
cuacagcgccuggcg

SEQ ID NO: 308456 - RNA, 18 nt, Bordetella pertussis
cuacagcucgccggcgau

SEQ ID NO: 308457 - RNA, 15 nt, Bordetella pertussis
cuacagggugccgcg

SEQ ID NO: 308458 - RNA, 18 nt, Bordetella pertussis
cuacagggugccgcgccg

SEQ ID NO: 308459 - RNA, 19 nt, Bordetella pertussis
cuacagggugccgcgccgg

SEQ ID NO: 308460 - RNA, 20 nt, Bordetella pertussis
cuacaggcccagcgccagca

SEQ ID NO: 308461 - RNA, 19 nt, Bordetella pertussis
cuacccccugaccggcggc

SEQ ID NO: 308462 - RNA, 20 nt, Bordetella pertussis
cuacccugcccauucccgcc

SEQ ID NO: 308463 - RNA, 16 nt, Bordetella pertussis
cuaccggcgccgacgc

SEQ ID NO: 308464 - RNA, 17 nt, Bordetella pertussis
cuaccggcgccgacgcg

SEQ ID NO: 308465 - RNA, 14 nt, Bordetella pertussis
cuaccucagcaugg

SEQ ID NO: 308466 - RNA, 23 nt, Bordetella pertussis
cuaccugucgggcggcggcgugg

SEQ ID NO: 308467 - RNA, 23 nt, Bordetella pertussis
cuacgaccugaauccguaagcgc

SEQ ID NO: 308468 - RNA, 23 nt, Bordetella pertussis
cuacgccgccgauggcgcgcggc

SEQ ID NO: 308469 - RNA, 14 nt, Bordetella pertussis
cuacgcgcgcgccg

SEQ ID NO: 308470 - RNA, 15 nt, Bordetella pertussis
cuacuggcgcgcgca

SEQ ID NO: 308471 - RNA, 23 nt, Bordetella pertussis
cuacugggccagauagucgcgga

SEQ ID NO: 308472 - RNA, 19 nt, Bordetella pertussis
cuagagcggcguggcgccg

SEQ ID NO: 308473 - RNA, 14 nt, Bordetella pertussis
cuagcgccgcgcca

SEQ ID NO: 308474 - RNA, 15 nt, Bordetella pertussis
cuagcgccgcgccag

SEQ ID NO: 308475 - RNA, 16 nt, Bordetella pertussis
cuagcgccgcgccagg

SEQ ID NO: 308476 - RNA, 17 nt, Bordetella pertussis
cuagcgccgcgccaggu

SEQ ID NO: 308477 - RNA, 21 nt, Bordetella pertussis
cuaggccguuuccucuggaga

SEQ ID NO: 308478 - RNA, 14 nt, Bordetella pertussis
cuaggcgcagcagg

SEQ ID NO: 308479 - RNA, 14 nt, Bordetella pertussis
cucagccgcccgcc

SEQ ID NO: 308480 - RNA, 20 nt, Bordetella pertussis
cucagccgcgcgcggccggc

SEQ ID NO: 308481 - RNA, 16 nt, Bordetella pertussis
cucagccgugccgcgc

SEQ ID NO: 308482 - RNA, 17 nt, Bordetella pertussis
cucagcgacgcgcgccg

SEQ ID NO: 308483 - RNA, 22 nt, Bordetella pertussis
cucagcgacgcgcgccggcgcu

SEQ ID NO: 308484 - RNA, 12 nt, Bordetella pertussis
cucagcgcgccg

SEQ ID NO: 308485 - RNA, 15 nt, Bordetella pertussis
cucagcgcgccgcgc

SEQ ID NO: 308486 - RNA, 22 nt, Bordetella pertussis
cucagcgcgccgcgccgggcgc

SEQ ID NO: 308487 - RNA, 15 nt, Bordetella pertussis
cucagcggccgcugc

SEQ ID NO: 308488 - RNA, 17 nt, Bordetella pertussis
cucagguagaccacgcg

SEQ ID NO: 308489 - RNA, 21 nt, Bordetella pertussis
cucagguagaccacgcgcugc

SEQ ID NO: 308490 - RNA, 17 nt, Bordetella pertussis
cucaguccaaggucagg

SEQ ID NO: 308491 - RNA, 13 nt, Bordetella pertussis
cucagucgggcag

SEQ ID NO: 308492 - RNA, 18 nt, Bordetella pertussis
cucagucgggcagcgccc

SEQ ID NO: 308493 - RNA, 19 nt, Bordetella pertussis
cucauaggcaucgaccagc

SEQ ID NO: 308494 - RNA, 22 nt, Bordetella pertussis
cucaucccgauuucggagcggc

SEQ ID NO: 308495 - RNA, 16 nt, Bordetella pertussis
cucaucggcaggccgg

SEQ ID NO: 308496 - RNA, 22 nt, Bordetella pertussis
cucaucggcaggccggcgcgcg

SEQ ID NO: 308497 - RNA, 13 nt, Bordetella pertussis
cucaugaccagcg

SEQ ID NO: 308498 - RNA, 15 nt, Bordetella pertussis
cucaugaccagcggc

SEQ ID NO: 308499 - RNA, 17 nt, Bordetella pertussis
cucaugaccagcggcgu

SEQ ID NO: 308500 - RNA, 12 nt, Bordetella pertussis
cucaugccggca

SEQ ID NO: 308501 - RNA, 20 nt, Bordetella pertussis
cucaugccggcaagcacgaa

SEQ ID NO: 308502 - RNA, 16 nt, Bordetella pertussis
cucaugcgggacaggc

SEQ ID NO: 308503 - RNA, 20 nt, Bordetella pertussis
cucaugcgggacaggcgcca

SEQ ID NO: 308504 - RNA, 19 nt, Bordetella pertussis
cucauggaggggcgcaggc

SEQ ID NO: 308505 - RNA, 19 nt, Bordetella pertussis
cucauggcacagcgcggcg

SEQ ID NO: 308506 - RNA, 22 nt, Bordetella pertussis
cuccacagccacugcggcccga

SEQ ID NO: 308507 - RNA, 14 nt, Bordetella pertussis
cuccaccagcaccg

SEQ ID NO: 308508 - RNA, 16 nt, Bordetella pertussis
cuccacccccgggcgc

SEQ ID NO: 308509 - RNA, 14 nt, Bordetella pertussis
cuccagcaccugca

SEQ ID NO: 308510 - RNA, 17 nt, Bordetella pertussis
cuccagcaucgccgcca

SEQ ID NO: 308511 - RNA, 16 nt, Bordetella pertussis
cuccagccaggcgcgc

SEQ ID NO: 308512 - RNA, 18 nt, Bordetella pertussis
cuccagccaggcgcgcag

SEQ ID NO: 308513 - RNA, 12 nt, Bordetella pertussis
cuccagccgcag

SEQ ID NO: 308514 - RNA, 13 nt, Bordetella pertussis
cuccagccggguc

SEQ ID NO: 308515 - RNA, 13 nt, Bordetella pertussis
cuccagcgccagc

SEQ ID NO: 308516 - RNA, 15 nt, Bordetella pertussis
cuccagcgccggcag

SEQ ID NO: 308517 - RNA, 12 nt, Bordetella pertussis
cuccccaggcca

SEQ ID NO: 308518 - RNA, 14 nt, Bordetella pertussis
cucccccacgccgc

SEQ ID NO: 308519 - RNA, 14 nt, Bordetella pertussis
cucccgaaaaccgc

SEQ ID NO: 308520 - RNA, 14 nt, Bordetella pertussis
cucccgccgcccgg

SEQ ID NO: 308521 - RNA, 13 nt, Bordetella pertussis
cucccgcgccauu

SEQ ID NO: 308522 - RNA, 21 nt, Bordetella pertussis
cucccgcgcugccgcugcagg

SEQ ID NO: 308523 - RNA, 14 nt, Bordetella pertussis
cucccggaccagca

SEQ ID NO: 308524 - RNA, 15 nt, Bordetella pertussis
cuccgaacaggcggu

SEQ ID NO: 308525 - RNA, 17 nt, Bordetella pertussis
cuccgaacaggcggucu

SEQ ID NO: 308526 - RNA, 14 nt, Bordetella pertussis
cuccgacaggcgcc

SEQ ID NO: 308527 - RNA, 21 nt, Bordetella pertussis
cuccgagacguagggcacauc

SEQ ID NO: 308528 - RNA, 21 nt, Bordetella pertussis
cuccgccauggaggcgcagcg

SEQ ID NO: 308529 - RNA, 17 nt, Bordetella pertussis
cuccgcgccgaccacgc

SEQ ID NO: 308530 - RNA, 14 nt, Bordetella pertussis
cuccggccgggcca

SEQ ID NO: 308531 - RNA, 18 nt, Bordetella pertussis
cuccggccgggccagcgc

SEQ ID NO: 308532 - RNA, 14 nt, Bordetella pertussis
cuccggcgccagca

SEQ ID NO: 308533 - RNA, 16 nt, Bordetella pertussis
cuccggcgccuggccg

SEQ ID NO: 308534 - RNA, 19 nt, Bordetella pertussis
cuccggcgugacguggccc

SEQ ID NO: 308535 - RNA, 17 nt, Bordetella pertussis
cuccgguucggcgcggc

SEQ ID NO: 308536 - RNA, 18 nt, Bordetella pertussis
cuccgguucggcgcggcg

SEQ ID NO: 308537 - RNA, 19 nt, Bordetella pertussis
cuccgguucggcgcggcgc

SEQ ID NO: 308538 - RNA, 17 nt, Bordetella pertussis
cuccguauccuggucga

SEQ ID NO: 308539 - RNA, 14 nt, Bordetella pertussis
cuccgugcaucggc

SEQ ID NO: 308540 - RNA, 15 nt, Bordetella pertussis
cuccgugcaucggca

SEQ ID NO: 308541 - RNA, 19 nt, Bordetella pertussis
cuccucggccaggucgcgc

SEQ ID NO: 308542 - RNA, 23 nt, Bordetella pertussis
cuccucggccaggucgcgcauca

SEQ ID NO: 308543 - RNA, 19 nt, Bordetella pertussis
cuccucggccugccggcgc

SEQ ID NO: 308544 - RNA, 16 nt, Bordetella pertussis
cuccugcagcaggucg

SEQ ID NO: 308545 - RNA, 15 nt, Bordetella pertussis
cucgaaacgcuggac

SEQ ID NO: 308546 - RNA, 15 nt, Bordetella pertussis
cucgaacacgccgac

SEQ ID NO: 308547 - RNA, 22 nt, Bordetella pertussis
cucgaacaccggcuuggccucg

SEQ ID NO: 308548 - RNA, 19 nt, Bordetella pertussis
cucgaacaggccaucgccg

SEQ ID NO: 308549 - RNA, 23 nt, Bordetella pertussis
cucgacagcagcccgcuggccga

SEQ ID NO: 308550 - RNA, 23 nt, Bordetella pertussis
cucgacauagagauuguccagcg

SEQ ID NO: 308551 - RNA, 12 nt, Bordetella pertussis
cucgaccagccc

SEQ ID NO: 308552 - RNA, 12 nt, Bordetella pertussis
cucgaccagcgc

SEQ ID NO: 308553 - RNA, 13 nt, Bordetella pertussis
cucgaccaggucc

SEQ ID NO: 308554 - RNA, 17 nt, Bordetella pertussis
cucgaccaucauggcca

SEQ ID NO: 308555 - RNA, 19 nt, Bordetella pertussis
cucgacgaacacgcgcgcc

SEQ ID NO: 308556 - RNA, 14 nt, Bordetella pertussis
cucgacgauggccg

SEQ ID NO: 308557 - RNA, 20 nt, Bordetella pertussis
cucgacgauggccggggcgu

SEQ ID NO: 308558 - RNA, 14 nt, Bordetella pertussis
cucgacgauggcgg

SEQ ID NO: 308559 - RNA, 19 nt, Bordetella pertussis
cucgacgccaucucgcgcg

SEQ ID NO: 308560 - RNA, 15 nt, Bordetella pertussis
cucgacgcccgggcg

SEQ ID NO: 308561 - RNA, 16 nt, Bordetella pertussis
cucgacgcccgggcgg

SEQ ID NO: 308562 - RNA, 19 nt, Bordetella pertussis
cucgagcaagggccagaca

SEQ ID NO: 308563 - RNA, 22 nt, Bordetella pertussis
cucgagcaccuugacggucacg

SEQ ID NO: 308564 - RNA, 13 nt, Bordetella pertussis
cucgagcaugcgg

SEQ ID NO: 308565 - RNA, 14 nt, Bordetella pertussis
cucgagccggcucc

SEQ ID NO: 308566 - RNA, 19 nt, Bordetella pertussis
cucgauaugcagcaccgga

SEQ ID NO: 308567 - RNA, 18 nt, Bordetella pertussis
cucgaucaccaccggcaa

SEQ ID NO: 308568 - RNA, 20 nt, Bordetella pertussis
cucgaucaccaccggcaagg

SEQ ID NO: 308569 - RNA, 19 nt, Bordetella pertussis
cucgaugcaauagcgcccg

SEQ ID NO: 308570 - RNA, 21 nt, Bordetella pertussis
cucgaugcaauagcgcccgcc

SEQ ID NO: 308571 - RNA, 16 nt, Bordetella pertussis
cucgaugcccagcacc

SEQ ID NO: 308572 - RNA, 19 nt, Bordetella pertussis
cucgaugcccagcaccgcc

SEQ ID NO: 308573 - RNA, 13 nt, Bordetella pertussis
cucgaugcgcgcc

SEQ ID NO: 308574 - RNA, 21 nt, Bordetella pertussis
cucgaugcggucggccgcgcc

SEQ ID NO: 308575 - RNA, 22 nt, Bordetella pertussis
cucgaugcggucggccgcgccg

SEQ ID NO: 308576 - RNA, 21 nt, Bordetella pertussis
cucgaugcgccaguccagcgc

SEQ ID NO: 308577 - RNA, 14 nt, Bordetella pertussis
cucgauggccucgg

SEQ ID NO: 308578 - RNA, 19 nt, Bordetella pertussis
cucgauggcgcaggcgcgc

SEQ ID NO: 308579 - RNA, 20 nt, Bordetella pertussis
cucgauggcgcaggcgcgcc

SEQ ID NO: 308580 - RNA, 21 nt, Bordetella pertussis
cucgauggcgcaggcgcgcca

SEQ ID NO: 308581 - RNA, 20 nt, Bordetella pertussis
cucgaugggauacgccgugc

SEQ ID NO: 308582 - RNA, 21 nt, Bordetella pertussis
cucgaugggauacgccgugcu

SEQ ID NO: 308583 - RNA, 15 nt, Bordetella pertussis
cucgaugggcgcgcg

SEQ ID NO: 308584 - RNA, 18 nt, Bordetella pertussis
cucgauguggcgcuggcg

SEQ ID NO: 308585 - RNA, 15 nt, Bordetella pertussis
cucgauugaccagca

SEQ ID NO: 308586 - RNA, 16 nt, Bordetella pertussis
cucgauugaccagcac

SEQ ID NO: 308587 - RNA, 17 nt, Bordetella pertussis
cucgauugaccagcacc

SEQ ID NO: 308588 - RNA, 17 nt, Bordetella pertussis
cucgccagcggcagcgc

SEQ ID NO: 308589 - RNA, 22 nt, Bordetella pertussis
cucgccagcggcagcgcgcagg

SEQ ID NO: 308590 - RNA, 23 nt, Bordetella pertussis
cucgcccacauagcggccggcgc

SEQ ID NO: 308591 - RNA, 23 nt, Bordetella pertussis
cucgcccacccccggcaccagga

SEQ ID NO: 308592 - RNA, 14 nt, Bordetella pertussis
cucgcccagcgagc

SEQ ID NO: 308593 - RNA, 23 nt, Bordetella pertussis
cucgcccagcgagccggccagcg

SEQ ID NO: 308594 - RNA, 18 nt, Bordetella pertussis
cucgcccagcggcgccga

SEQ ID NO: 308595 - RNA, 12 nt, Bordetella pertussis
cucgcccaggcc

SEQ ID NO: 308596 - RNA, 14 nt, Bordetella pertussis
cucgcccaggccgg

SEQ ID NO: 308597 - RNA, 16 nt, Bordetella pertussis
cucgcccaggccgggc

SEQ ID NO: 308598 - RNA, 16 nt, Bordetella pertussis
cucgcgaaagcacgcc

SEQ ID NO: 308599 - RNA, 17 nt, Bordetella pertussis
cucgcgaaagcacgcca

SEQ ID NO: 308600 - RNA, 15 nt, Bordetella pertussis
cucgcgcaccgacac

SEQ ID NO: 308601 - RNA, 13 nt, Bordetella pertussis
cucgcgcaccgca

SEQ ID NO: 308602 - RNA, 23 nt, Bordetella pertussis
cucgcgcaccgcaugggccaggc

SEQ ID NO: 308603 - RNA, 14 nt, Bordetella pertussis
cucgcgcgccaggu

SEQ ID NO: 308604 - RNA, 22 nt, Bordetella pertussis
cucgcgcgcggacugccagauc

SEQ ID NO: 308605 - RNA, 17 nt, Bordetella pertussis
cucgcgcgcaguccugc

SEQ ID NO: 308606 - RNA, 22 nt, Bordetella pertussis
cucgcgcggguccuugccgggc

SEQ ID NO: 308607 - RNA, 12 nt, Bordetella pertussis
cucgcgcucgag

SEQ ID NO: 308608 - RNA, 14 nt, Bordetella pertussis
cucgcgcucggcca

SEQ ID NO: 308609 - RNA, 17 nt, Bordetella pertussis
cucgcgcucggccagcg

SEQ ID NO: 308610 - RNA, 13 nt, Bordetella pertussis
cucgcgcucggcg

SEQ ID NO: 308611 - RNA, 12 nt, Bordetella pertussis
cucgcgcucgcg

SEQ ID NO: 308612 - RNA, 17 nt, Bordetella pertussis
cucgcgcugcagcauga

SEQ ID NO: 308613 - RNA, 23 nt, Bordetella pertussis
cucgcgcugcaggaucgcggcca

SEQ ID NO: 308614 - RNA, 16 nt, Bordetella pertussis
cucgcgcuugcugauu

SEQ ID NO: 308615 - RNA, 20 nt, Bordetella pertussis
cucgcgcuugcugauuucga

SEQ ID NO: 308616 - RNA, 17 nt, Bordetella pertussis
cucgcggaaauccgggc

SEQ ID NO: 308617 - RNA, 18 nt, Bordetella pertussis
cucgcggaugaccuggug

SEQ ID NO: 308618 - RNA, 20 nt, Bordetella pertussis
cucgcggcccuggucgucgc

SEQ ID NO: 308619 - RNA, 21 nt, Bordetella pertussis
cucgcgguugcgucucggccu

SEQ ID NO: 308620 - RNA, 19 nt, Bordetella pertussis
cucgcucaacagcuugccc

SEQ ID NO: 308621 - RNA, 14 nt, Bordetella pertussis
cucgcuccagcgga

SEQ ID NO: 308622 - RNA, 15 nt, Bordetella pertussis
cucgcugccggcgcc

SEQ ID NO: 308623 - RNA, 15 nt, Bordetella pertussis
cucgcuggcgaagac

SEQ ID NO: 308624 - RNA, 17 nt, Bordetella pertussis
cucggcauggcgcgcgc

SEQ ID NO: 308625 - RNA, 16 nt, Bordetella pertussis
cucggcaucggccacg

SEQ ID NO: 308626 - RNA, 16 nt, Bordetella pertussis
cucggccaccuggcgc

SEQ ID NO: 308627 - RNA, 16 nt, Bordetella pertussis
cucggccacgcgcugc

SEQ ID NO: 308628 - RNA, 16 nt, Bordetella pertussis
cucggccagcgccgaa

SEQ ID NO: 308629 - RNA, 14 nt, Bordetella pertussis
cucggccagcaugc

SEQ ID NO: 308630 - RNA, 16 nt, Bordetella pertussis
cucggccagcaugcgg

SEQ ID NO: 308631 - RNA, 14 nt, Bordetella pertussis
cucggcgaccaggc

SEQ ID NO: 308632 - RNA, 17 nt, Bordetella pertussis
cucggcgaccaggccca

SEQ ID NO: 308633 - RNA, 19 nt, Bordetella pertussis
cucggcgagcgccucgcgc

SEQ ID NO: 308634 - RNA, 13 nt, Bordetella pertussis
cucggcgcccagc

SEQ ID NO: 308635 - RNA, 17 nt, Bordetella pertussis
cucggcgcccgcggccu

SEQ ID NO: 308636 - RNA, 15 nt, Bordetella pertussis
cucggcgggcggcgc

SEQ ID NO: 308637 - RNA, 18 nt, Bordetella pertussis
cucggcgggcggcgccag

SEQ ID NO: 308638 - RNA, 17 nt, Bordetella pertussis
cucggcgggcuugucgc

SEQ ID NO: 308639 - RNA, 22 nt, Bordetella pertussis
cucgggauaggccucggccacc

SEQ ID NO: 308640 - RNA, 20 nt, Bordetella pertussis
cucgggcacggccagcacca

SEQ ID NO: 308641 - RNA, 14 nt, Bordetella pertussis
cucgggcagcagca

SEQ ID NO: 308642 - RNA, 17 nt, Bordetella pertussis
cucgggcaggucggcca

SEQ ID NO: 308643 - RNA, 17 nt, Bordetella pertussis
cucgggcgcauugccgc

SEQ ID NO: 308644 - RNA, 17 nt, Bordetella pertussis
cucgggcgacuccagcc

SEQ ID NO: 308645 - RNA, 17 nt, Bordetella pertussis
cucgggcgucaugcgcu

SEQ ID NO: 308646 - RNA, 23 nt, Bordetella pertussis
cucggggaaauugacggcgcucu

SEQ ID NO: 308647 - RNA, 16 nt, Bordetella pertussis
cucggucagcacgaac

SEQ ID NO: 308648 - RNA, 20 nt, Bordetella pertussis
cucggucauguccagcgcca

SEQ ID NO: 308649 - RNA, 23 nt, Bordetella pertussis
cucggucauguccagcgccaggc

SEQ ID NO: 308650 - RNA, 22 nt, Bordetella pertussis
cucggucggaaacacguccagc

SEQ ID NO: 308651 - RNA, 18 nt, Bordetella pertussis
cucggucgucagcacgcc

SEQ ID NO: 308652 - RNA, 20 nt, Bordetella pertussis
cucggugaugauggccaggu

SEQ ID NO: 308653 - RNA, 17 nt, Bordetella pertussis
cucggugcagcccagca

SEQ ID NO: 308654 - RNA, 14 nt, Bordetella pertussis
cucggugcgccgcc

SEQ ID NO: 308655 - RNA, 16 nt, Bordetella pertussis
cucggugcgcgcgccc

SEQ ID NO: 308656 - RNA, 22 nt, Bordetella pertussis
cucggugcgggccggcgcgccu

SEQ ID NO: 308657 - RNA, 12 nt, Bordetella pertussis
cucggugcugcu

SEQ ID NO: 308658 - RNA, 19 nt, Bordetella pertussis
cucgguggaggacgccgac

SEQ ID NO: 308659 - RNA, 15 nt, Bordetella pertussis
cucguacggcgucgg

SEQ ID NO: 308660 - RNA, 17 nt, Bordetella pertussis
cucguauucgcccggau

SEQ ID NO: 308661 - RNA, 20 nt, Bordetella pertussis
cucguccagguugcccgagc

SEQ ID NO: 308662 - RNA, 18 nt, Bordetella pertussis
cucguccccacggggacu

SEQ ID NO: 308663 - RNA, 20 nt, Bordetella pertussis
cucguccgucucgcccaggc

SEQ ID NO: 308664 - RNA, 17 nt, Bordetella pertussis
cucgucgaccaccagca

SEQ ID NO: 308665 - RNA, 18 nt, Bordetella pertussis
cucgucgaccacgccggc

SEQ ID NO: 308666 - RNA, 20 nt, Bordetella pertussis
cucgucgaccacgccggcgg

SEQ ID NO: 308667 - RNA, 13 nt, Bordetella pertussis
cucgucgaccgcc

SEQ ID NO: 308668 - RNA, 20 nt, Bordetella pertussis
cucgucgaccgccucgacgc

SEQ ID NO: 308669 - RNA, 16 nt, Bordetella pertussis
cucgucgacgcggccg

SEQ ID NO: 308670 - RNA, 15 nt, Bordetella pertussis
cucgucgccgcugga

SEQ ID NO: 308671 - RNA, 13 nt, Bordetella pertussis
cucgucguccagc

SEQ ID NO: 308672 - RNA, 20 nt, Bordetella pertussis
cucgugcaucaucugggcgu

SEQ ID NO: 308673 - RNA, 21 nt, Bordetella pertussis
cucgugccccgcaugcgcaga

SEQ ID NO: 308674 - RNA, 19 nt, Bordetella pertussis
cucgugcgaggccacggca

SEQ ID NO: 308675 - RNA, 13 nt, Bordetella pertussis
cucguggcgcgcc

SEQ ID NO: 308676 - RNA, 14 nt, Bordetella pertussis
cucguggcgcgccu

SEQ ID NO: 308677 - RNA, 17 nt, Bordetella pertussis
cucguugcccgcggucg

SEQ ID NO: 308678 - RNA, 13 nt, Bordetella pertussis
cucguuggccagc

SEQ ID NO: 308679 - RNA, 14 nt, Bordetella pertussis
cucguuggccagcg

SEQ ID NO: 308680 - RNA, 14 nt, Bordetella pertussis
cucugaucgcgcug

SEQ ID NO: 308681 - RNA, 16 nt, Bordetella pertussis
cucuucggcggccagc

SEQ ID NO: 308682 - RNA, 17 nt, Bordetella pertussis
cucuucgucgccggcgc

SEQ ID NO: 308683 - RNA, 21 nt, Bordetella pertussis
cucuucgucgccggcgcugcu

SEQ ID NO: 308684 - RNA, 22 nt, Bordetella pertussis
cucuugagcgcggccucgccgg

SEQ ID NO: 308685 - RNA, 22 nt, Bordetella pertussis
cugaacaccggcgcgccuggcg

SEQ ID NO: 308686 - RNA, 13 nt, Bordetella pertussis
cugccgagacggc

SEQ ID NO: 308687 - RNA, 15 nt, Bordetella pertussis
cugccgagacggccg

SEQ ID NO: 308688 - RNA, 18 nt, Bordetella pertussis
cugccgagacggccgccg

SEQ ID NO: 308689 - RNA, 19 nt, Bordetella pertussis
cugccgauacgggcgcggc

SEQ ID NO: 308690 - RNA, 18 nt, Bordetella pertussis
cugccgaucgugcacgcc

SEQ ID NO: 308691 - RNA, 20 nt, Bordetella pertussis
cugccgccaagggcgcgcca

SEQ ID NO: 308692 - RNA, 23 nt, Bordetella pertussis
cugccgccaagggcgcgccagca

SEQ ID NO: 308693 - RNA, 16 nt, Bordetella pertussis
cugccgcccuggcgca

SEQ ID NO: 308694 - RNA, 20 nt, Bordetella pertussis
cugccgcccuggcgcagggc

SEQ ID NO: 308695 - RNA, 18 nt, Bordetella pertussis
cugccgccugccaguucg

SEQ ID NO: 308696 - RNA, 19 nt, Bordetella pertussis
cugccgccugccaguucga

SEQ ID NO: 308697 - RNA, 19 nt, Bordetella pertussis
cugccgccuucgucgcgca

SEQ ID NO: 308698 - RNA, 14 nt, Bordetella pertussis
cugccgcgcccggc

SEQ ID NO: 308699 - RNA, 15 nt, Bordetella pertussis
cugccgcgcccggcg

SEQ ID NO: 308700 - RNA, 22 nt, Bordetella pertussis
cugccgcgcccggcggccaggc

SEQ ID NO: 308701 - RNA, 16 nt, Bordetella pertussis
cugccgcgccgaccgg

SEQ ID NO: 308702 - RNA, 21 nt, Bordetella pertussis
cugccgcgcauuugccgcggc

SEQ ID NO: 308703 - RNA, 14 nt, Bordetella pertussis
cugccgcgcgccgg

SEQ ID NO: 308704 - RNA, 14 nt, Bordetella pertussis
cugccgcgcguacg

SEQ ID NO: 308705 - RNA, 20 nt, Bordetella pertussis
cugccgcgcguacgcggcgc

SEQ ID NO: 308706 - RNA, 17 nt, Bordetella pertussis
cugccgcgugcccgcgu

SEQ ID NO: 308707 - RNA, 23 nt, Bordetella pertussis
cugccgcugaucuuccugggcga

SEQ ID NO: 308708 - RNA, 15 nt, Bordetella pertussis
cugccgcugcaggcc

SEQ ID NO: 308709 - RNA, 22 nt, Bordetella pertussis
cugccggcauugcccaccacgg

SEQ ID NO: 308710 - RNA, 12 nt, Bordetella pertussis
cugccggccggc

SEQ ID NO: 308711 - RNA, 14 nt, Bordetella pertussis
cugccggccggcca

SEQ ID NO: 308712 - RNA, 18 nt, Bordetella pertussis
cugccggcgcgcccaggg

SEQ ID NO: 308713 - RNA, 20 nt, Bordetella pertussis
cugccggcgcgccucggcgc

SEQ ID NO: 308714 - RNA, 20 nt, Bordetella pertussis
cugccggcgcgggcgcaggc

SEQ ID NO: 308715 - RNA, 23 nt, Bordetella pertussis
cugccggcgcgggcgcaggcguu

SEQ ID NO: 308716 - RNA, 14 nt, Bordetella pertussis
cugccgggacaggc

SEQ ID NO: 308717 - RNA, 17 nt, Bordetella pertussis
cugccggggcacccagg

SEQ ID NO: 308718 - RNA, 19 nt, Bordetella pertussis
cugccggggcacccaggcg

SEQ ID NO: 308719 - RNA, 14 nt, Bordetella pertussis
cugccgggcucggc

SEQ ID NO: 308720 - RNA, 19 nt, Bordetella pertussis
cugccgggcucggccacca

SEQ ID NO: 308721 - RNA, 22 nt, Bordetella pertussis
cugccgggcucggccaccaugc

SEQ ID NO: 308722 - RNA, 18 nt, Bordetella pertussis
cugccgguaaccgacgca

SEQ ID NO: 308723 - RNA, 20 nt, Bordetella pertussis
cugccgguaaccgacgcagc

SEQ ID NO: 308724 - RNA, 22 nt, Bordetella pertussis
cugccgucgucguccaggcgca

SEQ ID NO: 308725 - RNA, 16 nt, Bordetella pertussis
cugccgugggacaggc

SEQ ID NO: 308726 - RNA, 14 nt, Bordetella pertussis
cugccguucgcgcu

SEQ ID NO: 308727 - RNA, 16 nt, Bordetella pertussis
cugccguucgcgcugc

SEQ ID NO: 308728 - RNA, 17 nt, Bordetella pertussis
cugccguuccagcugcu

SEQ ID NO: 308729 - RNA, 21 nt, Bordetella pertussis
cugccguugucggucaucacg

SEQ ID NO: 308730 - RNA, 14 nt, Bordetella pertussis
cugccuccaggcgc

SEQ ID NO: 308731 - RNA, 16 nt, Bordetella pertussis
cugccugagcaccgcc

SEQ ID NO: 308732 - RNA, 15 nt, Bordetella pertussis
cugccugcagcgcgc

SEQ ID NO: 308733 - RNA, 17 nt, Bordetella pertussis
cugccugcagcgcgcgc

SEQ ID NO: 308734 - RNA, 18 nt, Bordetella pertussis
cugccugcagcgcgcgcg

SEQ ID NO: 308735 - RNA, 13 nt, Bordetella pertussis
cugccugccggcc

SEQ ID NO: 308736 - RNA, 15 nt, Bordetella pertussis
cugccugccggccgg

SEQ ID NO: 308737 - RNA, 18 nt, Bordetella pertussis
cugccugccggccggcca

SEQ ID NO: 308738 - RNA, 20 nt, Bordetella pertussis
cugccugccggccggccagu

SEQ ID NO: 308739 - RNA, 13 nt, Bordetella pertussis
cugccuggcgaac

SEQ ID NO: 308740 - RNA, 15 nt, Bordetella pertussis
cugcgaaaaagcccg

SEQ ID NO: 308741 - RNA, 19 nt, Bordetella pertussis
cugcgaaaaagcccgcgcc

SEQ ID NO: 308742 - RNA, 20 nt, Bordetella pertussis
cugcgaaaaagcccgcgcca

SEQ ID NO: 308743 - RNA, 22 nt, Bordetella pertussis
cugcgaaaaagcccgcgccacc

SEQ ID NO: 308744 - RNA, 17 nt, Bordetella pertussis
cugcgaaacagcagcgg

SEQ ID NO: 308745 - RNA, 18 nt, Bordetella pertussis
cugcgaaacagcagcgga

SEQ ID NO: 308746 - RNA, 16 nt, Bordetella pertussis
cugcgaaagcgcgucg

SEQ ID NO: 308747 - RNA, 18 nt, Bordetella pertussis
cugcgaacgcccggccca

SEQ ID NO: 308748 - RNA, 21 nt, Bordetella pertussis
cugcgaacgcccggcccaggc

SEQ ID NO: 308749 - RNA, 14 nt, Bordetella pertussis
cugcgacagcaggg

SEQ ID NO: 308750 - RNA, 17 nt, Bordetella pertussis
cugcgacagcagggcca

SEQ ID NO: 308751 - RNA, 18 nt, Bordetella pertussis
cugcgacagcagggccag

SEQ ID NO: 308752 - RNA, 20 nt, Bordetella pertussis
cugcgacagcagggccaggc

SEQ ID NO: 308753 - RNA, 19 nt, Bordetella pertussis
cugcgacaggcgcagcucg

SEQ ID NO: 308754 - RNA, 14 nt, Bordetella pertussis
cugcgacagcaccg

SEQ ID NO: 308755 - RNA, 18 nt, Bordetella pertussis
cugcgaccgagccacguc

SEQ ID NO: 308756 - RNA, 14 nt, Bordetella pertussis
cugcgagacgcgcu

SEQ ID NO: 308757 - RNA, 22 nt, Bordetella pertussis
cugcgagacgcgcucgcgcgcg

SEQ ID NO: 308758 - RNA, 19 nt, Bordetella pertussis
cugcgagagauagcccagc

SEQ ID NO: 308759 - RNA, 20 nt, Bordetella pertussis
cugcgagagauagcccagca

SEQ ID NO: 308760 - RNA, 21 nt, Bordetella pertussis
cugcgagagauagcccagcac

SEQ ID NO: 308761 - RNA, 19 nt, Bordetella pertussis
cugcgagccuucggccggc

SEQ ID NO: 308762 - RNA, 14 nt, Bordetella pertussis
cugcgaugccggcg

SEQ ID NO: 308763 - RNA, 15 nt, Bordetella pertussis
cugcgaugccggcgu

SEQ ID NO: 308764 - RNA, 19 nt, Bordetella pertussis
cugcgaugccggcguggcg

SEQ ID NO: 308765 - RNA, 21 nt, Bordetella pertussis
cugcgcacccgccuggacggc

SEQ ID NO: 308766 - RNA, 16 nt, Bordetella pertussis
cugcgcaccggccggc

SEQ ID NO: 308767 - RNA, 17 nt, Bordetella pertussis
cugcgcaccggccggcc

SEQ ID NO: 308768 - RNA, 21 nt, Bordetella pertussis
cugcgcacgcuggcgcccgcc

SEQ ID NO: 308769 - RNA, 13 nt, Bordetella pertussis
cugcgcagcgacu

SEQ ID NO: 308770 - RNA, 18 nt, Bordetella pertussis
cugcgcaggucggccagg

SEQ ID NO: 308771 - RNA, 19 nt, Bordetella pertussis
cugcgcaggucggccagga

SEQ ID NO: 308772 - RNA, 22 nt, Bordetella pertussis
cugcgcaggucggccaggacgg

SEQ ID NO: 308773 - RNA, 19 nt, Bordetella pertussis
cugcgcaucgaucagcgcg

SEQ ID NO: 308774 - RNA, 19 nt, Bordetella pertussis
cugcgcauggcgucaagcc

SEQ ID NO: 308775 - RNA, 18 nt, Bordetella pertussis
cugcgcaugggcgcaggc

SEQ ID NO: 308776 - RNA, 21 nt, Bordetella pertussis
cugcgcaugggcgcaggccgc

SEQ ID NO: 308777 - RNA, 18 nt, Bordetella pertussis
cugcgccaauuguccugg

SEQ ID NO: 308778 - RNA, 14 nt, Bordetella pertussis
cugcgccaccagcu

SEQ ID NO: 308779 - RNA, 13 nt, Bordetella pertussis
cugcgccaccgca

SEQ ID NO: 308780 - RNA, 15 nt, Bordetella pertussis
cugcgccaccuggcg

SEQ ID NO: 308781 - RNA, 21 nt, Bordetella pertussis
cugcgccaccuggcgcccggc

SEQ ID NO: 308782 - RNA, 14 nt, Bordetella pertussis
cugcgccacggcga

SEQ ID NO: 308783 - RNA, 14 nt, Bordetella pertussis
cugcgccacgucca

SEQ ID NO: 308784 - RNA, 22 nt, Bordetella pertussis
cugcgccacguccagcacggcc

SEQ ID NO: 308785 - RNA, 15 nt, Bordetella pertussis
cugcgccagccgcgc

SEQ ID NO: 308786 - RNA, 19 nt, Bordetella pertussis
cugcgccagcgccucgcgc

SEQ ID NO: 308787 - RNA, 20 nt, Bordetella pertussis
cugcgccagcgccucgcgcu

SEQ ID NO: 308788 - RNA, 13 nt, Bordetella pertussis
cugcgccagcgga

SEQ ID NO: 308789 - RNA, 16 nt, Bordetella pertussis
cugcgccagcuccagc

SEQ ID NO: 308790 - RNA, 18 nt, Bordetella pertussis
cugcgccaguugcggggc

SEQ ID NO: 308791 - RNA, 17 nt, Bordetella pertussis
cugcgccauguggcgac

SEQ ID NO: 308792 - RNA, 20 nt, Bordetella pertussis
cugcgccgccgcguggcggc

SEQ ID NO: 308793 - RNA, 14 nt, Bordetella pertussis
cugcgccgccucga

SEQ ID NO: 308794 - RNA, 14 nt, Bordetella pertussis
cugcgccgcggcgc

SEQ ID NO: 308795 - RNA, 16 nt, Bordetella pertussis
cugcgccgggcgcggc

SEQ ID NO: 308796 - RNA, 17 nt, Bordetella pertussis
cugcgccgggcgcggcc

SEQ ID NO: 308797 - RNA, 21 nt, Bordetella pertussis
cugcgccgggcgcggccaggc

SEQ ID NO: 308798 - RNA, 13 nt, Bordetella pertussis
cugcgccggcggc

SEQ ID NO: 308799 - RNA, 20 nt, Bordetella pertussis
cugcgccggcggcaccgcgc

SEQ ID NO: 308800 - RNA, 16 nt, Bordetella pertussis
cugcgccggguccggc

SEQ ID NO: 308801 - RNA, 16 nt, Bordetella pertussis
cugcgccgucugcgcc

SEQ ID NO: 308802 - RNA, 17 nt, Bordetella pertussis
cugcgccgucugcgccg

SEQ ID NO: 308803 - RNA, 20 nt, Bordetella pertussis
cugcgccugcuggucggccu

SEQ ID NO: 308804 - RNA, 16 nt, Bordetella pertussis
cugcgccuggccgcgc

SEQ ID NO: 308805 - RNA, 17 nt, Bordetella pertussis
cugcgccuggccgcgcu

SEQ ID NO: 308806 - RNA, 16 nt, Bordetella pertussis
cugcgccuuggcgcgc

SEQ ID NO: 308807 - RNA, 19 nt, Bordetella pertussis
cugcgcgaaacggccgggu

SEQ ID NO: 308808 - RNA, 21 nt, Bordetella pertussis
cugcgcgaccuccaguaucgu

SEQ ID NO: 308809 - RNA, 21 nt, Bordetella pertussis
cugcgcgacgaaucggucacg

SEQ ID NO: 308810 - RNA, 18 nt, Bordetella pertussis
cugcgcgaggugccggac

SEQ ID NO: 308811 - RNA, 23 nt, Bordetella pertussis
cugcgcgaggugccggacgccga

SEQ ID NO: 308812 - RNA, 16 nt, Bordetella pertussis
cugcgcgaggugggcg

SEQ ID NO: 308813 - RNA, 23 nt, Bordetella pertussis
cugcgcgaggugggcggcagcag

SEQ ID NO: 308814 - RNA, 21 nt, Bordetella pertussis
cugcgcgaugagcuggcgcag

SEQ ID NO: 308815 - RNA, 17 nt, Bordetella pertussis
cugcgcgaugcgcgcgc

SEQ ID NO: 308816 - RNA, 11 nt, Bordetella pertussis
cugcgcgccga

SEQ ID NO: 308817 - RNA, 14 nt, Bordetella pertussis
cugcgcgccgacca

SEQ ID NO: 308818 - RNA, 11 nt, Bordetella pertussis
cugcgcgccgc

SEQ ID NO: 308819 - RNA, 14 nt, Bordetella pertussis
cugcgcgccgccgg

SEQ ID NO: 308820 - RNA, 16 nt, Bordetella pertussis
cugcgcgccgccucga

SEQ ID NO: 308821 - RNA, 17 nt, Bordetella pertussis
cugcgcgccggcgccuu

SEQ ID NO: 308822 - RNA, 17 nt, Bordetella pertussis
cugcgcgccguggugcu

SEQ ID NO: 308823 - RNA, 18 nt, Bordetella pertussis
cugcgcgcgccagcgccu

SEQ ID NO: 308824 - RNA, 13 nt, Bordetella pertussis
cugcgcggcggcu

SEQ ID NO: 308825 - RNA, 22 nt, Bordetella pertussis
cugcgcggcggcuugccgucga

SEQ ID NO: 308826 - RNA, 18 nt, Bordetella pertussis
cugcgcggcgggccccgc

SEQ ID NO: 308827 - RNA, 18 nt, Bordetella pertussis
cugcgcggguccggcgug

SEQ ID NO: 308828 - RNA, 17 nt, Bordetella pertussis
cugcgcgucgacagcau

SEQ ID NO: 308829 - RNA, 16 nt, Bordetella pertussis
cugcgcguggccauca

SEQ ID NO: 308830 - RNA, 19 nt, Bordetella pertussis
cugcgcuugaccgccucga

SEQ ID NO: 308831 - RNA, 17 nt, Bordetella pertussis
cugcggcacggccagcg

SEQ ID NO: 308832 - RNA, 14 nt, Bordetella pertussis
cugcggcagcgacu

SEQ ID NO: 308833 - RNA, 13 nt, Bordetella pertussis
cugcggccccggc

SEQ ID NO: 308834 - RNA, 13 nt, Bordetella pertussis
cugcggcccgagc

SEQ ID NO: 308835 - RNA, 22 nt, Bordetella pertussis
cugcggccggugaucuugccga

SEQ ID NO: 308836 - RNA, 21 nt, Bordetella pertussis
cugcggcgauuucuacgccga

SEQ ID NO: 308837 - RNA, 16 nt, Bordetella pertussis
cugcggcgccagcgcc

SEQ ID NO: 308838 - RNA, 17 nt, Bordetella pertussis
cugcggcgccagcgccg

SEQ ID NO: 308839 - RNA, 12 nt, Bordetella pertussis
cugcggcgcggc

SEQ ID NO: 308840 - RNA, 17 nt, Bordetella pertussis
cugcggcgcggccagca

SEQ ID NO: 308841 - RNA, 15 nt, Bordetella pertussis
cugcggcgcggccga

SEQ ID NO: 308842 - RNA, 17 nt, Bordetella pertussis
cugcggcgcggccgacg

SEQ ID NO: 308843 - RNA, 23 nt, Bordetella pertussis
cugcggcgcggcgcgugccagca

SEQ ID NO: 308844 - RNA, 23 nt, Bordetella pertussis
cugcggcgcggugucggacaacu

SEQ ID NO: 308845 - RNA, 19 nt, Bordetella pertussis
cugcggcggauucaggcga

SEQ ID NO: 308846 - RNA, 22 nt, Bordetella pertussis
cugcggcgggaaugucccacag

SEQ ID NO: 308847 - RNA, 15 nt, Bordetella pertussis
cugcggcguggcgcc

SEQ ID NO: 308848 - RNA, 18 nt, Bordetella pertussis
cugcggcuugggcccggc

SEQ ID NO: 308849 - RNA, 14 nt, Bordetella pertussis
cugcgggccggcgc

SEQ ID NO: 308850 - RNA, 17 nt, Bordetella pertussis
cugcgggccggcgccgg

SEQ ID NO: 308851 - RNA, 20 nt, Bordetella pertussis
cugcgggccgggcaggccgc

SEQ ID NO: 308852 - RNA, 22 nt, Bordetella pertussis
cugcgggccgggcaggccgcgc

SEQ ID NO: 308853 - RNA, 19 nt, Bordetella pertussis
cugcgggcgcaagccagca

SEQ ID NO: 308854 - RNA, 15 nt, Bordetella pertussis
cugcgggcgcagcgc

SEQ ID NO: 308855 - RNA, 16 nt, Bordetella pertussis
cugcggggacaggcac

SEQ ID NO: 308856 - RNA, 22 nt, Bordetella pertussis
cugcggggacaggcacccugcc

SEQ ID NO: 308857 - RNA, 15 nt, Bordetella pertussis
cugcgggccgcacag

SEQ ID NO: 308858 - RNA, 12 nt, Bordetella pertussis
cugcggggcauu

SEQ ID NO: 308859 - RNA, 16 nt, Bordetella pertussis
cugcgggggcaggcac

SEQ ID NO: 308860 - RNA, 22 nt, Bordetella pertussis
cugcgggucgaguugcgcgcca

SEQ ID NO: 308861 - RNA, 23 nt, Bordetella pertussis
cugcgggucgaguugcgcgccau

SEQ ID NO: 308862 - RNA, 12 nt, Bordetella pertussis
cugcggucagcu

SEQ ID NO: 308863 - RNA, 18 nt, Bordetella pertussis
cugcgguccgaugucgag

SEQ ID NO: 308864 - RNA, 13 nt, Bordetella pertussis
cugcggugccugu

SEQ ID NO: 308865 - RNA, 16 nt, Bordetella pertussis
cugcgucacgaaagcg

SEQ ID NO: 308866 - RNA, 18 nt, Bordetella pertussis
cugcgucacgaaagcgcc

SEQ ID NO: 308867 - RNA, 22 nt, Bordetella pertussis
cugcgucacgaaagcgcccagg

SEQ ID NO: 308868 - RNA, 18 nt, Bordetella pertussis
cugcguccaccaccaggc

SEQ ID NO: 308869 - RNA, 21 nt, Bordetella pertussis
cugcguccaccaccaggccgg

SEQ ID NO: 308870 - RNA, 24 nt, Bordetella pertussis
cugcguccaccaccaggccggcca

SEQ ID NO: 308871 - RNA, 20 nt, Bordetella pertussis
cugcgucaguugaagacgcc

SEQ ID NO: 308872 - RNA, 22 nt, Bordetella pertussis
cugcgucaguugaagacgccgg

SEQ ID NO: 308873 - RNA, 12 nt, Bordetella pertussis
cugcguccagcc

SEQ ID NO: 308874 - RNA, 14 nt, Bordetella pertussis
cugcguccagccga

SEQ ID NO: 308875 - RNA, 15 nt, Bordetella pertussis
cugcgucugcgugcc

SEQ ID NO: 308876 - RNA, 13 nt, Bordetella pertussis
cugcgugaaacgc

SEQ ID NO: 308877 - RNA, 16 nt, Bordetella pertussis
cugcgugaaacgcucg

SEQ ID NO: 308878 - RNA, 15 nt, Bordetella pertussis
cugcgugcgcggcgu

SEQ ID NO: 308879 - RNA, 16 nt, Bordetella pertussis
cugcgugcgcggcgug

SEQ ID NO: 308880 - RNA, 17 nt, Bordetella pertussis
cugcgugcgcggcgugu

SEQ ID NO: 308881 - RNA, 16 nt, Bordetella pertussis
cugcguggcgacgcgc

SEQ ID NO: 308882 - RNA, 21 nt, Bordetella pertussis
cugcguggcgggccgcgccgc

SEQ ID NO: 308883 - RNA, 22 nt, Bordetella pertussis
cugcuacaccgugcuggccgac

SEQ ID NO: 308884 - RNA, 15 nt, Bordetella pertussis
cugcucaacggccac

SEQ ID NO: 308885 - RNA, 21 nt, Bordetella pertussis
aaccggcaucccugcuugcgc

SEQ ID NO: 308886 - RNA, 22 nt, Bordetella pertussis
cugcucgaucugguuggccaca

SEQ ID NO: 308887 - RNA, 18 nt, Bordetella pertussis
cugcucgccggccagcgc

SEQ ID NO: 308888 - RNA, 23 nt, Bordetella pertussis
cugcucgcgcagcguggcggcga

SEQ ID NO: 308889 - RNA, 16 nt, Bordetella pertussis
cugcucgggcgccucg

SEQ ID NO: 308890 - RNA, 23 nt, Bordetella pertussis
cugcucggugagcggcacgacgu

SEQ ID NO: 308891 - RNA, 21 nt, Bordetella pertussis
cugcucggugcucuggcccgc

SEQ ID NO: 308892 - RNA, 18 nt, Bordetella pertussis
cugcucguucugcgcgcc

SEQ ID NO: 308893 - RNA, 19 nt, Bordetella pertussis
cugcucguugcgcaagccg

SEQ ID NO: 308894 - RNA, 17 nt, Bordetella pertussis
cugcugaccgacggccu

SEQ ID NO: 308895 - RNA, 19 nt, Bordetella pertussis
cugcugacugugcagccac

SEQ ID NO: 308896 - RNA, 19 nt, Bordetella pertussis
cugcugauccucgccagcg

SEQ ID NO: 308897 - RNA, 22 nt, Bordetella pertussis
cugcugauccucgccagcggca

SEQ ID NO: 308898 - RNA, 20 nt, Bordetella pertussis
cugcugcaaggacaccauga

SEQ ID NO: 308899 - RNA, 13 nt, Bordetella pertussis
cugcugcacgcgc

SEQ ID NO: 308900 - RNA, 13 nt, Bordetella pertussis
cugcugcagcaca

SEQ ID NO: 308901 - RNA, 18 nt, Bordetella pertussis
cugcugcaggccggcgcg

SEQ ID NO: 308902 - RNA, 20 nt, Bordetella pertussis
cugcugcaggccggcgcgca

SEQ ID NO: 308903 - RNA, 16 nt, Bordetella pertussis
cugcugcaggcgcggg

SEQ ID NO: 308904 - RNA, 23 nt, Bordetella pertussis
cugcugcccgaagcgcagcacca

SEQ ID NO: 308905 - RNA, 23 nt, Bordetella pertussis
cugcugcccgccgccgcccacgc

SEQ ID NO: 308906 - RNA, 16 nt, Bordetella pertussis
cugcugcgagacgcgc

SEQ ID NO: 308907 - RNA, 20 nt, Bordetella pertussis
cugcugcgagacgcgcucgc

SEQ ID NO: 308908 - RNA, 14 nt, Bordetella pertussis
cugcugcgccuggc

SEQ ID NO: 308909 - RNA, 19 nt, Bordetella pertussis
cugcugcgccuggccgcgc

SEQ ID NO: 308910 - RNA, 16 nt, Bordetella pertussis
cugcugcgccuggcgg

SEQ ID NO: 308911 - RNA, 19 nt, Bordetella pertussis
cugcugcggcacggccagc

SEQ ID NO: 308912 - RNA, 13 nt, Bordetella pertussis
cugcugcguggua

SEQ ID NO: 308913 - RNA, 15 nt, Bordetella pertussis
cugcugcuggcugcc

SEQ ID NO: 308914 - RNA, 19 nt, Bordetella pertussis
cugcuggaccuggccacca

SEQ ID NO: 308915 - RNA, 15 nt, Bordetella pertussis
cugcuggagaucgcc

SEQ ID NO: 308916 - RNA, 20 nt, Bordetella pertussis
cugcuggagaucgccgagcg

SEQ ID NO: 308917 - RNA, 22 nt, Bordetella pertussis
cugcuggagaucgccgagcggc

SEQ ID NO: 308918 - RNA, 17 nt, Bordetella pertussis
cugcuggaggccggcgu

SEQ ID NO: 308919 - RNA, 20 nt, Bordetella pertussis
cugcuggccaagcgcgccgg

SEQ ID NO: 308920 - RNA, 16 nt, Bordetella pertussis
cugcuggccaccgucg

SEQ ID NO: 308921 - RNA, 17 nt, Bordetella pertussis
cugcuggccgccggcgc

SEQ ID NO: 308922 - RNA, 19 nt, Bordetella pertussis
cugcuggccgccggcgcgg

SEQ ID NO: 308923 - RNA, 15 nt, Bordetella pertussis
cugcuggccggccag

SEQ ID NO: 308924 - RNA, 15 nt, Bordetella pertussis
cugcuggccggcccc

SEQ ID NO: 308925 - RNA, 13 nt, Bordetella pertussis
cugcuggcgcgca

SEQ ID NO: 308926 - RNA, 21 nt, Bordetella pertussis
cugcuggcgcgcaccaucgcc

SEQ ID NO: 308927 - RNA, 14 nt, Bordetella pertussis
cugcuggcgcgcca

SEQ ID NO: 308928 - RNA, 22 nt, Bordetella pertussis
cugcuggcgcgucggcgcgcgc

SEQ ID NO: 308929 - RNA, 16 nt, Bordetella pertussis
cugcuggcggcgcugg

SEQ ID NO: 308930 - RNA, 19 nt, Bordetella pertussis
cugcuggcugcccuggcgc

SEQ ID NO: 308931 - RNA, 23 nt, Bordetella pertussis
cugcuggcuucggcgcugggcgc

SEQ ID NO: 308932 - RNA, 14 nt, Bordetella pertussis
cugcugggccgcgc

SEQ ID NO: 308933 - RNA, 15 nt, Bordetella pertussis
cugcugggccggcgc

SEQ ID NO: 308934 - RNA, 16 nt, Bordetella pertussis
cugcugggccggcgcg

SEQ ID NO: 308935 - RNA, 19 nt, Bordetella pertussis
cugcugggccggcgcgcgc

SEQ ID NO: 308936 - RNA, 22 nt, Bordetella pertussis
cugcugggccggcgcgcgcagg

SEQ ID NO: 308937 - RNA, 23 nt, Bordetella pertussis
cugcugggccggcgcgcgcaggc

SEQ ID NO: 308938 - RNA, 17 nt, Bordetella pertussis
cugcugguacagcccca

SEQ ID NO: 308939 - RNA, 23 nt, Bordetella pertussis
cugcugguacagccccagcgcca

SEQ ID NO: 308940 - RNA, 20 nt, Bordetella pertussis
cugcuggucgcgggccaggc

SEQ ID NO: 308941 - RNA, 22 nt, Bordetella pertussis
cugcuggucgcgggccaggccg

SEQ ID NO: 308942 - RNA, 16 nt, Bordetella pertussis
cugcuggucggccucg

SEQ ID NO: 308943 - RNA, 16 nt, Bordetella pertussis
cugcuggucggcgugg

SEQ ID NO: 308944 - RNA, 21 nt, Bordetella pertussis
cugcugguuuucggacgcagc

SEQ ID NO: 308945 - RNA, 19 nt, Bordetella pertussis
cugcuguacgacagcaagg

SEQ ID NO: 308946 - RNA, 19 nt, Bordetella pertussis
cugcugugccugccaagcg

SEQ ID NO: 308947 - RNA, 15 nt, Bordetella pertussis
cugcuguucgccacg

SEQ ID NO: 308948 - RNA, 19 nt, Bordetella pertussis
cugcuugaagacgcccagg

SEQ ID NO: 308949 - RNA, 22 nt, Bordetella pertussis
cugcuugagcgaaauggcggcc

SEQ ID NO: 308950 - RNA, 16 nt, Bordetella pertussis
cugcuugaggccgcgc

SEQ ID NO: 308951 - RNA, 13 nt, Bordetella pertussis
cugcuugcccagc

SEQ ID NO: 308952 - RNA, 20 nt, Bordetella pertussis
cugcuugcccaggccggcgc

SEQ ID NO: 308953 - RNA, 13 nt, Bordetella pertussis
cugcuugccggcc

SEQ ID NO: 308954 - RNA, 16 nt, Bordetella pertussis
cugcuuggcgcgcagc

SEQ ID NO: 308955 - RNA, 20 nt, Bordetella pertussis
cuggaaacuguuggcgugca

SEQ ID NO: 308956 - RNA, 18 nt, Bordetella pertussis
cuggaacagcuugggcau

SEQ ID NO: 308957 - RNA, 17 nt, Bordetella pertussis
cuggaacauggcccggu

SEQ ID NO: 308958 - RNA, 19 nt, Bordetella pertussis
cuggaacgcgccgcuggcg

SEQ ID NO: 308959 - RNA, 20 nt, Bordetella pertussis
cuggaacuugggaucggcca

SEQ ID NO: 308960 - RNA, 21 nt, Bordetella pertussis
cuggaacuugggaucggccag

SEQ ID NO: 308961 - RNA, 13 nt, Bordetella pertussis
cuggaagcgcgcc

SEQ ID NO: 308962 - RNA, 14 nt, Bordetella pertussis
cuggaagcgcgcca

SEQ ID NO: 308963 - RNA, 17 nt, Bordetella pertussis
cuggaagcugcggccgg

SEQ ID NO: 308964 - RNA, 18 nt, Bordetella pertussis
cuggaauacgccguugcg

SEQ ID NO: 308965 - RNA, 18 nt, Bordetella pertussis
cuggacagugcccugacc

SEQ ID NO: 308966 - RNA, 16 nt, Bordetella pertussis
cuggacccggagcugc

SEQ ID NO: 308967 - RNA, 18 nt, Bordetella pertussis
cuggaccgcgcgcgacga

SEQ ID NO: 308968 - RNA, 23 nt, Bordetella pertussis
cuggaccgcgcgcgacgacagcg

SEQ ID NO: 308969 - RNA, 16 nt, Bordetella pertussis
cuggaccggcuccggc

SEQ ID NO: 308970 - RNA, 13 nt, Bordetella pertussis
cuggacgacgugc

SEQ ID NO: 308971 - RNA, 18 nt, Bordetella pertussis
cuggacgagggccgcggc

SEQ ID NO: 308972 - RNA, 15 nt, Bordetella pertussis
cuggacgcccuggcg

SEQ ID NO: 308973 - RNA, 16 nt, Bordetella pertussis
cuggacgcccuggcgc

SEQ ID NO: 308974 - RNA, 13 nt, Bordetella pertussis
cuggacgcgcgcg

SEQ ID NO: 308975 - RNA, 17 nt, Bordetella pertussis
cuggacgcgcgcggcga

SEQ ID NO: 308976 - RNA, 21 nt, Bordetella pertussis
cuggacgcgcgcggcgaccgc

SEQ ID NO: 308977 - RNA, 20 nt, Bordetella pertussis
cuggacgucugagcgccggg

SEQ ID NO: 308978 - RNA, 16 nt, Bordetella pertussis
cuggaucgcgcccagc

SEQ ID NO: 308979 - RNA, 17 nt, Bordetella pertussis
cuggaucgcgcccagcg

SEQ ID NO: 308980 - RNA, 20 nt, Bordetella pertussis
cuggaugccaugccgggcaa

SEQ ID NO: 308981 - RNA, 14 nt, Bordetella pertussis
cuggauggccugcu

SEQ ID NO: 308982 - RNA, 15 nt, Bordetella pertussis
cuggauggcggccgc

SEQ ID NO: 308983 - RNA, 21 nt, Bordetella pertussis
cuggauggcggccgccagcgc

SEQ ID NO: 308984 - RNA, 18 nt, Bordetella pertussis
cuggauggucacgcccag

SEQ ID NO: 308985 - RNA, 21 nt, Bordetella pertussis
cuggauggugccgccgcccga

SEQ ID NO: 308986 - RNA, 20 nt, Bordetella pertussis
cuggauguacgucagcaugc

SEQ ID NO: 308987 - RNA, 21 nt, Bordetella pertussis
cuggauguacgucagcaugca

SEQ ID NO: 308988 - RNA, 15 nt, Bordetella pertussis
cuggaugugcaggcc

SEQ ID NO: 308989 - RNA, 21 nt, Bordetella pertussis
cuggauucgccggucggccgc

SEQ ID NO: 308990 - RNA, 15 nt, Bordetella pertussis
cuggcacugucggcg

SEQ ID NO: 308991 - RNA, 20 nt, Bordetella pertussis
cuggcagccuugaaagaggc

SEQ ID NO: 308992 - RNA, 14 nt, Bordetella pertussis
cuggcagcuggcgc

SEQ ID NO: 308993 - RNA, 14 nt, Bordetella pertussis
cuggcaucgucgcg

SEQ ID NO: 308994 - RNA, 13 nt, Bordetella pertussis
cuggcaugcggcg

SEQ ID NO: 308995 - RNA, 23 nt, Bordetella pertussis
cuggcaugugccaccgcccaggc

SEQ ID NO: 308996 - RNA, 15 nt, Bordetella pertussis
cuggcauugacgacg

SEQ ID NO: 308997 - RNA, 21 nt, Bordetella pertussis
cuggccagcggggccgugacg

SEQ ID NO: 308998 - RNA, 18 nt, Bordetella pertussis
cuggccagcgguucgucg

SEQ ID NO: 308999 - RNA, 16 nt, Bordetella pertussis
cuggccagcuggcggc

SEQ ID NO: 309000 - RNA, 18 nt, Bordetella pertussis
cuggccagcuggcggcgc

SEQ ID NO: 309001 - RNA, 19 nt, Bordetella pertussis
cuggccagcuggcggcgca

SEQ ID NO: 309002 - RNA, 22 nt, Bordetella pertussis
cuggccagcuggcggcgcagca

SEQ ID NO: 309003 - RNA, 16 nt, Bordetella pertussis
cuggccaucaccgccu

SEQ ID NO: 309004 - RNA, 20 nt, Bordetella pertussis
cuggccaucaccgccuccgg

SEQ ID NO: 309005 - RNA, 19 nt, Bordetella pertussis
cuggccaucuaugucggcu

SEQ ID NO: 309006 - RNA, 14 nt, Bordetella pertussis
cuggcccacgccca

SEQ ID NO: 309007 - RNA, 13 nt, Bordetella pertussis
cuggcccacgcgc

SEQ ID NO: 309008 - RNA, 17 nt, Bordetella pertussis
cuggcccacgcgcacga

SEQ ID NO: 309009 - RNA, 19 nt, Bordetella pertussis
cuggcccagaccaagcgcc

SEQ ID NO: 309010 - RNA, 20 nt, Bordetella pertussis
cuggcccagaucugccgcaa

SEQ ID NO: 309011 - RNA, 22 nt, Bordetella pertussis
cuggcccagcuccagcuggcgc

SEQ ID NO: 309012 - RNA, 23 nt, Bordetella pertussis
cuggcccagcuccagcuggcgca

SEQ ID NO: 309013 - RNA, 14 nt, Bordetella pertussis
cuggcccagcuggg

SEQ ID NO: 309014 - RNA, 18 nt, Bordetella pertussis
cuggcccagcugggcggc

SEQ ID NO: 309015 - RNA, 21 nt, Bordetella pertussis
cuggcccagcugggcggcgug

SEQ ID NO: 309016 - RNA, 14 nt, Bordetella pertussis
cuggccgacgcgcu

SEQ ID NO: 309017 - RNA, 16 nt, Bordetella pertussis
cuggccgagcgcggca

SEQ ID NO: 309018 - RNA, 17 nt, Bordetella pertussis
cuggccgauuucgcgcg

SEQ ID NO: 309019 - RNA, 18 nt, Bordetella pertussis
cuggccgauuucgcgcgc

SEQ ID NO: 309020 - RNA, 19 nt, Bordetella pertussis
cuggccgauuucgcgcgcc

SEQ ID NO: 309021 - RNA, 23 nt, Bordetella pertussis
cuggccgauuucgcgcgccagcg

SEQ ID NO: 309022 - RNA, 13 nt, Bordetella pertussis
cuggccgcccagc

SEQ ID NO: 309023 - RNA, 14 nt, Bordetella pertussis
cuggccgcccagcg

SEQ ID NO: 309024 - RNA, 15 nt, Bordetella pertussis
cuggccgcccagcgc

SEQ ID NO: 309025 - RNA, 16 nt, Bordetella pertussis
cuggccgcccagcgcc

SEQ ID NO: 309026 - RNA, 14 nt, Bordetella pertussis
cuggccgccgcgcu

SEQ ID NO: 309027 - RNA, 23 nt, Bordetella pertussis
cuggccgccgcgcucaccgaggg

SEQ ID NO: 309028 - RNA, 22 nt, Bordetella pertussis
cuggccgccgcggccucggccg

SEQ ID NO: 309029 - RNA, 17 nt, Bordetella pertussis
cuggccgccgcgggcgc

SEQ ID NO: 309030 - RNA, 20 nt, Bordetella pertussis
cuggccgcccgcggccugca

SEQ ID NO: 309031 - RNA, 15 nt, Bordetella pertussis
cuggccgccggcgcg

SEQ ID NO: 309032 - RNA, 15 nt, Bordetella pertussis
cuggccgccggcggc

SEQ ID NO: 309033 - RNA, 18 nt, Bordetella pertussis
cuggccgccggcggcgca

SEQ ID NO: 309034 - RNA, 17 nt, Bordetella pertussis
cuggccggugaugcggc

SEQ ID NO: 309035 - RNA, 21 nt, Bordetella pertussis
cuggccggugaugcggcgcgc

SEQ ID NO: 309036 - RNA, 13 nt, Bordetella pertussis
cuggccgucgccg

SEQ ID NO: 309037 - RNA, 19 nt, Bordetella pertussis
cuggccgucgccgcccugc

SEQ ID NO: 309038 - RNA, 19 nt, Bordetella pertussis
cugggcaucaacacgcugg

SEQ ID NO: 309039 - RNA, 20 nt, Bordetella pertussis
cugggcaugggcggcccggc

SEQ ID NO: 309040 - RNA, 16 nt, Bordetella pertussis
cugggccacagggcga

SEQ ID NO: 309041 - RNA, 19 nt, Bordetella pertussis
cugggccagcagcuggcgc

SEQ ID NO: 309042 - RNA, 20 nt, Bordetella pertussis
cugggccagcagcuggcgca

SEQ ID NO: 309043 - RNA, 15 nt, Bordetella pertussis
cugggccaccuuggu

SEQ ID NO: 309044 - RNA, 13 nt, Bordetella pertussis
cugggccaggccg

SEQ ID NO: 309045 - RNA, 14 nt, Bordetella pertussis
cugggccaggccgg

SEQ ID NO: 309046 - RNA, 23 nt, Bordetella pertussis
cugggccaucagguuguccagcg

SEQ ID NO: 309047 - RNA, 20 nt, Bordetella pertussis
cugggccaguucggcuugca

SEQ ID NO: 309048 - RNA, 16 nt, Bordetella pertussis
cugggccgagcgcgcc

SEQ ID NO: 309049 - RNA, 14 nt, Bordetella pertussis
cugggccgaggcgc

SEQ ID NO: 309050 - RNA, 19 nt, Bordetella pertussis
cugggccgaggcgccgccg

SEQ ID NO: 309051 - RNA, 19 nt, Bordetella pertussis
cugggccgccugcugggcc

SEQ ID NO: 309052 - RNA, 17 nt, Bordetella pertussis
cugggcgccggccagga

SEQ ID NO: 309053 - RNA, 13 nt, Bordetella pertussis
cugggcgcgccgc

SEQ ID NO: 309054 - RNA, 14 nt, Bordetella pertussis
cugggcgcgccgcu

SEQ ID NO: 309055 - RNA, 16 nt, Bordetella pertussis
cugggcgcgccgcugc

SEQ ID NO: 309056 - RNA, 13 nt, Bordetella pertussis
cugggcgcgcgcc

SEQ ID NO: 309057 - RNA, 17 nt, Bordetella pertussis
cugggcgcgcgcccagg

SEQ ID NO: 309058 - RNA, 20 nt, Bordetella pertussis
cugggcgccuacacgguggc

SEQ ID NO: 309059 - RNA, 14 nt, Bordetella pertussis
cugggcgcggcggu

SEQ ID NO: 309060 - RNA, 15 nt, Bordetella pertussis
cugggcgcugcugcu

SEQ ID NO: 309061 - RNA, 16 nt, Bordetella pertussis
cugggcggccaggcgg

SEQ ID NO: 309062 - RNA, 17 nt, Bordetella pertussis
cugggcggccaggcgga

SEQ ID NO: 309063 - RNA, 16 nt, Bordetella pertussis
cugggcggcgcagucg

SEQ ID NO: 309064 - RNA, 14 nt, Bordetella pertussis
cugggcggcgcgcu

SEQ ID NO: 309065 - RNA, 12 nt, Bordetella pertussis
cugggcggccuu

SEQ ID NO: 309066 - RNA, 15 nt, Bordetella pertussis
cugggcggcgugacc

SEQ ID NO: 309067 - RNA, 21 nt, Bordetella pertussis
cugggcggcgugaccgcgacg

SEQ ID NO: 309068 - RNA, 17 nt, Bordetella pertussis
cugggcgggccguugcg

SEQ ID NO: 309069 - RNA, 17 nt, Bordetella pertussis
cugggcgggcugguggu

SEQ ID NO: 309070 - RNA, 15 nt, Bordetella pertussis
cugggcgguugcgcu

SEQ ID NO: 309071 - RNA, 23 nt, Bordetella pertussis
cuggggcagcaggaguuccgcgu

SEQ ID NO: 309072 - RNA, 17 nt, Bordetella pertussis
cuggggcaggacgccgg

SEQ ID NO: 309073 - RNA, 19 nt, Bordetella pertussis
cuggggcaggacgccggcg

SEQ ID NO: 309074 - RNA, 19 nt, Bordetella pertussis
cuggggcaggcacuggcgc

SEQ ID NO: 309075 - RNA, 17 nt, Bordetella pertussis
cuggggccgagcgugcc

SEQ ID NO: 309076 - RNA, 20 nt, Bordetella pertussis
cuggggccgagcgugccggg

SEQ ID NO: 309077 - RNA, 19 nt, Bordetella pertussis
cuggggccgcggcgcgcgc

SEQ ID NO: 309078 - RNA, 13 nt, Bordetella pertussis
cuggggcgggcgc

SEQ ID NO: 309079 - RNA, 16 nt, Bordetella pertussis
cuggggcgggcgcugc

SEQ ID NO: 309080 - RNA, 16 nt, Bordetella pertussis
cuggggcugcugggcc

SEQ ID NO: 309081 - RNA, 20 nt, Bordetella pertussis
cuggggguucgugggcgagc

SEQ ID NO: 309082 - RNA, 14 nt, Bordetella pertussis
cugguaaagggcgc

SEQ ID NO: 309083 - RNA, 19 nt, Bordetella pertussis
cugguacagccccagcgcc

SEQ ID NO: 309084 - RNA, 20 nt, Bordetella pertussis
cuggucgagagccugggcgc

SEQ ID NO: 309085 - RNA, 16 nt, Bordetella pertussis
cuggucgagcgggcgc

SEQ ID NO: 309086 - RNA, 20 nt, Bordetella pertussis
cuggucgagcgggcgccaga

SEQ ID NO: 309087 - RNA, 17 nt, Bordetella pertussis
cuggucgcacgacagca

SEQ ID NO: 309088 - RNA, 18 nt, Bordetella pertussis
cuggucgcacgacagcau

SEQ ID NO: 309089 - RNA, 23 nt, Bordetella pertussis
cuggucgccaucugcugcgagac

SEQ ID NO: 309090 - RNA, 14 nt, Bordetella pertussis
cuggucgcgcgccu

SEQ ID NO: 309091 - RNA, 17 nt, Bordetella pertussis
cuggucgcgcgccugca

SEQ ID NO: 309092 - RNA, 13 nt, Bordetella pertussis
cuggucgcgggcc

SEQ ID NO: 309093 - RNA, 19 nt, Bordetella pertussis
cuggucgcgggccaggccg

SEQ ID NO: 309094 - RNA, 20 nt, Bordetella pertussis
cuggucgcgggccaggccgg

SEQ ID NO: 309095 - RNA, 15 nt, Bordetella pertussis
cuggucggcgcggca

SEQ ID NO: 309096 - RNA, 12 nt, Bordetella pertussis
cuggucggccuc

SEQ ID NO: 309097 - RNA, 18 nt, Bordetella pertussis
cuggucgggaugccccgc

SEQ ID NO: 309098 - RNA, 13 nt, Bordetella pertussis
cuggucgucggcc

SEQ ID NO: 309099 - RNA, 15 nt, Bordetella pertussis
cuggucgucggccac

SEQ ID NO: 309100 - RNA, 19 nt, Bordetella pertussis
cuggugaucugcugcgugg

SEQ ID NO: 309101 - RNA, 22 nt, Bordetella pertussis
cuggugauguccugcaggcccg

SEQ ID NO: 309102 - RNA, 17 nt, Bordetella pertussis
cuggugcaccacgcgcu

SEQ ID NO: 309103 - RNA, 20 nt, Bordetella pertussis
cuggugcacgaugcccaggg

SEQ ID NO: 309104 - RNA, 23 nt, Bordetella pertussis
cuggugcacgaugcccagggccg

SEQ ID NO: 309105 - RNA, 20 nt, Bordetella pertussis
cuggugccgguugcgcgccg

SEQ ID NO: 309106 - RNA, 19 nt, Bordetella pertussis
cuggugcgcguccugggcc

SEQ ID NO: 309107 - RNA, 16 nt, Bordetella pertussis
cuggugcgccgugccc

SEQ ID NO: 309108 - RNA, 21 nt, Bordetella pertussis
cuggugcucaaccucgacgcg

SEQ ID NO: 309109 - RNA, 19 nt, Bordetella pertussis
cuggugcuggugccgcugg

SEQ ID NO: 309110 - RNA, 18 nt, Bordetella pertussis
cugguggccaccagcccc

SEQ ID NO: 309111 - RNA, 22 nt, Bordetella pertussis
cuggugggccgacggcucgcgc

SEQ ID NO: 309112 - RNA, 15 nt, Bordetella pertussis
cugguggugccgcgc

SEQ ID NO: 309113 - RNA, 23 nt, Bordetella pertussis
cugguggugccguucccgccggg

SEQ ID NO: 309114 - RNA, 16 nt, Bordetella pertussis
cugguggugggcgugc

SEQ ID NO: 309115 - RNA, 15 nt, Bordetella pertussis
cugguucaggcgagc

SEQ ID NO: 309116 - RNA, 18 nt, Bordetella pertussis
cugguucaggcgagcggc

SEQ ID NO: 309117 - RNA, 16 nt, Bordetella pertussis
cugguuggccgccugg

SEQ ID NO: 309118 - RNA, 14 nt, Bordetella pertussis
cuguaccagcaugu

SEQ ID NO: 309119 - RNA, 13 nt, Bordetella pertussis
cugucccaggcgc

SEQ ID NO: 309120 - RNA, 19 nt, Bordetella pertussis
cuguccccaccgggacagg

SEQ ID NO: 309121 - RNA, 19 nt, Bordetella pertussis
cuguccccacguggacagg

SEQ ID NO: 309122 - RNA, 13 nt, Bordetella pertussis
cuguccccgaacg

SEQ ID NO: 309123 - RNA, 15 nt, Bordetella pertussis
cuguccccgcaugga

SEQ ID NO: 309124 - RNA, 23 nt, Bordetella pertussis
cuguccccgcggaggugucgccg

SEQ ID NO: 309125 - RNA, 19 nt, Bordetella pertussis
cuguccccgcggggacagg

SEQ ID NO: 309126 - RNA, 17 nt, Bordetella pertussis
cuguccccgcugcggca

SEQ ID NO: 309127 - RNA, 18 nt, Bordetella pertussis
cuguccccgcugcggcaa

SEQ ID NO: 309128 - RNA, 19 nt, Bordetella pertussis
cuguccccgcugggacagg

SEQ ID NO: 309129 - RNA, 23 nt, Bordetella pertussis
cuguccccgcugggacaggcaca

SEQ ID NO: 309130 - RNA, 19 nt, Bordetella pertussis
cuguccccguggggacagg

SEQ ID NO: 309131 - RNA, 17 nt, Bordetella pertussis
cugucccgacggggaca

SEQ ID NO: 309132 - RNA, 19 nt, Bordetella pertussis
cugucccgacggggacagg

SEQ ID NO: 309133 - RNA, 17 nt, Bordetella pertussis
cugucccggcggggaca

SEQ ID NO: 309134 - RNA, 22 nt, Bordetella pertussis
cugucccggcggggacaggcgc

SEQ ID NO: 309135 - RNA, 23 nt, Bordetella pertussis
cugucccggcggggacaggcgcc

SEQ ID NO: 309136 - RNA, 19 nt, Bordetella pertussis
cugucccggcugggacagg

SEQ ID NO: 309137 - RNA, 16 nt, Bordetella pertussis
cugucccaauccgcga

SEQ ID NO: 309138 - RNA, 17 nt, Bordetella pertussis
cugucccagauggcgcc

SEQ ID NO: 309139 - RNA, 19 nt, Bordetella pertussis
cugucccugccgggacagg

SEQ ID NO: 309140 - RNA, 18 nt, Bordetella pertussis
cugucccugcgggggcag

SEQ ID NO: 309141 - RNA, 19 nt, Bordetella pertussis
cuguccgccaccagaucga

SEQ ID NO: 309142 - RNA, 20 nt, Bordetella pertussis
cuguccggcgcucgccccgg

SEQ ID NO: 309143 - RNA, 13 nt, Bordetella pertussis
cuguccguggcca

SEQ ID NO: 309144 - RNA, 17 nt, Bordetella pertussis
cuguccuucguggcgcc

SEQ ID NO: 309145 - RNA, 13 nt, Bordetella pertussis
cugucgcaggcgc

SEQ ID NO: 309146 - RNA, 16 nt, Bordetella pertussis
cugucgcaggcgcugc

SEQ ID NO: 309147 - RNA, 19 nt, Bordetella pertussis
cugucgcaguagcguugca

SEQ ID NO: 309148 - RNA, 22 nt, Bordetella pertussis
cugucgcagucggggccgcagc

SEQ ID NO: 309149 - RNA, 15 nt, Bordetella pertussis
cugucgccacgggcg

SEQ ID NO: 309150 - RNA, 16 nt, Bordetella pertussis
cugucgccacgggcgu

SEQ ID NO: 309151 - RNA, 22 nt, Bordetella pertussis
cuguuccagccaguacaggcug

SEQ ID NO: 309152 - RNA, 20 nt, Bordetella pertussis
cuguucgccgcaccaggccg

SEQ ID NO: 309153 - RNA, 21 nt, Bordetella pertussis
cuguucgccgcaccaggccgc

SEQ ID NO: 309154 - RNA, 14 nt, Bordetella pertussis
cuguucgcgcagca

SEQ ID NO: 309155 - RNA, 19 nt, Bordetella pertussis
cuguucgcgcagcaggccg

SEQ ID NO: 309156 - RNA, 20 nt, Bordetella pertussis
cuguucgcgcagcaggccgc

SEQ ID NO: 309157 - RNA, 15 nt, Bordetella pertussis
cuguucggcgagccg

SEQ ID NO: 309158 - RNA, 15 nt, Bordetella pertussis
cuguucggcgaugcg

SEQ ID NO: 309159 - RNA, 15 nt, Bordetella pertussis
cuguucggcggcgcc

SEQ ID NO: 309160 - RNA, 21 nt, Bordetella pertussis
cuguugcuccaggccggcaug

SEQ ID NO: 309161 - RNA, 13 nt, Bordetella pertussis
cuuaccgcgccgg

SEQ ID NO: 309162 - RNA, 18 nt, Bordetella pertussis
cuuacuggaucuuggccu

SEQ ID NO: 309163 - RNA, 14 nt, Bordetella pertussis
cuuagcgcagcagc

SEQ ID NO: 309164 - RNA, 19 nt, Bordetella pertussis
cuucacgacacgcccagca

SEQ ID NO: 309165 - RNA, 18 nt, Bordetella pertussis
cuucacguagccggccag

SEQ ID NO: 309166 - RNA, 20 nt, Bordetella pertussis
cuucacguagccggccaggu

SEQ ID NO: 309167 - RNA, 23 nt, Bordetella pertussis
cuuccaguugcgggcgcaccugg

SEQ ID NO: 309168 - RNA, 15 nt, Bordetella pertussis
cuucccaggcgaggc

SEQ ID NO: 309169 - RNA, 21 nt, Bordetella pertussis
cuuccccgucggcggcaagca

SEQ ID NO: 309170 - RNA, 19 nt, Bordetella pertussis
cuuccuccgacaggcgccg

SEQ ID NO: 309171 - RNA, 12 nt, Bordetella pertussis
cuuccucggcgc

SEQ ID NO: 309172 - RNA, 15 nt, Bordetella pertussis
cuuccucggcgcgcg

SEQ ID NO: 309173 - RNA, 16 nt, Bordetella pertussis
cuuccucggcgcgcgc

SEQ ID NO: 309174 - RNA, 15 nt, Bordetella pertussis
cuuccugcugacagg

SEQ ID NO: 309175 - RNA, 17 nt, Bordetella pertussis
cuuccugcugcgccugg

SEQ ID NO: 309176 - RNA, 22 nt, Bordetella pertussis
cuucgacccggacaacgcgcgc

SEQ ID NO: 309177 - RNA, 21 nt, Bordetella pertussis
cuucgacggcgggaccggcga

SEQ ID NO: 309178 - RNA, 15 nt, Bordetella pertussis
cuucgacguccagcc

SEQ ID NO: 309179 - RNA, 19 nt, Bordetella pertussis
cuucgagauccgccggcga

SEQ ID NO: 309180 - RNA, 18 nt, Bordetella pertussis
cuucgagcgcggcgcgcg

SEQ ID NO: 309181 - RNA, 15 nt, Bordetella pertussis
cuucgaucgccuggg

SEQ ID NO: 309182 - RNA, 16 nt, Bordetella pertussis
cuucgaugcuggcgcg

SEQ ID NO: 309183 - RNA, 17 nt, Bordetella pertussis
cuucgaugcuggcgcgg

SEQ ID NO: 309184 - RNA, 18 nt, Bordetella pertussis
cuucgaugaugagcgcgc

SEQ ID NO: 309185 - RNA, 14 nt, Bordetella pertussis
cuucgccgcgcaca

SEQ ID NO: 309186 - RNA, 20 nt, Bordetella pertussis
cuucgccggugaacaccagg

SEQ ID NO: 309187 - RNA, 20 nt, Bordetella pertussis
cuucgcgcacauccagccga

SEQ ID NO: 309188 - RNA, 12 nt, Bordetella pertussis
cuucgcgcagca

SEQ ID NO: 309189 - RNA, 17 nt, Bordetella pertussis
cuucgcgcagcaaguca

SEQ ID NO: 309190 - RNA, 20 nt, Bordetella pertussis
cuucggccgucagcagcagg

SEQ ID NO: 309191 - RNA, 18 nt, Bordetella pertussis
cuucggccugcgccacca

SEQ ID NO: 309192 - RNA, 21 nt, Bordetella pertussis
cuucggcgacuucggcggcca

SEQ ID NO: 309193 - RNA, 14 nt, Bordetella pertussis
cuucggcgaucugg

SEQ ID NO: 309194 - RNA, 21 nt, Bordetella pertussis
cuucggcggccaugccgacgg

SEQ ID NO: 309195 - RNA, 17 nt, Bordetella pertussis
cuucucacugcccgcgc

SEQ ID NO: 309196 - RNA, 18 nt, Bordetella pertussis
cuucucguccgauggcga

SEQ ID NO: 309197 - RNA, 13 nt, Bordetella pertussis
cuucugcaaggcc

SEQ ID NO: 309198 - RNA, 13 nt, Bordetella pertussis
cuucugcgccacg

SEQ ID NO: 309199 - RNA, 15 nt, Bordetella pertussis
cuucugcgccagcgg

SEQ ID NO: 309200 - RNA, 14 nt, Bordetella pertussis
cuucuggacgcuga

SEQ ID NO: 309201 - RNA, 17 nt, Bordetella pertussis
cuucuggacuugcggca

SEQ ID NO: 309202 - RNA, 19 nt, Bordetella pertussis
cuucuggacuugcggcacg

SEQ ID NO: 309203 - RNA, 14 nt, Bordetella pertussis
cuucugggucggca

SEQ ID NO: 309204 - RNA, 17 nt, Bordetella pertussis
cuucuuccuugcgaugc

SEQ ID NO: 309205 - RNA, 21 nt, Bordetella pertussis
cuucuugaacucggccagcag

SEQ ID NO: 309206 - RNA, 11 nt, Bordetella pertussis
cuucuuggcca

SEQ ID NO: 309207 - RNA, 16 nt, Bordetella pertussis
cuugaacuccgcggcg

SEQ ID NO: 309208 - RNA, 17 nt, Bordetella pertussis
cuugaacucggccagca

SEQ ID NO: 309209 - RNA, 21 nt, Bordetella pertussis
cuugaacgccuugcccgggcu

SEQ ID NO: 309210 - RNA, 12 nt, Bordetella pertussis
cuugaagacgcc

SEQ ID NO: 309211 - RNA, 17 nt, Bordetella pertussis
cuugaccgacgugcugc

SEQ ID NO: 309212 - RNA, 16 nt, Bordetella pertussis
cuugaccgcaugcugc

SEQ ID NO: 309213 - RNA, 14 nt, Bordetella pertussis
cuugaccgccagca

SEQ ID NO: 309214 - RNA, 18 nt, Bordetella pertussis
cuugaccgccagcaucca

SEQ ID NO: 309215 - RNA, 17 nt, Bordetella pertussis
cuugaccugggccagca

SEQ ID NO: 309216 - RNA, 17 nt, Bordetella pertussis
cuugaccuuggcuugca

SEQ ID NO: 309217 - RNA, 20 nt, Bordetella pertussis
cuugacgaauuucucggcca

SEQ ID NO: 309218 - RNA, 17 nt, Bordetella pertussis
cuugacgccgccgaagg

SEQ ID NO: 309219 - RNA, 15 nt, Bordetella pertussis
cuugacgcgcaggcc

SEQ ID NO: 309220 - RNA, 11 nt, Bordetella pertussis
cuugacgcgcg

SEQ ID NO: 309221 - RNA, 13 nt, Bordetella pertussis
cuugacgcgcgcg

SEQ ID NO: 309222 - RNA, 13 nt, Bordetella pertussis
cuugacgcgcguu

SEQ ID NO: 309223 - RNA, 20 nt, Bordetella pertussis
cuugacggcgcggaucgaac

SEQ ID NO: 309224 - RNA, 23 nt, Bordetella pertussis
cuugacguagcggaucgcggcgc

SEQ ID NO: 309225 - RNA, 15 nt, Bordetella pertussis
cuugacguccagcca

SEQ ID NO: 309226 - RNA, 17 nt, Bordetella pertussis
cuugacguccagccagg

SEQ ID NO: 309227 - RNA, 16 nt, Bordetella pertussis
cuugacguccagcgac

SEQ ID NO: 309228 - RNA, 17 nt, Bordetella pertussis
cuugacguccagcgacu

SEQ ID NO: 309229 - RNA, 19 nt, Bordetella pertussis
cuugagauacuugcgcagc

SEQ ID NO: 309230 - RNA, 20 nt, Bordetella pertussis
cuugagauagcccuugauca

SEQ ID NO: 309231 - RNA, 16 nt, Bordetella pertussis
cuugagaugccagcgg

SEQ ID NO: 309232 - RNA, 19 nt, Bordetella pertussis
cuugagaugccagcggcgc

SEQ ID NO: 309233 - RNA, 22 nt, Bordetella pertussis
cuugacggucacggucuggccc

SEQ ID NO: 309234 - RNA, 19 nt, Bordetella pertussis
cuugacgguggccgcggcg

SEQ ID NO: 309235 - RNA, 16 nt, Bordetella pertussis
cuugagcacguccagc

SEQ ID NO: 309236 - RNA, 21 nt, Bordetella pertussis
cuugagcacguccagcggcgc

SEQ ID NO: 309237 - RNA, 15 nt, Bordetella pertussis
cuugagcggcccggg

SEQ ID NO: 309238 - RNA, 20 nt, Bordetella pertussis
cuugagcguggcguccaugc

SEQ ID NO: 309239 - RNA, 20 nt, Bordetella pertussis
cuugaggauaucggccaggc

SEQ ID NO: 309240 - RNA, 20 nt, Bordetella pertussis
cuugaugccgcccagcaugc

SEQ ID NO: 309241 - RNA, 14 nt, Bordetella pertussis
cuugaugccgccga

SEQ ID NO: 309242 - RNA, 16 nt, Bordetella pertussis
cuugauggccagcgcg

SEQ ID NO: 309243 - RNA, 22 nt, Bordetella pertussis
cuugauggccgggccguggcga

SEQ ID NO: 309244 - RNA, 18 nt, Bordetella pertussis
cuugauggccucggcggc

SEQ ID NO: 309245 - RNA, 13 nt, Bordetella pertussis
cuugccaggcccg

SEQ ID NO: 309246 - RNA, 15 nt, Bordetella pertussis
cuugccaggcccggc

SEQ ID NO: 309247 - RNA, 18 nt, Bordetella pertussis
cuugccaggcccggcgcg

SEQ ID NO: 309248 - RNA, 20 nt, Bordetella pertussis
cuugccaggcccggcgcgca

SEQ ID NO: 309249 - RNA, 23 nt, Bordetella pertussis
cuugccauaaggcuucucgacca

SEQ ID NO: 309250 - RNA, 20 nt, Bordetella pertussis
cuugccauaggccagcgccu

SEQ ID NO: 309251 - RNA, 13 nt, Bordetella pertussis
cuugccauccagc

SEQ ID NO: 309252 - RNA, 22 nt, Bordetella pertussis
cuugccauccagccaggccgca

SEQ ID NO: 309253 - RNA, 13 nt, Bordetella pertussis
cuugcccacgcca

SEQ ID NO: 309254 - RNA, 15 nt, Bordetella pertussis
cuugcccaggccggc

SEQ ID NO: 309255 - RNA, 20 nt, Bordetella pertussis
cuugcccaggcugggccaga

SEQ ID NO: 309256 - RNA, 19 nt, Bordetella pertussis
cuugcccgagaugcccgac

SEQ ID NO: 309257 - RNA, 16 nt, Bordetella pertussis
cuugcccuuggcggcc

SEQ ID NO: 309258 - RNA, 23 nt, Bordetella pertussis
cuugccgaaggugccugucccaa

SEQ ID NO: 309259 - RNA, 18 nt, Bordetella pertussis
cuugccgauccagcgccu

SEQ ID NO: 309260 - RNA, 14 nt, Bordetella pertussis
cuugccgcagcggc

SEQ ID NO: 309261 - RNA, 16 nt, Bordetella pertussis
cuugccgcagcggcca

SEQ ID NO: 309262 - RNA, 19 nt, Bordetella pertussis
cuugccgcagcggccaugg

SEQ ID NO: 309263 - RNA, 20 nt, Bordetella pertussis
cuugccgcccacugccaggc

SEQ ID NO: 309264 - RNA, 14 nt, Bordetella pertussis
cuugccgcccaggu

SEQ ID NO: 309265 - RNA, 17 nt, Bordetella pertussis
cuugccgcccaggucgg

SEQ ID NO: 309266 - RNA, 19 nt, Bordetella pertussis
cuugccgccggacggcgcc

SEQ ID NO: 309267 - RNA, 13 nt, Bordetella pertussis
cuugccgccgggc

SEQ ID NO: 309268 - RNA, 14 nt, Bordetella pertussis
cuugccgccgggca

SEQ ID NO: 309269 - RNA, 21 nt, Bordetella pertussis
cuugccgccgggcaugcacca

SEQ ID NO: 309270 - RNA, 22 nt, Bordetella pertussis
cuugccgccgugcgagcacggc

SEQ ID NO: 309271 - RNA, 20 nt, Bordetella pertussis
cuugccgccuucccaggcga

SEQ ID NO: 309272 - RNA, 16 nt, Bordetella pertussis
cuugccgcggcgcggc

SEQ ID NO: 309273 - RNA, 19 nt, Bordetella pertussis
cuugccgccgccgcgcgcg

SEQ ID NO: 309274 - RNA, 17 nt, Bordetella pertussis
cuugccgccgcgcagga

SEQ ID NO: 309275 - RNA, 20 nt, Bordetella pertussis
cuugccggaggucggcgcaa

SEQ ID NO: 309276 - RNA, 23 nt, Bordetella pertussis
cuugccgggcucgaugaccagca

SEQ ID NO: 309277 - RNA, 17 nt, Bordetella pertussis
cuugccggugcucggcc

SEQ ID NO: 309278 - RNA, 20 nt, Bordetella pertussis
cuugccggugcucggccagc

SEQ ID NO: 309279 - RNA, 20 nt, Bordetella pertussis
cuugccgguggacggccagc

SEQ ID NO: 309280 - RNA, 19 nt, Bordetella pertussis
cuugccguagcgcguggcc

SEQ ID NO: 309281 - RNA, 22 nt, Bordetella pertussis
cuugccguagcgcguggccagc

SEQ ID NO: 309282 - RNA, 19 nt, Bordetella pertussis
cuugccgucgaccgcgaag

SEQ ID NO: 309283 - RNA, 18 nt, Bordetella pertussis
cuugccugacgugcgcca

SEQ ID NO: 309284 - RNA, 16 nt, Bordetella pertussis
cuugccuugcgcggcc

SEQ ID NO: 309285 - RNA, 19 nt, Bordetella pertussis
cuugcgaacggccgcccgg

SEQ ID NO: 309286 - RNA, 20 nt, Bordetella pertussis
cuugcgaacggccgcccggc

SEQ ID NO: 309287 - RNA, 15 nt, Bordetella pertussis
cuugcgaggcccggc

SEQ ID NO: 309288 - RNA, 21 nt, Bordetella pertussis
cuugcgaggcccggccugcgu

SEQ ID NO: 309289 - RNA, 21 nt, Bordetella pertussis
cuugcgauaggugcgcagccg

SEQ ID NO: 309290 - RNA, 23 nt, Bordetella pertussis
cuugcgcaaguucaucaucgccg

SEQ ID NO: 309291 - RNA, 23 nt, Bordetella pertussis
cuugcgcauacgcggguucgacg

SEQ ID NO: 309292 - RNA, 15 nt, Bordetella pertussis
cuugcgccacgcccg

SEQ ID NO: 309293 - RNA, 21 nt, Bordetella pertussis
cuugcgccagccacgcgcgcu

SEQ ID NO: 309294 - RNA, 17 nt, Bordetella pertussis
cuugcgcgaaggccgcc

SEQ ID NO: 309295 - RNA, 17 nt, Bordetella pertussis
cuugcgcgacagcaggc

SEQ ID NO: 309296 - RNA, 18 nt, Bordetella pertussis
cuugcgcgacagcaggcc

SEQ ID NO: 309297 - RNA, 19 nt, Bordetella pertussis
cuugcgcgacagcaggccg

SEQ ID NO: 309298 - RNA, 12 nt, Bordetella pertussis
cuugcgcgccgc

SEQ ID NO: 309299 - RNA, 13 nt, Bordetella pertussis
cuugcgcgccgca

SEQ ID NO: 309300 - RNA, 15 nt, Bordetella pertussis
cuugcgcgcgccgga

SEQ ID NO: 309301 - RNA, 15 nt, Bordetella pertussis
cuugcgcggccagca

SEQ ID NO: 309302 - RNA, 14 nt, Bordetella pertussis
cuugcgcggcgagc

SEQ ID NO: 309303 - RNA, 17 nt, Bordetella pertussis
cuugcgcguaggcgcgc

SEQ ID NO: 309304 - RNA, 20 nt, Bordetella pertussis
cuugcgcguaggcgcgcgca

SEQ ID NO: 309305 - RNA, 16 nt, Bordetella pertussis
cuugcgcucgcccagc

SEQ ID NO: 309306 - RNA, 18 nt, Bordetella pertussis
cuugcgcuggcgcgcggc

SEQ ID NO: 309307 - RNA, 23 nt, Bordetella pertussis
cuugcgcuuuuuucuccagcgcc

SEQ ID NO: 309308 - RNA, 20 nt, Bordetella pertussis
cuugcggcccuugcgcgaac

SEQ ID NO: 309309 - RNA, 13 nt, Bordetella pertussis
cuugcggccgccg

SEQ ID NO: 309310 - RNA, 13 nt, Bordetella pertussis
cuugcggccgcgc

SEQ ID NO: 309311 - RNA, 14 nt, Bordetella pertussis
cuugcggccggcgc

SEQ ID NO: 309312 - RNA, 14 nt, Bordetella pertussis
cuugcggcgaggcu

SEQ ID NO: 309313 - RNA, 21 nt, Bordetella pertussis
cuugcgggccggcugggcggc

SEQ ID NO: 309314 - RNA, 22 nt, Bordetella pertussis
cuuggcccacucaugcgcugca

SEQ ID NO: 309315 - RNA, 23 nt, Bordetella pertussis
cuuggccgaacauauccacgcca

SEQ ID NO: 309316 - RNA, 19 nt, Bordetella pertussis
cuuggcccugcagcggcca

SEQ ID NO: 309317 - RNA, 16 nt, Bordetella pertussis
cuuggccgccacgcug

SEQ ID NO: 309318 - RNA, 17 nt, Bordetella pertussis
cuuggccucggccggca

SEQ ID NO: 309319 - RNA, 14 nt, Bordetella pertussis
cuuggccugggcgc

SEQ ID NO: 309320 - RNA, 17 nt, Bordetella pertussis
cuuggcgaacaccaggg

SEQ ID NO: 309321 - RNA, 15 nt, Bordetella pertussis
cuuggcgaccaggcc

SEQ ID NO: 309322 - RNA, 17 nt, Bordetella pertussis
cuuggcgaccaggccca

SEQ ID NO: 309323 - RNA, 18 nt, Bordetella pertussis
cuuggcgaccaggcccac

SEQ ID NO: 309324 - RNA, 23 nt, Bordetella pertussis
cuuggucggguccagcacgccuu

SEQ ID NO: 309325 - RNA, 16 nt, Bordetella pertussis
cuuggugcgcgccagg

SEQ ID NO: 309326 - RNA, 17 nt, Bordetella pertussis
cuugguggggucgaugc

SEQ ID NO: 309327 - RNA, 19 nt, Bordetella pertussis
cuugguggggucgaugcca

SEQ ID NO: 309328 - RNA, 16 nt, Bordetella pertussis
cuuguacaggcgcggc

SEQ ID NO: 309329 - RNA, 19 nt, Bordetella pertussis
cuuguacuggucgcgcagc

SEQ ID NO: 309330 - RNA, 21 nt, Bordetella pertussis
cuuguaguggcgguagacgcc

SEQ ID NO: 309331 - RNA, 14 nt, Bordetella pertussis
cuugugcgccgucg

SEQ ID NO: 309332 - RNA, 23 nt, Bordetella pertussis
cuuguucgagcgcgcgcaugcgc

SEQ ID NO: 309333 - RNA, 24 nt, Bordetella pertussis
cuuguucgagcgcgcgcaugcgca

SEQ ID NO: 309334 - RNA, 14 nt, Bordetella pertussis
cuuguucgcgcgcg

SEQ ID NO: 309335 - RNA, 19 nt, Bordetella pertussis
cuuguugcucuugaccugg

SEQ ID NO: 309336 - RNA, 22 nt, Bordetella pertussis
cuuguugcucuugaccugggcc

SEQ ID NO: 309337 - RNA, 13 nt, Bordetella pertussis
cuuguuggcgccg

SEQ ID NO: 309338 - RNA, 15 nt, Bordetella pertussis
gaaaccggcgcgcgc

SEQ ID NO: 309339 - RNA, 20 nt, Bordetella pertussis
gaaacucaccgccgcccgca

SEQ ID NO: 309340 - RNA, 14 nt, Bordetella pertussis
gaaacuggcgcugc

SEQ ID NO: 309341 - RNA, 20 nt, Bordetella pertussis
gaaagaggcauuggcggcgg

SEQ ID NO: 309342 - RNA, 14 nt, Bordetella pertussis
gaaagaggccaggc

SEQ ID NO: 309343 - RNA, 15 nt, Bordetella pertussis
gaaagaggccaggcc

SEQ ID NO: 309344 - RNA, 22 nt, Bordetella pertussis
gaaagcacggcgaugcugccgu

SEQ ID NO: 309345 - RNA, 23 nt, Bordetella pertussis
gaaagcacggcgaugcugccguc

SEQ ID NO: 309346 - RNA, 15 nt, Bordetella pertussis
gaaagcccggcccca

SEQ ID NO: 309347 - RNA, 21 nt, Bordetella pertussis
gaaagcccggccccaggccgg

SEQ ID NO: 309348 - RNA, 23 nt, Bordetella pertussis
gaaagcggcaaagccgcugcgcu

SEQ ID NO: 309349 - RNA, 16 nt, Bordetella pertussis
gaaagcgcggccgggc

SEQ ID NO: 309350 - RNA, 20 nt, Bordetella pertussis
gaaagcuggcguucgucgcc

SEQ ID NO: 309351 - RNA, 17 nt, Bordetella pertussis
gaaauccagcgcgccca

SEQ ID NO: 309352 - RNA, 19 nt, Bordetella pertussis
gaaauccguaguccagcag

SEQ ID NO: 309353 - RNA, 21 nt, Bordetella pertussis
gaaaucuucugcgccacggcg

SEQ ID NO: 309354 - RNA, 21 nt, Bordetella pertussis
gaacaccagguuuuccacagc

SEQ ID NO: 309355 - RNA, 14 nt, Bordetella pertussis
gaacaccaugcccg

SEQ ID NO: 309356 - RNA, 20 nt, Bordetella pertussis
gaacaccccggucagcaggg

SEQ ID NO: 309357 - RNA, 18 nt, Bordetella pertussis
gaacaccgccgcgccgcc

SEQ ID NO: 309358 - RNA, 19 nt, Bordetella pertussis
gaacaccggcgcgccuggc

SEQ ID NO: 309359 - RNA, 15 nt, Bordetella pertussis
gaacaccggcuuggc

SEQ ID NO: 309360 - RNA, 13 nt, Bordetella pertussis
gaacaccggcgcg

SEQ ID NO: 309361 - RNA, 18 nt, Bordetella pertussis
gaacagaaggcgugcgug

SEQ ID NO: 309362 - RNA, 20 nt, Bordetella pertussis
gaacagcaacgccacgcgcg

SEQ ID NO: 309363 - RNA, 17 nt, Bordetella pertussis
gaacagcauggcggcgc

SEQ ID NO: 309364 - RNA, 19 nt, Bordetella pertussis
gaacagcauggcggcgccc

SEQ ID NO: 309365 - RNA, 14 nt, Bordetella pertussis
gaacagccagggca

SEQ ID NO: 309366 - RNA, 20 nt, Bordetella pertussis
gaacagcuggaagcgcgcca

SEQ ID NO: 309367 - RNA, 13 nt, Bordetella pertussis
gaacaggaugcgc

SEQ ID NO: 309368 - RNA, 13 nt, Bordetella pertussis
gaacaggcgcgcc

SEQ ID NO: 309369 - RNA, 14 nt, Bordetella pertussis
gaacaggcgcgcca

SEQ ID NO: 309370 - RNA, 18 nt, Bordetella pertussis
gaacaggcgcgccagccg

SEQ ID NO: 309371 - RNA, 14 nt, Bordetella pertussis
gaacaggcugcgca

SEQ ID NO: 309372 - RNA, 18 nt, Bordetella pertussis
gaacagggcgcgacgcca

SEQ ID NO: 309373 - RNA, 19 nt, Bordetella pertussis
gaacagggugccgcccuug

SEQ ID NO: 309374 - RNA, 20 nt, Bordetella pertussis
gaacagguugaagccgacgg

SEQ ID NO: 309375 - RNA, 16 nt, Bordetella pertussis
gaacauccugaccggc

SEQ ID NO: 309376 - RNA, 14 nt, Bordetella pertussis
gaacauggcccggu

SEQ ID NO: 309377 - RNA, 22 nt, Bordetella pertussis
gaacauguccaccagccggccg

SEQ ID NO: 309378 - RNA, 19 nt, Bordetella pertussis
gaacauguucacgcccagg

SEQ ID NO: 309379 - RNA, 14 nt, Bordetella pertussis
gaaccacacgaccg

SEQ ID NO: 309380 - RNA, 12 nt, Bordetella pertussis
gaaccacagcau

SEQ ID NO: 309381 - RNA, 21 nt, Bordetella pertussis
gaaccgcgcagccgcuucacg

SEQ ID NO: 309382 - RNA, 16 nt, Bordetella pertussis
gaaccgcggcgcaggu

SEQ ID NO: 309383 - RNA, 20 nt, Bordetella pertussis
gaaccgcucagcccuugacg

SEQ ID NO: 309384 - RNA, 18 nt, Bordetella pertussis
gaacgacacccggucggc

SEQ ID NO: 309385 - RNA, 14 nt, Bordetella pertussis
gaacgacagaccgu

SEQ ID NO: 309386 - RNA, 19 nt, Bordetella pertussis
gaacgacagaccguagcgc

SEQ ID NO: 309387 - RNA, 22 nt, Bordetella pertussis
gaacgauucuuuccuggccggc

SEQ ID NO: 309388 - RNA, 20 nt, Bordetella pertussis
gaacgauuucuucgccuggc

SEQ ID NO: 309389 - RNA, 18 nt, Bordetella pertussis
gaacgcaagcccggcacg

SEQ ID NO: 309390 - RNA, 18 nt, Bordetella pertussis
gaacgccaccaggccgau

SEQ ID NO: 309391 - RNA, 15 nt, Bordetella pertussis
gaacgccagcagcac

SEQ ID NO: 309392 - RNA, 23 nt, Bordetella pertussis
gaacgccagggucugcuggucgc

SEQ ID NO: 309393 - RNA, 17 nt, Bordetella pertussis
gaacgcccggcccaggc

SEQ ID NO: 309394 - RNA, 21 nt, Bordetella pertussis
gaacgcccggcccaggccggg

SEQ ID NO: 309395 - RNA, 22 nt, Bordetella pertussis
gaacgcccggcccaggccgggc

SEQ ID NO: 309396 - RNA, 15 nt, Bordetella pertussis
gaacgccgccgcagc

SEQ ID NO: 309397 - RNA, 16 nt, Bordetella pertussis
gaacgccgcgcucagc

SEQ ID NO: 309398 - RNA, 20 nt, Bordetella pertussis
gaacgccgcgcucagcacca

SEQ ID NO: 309399 - RNA, 13 nt, Bordetella pertussis
gaacgccgcgcug

SEQ ID NO: 309400 - RNA, 14 nt, Bordetella pertussis
gaacgccgcgcugc

SEQ ID NO: 309401 - RNA, 24 nt, Bordetella pertussis
gaacgccgcgucgcuggccggacg

SEQ ID NO: 309402 - RNA, 19 nt, Bordetella pertussis
gaacgccgggccgugcgcc

SEQ ID NO: 309403 - RNA, 22 nt, Bordetella pertussis
gaacgccggcuugggcacacac

SEQ ID NO: 309404 - RNA, 18 nt, Bordetella pertussis
gaacgcgcgccggccagc

SEQ ID NO: 309405 - RNA, 19 nt, Bordetella pertussis
gaacgcgcgccggccagcg

SEQ ID NO: 309406 - RNA, 16 nt, Bordetella pertussis
gaacgcggccaugcgg

SEQ ID NO: 309407 - RNA, 15 nt, Bordetella pertussis
gaacgcguccaggcc

SEQ ID NO: 309408 - RNA, 20 nt, Bordetella pertussis
gaacgcguccaggcccuggc

SEQ ID NO: 309409 - RNA, 20 nt, Bordetella pertussis
gaacgcguaggucaggccca

SEQ ID NO: 309410 - RNA, 23 nt, Bordetella pertussis
gaacgcgucgcucauggaggggc

SEQ ID NO: 309411 - RNA, 19 nt, Bordetella pertussis
gaacggcagcgcgcgcgug

SEQ ID NO: 309412 - RNA, 22 nt, Bordetella pertussis
gaacggcaggugcacgcacggu

SEQ ID NO: 309413 - RNA, 23 nt, Bordetella pertussis
gaacggccccgccagggcggggc

SEQ ID NO: 309414 - RNA, 16 nt, Bordetella pertussis
gaacggccgggcgccc

SEQ ID NO: 309415 - RNA, 22 nt, Bordetella pertussis
gaacggccggucagcccaggcg

SEQ ID NO: 309416 - RNA, 13 nt, Bordetella pertussis
gaacggcgcggcc

SEQ ID NO: 309417 - RNA, 20 nt, Bordetella pertussis
gaacggcgcggccugcucga

SEQ ID NO: 309418 - RNA, 15 nt, Bordetella pertussis
gaacggccgcccggc

SEQ ID NO: 309419 - RNA, 17 nt, Bordetella pertussis
gaacggcucgagcuccu

SEQ ID NO: 309420 - RNA, 17 nt, Bordetella pertussis
gaacggcuugauggcga

SEQ ID NO: 309421 - RNA, 20 nt, Bordetella pertussis
gaacggcuugauggcgaugu

SEQ ID NO: 309422 - RNA, 11 nt, Bordetella pertussis
gaacggcuugg

SEQ ID NO: 309423 - RNA, 13 nt, Bordetella pertussis
gaacucgauccgg

SEQ ID NO: 309424 - RNA, 21 nt, Bordetella pertussis
gaacucgauccgggccuggcg

SEQ ID NO: 309425 - RNA, 19 nt, Bordetella pertussis
gaacucgcacacgcgcugg

SEQ ID NO: 309426 - RNA, 21 nt, Bordetella pertussis
gaacucgcacacgcgcugggc

SEQ ID NO: 309427 - RNA, 21 nt, Bordetella pertussis
gaacucgccgaacugccggcg

SEQ ID NO: 309428 - RNA, 12 nt, Bordetella pertussis
gaacucgcgcuc

SEQ ID NO: 309429 - RNA, 19 nt, Bordetella pertussis
gaacucgcgcucggccagc

SEQ ID NO: 309430 - RNA, 19 nt, Bordetella pertussis
gaacucgcgcucggcgacg

SEQ ID NO: 309431 - RNA, 13 nt, Bordetella pertussis
gaacucggccgca

SEQ ID NO: 309432 - RNA, 21 nt, Bordetella pertussis
gaacucgggguggaacugggc

SEQ ID NO: 309433 - RNA, 17 nt, Bordetella pertussis
gaacucguuggccagcg

SEQ ID NO: 309434 - RNA, 16 nt, Bordetella pertussis
gaacugggcgucgucc

SEQ ID NO: 309435 - RNA, 21 nt, Bordetella pertussis
gaacugggcgucguccugcag

SEQ ID NO: 309436 - RNA, 18 nt, Bordetella pertussis
gaacugucgcgccacggc

SEQ ID NO: 309437 - RNA, 13 nt, Bordetella pertussis
gaacuuggcgcgg

SEQ ID NO: 309438 - RNA, 16 nt, Bordetella pertussis
gaacuuggcgcggucc

SEQ ID NO: 309439 - RNA, 16 nt, Bordetella pertussis
gaagaagcagccgcgc

SEQ ID NO: 309440 - RNA, 16 nt, Bordetella pertussis
gaagaccgugaucggc

SEQ ID NO: 309441 - RNA, 21 nt, Bordetella pertussis
gaagaccgugaucggcgcaac

SEQ ID NO: 309442 - RNA, 15 nt, Bordetella pertussis
gaagaccucggcgcu

SEQ ID NO: 309443 - RNA, 18 nt, Bordetella pertussis
gaagacgaagucccagcc

SEQ ID NO: 309444 - RNA, 16 nt, Bordetella pertussis
gaagacgccggucgac

SEQ ID NO: 309445 - RNA, 17 nt, Bordetella pertussis
gaagacgccggucgaca

SEQ ID NO: 309446 - RNA, 17 nt, Bordetella pertussis
gaagagcuggcgcugcu

SEQ ID NO: 309447 - RNA, 14 nt, Bordetella pertussis
gaagaucggcccgg

SEQ ID NO: 309448 - RNA, 22 nt, Bordetella pertussis
gaagaucuccucgcgcgcgaug

SEQ ID NO: 309449 - RNA, 16 nt, Bordetella pertussis
gaagauguaccagccc

SEQ ID NO: 309450 - RNA, 22 nt, Bordetella pertussis
gaagauguggucggcgccgagg

SEQ ID NO: 309451 - RNA, 14 nt, Bordetella pertussis
gaagcacugcaggc

SEQ ID NO: 309452 - RNA, 16 nt, Bordetella pertussis
gaagcagcccagcacg

SEQ ID NO: 309453 - RNA, 20 nt, Bordetella pertussis
gaagcagcccagcacgacga

SEQ ID NO: 309454 - RNA, 20 nt, Bordetella pertussis
gaagcagccgcgcggccggg

SEQ ID NO: 309455 - RNA, 21 nt, Bordetella pertussis
gaagcaggcgguacagcggau

SEQ ID NO: 309456 - RNA, 16 nt, Bordetella pertussis
gaagcaggugaugcgc

SEQ ID NO: 309457 - RNA, 15 nt, Bordetella pertussis
gaagccaagcagggc

SEQ ID NO: 309458 - RNA, 20 nt, Bordetella pertussis
gaagccaccgucucgcccau

SEQ ID NO: 309459 - RNA, 18 nt, Bordetella pertussis
gaagccaucgacaagcgc

SEQ ID NO: 309460 - RNA, 18 nt, Bordetella pertussis
gaagcccccgcgcugcgc

SEQ ID NO: 309461 - RNA, 14 nt, Bordetella pertussis
gaagcccauggcgu

SEQ ID NO: 309462 - RNA, 17 nt, Bordetella pertussis
gaagcccggcugcucgu

SEQ ID NO: 309463 - RNA, 22 nt, Bordetella pertussis
gaagcccucgucgcggccguug

SEQ ID NO: 309464 - RNA, 15 nt, Bordetella pertussis
gaagccgcagcggca

SEQ ID NO: 309465 - RNA, 15 nt, Bordetella pertussis
gaagccgccgccguc

SEQ ID NO: 309466 - RNA, 15 nt, Bordetella pertussis
gaagccgggcggcga

SEQ ID NO: 309467 - RNA, 23 nt, Bordetella pertussis
gaagccgggcggcgagaugccgu

SEQ ID NO: 309468 - RNA, 21 nt, Bordetella pertussis
gaagccguaguugaugcuugc

SEQ ID NO: 309469 - RNA, 20 nt, Bordetella pertussis
gaagccguccuugagggcgc

SEQ ID NO: 309470 - RNA, 22 nt, Bordetella pertussis
gaagccguccuuggcgccggcg

SEQ ID NO: 309471 - RNA, 13 nt, Bordetella pertussis
gaagccugcgcgc

SEQ ID NO: 309472 - RNA, 14 nt, Bordetella pertussis
gaagccuugcgcgg

SEQ ID NO: 309473 - RNA, 16 nt, Bordetella pertussis
gaagccuugcgcggcc

SEQ ID NO: 309474 - RNA, 17 nt, Bordetella pertussis
gaagccuugcgcggcca

SEQ ID NO: 309475 - RNA, 14 nt, Bordetella pertussis
gaagcgagugcgcc

SEQ ID NO: 309476 - RNA, 16 nt, Bordetella pertussis
gaagcgcaagcccagg

SEQ ID NO: 309477 - RNA, 23 nt, Bordetella pertussis
gaagcgcaagcccaggcggccca

SEQ ID NO: 309478 - RNA, 13 nt, Bordetella pertussis
gaagcgcccuggc

SEQ ID NO: 309479 - RNA, 14 nt, Bordetella pertussis
gaagcgcccuggcg

SEQ ID NO: 309480 - RNA, 20 nt, Bordetella pertussis
gaagcgcccuggcguggcgc

SEQ ID NO: 309481 - RNA, 14 nt, Bordetella pertussis
gaagcgccgcgccu

SEQ ID NO: 309482 - RNA, 15 nt, Bordetella pertussis
gaagcgcaugucgaa

SEQ ID NO: 309483 - RNA, 12 nt, Bordetella pertussis
gaagcgcgccgc

SEQ ID NO: 309484 - RNA, 11 nt, Bordetella pertussis
gaagcgcgcgu

SEQ ID NO: 309485 - RNA, 19 nt, Bordetella pertussis
gaagcggaaacgcgcgcgc

SEQ ID NO: 309486 - RNA, 13 nt, Bordetella pertussis
gaagcggaugcgc

SEQ ID NO: 309487 - RNA, 14 nt, Bordetella pertussis
gaagcggcgcacca

SEQ ID NO: 309488 - RNA, 17 nt, Bordetella pertussis
gaagcggcgcaccagcg

SEQ ID NO: 309489 - RNA, 13 nt, Bordetella pertussis
gaagcggcaucgu

SEQ ID NO: 309490 - RNA, 19 nt, Bordetella pertussis
gaagcgggcgccggcgccc

SEQ ID NO: 309491 - RNA, 12 nt, Bordetella pertussis
gaagcgucggcc

SEQ ID NO: 309492 - RNA, 18 nt, Bordetella pertussis
gaagcgucggccugcacg

SEQ ID NO: 309493 - RNA, 22 nt, Bordetella pertussis
gaagcuguagcgguagccggcg

SEQ ID NO: 309494 - RNA, 16 nt, Bordetella pertussis
gaaggcagcaccgcca

SEQ ID NO: 309495 - RNA, 18 nt, Bordetella pertussis
gaaggcagcgcggccggc

SEQ ID NO: 309496 - RNA, 20 nt, Bordetella pertussis
gaaggccacgcgggcguggu

SEQ ID NO: 309497 - RNA, 11 nt, Bordetella pertussis
gaaggcccggu

SEQ ID NO: 309498 - RNA, 17 nt, Bordetella pertussis
gaaggccgaggccaggu

SEQ ID NO: 309499 - RNA, 16 nt, Bordetella pertussis
gaaggccgcaaccagg

SEQ ID NO: 309500 - RNA, 14 nt, Bordetella pertussis
gaaggccgccgcgu

SEQ ID NO: 309501 - RNA, 21 nt, Bordetella pertussis
gaaggccuuggccugggccga

SEQ ID NO: 309502 - RNA, 18 nt, Bordetella pertussis
gaaggcgaucugcggcgu

SEQ ID NO: 309503 - RNA, 16 nt, Bordetella pertussis
gaaggcgaugggcacc

SEQ ID NO: 309504 - RNA, 17 nt, Bordetella pertussis
gaaggcgccgacggcgc

SEQ ID NO: 309505 - RNA, 13 nt, Bordetella pertussis
gaaggcgccgacu

SEQ ID NO: 309506 - RNA, 15 nt, Bordetella pertussis
gaaggcgagcgcggc

SEQ ID NO: 309507 - RNA, 16 nt, Bordetella pertussis
gaaggcgagcgcggca

SEQ ID NO: 309508 - RNA, 14 nt, Bordetella pertussis
gaaggcgcgcucca

SEQ ID NO: 309509 - RNA, 15 nt, Bordetella pertussis
gaaggcgcggccggg

SEQ ID NO: 309510 - RNA, 16 nt, Bordetella pertussis
gaaggcgcggccgggc

SEQ ID NO: 309511 - RNA, 13 nt, Bordetella pertussis
gaaggcggccggc

SEQ ID NO: 309512 - RNA, 23 nt, Bordetella pertussis
gaaggcggccggcaggccggcca

SEQ ID NO: 309513 - RNA, 21 nt, Bordetella pertussis
gaaggcgguguagaccaccag

SEQ ID NO: 309514 - RNA, 22 nt, Bordetella pertussis
gaaggcgguguagaccaccagc

SEQ ID NO: 309515 - RNA, 16 nt, Bordetella pertussis
gaaggcuucgucgacc

SEQ ID NO: 309516 - RNA, 17 nt, Bordetella pertussis
gaaggcuuucugcuugc

SEQ ID NO: 309517 - RNA, 12 nt, Bordetella pertussis
gaagggcggcgc

SEQ ID NO: 309518 - RNA, 13 nt, Bordetella pertussis
gaaggggacuggc

SEQ ID NO: 309519 - RNA, 20 nt, Bordetella pertussis
gaaggggcggcuucaggcgc

SEQ ID NO: 309520 - RNA, 15 nt, Bordetella pertussis
gaagggcuggccggc

SEQ ID NO: 309521 - RNA, 18 nt, Bordetella pertussis
gaagguccacggcauggc

SEQ ID NO: 309522 - RNA, 23 nt, Bordetella pertussis
gaagguccacggcauggccagcu

SEQ ID NO: 309523 - RNA, 15 nt, Bordetella pertussis
gaaggucugggccag

SEQ ID NO: 309524 - RNA, 22 nt, Bordetella pertussis
gaaggucuggucgcacgacagc

SEQ ID NO: 309525 - RNA, 14 nt, Bordetella pertussis
gaaggugcgcagca

SEQ ID NO: 309526 - RNA, 18 nt, Bordetella pertussis
gaaguauucgcgcggcga

SEQ ID NO: 309527 - RNA, 19 nt, Bordetella pertussis
gaagucagccggugccagu

SEQ ID NO: 309528 - RNA, 20 nt, Bordetella pertussis
gaaguccugguuggccucgc

SEQ ID NO: 309529 - RNA, 19 nt, Bordetella pertussis
gaagucgcggcccgccagg

SEQ ID NO: 309530 - RNA, 12 nt, Bordetella pertussis
gaagucggccgg

SEQ ID NO: 309531 - RNA, 13 nt, Bordetella pertussis
gaagucgggcacc

SEQ ID NO: 309532 - RNA, 18 nt, Bordetella pertussis
gaagucgggcaccagcac

SEQ ID NO: 309533 - RNA, 19 nt, Bordetella pertussis
gaagugaugccgccggcgg

SEQ ID NO: 309534 - RNA, 14 nt, Bordetella pertussis
gaauacacgcgaug

SEQ ID NO: 309535 - RNA, 14 nt, Bordetella pertussis
gaauaccgccagcu

SEQ ID NO: 309536 - RNA, 20 nt, Bordetella pertussis
gaauaccgccagcucggccu

SEQ ID NO: 309537 - RNA, 22 nt, Bordetella pertussis
gaauagauaugggccugaucgg

SEQ ID NO: 309538 - RNA, 18 nt, Bordetella pertussis
gaauccaccggcgcgcgc

SEQ ID NO: 309539 - RNA, 20 nt, Bordetella pertussis
gaaucggcaccucggcgccg

SEQ ID NO: 309540 - RNA, 14 nt, Bordetella pertussis
gaaucggcgcgagc

SEQ ID NO: 309541 - RNA, 21 nt, Bordetella pertussis
gaaucgucaugaacgucaccc

SEQ ID NO: 309542 - RNA, 17 nt, Bordetella pertussis
gaaucgucgaccagcag

SEQ ID NO: 309543 - RNA, 21 nt, Bordetella pertussis
gaaugacgguggugucggcgg

SEQ ID NO: 309544 - RNA, 15 nt, Bordetella pertussis
gaaugccgccgugau

SEQ ID NO: 309545 - RNA, 16 nt, Bordetella pertussis
gaauggcugcgcgccg

SEQ ID NO: 309546 - RNA, 18 nt, Bordetella pertussis
gaauggucaagcggcugc

SEQ ID NO: 309547 - RNA, 17 nt, Bordetella pertussis
gaaugucccacaggcgc

SEQ ID NO: 309548 - RNA, 19 nt, Bordetella pertussis
gaaugucguugcacagcac

SEQ ID NO: 309549 - RNA, 19 nt, Bordetella pertussis
gaaugugcgagggcucgac

SEQ ID NO: 309550 - RNA, 16 nt, Bordetella pertussis
gacagcagggccaggc

SEQ ID NO: 309551 - RNA, 19 nt, Bordetella pertussis
gacagcagggccaggccca

SEQ ID NO: 309552 - RNA, 20 nt, Bordetella pertussis
gacagcagggccaggcccac

SEQ ID NO: 309553 - RNA, 17 nt, Bordetella pertussis
gacagcaguucggccgg

SEQ ID NO: 309554 - RNA, 21 nt, Bordetella pertussis
gacagcaucuuggccgccacg

SEQ ID NO: 309555 - RNA, 20 nt, Bordetella pertussis
gacagcaugaacggcagcgc

SEQ ID NO: 309556 - RNA, 16 nt, Bordetella pertussis
gacagccaggccagcg

SEQ ID NO: 309557 - RNA, 12 nt, Bordetella pertussis
gacagccccagc

SEQ ID NO: 309558 - RNA, 15 nt, Bordetella pertussis
gacagccccagcagc

SEQ ID NO: 309559 - RNA, 19 nt, Bordetella pertussis
gacagccccagcagcacgc

SEQ ID NO: 309560 - RNA, 14 nt, Bordetella pertussis
gacagcccgcgcug

SEQ ID NO: 309561 - RNA, 19 nt, Bordetella pertussis
gacagcccgcgcuggcgca

SEQ ID NO: 309562 - RNA, 20 nt, Bordetella pertussis
gacagccgcuaugacgaccg

SEQ ID NO: 309563 - RNA, 12 nt, Bordetella pertussis
gacagccgcgcc

SEQ ID NO: 309564 - RNA, 15 nt, Bordetella pertussis
gacagccgcgccagc

SEQ ID NO: 309565 - RNA, 23 nt, Bordetella pertussis
gacagccuuuccuccugccggcg

SEQ ID NO: 309566 - RNA, 22 nt, Bordetella pertussis
gacagcgacagccaggccagcg

SEQ ID NO: 309567 - RNA, 12 nt, Bordetella pertussis
gacagcgccagc

SEQ ID NO: 309568 - RNA, 13 nt, Bordetella pertussis
gacagcgcgcccg

SEQ ID NO: 309569 - RNA, 20 nt, Bordetella pertussis
gacagcgcgcccgcuugcgc

SEQ ID NO: 309570 - RNA, 21 nt, Bordetella pertussis
gacagcgcgcccgcuugcgcg

SEQ ID NO: 309571 - RNA, 18 nt, Bordetella pertussis
gacaggcacaccacgcga

SEQ ID NO: 309572 - RNA, 15 nt, Bordetella pertussis
gacaggcacaccggu

SEQ ID NO: 309573 - RNA, 18 nt, Bordetella pertussis
gacaggcaccccagcacc

SEQ ID NO: 309574 - RNA, 22 nt, Bordetella pertussis
gacaggcacccgagggucaggu

SEQ ID NO: 309575 - RNA, 17 nt, Bordetella pertussis
gacaggcacccgcacgg

SEQ ID NO: 309576 - RNA, 18 nt, Bordetella pertussis
gacaggcacccgcgcgca

SEQ ID NO: 309577 - RNA, 19 nt, Bordetella pertussis
gacaggcacccugccgugg

SEQ ID NO: 309578 - RNA, 14 nt, Bordetella pertussis
gacaggcaccgccg

SEQ ID NO: 309579 - RNA, 21 nt, Bordetella pertussis
gacaggcaccugcgguguccc

SEQ ID NO: 309580 - RNA, 22 nt, Bordetella pertussis
gacaggcaccuuggcccggcgg

SEQ ID NO: 309581 - RNA, 16 nt, Bordetella pertussis
gacaggcacgcgccga

SEQ ID NO: 309582 - RNA, 12 nt, Bordetella pertussis
gacaggaugggc

SEQ ID NO: 309583 - RNA, 22 nt, Bordetella pertussis
gacaggcgccucgcgacggccu

SEQ ID NO: 309584 - RNA, 11 nt, Bordetella pertussis
gacaggcgcgc

SEQ ID NO: 309585 - RNA, 21 nt, Bordetella pertussis
gacaggcgcgcaggcgggccu

SEQ ID NO: 309586 - RNA, 13 nt, Bordetella pertussis
gacaggcgcgcca

SEQ ID NO: 309587 - RNA, 14 nt, Bordetella pertussis
gacaggcgcgcccg

SEQ ID NO: 309588 - RNA, 17 nt, Bordetella pertussis
gacaggcggugcgcgcg

SEQ ID NO: 309589 - RNA, 21 nt, Bordetella pertussis
gacaggcggugcgcgcggccg

SEQ ID NO: 309590 - RNA, 22 nt, Bordetella pertussis
gacaggcggugcgcgcggccga

SEQ ID NO: 309591 - RNA, 16 nt, Bordetella pertussis
gacaggcucccgcugg

SEQ ID NO: 309592 - RNA, 19 nt, Bordetella pertussis
gacaggcucccgcuggcgg

SEQ ID NO: 309593 - RNA, 18 nt, Bordetella pertussis
gacagggccccggccucc

SEQ ID NO: 309594 - RNA, 16 nt, Bordetella pertussis
gacagggccgcgagca

SEQ ID NO: 309595 - RNA, 15 nt, Bordetella pertussis
gacaggucggcgccc

SEQ ID NO: 309596 - RNA, 17 nt, Bordetella pertussis
gacagugcccugacccg

SEQ ID NO: 309597 - RNA, 17 nt, Bordetella pertussis
gacaugcugcgacagca

SEQ ID NO: 309598 - RNA, 13 nt, Bordetella pertussis
gacaugcuggccc

SEQ ID NO: 309599 - RNA, 20 nt, Bordetella pertussis
gacaugcuggcccagcuggg

SEQ ID NO: 309600 - RNA, 17 nt, Bordetella pertussis
gacauggcgcgcgccag

SEQ ID NO: 309601 - RNA, 21 nt, Bordetella pertussis
gacauugucaagcagcgccgg

SEQ ID NO: 309602 - RNA, 19 nt, Bordetella pertussis
gaccaaccugaccgccuuc

SEQ ID NO: 309603 - RNA, 19 nt, Bordetella pertussis
gaccaacucgaggcggcgc

SEQ ID NO: 309604 - RNA, 17 nt, Bordetella pertussis
gaccaagcgccacagcg

SEQ ID NO: 309605 - RNA, 14 nt, Bordetella pertussis
gaccaagcugcgcg

SEQ ID NO: 309606 - RNA, 20 nt, Bordetella pertussis
gaccaagcugcgcgaggacc

SEQ ID NO: 309607 - RNA, 18 nt, Bordetella pertussis
gaccaauacgccgccaug

SEQ ID NO: 309608 - RNA, 19 nt, Bordetella pertussis
gaccaauacgccgccaugg

SEQ ID NO: 309609 - RNA, 14 nt, Bordetella pertussis
gaccaccagcaucg

SEQ ID NO: 309610 - RNA, 13 nt, Bordetella pertussis
gaccaccagcguc

SEQ ID NO: 309611 - RNA, 14 nt, Bordetella pertussis
gaccaccagcguca

SEQ ID NO: 309612 - RNA, 14 nt, Bordetella pertussis
gaccaccaggccgc

SEQ ID NO: 309613 - RNA, 19 nt, Bordetella pertussis
gaccaccaggccgccuaug

SEQ ID NO: 309614 - RNA, 17 nt, Bordetella pertussis
gaccaccugcaccgccg

SEQ ID NO: 309615 - RNA, 22 nt, Bordetella pertussis
gaccaccugcucggugagcggc

SEQ ID NO: 309616 - RNA, 22 nt, Bordetella pertussis
aacgcaauugcgugguggccuu

SEQ ID NO: 309617 - RNA, 15 nt, Bordetella pertussis
aacgcaugcgugcgc

SEQ ID NO: 309618 - RNA, 21 nt, Bordetella pertussis
aacgccaagcugcuggccggc

SEQ ID NO: 309619 - RNA, 15 nt, Bordetella pertussis
aacgcccggcgcggu

SEQ ID NO: 309620 - RNA, 18 nt, Bordetella pertussis
gaccacgcgcgcgccgcc

SEQ ID NO: 309621 - RNA, 16 nt, Bordetella pertussis
gaccacgcggcggugc

SEQ ID NO: 309622 - RNA, 16 nt, Bordetella pertussis
gaccacggccagcagc

SEQ ID NO: 309623 - RNA, 17 nt, Bordetella pertussis
gaccacggccagcagca

SEQ ID NO: 309624 - RNA, 21 nt, Bordetella pertussis
gaccacgcugggccagaccgc

SEQ ID NO: 309625 - RNA, 15 nt, Bordetella pertussis
gaccacggcgcgccc

SEQ ID NO: 309626 - RNA, 18 nt, Bordetella pertussis
gaccacggcgcgcccgca

SEQ ID NO: 309627 - RNA, 16 nt, Bordetella pertussis
gaccacggucuggcgc

SEQ ID NO: 309628 - RNA, 19 nt, Bordetella pertussis
gaccacggucuggcgcgac

SEQ ID NO: 309629 - RNA, 20 nt, Bordetella pertussis
gaccacgucgaucaggccca

SEQ ID NO: 309630 - RNA, 22 nt, Bordetella pertussis
aacgccggccgccauggccggc

SEQ ID NO: 309631 - RNA, 12 nt, Bordetella pertussis
aacgccgggccg

SEQ ID NO: 309632 - RNA, 14 nt, Bordetella pertussis
aacgcgacagcgcu

SEQ ID NO: 309633 - RNA, 22 nt, Bordetella pertussis
aacgcgauuuccuugcgccgcc

SEQ ID NO: 309634 - RNA, 16 nt, Bordetella pertussis
aacgcgcgcaacaggu

SEQ ID NO: 309635 - RNA, 15 nt, Bordetella pertussis
aacgcgcgccggcca

SEQ ID NO: 309636 - RNA, 22 nt, Bordetella pertussis
aacgcgcgccggccagcggcag

SEQ ID NO: 309637 - RNA, 21 nt, Bordetella pertussis
gaccagccagccgccgcgcgg

SEQ ID NO: 309638 - RNA, 13 nt, Bordetella pertussis
gaccagcccggcc

SEQ ID NO: 309639 - RNA, 16 nt, Bordetella pertussis
gaccagcccguccugg

SEQ ID NO: 309640 - RNA, 23 nt, Bordetella pertussis
gaccagcggaucgccgggcaggc

SEQ ID NO: 309641 - RNA, 19 nt, Bordetella pertussis
gaccagcuucugcgccugc

SEQ ID NO: 309642 - RNA, 17 nt, Bordetella pertussis
gaccagcuugucgacca

SEQ ID NO: 309643 - RNA, 21 nt, Bordetella pertussis
gaccagcuugucgaccaccgg

SEQ ID NO: 309644 - RNA, 20 nt, Bordetella pertussis
gaccaggaaguugcccaccg

SEQ ID NO: 309645 - RNA, 21 nt, Bordetella pertussis
gaccaggaugaugcagcacac

SEQ ID NO: 309646 - RNA, 14 nt, Bordetella pertussis
gaccaggucgaagc

SEQ ID NO: 309647 - RNA, 12 nt, Bordetella pertussis
gaccaggugcgg

SEQ ID NO: 309648 - RNA, 16 nt, Bordetella pertussis
gaccaggucgggcacg

SEQ ID NO: 309649 - RNA, 16 nt, Bordetella pertussis
gaccagucgacccacc

SEQ ID NO: 309650 - RNA, 20 nt, Bordetella pertussis
gaccagucgacccaccuggc

SEQ ID NO: 309651 - RNA, 16 nt, Bordetella pertussis
gaccaguucggccagc

SEQ ID NO: 309652 - RNA, 20 nt, Bordetella pertussis
gaccaguucggccagcagcu

SEQ ID NO: 309653 - RNA, 18 nt, Bordetella pertussis
gaccaguucgcgcagcgc

SEQ ID NO: 309654 - RNA, 20 nt, Bordetella pertussis
gaccaguucgcgcagcgccg

SEQ ID NO: 309655 - RNA, 16 nt, Bordetella pertussis
gaccaucacgagcagg

SEQ ID NO: 309656 - RNA, 17 nt, Bordetella pertussis
gaccaucacgagcaggu

SEQ ID NO: 309657 - RNA, 12 nt, Bordetella pertussis
gaccaucgcgca

SEQ ID NO: 309658 - RNA, 13 nt, Bordetella pertussis
gacccccggcccg

SEQ ID NO: 309659 - RNA, 14 nt, Bordetella pertussis
gaccccgucgaccg

SEQ ID NO: 309660 - RNA, 18 nt, Bordetella pertussis
gaccccguggucgccagc

SEQ ID NO: 309661 - RNA, 21 nt, Bordetella pertussis
gaccccguggucgccagcacg

SEQ ID NO: 309662 - RNA, 14 nt, Bordetella pertussis
gacccgaaccgauu

SEQ ID NO: 309663 - RNA, 15 nt, Bordetella pertussis
gacccgaaggcgcgg

SEQ ID NO: 309664 - RNA, 17 nt, Bordetella pertussis
gacccgaaggcgcggcc

SEQ ID NO: 309665 - RNA, 20 nt, Bordetella pertussis
gacccgaaggcgcggccggg

SEQ ID NO: 309666 - RNA, 22 nt, Bordetella pertussis
gacccgaaggcgcggccgggcu

SEQ ID NO: 309667 - RNA, 21 nt, Bordetella pertussis
gacccgaaucucccggcgccc

SEQ ID NO: 309668 - RNA, 13 nt, Bordetella pertussis
gacccgaugcgcc

SEQ ID NO: 309669 - RNA, 17 nt, Bordetella pertussis
aacgcugcgcgaugcgc

SEQ ID NO: 309670 - RNA, 15 nt, Bordetella pertussis
gaccgaaaagcccac

SEQ ID NO: 309671 - RNA, 15 nt, Bordetella pertussis
gaccgaacaccaccg

SEQ ID NO: 309672 - RNA, 14 nt, Bordetella pertussis
gaccgaagcgggcg

SEQ ID NO: 309673 - RNA, 17 nt, Bordetella pertussis
aacgcuuccugggccug

SEQ ID NO: 309674 - RNA, 15 nt, Bordetella pertussis
gaccgacggcaucgu

SEQ ID NO: 309675 - RNA, 16 nt, Bordetella pertussis
gaccgacggccuggag

SEQ ID NO: 309676 - RNA, 16 nt, Bordetella pertussis
gaccgauucgcgcacc

SEQ ID NO: 309677 - RNA, 16 nt, Bordetella pertussis
gaccgcacgauggcgc

SEQ ID NO: 309678 - RNA, 19 nt, Bordetella pertussis
gaccgcacgauggcgcgcg

SEQ ID NO: 309679 - RNA, 22 nt, Bordetella pertussis
gaccgcaggggauugccgcgcg

SEQ ID NO: 309680 - RNA, 23 nt, Bordetella pertussis
gaccgcaggggauugccgcgcgg

SEQ ID NO: 309681 - RNA, 18 nt, Bordetella pertussis
gaccgcaugcugcagcug

SEQ ID NO: 309682 - RNA, 14 nt, Bordetella pertussis
gaccgccagcaggc

SEQ ID NO: 309683 - RNA, 16 nt, Bordetella pertussis
gaccgccagcaggcgc

SEQ ID NO: 309684 - RNA, 14 nt, Bordetella pertussis
gaccgccagcaucc

SEQ ID NO: 309685 - RNA, 19 nt, Bordetella pertussis
gaccgccagcauccagccg

SEQ ID NO: 309686 - RNA, 14 nt, Bordetella pertussis
gaccgcccgcugcu

SEQ ID NO: 309687 - RNA, 17 nt, Bordetella pertussis
gaccgccggcaccagcg

SEQ ID NO: 309688 - RNA, 13 nt, Bordetella pertussis
gaccgccggccgg

SEQ ID NO: 309689 - RNA, 17 nt, Bordetella pertussis
gaccgccgggacaggca

SEQ ID NO: 309690 - RNA, 14 nt, Bordetella pertussis
gaccgccuccagcg

SEQ ID NO: 309691 - RNA, 22 nt, Bordetella pertussis
gaccgccuccagcgcggcgggc

SEQ ID NO: 309692 - RNA, 21 nt, Bordetella pertussis
gaccgccucgacgcccgggcg

SEQ ID NO: 309693 - RNA, 22 nt, Bordetella pertussis
gaccgcgaaccggugcuggugc

SEQ ID NO: 309694 - RNA, 20 nt, Bordetella pertussis
gaccgcgaagcgcgccagca

SEQ ID NO: 309695 - RNA, 18 nt, Bordetella pertussis
gaccgcuuccgagaaggc

SEQ ID NO: 309696 - RNA, 17 nt, Bordetella pertussis
gaccgcuuccgccaccg

SEQ ID NO: 309697 - RNA, 22 nt, Bordetella pertussis
gaccgcuuccgccaccgcgccg

SEQ ID NO: 309698 - RNA, 20 nt, Bordetella pertussis
gaccgcuucggucagcugcu

SEQ ID NO: 309699 - RNA, 22 nt, Bordetella pertussis
gaccgcuucggucagcugcugu

SEQ ID NO: 309700 - RNA, 21 nt, Bordetella pertussis
gaccggcaagcgcucgccggc

SEQ ID NO: 309701 - RNA, 22 nt, Bordetella pertussis
gaccggcaagcgcucgccggcg

SEQ ID NO: 309702 - RNA, 15 nt, Bordetella pertussis
gaccggcagggugcc

SEQ ID NO: 309703 - RNA, 17 nt, Bordetella pertussis
gaccggccccaccuggc

SEQ ID NO: 309704 - RNA, 19 nt, Bordetella pertussis
aacggcggcaggccgcgcc

SEQ ID NO: 309705 - RNA, 12 nt, Bordetella pertussis
gaccggcggcgc

SEQ ID NO: 309706 - RNA, 14 nt, Bordetella pertussis
gaccggcggcgcuc

SEQ ID NO: 309707 - RNA, 17 nt, Bordetella pertussis
gaccggcgugacgcgcg

SEQ ID NO: 309708 - RNA, 20 nt, Bordetella pertussis
gaccggcguguccagcggcg

SEQ ID NO: 309709 - RNA, 21 nt, Bordetella pertussis
gaccggcguguccagcggcgc

SEQ ID NO: 309710 - RNA, 23 nt, Bordetella pertussis
gaccggcguguccagcggcgcca

SEQ ID NO: 309711 - RNA, 21 nt, Bordetella pertussis
gaccggcuauaccgggcuggu

SEQ ID NO: 309712 - RNA, 15 nt, Bordetella pertussis
gaccggcucgaucgc

SEQ ID NO: 309713 - RNA, 18 nt, Bordetella pertussis
gaccggcucgaucgccgc

SEQ ID NO: 309714 - RNA, 22 nt, Bordetella pertussis
gaccggcucgaucgccgccggc

SEQ ID NO: 309715 - RNA, 17 nt, Bordetella pertussis
gaccggcuccggccgcu

SEQ ID NO: 309716 - RNA, 17 nt, Bordetella pertussis
gaccgggaauggcgccg

SEQ ID NO: 309717 - RNA, 18 nt, Bordetella pertussis
gaccgggaauggcgccgu

SEQ ID NO: 309718 - RNA, 13 nt, Bordetella pertussis
gaccgggccgaag

SEQ ID NO: 309719 - RNA, 17 nt, Bordetella pertussis
gaccgggccgaccaggc

SEQ ID NO: 309720 - RNA, 21 nt, Bordetella pertussis
gaccggggcguccaccgccga

SEQ ID NO: 309721 - RNA, 20 nt, Bordetella pertussis
gaccggguugcccggcaggc

SEQ ID NO: 309722 - RNA, 23 nt, Bordetella pertussis
gaccggguugcccggcaggcaca

SEQ ID NO: 309723 - RNA, 18 nt, Bordetella pertussis
gaccggguuuccagcccg

SEQ ID NO: 309724 - RNA, 14 nt, Bordetella pertussis
gaccgggucgucgg

SEQ ID NO: 309725 - RNA, 21 nt, Bordetella pertussis
gaccgggucgucgggcggcgc

SEQ ID NO: 309726 - RNA, 16 nt, Bordetella pertussis
gaccggguggcugcgc

SEQ ID NO: 309727 - RNA, 12 nt, Bordetella pertussis
gaccggugcccu

SEQ ID NO: 309728 - RNA, 13 nt, Bordetella pertussis
gaccguagcgcag

SEQ ID NO: 309729 - RNA, 14 nt, Bordetella pertussis
gaccgugcgccaac

SEQ ID NO: 309730 - RNA, 23 nt, Bordetella pertussis
aacggcgggcgcgcaggccucgc

SEQ ID NO: 309731 - RNA, 17 nt, Bordetella pertussis
aacggcuuggcgugcgc

SEQ ID NO: 309732 - RNA, 13 nt, Bordetella pertussis
aacgggcggcguc

SEQ ID NO: 309733 - RNA, 14 nt, Bordetella pertussis
aacgggcggcgucg

SEQ ID NO: 309734 - RNA, 15 nt, Bordetella pertussis
aacgggcggcgucgc

SEQ ID NO: 309735 - RNA, 21 nt, Bordetella pertussis
gaccguuccagacgauggugc

SEQ ID NO: 309736 - RNA, 14 nt, Bordetella pertussis
gaccuccaggccca

SEQ ID NO: 309737 - RNA, 16 nt, Bordetella pertussis
gaccuccaggcccagg

SEQ ID NO: 309738 - RNA, 19 nt, Bordetella pertussis
gaccuccggcaacagcagg

SEQ ID NO: 309739 - RNA, 13 nt, Bordetella pertussis
gaccucgagcacc

SEQ ID NO: 309740 - RNA, 17 nt, Bordetella pertussis
gaccucgcccaggccgg

SEQ ID NO: 309741 - RNA, 20 nt, Bordetella pertussis
gaccucgcgcugcagcauga

SEQ ID NO: 309742 - RNA, 15 nt, Bordetella pertussis
gaccucggcaccgag

SEQ ID NO: 309743 - RNA, 21 nt, Bordetella pertussis
gaccucggcggcgucgcuggc

SEQ ID NO: 309744 - RNA, 24 nt, Bordetella pertussis
gaccucggcggcgucgcuggcagc

SEQ ID NO: 309745 - RNA, 22 nt, Bordetella pertussis
gaccucuucguugucgcgcgcg

SEQ ID NO: 309746 - RNA, 16 nt, Bordetella pertussis
gaccugacccccgaac

SEQ ID NO: 309747 - RNA, 21 nt, Bordetella pertussis
gaccugacccccgaacugggc

SEQ ID NO: 309748 - RNA, 21 nt, Bordetella pertussis
gaccugagccaggcgcccggc

SEQ ID NO: 309749 - RNA, 22 nt, Bordetella pertussis
gaccugagccaggcgcccggcg

SEQ ID NO: 309750 - RNA, 13 nt, Bordetella pertussis
gaccugaucgcgc

SEQ ID NO: 309751 - RNA, 16 nt, Bordetella pertussis
gaccugaucgcgcagc

SEQ ID NO: 309752 - RNA, 18 nt, Bordetella pertussis
gaccugaucgcgcagcgc

SEQ ID NO: 309753 - RNA, 23 nt, Bordetella pertussis
gaccugaucgcgcagcgccuggc

SEQ ID NO: 309754 - RNA, 24 nt, Bordetella pertussis
gaccugaauccguaagcgcuggac

SEQ ID NO: 309755 - RNA, 13 nt, Bordetella pertussis
gaccugcuggcgc

SEQ ID NO: 309756 - RNA, 14 nt, Bordetella pertussis
gaccugcuggcgcg

SEQ ID NO: 309757 - RNA, 22 nt, Bordetella pertussis
gaccugcuggcguuugcgcgcg

SEQ ID NO: 309758 - RNA, 11 nt, Bordetella pertussis
gaccugcuuga

SEQ ID NO: 309759 - RNA, 18 nt, Bordetella pertussis
gaccuggacgagggccgc

SEQ ID NO: 309760 - RNA, 11 nt, Bordetella pertussis
gaccugggcca

SEQ ID NO: 309761 - RNA, 17 nt, Bordetella pertussis
gaccugggccagcaggu

SEQ ID NO: 309762 - RNA, 19 nt, Bordetella pertussis
gaccuggggguucgugggc

SEQ ID NO: 309763 - RNA, 23 nt, Bordetella pertussis
gaccuggggguucgugggcgagc

SEQ ID NO: 309764 - RNA, 13 nt, Bordetella pertussis
gaccuugugcggc

SEQ ID NO: 309765 - RNA, 14 nt, Bordetella pertussis
gacgaaagcggcaa

SEQ ID NO: 309766 - RNA, 23 nt, Bordetella pertussis
gacgaaagcggcaaagccgcugc

SEQ ID NO: 309767 - RNA, 21 nt, Bordetella pertussis
gacgaaauagccgaccacccg

SEQ ID NO: 309768 - RNA, 21 nt, Bordetella pertussis
gacgaaaugcgugacacggcc

SEQ ID NO: 309769 - RNA, 22 nt, Bordetella pertussis
gacgaaaugcgugacacggcca

SEQ ID NO: 309770 - RNA, 19 nt, Bordetella pertussis
gacgacagcggcgagcgcg

SEQ ID NO: 309771 - RNA, 16 nt, Bordetella pertussis
gacgaccccgccgugc

SEQ ID NO: 309772 - RNA, 17 nt, Bordetella pertussis
gacgaccccgccgugcc

SEQ ID NO: 309773 - RNA, 21 nt, Bordetella pertussis
gacgaccccgccgugccgggc

SEQ ID NO: 309774 - RNA, 13 nt, Bordetella pertussis
gacgaccgcgacc

SEQ ID NO: 309775 - RNA, 21 nt, Bordetella pertussis
gacguagagaccaagcugcgc

SEQ ID NO: 309776 - RNA, 14 nt, Bordetella pertussis
gacguagccgcugc

SEQ ID NO: 309777 - RNA, 17 nt, Bordetella pertussis
gacguagucgcgccagc

SEQ ID NO: 309778 - RNA, 20 nt, Bordetella pertussis
gacguagucgcgccagcggc

SEQ ID NO: 309779 - RNA, 19 nt, Bordetella pertussis
gacguagucgcacgcggcu

SEQ ID NO: 309780 - RNA, 14 nt, Bordetella pertussis
gacguccagcgacu

SEQ ID NO: 309781 - RNA, 15 nt, Bordetella pertussis
gacguccagcgccac

SEQ ID NO: 309782 - RNA, 21 nt, Bordetella pertussis
gacguccagcgccaccagcag

SEQ ID NO: 309783 - RNA, 22 nt, Bordetella pertussis
gacguccacgaugucguccagc

SEQ ID NO: 309784 - RNA, 22 nt, Bordetella pertussis
gacguccagcccgugggcggcg

SEQ ID NO: 309785 - RNA, 19 nt, Bordetella pertussis
gacgucccaggccgaagcc

SEQ ID NO: 309786 - RNA, 20 nt, Bordetella pertussis
gacgucccaggccgaagcca

SEQ ID NO: 309787 - RNA, 17 nt, Bordetella pertussis
gacguccggcgggccgc

SEQ ID NO: 309788 - RNA, 15 nt, Bordetella pertussis
gacgucgacguugcg

SEQ ID NO: 309789 - RNA, 13 nt, Bordetella pertussis
gacgucgaucgag

SEQ ID NO: 309790 - RNA, 14 nt, Bordetella pertussis
gacgucggccucgc

SEQ ID NO: 309791 - RNA, 18 nt, Bordetella pertussis
gacgucggcgauggcccg

SEQ ID NO: 309792 - RNA, 16 nt, Bordetella pertussis
gacgucggugacggcg

SEQ ID NO: 309793 - RNA, 17 nt, Bordetella pertussis
gacgucguagugcgcgc

SEQ ID NO: 309794 - RNA, 19 nt, Bordetella pertussis
gacgugcgcgaccgcgcgg

SEQ ID NO: 309795 - RNA, 23 nt, Bordetella pertussis
gacgugcgcgaccgcgcggcgcu

SEQ ID NO: 309796 - RNA, 20 nt, Bordetella pertussis
gacgugcugaccgacgugcg

SEQ ID NO: 309797 - RNA, 16 nt, Bordetella pertussis
gacgugcugcugcacg

SEQ ID NO: 309798 - RNA, 19 nt, Bordetella pertussis
gacgugcugcugcacguga

SEQ ID NO: 309799 - RNA, 17 nt, Bordetella pertussis
gacguggccuaccacgc

SEQ ID NO: 309800 - RNA, 14 nt, Bordetella pertussis
gacguggcgcucca

SEQ ID NO: 309801 - RNA, 23 nt, Bordetella pertussis
gacguggcgcuccaugcggcggc

SEQ ID NO: 309802 - RNA, 16 nt, Bordetella pertussis
gacguucuccagcgcc

SEQ ID NO: 309803 - RNA, 17 nt, Bordetella pertussis
gacguucuccagcgccg

SEQ ID NO: 309804 - RNA, 18 nt, Bordetella pertussis
gacguucuccagcgccgu

SEQ ID NO: 309805 - RNA, 21 nt, Bordetella pertussis
gacguugcauaccucgauggc

SEQ ID NO: 309806 - RNA, 16 nt, Bordetella pertussis
gacguugccgcgcgcg

SEQ ID NO: 309807 - RNA, 12 nt, Bordetella pertussis
gacguugcgcga

SEQ ID NO: 309808 - RNA, 19 nt, Bordetella pertussis
gacguugcgcgacaggccc

SEQ ID NO: 309809 - RNA, 18 nt, Bordetella pertussis
gacguuggucaccacgcc

SEQ ID NO: 309810 - RNA, 22 nt, Bordetella pertussis
gacguuggucaccacgccuucg

SEQ ID NO: 309811 - RNA, 14 nt, Bordetella pertussis
gacguuguccaggc

SEQ ID NO: 309812 - RNA, 16 nt, Bordetella pertussis
gacuacgcgcuggcgc

SEQ ID NO: 309813 - RNA, 19 nt, Bordetella pertussis
gacuacggcggacuggccg

SEQ ID NO: 309814 - RNA, 19 nt, Bordetella pertussis
gacuccaggagcucguccc

SEQ ID NO: 309815 - RNA, 20 nt, Bordetella pertussis
gacucccaugacccugcacg

SEQ ID NO: 309816 - RNA, 20 nt, Bordetella pertussis
gacucgaaacgggcggcguc

SEQ ID NO: 309817 - RNA, 19 nt, Bordetella pertussis
gacucgacgaacacgcgcg

SEQ ID NO: 309818 - RNA, 13 nt, Bordetella pertussis
gacucgauggcgc

SEQ ID NO: 309819 - RNA, 19 nt, Bordetella pertussis
gacucgauggcgcaggcgc

SEQ ID NO: 309820 - RNA, 18 nt, Bordetella pertussis
gacucgccgugcugggcg

SEQ ID NO: 309821 - RNA, 17 nt, Bordetella pertussis
gacucggccgagaacgc

SEQ ID NO: 309822 - RNA, 20 nt, Bordetella pertussis
gacucggccgagaacgccgu

SEQ ID NO: 309823 - RNA, 22 nt, Bordetella pertussis
gacucguccauggugggcaggu

SEQ ID NO: 309824 - RNA, 18 nt, Bordetella pertussis
gacucgucgaccaccagc

SEQ ID NO: 309825 - RNA, 21 nt, Bordetella pertussis
gacucgucgaccaccagcauc

SEQ ID NO: 309826 - RNA, 23 nt, Bordetella pertussis
gacucgggcaugcgccugcgcca

SEQ ID NO: 309827 - RNA, 14 nt, Bordetella pertussis
gacugagucgucau

SEQ ID NO: 309828 - RNA, 18 nt, Bordetella pertussis
gacugcagcaggcugggc

SEQ ID NO: 309829 - RNA, 20 nt, Bordetella pertussis
gacugcagcaggcugggcga

SEQ ID NO: 309830 - RNA, 18 nt, Bordetella pertussis
gacugcaggaugaggcgc

SEQ ID NO: 309831 - RNA, 19 nt, Bordetella pertussis
gacugccccagcggcuggc

SEQ ID NO: 309832 - RNA, 20 nt, Bordetella pertussis
gacugccccagcggcuggcg

SEQ ID NO: 309833 - RNA, 21 nt, Bordetella pertussis
gacugccccagcggcuggcgc

SEQ ID NO: 309834 - RNA, 12 nt, Bordetella pertussis
gacugcgccgca

SEQ ID NO: 309835 - RNA, 21 nt, Bordetella pertussis
gacugcuguacgacagcaagg

SEQ ID NO: 309836 - RNA, 14 nt, Bordetella pertussis
gacuggcaccggca

SEQ ID NO: 309837 - RNA, 15 nt, Bordetella pertussis
gacuggcaccggcaa

SEQ ID NO: 309838 - RNA, 14 nt, Bordetella pertussis
gacuggcaccggcc

SEQ ID NO: 309839 - RNA, 16 nt, Bordetella pertussis
gacuggcaccugcaag

SEQ ID NO: 309840 - RNA, 16 nt, Bordetella pertussis
gacuggcacgcgcuga

SEQ ID NO: 309841 - RNA, 15 nt, Bordetella pertussis
gacuggccgcgccgc

SEQ ID NO: 309842 - RNA, 17 nt, Bordetella pertussis
gacuggcucccgcugac

SEQ ID NO: 309843 - RNA, 21 nt, Bordetella pertussis
gacugggcggauuggacagca

SEQ ID NO: 309844 - RNA, 14 nt, Bordetella pertussis
gacugggugcgccu

SEQ ID NO: 309845 - RNA, 17 nt, Bordetella pertussis
gacugggugcgccugac

SEQ ID NO: 309846 - RNA, 22 nt, Bordetella pertussis
gacuggugcaacuccacgcccu

SEQ ID NO: 309847 - RNA, 12 nt, Bordetella pertussis
aacguggcgcgc

SEQ ID NO: 309848 - RNA, 23 nt, Bordetella pertussis
aacguggcggcgauguggcgcgc

SEQ ID NO: 309849 - RNA, 20 nt, Bordetella pertussis
gacuucaccgugaugggcgc

SEQ ID NO: 309850 - RNA, 19 nt, Bordetella pertussis
gacuuccggggagccugcc

SEQ ID NO: 309851 - RNA, 19 nt, Bordetella pertussis
gacuuccgugccauacagc

SEQ ID NO: 309852 - RNA, 16 nt, Bordetella pertussis
gacuucgccgaucgag

SEQ ID NO: 309853 - RNA, 14 nt, Bordetella pertussis
gacuucggcggccu

SEQ ID NO: 309854 - RNA, 17 nt, Bordetella pertussis
gacuucguguucgcggc

SEQ ID NO: 309855 - RNA, 19 nt, Bordetella pertussis
gacuucguguucgcggccg

SEQ ID NO: 309856 - RNA, 20 nt, Bordetella pertussis
gacuucguguucgcggccgg

SEQ ID NO: 309857 - RNA, 14 nt, Bordetella pertussis
gacuucguccggcg

SEQ ID NO: 309858 - RNA, 18 nt, Bordetella pertussis
gacuugaaucccgacgag

SEQ ID NO: 309859 - RNA, 12 nt, Bordetella pertussis
gagaaauccagc

SEQ ID NO: 309860 - RNA, 16 nt, Bordetella pertussis
gagaacgccgucgggg

SEQ ID NO: 309861 - RNA, 16 nt, Bordetella pertussis
gagaacgcggccgcga

SEQ ID NO: 309862 - RNA, 13 nt, Bordetella pertussis
gagaauggcgcga

SEQ ID NO: 309863 - RNA, 13 nt, Bordetella pertussis
gagacaggcgcgc

SEQ ID NO: 309864 - RNA, 15 nt, Bordetella pertussis
gagacaggcgcgcca

SEQ ID NO: 309865 - RNA, 16 nt, Bordetella pertussis
gagacaggcgcgccau

SEQ ID NO: 309866 - RNA, 12 nt, Bordetella pertussis
gagacaucaugc

SEQ ID NO: 309867 - RNA, 14 nt, Bordetella pertussis
gagaccagcagcgg

SEQ ID NO: 309868 - RNA, 13 nt, Bordetella pertussis
gagaccaugacgu

SEQ ID NO: 309869 - RNA, 15 nt, Bordetella pertussis
gagaccaugacgucg

SEQ ID NO: 309870 - RNA, 16 nt, Bordetella pertussis
gagaccgcccgcugcu

SEQ ID NO: 309871 - RNA, 19 nt, Bordetella pertussis
gagaccggguugcccggca

SEQ ID NO: 309872 - RNA, 19 nt, Bordetella pertussis
gagacgaaggcgccggcca

SEQ ID NO: 309873 - RNA, 15 nt, Bordetella pertussis
gagacgcugucgcgc

SEQ ID NO: 309874 - RNA, 19 nt, Bordetella pertussis
gagacgcugucgcgcccgg

SEQ ID NO: 309875 - RNA, 14 nt, Bordetella pertussis
gagacggccgccga

SEQ ID NO: 309876 - RNA, 21 nt, Bordetella pertussis
gagacggaugcuugcggggca

SEQ ID NO: 309877 - RNA, 16 nt, Bordetella pertussis
gagacguagccgcugc

SEQ ID NO: 309878 - RNA, 14 nt, Bordetella pertussis
gagacgucuucgua

SEQ ID NO: 309879 - RNA, 21 nt, Bordetella pertussis
gagagccggccacgcgcugca

SEQ ID NO: 309880 - RNA, 22 nt, Bordetella pertussis
gagagcgccacgccagcggcga

SEQ ID NO: 309881 - RNA, 19 nt, Bordetella pertussis
gagaguucggugucggcgu

SEQ ID NO: 309882 - RNA, 21 nt, Bordetella pertussis
gagauccagcgagaccuugug

SEQ ID NO: 309883 - RNA, 17 nt, Bordetella pertussis
gagaucgccgagcggca

SEQ ID NO: 309884 - RNA, 19 nt, Bordetella pertussis
gagaugccagcggcgcagc

SEQ ID NO: 309885 - RNA, 21 nt, Bordetella pertussis
gagaugccagcggcgcagccg

SEQ ID NO: 309886 - RNA, 21 nt, Bordetella pertussis
gagauggccuuuuccaggcgu

SEQ ID NO: 309887 - RNA, 20 nt, Bordetella pertussis
gagauggcgcaggcgcgcgc

SEQ ID NO: 309888 - RNA, 13 nt, Bordetella pertussis
gagauggcgccga

SEQ ID NO: 309889 - RNA, 15 nt, Bordetella pertussis
gagauggcgugcacg

SEQ ID NO: 309890 - RNA, 16 nt, Bordetella pertussis
gagauggguacagcgc

SEQ ID NO: 309891 - RNA, 22 nt, Bordetella pertussis
gagauggguacagcgcgcccga

SEQ ID NO: 309892 - RNA, 20 nt, Bordetella pertussis
gagauguccauggccugcag

SEQ ID NO: 309893 - RNA, 23 nt, Bordetella pertussis
gagaugugcggcguggcggggcg

SEQ ID NO: 309894 - RNA, 19 nt, Bordetella pertussis
gagauuggccgagcgcgga

SEQ ID NO: 309895 - RNA, 14 nt, Bordetella pertussis
gagauuguccagcg

SEQ ID NO: 309896 - RNA, 17 nt, Bordetella pertussis
gagcacaugcccggcca

SEQ ID NO: 309897 - RNA, 20 nt, Bordetella pertussis
gagcacaugcccggccacca

SEQ ID NO: 309898 - RNA, 14 nt, Bordetella pertussis
gagcaccagcagcc

SEQ ID NO: 309899 - RNA, 16 nt, Bordetella pertussis
gagcaccgagaccggg

SEQ ID NO: 309900 - RNA, 22 nt, Bordetella pertussis
gagcaccguauccucgaucagc

SEQ ID NO: 309901 - RNA, 12 nt, Bordetella pertussis
gagcacgcggcg

SEQ ID NO: 309902 - RNA, 14 nt, Bordetella pertussis
gagcacgcggcgcg

SEQ ID NO: 309903 - RNA, 15 nt, Bordetella pertussis
gagcacggcgcggcu

SEQ ID NO: 309904 - RNA, 14 nt, Bordetella pertussis
gagcacggcguggc

SEQ ID NO: 309905 - RNA, 16 nt, Bordetella pertussis
gagcacggcguggcgc

SEQ ID NO: 309906 - RNA, 18 nt, Bordetella pertussis
gagcacggcguggcgcgc

SEQ ID NO: 309907 - RNA, 19 nt, Bordetella pertussis
gagcacggcguggcgcgca

SEQ ID NO: 309908 - RNA, 18 nt, Bordetella pertussis
gagcacguccagcggcgc

SEQ ID NO: 309909 - RNA, 16 nt, Bordetella pertussis
gagcacuuucgacacg

SEQ ID NO: 309910 - RNA, 20 nt, Bordetella pertussis
gagcagaugcaccggccagu

SEQ ID NO: 309911 - RNA, 22 nt, Bordetella pertussis
gagcagaugcgacuggcggcug

SEQ ID NO: 309912 - RNA, 15 nt, Bordetella pertussis
gagcagcagcgggcu

SEQ ID NO: 309913 - RNA, 21 nt, Bordetella pertussis
gagcagcaugugcucgggacg

SEQ ID NO: 309914 - RNA, 16 nt, Bordetella pertussis
gagcaggccgcccagc

SEQ ID NO: 309915 - RNA, 15 nt, Bordetella pertussis
gagcaggccgccgcc

SEQ ID NO: 309916 - RNA, 17 nt, Bordetella pertussis
gagcaggccggcguuca

SEQ ID NO: 309917 - RNA, 14 nt, Bordetella pertussis
gagcaggcgcgcgg

SEQ ID NO: 309918 - RNA, 13 nt, Bordetella pertussis
gagcaggcgcugg

SEQ ID NO: 309919 - RNA, 22 nt, Bordetella pertussis
gagcaggcccguguagacggca

SEQ ID NO: 309920 - RNA, 20 nt, Bordetella pertussis
gagcagggggucgaucaugg

SEQ ID NO: 309921 - RNA, 16 nt, Bordetella pertussis
gagcaguacacgcgca

SEQ ID NO: 309922 - RNA, 15 nt, Bordetella pertussis
gagcagucgaccacg

SEQ ID NO: 309923 - RNA, 17 nt, Bordetella pertussis
gagcagucgcgcagcca

SEQ ID NO: 309924 - RNA, 19 nt, Bordetella pertussis
gagcagucgcgcagccaca

SEQ ID NO: 309925 - RNA, 18 nt, Bordetella pertussis
gagcaucauggcgcgcgc

SEQ ID NO: 309926 - RNA, 14 nt, Bordetella pertussis
aacucaccgccgcc

SEQ ID NO: 309927 - RNA, 22 nt, Bordetella pertussis
aacuccaggaaagcgccgccgc

SEQ ID NO: 309928 - RNA, 17 nt, Bordetella pertussis
gagcaucuggcgcaugg

SEQ ID NO: 309929 - RNA, 13 nt, Bordetella pertussis
gagcaugcggcgu

SEQ ID NO: 309930 - RNA, 13 nt, Bordetella pertussis
gagcauugccgcg

SEQ ID NO: 309931 - RNA, 15 nt, Bordetella pertussis
gagcauugccgcggc

SEQ ID NO: 309932 - RNA, 12 nt, Bordetella pertussis
gagccaggcgcc

SEQ ID NO: 309933 - RNA, 17 nt, Bordetella pertussis
gagccaggcgcccggcg

SEQ ID NO: 309934 - RNA, 17 nt, Bordetella pertussis
gagccaggcggcguagu

SEQ ID NO: 309935 - RNA, 14 nt, Bordetella pertussis
gagccagguggaca

SEQ ID NO: 309936 - RNA, 21 nt, Bordetella pertussis
gagccagguggacagcgccag

SEQ ID NO: 309937 - RNA, 16 nt, Bordetella pertussis
gagccaugccgucugg

SEQ ID NO: 309938 - RNA, 18 nt, Bordetella pertussis
gagccaugccgucuggcg

SEQ ID NO: 309939 - RNA, 19 nt, Bordetella pertussis
gagccaugccgucuggcgg

SEQ ID NO: 309940 - RNA, 16 nt, Bordetella pertussis
gagcccgacgcgaggc

SEQ ID NO: 309941 - RNA, 18 nt, Bordetella pertussis
gagcccgcgucggcgcgg

SEQ ID NO: 309942 - RNA, 12 nt, Bordetella pertussis
gagcccgcugcc

SEQ ID NO: 309943 - RNA, 22 nt, Bordetella pertussis
gagcccgcugccgagacggccg

SEQ ID NO: 309944 - RNA, 19 nt, Bordetella pertussis
gagcccgggcgugccugcu

SEQ ID NO: 309945 - RNA, 21 nt, Bordetella pertussis
gagccgaaguacacggccagc

SEQ ID NO: 309946 - RNA, 22 nt, Bordetella pertussis
gagccgcagguccaggccuggg

SEQ ID NO: 309947 - RNA, 16 nt, Bordetella pertussis
gagccgccccggcgcg

SEQ ID NO: 309948 - RNA, 19 nt, Bordetella pertussis
gagccgccccggcgcggcg

SEQ ID NO: 309949 - RNA, 17 nt, Bordetella pertussis
gagccgguccgccucgc

SEQ ID NO: 309950 - RNA, 22 nt, Bordetella pertussis
gagcgaauccaucaucagcaug

SEQ ID NO: 309951 - RNA, 21 nt, Bordetella pertussis
gagcgacacccgcggccaggg

SEQ ID NO: 309952 - RNA, 17 nt, Bordetella pertussis
gagcgacaugucgccgc

SEQ ID NO: 309953 - RNA, 16 nt, Bordetella pertussis
gagcgacccguggccc

SEQ ID NO: 309954 - RNA, 16 nt, Bordetella pertussis
gagcgacggcagaugg

SEQ ID NO: 309955 - RNA, 20 nt, Bordetella pertussis
gagcgcaagcaccgccugcu

SEQ ID NO: 309956 - RNA, 23 nt, Bordetella pertussis
gagcgccugcgccacguccagca

SEQ ID NO: 309957 - RNA, 23 nt, Bordetella pertussis
gagcgccucgaguuugcggucca

SEQ ID NO: 309958 - RNA, 16 nt, Bordetella pertussis
gagcgcgacagcacca

SEQ ID NO: 309959 - RNA, 21 nt, Bordetella pertussis
gagcgcgaaauccagcgcgcc

SEQ ID NO: 309960 - RNA, 22 nt, Bordetella pertussis
gagcgcgccagcacgguggcgc

SEQ ID NO: 309961 - RNA, 13 nt, Bordetella pertussis
gaggaaagcggcc

SEQ ID NO: 309962 - RNA, 18 nt, Bordetella pertussis
gaggaaccagccgucggc

SEQ ID NO: 309963 - RNA, 21 nt, Bordetella pertussis
gaggaacuggacggcgcuggg

SEQ ID NO: 309964 - RNA, 20 nt, Bordetella pertussis
gaggaacgccgcgcucagca

SEQ ID NO: 309965 - RNA, 16 nt, Bordetella pertussis
gaggaacggcaccagc

SEQ ID NO: 309966 - RNA, 13 nt, Bordetella pertussis
gaggaaggcccgc

SEQ ID NO: 309967 - RNA, 17 nt, Bordetella pertussis
gaggaaggcccgcgucu

SEQ ID NO: 309968 - RNA, 21 nt, Bordetella pertussis
gaggaucuggccggcgcuggg

SEQ ID NO: 309969 - RNA, 16 nt, Bordetella pertussis
gaggcaaucagcccca

SEQ ID NO: 309970 - RNA, 21 nt, Bordetella pertussis
gaggcacuccgucauggcgcc

SEQ ID NO: 309971 - RNA, 19 nt, Bordetella pertussis
gaggccgaguggccgcugu

SEQ ID NO: 309972 - RNA, 18 nt, Bordetella pertussis
gaggccggcgugcugucc

SEQ ID NO: 309973 - RNA, 22 nt, Bordetella pertussis
gaggcgaacauggccgagaugc

SEQ ID NO: 309974 - RNA, 17 nt, Bordetella pertussis
gaggcgauggucggccg

SEQ ID NO: 309975 - RNA, 19 nt, Bordetella pertussis
gaggcgauggucggccgga

SEQ ID NO: 309976 - RNA, 19 nt, Bordetella pertussis
gaggcgaugcugaccaccg

SEQ ID NO: 309977 - RNA, 16 nt, Bordetella pertussis
gaggcgcagcgcggca

SEQ ID NO: 309978 - RNA, 16 nt, Bordetella pertussis
gaggcgcaguccagcg

SEQ ID NO: 309979 - RNA, 16 nt, Bordetella pertussis
gaggcgcagcgcagcu

SEQ ID NO: 309980 - RNA, 19 nt, Bordetella pertussis
gaggcgccccagagcaccg

SEQ ID NO: 309981 - RNA, 13 nt, Bordetella pertussis
gaggcgcgcagcu

SEQ ID NO: 309982 - RNA, 12 nt, Bordetella pertussis
gaggcgccgcgg

SEQ ID NO: 309983 - RNA, 13 nt, Bordetella pertussis
gaggcgcggcucg

SEQ ID NO: 309984 - RNA, 18 nt, Bordetella pertussis
gaggcgcgggcagcaccg

SEQ ID NO: 309985 - RNA, 18 nt, Bordetella pertussis
gaggcgcugaugccguac

SEQ ID NO: 309986 - RNA, 15 nt, Bordetella pertussis
gaggcgcuggccggc

SEQ ID NO: 309987 - RNA, 16 nt, Bordetella pertussis
gaggcgcuggccggcg

SEQ ID NO: 309988 - RNA, 14 nt, Bordetella pertussis
gaggcgcuggcguc

SEQ ID NO: 309989 - RNA, 19 nt, Bordetella pertussis
gaggcgcuggcguccagcc

SEQ ID NO: 309990 - RNA, 19 nt, Bordetella pertussis
gaggcggccgcgggcggcg

SEQ ID NO: 309991 - RNA, 14 nt, Bordetella pertussis
gaggcggccgggcg

SEQ ID NO: 309992 - RNA, 16 nt, Bordetella pertussis
gaggcggccuugaugg

SEQ ID NO: 309993 - RNA, 15 nt, Bordetella pertussis
gaggcggcggccggg

SEQ ID NO: 309994 - RNA, 19 nt, Bordetella pertussis
gaggcgggcagcauggcgc

SEQ ID NO: 309995 - RNA, 22 nt, Bordetella pertussis
gaggcgggcagcauggcgccau

SEQ ID NO: 309996 - RNA, 15 nt, Bordetella pertussis
gaggcggggcuggcg

SEQ ID NO: 309997 - RNA, 16 nt, Bordetella pertussis
gaggcggggcuggcgc

SEQ ID NO: 309998 - RNA, 18 nt, Bordetella pertussis
gaggcggggcuggcgcgg

SEQ ID NO: 309999 - RNA, 23 nt, Bordetella pertussis
gaggcggggcuggcgcggcuggc

SEQ ID NO: 310000 - RNA, 17 nt, Bordetella pertussis
gaggcgugcugcaccug

SEQ ID NO: 310001 - RNA, 23 nt, Bordetella pertussis
gagggccacgcgcuugcgcgcca

SEQ ID NO: 310002 - RNA, 18 nt, Bordetella pertussis
gagggccggaacagcguc

SEQ ID NO: 310003 - RNA, 21 nt, Bordetella pertussis
gagggccuggucagcgccgac

SEQ ID NO: 310004 - RNA, 13 nt, Bordetella pertussis
gagggcgacggcg

SEQ ID NO: 310005 - RNA, 15 nt, Bordetella pertussis
gagggcgacggcggc

SEQ ID NO: 310006 - RNA, 14 nt, Bordetella pertussis
gagggcgcgggcca

SEQ ID NO: 310007 - RNA, 15 nt, Bordetella pertussis
gagggcggggcguga

SEQ ID NO: 310008 - RNA, 23 nt, Bordetella pertussis
gagggcggggcgugagcaggcgc

SEQ ID NO: 310009 - RNA, 22 nt, Bordetella pertussis
gaggugccguccggcaccucga

SEQ ID NO: 310010 - RNA, 21 nt, Bordetella pertussis
gaguagaaguaggcggccagg

SEQ ID NO: 310011 - RNA, 16 nt, Bordetella pertussis
gaguagcggcgcaacc

SEQ ID NO: 310012 - RNA, 13 nt, Bordetella pertussis
gaguaggccggca

SEQ ID NO: 310013 - RNA, 21 nt, Bordetella pertussis
gagucgugcaggauggcgucg

SEQ ID NO: 310014 - RNA, 13 nt, Bordetella pertussis
gagugcaggcccg

SEQ ID NO: 310015 - RNA, 13 nt, Bordetella pertussis
gagugcgaggacg

SEQ ID NO: 310016 - RNA, 17 nt, Bordetella pertussis
gaguuccgcgacgcgga

SEQ ID NO: 310017 - RNA, 14 nt, Bordetella pertussis
gaguucgcugcgaa

SEQ ID NO: 310018 - RNA, 16 nt, Bordetella pertussis
gaguuggcagaguggc

SEQ ID NO: 310019 - RNA, 22 nt, Bordetella pertussis
gaguuggcagaguggcaggagg

SEQ ID NO: 310020 - RNA, 17 nt, Bordetella pertussis
gaguuguccuggccggg

SEQ ID NO: 310021 - RNA, 17 nt, Bordetella pertussis
gauaccggcauggcagc

SEQ ID NO: 310022 - RNA, 15 nt, Bordetella pertussis
gauaccggagcggcu

SEQ ID NO: 310023 - RNA, 13 nt, Bordetella pertussis
gauacgcgccgcc

SEQ ID NO: 310024 - RNA, 17 nt, Bordetella pertussis
gauacgcgccgccuggc

SEQ ID NO: 310025 - RNA, 17 nt, Bordetella pertussis
gauagaguucggcgcgg

SEQ ID NO: 310026 - RNA, 14 nt, Bordetella pertussis
gauagcccagcacc

SEQ ID NO: 310027 - RNA, 15 nt, Bordetella pertussis
gauagcccagcaccu

SEQ ID NO: 310028 - RNA, 12 nt, Bordetella pertussis
gauagcccaggc

SEQ ID NO: 310029 - RNA, 12 nt, Bordetella pertussis
gauagccgcgcg

SEQ ID NO: 310030 - RNA, 18 nt, Bordetella pertussis
gauaggcgaagcgcggga

SEQ ID NO: 310031 - RNA, 15 nt, Bordetella pertussis
gauaggcggccaggc

SEQ ID NO: 310032 - RNA, 19 nt, Bordetella pertussis
gauauccaucggcgcgcgc

SEQ ID NO: 310033 - RNA, 17 nt, Bordetella pertussis
gauauccaucuggcccg

SEQ ID NO: 310034 - RNA, 16 nt, Bordetella pertussis
gauaucccgcucggcu

SEQ ID NO: 310035 - RNA, 14 nt, Bordetella pertussis
gauaucggccaggc

SEQ ID NO: 310036 - RNA, 17 nt, Bordetella pertussis
gaucaacgugcgccagg

SEQ ID NO: 310037 - RNA, 18 nt, Bordetella pertussis
gaucaagcggcccgcgcc

SEQ ID NO: 310038 - RNA, 19 nt, Bordetella pertussis
gaucaagcggcccgcgccc

SEQ ID NO: 310039 - RNA, 21 nt, Bordetella pertussis
gaucacccacagcagcgcgcc

SEQ ID NO: 310040 - RNA, 14 nt, Bordetella pertussis
gaucacccagcggc

SEQ ID NO: 310041 - RNA, 17 nt, Bordetella pertussis
gaucaccgcauggaacc

SEQ ID NO: 310042 - RNA, 13 nt, Bordetella pertussis
gaucaccgccaug

SEQ ID NO: 310043 - RNA, 12 nt, Bordetella pertussis
gaucaccgccgc

SEQ ID NO: 310044 - RNA, 15 nt, Bordetella pertussis
gaucaccgccgcgcc

SEQ ID NO: 310045 - RNA, 17 nt, Bordetella pertussis
gaucaccgccgcgccgc

SEQ ID NO: 310046 - RNA, 15 nt, Bordetella pertussis
gaucaccgccggcgg

SEQ ID NO: 310047 - RNA, 17 nt, Bordetella pertussis
gaucacgccgaaggcgu

SEQ ID NO: 310048 - RNA, 13 nt, Bordetella pertussis
gaucacggcgcgc

SEQ ID NO: 310049 - RNA, 16 nt, Bordetella pertussis
gaucacggcgcgcgcc

SEQ ID NO: 310050 - RNA, 17 nt, Bordetella pertussis
gaucacgugccagccga

SEQ ID NO: 310051 - RNA, 17 nt, Bordetella pertussis
gaucagaaaggcagcgg

SEQ ID NO: 310052 - RNA, 16 nt, Bordetella pertussis
gaucagcaccgcgacc

SEQ ID NO: 310053 - RNA, 19 nt, Bordetella pertussis
gaucaggucgaugccggcg

SEQ ID NO: 310054 - RNA, 20 nt, Bordetella pertussis
gaucaugccgcugaccagca

SEQ ID NO: 310055 - RNA, 14 nt, Bordetella pertussis
gaucaugccgcugc

SEQ ID NO: 310056 - RNA, 16 nt, Bordetella pertussis
gaucaugccgcugccc

SEQ ID NO: 310057 - RNA, 13 nt, Bordetella pertussis
gaucaugcgcugc

SEQ ID NO: 310058 - RNA, 23 nt, Bordetella pertussis
gaucauggcgccgauggcgccgc

SEQ ID NO: 310059 - RNA, 18 nt, Bordetella pertussis
gauccacgcccgcgccga

SEQ ID NO: 310060 - RNA, 19 nt, Bordetella pertussis
gauccacgcccgcgccgaa

SEQ ID NO: 310061 - RNA, 15 nt, Bordetella pertussis
gauccacggccggcg

SEQ ID NO: 310062 - RNA, 16 nt, Bordetella pertussis
gauccacggccggcgc

SEQ ID NO: 310063 - RNA, 19 nt, Bordetella pertussis
gauccacggccggcgcacg

SEQ ID NO: 310064 - RNA, 16 nt, Bordetella pertussis
gauccacgccgccggc

SEQ ID NO: 310065 - RNA, 18 nt, Bordetella pertussis
gauccacucggccagcgc

SEQ ID NO: 310066 - RNA, 13 nt, Bordetella pertussis
gaucccaggccgg

SEQ ID NO: 310067 - RNA, 14 nt, Bordetella pertussis
gaucccgacgaucc

SEQ ID NO: 310068 - RNA, 22 nt, Bordetella pertussis
gaucccggccacgggaccgcuc

SEQ ID NO: 310069 - RNA, 19 nt, Bordetella pertussis
gaucccggcgaucaugccg

SEQ ID NO: 310070 - RNA, 14 nt, Bordetella pertussis
gaucccggcgccag

SEQ ID NO: 310071 - RNA, 17 nt, Bordetella pertussis
gaucccggcgccagcca

SEQ ID NO: 310072 - RNA, 18 nt, Bordetella pertussis
gaucccggcgccagccag

SEQ ID NO: 310073 - RNA, 14 nt, Bordetella pertussis
gaucccggcgcugg

SEQ ID NO: 310074 - RNA, 18 nt, Bordetella pertussis
gauccgcgacgcccuggc

SEQ ID NO: 310075 - RNA, 14 nt, Bordetella pertussis
gauccgcgccaggc

SEQ ID NO: 310076 - RNA, 17 nt, Bordetella pertussis
gauccgcgggcgggccg

SEQ ID NO: 310077 - RNA, 20 nt, Bordetella pertussis
gauccgcggguauucgaagg

SEQ ID NO: 310078 - RNA, 17 nt, Bordetella pertussis
gauccggacugaacgcg

SEQ ID NO: 310079 - RNA, 12 nt, Bordetella pertussis
gauccggcgacc

SEQ ID NO: 310080 - RNA, 15 nt, Bordetella pertussis
gauccggcgaccgac

SEQ ID NO: 310081 - RNA, 17 nt, Bordetella pertussis
gauccggcgaccgacgg

SEQ ID NO: 310082 - RNA, 18 nt, Bordetella pertussis
gauccggcgaccgacggc

SEQ ID NO: 310083 - RNA, 16 nt, Bordetella pertussis
gaucgacugccccaug

SEQ ID NO: 310084 - RNA, 21 nt, Bordetella pertussis
gaucgagaaguuggcgggcgc

SEQ ID NO: 310085 - RNA, 19 nt, Bordetella pertussis
gaucgcacacaccgcguca

SEQ ID NO: 310086 - RNA, 14 nt, Bordetella pertussis
gaucgcaucgcggc

SEQ ID NO: 310087 - RNA, 20 nt, Bordetella pertussis
gaucgcauuucucggccugg

SEQ ID NO: 310088 - RNA, 21 nt, Bordetella pertussis
gaucgcauuucucggccuggg

SEQ ID NO: 310089 - RNA, 22 nt, Bordetella pertussis
gaucgcauuucucggccugggc

SEQ ID NO: 310090 - RNA, 19 nt, Bordetella pertussis
gaucgccaacgucggcagc

SEQ ID NO: 310091 - RNA, 22 nt, Bordetella pertussis
gaucgccaacgucggcagccag

SEQ ID NO: 310092 - RNA, 12 nt, Bordetella pertussis
gaucgccaccag

SEQ ID NO: 310093 - RNA, 13 nt, Bordetella pertussis
gaucgccagcgcc

SEQ ID NO: 310094 - RNA, 21 nt, Bordetella pertussis
gaucgccaugacgcuggucga

SEQ ID NO: 310095 - RNA, 16 nt, Bordetella pertussis
gaucgccuggggcggg

SEQ ID NO: 310096 - RNA, 19 nt, Bordetella pertussis
gaucgccuggggcgggcgc

SEQ ID NO: 310097 - RNA, 13 nt, Bordetella pertussis
gaucgcgauggcc

SEQ ID NO: 310098 - RNA, 23 nt, Bordetella pertussis
gaucgcgcacagcauggccacca

SEQ ID NO: 310099 - RNA, 20 nt, Bordetella pertussis
gaucgcgcagcaccgccagc

SEQ ID NO: 310100 - RNA, 12 nt, Bordetella pertussis
gaucgcgcagcg

SEQ ID NO: 310101 - RNA, 15 nt, Bordetella pertussis
gaucgcgcagcgccu

SEQ ID NO: 310102 - RNA, 18 nt, Bordetella pertussis
gaucgcgcagcgccuggc

SEQ ID NO: 310103 - RNA, 13 nt, Bordetella pertussis
gaucgcgcccagc

SEQ ID NO: 310104 - RNA, 22 nt, Bordetella pertussis
gaucgcgcccagcgagcugcgc

SEQ ID NO: 310105 - RNA, 13 nt, Bordetella pertussis
gaucgcgccgacg

SEQ ID NO: 310106 - RNA, 14 nt, Bordetella pertussis
gaucgcgccgacga

SEQ ID NO: 310107 - RNA, 16 nt, Bordetella pertussis
gaucgcgccgacgacc

SEQ ID NO: 310108 - RNA, 17 nt, Bordetella pertussis
gaucgcgccgacgaccg

SEQ ID NO: 310109 - RNA, 15 nt, Bordetella pertussis
gaucgcgcuggaccg

SEQ ID NO: 310110 - RNA, 13 nt, Bordetella pertussis
gaucgcggccagc

SEQ ID NO: 310111 - RNA, 14 nt, Bordetella pertussis
gaucgcggccagcc

SEQ ID NO: 310112 - RNA, 15 nt, Bordetella pertussis
gaucgcggccagccg

SEQ ID NO: 310113 - RNA, 12 nt, Bordetella pertussis
gaucgcggcgcg

SEQ ID NO: 310114 - RNA, 15 nt, Bordetella pertussis
gaucgcggcgcggcu

SEQ ID NO: 310115 - RNA, 13 nt, Bordetella pertussis
gaucgcggcgcug

SEQ ID NO: 310116 - RNA, 15 nt, Bordetella pertussis
gaucgcggcgcuggc

SEQ ID NO: 310117 - RNA, 17 nt, Bordetella pertussis
gaucgcggcgcuggcga

SEQ ID NO: 310118 - RNA, 12 nt, Bordetella pertussis
gaucgcggcggg

SEQ ID NO: 310119 - RNA, 15 nt, Bordetella pertussis
gaucgcggcuccagc

SEQ ID NO: 310120 - RNA, 23 nt, Bordetella pertussis
gaucgcgucggccaaggccggcg

SEQ ID NO: 310121 - RNA, 23 nt, Bordetella pertussis
gaucggagaaaucgccgccggcg

SEQ ID NO: 310122 - RNA, 12 nt, Bordetella pertussis
gaucggccacga

SEQ ID NO: 310123 - RNA, 11 nt, Bordetella pertussis
gaucggccagg

SEQ ID NO: 310124 - RNA, 15 nt, Bordetella pertussis
gaucggccaggccgg

SEQ ID NO: 310125 - RNA, 16 nt, Bordetella pertussis
gaucggccaggccggc

SEQ ID NO: 310126 - RNA, 17 nt, Bordetella pertussis
gaucggccaggccggcc

SEQ ID NO: 310127 - RNA, 16 nt, Bordetella pertussis
gaucggcccggcgccg

SEQ ID NO: 310128 - RNA, 17 nt, Bordetella pertussis
gaucggcccgggcgugg

SEQ ID NO: 310129 - RNA, 18 nt, Bordetella pertussis
gaucggcccgggcguggc

SEQ ID NO: 310130 - RNA, 19 nt, Bordetella pertussis
gaucggcccgggcguggcg

SEQ ID NO: 310131 - RNA, 12 nt, Bordetella pertussis
gaucggccggcc

SEQ ID NO: 310132 - RNA, 14 nt, Bordetella pertussis
gaucggccggccgg

SEQ ID NO: 310133 - RNA, 16 nt, Bordetella pertussis
gaucggccggccgggc

SEQ ID NO: 310134 - RNA, 16 nt, Bordetella pertussis
gaucggccucggucuc

SEQ ID NO: 310135 - RNA, 22 nt, Bordetella pertussis
gaucggccugaaccaggccgcc

SEQ ID NO: 310136 - RNA, 13 nt, Bordetella pertussis
gaucggcgccgcg

SEQ ID NO: 310137 - RNA, 15 nt, Bordetella pertussis
gaucggcgccuggcc

SEQ ID NO: 310138 - RNA, 22 nt, Bordetella pertussis
gaucggcgccuggccgcccagc

SEQ ID NO: 310139 - RNA, 13 nt, Bordetella pertussis
gaucggcgcgccc

SEQ ID NO: 310140 - RNA, 17 nt, Bordetella pertussis
gaucggcgcuggccugg

SEQ ID NO: 310141 - RNA, 20 nt, Bordetella pertussis
gaucggcgcuggccuggccg

SEQ ID NO: 310142 - RNA, 21 nt, Bordetella pertussis
gaucggcgcuggccuggccgc

SEQ ID NO: 310143 - RNA, 15 nt, Bordetella pertussis
gaucggcggccuggg

SEQ ID NO: 310144 - RNA, 16 nt, Bordetella pertussis
gaucggcggccugggc

SEQ ID NO: 310145 - RNA, 18 nt, Bordetella pertussis
gaucggcgucagcgccca

SEQ ID NO: 310146 - RNA, 18 nt, Bordetella pertussis
gaucggcguggucgcagu

SEQ ID NO: 310147 - RNA, 18 nt, Bordetella pertussis
gaucggcuugccgcgcgg

SEQ ID NO: 310148 - RNA, 20 nt, Bordetella pertussis
gaucggcuugccgcgcggcg

SEQ ID NO: 310149 - RNA, 15 nt, Bordetella pertussis
gaucgggcagcuugg

SEQ ID NO: 310150 - RNA, 22 nt, Bordetella pertussis
gaucgggcagcuuggcgcgccg

SEQ ID NO: 310151 - RNA, 23 nt, Bordetella pertussis
gaucggggcaacgacgcaggcgc

SEQ ID NO: 310152 - RNA, 18 nt, Bordetella pertussis
gaucgucaccaucgccgc

SEQ ID NO: 310153 - RNA, 22 nt, Bordetella pertussis
gaucguccugaaucgcccgggc

SEQ ID NO: 310154 - RNA, 15 nt, Bordetella pertussis
gaucgucgcugcgcg

SEQ ID NO: 310155 - RNA, 17 nt, Bordetella pertussis
gaucgucuugaccagca

SEQ ID NO: 310156 - RNA, 19 nt, Bordetella pertussis
gaucgucuugaccagcagg

SEQ ID NO: 310157 - RNA, 21 nt, Bordetella pertussis
gaucgugcacgcccgcggcgc

SEQ ID NO: 310158 - RNA, 20 nt, Bordetella pertussis
gaucgugcccagcuggcacc

SEQ ID NO: 310159 - RNA, 14 nt, Bordetella pertussis
gaucgugcgccacu

SEQ ID NO: 310160 - RNA, 24 nt, Bordetella pertussis
gaucgugcgccacuucgccucggc

SEQ ID NO: 310161 - RNA, 22 nt, Bordetella pertussis
gaucguucccuacccgccgggc

SEQ ID NO: 310162 - RNA, 15 nt, Bordetella pertussis
gaucuacgacgccug

SEQ ID NO: 310163 - RNA, 17 nt, Bordetella pertussis
gaucuacgacgccugga

SEQ ID NO: 310164 - RNA, 22 nt, Bordetella pertussis
gaucuacgacgccuggaccggc

SEQ ID NO: 310165 - RNA, 15 nt, Bordetella pertussis
gaucucgcgcaccga

SEQ ID NO: 310166 - RNA, 14 nt, Bordetella pertussis
gaucucggccagca

SEQ ID NO: 310167 - RNA, 13 nt, Bordetella pertussis
gaucucggccugc

SEQ ID NO: 310168 - RNA, 20 nt, Bordetella pertussis
gaucucgggcaggucggcca

SEQ ID NO: 310169 - RNA, 16 nt, Bordetella pertussis
gaucucgucgaccgcc

SEQ ID NO: 310170 - RNA, 21 nt, Bordetella pertussis
gaucugcgagccuucggccgg

SEQ ID NO: 310171 - RNA, 14 nt, Bordetella pertussis
gaucugcgcggcgg

SEQ ID NO: 310172 - RNA, 14 nt, Bordetella pertussis
gaucugcggcgugg

SEQ ID NO: 310173 - RNA, 18 nt, Bordetella pertussis
gaucugcuugaggccgcg

SEQ ID NO: 310174 - RNA, 16 nt, Bordetella pertussis
gaucugcugggccggg

SEQ ID NO: 310175 - RNA, 23 nt, Bordetella pertussis
gaucuggcaaucgggguggcgcc

SEQ ID NO: 310176 - RNA, 23 nt, Bordetella pertussis
gaucuggccgauggccucgcugc

SEQ ID NO: 310177 - RNA, 21 nt, Bordetella pertussis
gaucuggcgcgucaggccggg

SEQ ID NO: 310178 - RNA, 13 nt, Bordetella pertussis
gaugcggcgccac

SEQ ID NO: 310179 - RNA, 22 nt, Bordetella pertussis
gaugcggcgccacgcagaaggc

SEQ ID NO: 310180 - RNA, 15 nt, Bordetella pertussis
gaugcggcgcaugcu

SEQ ID NO: 310181 - RNA, 22 nt, Bordetella pertussis
gaugcggcgcgccgcgucggug

SEQ ID NO: 310182 - RNA, 15 nt, Bordetella pertussis
gaugcgggccacgcc

SEQ ID NO: 310183 - RNA, 17 nt, Bordetella pertussis
gaugcgggccacgccgg

SEQ ID NO: 310184 - RNA, 20 nt, Bordetella pertussis
gaugcgggccacgccggccg

SEQ ID NO: 310185 - RNA, 22 nt, Bordetella pertussis
gaugcgggccacgccggccggg

SEQ ID NO: 310186 - RNA, 16 nt, Bordetella pertussis
gaugcgggcaucgccc

SEQ ID NO: 310187 - RNA, 14 nt, Bordetella pertussis
gaugcgggcggcgg

SEQ ID NO: 310188 - RNA, 20 nt, Bordetella pertussis
gaugcgggggaugaacagcg

SEQ ID NO: 310189 - RNA, 20 nt, Bordetella pertussis
gaugcggguacuggccgacg

SEQ ID NO: 310190 - RNA, 14 nt, Bordetella pertussis
gaugcgggucggcg

SEQ ID NO: 310191 - RNA, 20 nt, Bordetella pertussis
gaugcgggucggcgccauga

SEQ ID NO: 310192 - RNA, 15 nt, Bordetella pertussis
gaugcgguaccacgc

SEQ ID NO: 310193 - RNA, 17 nt, Bordetella pertussis
gaugcgguaccacgcga

SEQ ID NO: 310194 - RNA, 20 nt, Bordetella pertussis
gaugcgguacugcggcgccu

SEQ ID NO: 310195 - RNA, 18 nt, Bordetella pertussis
gaugcgguaggcccagca

SEQ ID NO: 310196 - RNA, 14 nt, Bordetella pertussis
gaugcggucggcca

SEQ ID NO: 310197 - RNA, 14 nt, Bordetella pertussis
gaugcggucggccg

SEQ ID NO: 310198 - RNA, 17 nt, Bordetella pertussis
gaugcggucggccgcgc

SEQ ID NO: 310199 - RNA, 22 nt, Bordetella pertussis
gaugcgguugaucagggccgcc

SEQ ID NO: 310200 - RNA, 20 nt, Bordetella pertussis
gaugcgguuguugccgcguc

SEQ ID NO: 310201 - RNA, 22 nt, Bordetella pertussis
gaugcuggcgcggaccugcucg

SEQ ID NO: 310202 - RNA, 18 nt, Bordetella pertussis
gaugcuggucagccuggg

SEQ ID NO: 310203 - RNA, 15 nt, Bordetella pertussis
gaugcuugcggggca

SEQ ID NO: 310204 - RNA, 20 nt, Bordetella pertussis
gauggaaucauuggccagcg

SEQ ID NO: 310205 - RNA, 22 nt, Bordetella pertussis
gauggaaucauuggccagcgcg

SEQ ID NO: 310206 - RNA, 12 nt, Bordetella pertussis
gauggaacucgu

SEQ ID NO: 310207 - RNA, 14 nt, Bordetella pertussis
gauggccagcgcgc

SEQ ID NO: 310208 - RNA, 15 nt, Bordetella pertussis
gauggccagcgcgcg

SEQ ID NO: 310209 - RNA, 16 nt, Bordetella pertussis
gauggccagcgcgcgg

SEQ ID NO: 310210 - RNA, 15 nt, Bordetella pertussis
gauggccaucgacgc

SEQ ID NO: 310211 - RNA, 18 nt, Bordetella pertussis
gauggccagguggcggcg

SEQ ID NO: 310212 - RNA, 12 nt, Bordetella pertussis
gauggcccaggg

SEQ ID NO: 310213 - RNA, 21 nt, Bordetella pertussis
gauggcccagggcagcggcca

SEQ ID NO: 310214 - RNA, 22 nt, Bordetella pertussis
gauggcccgcagguggggcagc

SEQ ID NO: 310215 - RNA, 20 nt, Bordetella pertussis
gauggcccgguaggccacgc

SEQ ID NO: 310216 - RNA, 15 nt, Bordetella pertussis
gauggccgacauguc

SEQ ID NO: 310217 - RNA, 17 nt, Bordetella pertussis
gauggccgaaucguuca

SEQ ID NO: 310218 - RNA, 16 nt, Bordetella pertussis
gauggccgccagcggc

SEQ ID NO: 310219 - RNA, 23 nt, Bordetella pertussis
gauggccgccagcguaucgccgc

SEQ ID NO: 310220 - RNA, 21 nt, Bordetella pertussis
gauggccuuuuccaggcgugc

SEQ ID NO: 310221 - RNA, 20 nt, Bordetella pertussis
gauggcgauguaggccaggu

SEQ ID NO: 310222 - RNA, 22 nt, Bordetella pertussis
gauggcgcaauaggccgcgaug

SEQ ID NO: 310223 - RNA, 20 nt, Bordetella pertussis
gauggcgcaggcgcgccagg

SEQ ID NO: 310224 - RNA, 12 nt, Bordetella pertussis
gauggcgccagc

SEQ ID NO: 310225 - RNA, 16 nt, Bordetella pertussis
gauggcgcccacggcc

SEQ ID NO: 310226 - RNA, 14 nt, Bordetella pertussis
gauggcgccggcca

SEQ ID NO: 310227 - RNA, 16 nt, Bordetella pertussis
gauggcgccggccagc

SEQ ID NO: 310228 - RNA, 17 nt, Bordetella pertussis
gauggcgcgcgccacca

SEQ ID NO: 310229 - RNA, 12 nt, Bordetella pertussis
gauggcgcgcgg

SEQ ID NO: 310230 - RNA, 17 nt, Bordetella pertussis
gauggcgcgcggcuggg

SEQ ID NO: 310231 - RNA, 12 nt, Bordetella pertussis
gauggcggcggc

SEQ ID NO: 310232 - RNA, 13 nt, Bordetella pertussis
gauggcggcggcg

SEQ ID NO: 310233 - RNA, 20 nt, Bordetella pertussis
gauggcgggguuggccgcca

SEQ ID NO: 310234 - RNA, 22 nt, Bordetella pertussis
gauggcgggguuggccgccagg

SEQ ID NO: 310235 - RNA, 17 nt, Bordetella pertussis
gauggcggucaccaacg

SEQ ID NO: 310236 - RNA, 17 nt, Bordetella pertussis
gauggcgguggugggca

SEQ ID NO: 310237 - RNA, 17 nt, Bordetella pertussis
gauggcguacagcaggg

SEQ ID NO: 310238 - RNA, 13 nt, Bordetella pertussis
gauggcguaggcg

SEQ ID NO: 310239 - RNA, 17 nt, Bordetella pertussis
gauggcguccagcagca

SEQ ID NO: 310240 - RNA, 19 nt, Bordetella pertussis
gauggcgugcacgcguaug

SEQ ID NO: 310241 - RNA, 14 nt, Bordetella pertussis
gauggcguugaugu

SEQ ID NO: 310242 - RNA, 17 nt, Bordetella pertussis
gauggcguugcgcacca

SEQ ID NO: 310243 - RNA, 13 nt, Bordetella pertussis
gaugggcgcgcgc

SEQ ID NO: 310244 - RNA, 17 nt, Bordetella pertussis
gaugggcgcgcgcaucg

SEQ ID NO: 310245 - RNA, 13 nt, Bordetella pertussis
gaugggcgcggcg

SEQ ID NO: 310246 - RNA, 15 nt, Bordetella pertussis
gaugggcgcggcgcg

SEQ ID NO: 310247 - RNA, 20 nt, Bordetella pertussis
gaugggcgcggcgcgcgccg

SEQ ID NO: 310248 - RNA, 12 nt, Bordetella pertussis
gaugggcggcga

SEQ ID NO: 310249 - RNA, 17 nt, Bordetella pertussis
gauggggccgggcgcca

SEQ ID NO: 310250 - RNA, 15 nt, Bordetella pertussis
gauggggccgucgcc

SEQ ID NO: 310251 - RNA, 19 nt, Bordetella pertussis
gaugggccugcccauggcc

SEQ ID NO: 310252 - RNA, 17 nt, Bordetella pertussis
gauggguacagcgcgcc

SEQ ID NO: 310253 - RNA, 17 nt, Bordetella pertussis
gauggguacgccggccu

SEQ ID NO: 310254 - RNA, 22 nt, Bordetella pertussis
gauggguacgccggccugacgc

SEQ ID NO: 310255 - RNA, 20 nt, Bordetella pertussis
gauggugccgguggugccca

SEQ ID NO: 310256 - RNA, 14 nt, Bordetella pertussis
gauggugcgggcga

SEQ ID NO: 310257 - RNA, 16 nt, Bordetella pertussis
gauggugucgaagccg

SEQ ID NO: 310258 - RNA, 19 nt, Bordetella pertussis
gauguccacggucgccggc

SEQ ID NO: 310259 - RNA, 19 nt, Bordetella pertussis
gauguccagcgccagcagg

SEQ ID NO: 310260 - RNA, 16 nt, Bordetella pertussis
gauguccauggccugc

SEQ ID NO: 310261 - RNA, 14 nt, Bordetella pertussis
gauguccggcgcga

SEQ ID NO: 310262 - RNA, 17 nt, Bordetella pertussis
gauguccugcaggcccg

SEQ ID NO: 310263 - RNA, 13 nt, Bordetella pertussis
gaugucgaacagc

SEQ ID NO: 310264 - RNA, 16 nt, Bordetella pertussis
gaugucgugaucgcca

SEQ ID NO: 310265 - RNA, 17 nt, Bordetella pertussis
gaugucgugaucgccag

SEQ ID NO: 310266 - RNA, 19 nt, Bordetella pertussis
gaugucgugaucgccagcg

SEQ ID NO: 310267 - RNA, 15 nt, Bordetella pertussis
gaugugcaggccgag

SEQ ID NO: 310268 - RNA, 18 nt, Bordetella pertussis
gaugugcaugccgucgcg

SEQ ID NO: 310269 - RNA, 16 nt, Bordetella pertussis
gaugugcggcguggcg

SEQ ID NO: 310270 - RNA, 17 nt, Bordetella pertussis
gaugugcggcguggcgg

SEQ ID NO: 310271 - RNA, 19 nt, Bordetella pertussis
gaugugcggcguggcgggg

SEQ ID NO: 310272 - RNA, 20 nt, Bordetella pertussis
gaugugcggcguggcggggc

SEQ ID NO: 310273 - RNA, 23 nt, Bordetella pertussis
gaugugcggcguggcggggcguu

SEQ ID NO: 310274 - RNA, 21 nt, Bordetella pertussis
gauuagccucguuggucagca

SEQ ID NO: 310275 - RNA, 16 nt, Bordetella pertussis
gauuaugccgcccgca

SEQ ID NO: 310276 - RNA, 15 nt, Bordetella pertussis
gauuccagcgccgcc

SEQ ID NO: 310277 - RNA, 24 nt, Bordetella pertussis
gauucccaggcccggccgcagggc

SEQ ID NO: 310278 - RNA, 21 nt, Bordetella pertussis
gauuccugucgcgcugcuuuc

SEQ ID NO: 310279 - RNA, 13 nt, Bordetella pertussis
gauucggucgcca

SEQ ID NO: 310280 - RNA, 23 nt, Bordetella pertussis
gauucuugaaaaagcugccggca

SEQ ID NO: 310281 - RNA, 17 nt, Bordetella pertussis
gauuggacagcaguucg

SEQ ID NO: 310282 - RNA, 17 nt, Bordetella pertussis
gauuggccgagcgcgga

SEQ ID NO: 310283 - RNA, 22 nt, Bordetella pertussis
gauuggcgaaaggcaccgagca

SEQ ID NO: 310284 - RNA, 18 nt, Bordetella pertussis
gauuucgcgaugcucgau

SEQ ID NO: 310285 - RNA, 20 nt, Bordetella pertussis
gauuucgcgcgccagcgcgg

SEQ ID NO: 310286 - RNA, 21 nt, Bordetella pertussis
gauuucgcgcgccagcgcggc

SEQ ID NO: 310287 - RNA, 22 nt, Bordetella pertussis
gauuucgcgcgccagcgcggcg

SEQ ID NO: 310288 - RNA, 23 nt, Bordetella pertussis
gauuucgggugaggggccagccu

SEQ ID NO: 310289 - RNA, 16 nt, Bordetella pertussis
gauuucuucgccuggc

SEQ ID NO: 310290 - RNA, 21 nt, Bordetella pertussis
gauuucuucgccuggccggcu

SEQ ID NO: 310291 - RNA, 18 nt, Bordetella pertussis
gcaaaagcguuccagcag

SEQ ID NO: 310292 - RNA, 23 nt, Bordetella pertussis
gcaaacaggcugcugugccugcc

SEQ ID NO: 310293 - RNA, 14 nt, Bordetella pertussis
gcaaagccugacgg

SEQ ID NO: 310294 - RNA, 15 nt, Bordetella pertussis
gcaaagccugacggc

SEQ ID NO: 310295 - RNA, 23 nt, Bordetella pertussis
gcaaaguagugcccccacgcugc

SEQ ID NO: 310296 - RNA, 23 nt, Bordetella pertussis
gcaaagucggggcgccggucgug

SEQ ID NO: 310297 - RNA, 14 nt, Bordetella pertussis
gcaacaaccgcgcc

SEQ ID NO: 310298 - RNA, 21 nt, Bordetella pertussis
gcaaccagcucagcuuggcgu

SEQ ID NO: 310299 - RNA, 16 nt, Bordetella pertussis
gcaacccagcagcggc

SEQ ID NO: 310300 - RNA, 20 nt, Bordetella pertussis
gcaacccgcccggguuggcg

SEQ ID NO: 310301 - RNA, 22 nt, Bordetella pertussis
gcaacccgcccuugccagggcc

SEQ ID NO: 310302 - RNA, 19 nt, Bordetella pertussis
gcaacccgcuuuuuccugc

SEQ ID NO: 310303 - RNA, 17 nt, Bordetella pertussis
gcaaccgccacgugcug

SEQ ID NO: 310304 - RNA, 13 nt, Bordetella pertussis
gcaaccggcccga

SEQ ID NO: 310305 - RNA, 15 nt, Bordetella pertussis
gcaaccggucggccg

SEQ ID NO: 310306 - RNA, 16 nt, Bordetella pertussis
gcaaccggucggccgg

SEQ ID NO: 310307 - RNA, 17 nt, Bordetella pertussis
gcaaccggucggccggc

SEQ ID NO: 310308 - RNA, 18 nt, Bordetella pertussis
gcaaccggucggccggca

SEQ ID NO: 310309 - RNA, 23 nt, Bordetella pertussis
gcaaccggucggccggcagcggc

SEQ ID NO: 310310 - RNA, 18 nt, Bordetella pertussis
gcaaccgucgccagcgcg

SEQ ID NO: 310311 - RNA, 19 nt, Bordetella pertussis
gcaaccgucgccagcgcgu

SEQ ID NO: 310312 - RNA, 13 nt, Bordetella pertussis
gcaaccucgccgc

SEQ ID NO: 310313 - RNA, 16 nt, Bordetella pertussis
gcaaccugcacgcggg

SEQ ID NO: 310314 - RNA, 13 nt, Bordetella pertussis
gcaaccuggucaa

SEQ ID NO: 310315 - RNA, 18 nt, Bordetella pertussis
gcaaccuggucaagggcg

SEQ ID NO: 310316 - RNA, 20 nt, Bordetella pertussis
gcaaccuggucaagggcggc

SEQ ID NO: 310317 - RNA, 21 nt, Bordetella pertussis
gcaaccuggucaagggcggcc

SEQ ID NO: 310318 - RNA, 15 nt, Bordetella pertussis
gcaacgacgcaggcg

SEQ ID NO: 310319 - RNA, 19 nt, Bordetella pertussis
gcaacgacgcaggcgccgc

SEQ ID NO: 310320 - RNA, 21 nt, Bordetella pertussis
gcaacgacgcaggcgccgcac

SEQ ID NO: 310321 - RNA, 15 nt, Bordetella pertussis
gcaacgccacgcgcg

SEQ ID NO: 310322 - RNA, 18 nt, Bordetella pertussis
gcaacgccacgcgcggau

SEQ ID NO: 310323 - RNA, 19 nt, Bordetella pertussis
gcaacgcaggcgccgcccc

SEQ ID NO: 310324 - RNA, 14 nt, Bordetella pertussis
gcaacgcaugcgcg

SEQ ID NO: 310325 - RNA, 20 nt, Bordetella pertussis
gcaacgccgccaccagggcg

SEQ ID NO: 310326 - RNA, 21 nt, Bordetella pertussis
gcaacgccgcccguccgggcg

SEQ ID NO: 310327 - RNA, 19 nt, Bordetella pertussis
gcaacgccgccggcagggc

SEQ ID NO: 310328 - RNA, 18 nt, Bordetella pertussis
gcaacgccggccauggcg

SEQ ID NO: 310329 - RNA, 18 nt, Bordetella pertussis
gcaacgccggccgccaug

SEQ ID NO: 310330 - RNA, 16 nt, Bordetella pertussis
gcaacgccggcggcac

SEQ ID NO: 310331 - RNA, 22 nt, Bordetella pertussis
gcaacgccgggucgaggucgau

SEQ ID NO: 310332 - RNA, 18 nt, Bordetella pertussis
gcaacgggucgcgcagca

SEQ ID NO: 310333 - RNA, 16 nt, Bordetella pertussis
gcaacgggccggccgc

SEQ ID NO: 310334 - RNA, 18 nt, Bordetella pertussis
gcaacggugagccggcca

SEQ ID NO: 310335 - RNA, 14 nt, Bordetella pertussis
gcaacgucgaacag

SEQ ID NO: 310336 - RNA, 15 nt, Bordetella pertussis
gcaacgugcgcacgc

SEQ ID NO: 310337 - RNA, 17 nt, Bordetella pertussis
gcaacuccacgcccugc

SEQ ID NO: 310338 - RNA, 17 nt, Bordetella pertussis
gcaacucggccaccugg

SEQ ID NO: 310339 - RNA, 14 nt, Bordetella pertussis
gcaacugguuggcc

SEQ ID NO: 310340 - RNA, 17 nt, Bordetella pertussis
gcaagaaucgacucggc

SEQ ID NO: 310341 - RNA, 20 nt, Bordetella pertussis
gcaagaaucgacucggccga

SEQ ID NO: 310342 - RNA, 14 nt, Bordetella pertussis
gcaagaagauccgc

SEQ ID NO: 310343 - RNA, 13 nt, Bordetella pertussis
gcaagacgcggca

SEQ ID NO: 310344 - RNA, 12 nt, Bordetella pertussis
gcaagagccugg

SEQ ID NO: 310345 - RNA, 16 nt, Bordetella pertussis
gcaagauuucauggcg

SEQ ID NO: 310346 - RNA, 17 nt, Bordetella pertussis
gcaagauuucauggcgu

SEQ ID NO: 310347 - RNA, 20 nt, Bordetella pertussis
gcaagcauuugcgcgacggc

SEQ ID NO: 310348 - RNA, 12 nt, Bordetella pertussis
gcaagccagcac

SEQ ID NO: 310349 - RNA, 19 nt, Bordetella pertussis
gcaagccagggcaggaggc

SEQ ID NO: 310350 - RNA, 13 nt, Bordetella pertussis
gcaagcccaccgg

SEQ ID NO: 310351 - RNA, 15 nt, Bordetella pertussis
gcaagcccaccgggc

SEQ ID NO: 310352 - RNA, 19 nt, Bordetella pertussis
gcaagcccaccgggccggc

SEQ ID NO: 310353 - RNA, 19 nt, Bordetella pertussis
gcaagcccaggcggcccag

SEQ ID NO: 310354 - RNA, 14 nt, Bordetella pertussis
gcaagccccaggca

SEQ ID NO: 310355 - RNA, 15 nt, Bordetella pertussis
gcaagcccggcacgg

SEQ ID NO: 310356 - RNA, 14 nt, Bordetella pertussis
gcaagccgauccgc

SEQ ID NO: 310357 - RNA, 22 nt, Bordetella pertussis
gcaagccgcccggccggcacgg

SEQ ID NO: 310358 - RNA, 19 nt, Bordetella pertussis
gcaagccggccgcgccgcg

SEQ ID NO: 310359 - RNA, 18 nt, Bordetella pertussis
gcaagccggccgcgcggc

SEQ ID NO: 310360 - RNA, 17 nt, Bordetella pertussis
gcaagccuugcggcccu

SEQ ID NO: 310361 - RNA, 15 nt, Bordetella pertussis
gcaagcggccggccu

SEQ ID NO: 310362 - RNA, 20 nt, Bordetella pertussis
gcaagcggcguggggccggc

SEQ ID NO: 310363 - RNA, 22 nt, Bordetella pertussis
gcaagcugcugcuggaccuggc

SEQ ID NO: 310364 - RNA, 18 nt, Bordetella pertussis
gcaagcugcuggcgcgcc

SEQ ID NO: 310365 - RNA, 19 nt, Bordetella pertussis
gcaagcuggccgaugucgc

SEQ ID NO: 310366 - RNA, 20 nt, Bordetella pertussis
gcaagcuggcggcgcgcggc

SEQ ID NO: 310367 - RNA, 17 nt, Bordetella pertussis
gcaaggaaguggccgag

SEQ ID NO: 310368 - RNA, 18 nt, Bordetella pertussis
gcaaggaaguggccgagc

SEQ ID NO: 310369 - RNA, 15 nt, Bordetella pertussis
gcaaggacaaggcgc

SEQ ID NO: 310370 - RNA, 18 nt, Bordetella pertussis
gcaaggaccaugcgcugg

SEQ ID NO: 310371 - RNA, 17 nt, Bordetella pertussis
gcaaggcaugcgccagc

SEQ ID NO: 310372 - RNA, 18 nt, Bordetella pertussis
gcaaggcaugcgccagcg

SEQ ID NO: 310373 - RNA, 19 nt, Bordetella pertussis
gcaaggcccgccgcggcag

SEQ ID NO: 310374 - RNA, 22 nt, Bordetella pertussis
gcaaggccgcgaacgcgccggc

SEQ ID NO: 310375 - RNA, 17 nt, Bordetella pertussis
gcaaggccugccaaaga

SEQ ID NO: 310376 - RNA, 14 nt, Bordetella pertussis
gcaaggccggcggc

SEQ ID NO: 310377 - RNA, 16 nt, Bordetella pertussis
gcaaggccggcggcac

SEQ ID NO: 310378 - RNA, 14 nt, Bordetella pertussis
gcaaggcgcgccac

SEQ ID NO: 310379 - RNA, 22 nt, Bordetella pertussis
gcaaggcgcgccaccggucgcc

SEQ ID NO: 310380 - RNA, 15 nt, Bordetella pertussis
gcaaggcggcccggc

SEQ ID NO: 310381 - RNA, 13 nt, Bordetella pertussis
gcaaggcgggcug

SEQ ID NO: 310382 - RNA, 20 nt, Bordetella pertussis
gcaaggcgggcuggucgcgc

SEQ ID NO: 310383 - RNA, 18 nt, Bordetella pertussis
gcaaggcgucggccaggc

SEQ ID NO: 310384 - RNA, 14 nt, Bordetella pertussis
gcaagggagaccgg

SEQ ID NO: 310385 - RNA, 20 nt, Bordetella pertussis
gcaagggccagucguucagc

SEQ ID NO: 310386 - RNA, 14 nt, Bordetella pertussis
gcaagggccccagc

SEQ ID NO: 310387 - RNA, 22 nt, Bordetella pertussis
gcaagggcgucuucgccgacca

SEQ ID NO: 310388 - RNA, 17 nt, Bordetella pertussis
gcaaggggccggcgccg

SEQ ID NO: 310389 - RNA, 15 nt, Bordetella pertussis
gcaagggggacuggc

SEQ ID NO: 310390 - RNA, 17 nt, Bordetella pertussis
gcaagggguccguggcg

SEQ ID NO: 310391 - RNA, 22 nt, Bordetella pertussis
gcaagggugccuguccccgcgg

SEQ ID NO: 310392 - RNA, 22 nt, Bordetella pertussis
gcaagguagccgaugaccggcc

SEQ ID NO: 310393 - RNA, 17 nt, Bordetella pertussis
gcaagguggcgugcagc

SEQ ID NO: 310394 - RNA, 23 nt, Bordetella pertussis
gcaaguguggcgcaccgcgcugg

SEQ ID NO: 310395 - RNA, 17 nt, Bordetella pertussis
gcaaguucaucaucgcc

SEQ ID NO: 310396 - RNA, 20 nt, Bordetella pertussis
gcaaguucaucaucgccgac

SEQ ID NO: 310397 - RNA, 18 nt, Bordetella pertussis
gcaauaccuucagcccgg

SEQ ID NO: 310398 - RNA, 20 nt, Bordetella pertussis
gcaauaccuucagcccggcg

SEQ ID NO: 310399 - RNA, 19 nt, Bordetella pertussis
gcaaucagccccaggcgcg

SEQ ID NO: 310400 - RNA, 20 nt, Bordetella pertussis
gcaaucagccccaggcgcgu

SEQ ID NO: 310401 - RNA, 23 nt, Bordetella pertussis
gcaaucccggcgacaccgcggcc

SEQ ID NO: 310402 - RNA, 21 nt, Bordetella pertussis
gcaaucgacgaacaaggccgg

SEQ ID NO: 310403 - RNA, 24 nt, Bordetella pertussis
gcaaucgaugaagaucaggcggcu

SEQ ID NO: 310404 - RNA, 21 nt, Bordetella pertussis
gcaaucgaugaucacgcgcuc

SEQ ID NO: 310405 - RNA, 21 nt, Bordetella pertussis
gcaaucggagguaugcacgac

SEQ ID NO: 310406 - RNA, 18 nt, Bordetella pertussis
gcaaucgggguggcgccg

SEQ ID NO: 310407 - RNA, 14 nt, Bordetella pertussis
gcaaugcgcaggcc

SEQ ID NO: 310408 - RNA, 16 nt, Bordetella pertussis
gcaaugcgcaggcccg

SEQ ID NO: 310409 - RNA, 18 nt, Bordetella pertussis
gcaaugcgcaggcccgac

SEQ ID NO: 310410 - RNA, 13 nt, Bordetella pertussis
gcaaugcgcgcgc

SEQ ID NO: 310411 - RNA, 13 nt, Bordetella pertussis
gcaaugcgcggcg

SEQ ID NO: 310412 - RNA, 18 nt, Bordetella pertussis
gcaaugcggccaggcccg

SEQ ID NO: 310413 - RNA, 21 nt, Bordetella pertussis
gcaauggacacagcggcgcga

SEQ ID NO: 310414 - RNA, 15 nt, Bordetella pertussis
gcaaugguccagcag

SEQ ID NO: 310415 - RNA, 14 nt, Bordetella pertussis
gcaaugucgcaggc

SEQ ID NO: 310416 - RNA, 17 nt, Bordetella pertussis
gcaaugucgcaggccgc

SEQ ID NO: 310417 - RNA, 13 nt, Bordetella pertussis
gcacaaccuggcg

SEQ ID NO: 310418 - RNA, 16 nt, Bordetella pertussis
gcacaccagcgccagg

SEQ ID NO: 310419 - RNA, 17 nt, Bordetella pertussis
gcacaccagcgccagga

SEQ ID NO: 310420 - RNA, 13 nt, Bordetella pertussis
gcacaccgucacg

SEQ ID NO: 310421 - RNA, 16 nt, Bordetella pertussis
gcacaccgucacgcgc

SEQ ID NO: 310422 - RNA, 21 nt, Bordetella pertussis
gcacaccgucacgcgcaaggc

SEQ ID NO: 310423 - RNA, 16 nt, Bordetella pertussis
gcacacucugucgcgg

SEQ ID NO: 310424 - RNA, 22 nt, Bordetella pertussis
gcacagcaccugguggcgcugg

SEQ ID NO: 310425 - RNA, 19 nt, Bordetella pertussis
gcacagcaugcgcuggucg

SEQ ID NO: 310426 - RNA, 23 nt, Bordetella pertussis
gcacagcaugcgcuggucgcgca

SEQ ID NO: 310427 - RNA, 14 nt, Bordetella pertussis
gcaccagucccgca

SEQ ID NO: 310428 - RNA, 16 nt, Bordetella pertussis
gcaccagugcgccggc

SEQ ID NO: 310429 - RNA, 17 nt, Bordetella pertussis
gcaccagugcgccggcg

SEQ ID NO: 310430 - RNA, 21 nt, Bordetella pertussis
gcaccagugcgccggcgcggc

SEQ ID NO: 310431 - RNA, 22 nt, Bordetella pertussis
gcaccagugcgccggcgcggcg

SEQ ID NO: 310432 - RNA, 22 nt, Bordetella pertussis
gcaccaguuuucucauggccgc

SEQ ID NO: 310433 - RNA, 15 nt, Bordetella pertussis
gcaccaucgccgagc

SEQ ID NO: 310434 - RNA, 14 nt, Bordetella pertussis
gcaccaucgccgcc

SEQ ID NO: 310435 - RNA, 22 nt, Bordetella pertussis
gcacccagccggacccgcgccg

SEQ ID NO: 310436 - RNA, 13 nt, Bordetella pertussis
gcacccaggcggg

SEQ ID NO: 310437 - RNA, 19 nt, Bordetella pertussis
gcacccaggcgggcuggcg

SEQ ID NO: 310438 - RNA, 19 nt, Bordetella pertussis
gcaccccagcaccccgucg

SEQ ID NO: 310439 - RNA, 14 nt, Bordetella pertussis
gcacccgcacgggc

SEQ ID NO: 310440 - RNA, 15 nt, Bordetella pertussis
gcacccgcaggccgu

SEQ ID NO: 310441 - RNA, 19 nt, Bordetella pertussis
gcacccgcaugguggcgca

SEQ ID NO: 310442 - RNA, 11 nt, Bordetella pertussis
gcacccgcggc

SEQ ID NO: 310443 - RNA, 23 nt, Bordetella pertussis
gcacccgcuaccccggcagcguc

SEQ ID NO: 310444 - RNA, 21 nt, Bordetella pertussis
gcacccgucccugguccagca

SEQ ID NO: 310445 - RNA, 19 nt, Bordetella pertussis
gcacccugcaggccgggca

SEQ ID NO: 310446 - RNA, 20 nt, Bordetella pertussis
gcacccugcaggccgggcag

SEQ ID NO: 310447 - RNA, 22 nt, Bordetella pertussis
gcacccugucauacgccaugaa

SEQ ID NO: 310448 - RNA, 21 nt, Bordetella pertussis
gcacccuugcucagucgggca

SEQ ID NO: 310449 - RNA, 19 nt, Bordetella pertussis
gcaccgaacgggcguggcg

SEQ ID NO: 310450 - RNA, 22 nt, Bordetella pertussis
gcaccgaacgggcguggcgcag

SEQ ID NO: 310451 - RNA, 16 nt, Bordetella pertussis
gcaccgaagcauccca

SEQ ID NO: 310452 - RNA, 16 nt, Bordetella pertussis
gcaccgaccagcgcgc

SEQ ID NO: 310453 - RNA, 21 nt, Bordetella pertussis
gcaccgaccagcgcgcgccgg

SEQ ID NO: 310454 - RNA, 16 nt, Bordetella pertussis
gcaccgacacgcuggc

SEQ ID NO: 310455 - RNA, 17 nt, Bordetella pertussis
gcaccgacacgcuggcg

SEQ ID NO: 310456 - RNA, 13 nt, Bordetella pertussis
gcaccgacaggcc

SEQ ID NO: 310457 - RNA, 15 nt, Bordetella pertussis
gcaccgacaggccga

SEQ ID NO: 310458 - RNA, 16 nt, Bordetella pertussis
gcaccgacggcagccc

SEQ ID NO: 310459 - RNA, 14 nt, Bordetella pertussis
gcaccgacgggcug

SEQ ID NO: 310460 - RNA, 21 nt, Bordetella pertussis
gcaccgcaugggccaggcgcu

SEQ ID NO: 310461 - RNA, 16 nt, Bordetella pertussis
gcaccgccaccguggc

SEQ ID NO: 310462 - RNA, 20 nt, Bordetella pertussis
gcaccgccaccguggcgucc

SEQ ID NO: 310463 - RNA, 14 nt, Bordetella pertussis
gcaccgccagcgcg

SEQ ID NO: 310464 - RNA, 16 nt, Bordetella pertussis
gcaccgccagcgcguc

SEQ ID NO: 310465 - RNA, 21 nt, Bordetella pertussis
gcaccgccaggcagauccgcc

SEQ ID NO: 310466 - RNA, 20 nt, Bordetella pertussis
gcaccgccaugugcgccgcg

SEQ ID NO: 310467 - RNA, 23 nt, Bordetella pertussis
gcaccgccaugugcgccgcgccg

SEQ ID NO: 310468 - RNA, 22 nt, Bordetella pertussis
gcaccgcgcgcacgaccaccag

SEQ ID NO: 310469 - RNA, 15 nt, Bordetella pertussis
gcaccgcggcgggcu

SEQ ID NO: 310470 - RNA, 16 nt, Bordetella pertussis
gcaccggcgccacggc

SEQ ID NO: 310471 - RNA, 15 nt, Bordetella pertussis
gcaccggccggccgg

SEQ ID NO: 310472 - RNA, 20 nt, Bordetella pertussis
gcaccggcgugagcgccacc

SEQ ID NO: 310473 - RNA, 19 nt, Bordetella pertussis
gcaccggcgugcgcuggcu

SEQ ID NO: 310474 - RNA, 19 nt, Bordetella pertussis
gcaccggcuuggggcgcgc

SEQ ID NO: 310475 - RNA, 21 nt, Bordetella pertussis
gcaccggcuuggggcgcgccg

SEQ ID NO: 310476 - RNA, 16 nt, Bordetella pertussis
gcaccgggcggcccgg

SEQ ID NO: 310477 - RNA, 19 nt, Bordetella pertussis
gcaccgggcggcccggcgg

SEQ ID NO: 310478 - RNA, 14 nt, Bordetella pertussis
gcaccgggccgaac

SEQ ID NO: 310479 - RNA, 20 nt, Bordetella pertussis
gcaccgggaaguccgccgcg

SEQ ID NO: 310480 - RNA, 23 nt, Bordetella pertussis
gcaccgggaaguccgccgcguug

SEQ ID NO: 310481 - RNA, 19 nt, Bordetella pertussis
gcaccggguaauggcgcuc

SEQ ID NO: 310482 - RNA, 23 nt, Bordetella pertussis
gcaccggguaauggcgcuccagc

SEQ ID NO: 310483 - RNA, 21 nt, Bordetella pertussis
gcaccgucacgcgcuccagcg

SEQ ID NO: 310484 - RNA, 15 nt, Bordetella pertussis
gcaccgucaggugca

SEQ ID NO: 310485 - RNA, 12 nt, Bordetella pertussis
gcaccguccagc

SEQ ID NO: 310486 - RNA, 15 nt, Bordetella pertussis
gcaccgugaccugcg

SEQ ID NO: 310487 - RNA, 22 nt, Bordetella pertussis
gcaccgugaugcgcgccgcucu

SEQ ID NO: 310488 - RNA, 17 nt, Bordetella pertussis
gcaccgugccggcguau

SEQ ID NO: 310489 - RNA, 21 nt, Bordetella pertussis
gcaccucacggugaccgggug

SEQ ID NO: 310490 - RNA, 13 nt, Bordetella pertussis
gcaccucggccgg

SEQ ID NO: 310491 - RNA, 19 nt, Bordetella pertussis
gcaccucguaaguggcggc

SEQ ID NO: 310492 - RNA, 18 nt, Bordetella pertussis
gcaccucggggcgcggcc

SEQ ID NO: 310493 - RNA, 20 nt, Bordetella pertussis
gcaccucggggcgcggccgg

SEQ ID NO: 310494 - RNA, 17 nt, Bordetella pertussis
gcaccugaacaccggcg

SEQ ID NO: 310495 - RNA, 22 nt, Bordetella pertussis
gcaccugaacaccggcgcgccu

SEQ ID NO: 310496 - RNA, 14 nt, Bordetella pertussis
gcaccugcaggccg

SEQ ID NO: 310497 - RNA, 15 nt, Bordetella pertussis
gcaccugcaggccgc

SEQ ID NO: 310498 - RNA, 17 nt, Bordetella pertussis
gcaccugcaggccgccg

SEQ ID NO: 310499 - RNA, 19 nt, Bordetella pertussis
gcaccugcaggccgccggc

SEQ ID NO: 310500 - RNA, 22 nt, Bordetella pertussis
gcaccugcaggccgccggccag

SEQ ID NO: 310501 - RNA, 14 nt, Bordetella pertussis
gcaccugccugccg

SEQ ID NO: 310502 - RNA, 18 nt, Bordetella pertussis
gcaccugccugccgccug

SEQ ID NO: 310503 - RNA, 21 nt, Bordetella pertussis
gcaccugccugccgccugcca

SEQ ID NO: 310504 - RNA, 15 nt, Bordetella pertussis
gcaccuucgcgcagc

SEQ ID NO: 310505 - RNA, 17 nt, Bordetella pertussis
gcaccuucgcgcagcgg

SEQ ID NO: 310506 - RNA, 18 nt, Bordetella pertussis
gcaccuucugccgccagg

SEQ ID NO: 310507 - RNA, 19 nt, Bordetella pertussis
gcaccuucugccgccaggc

SEQ ID NO: 310508 - RNA, 20 nt, Bordetella pertussis
gcaccuucuuccaggcgccc

SEQ ID NO: 310509 - RNA, 16 nt, Bordetella pertussis
gcaccuugcccacgcc

SEQ ID NO: 310510 - RNA, 14 nt, Bordetella pertussis
gcaccuuggcccgg

SEQ ID NO: 310511 - RNA, 20 nt, Bordetella pertussis
gcaccuugaccuggucggcc

SEQ ID NO: 310512 - RNA, 17 nt, Bordetella pertussis
gcaccuugucgcgcagc

SEQ ID NO: 310513 - RNA, 22 nt, Bordetella pertussis
gcaccuuucugcugcucgcggc

SEQ ID NO: 310514 - RNA, 17 nt, Bordetella pertussis
gcacgaaaagccgcggc

SEQ ID NO: 310515 - RNA, 18 nt, Bordetella pertussis
gcacgaaaagccgcggcc

SEQ ID NO: 310516 - RNA, 19 nt, Bordetella pertussis
gcacgaacagguugaagcc

SEQ ID NO: 310517 - RNA, 22 nt, Bordetella pertussis
gcacgaaccacaggguggcgcc

SEQ ID NO: 310518 - RNA, 14 nt, Bordetella pertussis
gcacgacgacggcc

SEQ ID NO: 310519 - RNA, 19 nt, Bordetella pertussis
gcacgacgacggccggcgc

SEQ ID NO: 310520 - RNA, 14 nt, Bordetella pertussis
gcacgacgaucggc

SEQ ID NO: 310521 - RNA, 17 nt, Bordetella pertussis
gcacgacgcgaaccagg

SEQ ID NO: 310522 - RNA, 19 nt, Bordetella pertussis
gcacgacgcgaaccaggcc

SEQ ID NO: 310523 - RNA, 22 nt, Bordetella pertussis
gcacgacggccuccgcgccgac

SEQ ID NO: 310524 - RNA, 16 nt, Bordetella pertussis
gcacgacgucgcgcgg

SEQ ID NO: 310525 - RNA, 18 nt, Bordetella pertussis
gcacgacgucgcgcggau

SEQ ID NO: 310526 - RNA, 22 nt, Bordetella pertussis
gcacgacguggccuaccacgca

SEQ ID NO: 310527 - RNA, 17 nt, Bordetella pertussis
gcacgacuacggcggac

SEQ ID NO: 310528 - RNA, 22 nt, Bordetella pertussis
gcacgacuacggcggacuggcc

SEQ ID NO: 310529 - RNA, 17 nt, Bordetella pertussis
gcacgagaucgccuggg

SEQ ID NO: 310530 - RNA, 19 nt, Bordetella pertussis
gcacgagauguccauggcc

SEQ ID NO: 310531 - RNA, 15 nt, Bordetella pertussis
gcacgaggcgcucgg

SEQ ID NO: 310532 - RNA, 15 nt, Bordetella pertussis
gcacgaugccgucgc

SEQ ID NO: 310533 - RNA, 17 nt, Bordetella pertussis
gcacgauggggcagcca

SEQ ID NO: 310534 - RNA, 13 nt, Bordetella pertussis
gcacgauggggcc

SEQ ID NO: 310535 - RNA, 14 nt, Bordetella pertussis
gcacgauggggcca

SEQ ID NO: 310536 - RNA, 18 nt, Bordetella pertussis
gcacgauggggccgucgc

SEQ ID NO: 310537 - RNA, 24 nt, Bordetella pertussis
gcacgauggggccgucgccgaucg

SEQ ID NO: 310538 - RNA, 22 nt, Bordetella pertussis
gcacgaugguaucggccgggcc

SEQ ID NO: 310539 - RNA, 17 nt, Bordetella pertussis
gcacgauggucagcggc

SEQ ID NO: 310540 - RNA, 18 nt, Bordetella pertussis
gcacgauggcgcgcgaac

SEQ ID NO: 310541 - RNA, 17 nt, Bordetella pertussis
gcacgaugguguucagg

SEQ ID NO: 310542 - RNA, 19 nt, Bordetella pertussis
gcacgauguugccgccggc

SEQ ID NO: 310543 - RNA, 23 nt, Bordetella pertussis
gcacgauguugccgccggccagg

SEQ ID NO: 310544 - RNA, 23 nt, Bordetella pertussis
gcacgauuccgccuacuggcgcg

SEQ ID NO: 310545 - RNA, 21 nt, Bordetella pertussis
gcacgauuucacccagggugu

SEQ ID NO: 310546 - RNA, 13 nt, Bordetella pertussis
gcacgcacagcau

SEQ ID NO: 310547 - RNA, 24 nt, Bordetella pertussis
gcacgcacagcaugcgcuggucgc

SEQ ID NO: 310548 - RNA, 15 nt, Bordetella pertussis
gcacgcaccaggcgc

SEQ ID NO: 310549 - RNA, 17 nt, Bordetella pertussis
gcacgcaccaggcgcac

SEQ ID NO: 310550 - RNA, 16 nt, Bordetella pertussis
gcacgcaccgcgccag

SEQ ID NO: 310551 - RNA, 17 nt, Bordetella pertussis
gcacgcaccgcgccagc

SEQ ID NO: 310552 - RNA, 23 nt, Bordetella pertussis
gcacgcacgguacgccgaacaag

SEQ ID NO: 310553 - RNA, 12 nt, Bordetella pertussis
gcacgcagcccu

SEQ ID NO: 310554 - RNA, 17 nt, Bordetella pertussis
gcacgcccuggcugagc

SEQ ID NO: 310555 - RNA, 17 nt, Bordetella pertussis
gcacgccgaccuggcgc

SEQ ID NO: 310556 - RNA, 17 nt, Bordetella pertussis
gcacgccgaucgcgcac

SEQ ID NO: 310557 - RNA, 18 nt, Bordetella pertussis
gcacgccgaucgcgcaca

SEQ ID NO: 310558 - RNA, 22 nt, Bordetella pertussis
gcacgccgauguccacgaaggc

SEQ ID NO: 310559 - RNA, 15 nt, Bordetella pertussis
gcacgccgcgccagg

SEQ ID NO: 310560 - RNA, 16 nt, Bordetella pertussis
gcacgccgcgccaggc

SEQ ID NO: 310561 - RNA, 17 nt, Bordetella pertussis
gcacgccgcgccaggca

SEQ ID NO: 310562 - RNA, 15 nt, Bordetella pertussis
gcacgccgcgccggc

SEQ ID NO: 310563 - RNA, 16 nt, Bordetella pertussis
gcacgccgcgccggcg

SEQ ID NO: 310564 - RNA, 14 nt, Bordetella pertussis
gcacgccgcgcucg

SEQ ID NO: 310565 - RNA, 15 nt, Bordetella pertussis
gcacgccggccacga

SEQ ID NO: 310566 - RNA, 14 nt, Bordetella pertussis
gcacgccggccagg

SEQ ID NO: 310567 - RNA, 17 nt, Bordetella pertussis
gcacgccggccaggucg

SEQ ID NO: 310568 - RNA, 15 nt, Bordetella pertussis
gcacgccggccuugc

SEQ ID NO: 310569 - RNA, 13 nt, Bordetella pertussis
gcacgccggcggc

SEQ ID NO: 310570 - RNA, 15 nt, Bordetella pertussis
gcacgccggcggccc

SEQ ID NO: 310571 - RNA, 14 nt, Bordetella pertussis
gcacgccggcgggc

SEQ ID NO: 310572 - RNA, 13 nt, Bordetella pertussis
gcacgcgcgccag

SEQ ID NO: 310573 - RNA, 17 nt, Bordetella pertussis
gcacgcgcgccagcugg

SEQ ID NO: 310574 - RNA, 14 nt, Bordetella pertussis
gcacgcgcgccggc

SEQ ID NO: 310575 - RNA, 13 nt, Bordetella pertussis
gcacgcgcgcggc

SEQ ID NO: 310576 - RNA, 14 nt, Bordetella pertussis
gcacgcgcgcggcg

SEQ ID NO: 310577 - RNA, 18 nt, Bordetella pertussis
gcacgcgcgcggcgcggc

SEQ ID NO: 310578 - RNA, 19 nt, Bordetella pertussis
gcacgcgcgcggcgcggcu

SEQ ID NO: 310579 - RNA, 15 nt, Bordetella pertussis
gcacgcgcgcgggcg

SEQ ID NO: 310580 - RNA, 19 nt, Bordetella pertussis
gcacgcgcgcgggcgcgcc

SEQ ID NO: 310581 - RNA, 12 nt, Bordetella pertussis
gcacgcgcggca

SEQ ID NO: 310582 - RNA, 14 nt, Bordetella pertussis
gcacgcggccgcgc

SEQ ID NO: 310583 - RNA, 16 nt, Bordetella pertussis
gcacgcggccgcgggc

SEQ ID NO: 310584 - RNA, 13 nt, Bordetella pertussis
gcacgcggcgcgg

SEQ ID NO: 310585 - RNA, 19 nt, Bordetella pertussis
gcacgcgcucgggcagcuc

SEQ ID NO: 310586 - RNA, 15 nt, Bordetella pertussis
gcacgcgggcgcuga

SEQ ID NO: 310587 - RNA, 17 nt, Bordetella pertussis
gcacgcgggcgcugacg

SEQ ID NO: 310588 - RNA, 17 nt, Bordetella pertussis
gcacgcgguccacgccg

SEQ ID NO: 310589 - RNA, 19 nt, Bordetella pertussis
gcacgcgguccacgccggg

SEQ ID NO: 310590 - RNA, 16 nt, Bordetella pertussis
gcacgcguucgggcgg

SEQ ID NO: 310591 - RNA, 17 nt, Bordetella pertussis
gcacgcguucgggcggc

SEQ ID NO: 310592 - RNA, 23 nt, Bordetella pertussis
gcacgcguucgggcggcaggugc

SEQ ID NO: 310593 - RNA, 13 nt, Bordetella pertussis
gcacgcuggcgcc

SEQ ID NO: 310594 - RNA, 20 nt, Bordetella pertussis
gcacgcugggcgaggcgcug

SEQ ID NO: 310595 - RNA, 14 nt, Bordetella pertussis
gcacggacagcccg

SEQ ID NO: 310596 - RNA, 20 nt, Bordetella pertussis
gcacggacagcccgcgcugg

SEQ ID NO: 310597 - RNA, 21 nt, Bordetella pertussis
gcacggacagcccgcgcuggc

SEQ ID NO: 310598 - RNA, 22 nt, Bordetella pertussis
gcacggacagcccgcgcuggcg

SEQ ID NO: 310599 - RNA, 14 nt, Bordetella pertussis
gcacgcuugccgca

SEQ ID NO: 310600 - RNA, 17 nt, Bordetella pertussis
gcacggagggugcgcaa

SEQ ID NO: 310601 - RNA, 12 nt, Bordetella pertussis
gcacggcggcga

SEQ ID NO: 310602 - RNA, 15 nt, Bordetella pertussis
gcacggcggcgauca

SEQ ID NO: 310603 - RNA, 18 nt, Bordetella pertussis
gcacggcguggcgcgcac

SEQ ID NO: 310604 - RNA, 19 nt, Bordetella pertussis
gcacggcuugcgcgccugc

SEQ ID NO: 310605 - RNA, 14 nt, Bordetella pertussis
gcacgggcgaggcg

SEQ ID NO: 310606 - RNA, 18 nt, Bordetella pertussis
gcacgggcgaggcggggc

SEQ ID NO: 310607 - RNA, 23 nt, Bordetella pertussis
gcacgggcgagggcugcccucgc

SEQ ID NO: 310608 - RNA, 12 nt, Bordetella pertussis
gcacgggcgccu

SEQ ID NO: 310609 - RNA, 14 nt, Bordetella pertussis
gcacgggcgccugu

SEQ ID NO: 310610 - RNA, 17 nt, Bordetella pertussis
gcacgggcgccuguccc

SEQ ID NO: 310611 - RNA, 13 nt, Bordetella pertussis
gcacgggcgcugc

SEQ ID NO: 310612 - RNA, 15 nt, Bordetella pertussis
gcacggugccgcgcg

SEQ ID NO: 310613 - RNA, 16 nt, Bordetella pertussis
gcacgguggacaggcu

SEQ ID NO: 310614 - RNA, 17 nt, Bordetella pertussis
gcacgguggcgaaggcc

SEQ ID NO: 310615 - RNA, 14 nt, Bordetella pertussis
gcacgguggcgccc

SEQ ID NO: 310616 - RNA, 18 nt, Bordetella pertussis
gcacgguggcgcccggcg

SEQ ID NO: 310617 - RNA, 19 nt, Bordetella pertussis
gcacggugggcagcagcac

SEQ ID NO: 310618 - RNA, 12 nt, Bordetella pertussis
gcacguccagcg

SEQ ID NO: 310619 - RNA, 13 nt, Bordetella pertussis
gcacguccagcgg

SEQ ID NO: 310620 - RNA, 15 nt, Bordetella pertussis
gcacguccagcggcg

SEQ ID NO: 310621 - RNA, 16 nt, Bordetella pertussis
gcacguccagcggcgc

SEQ ID NO: 310622 - RNA, 18 nt, Bordetella pertussis
gcacguccagcggcgcga

SEQ ID NO: 310623 - RNA, 23 nt, Bordetella pertussis
gcacguccagcggcgcgacgcgc

SEQ ID NO: 310624 - RNA, 19 nt, Bordetella pertussis
gcacgucccagucgccgcg

SEQ ID NO: 310625 - RNA, 18 nt, Bordetella pertussis
gcacguccggcacggcgg

SEQ ID NO: 310626 - RNA, 16 nt, Bordetella pertussis
gcacgugggcacgccg

SEQ ID NO: 310627 - RNA, 17 nt, Bordetella pertussis
gcacgugggcacgccgg

SEQ ID NO: 310628 - RNA, 18 nt, Bordetella pertussis
gcacgugggcacgccggc

SEQ ID NO: 310629 - RNA, 20 nt, Bordetella pertussis
gcacgugggcacgccggccu

SEQ ID NO: 310630 - RNA, 19 nt, Bordetella pertussis
gcacguugucgagcaggcc

SEQ ID NO: 310631 - RNA, 21 nt, Bordetella pertussis
gcacguugucgagcaggccgc

SEQ ID NO: 310632 - RNA, 15 nt, Bordetella pertussis
gcagaagcagccgcg

SEQ ID NO: 310633 - RNA, 16 nt, Bordetella pertussis
gcagaagcagccgcgc

SEQ ID NO: 310634 - RNA, 17 nt, Bordetella pertussis
gcagaagcagccgcgcg

SEQ ID NO: 310635 - RNA, 15 nt, Bordetella pertussis
gcagaaugccgccca

SEQ ID NO: 310636 - RNA, 18 nt, Bordetella pertussis
gcagacccgcgcccagcu

SEQ ID NO: 310637 - RNA, 15 nt, Bordetella pertussis
gcagaccgagcgcgc

SEQ ID NO: 310638 - RNA, 13 nt, Bordetella pertussis
gcagacccuggcg

SEQ ID NO: 310639 - RNA, 14 nt, Bordetella pertussis
gcagacccuggcgc

SEQ ID NO: 310640 - RNA, 17 nt, Bordetella pertussis
gcagaccuaccaggccg

SEQ ID NO: 310641 - RNA, 17 nt, Bordetella pertussis
gcagacgaucauccagg

SEQ ID NO: 310642 - RNA, 17 nt, Bordetella pertussis
gcagacgaugcccaggc

SEQ ID NO: 310643 - RNA, 21 nt, Bordetella pertussis
gcagacgccaucuugcaggcg

SEQ ID NO: 310644 - RNA, 12 nt, Bordetella pertussis
gcagacgcgcuc

SEQ ID NO: 310645 - RNA, 17 nt, Bordetella pertussis
gcagacgcgcucaggcg

SEQ ID NO: 310646 - RNA, 19 nt, Bordetella pertussis
gcagacgcgcucaggcggu

SEQ ID NO: 310647 - RNA, 18 nt, Bordetella pertussis
gcagacgcuucaggccgu

SEQ ID NO: 310648 - RNA, 17 nt, Bordetella pertussis
gcagacggucgacaccg

SEQ ID NO: 310649 - RNA, 20 nt, Bordetella pertussis
gcagaucaucgagcaccgcc

SEQ ID NO: 310650 - RNA, 15 nt, Bordetella pertussis
gcagaucaucggcgc

SEQ ID NO: 310651 - RNA, 14 nt, Bordetella pertussis
gcagaucccaggcg

SEQ ID NO: 310652 - RNA, 21 nt, Bordetella pertussis
gcagauccucgaacaggccau

SEQ ID NO: 310653 - RNA, 21 nt, Bordetella pertussis
gcagaucgccaacgucggcag

SEQ ID NO: 310654 - RNA, 17 nt, Bordetella pertussis
gcagaucggcgcuggcc

SEQ ID NO: 310655 - RNA, 15 nt, Bordetella pertussis
gcagaucggcggccu

SEQ ID NO: 310656 - RNA, 17 nt, Bordetella pertussis
gcagaucggcggccugg

SEQ ID NO: 310657 - RNA, 19 nt, Bordetella pertussis
gcagaucggcggccugggc

SEQ ID NO: 310658 - RNA, 21 nt, Bordetella pertussis
gcagaucggcggccugggcca

SEQ ID NO: 310659 - RNA, 19 nt, Bordetella pertussis
gcagaugaucuacgcgcgc

SEQ ID NO: 310660 - RNA, 16 nt, Bordetella pertussis
gcagaugcaccggcca

SEQ ID NO: 310661 - RNA, 14 nt, Bordetella pertussis
gcagauggccagca

SEQ ID NO: 310662 - RNA, 22 nt, Bordetella pertussis
gcagauggccagcagcgccgcc

SEQ ID NO: 310663 - RNA, 16 nt, Bordetella pertussis
gcagauggccaucgac

SEQ ID NO: 310664 - RNA, 19 nt, Bordetella pertussis
gcagauggccaucgacgcc

SEQ ID NO: 310665 - RNA, 19 nt, Bordetella pertussis
gcagaugggcggcgacgaa

SEQ ID NO: 310666 - RNA, 17 nt, Bordetella pertussis
gcagcacacggucagca

SEQ ID NO: 310667 - RNA, 23 nt, Bordetella pertussis
gcagcacacggucagcaacccca

SEQ ID NO: 310668 - RNA, 19 nt, Bordetella pertussis
gcagcaccacaucgccggc

SEQ ID NO: 310669 - RNA, 14 nt, Bordetella pertussis
gcagcaccggcgug

SEQ ID NO: 310670 - RNA, 23 nt, Bordetella pertussis
gcagcaccucggacgagacaggc

SEQ ID NO: 310671 - RNA, 18 nt, Bordetella pertussis
gcagcaccuucugccgcc

SEQ ID NO: 310672 - RNA, 19 nt, Bordetella pertussis
gcagcaccuucugccgcca

SEQ ID NO: 310673 - RNA, 22 nt, Bordetella pertussis
gcagcaccuucugccgccaggc

SEQ ID NO: 310674 - RNA, 23 nt, Bordetella pertussis
gcagcaccuucugccgccaggca

SEQ ID NO: 310675 - RNA, 21 nt, Bordetella pertussis
gcagcacgaucgcggcgcugg

SEQ ID NO: 310676 - RNA, 22 nt, Bordetella pertussis
gcagcacgaucgcggcgcuggc

SEQ ID NO: 310677 - RNA, 14 nt, Bordetella pertussis
gcagcacgauggcg

SEQ ID NO: 310678 - RNA, 15 nt, Bordetella pertussis
gcagcacgauggcgc

SEQ ID NO: 310679 - RNA, 19 nt, Bordetella pertussis
gcagcacgauggcgcccac

SEQ ID NO: 310680 - RNA, 20 nt, Bordetella pertussis
gcagcacgauggcgcccacg

SEQ ID NO: 310681 - RNA, 15 nt, Bordetella pertussis
gcagcacgcaccagg

SEQ ID NO: 310682 - RNA, 18 nt, Bordetella pertussis
gcagcacgcccagauggc

SEQ ID NO: 310683 - RNA, 14 nt, Bordetella pertussis
gcagcacgcccagu

SEQ ID NO: 310684 - RNA, 16 nt, Bordetella pertussis
gcagcacgcccgcgcg

SEQ ID NO: 310685 - RNA, 18 nt, Bordetella pertussis
gcagcacgccgaucgcgc

SEQ ID NO: 310686 - RNA, 15 nt, Bordetella pertussis
gcagcacgcgcacca

SEQ ID NO: 310687 - RNA, 16 nt, Bordetella pertussis
gcagcacgcgcaccag

SEQ ID NO: 310688 - RNA, 19 nt, Bordetella pertussis
gcagcacgcgcaccaggcc

SEQ ID NO: 310689 - RNA, 20 nt, Bordetella pertussis
gcagcacgcgcaccaggccu

SEQ ID NO: 310690 - RNA, 12 nt, Bordetella pertussis
gcagcacgcugc

SEQ ID NO: 310691 - RNA, 13 nt, Bordetella pertussis
gcagcacgcugcg

SEQ ID NO: 310692 - RNA, 15 nt, Bordetella pertussis
gcagcacgcuggccu

SEQ ID NO: 310693 - RNA, 16 nt, Bordetella pertussis
gcagcacgcuggccuu

SEQ ID NO: 310694 - RNA, 14 nt, Bordetella pertussis
gcagcacggccacg

SEQ ID NO: 310695 - RNA, 20 nt, Bordetella pertussis
gcagcacggccacggccggc

SEQ ID NO: 310696 - RNA, 21 nt, Bordetella pertussis
gcagcacggccacggccggca

SEQ ID NO: 310697 - RNA, 20 nt, Bordetella pertussis
gcagcacggcuugcgcgccu

SEQ ID NO: 310698 - RNA, 13 nt, Bordetella pertussis
gcagcagauugcc

SEQ ID NO: 310699 - RNA, 21 nt, Bordetella pertussis
gcagcagauugccgcgcggcg

SEQ ID NO: 310700 - RNA, 12 nt, Bordetella pertussis
gcagcagcacgc

SEQ ID NO: 310701 - RNA, 18 nt, Bordetella pertussis
gcagcagcacgcagaugu

SEQ ID NO: 310702 - RNA, 15 nt, Bordetella pertussis
gcagcagcacgccca

SEQ ID NO: 310703 - RNA, 13 nt, Bordetella pertussis
gcagcagcagcgc

SEQ ID NO: 310704 - RNA, 14 nt, Bordetella pertussis
gcagcagcagcgca

SEQ ID NO: 310705 - RNA, 14 nt, Bordetella pertussis
gcagcagcagcgug

SEQ ID NO: 310706 - RNA, 14 nt, Bordetella pertussis
gcagcagccgcuag

SEQ ID NO: 310707 - RNA, 24 nt, Bordetella pertussis
gcagcagcgagaacagccacacgc

SEQ ID NO: 310708 - RNA, 17 nt, Bordetella pertussis
gcagcagcgccgcgccg

SEQ ID NO: 310709 - RNA, 20 nt, Bordetella pertussis
gcagcagcguggccgccacc

SEQ ID NO: 310710 - RNA, 21 nt, Bordetella pertussis
gcagcagcguggccgccacca

SEQ ID NO: 310711 - RNA, 15 nt, Bordetella pertussis
gcagcagcuugccga

SEQ ID NO: 310712 - RNA, 20 nt, Bordetella pertussis
gcagcaggaguuccgcgucu

SEQ ID NO: 310713 - RNA, 16 nt, Bordetella pertussis
gcagcaggcccaugcc

SEQ ID NO: 310714 - RNA, 17 nt, Bordetella pertussis
gcagcaggcccuccggc

SEQ ID NO: 310715 - RNA, 12 nt, Bordetella pertussis
gcagcaggccgc

SEQ ID NO: 310716 - RNA, 14 nt, Bordetella pertussis
gcagcaggccgcgc

SEQ ID NO: 310717 - RNA, 17 nt, Bordetella pertussis
gcagcaggccgcgcgug

SEQ ID NO: 310718 - RNA, 12 nt, Bordetella pertussis
gcagcaggccgu

SEQ ID NO: 310719 - RNA, 18 nt, Bordetella pertussis
gcagcaggccguugccgc

SEQ ID NO: 310720 - RNA, 13 nt, Bordetella pertussis
gcagcaggcgcac

SEQ ID NO: 310721 - RNA, 13 nt, Bordetella pertussis
gcagcaggcgcau

SEQ ID NO: 310722 - RNA, 20 nt, Bordetella pertussis
gcagcaggcgcucggccagc

SEQ ID NO: 310723 - RNA, 21 nt, Bordetella pertussis
gcagcaggcgcucggccagcg

SEQ ID NO: 310724 - RNA, 23 nt, Bordetella pertussis
gcagcagggccacgcccaggccg

SEQ ID NO: 310725 - RNA, 15 nt, Bordetella pertussis
gcagcagggccaggc

SEQ ID NO: 310726 - RNA, 16 nt, Bordetella pertussis
gcagcagggccaggcc

SEQ ID NO: 310727 - RNA, 17 nt, Bordetella pertussis
gcagcagggccaggccg

SEQ ID NO: 310728 - RNA, 18 nt, Bordetella pertussis
gcagcagggccaggccga

SEQ ID NO: 310729 - RNA, 18 nt, Bordetella pertussis
gcagcagguaguagccga

SEQ ID NO: 310730 - RNA, 16 nt, Bordetella pertussis
gcagcaggcugggcga

SEQ ID NO: 310731 - RNA, 17 nt, Bordetella pertussis
gcagcaguucggcgucg

SEQ ID NO: 310732 - RNA, 18 nt, Bordetella pertussis
gcagcaguucggucagcg

SEQ ID NO: 310733 - RNA, 19 nt, Bordetella pertussis
gcagcaucuugcgccgcug

SEQ ID NO: 310734 - RNA, 15 nt, Bordetella pertussis
gcagcaugagcugau

SEQ ID NO: 310735 - RNA, 14 nt, Bordetella pertussis
gcagcaugaccgac

SEQ ID NO: 310736 - RNA, 14 nt, Bordetella pertussis
gcagcaugccgcgg

SEQ ID NO: 310737 - RNA, 15 nt, Bordetella pertussis
gcagcaugccgcggu

SEQ ID NO: 310738 - RNA, 19 nt, Bordetella pertussis
gcagcaugccgcgguggcg

SEQ ID NO: 310739 - RNA, 15 nt, Bordetella pertussis
gcagcaugcggcccg

SEQ ID NO: 310740 - RNA, 16 nt, Bordetella pertussis
gcagcaugcggcccgc

SEQ ID NO: 310741 - RNA, 18 nt, Bordetella pertussis
gcagcaugcggcccgcgc

SEQ ID NO: 310742 - RNA, 20 nt, Bordetella pertussis
gcagcaugcggcccgcgcug

SEQ ID NO: 310743 - RNA, 16 nt, Bordetella pertussis
gcagcauggcgccaug

SEQ ID NO: 310744 - RNA, 24 nt, Bordetella pertussis
gcagcauggcgccaugcgacagcc

SEQ ID NO: 310745 - RNA, 14 nt, Bordetella pertussis
gcagcauggcgggc

SEQ ID NO: 310746 - RNA, 22 nt, Bordetella pertussis
gcagcaugugcucgggacgcag

SEQ ID NO: 310747 - RNA, 19 nt, Bordetella pertussis
gcagcauucuggugcagcg

SEQ ID NO: 310748 - RNA, 17 nt, Bordetella pertussis
gcagcauuucgaugcgc

SEQ ID NO: 310749 - RNA, 21 nt, Bordetella pertussis
gcagcauuucgaugcgcacca

SEQ ID NO: 310750 - RNA, 21 nt, Bordetella pertussis
gcagcauuucggcgccgccgg

SEQ ID NO: 310751 - RNA, 15 nt, Bordetella pertussis
gcagccacagcgcgu

SEQ ID NO: 310752 - RNA, 17 nt, Bordetella pertussis
gcagccacagcgcgugg

SEQ ID NO: 310753 - RNA, 13 nt, Bordetella pertussis
gcagccacaggcc

SEQ ID NO: 310754 - RNA, 23 nt, Bordetella pertussis
gcagccacgggauguccgcgucg

SEQ ID NO: 310755 - RNA, 19 nt, Bordetella pertussis
gcagccagguaagcuggcg

SEQ ID NO: 310756 - RNA, 15 nt, Bordetella pertussis
gcagccagguggcga

SEQ ID NO: 310757 - RNA, 23 nt, Bordetella pertussis
gcagccagguggcgaugccgggc

SEQ ID NO: 310758 - RNA, 24 nt, Bordetella pertussis
gcagccagguggcgaugccgggca

SEQ ID NO: 310759 - RNA, 20 nt, Bordetella pertussis
gcagccaguugggccagggc

SEQ ID NO: 310760 - RNA, 17 nt, Bordetella pertussis
gcagcccacucagggcg

SEQ ID NO: 310761 - RNA, 22 nt, Bordetella pertussis
gcagccauccucgcccagcggc

SEQ ID NO: 310762 - RNA, 23 nt, Bordetella pertussis
gcagccauccucgcccagcggcg

SEQ ID NO: 310763 - RNA, 13 nt, Bordetella pertussis
gcagcccagcgcg

SEQ ID NO: 310764 - RNA, 14 nt, Bordetella pertussis
gcagcccagcgcga

SEQ ID NO: 310765 - RNA, 22 nt, Bordetella pertussis
gcagccgaugauggugaacgcc

SEQ ID NO: 310766 - RNA, 20 nt, Bordetella pertussis
gcagccgcaauaccuucagc

SEQ ID NO: 310767 - RNA, 13 nt, Bordetella pertussis
gcagccgcaccag

SEQ ID NO: 310768 - RNA, 14 nt, Bordetella pertussis
gcagccgcaccagc

SEQ ID NO: 310769 - RNA, 15 nt, Bordetella pertussis
gcagccgcaccagcg

SEQ ID NO: 310770 - RNA, 15 nt, Bordetella pertussis
gcagccgcccggcag

SEQ ID NO: 310771 - RNA, 14 nt, Bordetella pertussis
gcagccgccgcagg

SEQ ID NO: 310772 - RNA, 13 nt, Bordetella pertussis
gcagccgcgccaa

SEQ ID NO: 310773 - RNA, 23 nt, Bordetella pertussis
gcagccgguuggcgccuuccggc

SEQ ID NO: 310774 - RNA, 16 nt, Bordetella pertussis
gcagccguugaucugg

SEQ ID NO: 310775 - RNA, 18 nt, Bordetella pertussis
gcagccguugaucugguu

SEQ ID NO: 310776 - RNA, 17 nt, Bordetella pertussis
gcagccuucguccugcc

SEQ ID NO: 310777 - RNA, 15 nt, Bordetella pertussis
gcagcgacggcccca

SEQ ID NO: 310778 - RNA, 20 nt, Bordetella pertussis
gcagcgacggccccagcgcc

SEQ ID NO: 310779 - RNA, 20 nt, Bordetella pertussis
gcagcgacuugucgcgcccg

SEQ ID NO: 310780 - RNA, 22 nt, Bordetella pertussis
gcagcgacuugucgcgcccgaa

SEQ ID NO: 310781 - RNA, 17 nt, Bordetella pertussis
gcagcgacucgaacacc

SEQ ID NO: 310782 - RNA, 15 nt, Bordetella pertussis
gcagcgagagcgcca

SEQ ID NO: 310783 - RNA, 20 nt, Bordetella pertussis
gcagcgagagcgccacgcca

SEQ ID NO: 310784 - RNA, 21 nt, Bordetella pertussis
gcagcgaggccucgugcugcu

SEQ ID NO: 310785 - RNA, 16 nt, Bordetella pertussis
gcagcgaggcgcgggc

SEQ ID NO: 310786 - RNA, 17 nt, Bordetella pertussis
gcagcgaggcgcgggcg

SEQ ID NO: 310787 - RNA, 13 nt, Bordetella pertussis
gcagcgccaccgg

SEQ ID NO: 310788 - RNA, 14 nt, Bordetella pertussis
gcagcgaggcgcag

SEQ ID NO: 310789 - RNA, 14 nt, Bordetella pertussis
gcagcgccagggcc

SEQ ID NO: 310790 - RNA, 18 nt, Bordetella pertussis
gcagcgccagggccaggc

SEQ ID NO: 310791 - RNA, 19 nt, Bordetella pertussis
gcagcgccagggccaggcc

SEQ ID NO: 310792 - RNA, 13 nt, Bordetella pertussis
gcagcgcccaggc

SEQ ID NO: 310793 - RNA, 15 nt, Bordetella pertussis
gcagcgcccaggcga

SEQ ID NO: 310794 - RNA, 16 nt, Bordetella pertussis
gcagcgcccgcgccau

SEQ ID NO: 310795 - RNA, 13 nt, Bordetella pertussis
gcagcgccugccg

SEQ ID NO: 310796 - RNA, 14 nt, Bordetella pertussis
gcagcgccuggccg

SEQ ID NO: 310797 - RNA, 17 nt, Bordetella pertussis
gcagcgccuggccgagc

SEQ ID NO: 310798 - RNA, 18 nt, Bordetella pertussis
gcagcgccuggccgagcg

SEQ ID NO: 310799 - RNA, 19 nt, Bordetella pertussis
gcagcgccuggccgagcgc

SEQ ID NO: 310800 - RNA, 17 nt, Bordetella pertussis
gcagcgccuugcggcgc

SEQ ID NO: 310801 - RNA, 19 nt, Bordetella pertussis
gcagcgcgaacggcgggcg

SEQ ID NO: 310802 - RNA, 21 nt, Bordetella pertussis
gcagugccugcgaacgcccgg

SEQ ID NO: 310803 - RNA, 22 nt, Bordetella pertussis
gcagugccugcgaacgcccggc

SEQ ID NO: 310804 - RNA, 17 nt, Bordetella pertussis
gcagugguggugcagcg

SEQ ID NO: 310805 - RNA, 21 nt, Bordetella pertussis
gcagugguggugcagcggcag

SEQ ID NO: 310806 - RNA, 18 nt, Bordetella pertussis
gcagugucaggaugcccu

SEQ ID NO: 310807 - RNA, 16 nt, Bordetella pertussis
gcagugugccuguccc

SEQ ID NO: 310808 - RNA, 15 nt, Bordetella pertussis
gcaguucgcccggcu

SEQ ID NO: 310809 - RNA, 17 nt, Bordetella pertussis
gcaguucgggguccagc

SEQ ID NO: 310810 - RNA, 13 nt, Bordetella pertussis
gcaguucgcccgg

SEQ ID NO: 310811 - RNA, 22 nt, Bordetella pertussis
gcaguugacccauaccagcccg

SEQ ID NO: 310812 - RNA, 23 nt, Bordetella pertussis
gcaguugacccauaccagcccgg

SEQ ID NO: 310813 - RNA, 17 nt, Bordetella pertussis
gcaguugcgccacgguc

SEQ ID NO: 310814 - RNA, 18 nt, Bordetella pertussis
gcaguugcgucuccagcg

SEQ ID NO: 310815 - RNA, 20 nt, Bordetella pertussis
gcaguugcgucuccagcgcg

SEQ ID NO: 310816 - RNA, 14 nt, Bordetella pertussis
gcaguugcuggcgg

SEQ ID NO: 310817 - RNA, 23 nt, Bordetella pertussis
gcauacauccucgaugccgaacu

SEQ ID NO: 310818 - RNA, 15 nt, Bordetella pertussis
gcauacccugcgcgc

SEQ ID NO: 310819 - RNA, 22 nt, Bordetella pertussis
gcauacgccgauggcgcggccg

SEQ ID NO: 310820 - RNA, 14 nt, Bordetella pertussis
gcauacgccgcuga

SEQ ID NO: 310821 - RNA, 20 nt, Bordetella pertussis
gcauacggacgagcgcagca

SEQ ID NO: 310822 - RNA, 14 nt, Bordetella pertussis
gcauacucgaugcc

SEQ ID NO: 310823 - RNA, 20 nt, Bordetella pertussis
gcauacucgaugcccagcac

SEQ ID NO: 310824 - RNA, 22 nt, Bordetella pertussis
gcauacucggaagacauggcgc

SEQ ID NO: 310825 - RNA, 15 nt, Bordetella pertussis
gcauagacgccgacc

SEQ ID NO: 310826 - RNA, 13 nt, Bordetella pertussis
gcauagcccaggc

SEQ ID NO: 310827 - RNA, 20 nt, Bordetella pertussis
gcauaggcggcgcaggccag

SEQ ID NO: 310828 - RNA, 22 nt, Bordetella pertussis
gcauagguaucggcccgcgcca

SEQ ID NO: 310829 - RNA, 14 nt, Bordetella pertussis
gcauauccaggcgg

SEQ ID NO: 310830 - RNA, 16 nt, Bordetella pertussis
gcaucaacacgcugga

SEQ ID NO: 310831 - RNA, 20 nt, Bordetella pertussis
gcaucacgccgguguucucg

SEQ ID NO: 310832 - RNA, 21 nt, Bordetella pertussis
gcaucacuuucccauccuggc

SEQ ID NO: 310833 - RNA, 21 nt, Bordetella pertussis
gcaucagcagacccuggcgcg

SEQ ID NO: 310834 - RNA, 13 nt, Bordetella pertussis
gcaucagcgcgcc

SEQ ID NO: 310835 - RNA, 19 nt, Bordetella pertussis
gcaucagggcgaugccgca

SEQ ID NO: 310836 - RNA, 19 nt, Bordetella pertussis
gcaucaggggcucggccag

SEQ ID NO: 310837 - RNA, 17 nt, Bordetella pertussis
gcaucaguucaggcugg

SEQ ID NO: 310838 - RNA, 13 nt, Bordetella pertussis
gcaucauggcgcg

SEQ ID NO: 310839 - RNA, 23 nt, Bordetella pertussis
gcaucauggcgcgcgccgcgcug

SEQ ID NO: 310840 - RNA, 20 nt, Bordetella pertussis
gcaucauguaaggcgcaugc

SEQ ID NO: 310841 - RNA, 21 nt, Bordetella pertussis
gcaucauguaaggcgcaugcc

SEQ ID NO: 310842 - RNA, 22 nt, Bordetella pertussis
gcaucauguaaggcgcaugcca

SEQ ID NO: 310843 - RNA, 13 nt, Bordetella pertussis
gcauccagcggca

SEQ ID NO: 310844 - RNA, 20 nt, Bordetella pertussis
gcauccaggucuacccgcgc

SEQ ID NO: 310845 - RNA, 17 nt, Bordetella pertussis
gcauccaggugccgcgu

SEQ ID NO: 310846 - RNA, 20 nt, Bordetella pertussis
gcaucccaauuggccgcccu

SEQ ID NO: 310847 - RNA, 21 nt, Bordetella pertussis
gcaucccaauuggccgcccug

SEQ ID NO: 310848 - RNA, 19 nt, Bordetella pertussis
gcauccgcgccaggauggc

SEQ ID NO: 310849 - RNA, 17 nt, Bordetella pertussis
gcauccggcccagcgcc

SEQ ID NO: 310850 - RNA, 13 nt, Bordetella pertussis
gcauccggcccgg

SEQ ID NO: 310851 - RNA, 20 nt, Bordetella pertussis
gcauccggugauuucggcgc

SEQ ID NO: 310852 - RNA, 18 nt, Bordetella pertussis
gcauccuucacgaaccgc

SEQ ID NO: 310853 - RNA, 15 nt, Bordetella pertussis
gcaucgacagcgcgc

SEQ ID NO: 310854 - RNA, 17 nt, Bordetella pertussis
gcaucgacagcgcgccc

SEQ ID NO: 310855 - RNA, 21 nt, Bordetella pertussis
gcaucgacaugcccgccggca

SEQ ID NO: 310856 - RNA, 17 nt, Bordetella pertussis
gcaucgaccacgcgcgc

SEQ ID NO: 310857 - RNA, 15 nt, Bordetella pertussis
gcaucgaccagcgca

SEQ ID NO: 310858 - RNA, 17 nt, Bordetella pertussis
gcaucgaccagcgcacg

SEQ ID NO: 310859 - RNA, 18 nt, Bordetella pertussis
gcaucgaccagcgcacgg

SEQ ID NO: 310860 - RNA, 18 nt, Bordetella pertussis
gcaucgagaaaccagccg

SEQ ID NO: 310861 - RNA, 16 nt, Bordetella pertussis
gcaucgaucagcgcgc

SEQ ID NO: 310862 - RNA, 18 nt, Bordetella pertussis
gcaucgaucagcgcgccg

SEQ ID NO: 310863 - RNA, 16 nt, Bordetella pertussis
gcaucgaucaggcugu

SEQ ID NO: 310864 - RNA, 19 nt, Bordetella pertussis
gcaucgaucaggcugucgc

SEQ ID NO: 310865 - RNA, 15 nt, Bordetella pertussis
gcaucgaugcggccu

SEQ ID NO: 310866 - RNA, 18 nt, Bordetella pertussis
gcaucgauuucucgcugc

SEQ ID NO: 310867 - RNA, 19 nt, Bordetella pertussis
gcaucgauuucucgcugcu

SEQ ID NO: 310868 - RNA, 15 nt, Bordetella pertussis
gcaucgccaugccgg

SEQ ID NO: 310869 - RNA, 15 nt, Bordetella pertussis
gcaucgcccaccaug

SEQ ID NO: 310870 - RNA, 12 nt, Bordetella pertussis
gcaucgccgaac

SEQ ID NO: 310871 - RNA, 18 nt, Bordetella pertussis
gcaucgccgccagcuugg

SEQ ID NO: 310872 - RNA, 15 nt, Bordetella pertussis
gcaucgccgcgggcg

SEQ ID NO: 310873 - RNA, 17 nt, Bordetella pertussis
gcaucgcgaugcgcagc

SEQ ID NO: 310874 - RNA, 22 nt, Bordetella pertussis
gcaucgcgcaagggccagucgu

SEQ ID NO: 310875 - RNA, 13 nt, Bordetella pertussis
gcaucgcgcgccg

SEQ ID NO: 310876 - RNA, 14 nt, Bordetella pertussis
gcaucgcgcgccgc

SEQ ID NO: 310877 - RNA, 15 nt, Bordetella pertussis
gcaucgcgcgccgcc

SEQ ID NO: 310878 - RNA, 20 nt, Bordetella pertussis
gcaucgcgcgccgccgcccg

SEQ ID NO: 310879 - RNA, 14 nt, Bordetella pertussis
gcaucgcgcgcgcc

SEQ ID NO: 310880 - RNA, 13 nt, Bordetella pertussis
gcaucgcgcggca

SEQ ID NO: 310881 - RNA, 14 nt, Bordetella pertussis
gcaucgcgcggcau

SEQ ID NO: 310882 - RNA, 13 nt, Bordetella pertussis
gcaucgcgcugac

SEQ ID NO: 310883 - RNA, 17 nt, Bordetella pertussis
gcaucgcggcagcccgg

SEQ ID NO: 310884 - RNA, 13 nt, Bordetella pertussis
gcaucgcgcagcg

SEQ ID NO: 310885 - RNA, 21 nt, Bordetella pertussis
gcaucggcacaccccgggcgg

SEQ ID NO: 310886 - RNA, 18 nt, Bordetella pertussis
gcaucggcacccagccgg

SEQ ID NO: 310887 - RNA, 14 nt, Bordetella pertussis
gcaucggccagcau

SEQ ID NO: 310888 - RNA, 21 nt, Bordetella pertussis
gcaucggccaggcgccugagc

SEQ ID NO: 310889 - RNA, 17 nt, Bordetella pertussis
gcaucggccauggcggu

SEQ ID NO: 310890 - RNA, 18 nt, Bordetella pertussis
gcaucggccggcggucgc

SEQ ID NO: 310891 - RNA, 23 nt, Bordetella pertussis
gcaucggccggcggucgcgcugg

SEQ ID NO: 310892 - RNA, 24 nt, Bordetella pertussis
gcaucggccggcggucgcgcuggc

SEQ ID NO: 310893 - RNA, 18 nt, Bordetella pertussis
gcaucggccugcaccggc

SEQ ID NO: 310894 - RNA, 21 nt, Bordetella pertussis
gcaucggccugcaccggcgcg

SEQ ID NO: 310895 - RNA, 18 nt, Bordetella pertussis
gcaucggcgccggcgucc

SEQ ID NO: 310896 - RNA, 13 nt, Bordetella pertussis
gcaucggcgccgc

SEQ ID NO: 310897 - RNA, 14 nt, Bordetella pertussis
gcaucggcgccgcg

SEQ ID NO: 310898 - RNA, 15 nt, Bordetella pertussis
gcaucggcuggcgca

SEQ ID NO: 310899 - RNA, 16 nt, Bordetella pertussis
gcaucggcuggcgcaa

SEQ ID NO: 310900 - RNA, 20 nt, Bordetella pertussis
gcaucgggauccgugcggcg

SEQ ID NO: 310901 - RNA, 15 nt, Bordetella pertussis
gcaucgggcagggcu

SEQ ID NO: 310902 - RNA, 22 nt, Bordetella pertussis
gcaucguaguugggcgccuugc

SEQ ID NO: 310903 - RNA, 20 nt, Bordetella pertussis
gcaucguaucgggcgucagc

SEQ ID NO: 310904 - RNA, 21 nt, Bordetella pertussis
gcaucgucaggcaggcgcgcc

SEQ ID NO: 310905 - RNA, 15 nt, Bordetella pertussis
gcaucgucgcgcugc

SEQ ID NO: 310906 - RNA, 22 nt, Bordetella pertussis
gcaucguggccgcuucggcggc

SEQ ID NO: 310907 - RNA, 19 nt, Bordetella pertussis
gcaucgugugccagccccc

SEQ ID NO: 310908 - RNA, 14 nt, Bordetella pertussis
gcaucucgaagcgc

SEQ ID NO: 310909 - RNA, 18 nt, Bordetella pertussis
gcaucucggcaucggcca

SEQ ID NO: 310910 - RNA, 19 nt, Bordetella pertussis
gcaucuugccuuggcgaau

SEQ ID NO: 310911 - RNA, 15 nt, Bordetella pertussis
gcaucuugcgccgcu

SEQ ID NO: 310912 - RNA, 18 nt, Bordetella pertussis
gcaucuugcgccgcugcg

SEQ ID NO: 310913 - RNA, 15 nt, Bordetella pertussis
gcaucuuggccgcca

SEQ ID NO: 310914 - RNA, 16 nt, Bordetella pertussis
gcaugaaaaagggcgc

SEQ ID NO: 310915 - RNA, 19 nt, Bordetella pertussis
gcaugaaaaagggcgcacc

SEQ ID NO: 310916 - RNA, 17 nt, Bordetella pertussis
gcaugaaccgcagcgcc

SEQ ID NO: 310917 - RNA, 18 nt, Bordetella pertussis
gcaugaaccgcagcgcca

SEQ ID NO: 310918 - RNA, 18 nt, Bordetella pertussis
gcaugaacggcagcgcgc

SEQ ID NO: 310919 - RNA, 14 nt, Bordetella pertussis
gcaugaagcgcagc

SEQ ID NO: 310920 - RNA, 15 nt, Bordetella pertussis
gcaugaagcgcagca

SEQ ID NO: 310921 - RNA, 17 nt, Bordetella pertussis
gcaugaagcgguggcgg

SEQ ID NO: 310922 - RNA, 15 nt, Bordetella pertussis
gcaugaagcugccca

SEQ ID NO: 310923 - RNA, 16 nt, Bordetella pertussis
gcaugaccgacaggcg

SEQ ID NO: 310924 - RNA, 20 nt, Bordetella pertussis
gcaugaccgccgccagcagc

SEQ ID NO: 310925 - RNA, 22 nt, Bordetella pertussis
gcaugaccgccgccagcagcgc

SEQ ID NO: 310926 - RNA, 16 nt, Bordetella pertussis
gcaugaccgccggcac

SEQ ID NO: 310927 - RNA, 15 nt, Bordetella pertussis
gcaugaccucggccu

SEQ ID NO: 310928 - RNA, 22 nt, Bordetella pertussis
gcaugaccugcgacagcaccgg

SEQ ID NO: 310929 - RNA, 18 nt, Bordetella pertussis
gcaugacgaggugccugu

SEQ ID NO: 310930 - RNA, 24 nt, Bordetella pertussis
gcaugacgaucacgggcuguucgc

SEQ ID NO: 310931 - RNA, 20 nt, Bordetella pertussis
gcaugacggccaggauggcg

SEQ ID NO: 310932 - RNA, 21 nt, Bordetella pertussis
gcaugacggccaggauggcgu

SEQ ID NO: 310933 - RNA, 20 nt, Bordetella pertussis
gcaugacggggucggggcag

SEQ ID NO: 310934 - RNA, 22 nt, Bordetella pertussis
gcaugaucuugccgaccgcguc

SEQ ID NO: 310935 - RNA, 14 nt, Bordetella pertussis
gcaugauggccggc

SEQ ID NO: 310936 - RNA, 15 nt, Bordetella pertussis
gcaugauggccggcc

SEQ ID NO: 310937 - RNA, 21 nt, Bordetella pertussis
gcaugauggugcugccgcugc

SEQ ID NO: 310938 - RNA, 21 nt, Bordetella pertussis
gcaugaugucgcgggcccgcu

SEQ ID NO: 310939 - RNA, 21 nt, Bordetella pertussis
gcaugauuccugucgcgcugc

SEQ ID NO: 310940 - RNA, 17 nt, Bordetella pertussis
gcaugcaagacaggccg

SEQ ID NO: 310941 - RNA, 17 nt, Bordetella pertussis
gcaugcaccgcguggcg

SEQ ID NO: 310942 - RNA, 23 nt, Bordetella pertussis
gcaugcaccgcguggcgcugcgu

SEQ ID NO: 310943 - RNA, 14 nt, Bordetella pertussis
gcaugcacgauggu

SEQ ID NO: 310944 - RNA, 21 nt, Bordetella pertussis
gcaugcacgaugguaucggcc

SEQ ID NO: 310945 - RNA, 20 nt, Bordetella pertussis
gcaugcagcauguauucauc

SEQ ID NO: 310946 - RNA, 16 nt, Bordetella pertussis
gcaugccaccacaagg

SEQ ID NO: 310947 - RNA, 21 nt, Bordetella pertussis
gcaugccagcuugcaggcgcc

SEQ ID NO: 310948 - RNA, 19 nt, Bordetella pertussis
gcaugcccauuuccaccac

SEQ ID NO: 310949 - RNA, 20 nt, Bordetella pertussis
gcaugcccauuuccaccacg

SEQ ID NO: 310950 - RNA, 20 nt, Bordetella pertussis
gcaugccccaacggcgcacc

SEQ ID NO: 310951 - RNA, 21 nt, Bordetella pertussis
gcaugccccaacggcgcaccg

SEQ ID NO: 310952 - RNA, 15 nt, Bordetella pertussis
gcaugccaugcgcac

SEQ ID NO: 310953 - RNA, 20 nt, Bordetella pertussis
gcaugcccgaccgcaugggc

SEQ ID NO: 310954 - RNA, 17 nt, Bordetella pertussis
gcaugccgaccaccagc

SEQ ID NO: 310955 - RNA, 19 nt, Bordetella pertussis
gcaugccgaccaccagcac

SEQ ID NO: 310956 - RNA, 18 nt, Bordetella pertussis
gcaugccgaucagcgggc

SEQ ID NO: 310957 - RNA, 16 nt, Bordetella pertussis
gcaugccgcgguggcg

SEQ ID NO: 310958 - RNA, 19 nt, Bordetella pertussis
gcaugccgcgguggcgggc

SEQ ID NO: 310959 - RNA, 19 nt, Bordetella pertussis
gcaugccgcugcaggucgg

SEQ ID NO: 310960 - RNA, 22 nt, Bordetella pertussis
gcaugccggacgcggggauggc

SEQ ID NO: 310961 - RNA, 23 nt, Bordetella pertussis
gcaugccggacgcggggauggcu

SEQ ID NO: 310962 - RNA, 14 nt, Bordetella pertussis
gcaugccggcgaug

SEQ ID NO: 310963 - RNA, 16 nt, Bordetella pertussis
gcaugccggcgaugau

SEQ ID NO: 310964 - RNA, 13 nt, Bordetella pertussis
gcaugccguccac

SEQ ID NO: 310965 - RNA, 16 nt, Bordetella pertussis
gcaugccgucgagcgc

SEQ ID NO: 310966 - RNA, 23 nt, Bordetella pertussis
gcaugccgucgcgcucggacgcc

SEQ ID NO: 310967 - RNA, 16 nt, Bordetella pertussis
gcaugcgaaagccggc

SEQ ID NO: 310968 - RNA, 18 nt, Bordetella pertussis
gcaugcgaaagccggccu

SEQ ID NO: 310969 - RNA, 13 nt, Bordetella pertussis
gcaugcgccagcc

SEQ ID NO: 310970 - RNA, 19 nt, Bordetella pertussis
gcaugcgccagccagcgca

SEQ ID NO: 310971 - RNA, 14 nt, Bordetella pertussis
gcaugcgccagcgc

SEQ ID NO: 310972 - RNA, 15 nt, Bordetella pertussis
gcaugcgccagcgcc

SEQ ID NO: 310973 - RNA, 21 nt, Bordetella pertussis
gcaugcgccgcaccagcggcg

SEQ ID NO: 310974 - RNA, 15 nt, Bordetella pertussis
gcaugcgccggcccg

SEQ ID NO: 310975 - RNA, 16 nt, Bordetella pertussis
gcaugcgccggcccgg

SEQ ID NO: 310976 - RNA, 15 nt, Bordetella pertussis
gcaugcgccugcgcc

SEQ ID NO: 310977 - RNA, 22 nt, Bordetella pertussis
gcaugcgccugucccaggcgcu

SEQ ID NO: 310978 - RNA, 18 nt, Bordetella pertussis
gcaugcgcgaacgcgcgc

SEQ ID NO: 310979 - RNA, 23 nt, Bordetella pertussis
gcaugcgcgaacgcgcgccggcc

SEQ ID NO: 310980 - RNA, 17 nt, Bordetella pertussis
gcaugcgcagcgcgucg

SEQ ID NO: 310981 - RNA, 22 nt, Bordetella pertussis
gcaugcgcagcgcgucggcgcg

SEQ ID NO: 310982 - RNA, 13 nt, Bordetella pertussis
gcaugcgcgccag

SEQ ID NO: 310983 - RNA, 14 nt, Bordetella pertussis
gcaugcgcgccagu

SEQ ID NO: 310984 - RNA, 14 nt, Bordetella pertussis
gcaugcgcgcgacu

SEQ ID NO: 310985 - RNA, 14 nt, Bordetella pertussis
gcaugcgcgcggcc

SEQ ID NO: 310986 - RNA, 15 nt, Bordetella pertussis
gcaugcgcgcggccu

SEQ ID NO: 310987 - RNA, 21 nt, Bordetella pertussis
gcaugcgcgucuccagcgccg

SEQ ID NO: 310988 - RNA, 18 nt, Bordetella pertussis
gcaugcggcccgcgcugu

SEQ ID NO: 310989 - RNA, 19 nt, Bordetella pertussis
gcaugcggcgccugucccg

SEQ ID NO: 310990 - RNA, 13 nt, Bordetella pertussis
gcaugcgggccau

SEQ ID NO: 310991 - RNA, 15 nt, Bordetella pertussis
gcaugcgugaagccc

SEQ ID NO: 310992 - RNA, 21 nt, Bordetella pertussis
gcaugcgguuucucagcgcgc

SEQ ID NO: 310993 - RNA, 21 nt, Bordetella pertussis
gcaugcgugcgcaucagcgca

SEQ ID NO: 310994 - RNA, 21 nt, Bordetella pertussis
gcaugcucuggcacaccagcg

SEQ ID NO: 310995 - RNA, 16 nt, Bordetella pertussis
gcaugcugcagcugcu

SEQ ID NO: 310996 - RNA, 20 nt, Bordetella pertussis
gcaugcugguugggcucggu

SEQ ID NO: 310997 - RNA, 22 nt, Bordetella pertussis
gcauggaaccgguuggccagcu

SEQ ID NO: 310998 - RNA, 20 nt, Bordetella pertussis
gcauggacugcaggcgcugc

SEQ ID NO: 310999 - RNA, 16 nt, Bordetella pertussis
gcauggagcuggggcc

SEQ ID NO: 311000 - RNA, 14 nt, Bordetella pertussis
gcauggccagcgcg

SEQ ID NO: 311001 - RNA, 16 nt, Bordetella pertussis
gcauggccagcgcgca

SEQ ID NO: 311002 - RNA, 13 nt, Bordetella pertussis
gcauggccagcac

SEQ ID NO: 311003 - RNA, 13 nt, Bordetella pertussis
gcauggccaucgc

SEQ ID NO: 311004 - RNA, 14 nt, Bordetella pertussis
gcauggccguggcg

SEQ ID NO: 311005 - RNA, 16 nt, Bordetella pertussis
gcauggcgaucgaacg

SEQ ID NO: 311006 - RNA, 17 nt, Bordetella pertussis
gcauggcgaucgaacgc

SEQ ID NO: 311007 - RNA, 17 nt, Bordetella pertussis
gcauggcgccgcgccgc

SEQ ID NO: 311008 - RNA, 18 nt, Bordetella pertussis
gcauggcgccgcgccgcc

SEQ ID NO: 311009 - RNA, 22 nt, Bordetella pertussis
gcauggcgccgcgccgccgccu

SEQ ID NO: 311010 - RNA, 20 nt, Bordetella pertussis
gcauggcgcgcgggcccugg

SEQ ID NO: 311011 - RNA, 19 nt, Bordetella pertussis
gcauggcgcgugcgcgcgc

SEQ ID NO: 311012 - RNA, 21 nt, Bordetella pertussis
gcauggcgcgugcgcgcgcca

SEQ ID NO: 311013 - RNA, 12 nt, Bordetella pertussis
gcauggcggcca

SEQ ID NO: 311014 - RNA, 14 nt, Bordetella pertussis
gcauggcggccagc

SEQ ID NO: 311015 - RNA, 15 nt, Bordetella pertussis
gcauggcggccaggc

SEQ ID NO: 311016 - RNA, 16 nt, Bordetella pertussis
gcauggcggccaggcg

SEQ ID NO: 311017 - RNA, 21 nt, Bordetella pertussis
gcauggcggccaggcgcgccg

SEQ ID NO: 311018 - RNA, 22 nt, Bordetella pertussis
gcauggcggccaggcgcgccgc

SEQ ID NO: 311019 - RNA, 14 nt, Bordetella pertussis
gcauggcggcgccc

SEQ ID NO: 311020 - RNA, 19 nt, Bordetella pertussis
gcauggcggcgcccgcugc

SEQ ID NO: 311021 - RNA, 14 nt, Bordetella pertussis
gcauggcgggcgag

SEQ ID NO: 311022 - RNA, 20 nt, Bordetella pertussis
gcauggcgggcgagaucagc

SEQ ID NO: 311023 - RNA, 22 nt, Bordetella pertussis
gcauggcgucaagccagcggcg

SEQ ID NO: 311024 - RNA, 20 nt, Bordetella pertussis
gcauggcgucgaaacgcugc

SEQ ID NO: 311025 - RNA, 24 nt, Bordetella pertussis
gcauggcgucgaaacgcugcgcga

SEQ ID NO: 311026 - RNA, 19 nt, Bordetella pertussis
gcauggcgaugaccucggc

SEQ ID NO: 311027 - RNA, 19 nt, Bordetella pertussis
gcauggcuggucccugcgc

SEQ ID NO: 311028 - RNA, 20 nt, Bordetella pertussis
gcaugggagaguucauccac

SEQ ID NO: 311029 - RNA, 23 nt, Bordetella pertussis
gcaugggcacauacagcggagcc

SEQ ID NO: 311030 - RNA, 14 nt, Bordetella pertussis
gcaugggcgcaggc

SEQ ID NO: 311031 - RNA, 13 nt, Bordetella pertussis
gcaugggcgccga

SEQ ID NO: 311032 - RNA, 14 nt, Bordetella pertussis
gcaugggcgcgccc

SEQ ID NO: 311033 - RNA, 19 nt, Bordetella pertussis
gcaugggccaggcgcucca

SEQ ID NO: 311034 - RNA, 21 nt, Bordetella pertussis
gcaugggcccgggcgcgcugu

SEQ ID NO: 311035 - RNA, 14 nt, Bordetella pertussis
gcauggggacuggc

SEQ ID NO: 311036 - RNA, 22 nt, Bordetella pertussis
gcauggggacuggcgccugcaa

SEQ ID NO: 311037 - RNA, 20 nt, Bordetella pertussis
gcauggguaaagcgccggcc

SEQ ID NO: 311038 - RNA, 19 nt, Bordetella pertussis
gcauggggcaggcgcagcg

SEQ ID NO: 311039 - RNA, 16 nt, Bordetella pertussis
gcaugggggcuggcgc

SEQ ID NO: 311040 - RNA, 18 nt, Bordetella pertussis
gcaugguagcgguccagc

SEQ ID NO: 311041 - RNA, 14 nt, Bordetella pertussis
gcaugguggcgcag

SEQ ID NO: 311042 - RNA, 17 nt, Bordetella pertussis
gcauguacucggccagg

SEQ ID NO: 311043 - RNA, 19 nt, Bordetella pertussis
gcauguaggccucgggcca

SEQ ID NO: 311044 - RNA, 20 nt, Bordetella pertussis
gcauguaggccucgggccau

SEQ ID NO: 311045 - RNA, 21 nt, Bordetella pertussis
gcauguagucgucgcuggccc

SEQ ID NO: 311046 - RNA, 23 nt, Bordetella pertussis
gcauguauucaucacgggcgcca

SEQ ID NO: 311047 - RNA, 14 nt, Bordetella pertussis
gcaugucagcgccu

SEQ ID NO: 311048 - RNA, 14 nt, Bordetella pertussis
gcauguccagcggc

SEQ ID NO: 311049 - RNA, 16 nt, Bordetella pertussis
gcauguccgccacgcc

SEQ ID NO: 311050 - RNA, 13 nt, Bordetella pertussis
gcauguccgccau

SEQ ID NO: 311051 - RNA, 19 nt, Bordetella pertussis
gcauguccgccaugcgaug

SEQ ID NO: 311052 - RNA, 23 nt, Bordetella pertussis
gcauguccguaucgcggccgagc

SEQ ID NO: 311053 - RNA, 18 nt, Bordetella pertussis
gcaugucgaagcaggcgg

SEQ ID NO: 311054 - RNA, 19 nt, Bordetella pertussis
gcaugucgaagcaggcggu

SEQ ID NO: 311055 - RNA, 23 nt, Bordetella pertussis
gcaugucgaagcaggcgguacag

SEQ ID NO: 311056 - RNA, 19 nt, Bordetella pertussis
gcaugucgcggcccacggc

SEQ ID NO: 311057 - RNA, 20 nt, Bordetella pertussis
gcaugucgcggcccacggcc

SEQ ID NO: 311058 - RNA, 21 nt, Bordetella pertussis
gcaugucgcggcccacggcca

SEQ ID NO: 311059 - RNA, 18 nt, Bordetella pertussis
gcaugucguacaggccgu

SEQ ID NO: 311060 - RNA, 16 nt, Bordetella pertussis
gcaugugcgcggcguu

SEQ ID NO: 311061 - RNA, 15 nt, Bordetella pertussis
gcaugugccaccgcc

SEQ ID NO: 311062 - RNA, 21 nt, Bordetella pertussis
gcauucgaacaacagcgccug

SEQ ID NO: 311063 - RNA, 15 nt, Bordetella pertussis
gcauucggcggccgg

SEQ ID NO: 311064 - RNA, 17 nt, Bordetella pertussis
gcauucggcggccggcu

SEQ ID NO: 311065 - RNA, 19 nt, Bordetella pertussis
gcauucgugaugccccagg

SEQ ID NO: 311066 - RNA, 14 nt, Bordetella pertussis
gcauucguccaggu

SEQ ID NO: 311067 - RNA, 23 nt, Bordetella pertussis
gcauucguccagguugucggcca

SEQ ID NO: 311068 - RNA, 14 nt, Bordetella pertussis
gcauucucggacag

SEQ ID NO: 311069 - RNA, 22 nt, Bordetella pertussis
gcauugaucgaucagccagccg

SEQ ID NO: 311070 - RNA, 16 nt, Bordetella pertussis
gcauugcacaacgggc

SEQ ID NO: 311071 - RNA, 15 nt, Bordetella pertussis
gcauugcccaccacg

SEQ ID NO: 311072 - RNA, 16 nt, Bordetella pertussis
gcauugccgccgcccu

SEQ ID NO: 311073 - RNA, 20 nt, Bordetella pertussis
gcauugccggagcagcagcg

SEQ ID NO: 311074 - RNA, 13 nt, Bordetella pertussis
gcauugcgccagc

SEQ ID NO: 311075 - RNA, 15 nt, Bordetella pertussis
gcauugcgccagccg

SEQ ID NO: 311076 - RNA, 14 nt, Bordetella pertussis
gcauuggcgccgcg

SEQ ID NO: 311077 - RNA, 17 nt, Bordetella pertussis
gcauuggcgccgcgcuc

SEQ ID NO: 311078 - RNA, 13 nt, Bordetella pertussis
gcauuggcggcgg

SEQ ID NO: 311079 - RNA, 14 nt, Bordetella pertussis
gcauugggcagcgg

SEQ ID NO: 311080 - RNA, 22 nt, Bordetella pertussis
gcauuuccucgaccagcgcgcg

SEQ ID NO: 311081 - RNA, 23 nt, Bordetella pertussis
gcauuuccucgaccagcgcgcgg

SEQ ID NO: 311082 - RNA, 16 nt, Bordetella pertussis
gcauuucggcgccgcc

SEQ ID NO: 311083 - RNA, 16 nt, Bordetella pertussis
gccaaagcgcagcgug

SEQ ID NO: 311084 - RNA, 21 nt, Bordetella pertussis
gccaaaucaacgaucuaggcc

SEQ ID NO: 311085 - RNA, 21 nt, Bordetella pertussis
gccaacacgauccacggccgg

SEQ ID NO: 311086 - RNA, 17 nt, Bordetella pertussis
gccaacagcucgcgcca

SEQ ID NO: 311087 - RNA, 18 nt, Bordetella pertussis
gccaacagcucgcgccag

SEQ ID NO: 311088 - RNA, 19 nt, Bordetella pertussis
gccaacagcucgcgccagg

SEQ ID NO: 311089 - RNA, 15 nt, Bordetella pertussis
gccaacccucgcacg

SEQ ID NO: 311090 - RNA, 18 nt, Bordetella pertussis
gccaacgauuccgcgucc

SEQ ID NO: 311091 - RNA, 20 nt, Bordetella pertussis
gccaacgauuccgcguccau

SEQ ID NO: 311092 - RNA, 18 nt, Bordetella pertussis
gccaacgccaagcugcug

SEQ ID NO: 311093 - RNA, 19 nt, Bordetella pertussis
gccaacgccaagcugcugg

SEQ ID NO: 311094 - RNA, 16 nt, Bordetella pertussis
gccaacggcuggcugg

SEQ ID NO: 311095 - RNA, 13 nt, Bordetella pertussis
gccaacgucggca

SEQ ID NO: 311096 - RNA, 15 nt, Bordetella pertussis
gccaacgucggcagc

SEQ ID NO: 311097 - RNA, 17 nt, Bordetella pertussis
gccaacgucggcagcca

SEQ ID NO: 311098 - RNA, 23 nt, Bordetella pertussis
gccaacggugccagucccccugc

SEQ ID NO: 311099 - RNA, 18 nt, Bordetella pertussis
gccaagcagcgccugccg

SEQ ID NO: 311100 - RNA, 13 nt, Bordetella pertussis
gccaagcgccgcg

SEQ ID NO: 311101 - RNA, 13 nt, Bordetella pertussis
gccaagcgcgccg

SEQ ID NO: 311102 - RNA, 18 nt, Bordetella pertussis
gccaagcugcuggccggc

SEQ ID NO: 311103 - RNA, 19 nt, Bordetella pertussis
gccaaggccggcgcgucgc

SEQ ID NO: 311104 - RNA, 21 nt, Bordetella pertussis
gccaauagcgguggcgggcca

SEQ ID NO: 311105 - RNA, 17 nt, Bordetella pertussis
gccaaucggccugcugg

SEQ ID NO: 311106 - RNA, 18 nt, Bordetella pertussis
gccaaucggccugcuggu

SEQ ID NO: 311107 - RNA, 21 nt, Bordetella pertussis
gccaaucugccgcugaccggc

SEQ ID NO: 311108 - RNA, 16 nt, Bordetella pertussis
gccacaagcggcccca

SEQ ID NO: 311109 - RNA, 17 nt, Bordetella pertussis
gccacaauugccagccu

SEQ ID NO: 311110 - RNA, 21 nt, Bordetella pertussis
gccacaccagguugucggcgc

SEQ ID NO: 311111 - RNA, 22 nt, Bordetella pertussis
gccacaccagguugucggcgcc

SEQ ID NO: 311112 - RNA, 23 nt, Bordetella pertussis
gccacaccagguugucggcgcca

SEQ ID NO: 311113 - RNA, 13 nt, Bordetella pertussis
gccacacgaucag

SEQ ID NO: 311114 - RNA, 16 nt, Bordetella pertussis
gccacacgaucagcgc

SEQ ID NO: 311115 - RNA, 18 nt, Bordetella pertussis
gccacacgaucagcgccc

SEQ ID NO: 311116 - RNA, 20 nt, Bordetella pertussis
gccacacgcugaagcgccgc

SEQ ID NO: 311117 - RNA, 15 nt, Bordetella pertussis
gccacacgggcgccu

SEQ ID NO: 311118 - RNA, 17 nt, Bordetella pertussis
gccacacgggcgccugc

SEQ ID NO: 311119 - RNA, 20 nt, Bordetella pertussis
gccacagggccugacgcuca

SEQ ID NO: 311120 - RNA, 23 nt, Bordetella pertussis
gccacagggccugacgcucaucc

SEQ ID NO: 311121 - RNA, 21 nt, Bordetella pertussis
gccacaggugcgcggcgcgcc

SEQ ID NO: 311122 - RNA, 22 nt, Bordetella pertussis
gccacaggugcgcggcgcgccg

SEQ ID NO: 311123 - RNA, 18 nt, Bordetella pertussis
gccacauaaucgucggca

SEQ ID NO: 311124 - RNA, 22 nt, Bordetella pertussis
gccacaucaucgaccaccagcg

SEQ ID NO: 311125 - RNA, 17 nt, Bordetella pertussis
gccacauccugcacggc

SEQ ID NO: 311126 - RNA, 16 nt, Bordetella pertussis
gccacauggucgccca

SEQ ID NO: 311127 - RNA, 19 nt, Bordetella pertussis
gccacauggucgcccagca

SEQ ID NO: 311128 - RNA, 16 nt, Bordetella pertussis
gccaccgugauggcgc

SEQ ID NO: 311129 - RNA, 16 nt, Bordetella pertussis
gccaccgucgccaccu

SEQ ID NO: 311130 - RNA, 20 nt, Bordetella pertussis
gccacgaaacccaggaagcg

SEQ ID NO: 311131 - RNA, 23 nt, Bordetella pertussis
gccacgaacggcgcgaaggugcg

SEQ ID NO: 311132 - RNA, 16 nt, Bordetella pertussis
gccacgaagcgcagca

SEQ ID NO: 311133 - RNA, 19 nt, Bordetella pertussis
gccacgaagugcgccccca

SEQ ID NO: 311134 - RNA, 19 nt, Bordetella pertussis
gccacgaauuccucgccgc

SEQ ID NO: 311135 - RNA, 22 nt, Bordetella pertussis
gccacgaauuccucgccgccca

SEQ ID NO: 311136 - RNA, 16 nt, Bordetella pertussis
gccacgaccaccagcg

SEQ ID NO: 311137 - RNA, 14 nt, Bordetella pertussis
gccacgaccggcuc

SEQ ID NO: 311138 - RNA, 16 nt, Bordetella pertussis
gccacgacgccgucgc

SEQ ID NO: 311139 - RNA, 18 nt, Bordetella pertussis
gccacgacgccgucgcgg

SEQ ID NO: 311140 - RNA, 19 nt, Bordetella pertussis
gccacgacgccgucgcgga

SEQ ID NO: 311141 - RNA, 21 nt, Bordetella pertussis
gccacgacguagucggcgccc

SEQ ID NO: 311142 - RNA, 22 nt, Bordetella pertussis
gccacgagcaguacacgcgcaa

SEQ ID NO: 311143 - RNA, 23 nt, Bordetella pertussis
gccacgaucccgucauggcggca

SEQ ID NO: 311144 - RNA, 12 nt, Bordetella pertussis
gccacgcagcgc

SEQ ID NO: 311145 - RNA, 13 nt, Bordetella pertussis
gccacgcaggcgg

SEQ ID NO: 311146 - RNA, 18 nt, Bordetella pertussis
gccacgcaggcgggcgcc

SEQ ID NO: 311147 - RNA, 19 nt, Bordetella pertussis
gccacgcaggcgggcgccg

SEQ ID NO: 311148 - RNA, 20 nt, Bordetella pertussis
gccacgcaggcgggcgccgc

SEQ ID NO: 311149 - RNA, 21 nt, Bordetella pertussis
gccacgcaggcgggcgccgcg

SEQ ID NO: 311150 - RNA, 19 nt, Bordetella pertussis
gccacgccagcggcgagca

SEQ ID NO: 311151 - RNA, 15 nt, Bordetella pertussis
gccacgcccaggccg

SEQ ID NO: 311152 - RNA, 18 nt, Bordetella pertussis
gccacgcccaggccgugg

SEQ ID NO: 311153 - RNA, 21 nt, Bordetella pertussis
gccacgcccaggccguggcgc

SEQ ID NO: 311154 - RNA, 23 nt, Bordetella pertussis
gccacgcccaggccguggcgcac

SEQ ID NO: 311155 - RNA, 23 nt, Bordetella pertussis
gccacgcccgucucgcgcgccag

SEQ ID NO: 311156 - RNA, 12 nt, Bordetella pertussis
gccacgcccugg

SEQ ID NO: 311157 - RNA, 23 nt, Bordetella pertussis
gccacgcccaagucgaguucggc

SEQ ID NO: 311158 - RNA, 14 nt, Bordetella pertussis
gccacggcccgcca

SEQ ID NO: 311159 - RNA, 16 nt, Bordetella pertussis
gccacggcccgccagg

SEQ ID NO: 311160 - RNA, 13 nt, Bordetella pertussis
gccacggcccugg

SEQ ID NO: 311161 - RNA, 13 nt, Bordetella pertussis
gccacggccgcga

SEQ ID NO: 311162 - RNA, 17 nt, Bordetella pertussis
gccacggccugcccggg

SEQ ID NO: 311163 - RNA, 22 nt, Bordetella pertussis
gccacggcgaugaacagcggca

SEQ ID NO: 311164 - RNA, 14 nt, Bordetella pertussis
gccacggcgggccg

SEQ ID NO: 311165 - RNA, 18 nt, Bordetella pertussis
gccacggcgggccggcuc

SEQ ID NO: 311166 - RNA, 23 nt, Bordetella pertussis
gccacggcggugaccaccaggcc

SEQ ID NO: 311167 - RNA, 22 nt, Bordetella pertussis
gccacggcgucgaugcgcgcgc

SEQ ID NO: 311168 - RNA, 13 nt, Bordetella pertussis
gccacggcgucgc

SEQ ID NO: 311169 - RNA, 19 nt, Bordetella pertussis
gccacggcgucgccggcca

SEQ ID NO: 311170 - RNA, 20 nt, Bordetella pertussis
gccacggcgucgccggccag

SEQ ID NO: 311171 - RNA, 19 nt, Bordetella pertussis
gccacggcuucgcccagcg

SEQ ID NO: 311172 - RNA, 21 nt, Bordetella pertussis
gccacgggauguccgcgucgg

SEQ ID NO: 311173 - RNA, 14 nt, Bordetella pertussis
gccacgggcccgcg

SEQ ID NO: 311174 - RNA, 20 nt, Bordetella pertussis
gccacgggcccgcgcagacg

SEQ ID NO: 311175 - RNA, 21 nt, Bordetella pertussis
gccacgggcgucaccggcgag

SEQ ID NO: 311176 - RNA, 13 nt, Bordetella pertussis
gccacggucggca

SEQ ID NO: 311177 - RNA, 21 nt, Bordetella pertussis
gccacggucugcacgccgggc

SEQ ID NO: 311178 - RNA, 19 nt, Bordetella pertussis
gccacucgaugggcgcgcg

SEQ ID NO: 311179 - RNA, 21 nt, Bordetella pertussis
gccacucgaugggcgcgcgca

SEQ ID NO: 311180 - RNA, 17 nt, Bordetella pertussis
gccacugccaggcgccc

SEQ ID NO: 311181 - RNA, 12 nt, Bordetella pertussis
gccacugcggcc

SEQ ID NO: 311182 - RNA, 18 nt, Bordetella pertussis
gccagaaagcgcggccgg

SEQ ID NO: 311183 - RNA, 16 nt, Bordetella pertussis
gccagaacagccgcga

SEQ ID NO: 311184 - RNA, 21 nt, Bordetella pertussis
gccagacauugucaagcagcg

SEQ ID NO: 311185 - RNA, 22 nt, Bordetella pertussis
gccagacauugucaagcagcgc

SEQ ID NO: 311186 - RNA, 14 nt, Bordetella pertussis
gccagaccgcgcgc

SEQ ID NO: 311187 - RNA, 17 nt, Bordetella pertussis
gccagaccgcgcgcacc

SEQ ID NO: 311188 - RNA, 13 nt, Bordetella pertussis
gccagacggccag

SEQ ID NO: 311189 - RNA, 18 nt, Bordetella pertussis
gccagacggccagcgcgc

SEQ ID NO: 311190 - RNA, 16 nt, Bordetella pertussis
gccagauaaaggccgc

SEQ ID NO: 311191 - RNA, 16 nt, Bordetella pertussis
gccagauagcccaggc

SEQ ID NO: 311192 - RNA, 15 nt, Bordetella pertussis
gccagauagucgcgg

SEQ ID NO: 311193 - RNA, 21 nt, Bordetella pertussis
gccagauagucgcggaugcgc

SEQ ID NO: 311194 - RNA, 22 nt, Bordetella pertussis
gccagauagucgcggaugcgcg

SEQ ID NO: 311195 - RNA, 19 nt, Bordetella pertussis
gccagaucguugaucucgc

SEQ ID NO: 311196 - RNA, 17 nt, Bordetella pertussis
gccagaucucgcguccg

SEQ ID NO: 311197 - RNA, 14 nt, Bordetella pertussis
gccagaugcgccgc

SEQ ID NO: 311198 - RNA, 17 nt, Bordetella pertussis
gccagcacgaaccacag

SEQ ID NO: 311199 - RNA, 15 nt, Bordetella pertussis
gccagcacgaucacg

SEQ ID NO: 311200 - RNA, 23 nt, Bordetella pertussis
gccagcacgaucacgaacagcgc

SEQ ID NO: 311201 - RNA, 14 nt, Bordetella pertussis
gccagcacgccggc

SEQ ID NO: 311202 - RNA, 16 nt, Bordetella pertussis
gccagcacgccggcca

SEQ ID NO: 311203 - RNA, 18 nt, Bordetella pertussis
gccagcacgccggccagg

SEQ ID NO: 311204 - RNA, 15 nt, Bordetella pertussis
gccagcacgccggcg

SEQ ID NO: 311205 - RNA, 16 nt, Bordetella pertussis
gccagcacgcgcagcu

SEQ ID NO: 311206 - RNA, 15 nt, Bordetella pertussis
gccagcagcaggccg

SEQ ID NO: 311207 - RNA, 16 nt, Bordetella pertussis
gccagcagcaggccgu

SEQ ID NO: 311208 - RNA, 13 nt, Bordetella pertussis
gccagcacgccgg

SEQ ID NO: 311209 - RNA, 18 nt, Bordetella pertussis
gccagcagcgcaucgcgc

SEQ ID NO: 311210 - RNA, 24 nt, Bordetella pertussis
gccagcagcgcaucgcgcgcgccg

SEQ ID NO: 311211 - RNA, 14 nt, Bordetella pertussis
gccagcagcgccgc

SEQ ID NO: 311212 - RNA, 23 nt, Bordetella pertussis
gccagcagcgcgugcagccagcg

SEQ ID NO: 311213 - RNA, 14 nt, Bordetella pertussis
gccagcagcucggc

SEQ ID NO: 311214 - RNA, 18 nt, Bordetella pertussis
gccagcagcucggccacc

SEQ ID NO: 311215 - RNA, 21 nt, Bordetella pertussis
gccagcagggucagcggccgg

SEQ ID NO: 311216 - RNA, 17 nt, Bordetella pertussis
gccagcaggucgcgcac

SEQ ID NO: 311217 - RNA, 23 nt, Bordetella pertussis
gccagcaggucgcgcacgcuggc

SEQ ID NO: 311218 - RNA, 22 nt, Bordetella pertussis
gccagcaguucgggguccagca

SEQ ID NO: 311219 - RNA, 23 nt, Bordetella pertussis
gccagcaguucgggguccagcaa

SEQ ID NO: 311220 - RNA, 21 nt, Bordetella pertussis
gccagccaccccgucaucgcc

SEQ ID NO: 311221 - RNA, 14 nt, Bordetella pertussis
gccagccacgccgg

SEQ ID NO: 311222 - RNA, 15 nt, Bordetella pertussis
gccagccacgccggc

SEQ ID NO: 311223 - RNA, 16 nt, Bordetella pertussis
gccagccacgcgcgcu

SEQ ID NO: 311224 - RNA, 21 nt, Bordetella pertussis
gccagccacgcgcgcuggcgc

SEQ ID NO: 311225 - RNA, 12 nt, Bordetella pertussis
gccagccagcgc

SEQ ID NO: 311226 - RNA, 15 nt, Bordetella pertussis
gccagccagcgccgc

SEQ ID NO: 311227 - RNA, 13 nt, Bordetella pertussis
gccagccaggcgg

SEQ ID NO: 311228 - RNA, 16 nt, Bordetella pertussis
gccagcccaccagcgc

SEQ ID NO: 311229 - RNA, 17 nt, Bordetella pertussis
gccagcccccugcgggg

SEQ ID NO: 311230 - RNA, 18 nt, Bordetella pertussis
gccagccccggcgcgccg

SEQ ID NO: 311231 - RNA, 15 nt, Bordetella pertussis
gccagcccgcgcgcg

SEQ ID NO: 311232 - RNA, 15 nt, Bordetella pertussis
gccagcccgcugccg

SEQ ID NO: 311233 - RNA, 16 nt, Bordetella pertussis
gccagcccgccgcugg

SEQ ID NO: 311234 - RNA, 13 nt, Bordetella pertussis
gccagccgcgccu

SEQ ID NO: 311235 - RNA, 16 nt, Bordetella pertussis
gccagccgcgccugca

SEQ ID NO: 311236 - RNA, 23 nt, Bordetella pertussis
gccagccgcgccugcagcagcgg

SEQ ID NO: 311237 - RNA, 16 nt, Bordetella pertussis
gccagccgcgcgaccu

SEQ ID NO: 311238 - RNA, 15 nt, Bordetella pertussis
gccagccgcuccagg

SEQ ID NO: 311239 - RNA, 13 nt, Bordetella pertussis
gccagccgcucgc

SEQ ID NO: 311240 - RNA, 15 nt, Bordetella pertussis
gccagccgcucgcgc

SEQ ID NO: 311241 - RNA, 20 nt, Bordetella pertussis
gccagccgcucgcgcgacca

SEQ ID NO: 311242 - RNA, 15 nt, Bordetella pertussis
gccagccgcuggcgc

SEQ ID NO: 311243 - RNA, 20 nt, Bordetella pertussis
gccagccgcuggcgcgccgc

SEQ ID NO: 311244 - RNA, 22 nt, Bordetella pertussis
gccagccgcuugcggccaggcg

SEQ ID NO: 311245 - RNA, 15 nt, Bordetella pertussis
gccagccggcccagc

SEQ ID NO: 311246 - RNA, 14 nt, Bordetella pertussis
gccagccggcccga

SEQ ID NO: 311247 - RNA, 17 nt, Bordetella pertussis
gccagccggcgcgccau

SEQ ID NO: 311248 - RNA, 16 nt, Bordetella pertussis
gccagccggccgaugg

SEQ ID NO: 311249 - RNA, 19 nt, Bordetella pertussis
gccagccgggcgaucgcgu

SEQ ID NO: 311250 - RNA, 17 nt, Bordetella pertussis
gccagccggguggucgc

SEQ ID NO: 311251 - RNA, 13 nt, Bordetella pertussis
gccagcgaggccg

SEQ ID NO: 311252 - RNA, 16 nt, Bordetella pertussis
gccagcgaggccgcuu

SEQ ID NO: 311253 - RNA, 19 nt, Bordetella pertussis
gccagcgccaccaccggca

SEQ ID NO: 311254 - RNA, 12 nt, Bordetella pertussis
gccagcgccacg

SEQ ID NO: 311255 - RNA, 15 nt, Bordetella pertussis
gccagcgccacgccc

SEQ ID NO: 311256 - RNA, 16 nt, Bordetella pertussis
gccagcgccacgcccu

SEQ ID NO: 311257 - RNA, 18 nt, Bordetella pertussis
gccagcgccacgcccugg

SEQ ID NO: 311258 - RNA, 16 nt, Bordetella pertussis
gccagcgccacgcgag

SEQ ID NO: 311259 - RNA, 18 nt, Bordetella pertussis
gccagcgccagaaagcgc

SEQ ID NO: 311260 - RNA, 20 nt, Bordetella pertussis
gccagcgccagaaagcgcgg

SEQ ID NO: 311261 - RNA, 13 nt, Bordetella pertussis
gccagcgccagca

SEQ ID NO: 311262 - RNA, 14 nt, Bordetella pertussis
gccagcgccagcac

SEQ ID NO: 311263 - RNA, 15 nt, Bordetella pertussis
gccagcgccagcacg

SEQ ID NO: 311264 - RNA, 16 nt, Bordetella pertussis
gccagcgccagcacga

SEQ ID NO: 311265 - RNA, 13 nt, Bordetella pertussis
gccagcgccagcc

SEQ ID NO: 311266 - RNA, 13 nt, Bordetella pertussis
gccagcgcggcuu

SEQ ID NO: 311267 - RNA, 15 nt, Bordetella pertussis
gccagcgcggcuugg

SEQ ID NO: 311268 - RNA, 18 nt, Bordetella pertussis
gccagcgcggcgggccgg

SEQ ID NO: 311269 - RNA, 20 nt, Bordetella pertussis
gccagcgcgucgagcagcgc

SEQ ID NO: 311270 - RNA, 16 nt, Bordetella pertussis
gccagcgcgucgcgua

SEQ ID NO: 311271 - RNA, 23 nt, Bordetella pertussis
gccagcgcgucgcguagcgcggc

SEQ ID NO: 311272 - RNA, 21 nt, Bordetella pertussis
gccagcgcgucguccagcgug

SEQ ID NO: 311273 - RNA, 19 nt, Bordetella pertussis
gccagcgcuguccaggccg

SEQ ID NO: 311274 - RNA, 17 nt, Bordetella pertussis
gccagcgcuucgggcag

SEQ ID NO: 311275 - RNA, 21 nt, Bordetella pertussis
gccagcgcuucgggcagcucg

SEQ ID NO: 311276 - RNA, 22 nt, Bordetella pertussis
gccagcgcuucgggcagcucgc

SEQ ID NO: 311277 - RNA, 23 nt, Bordetella pertussis
gccagcgcuucgggcagcucgcg

SEQ ID NO: 311278 - RNA, 21 nt, Bordetella pertussis
gccagcggaugaugcggcgcc

SEQ ID NO: 311279 - RNA, 22 nt, Bordetella pertussis
gccagcggauggugcucggcga

SEQ ID NO: 311280 - RNA, 13 nt, Bordetella pertussis
gccagcggcagcg

SEQ ID NO: 311281 - RNA, 17 nt, Bordetella pertussis
gccagcggcagcgcgca

SEQ ID NO: 311282 - RNA, 16 nt, Bordetella pertussis
gccagcggcaggacgg

SEQ ID NO: 311283 - RNA, 17 nt, Bordetella pertussis
gccagcggcaggacggg

SEQ ID NO: 311284 - RNA, 16 nt, Bordetella pertussis
gccagcggcaggccca

SEQ ID NO: 311285 - RNA, 19 nt, Bordetella pertussis
gccagcggcaggcccagcu

SEQ ID NO: 311286 - RNA, 19 nt, Bordetella pertussis
gccagcggcaggggcucgc

SEQ ID NO: 311287 - RNA, 21 nt, Bordetella pertussis
gccagcggcaggggcucgcgc

SEQ ID NO: 311288 - RNA, 16 nt, Bordetella pertussis
gccagcggccgauagc

SEQ ID NO: 311289 - RNA, 18 nt, Bordetella pertussis
gccagcggugcgcggcgc

SEQ ID NO: 311290 - RNA, 20 nt, Bordetella pertussis
gccagcggugcgcggcgcag

SEQ ID NO: 311291 - RNA, 22 nt, Bordetella pertussis
gccagcggugcgcggcgcagcc

SEQ ID NO: 311292 - RNA, 15 nt, Bordetella pertussis
gccagcggccgucgc

SEQ ID NO: 311293 - RNA, 15 nt, Bordetella pertussis
gccagcggcgagcaa

SEQ ID NO: 311294 - RNA, 19 nt, Bordetella pertussis
gccagcgguucgucggcgc

SEQ ID NO: 311295 - RNA, 14 nt, Bordetella pertussis
gccagcguaucgcc

SEQ ID NO: 311296 - RNA, 15 nt, Bordetella pertussis
gccagcgucagcgca

SEQ ID NO: 311297 - RNA, 16 nt, Bordetella pertussis
gccagcgucaggcugg

SEQ ID NO: 311298 - RNA, 17 nt, Bordetella pertussis
gccaggaagaucggccc

SEQ ID NO: 311299 - RNA, 19 nt, Bordetella pertussis
gccaggaagaucggcccgg

SEQ ID NO: 311300 - RNA, 21 nt, Bordetella pertussis
gccaggaagaucggcccggcg

SEQ ID NO: 311301 - RNA, 15 nt, Bordetella pertussis
gccaggaagcgcgcc

SEQ ID NO: 311302 - RNA, 22 nt, Bordetella pertussis
gccaggaagcgcgccgcgcgca

SEQ ID NO: 311303 - RNA, 17 nt, Bordetella pertussis
gccaggaccgaggugcc

SEQ ID NO: 311304 - RNA, 21 nt, Bordetella pertussis
gccaggacgaucccggccacg

SEQ ID NO: 311305 - RNA, 22 nt, Bordetella pertussis
gccaggacgaucccggccacgg

SEQ ID NO: 311306 - RNA, 23 nt, Bordetella pertussis
gccaggacuucgucgaucauggc

SEQ ID NO: 311307 - RNA, 15 nt, Bordetella pertussis
gccaggcagauccgc

SEQ ID NO: 311308 - RNA, 21 nt, Bordetella pertussis
gccaggcauugaagcuggcgc

SEQ ID NO: 311309 - RNA, 23 nt, Bordetella pertussis
gccaggcauugaagcuggcgccg

SEQ ID NO: 311310 - RNA, 13 nt, Bordetella pertussis
gccaggccagcag

SEQ ID NO: 311311 - RNA, 14 nt, Bordetella pertussis
gccaggccagcgcc

SEQ ID NO: 311312 - RNA, 16 nt, Bordetella pertussis
gccaggccagcgccag

SEQ ID NO: 311313 - RNA, 15 nt, Bordetella pertussis
gccaggcccacggcg

SEQ ID NO: 311314 - RNA, 18 nt, Bordetella pertussis
gccaggcccacggcgcca

SEQ ID NO: 311315 - RNA, 13 nt, Bordetella pertussis
gccaggcccaugc

SEQ ID NO: 311316 - RNA, 19 nt, Bordetella pertussis
gccaggcccaugccgcccg

SEQ ID NO: 311317 - RNA, 20 nt, Bordetella pertussis
gccaggcccaugccgcccgc

SEQ ID NO: 311318 - RNA, 21 nt, Bordetella pertussis
gccaggcccaugccgcccgcc

SEQ ID NO: 311319 - RNA, 22 nt, Bordetella pertussis
gccaggcccaugccgcccgcca

SEQ ID NO: 311320 - RNA, 15 nt, Bordetella pertussis
gccaggccccgccgg

SEQ ID NO: 311321 - RNA, 13 nt, Bordetella pertussis
gccaggcccggcg

SEQ ID NO: 311322 - RNA, 14 nt, Bordetella pertussis
gccaggcccggcgc

SEQ ID NO: 311323 - RNA, 18 nt, Bordetella pertussis
gccaggcccggcgcgcau

SEQ ID NO: 311324 - RNA, 17 nt, Bordetella pertussis
gccaggcccucgcggcc

SEQ ID NO: 311325 - RNA, 18 nt, Bordetella pertussis
gccaggcccucgcggccg

SEQ ID NO: 311326 - RNA, 15 nt, Bordetella pertussis
gccaggccucggucg

SEQ ID NO: 311327 - RNA, 17 nt, Bordetella pertussis
gccaggcgaaccuggcg

SEQ ID NO: 311328 - RNA, 16 nt, Bordetella pertussis
gccaggcgagcgccgc

SEQ ID NO: 311329 - RNA, 17 nt, Bordetella pertussis
gccaggcgagcgccgcg

SEQ ID NO: 311330 - RNA, 20 nt, Bordetella pertussis
gccaggcgagcgccgcgcuc

SEQ ID NO: 311331 - RNA, 22 nt, Bordetella pertussis
gccaggcgagcgccgcgcucca

SEQ ID NO: 311332 - RNA, 21 nt, Bordetella pertussis
gccaggcgauggccgggagcg

SEQ ID NO: 311333 - RNA, 13 nt, Bordetella pertussis
gccaggcgcagua

SEQ ID NO: 311334 - RNA, 20 nt, Bordetella pertussis
gccaggcgcaguaucuggug

SEQ ID NO: 311335 - RNA, 21 nt, Bordetella pertussis
gccaggcgcauguccgccacg

SEQ ID NO: 311336 - RNA, 19 nt, Bordetella pertussis
gccaggcgccagaugcgcc

SEQ ID NO: 311337 - RNA, 14 nt, Bordetella pertussis
gccaggcgcccggc

SEQ ID NO: 311338 - RNA, 17 nt, Bordetella pertussis
gccaggcgcccggcgug

SEQ ID NO: 311339 - RNA, 14 nt, Bordetella pertussis
gccaggcgccgcgu

SEQ ID NO: 311340 - RNA, 16 nt, Bordetella pertussis
gccaggcgccgcgucc

SEQ ID NO: 311341 - RNA, 23 nt, Bordetella pertussis
gccaggcgccgcguccggcgccc

SEQ ID NO: 311342 - RNA, 13 nt, Bordetella pertussis
gccaggcgccgcu

SEQ ID NO: 311343 - RNA, 18 nt, Bordetella pertussis
gccaggcgccgcucagcg

SEQ ID NO: 311344 - RNA, 14 nt, Bordetella pertussis
gccaggcgccggcg

SEQ ID NO: 311345 - RNA, 14 nt, Bordetella pertussis
gccaggcgccgggc

SEQ ID NO: 311346 - RNA, 20 nt, Bordetella pertussis
gccaggcgccgggccgcuag

SEQ ID NO: 311347 - RNA, 16 nt, Bordetella pertussis
gccaggcgcgaucgaa

SEQ ID NO: 311348 - RNA, 18 nt, Bordetella pertussis
gccaggcgcgaucgaacg

SEQ ID NO: 311349 - RNA, 15 nt, Bordetella pertussis
gccaggcgcgcaucg

SEQ ID NO: 311350 - RNA, 16 nt, Bordetella pertussis
gccaggcgcgcaucgc

SEQ ID NO: 311351 - RNA, 13 nt, Bordetella pertussis
gccaggcgcgccg

SEQ ID NO: 311352 - RNA, 14 nt, Bordetella pertussis
gccaggcgcgccgc

SEQ ID NO: 311353 - RNA, 13 nt, Bordetella pertussis
gccaggcgcggau

SEQ ID NO: 311354 - RNA, 12 nt, Bordetella pertussis
gccaggcgcucc

SEQ ID NO: 311355 - RNA, 15 nt, Bordetella pertussis
gccaggcgcuccagc

SEQ ID NO: 311356 - RNA, 13 nt, Bordetella pertussis
gccaggcgcucgg

SEQ ID NO: 311357 - RNA, 19 nt, Bordetella pertussis
gccaggcggcggcgcggcg

SEQ ID NO: 311358 - RNA, 22 nt, Bordetella pertussis
gccaggcggcggcgcggcgcca

SEQ ID NO: 311359 - RNA, 23 nt, Bordetella pertussis
gccaggcggcggcgcggcgccau

SEQ ID NO: 311360 - RNA, 19 nt, Bordetella pertussis
gccaggcgguacaggccgg

SEQ ID NO: 311361 - RNA, 23 nt, Bordetella pertussis
gccaggcgguggccucguccacg

SEQ ID NO: 311362 - RNA, 13 nt, Bordetella pertussis
gccaggcguacgc

SEQ ID NO: 311363 - RNA, 21 nt, Bordetella pertussis
gccaggcguagaccaccugcu

SEQ ID NO: 311364 - RNA, 13 nt, Bordetella pertussis
gccaggcucagca

SEQ ID NO: 311365 - RNA, 17 nt, Bordetella pertussis
gccaggcucugggcgga

SEQ ID NO: 311366 - RNA, 22 nt, Bordetella pertussis
gccaggcugaaugccgccguga

SEQ ID NO: 311367 - RNA, 16 nt, Bordetella pertussis
gccaggcugaccagcg

SEQ ID NO: 311368 - RNA, 15 nt, Bordetella pertussis
gccagggugaccugg

SEQ ID NO: 311369 - RNA, 18 nt, Bordetella pertussis
gccagggugccccgccgg

SEQ ID NO: 311370 - RNA, 18 nt, Bordetella pertussis
gccaggguuugcuggcgc

SEQ ID NO: 311371 - RNA, 16 nt, Bordetella pertussis
gccagguacaggccgc

SEQ ID NO: 311372 - RNA, 21 nt, Bordetella pertussis
gccagguacaggccgccgguc

SEQ ID NO: 311373 - RNA, 23 nt, Bordetella pertussis
gccagguagucgucgaaggcgcg

SEQ ID NO: 311374 - RNA, 16 nt, Bordetella pertussis
gccaggugcacagcgu

SEQ ID NO: 311375 - RNA, 18 nt, Bordetella pertussis
gccagguggacagcgcca

SEQ ID NO: 311376 - RNA, 20 nt, Bordetella pertussis
gccagguggacagcgccagc

SEQ ID NO: 311377 - RNA, 21 nt, Bordetella pertussis
gccagguggacagcgccagcc

SEQ ID NO: 311378 - RNA, 14 nt, Bordetella pertussis
gccagguggcgaug

SEQ ID NO: 311379 - RNA, 15 nt, Bordetella pertussis
gccagguggcggcgg

SEQ ID NO: 311380 - RNA, 16 nt, Bordetella pertussis
gccagguggcggcggc

SEQ ID NO: 311381 - RNA, 15 nt, Bordetella pertussis
gccagguguaggcca

SEQ ID NO: 311382 - RNA, 17 nt, Bordetella pertussis
gccaguagcgccggcuu

SEQ ID NO: 311383 - RNA, 22 nt, Bordetella pertussis
gccaguccccauguggggacag

SEQ ID NO: 311384 - RNA, 14 nt, Bordetella pertussis
gccagucccccgcg

SEQ ID NO: 311385 - RNA, 20 nt, Bordetella pertussis
gccagucccccgcggggaca

SEQ ID NO: 311386 - RNA, 19 nt, Bordetella pertussis
gccaguccagcgcgccgcg

SEQ ID NO: 311387 - RNA, 15 nt, Bordetella pertussis
gccaguccccgcaug

SEQ ID NO: 311388 - RNA, 15 nt, Bordetella pertussis
gccaguccgcagcgc

SEQ ID NO: 311389 - RNA, 16 nt, Bordetella pertussis
gccaguccgcagcgca

SEQ ID NO: 311390 - RNA, 22 nt, Bordetella pertussis
gccaguccgcagcgcagcgcca

SEQ ID NO: 311391 - RNA, 14 nt, Bordetella pertussis
gccaguccgcagcg

SEQ ID NO: 311392 - RNA, 16 nt, Bordetella pertussis
gccaguccgcgcucgc

SEQ ID NO: 311393 - RNA, 19 nt, Bordetella pertussis
gccaguccgcgcucgccca

SEQ ID NO: 311394 - RNA, 22 nt, Bordetella pertussis
gccaguccgcgcucgcccagcc

SEQ ID NO: 311395 - RNA, 20 nt, Bordetella pertussis
gccagugaaacgcgacgcgc

SEQ ID NO: 311396 - RNA, 13 nt, Bordetella pertussis
gccagugauggcc

SEQ ID NO: 311397 - RNA, 12 nt, Bordetella pertussis
gccagugccugg

SEQ ID NO: 311398 - RNA, 18 nt, Bordetella pertussis
gccagugccuggacgcgc

SEQ ID NO: 311399 - RNA, 22 nt, Bordetella pertussis
gccagugccuggacgcgcuggc

SEQ ID NO: 311400 - RNA, 20 nt, Bordetella pertussis
gccagugcuucgagauccgc

SEQ ID NO: 311401 - RNA, 16 nt, Bordetella pertussis
gccaguucaaggcgcg

SEQ ID NO: 311402 - RNA, 17 nt, Bordetella pertussis
gccaguucaaggcgcga

SEQ ID NO: 311403 - RNA, 19 nt, Bordetella pertussis
gccaguuccgugcgcgccc

SEQ ID NO: 311404 - RNA, 19 nt, Bordetella pertussis
gccaguucgacgcccaugc

SEQ ID NO: 311405 - RNA, 15 nt, Bordetella pertussis
gccaguucgaugcgc

SEQ ID NO: 311406 - RNA, 16 nt, Bordetella pertussis
gccaguucgcggcgca

SEQ ID NO: 311407 - RNA, 18 nt, Bordetella pertussis
gccaguucgcggcgcagc

SEQ ID NO: 311408 - RNA, 19 nt, Bordetella pertussis
gccaguucgcggcgcagcg

SEQ ID NO: 311409 - RNA, 20 nt, Bordetella pertussis
gccaguucgcggcgcagcgc

SEQ ID NO: 311410 - RNA, 14 nt, Bordetella pertussis
gccaguugaaccgc

SEQ ID NO: 311411 - RNA, 16 nt, Bordetella pertussis
gccaguugccgccgcc

SEQ ID NO: 311412 - RNA, 17 nt, Bordetella pertussis
gccaguugccgccgccg

SEQ ID NO: 311413 - RNA, 13 nt, Bordetella pertussis
gccaguugcgggg

SEQ ID NO: 311414 - RNA, 19 nt, Bordetella pertussis
gccaguugggccagggccu

SEQ ID NO: 311415 - RNA, 17 nt, Bordetella pertussis
gccaguuguagguccag

SEQ ID NO: 311416 - RNA, 22 nt, Bordetella pertussis
gccauaaggcuucucgaccagg

SEQ ID NO: 311417 - RNA, 14 nt, Bordetella pertussis
gccauaggccagcg

SEQ ID NO: 311418 - RNA, 17 nt, Bordetella pertussis
gccauaggccagcgccu

SEQ ID NO: 311419 - RNA, 20 nt, Bordetella pertussis
gccauaggcgcgcaccagcc

SEQ ID NO: 311420 - RNA, 21 nt, Bordetella pertussis
gccauaggcgcgcaccagccc

SEQ ID NO: 311421 - RNA, 16 nt, Bordetella pertussis
gccauagucgcgcaau

SEQ ID NO: 311422 - RNA, 17 nt, Bordetella pertussis
gccauaucccugcggca

SEQ ID NO: 311423 - RNA, 14 nt, Bordetella pertussis
gccaucaacguggc

SEQ ID NO: 311424 - RNA, 15 nt, Bordetella pertussis
gccaucaacguggcg

SEQ ID NO: 311425 - RNA, 21 nt, Bordetella pertussis
gccaucacggugucgaugggc

SEQ ID NO: 311426 - RNA, 16 nt, Bordetella pertussis
gccaucaggugcaggg

SEQ ID NO: 311427 - RNA, 20 nt, Bordetella pertussis
gccaucaucaucgucggcgc

SEQ ID NO: 311428 - RNA, 22 nt, Bordetella pertussis
gccaucaucaucgucggcgcca

SEQ ID NO: 311429 - RNA, 15 nt, Bordetella pertussis
gccauccagccaggc

SEQ ID NO: 311430 - RNA, 17 nt, Bordetella pertussis
gccauccagccaggccg

SEQ ID NO: 311431 - RNA, 18 nt, Bordetella pertussis
gccauccagccaggccgc

SEQ ID NO: 311432 - RNA, 14 nt, Bordetella pertussis
gccauccguccgcc

SEQ ID NO: 311433 - RNA, 13 nt, Bordetella pertussis
gccauccggccgc

SEQ ID NO: 311434 - RNA, 13 nt, Bordetella pertussis
gccauccucgccc

SEQ ID NO: 311435 - RNA, 17 nt, Bordetella pertussis
gccauccucgcccagcg

SEQ ID NO: 311436 - RNA, 18 nt, Bordetella pertussis
gccauccucgcccagcgg

SEQ ID NO: 311437 - RNA, 19 nt, Bordetella pertussis
gccauccucgcccagcggc

SEQ ID NO: 311438 - RNA, 22 nt, Bordetella pertussis
gccauccucgcccagcggcgcc

SEQ ID NO: 311439 - RNA, 18 nt, Bordetella pertussis
gccauccugaacgccgcg

SEQ ID NO: 311440 - RNA, 14 nt, Bordetella pertussis
gccauccuggccgc

SEQ ID NO: 311441 - RNA, 22 nt, Bordetella pertussis
gccaucgacgcuugccggcgau

SEQ ID NO: 311442 - RNA, 18 nt, Bordetella pertussis
gccaucgauaugggcggc

SEQ ID NO: 311443 - RNA, 16 nt, Bordetella pertussis
gccaucgccaggacca

SEQ ID NO: 311444 - RNA, 12 nt, Bordetella pertussis
gccaucgccgcc

SEQ ID NO: 311445 - RNA, 13 nt, Bordetella pertussis
gccaucgcgcauu

SEQ ID NO: 311446 - RNA, 15 nt, Bordetella pertussis
gccaucgcgucgacg

SEQ ID NO: 311447 - RNA, 16 nt, Bordetella pertussis
gccaucgcgucgacgg

SEQ ID NO: 311448 - RNA, 15 nt, Bordetella pertussis
gccaucggcgccaag

SEQ ID NO: 311449 - RNA, 22 nt, Bordetella pertussis
gccaucggcgccaagcggcagg

SEQ ID NO: 311450 - RNA, 22 nt, Bordetella pertussis
gccaucgucguagcgccagcgu

SEQ ID NO: 311451 - RNA, 17 nt, Bordetella pertussis
gccaucuaugucggcua

SEQ ID NO: 311452 - RNA, 16 nt, Bordetella pertussis
gccaucucgcgcgcua

SEQ ID NO: 311453 - RNA, 16 nt, Bordetella pertussis
gccaucucgucgguca

SEQ ID NO: 311454 - RNA, 20 nt, Bordetella pertussis
gccaucugcugcgagacgcg

SEQ ID NO: 311455 - RNA, 21 nt, Bordetella pertussis
gccaucugcugcgagacgcgc

SEQ ID NO: 311456 - RNA, 23 nt, Bordetella pertussis
gccaucuugcaggcgccaguccc

SEQ ID NO: 311457 - RNA, 19 nt, Bordetella pertussis
gccaucuuggugcgcgcca

SEQ ID NO: 311458 - RNA, 20 nt, Bordetella pertussis
gccaugaacgcuugacggcc

SEQ ID NO: 311459 - RNA, 23 nt, Bordetella pertussis
gccaugaacgcuugacggccaag

SEQ ID NO: 311460 - RNA, 23 nt, Bordetella pertussis
gccaugaacgcuugacggccagg

SEQ ID NO: 311461 - RNA, 23 nt, Bordetella pertussis
gccaugaaagcgaacagggcgcg

SEQ ID NO: 311462 - RNA, 14 nt, Bordetella pertussis
gccaugaacucgcg

SEQ ID NO: 311463 - RNA, 22 nt, Bordetella pertussis
gccaugacauaggagaguucgg

SEQ ID NO: 311464 - RNA, 21 nt, Bordetella pertussis
gccaugacaugcgggccucga

SEQ ID NO: 311465 - RNA, 19 nt, Bordetella pertussis
gccaugaccacgucgacca

SEQ ID NO: 311466 - RNA, 14 nt, Bordetella pertussis
gccaugagccacaa

SEQ ID NO: 311467 - RNA, 14 nt, Bordetella pertussis
gccaugcccaggcc

SEQ ID NO: 311468 - RNA, 15 nt, Bordetella pertussis
gccaugcccaggccc

SEQ ID NO: 311469 - RNA, 17 nt, Bordetella pertussis
gccaugcccaggcccag

SEQ ID NO: 311470 - RNA, 14 nt, Bordetella pertussis
gccaugccgcgccc

SEQ ID NO: 311471 - RNA, 16 nt, Bordetella pertussis
gccaugccgcgcccgc

SEQ ID NO: 311472 - RNA, 17 nt, Bordetella pertussis
gccaugccgcgcccgcc

SEQ ID NO: 311473 - RNA, 16 nt, Bordetella pertussis
gccaugccgcgcgccu

SEQ ID NO: 311474 - RNA, 12 nt, Bordetella pertussis
gccaugccggga

SEQ ID NO: 311475 - RNA, 13 nt, Bordetella pertussis
gccaugccgggca

SEQ ID NO: 311476 - RNA, 17 nt, Bordetella pertussis
gccaugccgggcaagca

SEQ ID NO: 311477 - RNA, 20 nt, Bordetella pertussis
gccaugccguccugcugcgg

SEQ ID NO: 311478 - RNA, 21 nt, Bordetella pertussis
gccaugccguccugcugcggc

SEQ ID NO: 311479 - RNA, 14 nt, Bordetella pertussis
gccaugccgucgcg

SEQ ID NO: 311480 - RNA, 17 nt, Bordetella pertussis
gccaugccgucgcgcac

SEQ ID NO: 311481 - RNA, 14 nt, Bordetella pertussis
gccaugcgacagcc

SEQ ID NO: 311482 - RNA, 16 nt, Bordetella pertussis
gccaugcgacagcccg

SEQ ID NO: 311483 - RNA, 17 nt, Bordetella pertussis
gccaugcgacagcccgg

SEQ ID NO: 311484 - RNA, 19 nt, Bordetella pertussis
gccaugcgacagcccggga

SEQ ID NO: 311485 - RNA, 15 nt, Bordetella pertussis
gccauggccggccgc

SEQ ID NO: 311486 - RNA, 18 nt, Bordetella pertussis
gccauggccggccgccgg

SEQ ID NO: 311487 - RNA, 14 nt, Bordetella pertussis
gccauggccggcgu

SEQ ID NO: 311488 - RNA, 21 nt, Bordetella pertussis
gccauggcgcgcagauugcgc

SEQ ID NO: 311489 - RNA, 14 nt, Bordetella pertussis
gccauggcgcuggc

SEQ ID NO: 311490 - RNA, 22 nt, Bordetella pertussis
gccauggcgcuggcaggcgccu

SEQ ID NO: 311491 - RNA, 15 nt, Bordetella pertussis
gccauggcggccgcc

SEQ ID NO: 311492 - RNA, 19 nt, Bordetella pertussis
gccauggcggccgccgcca

SEQ ID NO: 311493 - RNA, 14 nt, Bordetella pertussis
gccauggcggccgg

SEQ ID NO: 311494 - RNA, 15 nt, Bordetella pertussis
gccauggcggccggc

SEQ ID NO: 311495 - RNA, 16 nt, Bordetella pertussis
gccauggcggcgccca

SEQ ID NO: 311496 - RNA, 17 nt, Bordetella pertussis
gccauggcggcgcccau

SEQ ID NO: 311497 - RNA, 20 nt, Bordetella pertussis
gccaugcgauaggcgaagcg

SEQ ID NO: 311498 - RNA, 13 nt, Bordetella pertussis
gccauggcggcgg

SEQ ID NO: 311499 - RNA, 22 nt, Bordetella pertussis
gccauggcggcggccacgaccg

SEQ ID NO: 311500 - RNA, 13 nt, Bordetella pertussis
gccauggucgcga

SEQ ID NO: 311501 - RNA, 16 nt, Bordetella pertussis
gccauggucgcgacca

SEQ ID NO: 311502 - RNA, 20 nt, Bordetella pertussis
gccauggucgcgaccaccgu

SEQ ID NO: 311503 - RNA, 18 nt, Bordetella pertussis
gccauggugaacggcccc

SEQ ID NO: 311504 - RNA, 16 nt, Bordetella pertussis
gccauggugccgcgca

SEQ ID NO: 311505 - RNA, 17 nt, Bordetella pertussis
gccauggugccgcgcag

SEQ ID NO: 311506 - RNA, 18 nt, Bordetella pertussis
gccauggugccgcgcagg

SEQ ID NO: 311507 - RNA, 14 nt, Bordetella pertussis
gccauguagauggc

SEQ ID NO: 311508 - RNA, 18 nt, Bordetella pertussis
gccauguagauggccgcc

SEQ ID NO: 311509 - RNA, 21 nt, Bordetella pertussis
gccauguauaacguggcgcgc

SEQ ID NO: 311510 - RNA, 12 nt, Bordetella pertussis
gcccaggcccgu

SEQ ID NO: 311511 - RNA, 16 nt, Bordetella pertussis
gcccaggcccuggcug

SEQ ID NO: 311512 - RNA, 20 nt, Bordetella pertussis
gcccaggccgccggcggcgu

SEQ ID NO: 311513 - RNA, 21 nt, Bordetella pertussis
gcccaggccgccggcggcguc

SEQ ID NO: 311514 - RNA, 15 nt, Bordetella pertussis
gcccaggccggcgcg

SEQ ID NO: 311515 - RNA, 16 nt, Bordetella pertussis
gcccaggccggcgcgc

SEQ ID NO: 311516 - RNA, 15 nt, Bordetella pertussis
gcccaggccgggcgu

SEQ ID NO: 311517 - RNA, 16 nt, Bordetella pertussis
gcccaggccguggcgc

SEQ ID NO: 311518 - RNA, 18 nt, Bordetella pertussis
gcccaggcgaugcccagc

SEQ ID NO: 311519 - RNA, 22 nt, Bordetella pertussis
gcccaggcgaugcccagcgccg

SEQ ID NO: 311520 - RNA, 12 nt, Bordetella pertussis
gcccaggcgcag

SEQ ID NO: 311521 - RNA, 13 nt, Bordetella pertussis
gcccaggcgcagc

SEQ ID NO: 311522 - RNA, 15 nt, Bordetella pertussis
gcccaggcgcagccg

SEQ ID NO: 311523 - RNA, 18 nt, Bordetella pertussis
gcccaggcgcgcuggcgc

SEQ ID NO: 311524 - RNA, 17 nt, Bordetella pertussis
gcccaggcggcccagcg

SEQ ID NO: 311525 - RNA, 14 nt, Bordetella pertussis
gcccaggcgggcgu

SEQ ID NO: 311526 - RNA, 14 nt, Bordetella pertussis
gcccagggcagcgg

SEQ ID NO: 311527 - RNA, 15 nt, Bordetella pertussis
gcccagggccgcgcc

SEQ ID NO: 311528 - RNA, 19 nt, Bordetella pertussis
gcccagggccgcgccgggg

SEQ ID NO: 311529 - RNA, 13 nt, Bordetella pertussis
gcccaggggccgg

SEQ ID NO: 311530 - RNA, 20 nt, Bordetella pertussis
gcccaggggccggcgcgccg

SEQ ID NO: 311531 - RNA, 21 nt, Bordetella pertussis
gcccaggggccggcgcgccgc

SEQ ID NO: 311532 - RNA, 22 nt, Bordetella pertussis
gcccaggggccggcgcgccgcg

SEQ ID NO: 311533 - RNA, 17 nt, Bordetella pertussis
gcccagggucggaugcg

SEQ ID NO: 311534 - RNA, 20 nt, Bordetella pertussis
gcccagguacaucaucccca

SEQ ID NO: 311535 - RNA, 22 nt, Bordetella pertussis
gcccagguccugcgccagcuug

SEQ ID NO: 311536 - RNA, 16 nt, Bordetella pertussis
gcccagguccagcgcc

SEQ ID NO: 311537 - RNA, 15 nt, Bordetella pertussis
gcccaggucguugcg

SEQ ID NO: 311538 - RNA, 17 nt, Bordetella pertussis
gcccagguugcggccgc

SEQ ID NO: 311539 - RNA, 21 nt, Bordetella pertussis
gcccagguugcggccgccacc

SEQ ID NO: 311540 - RNA, 22 nt, Bordetella pertussis
gcccagguugcucgccucgaug

SEQ ID NO: 311541 - RNA, 15 nt, Bordetella pertussis
gcccaguacgaugcc

SEQ ID NO: 311542 - RNA, 15 nt, Bordetella pertussis
gcccagucguccagc

SEQ ID NO: 311543 - RNA, 16 nt, Bordetella pertussis
gcccagucguccagca

SEQ ID NO: 311544 - RNA, 18 nt, Bordetella pertussis
gcccagucguccagcacg

SEQ ID NO: 311545 - RNA, 15 nt, Bordetella pertussis
gcccaguccagggug

SEQ ID NO: 311546 - RNA, 20 nt, Bordetella pertussis
gcccaguucgcgcagcagcu

SEQ ID NO: 311547 - RNA, 16 nt, Bordetella pertussis
gcccaguucggcgacg

SEQ ID NO: 311548 - RNA, 14 nt, Bordetella pertussis
gcccaguucggcgc

SEQ ID NO: 311549 - RNA, 21 nt, Bordetella pertussis
gcccaguucgucccagggggu

SEQ ID NO: 311550 - RNA, 17 nt, Bordetella pertussis
gcccaugaaggcggcca

SEQ ID NO: 311551 - RNA, 17 nt, Bordetella pertussis
gcccaugaccggcgugu

SEQ ID NO: 311552 - RNA, 22 nt, Bordetella pertussis
gcccaugaccggcguguccagc

SEQ ID NO: 311553 - RNA, 16 nt, Bordetella pertussis
gcccaugacgccggug

SEQ ID NO: 311554 - RNA, 19 nt, Bordetella pertussis
gcccaugaucagggccgug

SEQ ID NO: 311555 - RNA, 17 nt, Bordetella pertussis
gcccaugauggugccgg

SEQ ID NO: 311556 - RNA, 19 nt, Bordetella pertussis
gcccaugauggugccggug

SEQ ID NO: 311557 - RNA, 15 nt, Bordetella pertussis
gcccaugccgccaug

SEQ ID NO: 311558 - RNA, 17 nt, Bordetella pertussis
gcccaugccgccaugca

SEQ ID NO: 311559 - RNA, 16 nt, Bordetella pertussis
gcccaugccgcccgcc

SEQ ID NO: 311560 - RNA, 17 nt, Bordetella pertussis
gcccaugccgcccgcca

SEQ ID NO: 311561 - RNA, 17 nt, Bordetella pertussis
gcccaugccgccgggca

SEQ ID NO: 311562 - RNA, 12 nt, Bordetella pertussis
gcccaugccgcg

SEQ ID NO: 311563 - RNA, 22 nt, Bordetella pertussis
gcccaugccgcggacccaggcc

SEQ ID NO: 311564 - RNA, 15 nt, Bordetella pertussis
gcccaugcgcugcgc

SEQ ID NO: 311565 - RNA, 17 nt, Bordetella pertussis
gcccaugcgcuggcgca

SEQ ID NO: 311566 - RNA, 20 nt, Bordetella pertussis
gcccaugcgcuggcgcaagg

SEQ ID NO: 311567 - RNA, 19 nt, Bordetella pertussis
gcccaugcugaauugcggg

SEQ ID NO: 311568 - RNA, 17 nt, Bordetella pertussis
gcccauggccagggagg

SEQ ID NO: 311569 - RNA, 19 nt, Bordetella pertussis
gcccauggccugcaaccug

SEQ ID NO: 311570 - RNA, 13 nt, Bordetella pertussis
gcccauggcgcgc

SEQ ID NO: 311571 - RNA, 16 nt, Bordetella pertussis
gcccauggcgcgcagc

SEQ ID NO: 311572 - RNA, 17 nt, Bordetella pertussis
gcccauggcgcgcagca

SEQ ID NO: 311573 - RNA, 14 nt, Bordetella pertussis
gcccauggcguagg

SEQ ID NO: 311574 - RNA, 16 nt, Bordetella pertussis
gcccaugcgaucggcc

SEQ ID NO: 311575 - RNA, 17 nt, Bordetella pertussis
gcccaugcgcauggcca

SEQ ID NO: 311576 - RNA, 20 nt, Bordetella pertussis
gcccauggucaggacgacga

SEQ ID NO: 311577 - RNA, 19 nt, Bordetella pertussis
gcccauguagaacgccagg

SEQ ID NO: 311578 - RNA, 22 nt, Bordetella pertussis
gcccauguagaacgccaggguc

SEQ ID NO: 311579 - RNA, 23 nt, Bordetella pertussis
gcccauguucuggucucccggca

SEQ ID NO: 311580 - RNA, 22 nt, Bordetella pertussis
gcccauguugaacugcaggccg

SEQ ID NO: 311581 - RNA, 23 nt, Bordetella pertussis
gcccauguugaacugcaggccgc

SEQ ID NO: 311582 - RNA, 16 nt, Bordetella pertussis
gcccauucccgcccug

SEQ ID NO: 311583 - RNA, 16 nt, Bordetella pertussis
gcccauuuccgcuucg

SEQ ID NO: 311584 - RNA, 22 nt, Bordetella pertussis
gcccauuuccgcuucggacagc

SEQ ID NO: 311585 - RNA, 15 nt, Bordetella pertussis
gcccauuucgauggc

SEQ ID NO: 311586 - RNA, 13 nt, Bordetella pertussis
gccccaacgcggc

SEQ ID NO: 311587 - RNA, 17 nt, Bordetella pertussis
gccccaacgcggccagc

SEQ ID NO: 311588 - RNA, 18 nt, Bordetella pertussis
gccccaacgcggccagcg

SEQ ID NO: 311589 - RNA, 19 nt, Bordetella pertussis
gccccaacgcggccagcgg

SEQ ID NO: 311590 - RNA, 17 nt, Bordetella pertussis
gccccaguccaggccgg

SEQ ID NO: 311591 - RNA, 21 nt, Bordetella pertussis
gccccaguccaggccggccug

SEQ ID NO: 311592 - RNA, 23 nt, Bordetella pertussis
gccccaguccaggccggccugca

SEQ ID NO: 311593 - RNA, 17 nt, Bordetella pertussis
gccccagucgcugcucg

SEQ ID NO: 311594 - RNA, 13 nt, Bordetella pertussis
gccccaucaccau

SEQ ID NO: 311595 - RNA, 17 nt, Bordetella pertussis
gccccaucauguuguag

SEQ ID NO: 311596 - RNA, 21 nt, Bordetella pertussis
gccccauccacggcgccaugc

SEQ ID NO: 311597 - RNA, 18 nt, Bordetella pertussis
gccccaucccauccgcgc

SEQ ID NO: 311598 - RNA, 19 nt, Bordetella pertussis
gccccaucccauccgcgcc

SEQ ID NO: 311599 - RNA, 19 nt, Bordetella pertussis
gccccaugcgcggcacguc

SEQ ID NO: 311600 - RNA, 15 nt, Bordetella pertussis
gccccauggcaugca

SEQ ID NO: 311601 - RNA, 22 nt, Bordetella pertussis
gccccauggcaugcaccgcgug

SEQ ID NO: 311602 - RNA, 17 nt, Bordetella pertussis
gccccauggccugggug

SEQ ID NO: 311603 - RNA, 20 nt, Bordetella pertussis
gccccauugcgggugggcau

SEQ ID NO: 311604 - RNA, 19 nt, Bordetella pertussis
gccccauugggacgccagc

SEQ ID NO: 311605 - RNA, 22 nt, Bordetella pertussis
gccccauugggacgccagcccg

SEQ ID NO: 311606 - RNA, 20 nt, Bordetella pertussis
gccccauuuuuuugccugcu

SEQ ID NO: 311607 - RNA, 18 nt, Bordetella pertussis
gcccccacgccgcugaug

SEQ ID NO: 311608 - RNA, 17 nt, Bordetella pertussis
gcccccagcacgguugc

SEQ ID NO: 311609 - RNA, 19 nt, Bordetella pertussis
gcccccgaaggccgcgccu

SEQ ID NO: 311610 - RNA, 19 nt, Bordetella pertussis
gccccgacgcggucgccca

SEQ ID NO: 311611 - RNA, 20 nt, Bordetella pertussis
gccccgaucggcgccgcgcg

SEQ ID NO: 311612 - RNA, 15 nt, Bordetella pertussis
gccccgcaaggggcc

SEQ ID NO: 311613 - RNA, 20 nt, Bordetella pertussis
gccccgcaaggggccggcgc

SEQ ID NO: 311614 - RNA, 22 nt, Bordetella pertussis
gccccgcaaggggccggcgccg

SEQ ID NO: 311615 - RNA, 22 nt, Bordetella pertussis
gccccgaugauggauucgcgcc

SEQ ID NO: 311616 - RNA, 17 nt, Bordetella pertussis
gccccgcagggcccgca

SEQ ID NO: 311617 - RNA, 21 nt, Bordetella pertussis
gccccgcagggcccgcaucgg

SEQ ID NO: 311618 - RNA, 21 nt, Bordetella pertussis
gccccgccacgucgccggcgu

SEQ ID NO: 311619 - RNA, 22 nt, Bordetella pertussis
gccccgccacgucgccggcguu

SEQ ID NO: 311620 - RNA, 15 nt, Bordetella pertussis
gccccgcccgcguca

SEQ ID NO: 311621 - RNA, 18 nt, Bordetella pertussis
gccccgcccgcgucacga

SEQ ID NO: 311622 - RNA, 20 nt, Bordetella pertussis
gccccgccagggcggggccg

SEQ ID NO: 311623 - RNA, 17 nt, Bordetella pertussis
gccccgccgggccgcgc

SEQ ID NO: 311624 - RNA, 21 nt, Bordetella pertussis
gccccgccgggccgcgcccac

SEQ ID NO: 311625 - RNA, 22 nt, Bordetella pertussis
aagagccguacucgaucgccau

SEQ ID NO: 311626 - RNA, 23 nt, Bordetella pertussis
gccccgcuggccgucgccgcccu

SEQ ID NO: 311627 - RNA, 16 nt, Bordetella pertussis
gccccgcuucgggccg

SEQ ID NO: 311628 - RNA, 22 nt, Bordetella pertussis
gccccgcuucgggccggauggc

SEQ ID NO: 311629 - RNA, 15 nt, Bordetella pertussis
gccccggcaccaucg

SEQ ID NO: 311630 - RNA, 19 nt, Bordetella pertussis
gccccggcaccaucgccgc

SEQ ID NO: 311631 - RNA, 21 nt, Bordetella pertussis
gccccggcaccaucgccgccu

SEQ ID NO: 311632 - RNA, 23 nt, Bordetella pertussis
gccccuugcccaacgcggcgucg

SEQ ID NO: 311633 - RNA, 15 nt, Bordetella pertussis
gcccgaacagaaggc

SEQ ID NO: 311634 - RNA, 17 nt, Bordetella pertussis
gcccgaacagaaggcgu

SEQ ID NO: 311635 - RNA, 14 nt, Bordetella pertussis
gcccgaaccggcau

SEQ ID NO: 311636 - RNA, 21 nt, Bordetella pertussis
gcccgaagauuuccucgcgca

SEQ ID NO: 311637 - RNA, 17 nt, Bordetella pertussis
gcccgaaggcagcggca

SEQ ID NO: 311638 - RNA, 19 nt, Bordetella pertussis
gcccgaaggcagcggcaca

SEQ ID NO: 311639 - RNA, 21 nt, Bordetella pertussis
gcccgaaggcagcggcacauc

SEQ ID NO: 311640 - RNA, 15 nt, Bordetella pertussis
gcccgaagcgcagca

SEQ ID NO: 311641 - RNA, 22 nt, Bordetella pertussis
gcccgaagcgcagcaccagguc

SEQ ID NO: 311642 - RNA, 22 nt, Bordetella pertussis
gcccgacaccuggacccgcucg

SEQ ID NO: 311643 - RNA, 15 nt, Bordetella pertussis
gcccgacagcacgcc

SEQ ID NO: 311644 - RNA, 19 nt, Bordetella pertussis
gcccgaccugcuggcgcgc

SEQ ID NO: 311645 - RNA, 20 nt, Bordetella pertussis
gcccgaccugcuggcgcgca

SEQ ID NO: 311646 - RNA, 19 nt, Bordetella pertussis
gcccgacgacaacccgaac

SEQ ID NO: 311647 - RNA, 17 nt, Bordetella pertussis
gcccgacgaggagccgg

SEQ ID NO: 311648 - RNA, 15 nt, Bordetella pertussis
gcccgacgccgcgcg

SEQ ID NO: 311649 - RNA, 15 nt, Bordetella pertussis
gcccgacgcgaggca

SEQ ID NO: 311650 - RNA, 18 nt, Bordetella pertussis
gcccgacggacuggcugg

SEQ ID NO: 311651 - RNA, 14 nt, Bordetella pertussis
gcccgacggccagc

SEQ ID NO: 311652 - RNA, 15 nt, Bordetella pertussis
gcccgacggccagcg

SEQ ID NO: 311653 - RNA, 12 nt, Bordetella pertussis
gcccgacggcgc

SEQ ID NO: 311654 - RNA, 20 nt, Bordetella pertussis
gcccgacggcgccgauccgg

SEQ ID NO: 311655 - RNA, 16 nt, Bordetella pertussis
gcccgacggcgcgccc

SEQ ID NO: 311656 - RNA, 18 nt, Bordetella pertussis
gcccgacggcgcgcccgc

SEQ ID NO: 311657 - RNA, 21 nt, Bordetella pertussis
gcccgacggcgcgcccgccgc

SEQ ID NO: 311658 - RNA, 23 nt, Bordetella pertussis
gcccgacggcgcgcccgccgcgu

SEQ ID NO: 311659 - RNA, 18 nt, Bordetella pertussis
gcccgacuuggugggcac

SEQ ID NO: 311660 - RNA, 22 nt, Bordetella pertussis
gcccgagaagggcuugaccagg

SEQ ID NO: 311661 - RNA, 15 nt, Bordetella pertussis
gcccgagaccgcccg

SEQ ID NO: 311662 - RNA, 16 nt, Bordetella pertussis
gcccgagaccgcccgc

SEQ ID NO: 311663 - RNA, 15 nt, Bordetella pertussis
gcccgagagcugcgu

SEQ ID NO: 311664 - RNA, 16 nt, Bordetella pertussis
gcccgagaugcccgac

SEQ ID NO: 311665 - RNA, 17 nt, Bordetella pertussis
gcccgagaugcccgacg

SEQ ID NO: 311666 - RNA, 14 nt, Bordetella pertussis
gcccgagauggcgc

SEQ ID NO: 311667 - RNA, 15 nt, Bordetella pertussis
gcccgagauggcgca

SEQ ID NO: 311668 - RNA, 22 nt, Bordetella pertussis
gcccgagauggcgcaggcgcgc

SEQ ID NO: 311669 - RNA, 13 nt, Bordetella pertussis
gcccgagcgccac

SEQ ID NO: 311670 - RNA, 16 nt, Bordetella pertussis
gcccgagcgcgacagc

SEQ ID NO: 311671 - RNA, 13 nt, Bordetella pertussis
gcccgagcggcgc

SEQ ID NO: 311672 - RNA, 17 nt, Bordetella pertussis
gcccgaggcgcgcagca

SEQ ID NO: 311673 - RNA, 14 nt, Bordetella pertussis
gcccgaggcggcgc

SEQ ID NO: 311674 - RNA, 15 nt, Bordetella pertussis
gcccgaggcggcgcg

SEQ ID NO: 311675 - RNA, 16 nt, Bordetella pertussis
gcccgaggcggcgcgg

SEQ ID NO: 311676 - RNA, 20 nt, Bordetella pertussis
gcccgcaccaugccgauggc

SEQ ID NO: 311677 - RNA, 21 nt, Bordetella pertussis
gcccgcaccaugccgauggcg

SEQ ID NO: 311678 - RNA, 15 nt, Bordetella pertussis
gcccgcaccgcccgc

SEQ ID NO: 311679 - RNA, 12 nt, Bordetella pertussis
gcccgcaccggg

SEQ ID NO: 311680 - RNA, 17 nt, Bordetella pertussis
gcccgcaccgggcggcc

SEQ ID NO: 311681 - RNA, 19 nt, Bordetella pertussis
gcccgcaccgggcggcccg

SEQ ID NO: 311682 - RNA, 20 nt, Bordetella pertussis
gcccgcaccgggcggcccgg

SEQ ID NO: 311683 - RNA, 21 nt, Bordetella pertussis
gcccgcaccugaacaccggcg

SEQ ID NO: 311684 - RNA, 16 nt, Bordetella pertussis
gcccgcacgaagcggc

SEQ ID NO: 311685 - RNA, 13 nt, Bordetella pertussis
gcccgcacgggcc

SEQ ID NO: 311686 - RNA, 15 nt, Bordetella pertussis
gcccgcacgggccga

SEQ ID NO: 311687 - RNA, 21 nt, Bordetella pertussis
gcccgcacgggccgacggccu

SEQ ID NO: 311688 - RNA, 18 nt, Bordetella pertussis
gcccgccaccacgcgcac

SEQ ID NO: 311689 - RNA, 20 nt, Bordetella pertussis
gcccgccaccacgcgcacca

SEQ ID NO: 311690 - RNA, 22 nt, Bordetella pertussis
gcccgccaccacgcgcaccagc

SEQ ID NO: 311691 - RNA, 17 nt, Bordetella pertussis
gcccgccaccacggcgc

SEQ ID NO: 311692 - RNA, 18 nt, Bordetella pertussis
gcccgccaccacggcgcg

SEQ ID NO: 311693 - RNA, 19 nt, Bordetella pertussis
gcccgccaccacggcgcgg

SEQ ID NO: 311694 - RNA, 19 nt, Bordetella pertussis
gcccgccaccaggaacgcc

SEQ ID NO: 311695 - RNA, 22 nt, Bordetella pertussis
gcccgccaccaggaacgccagc

SEQ ID NO: 311696 - RNA, 16 nt, Bordetella pertussis
gcccgccacgcgggcc

SEQ ID NO: 311697 - RNA, 21 nt, Bordetella pertussis
gcccgccacgcgggccggccg

SEQ ID NO: 311698 - RNA, 15 nt, Bordetella pertussis
gcccgccacggcgcc

SEQ ID NO: 311699 - RNA, 16 nt, Bordetella pertussis
gcccgccacggcgccc

SEQ ID NO: 311700 - RNA, 18 nt, Bordetella pertussis
gcccgccagcagcucggc

SEQ ID NO: 311701 - RNA, 13 nt, Bordetella pertussis
gcccgcccgacga

SEQ ID NO: 311702 - RNA, 22 nt, Bordetella pertussis
gcccgcccgacgaggagccggc

SEQ ID NO: 311703 - RNA, 15 nt, Bordetella pertussis
gcccgcccgccgccu

SEQ ID NO: 311704 - RNA, 15 nt, Bordetella pertussis
gcccgcccgcgagcg

SEQ ID NO: 311705 - RNA, 13 nt, Bordetella pertussis
gcccgcccgcgcc

SEQ ID NO: 311706 - RNA, 11 nt, Bordetella pertussis
gcccgcccggg

SEQ ID NO: 311707 - RNA, 21 nt, Bordetella pertussis
gcccgcccuuggucaccgaga

SEQ ID NO: 311708 - RNA, 22 nt, Bordetella pertussis
gcccgccgacgaaaugccggcg

SEQ ID NO: 311709 - RNA, 16 nt, Bordetella pertussis
gcccgccgacugggcu

SEQ ID NO: 311710 - RNA, 19 nt, Bordetella pertussis
gcccgccgagucggcgaug

SEQ ID NO: 311711 - RNA, 21 nt, Bordetella pertussis
gcccgccgagucggcgauggc

SEQ ID NO: 311712 - RNA, 12 nt, Bordetella pertussis
gcccgccgccgg

SEQ ID NO: 311713 - RNA, 14 nt, Bordetella pertussis
gcccgccgcgccau

SEQ ID NO: 311714 - RNA, 16 nt, Bordetella pertussis
gcccgccgcgccaugc

SEQ ID NO: 311715 - RNA, 23 nt, Bordetella pertussis
gcccgccgcgccaugcucgcgca

SEQ ID NO: 311716 - RNA, 15 nt, Bordetella pertussis
gcccgccgcggcagg

SEQ ID NO: 311717 - RNA, 22 nt, Bordetella pertussis
gcccgccgcggcaggccccggc

SEQ ID NO: 311718 - RNA, 13 nt, Bordetella pertussis
gcccgccgcgucg

SEQ ID NO: 311719 - RNA, 14 nt, Bordetella pertussis
gcccgccgcgucgg

SEQ ID NO: 311720 - RNA, 21 nt, Bordetella pertussis
gcccgccguggccaagggcgc

SEQ ID NO: 311721 - RNA, 23 nt, Bordetella pertussis
gcccgccguggccaagggcgccg

SEQ ID NO: 311722 - RNA, 15 nt, Bordetella pertussis
gcccgccucaggccg

SEQ ID NO: 311723 - RNA, 17 nt, Bordetella pertussis
gcccgccucaggccgga

SEQ ID NO: 311724 - RNA, 12 nt, Bordetella pertussis
gcccgccucagg

SEQ ID NO: 311725 - RNA, 14 nt, Bordetella pertussis
gcccgccucaggcc

SEQ ID NO: 311726 - RNA, 12 nt, Bordetella pertussis
gcccgccucgag

SEQ ID NO: 311727 - RNA, 14 nt, Bordetella pertussis
gcccgccucgagcg

SEQ ID NO: 311728 - RNA, 17 nt, Bordetella pertussis
gcccgccugcagcagcg

SEQ ID NO: 311729 - RNA, 14 nt, Bordetella pertussis
gcccgccugcgcca

SEQ ID NO: 311730 - RNA, 16 nt, Bordetella pertussis
gcccgccuucgcugac

SEQ ID NO: 311731 - RNA, 17 nt, Bordetella pertussis
gcccgccuucggcggcg

SEQ ID NO: 311732 - RNA, 20 nt, Bordetella pertussis
gcccgccuucggcggcgggc

SEQ ID NO: 311733 - RNA, 14 nt, Bordetella pertussis
gcccgcgcaccagg

SEQ ID NO: 311734 - RNA, 18 nt, Bordetella pertussis
gcccgcgcaccaggcgcg

SEQ ID NO: 311735 - RNA, 15 nt, Bordetella pertussis
gcccgccuggcgccg

SEQ ID NO: 311736 - RNA, 17 nt, Bordetella pertussis
gcccgccuggcgccgcg

SEQ ID NO: 311737 - RNA, 18 nt, Bordetella pertussis
gcccgccuggucgcuggc

SEQ ID NO: 311738 - RNA, 20 nt, Bordetella pertussis
gcccgccuggucgcuggcgc

SEQ ID NO: 311739 - RNA, 17 nt, Bordetella pertussis
gcccgcgcagacgggcc

SEQ ID NO: 311740 - RNA, 18 nt, Bordetella pertussis
gcccgccugcgccagccg

SEQ ID NO: 311741 - RNA, 22 nt, Bordetella pertussis
gcccgcgcaugcaagacaggcc

SEQ ID NO: 311742 - RNA, 13 nt, Bordetella pertussis
gcccgcgccacca

SEQ ID NO: 311743 - RNA, 16 nt, Bordetella pertussis
gcccgcgccaccaccg

SEQ ID NO: 311744 - RNA, 15 nt, Bordetella pertussis
gcccgcgccagcgcc

SEQ ID NO: 311745 - RNA, 16 nt, Bordetella pertussis
gcccgcgccagcgcca

SEQ ID NO: 311746 - RNA, 18 nt, Bordetella pertussis
gcccgcgccagcgccacg

SEQ ID NO: 311747 - RNA, 20 nt, Bordetella pertussis
gcccgcgccagcgccacgcc

SEQ ID NO: 311748 - RNA, 13 nt, Bordetella pertussis
gcccgcgccaucg

SEQ ID NO: 311749 - RNA, 14 nt, Bordetella pertussis
gcccgcgcccagcu

SEQ ID NO: 311750 - RNA, 14 nt, Bordetella pertussis
gcccgcgccgaagu

SEQ ID NO: 311751 - RNA, 18 nt, Bordetella pertussis
gcccgcugccgagacggc

SEQ ID NO: 311752 - RNA, 19 nt, Bordetella pertussis
gcccgcugccgagacggcc

SEQ ID NO: 311753 - RNA, 13 nt, Bordetella pertussis
gcccgcgccgcgu

SEQ ID NO: 311754 - RNA, 20 nt, Bordetella pertussis
gcccgcugcguccaccacca

SEQ ID NO: 311755 - RNA, 13 nt, Bordetella pertussis
gcccgcuggccau

SEQ ID NO: 311756 - RNA, 21 nt, Bordetella pertussis
gcccgcuggccgaucugcugg

SEQ ID NO: 311757 - RNA, 15 nt, Bordetella pertussis
gcccgcuuccuuggg

SEQ ID NO: 311758 - RNA, 24 nt, Bordetella pertussis
gcccgcuucucacugcccgcgccg

SEQ ID NO: 311759 - RNA, 16 nt, Bordetella pertussis
gcccgcuugcggccgg

SEQ ID NO: 311760 - RNA, 17 nt, Bordetella pertussis
gcccgcuugcggccggc

SEQ ID NO: 311761 - RNA, 16 nt, Bordetella pertussis
gcccggacgcggccgg

SEQ ID NO: 311762 - RNA, 18 nt, Bordetella pertussis
gcccggacgcggccggca

SEQ ID NO: 311763 - RNA, 16 nt, Bordetella pertussis
gcccggauauggccgg

SEQ ID NO: 311764 - RNA, 19 nt, Bordetella pertussis
gcccggauauggccggcgc

SEQ ID NO: 311765 - RNA, 16 nt, Bordetella pertussis
gcccggaucaguccgg

SEQ ID NO: 311766 - RNA, 13 nt, Bordetella pertussis
gcccggcaacccg

SEQ ID NO: 311767 - RNA, 18 nt, Bordetella pertussis
gcccggcaccaugcgcac

SEQ ID NO: 311768 - RNA, 19 nt, Bordetella pertussis
gcccggcagaacagcggau

SEQ ID NO: 311769 - RNA, 17 nt, Bordetella pertussis
gcccggcagcugacggg

SEQ ID NO: 311770 - RNA, 12 nt, Bordetella pertussis
gcccggcaggca

SEQ ID NO: 311771 - RNA, 17 nt, Bordetella pertussis
gcccggcaggcacacga

SEQ ID NO: 311772 - RNA, 20 nt, Bordetella pertussis
gcccggcagggucucggcca

SEQ ID NO: 311773 - RNA, 23 nt, Bordetella pertussis
gcccggccaagcuggagaagcgc

SEQ ID NO: 311774 - RNA, 15 nt, Bordetella pertussis
gcccggccaccagcg

SEQ ID NO: 311775 - RNA, 17 nt, Bordetella pertussis
gcccggccaccagcgug

SEQ ID NO: 311776 - RNA, 16 nt, Bordetella pertussis
gcccggccacggccgg

SEQ ID NO: 311777 - RNA, 14 nt, Bordetella pertussis
gcccggcccaggcc

SEQ ID NO: 311778 - RNA, 15 nt, Bordetella pertussis
gcccggcccaggccg

SEQ ID NO: 311779 - RNA, 16 nt, Bordetella pertussis
gcccggcccaggccgg

SEQ ID NO: 311780 - RNA, 17 nt, Bordetella pertussis
gcccggccccaggccgg

SEQ ID NO: 311781 - RNA, 16 nt, Bordetella pertussis
gcccggcccccagccc

SEQ ID NO: 311782 - RNA, 17 nt, Bordetella pertussis
gcccggcccccagccca

SEQ ID NO: 311783 - RNA, 12 nt, Bordetella pertussis
gcccggccgcca

SEQ ID NO: 311784 - RNA, 15 nt, Bordetella pertussis
gcccggccgccagca

SEQ ID NO: 311785 - RNA, 14 nt, Bordetella pertussis
gcccggccgccagc

SEQ ID NO: 311786 - RNA, 18 nt, Bordetella pertussis
gcccggccgccgccggca

SEQ ID NO: 311787 - RNA, 21 nt, Bordetella pertussis
gcccggccgccucaccgcgcc

SEQ ID NO: 311788 - RNA, 16 nt, Bordetella pertussis
gcccggccggcccgcg

SEQ ID NO: 311789 - RNA, 19 nt, Bordetella pertussis
gcccggccggcccgcgcgc

SEQ ID NO: 311790 - RNA, 13 nt, Bordetella pertussis
gcccggccggccu

SEQ ID NO: 311791 - RNA, 17 nt, Bordetella pertussis
gcccggccggcacggcc

SEQ ID NO: 311792 - RNA, 19 nt, Bordetella pertussis
gcccggccggcacggccgg

SEQ ID NO: 311793 - RNA, 15 nt, Bordetella pertussis
gcccggcgagcaugg

SEQ ID NO: 311794 - RNA, 11 nt, Bordetella pertussis
gcccggcgcca

SEQ ID NO: 311795 - RNA, 13 nt, Bordetella pertussis
gcccggcgccacc

SEQ ID NO: 311796 - RNA, 12 nt, Bordetella pertussis
gcccggcgccgc

SEQ ID NO: 311797 - RNA, 13 nt, Bordetella pertussis
gcccggcgccgcg

SEQ ID NO: 311798 - RNA, 14 nt, Bordetella pertussis
gcccggcgccggug

SEQ ID NO: 311799 - RNA, 15 nt, Bordetella pertussis
gcccggcgccggugg

SEQ ID NO: 311800 - RNA, 12 nt, Bordetella pertussis
gcccggcgcgau

SEQ ID NO: 311801 - RNA, 11 nt, Bordetella pertussis
gcccggcgcgc

SEQ ID NO: 311802 - RNA, 13 nt, Bordetella pertussis
gcccggcgcgcau

SEQ ID NO: 311803 - RNA, 14 nt, Bordetella pertussis
gcccggcgcgcauc

SEQ ID NO: 311804 - RNA, 17 nt, Bordetella pertussis
gcccggcgcgccuucgg

SEQ ID NO: 311805 - RNA, 20 nt, Bordetella pertussis
gcccggcggaucacccagcg

SEQ ID NO: 311806 - RNA, 12 nt, Bordetella pertussis
gcccggcggcca

SEQ ID NO: 311807 - RNA, 13 nt, Bordetella pertussis
gcccggcggccag

SEQ ID NO: 311808 - RNA, 14 nt, Bordetella pertussis
gcccggcggccagg

SEQ ID NO: 311809 - RNA, 16 nt, Bordetella pertussis
gcccggcggccaggcc

SEQ ID NO: 311810 - RNA, 17 nt, Bordetella pertussis
gcccggcggccaggccg

SEQ ID NO: 311811 - RNA, 18 nt, Bordetella pertussis
gcccggcggccaggccgg

SEQ ID NO: 311812 - RNA, 19 nt, Bordetella pertussis
gcccggcggccaggccggc

SEQ ID NO: 311813 - RNA, 21 nt, Bordetella pertussis
gcccggcggccaggccggcgc

SEQ ID NO: 311814 - RNA, 22 nt, Bordetella pertussis
gcccggcggccaggccggcgcg

SEQ ID NO: 311815 - RNA, 23 nt, Bordetella pertussis
gcccggcggccaggccggcgcgc

SEQ ID NO: 311816 - RNA, 14 nt, Bordetella pertussis
gcccggcggcgcgc

SEQ ID NO: 311817 - RNA, 16 nt, Bordetella pertussis
gcccggcggcgcgccg

SEQ ID NO: 311818 - RNA, 24 nt, Bordetella pertussis
gcccggcggcgcgccgccgggccu

SEQ ID NO: 311819 - RNA, 14 nt, Bordetella pertussis
gcccggcggcgcgg

SEQ ID NO: 311820 - RNA, 12 nt, Bordetella pertussis
gcccggcggcgc

SEQ ID NO: 311821 - RNA, 13 nt, Bordetella pertussis
gcccggcggcgcg

SEQ ID NO: 311822 - RNA, 14 nt, Bordetella pertussis
gcccggcgggccgg

SEQ ID NO: 311823 - RNA, 15 nt, Bordetella pertussis
gcccggcgggccggc

SEQ ID NO: 311824 - RNA, 16 nt, Bordetella pertussis
gcccggcgggccggcu

SEQ ID NO: 311825 - RNA, 22 nt, Bordetella pertussis
gcccggcgggaacaggcaccga

SEQ ID NO: 311826 - RNA, 17 nt, Bordetella pertussis
gcccggcggugaccugg

SEQ ID NO: 311827 - RNA, 12 nt, Bordetella pertussis
gcccggcguagc

SEQ ID NO: 311828 - RNA, 12 nt, Bordetella pertussis
gcccggcgucgg

SEQ ID NO: 311829 - RNA, 19 nt, Bordetella pertussis
gcccggcgugcccagggcc

SEQ ID NO: 311830 - RNA, 16 nt, Bordetella pertussis
gcccggcuccaggccg

SEQ ID NO: 311831 - RNA, 16 nt, Bordetella pertussis
gcccggcucgccgagc

SEQ ID NO: 311832 - RNA, 15 nt, Bordetella pertussis
gcccggcuucgauca

SEQ ID NO: 311833 - RNA, 19 nt, Bordetella pertussis
gcccggcuucgaucaugcc

SEQ ID NO: 311834 - RNA, 21 nt, Bordetella pertussis
gcccgggaaacucgcgcagcg

SEQ ID NO: 311835 - RNA, 16 nt, Bordetella pertussis
gcccgggcaggcucag

SEQ ID NO: 311836 - RNA, 17 nt, Bordetella pertussis
gcccgggcaggcucagc

SEQ ID NO: 311837 - RNA, 22 nt, Bordetella pertussis
gcccgggccgucuacaggccca

SEQ ID NO: 311838 - RNA, 14 nt, Bordetella pertussis
gcccgggcgccggc

SEQ ID NO: 311839 - RNA, 15 nt, Bordetella pertussis
gcccgggcgccggca

SEQ ID NO: 311840 - RNA, 14 nt, Bordetella pertussis
gcccgggcgcgcug

SEQ ID NO: 311841 - RNA, 15 nt, Bordetella pertussis
gcccgggcgcgcugu

SEQ ID NO: 311842 - RNA, 17 nt, Bordetella pertussis
gcccgggcgugccugcu

SEQ ID NO: 311843 - RNA, 17 nt, Bordetella pertussis
gcccgggcguggcgucg

SEQ ID NO: 311844 - RNA, 17 nt, Bordetella pertussis
gcccgggcugcugcacg

SEQ ID NO: 311845 - RNA, 21 nt, Bordetella pertussis
gcccgggcugcugcacgcgcg

SEQ ID NO: 311846 - RNA, 14 nt, Bordetella pertussis
gcccggggugugcc

SEQ ID NO: 311847 - RNA, 21 nt, Bordetella pertussis
gcccgggguugccaagauggc

SEQ ID NO: 311848 - RNA, 20 nt, Bordetella pertussis
gcccgggguugggaucgcgc

SEQ ID NO: 311849 - RNA, 21 nt, Bordetella pertussis
gcccgggguugggaucgcgcc

SEQ ID NO: 311850 - RNA, 22 nt, Bordetella pertussis
gcccgggguugggaucgcgcca

SEQ ID NO: 311851 - RNA, 23 nt, Bordetella pertussis
gcccgggugccuguccccgccgg

SEQ ID NO: 311852 - RNA, 22 nt, Bordetella pertussis
gcccgggugaucaguccgacga

SEQ ID NO: 311853 - RNA, 16 nt, Bordetella pertussis
gcccggguuggcgucc

SEQ ID NO: 311854 - RNA, 20 nt, Bordetella pertussis
gcccggguuggcguccaggc

SEQ ID NO: 311855 - RNA, 22 nt, Bordetella pertussis
gcccggguuuuuuuuggcguac

SEQ ID NO: 311856 - RNA, 13 nt, Bordetella pertussis
gcccgguaggcca

SEQ ID NO: 311857 - RNA, 15 nt, Bordetella pertussis
gcccgguaggccacg

SEQ ID NO: 311858 - RNA, 14 nt, Bordetella pertussis
gcccggugaucgag

SEQ ID NO: 311859 - RNA, 19 nt, Bordetella pertussis
gcccggugaucgaguaggc

SEQ ID NO: 311860 - RNA, 21 nt, Bordetella pertussis
gcccggugcguaccagcccag

SEQ ID NO: 311861 - RNA, 14 nt, Bordetella pertussis
gcccgguucgugcc

SEQ ID NO: 311862 - RNA, 16 nt, Bordetella pertussis
gcccgguucgccgucg

SEQ ID NO: 311863 - RNA, 14 nt, Bordetella pertussis
gcccguagcagaug

SEQ ID NO: 311864 - RNA, 15 nt, Bordetella pertussis
gcccguagcagaugc

SEQ ID NO: 311865 - RNA, 20 nt, Bordetella pertussis
gcccguacgucaaggccugc

SEQ ID NO: 311866 - RNA, 16 nt, Bordetella pertussis
gcccgucagcggcgcg

SEQ ID NO: 311867 - RNA, 19 nt, Bordetella pertussis
gcccgucagcggcgcgccc

SEQ ID NO: 311868 - RNA, 15 nt, Bordetella pertussis
gcccgucaggguacg

SEQ ID NO: 311869 - RNA, 23 nt, Bordetella pertussis
gcccgucaggguacgcucgacga

SEQ ID NO: 311870 - RNA, 14 nt, Bordetella pertussis
gcccgucaguccgu

SEQ ID NO: 311871 - RNA, 20 nt, Bordetella pertussis
gcccgucaugcgccgcagca

SEQ ID NO: 311872 - RNA, 22 nt, Bordetella pertussis
gcccgucaugcgccgcagcacc

SEQ ID NO: 311873 - RNA, 13 nt, Bordetella pertussis
gcccguccacggc

SEQ ID NO: 311874 - RNA, 20 nt, Bordetella pertussis
gcccgucccgacccccggcc

SEQ ID NO: 311875 - RNA, 17 nt, Bordetella pertussis
gcccguccgggcggcgu

SEQ ID NO: 311876 - RNA, 16 nt, Bordetella pertussis
gcccguccuggugcac

SEQ ID NO: 311877 - RNA, 15 nt, Bordetella pertussis
gcccgucgcgccagg

SEQ ID NO: 311878 - RNA, 18 nt, Bordetella pertussis
gcccgucgcgccaggccg

SEQ ID NO: 311879 - RNA, 19 nt, Bordetella pertussis
gcccgucgcgccaggccgg

SEQ ID NO: 311880 - RNA, 13 nt, Bordetella pertussis
gcccgucgcuggc

SEQ ID NO: 311881 - RNA, 14 nt, Bordetella pertussis
gcccgucgcuggcg

SEQ ID NO: 311882 - RNA, 15 nt, Bordetella pertussis
gcccgucgcuggcgc

SEQ ID NO: 311883 - RNA, 22 nt, Bordetella pertussis
gcccgucgcuggcgcguugcgc

SEQ ID NO: 311884 - RNA, 22 nt, Bordetella pertussis
gcccgucgggcaggucggcgcg

SEQ ID NO: 311885 - RNA, 18 nt, Bordetella pertussis
gcccgucuauggccugca

SEQ ID NO: 311886 - RNA, 17 nt, Bordetella pertussis
gcccgucuuggcguggu

SEQ ID NO: 311887 - RNA, 13 nt, Bordetella pertussis
gcccgugcgcaac

SEQ ID NO: 311888 - RNA, 14 nt, Bordetella pertussis
gcccgugcgcaacg

SEQ ID NO: 311889 - RNA, 18 nt, Bordetella pertussis
gcccgugcgcaacgcgcg

SEQ ID NO: 311890 - RNA, 11 nt, Bordetella pertussis
gcccgugcgcg

SEQ ID NO: 311891 - RNA, 17 nt, Bordetella pertussis
gcccgugcgggccugca

SEQ ID NO: 311892 - RNA, 19 nt, Bordetella pertussis
gcccgugcgugcgccuguc

SEQ ID NO: 311893 - RNA, 20 nt, Bordetella pertussis
gcccgugcuccagaacgcgc

SEQ ID NO: 311894 - RNA, 22 nt, Bordetella pertussis
gcccgugcuccagaacgcgccg

SEQ ID NO: 311895 - RNA, 15 nt, Bordetella pertussis
gcccgugccuugccg

SEQ ID NO: 311896 - RNA, 22 nt, Bordetella pertussis
gcccguggacgaauacgcuggc

SEQ ID NO: 311897 - RNA, 18 nt, Bordetella pertussis
gcccgugggcggcguaga

SEQ ID NO: 311898 - RNA, 16 nt, Bordetella pertussis
gcccguguagacggca

SEQ ID NO: 311899 - RNA, 16 nt, Bordetella pertussis
gcccgugucgccgucg

SEQ ID NO: 311900 - RNA, 18 nt, Bordetella pertussis
gcccgugucggcaaccug

SEQ ID NO: 311901 - RNA, 16 nt, Bordetella pertussis
gcccguucacgcgcag

SEQ ID NO: 311902 - RNA, 17 nt, Bordetella pertussis
gcccguucacgcgcagc

SEQ ID NO: 311903 - RNA, 18 nt, Bordetella pertussis
gcccguucacgcgcagcg

SEQ ID NO: 311904 - RNA, 16 nt, Bordetella pertussis
gcccguuggcaggcca

SEQ ID NO: 311905 - RNA, 19 nt, Bordetella pertussis
gcccguuggcaggccagca

SEQ ID NO: 311906 - RNA, 18 nt, Bordetella pertussis
gcccguugcggcgccucg

SEQ ID NO: 311907 - RNA, 17 nt, Bordetella pertussis
gcccuagagcaugcggc

SEQ ID NO: 311908 - RNA, 18 nt, Bordetella pertussis
gcccuagagcaugcggcg

SEQ ID NO: 311909 - RNA, 14 nt, Bordetella pertussis
gcccucaguccagc

SEQ ID NO: 311910 - RNA, 18 nt, Bordetella pertussis
gcccucaguccagcuggc

SEQ ID NO: 311911 - RNA, 21 nt, Bordetella pertussis
gcccucaguccagcuggcccu

SEQ ID NO: 311912 - RNA, 21 nt, Bordetella pertussis
gcccucccagaaacuggcgcu

SEQ ID NO: 311913 - RNA, 15 nt, Bordetella pertussis
gccgaaacgcuggcg

SEQ ID NO: 311914 - RNA, 16 nt, Bordetella pertussis
gccgaaacgcuggcgu

SEQ ID NO: 311915 - RNA, 22 nt, Bordetella pertussis
gccgaaauauggaccagcccgu

SEQ ID NO: 311916 - RNA, 15 nt, Bordetella pertussis
gccgaaauggcggcg

SEQ ID NO: 311917 - RNA, 17 nt, Bordetella pertussis
gccgaacaagguccagg

SEQ ID NO: 311918 - RNA, 22 nt, Bordetella pertussis
gccgaacaagguccaggcccgg

SEQ ID NO: 311919 - RNA, 20 nt, Bordetella pertussis
gccgaacacaucgagggcgu

SEQ ID NO: 311920 - RNA, 22 nt, Bordetella pertussis
gccgaacacaucgagggcguca

SEQ ID NO: 311921 - RNA, 23 nt, Bordetella pertussis
gccgaacaugacguucuccagcg

SEQ ID NO: 311922 - RNA, 18 nt, Bordetella pertussis
gccgaaccagaucagguc

SEQ ID NO: 311923 - RNA, 15 nt, Bordetella pertussis
gccgaaccagcgcac

SEQ ID NO: 311924 - RNA, 23 nt, Bordetella pertussis
gccgaaccagcgcaccaccagca

SEQ ID NO: 311925 - RNA, 20 nt, Bordetella pertussis
gccgaaccauugcagggugu

SEQ ID NO: 311926 - RNA, 23 nt, Bordetella pertussis
gccgaaccauugcagggugucgg

SEQ ID NO: 311927 - RNA, 19 nt, Bordetella pertussis
gccgaacgacuuggcgcaa

SEQ ID NO: 311928 - RNA, 12 nt, Bordetella pertussis
gccgaacgcgca

SEQ ID NO: 311929 - RNA, 15 nt, Bordetella pertussis
gccgaacgcgcagcg

SEQ ID NO: 311930 - RNA, 20 nt, Bordetella pertussis
gccgaacggggccgccucgg

SEQ ID NO: 311931 - RNA, 16 nt, Bordetella pertussis
gccgaacggcagcagc

SEQ ID NO: 311932 - RNA, 20 nt, Bordetella pertussis
gccgaacggcagcagcgcgc

SEQ ID NO: 311933 - RNA, 20 nt, Bordetella pertussis
gccgaagauucccgcgcacg

SEQ ID NO: 311934 - RNA, 20 nt, Bordetella pertussis
gccgaagcaaugcagcgcga

SEQ ID NO: 311935 - RNA, 16 nt, Bordetella pertussis
gccgaagcgcaggccu

SEQ ID NO: 311936 - RNA, 18 nt, Bordetella pertussis
gccgaagcgucggccugc

SEQ ID NO: 311937 - RNA, 13 nt, Bordetella pertussis
gccgaauccggcc

SEQ ID NO: 311938 - RNA, 14 nt, Bordetella pertussis
gccgaauccggcca

SEQ ID NO: 311939 - RNA, 15 nt, Bordetella pertussis
gccgaauccggccag

SEQ ID NO: 311940 - RNA, 23 nt, Bordetella pertussis
gccgaauccggccagcacgccgg

SEQ ID NO: 311941 - RNA, 17 nt, Bordetella pertussis
gccgaaucggccccugc

SEQ ID NO: 311942 - RNA, 23 nt, Bordetella pertussis
gccgaauucguuggugcccagcg

SEQ ID NO: 311943 - RNA, 19 nt, Bordetella pertussis
gccgaauugccgccgcugc

SEQ ID NO: 311944 - RNA, 21 nt, Bordetella pertussis
gccgaauugcuggagcgccac

SEQ ID NO: 311945 - RNA, 21 nt, Bordetella pertussis
gccgacaacggcgugcugcgg

SEQ ID NO: 311946 - RNA, 14 nt, Bordetella pertussis
gccgaccaccagca

SEQ ID NO: 311947 - RNA, 16 nt, Bordetella pertussis
gccgaccaccagcacc

SEQ ID NO: 311948 - RNA, 23 nt, Bordetella pertussis
gccgaccaccagcaccgaugcgc

SEQ ID NO: 311949 - RNA, 18 nt, Bordetella pertussis
gccgaccacccgcgccag

SEQ ID NO: 311950 - RNA, 19 nt, Bordetella pertussis
gccgaccaccugcaccgcc

SEQ ID NO: 311951 - RNA, 13 nt, Bordetella pertussis
gccgaccacggcu

SEQ ID NO: 311952 - RNA, 13 nt, Bordetella pertussis
gccgaccagcgag

SEQ ID NO: 311953 - RNA, 14 nt, Bordetella pertussis
gccgacccgcggcc

SEQ ID NO: 311954 - RNA, 20 nt, Bordetella pertussis
gccgacccgggcgggcgucu

SEQ ID NO: 311955 - RNA, 13 nt, Bordetella pertussis
gccgacccugccc

SEQ ID NO: 311956 - RNA, 18 nt, Bordetella pertussis
gccgacccugcccggcag

SEQ ID NO: 311957 - RNA, 14 nt, Bordetella pertussis
gccgaccuccaggc

SEQ ID NO: 311958 - RNA, 15 nt, Bordetella pertussis
gccgaccuccaggcc

SEQ ID NO: 311959 - RNA, 20 nt, Bordetella pertussis
gccgaccuccaggcccaggc

SEQ ID NO: 311960 - RNA, 21 nt, Bordetella pertussis
gccgaccuccaggcccaggcg

SEQ ID NO: 311961 - RNA, 17 nt, Bordetella pertussis
gccgaccucgucgggcu

SEQ ID NO: 311962 - RNA, 20 nt, Bordetella pertussis
gccgaccucuucguugucgc

SEQ ID NO: 311963 - RNA, 22 nt, Bordetella pertussis
gccgaccucuucguugucgcgc

SEQ ID NO: 311964 - RNA, 23 nt, Bordetella pertussis
gccgaccucuucguugucgcgcg

SEQ ID NO: 311965 - RNA, 15 nt, Bordetella pertussis
gccgacgaugccgcc

SEQ ID NO: 311966 - RNA, 19 nt, Bordetella pertussis
gccgacgaugccgccgccg

SEQ ID NO: 311967 - RNA, 22 nt, Bordetella pertussis
gccgacgaugccgccgccgacg

SEQ ID NO: 311968 - RNA, 19 nt, Bordetella pertussis
gccgacgaugucgccgccg

SEQ ID NO: 311969 - RNA, 20 nt, Bordetella pertussis
gccgacgaugucgccgccgc

SEQ ID NO: 311970 - RNA, 21 nt, Bordetella pertussis
gccgacgaugucgccgccgcg

SEQ ID NO: 311971 - RNA, 23 nt, Bordetella pertussis
gccgacgaugucgccgccgcgca

SEQ ID NO: 311972 - RNA, 15 nt, Bordetella pertussis
gccgacgaugaccau

SEQ ID NO: 311973 - RNA, 19 nt, Bordetella pertussis
gccgacgcgcccgggcuga

SEQ ID NO: 311974 - RNA, 13 nt, Bordetella pertussis
gccgacgcgcugg

SEQ ID NO: 311975 - RNA, 15 nt, Bordetella pertussis
gccgacgcgcugguc

SEQ ID NO: 311976 - RNA, 23 nt, Bordetella pertussis
gccgacgcgcugguccgccgccg

SEQ ID NO: 311977 - RNA, 15 nt, Bordetella pertussis
gccgacgggccgguc

SEQ ID NO: 311978 - RNA, 18 nt, Bordetella pertussis
gccgacguagucgcgcca

SEQ ID NO: 311979 - RNA, 20 nt, Bordetella pertussis
gccgacguagucgcgccagc

SEQ ID NO: 311980 - RNA, 17 nt, Bordetella pertussis
gccgacguggaccgcgc

SEQ ID NO: 311981 - RNA, 23 nt, Bordetella pertussis
gccgacuuccugggugcgccaau

SEQ ID NO: 311982 - RNA, 19 nt, Bordetella pertussis
gccgagaaauccagcgcgc

SEQ ID NO: 311983 - RNA, 16 nt, Bordetella pertussis
gccgagaacgccgucg

SEQ ID NO: 311984 - RNA, 14 nt, Bordetella pertussis
gccgagacggccgc

SEQ ID NO: 311985 - RNA, 17 nt, Bordetella pertussis
gccgagacggccgccga

SEQ ID NO: 311986 - RNA, 21 nt, Bordetella pertussis
gccgagaugugcggcguggcg

SEQ ID NO: 311987 - RNA, 15 nt, Bordetella pertussis
gccgagaugccguuc

SEQ ID NO: 311988 - RNA, 13 nt, Bordetella pertussis
gccgagccauugu

SEQ ID NO: 311989 - RNA, 15 nt, Bordetella pertussis
gccgagcccgcgucg

SEQ ID NO: 311990 - RNA, 22 nt, Bordetella pertussis
gccgagccgccccggcgcggcg

SEQ ID NO: 311991 - RNA, 13 nt, Bordetella pertussis
gccgagccgcugu

SEQ ID NO: 311992 - RNA, 15 nt, Bordetella pertussis
gccgagccgcugucg

SEQ ID NO: 311993 - RNA, 21 nt, Bordetella pertussis
gccgagccgcugucgcaggcg

SEQ ID NO: 311994 - RNA, 13 nt, Bordetella pertussis
gccgagccuggcg

SEQ ID NO: 311995 - RNA, 13 nt, Bordetella pertussis
gccgagcgcaccc

SEQ ID NO: 311996 - RNA, 16 nt, Bordetella pertussis
gccgagcgugccggga

SEQ ID NO: 311997 - RNA, 17 nt, Bordetella pertussis
gccgagcgugccgggau

SEQ ID NO: 311998 - RNA, 23 nt, Bordetella pertussis
gccgaggucggcgguccacagcc

SEQ ID NO: 311999 - RNA, 23 nt, Bordetella pertussis
gccgaggugaucugguccacggc

SEQ ID NO: 312000 - RNA, 19 nt, Bordetella pertussis
gccgaguggaugcgcuugc

SEQ ID NO: 312001 - RNA, 20 nt, Bordetella pertussis
gccgaguggcgggccauguc

SEQ ID NO: 312002 - RNA, 18 nt, Bordetella pertussis
gccgaguuuccgcacccg

SEQ ID NO: 312003 - RNA, 20 nt, Bordetella pertussis
gccgauacaggcgcucgcgc

SEQ ID NO: 312004 - RNA, 19 nt, Bordetella pertussis
gccgauaccacgcgcggcg

SEQ ID NO: 312005 - RNA, 23 nt, Bordetella pertussis
gccgauaccacgcgcggcggcgg

SEQ ID NO: 312006 - RNA, 18 nt, Bordetella pertussis
gccgauacgcgugcgcgg

SEQ ID NO: 312007 - RNA, 20 nt, Bordetella pertussis
gccgauacgcgugcgcggcc

SEQ ID NO: 312008 - RNA, 21 nt, Bordetella pertussis
gccgauacgggcgcggcgucg

SEQ ID NO: 312009 - RNA, 22 nt, Bordetella pertussis
gccgauacgggcgcggcgucga

SEQ ID NO: 312010 - RNA, 17 nt, Bordetella pertussis
gccgauacgucgcagca

SEQ ID NO: 312011 - RNA, 22 nt, Bordetella pertussis
gccgauacgucgcagcacgccc

SEQ ID NO: 312012 - RNA, 15 nt, Bordetella pertussis
gccgauagccgcggc

SEQ ID NO: 312013 - RNA, 23 nt, Bordetella pertussis
gccgauauugcgguacaggucgu

SEQ ID NO: 312014 - RNA, 16 nt, Bordetella pertussis
gccgaucaccugcagg

SEQ ID NO: 312015 - RNA, 19 nt, Bordetella pertussis
gccgaucaccugcaggccc

SEQ ID NO: 312016 - RNA, 17 nt, Bordetella pertussis
gccgaucagcaggucgg

SEQ ID NO: 312017 - RNA, 20 nt, Bordetella pertussis
gccgaucagcaggucggcgc

SEQ ID NO: 312018 - RNA, 14 nt, Bordetella pertussis
gccgaucagccggc

SEQ ID NO: 312019 - RNA, 16 nt, Bordetella pertussis
gccgaucagccggcca

SEQ ID NO: 312020 - RNA, 17 nt, Bordetella pertussis
gccgaucagccggccau

SEQ ID NO: 312021 - RNA, 15 nt, Bordetella pertussis
gccgaucagcaccac

SEQ ID NO: 312022 - RNA, 22 nt, Bordetella pertussis
gccgaucagcggauugaccagc

SEQ ID NO: 312023 - RNA, 20 nt, Bordetella pertussis
gccgaucagcgggcuggcca

SEQ ID NO: 312024 - RNA, 20 nt, Bordetella pertussis
gccgauccacucggccagcg

SEQ ID NO: 312025 - RNA, 19 nt, Bordetella pertussis
gccgauccagcccaccgcg

SEQ ID NO: 312026 - RNA, 23 nt, Bordetella pertussis
gccgauccagcccaccgcgaacc

SEQ ID NO: 312027 - RNA, 21 nt, Bordetella pertussis
gccgauccagggccgcagcaa

SEQ ID NO: 312028 - RNA, 18 nt, Bordetella pertussis
gccgaucggcgucuggaa

SEQ ID NO: 312029 - RNA, 18 nt, Bordetella pertussis
gccgaucggcuugccgcg

SEQ ID NO: 312030 - RNA, 15 nt, Bordetella pertussis
gccgaucgugcacgc

SEQ ID NO: 312031 - RNA, 22 nt, Bordetella pertussis
gccgaucgugcacgcccgcggc

SEQ ID NO: 312032 - RNA, 23 nt, Bordetella pertussis
gccgaucgugcacgcccgcggcg

SEQ ID NO: 312033 - RNA, 21 nt, Bordetella pertussis
gccgaucucacgggcgaagcg

SEQ ID NO: 312034 - RNA, 18 nt, Bordetella pertussis
gccgaucugcugggccgg

SEQ ID NO: 312035 - RNA, 21 nt, Bordetella pertussis
gccgaucugcugggccgggug

SEQ ID NO: 312036 - RNA, 18 nt, Bordetella pertussis
gccgauugaggccagcac

SEQ ID NO: 312037 - RNA, 19 nt, Bordetella pertussis
gccgauugaggccagcacg

SEQ ID NO: 312038 - RNA, 15 nt, Bordetella pertussis
gccgauuucgccgcc

SEQ ID NO: 312039 - RNA, 17 nt, Bordetella pertussis
gccgauuucgccgccgc

SEQ ID NO: 312040 - RNA, 16 nt, Bordetella pertussis
gccgauuucgcgcgcc

SEQ ID NO: 312041 - RNA, 18 nt, Bordetella pertussis
gccgauuucgcgcgccag

SEQ ID NO: 312042 - RNA, 20 nt, Bordetella pertussis
gccgauuucgcgcgccagcg

SEQ ID NO: 312043 - RNA, 19 nt, Bordetella pertussis
gccgauuucggccgccggc

SEQ ID NO: 312044 - RNA, 22 nt, Bordetella pertussis
gccgauuucggccgccggcgag

SEQ ID NO: 312045 - RNA, 14 nt, Bordetella pertussis
gccgcaacaggcag

SEQ ID NO: 312046 - RNA, 21 nt, Bordetella pertussis
gccgcaacaggcagcugcgcg

SEQ ID NO: 312047 - RNA, 23 nt, Bordetella pertussis
gccgcaaucgaugaagaucaggc

SEQ ID NO: 312048 - RNA, 15 nt, Bordetella pertussis
gccgcacagcguggc

SEQ ID NO: 312049 - RNA, 17 nt, Bordetella pertussis
gccgcacaucgucgacg

SEQ ID NO: 312050 - RNA, 12 nt, Bordetella pertussis
gccgcaccagcg

SEQ ID NO: 312051 - RNA, 15 nt, Bordetella pertussis
gccgcaccagcgccg

SEQ ID NO: 312052 - RNA, 13 nt, Bordetella pertussis
gccgcaccagcgg

SEQ ID NO: 312053 - RNA, 16 nt, Bordetella pertussis
gccgcaccaggccgcg

SEQ ID NO: 312054 - RNA, 20 nt, Bordetella pertussis
gccgcaccaggccgcggcgc

SEQ ID NO: 312055 - RNA, 22 nt, Bordetella pertussis
gccgcaccaggccgcggcgccc

SEQ ID NO: 312056 - RNA, 19 nt, Bordetella pertussis
gccgcacccgaugacgggg

SEQ ID NO: 312057 - RNA, 15 nt, Bordetella pertussis
gccgcagaacagcag

SEQ ID NO: 312058 - RNA, 17 nt, Bordetella pertussis
gccgcagaacagcagcg

SEQ ID NO: 312059 - RNA, 20 nt, Bordetella pertussis
gccgcagcaauugccccagc

SEQ ID NO: 312060 - RNA, 23 nt, Bordetella pertussis
gccgcagcaauugccccagcacg

SEQ ID NO: 312061 - RNA, 14 nt, Bordetella pertussis
gccgcagcaccaca

SEQ ID NO: 312062 - RNA, 21 nt, Bordetella pertussis
gccgcagcaccacaucgccgg

SEQ ID NO: 312063 - RNA, 22 nt, Bordetella pertussis
gccgcagcaccacaucgccggc

SEQ ID NO: 312064 - RNA, 17 nt, Bordetella pertussis
gccgcagcaccucggcg

SEQ ID NO: 312065 - RNA, 14 nt, Bordetella pertussis
gccgcagauggcgu

SEQ ID NO: 312066 - RNA, 16 nt, Bordetella pertussis
gccgcagauggcguag

SEQ ID NO: 312067 - RNA, 14 nt, Bordetella pertussis
gccgcagcaggcgc

SEQ ID NO: 312068 - RNA, 14 nt, Bordetella pertussis
gccgcagcauggcg

SEQ ID NO: 312069 - RNA, 15 nt, Bordetella pertussis
gccgcagcauggcgc

SEQ ID NO: 312070 - RNA, 20 nt, Bordetella pertussis
gccgcagcauggcgccagcu

SEQ ID NO: 312071 - RNA, 13 nt, Bordetella pertussis
gccgcagcccgcg

SEQ ID NO: 312072 - RNA, 15 nt, Bordetella pertussis
gccgcagccgccagc

SEQ ID NO: 312073 - RNA, 17 nt, Bordetella pertussis
gccgcagccgccagcgc

SEQ ID NO: 312074 - RNA, 16 nt, Bordetella pertussis
gccgcagccggcugca

SEQ ID NO: 312075 - RNA, 17 nt, Bordetella pertussis
gccgcagccgucgcgcu

SEQ ID NO: 312076 - RNA, 18 nt, Bordetella pertussis
gccgcaguauuccugcug

SEQ ID NO: 312077 - RNA, 15 nt, Bordetella pertussis
gccgcagugcgcgcg

SEQ ID NO: 312078 - RNA, 15 nt, Bordetella pertussis
gccgcaguuccaggc

SEQ ID NO: 312079 - RNA, 20 nt, Bordetella pertussis
gccgcaguugaacacgcggu

SEQ ID NO: 312080 - RNA, 18 nt, Bordetella pertussis
gccgcauaccuuggcgcc

SEQ ID NO: 312081 - RNA, 20 nt, Bordetella pertussis
gccgcauaccuuggcgccca

SEQ ID NO: 312082 - RNA, 22 nt, Bordetella pertussis
gccgcauaccuuggcgcccagc

SEQ ID NO: 312083 - RNA, 13 nt, Bordetella pertussis
gccgcaugccggc

SEQ ID NO: 312084 - RNA, 15 nt, Bordetella pertussis
gccgcaugccgggcu

SEQ ID NO: 312085 - RNA, 21 nt, Bordetella pertussis
gccgcaucauguaaggcgcau

SEQ ID NO: 312086 - RNA, 13 nt, Bordetella pertussis
gccgcauggcggc

SEQ ID NO: 312087 - RNA, 21 nt, Bordetella pertussis
gccgcauuuccucgaccagcg

SEQ ID NO: 312088 - RNA, 22 nt, Bordetella pertussis
gccgcauuuccucgaccagcgc

SEQ ID NO: 312089 - RNA, 23 nt, Bordetella pertussis
gccgcauuuccucgaccagcgcg

SEQ ID NO: 312090 - RNA, 24 nt, Bordetella pertussis
gccgcauuucguaaagccgcacgc

SEQ ID NO: 312091 - RNA, 23 nt, Bordetella pertussis
gccgccaacgccaagcugcuggc

SEQ ID NO: 312092 - RNA, 15 nt, Bordetella pertussis
gccgccaacgcggcg

SEQ ID NO: 312093 - RNA, 16 nt, Bordetella pertussis
gccgccaacgcggcgc

SEQ ID NO: 312094 - RNA, 14 nt, Bordetella pertussis
gccgccaagggcgc

SEQ ID NO: 312095 - RNA, 16 nt, Bordetella pertussis
gccgccaagggcgcgc

SEQ ID NO: 312096 - RNA, 18 nt, Bordetella pertussis
gccgccaagggcgcgcca

SEQ ID NO: 312097 - RNA, 20 nt, Bordetella pertussis
gccgccaagggcgcgccagc

SEQ ID NO: 312098 - RNA, 21 nt, Bordetella pertussis
gccgccaagggcgcgccagca

SEQ ID NO: 312099 - RNA, 12 nt, Bordetella pertussis
gccgccacacga

SEQ ID NO: 312100 - RNA, 18 nt, Bordetella pertussis
gccgccacaggcugacgc

SEQ ID NO: 312101 - RNA, 21 nt, Bordetella pertussis
gccgccacaggcugacgcccg

SEQ ID NO: 312102 - RNA, 23 nt, Bordetella pertussis
gccgccacaggcugacgcccggc

SEQ ID NO: 312103 - RNA, 18 nt, Bordetella pertussis
gccgccaccaccucggcc

SEQ ID NO: 312104 - RNA, 20 nt, Bordetella pertussis
gccgccaccaccucggccuc

SEQ ID NO: 312105 - RNA, 22 nt, Bordetella pertussis
gccgccagcaaggcgucggcca

SEQ ID NO: 312106 - RNA, 14 nt, Bordetella pertussis
gccgccagcaccug

SEQ ID NO: 312107 - RNA, 16 nt, Bordetella pertussis
gccgccagcaccugcu

SEQ ID NO: 312108 - RNA, 14 nt, Bordetella pertussis
gccgccagcacgcc

SEQ ID NO: 312109 - RNA, 14 nt, Bordetella pertussis
gccgccagcagcgc

SEQ ID NO: 312110 - RNA, 16 nt, Bordetella pertussis
gccgccagcauggcgg

SEQ ID NO: 312111 - RNA, 19 nt, Bordetella pertussis
gccgccagcauggcggcca

SEQ ID NO: 312112 - RNA, 20 nt, Bordetella pertussis
gccgccagcauggcggccag

SEQ ID NO: 312113 - RNA, 18 nt, Bordetella pertussis
gccgccagcauggcgucg

SEQ ID NO: 312114 - RNA, 13 nt, Bordetella pertussis
gccgccagcccga

SEQ ID NO: 312115 - RNA, 15 nt, Bordetella pertussis
gccgccagcccgagg

SEQ ID NO: 312116 - RNA, 15 nt, Bordetella pertussis
gccgccagccgcugg

SEQ ID NO: 312117 - RNA, 16 nt, Bordetella pertussis
gccgccagccgcuggc

SEQ ID NO: 312118 - RNA, 18 nt, Bordetella pertussis
gccgccagccgcuggcgc

SEQ ID NO: 312119 - RNA, 13 nt, Bordetella pertussis
gccgccagccggc

SEQ ID NO: 312120 - RNA, 15 nt, Bordetella pertussis
gccgccagccggccc

SEQ ID NO: 312121 - RNA, 16 nt, Bordetella pertussis
gccgccagccggcccg

SEQ ID NO: 312122 - RNA, 14 nt, Bordetella pertussis
gccgccagcgccau

SEQ ID NO: 312123 - RNA, 22 nt, Bordetella pertussis
gccgccagcgccuggaccugga

SEQ ID NO: 312124 - RNA, 14 nt, Bordetella pertussis
gccgccagcgcgcc

SEQ ID NO: 312125 - RNA, 15 nt, Bordetella pertussis
gccgccagcggcugg

SEQ ID NO: 312126 - RNA, 17 nt, Bordetella pertussis
gccgccagcggcuggcg

SEQ ID NO: 312127 - RNA, 20 nt, Bordetella pertussis
gccgccagcggcuggcgccg

SEQ ID NO: 312128 - RNA, 19 nt, Bordetella pertussis
gccgccagcguaucgccgc

SEQ ID NO: 312129 - RNA, 13 nt, Bordetella pertussis
gccgccagcggcu

SEQ ID NO: 312130 - RNA, 19 nt, Bordetella pertussis
gccgccagcuuggugcuca

SEQ ID NO: 312131 - RNA, 13 nt, Bordetella pertussis
gccgccaggacuu

SEQ ID NO: 312132 - RNA, 22 nt, Bordetella pertussis
gccgccaggacuucgucgauca

SEQ ID NO: 312133 - RNA, 13 nt, Bordetella pertussis
gccgccaggccgu

SEQ ID NO: 312134 - RNA, 21 nt, Bordetella pertussis
gccgccaggccgucgagcacg

SEQ ID NO: 312135 - RNA, 23 nt, Bordetella pertussis
gccgccagguagcggguggccga

SEQ ID NO: 312136 - RNA, 16 nt, Bordetella pertussis
gccgccauagcugcgc

SEQ ID NO: 312137 - RNA, 20 nt, Bordetella pertussis
gccgccauagcugcgccaau

SEQ ID NO: 312138 - RNA, 17 nt, Bordetella pertussis
gccgccauaggcgcgca

SEQ ID NO: 312139 - RNA, 18 nt, Bordetella pertussis
gccgccauaggcgcgcac

SEQ ID NO: 312140 - RNA, 14 nt, Bordetella pertussis
gccgccaucauccu

SEQ ID NO: 312141 - RNA, 20 nt, Bordetella pertussis
gccgccaucauccuggucga

SEQ ID NO: 312142 - RNA, 16 nt, Bordetella pertussis
gccgccauggcgcugg

SEQ ID NO: 312143 - RNA, 18 nt, Bordetella pertussis
gccgccauggcgcuggca

SEQ ID NO: 312144 - RNA, 14 nt, Bordetella pertussis
gccgccauggcggc

SEQ ID NO: 312145 - RNA, 20 nt, Bordetella pertussis
gccgccauggcggcgcccau

SEQ ID NO: 312146 - RNA, 16 nt, Bordetella pertussis
gccgccauggucgcga

SEQ ID NO: 312147 - RNA, 20 nt, Bordetella pertussis
gccgccauggucgcgaccac

SEQ ID NO: 312148 - RNA, 21 nt, Bordetella pertussis
gccgccauggucgcgaccacc

SEQ ID NO: 312149 - RNA, 22 nt, Bordetella pertussis
gccgccauggugccgcgcaggc

SEQ ID NO: 312150 - RNA, 16 nt, Bordetella pertussis
gccgccaugcagcugg

SEQ ID NO: 312151 - RNA, 17 nt, Bordetella pertussis
gccgccaugcgccagca

SEQ ID NO: 312152 - RNA, 21 nt, Bordetella pertussis
gccgccauguauaacguggcg

SEQ ID NO: 312153 - RNA, 22 nt, Bordetella pertussis
gccgccauguauaacguggcgc

SEQ ID NO: 312154 - RNA, 14 nt, Bordetella pertussis
gccgcccaccacca

SEQ ID NO: 312155 - RNA, 15 nt, Bordetella pertussis
gccgcccaccgugac

SEQ ID NO: 312156 - RNA, 20 nt, Bordetella pertussis
gccgcccaccgugaccagcg

SEQ ID NO: 312157 - RNA, 17 nt, Bordetella pertussis
gccgcccacgaucacca

SEQ ID NO: 312158 - RNA, 12 nt, Bordetella pertussis
gccgcccacgcc

SEQ ID NO: 312159 - RNA, 18 nt, Bordetella pertussis
gccgcccacgccgccugg

SEQ ID NO: 312160 - RNA, 20 nt, Bordetella pertussis
gccgcccacgccgccuggcc

SEQ ID NO: 312161 - RNA, 16 nt, Bordetella pertussis
gccgcccacgccgcug

SEQ ID NO: 312162 - RNA, 17 nt, Bordetella pertussis
gccgcccacgccgcugu

SEQ ID NO: 312163 - RNA, 13 nt, Bordetella pertussis
gccgcccacugcc

SEQ ID NO: 312164 - RNA, 22 nt, Bordetella pertussis
gccgcccacugccaggcgagcg

SEQ ID NO: 312165 - RNA, 20 nt, Bordetella pertussis
gccgcccacgggcgccuggu

SEQ ID NO: 312166 - RNA, 23 nt, Bordetella pertussis
gccgcccagcaccuuggcauuga

SEQ ID NO: 312167 - RNA, 12 nt, Bordetella pertussis
gccgcccagcau

SEQ ID NO: 312168 - RNA, 13 nt, Bordetella pertussis
gccgcccagcaug

SEQ ID NO: 312169 - RNA, 23 nt, Bordetella pertussis
gccgcccagcauuucgcgugcgu

SEQ ID NO: 312170 - RNA, 12 nt, Bordetella pertussis
gccgcccagccg

SEQ ID NO: 312171 - RNA, 18 nt, Bordetella pertussis
gccgcccagccgcgccag

SEQ ID NO: 312172 - RNA, 13 nt, Bordetella pertussis
gccgcccagccgg

SEQ ID NO: 312173 - RNA, 14 nt, Bordetella pertussis
gccgcccagccggc

SEQ ID NO: 312174 - RNA, 16 nt, Bordetella pertussis
gccgcccagccggccg

SEQ ID NO: 312175 - RNA, 14 nt, Bordetella pertussis
gccgcccagcgcau

SEQ ID NO: 312176 - RNA, 13 nt, Bordetella pertussis
gccgcccagcgcg

SEQ ID NO: 312177 - RNA, 14 nt, Bordetella pertussis
gccgcccagcgcgu

SEQ ID NO: 312178 - RNA, 15 nt, Bordetella pertussis
gccgcccagcgcgug

SEQ ID NO: 312179 - RNA, 21 nt, Bordetella pertussis
gccgcccagcgcgugggccag

SEQ ID NO: 312180 - RNA, 23 nt, Bordetella pertussis
gccgcccagcgcgugggccagca

SEQ ID NO: 312181 - RNA, 13 nt, Bordetella pertussis
gccgcccaggcgc

SEQ ID NO: 312182 - RNA, 20 nt, Bordetella pertussis
gccgcccaggcgcagccgcg

SEQ ID NO: 312183 - RNA, 21 nt, Bordetella pertussis
gccgcccaggcgcagccgcgc

SEQ ID NO: 312184 - RNA, 20 nt, Bordetella pertussis
gccgcccaggucggacgcgc

SEQ ID NO: 312185 - RNA, 19 nt, Bordetella pertussis
gccgcccagucguccagca

SEQ ID NO: 312186 - RNA, 22 nt, Bordetella pertussis
gccgcccagucguccagcacgc

SEQ ID NO: 312187 - RNA, 23 nt, Bordetella pertussis
gccgcccagucguccagcacgcg

SEQ ID NO: 312188 - RNA, 15 nt, Bordetella pertussis
gccgccccaacggcc

SEQ ID NO: 312189 - RNA, 19 nt, Bordetella pertussis
gccgcccaugccgccgggc

SEQ ID NO: 312190 - RNA, 23 nt, Bordetella pertussis
gccgcccaugcgcauggccagca

SEQ ID NO: 312191 - RNA, 15 nt, Bordetella pertussis
gccgccccagcagca

SEQ ID NO: 312192 - RNA, 21 nt, Bordetella pertussis
gccgccccagcagcagcgagc

SEQ ID NO: 312193 - RNA, 18 nt, Bordetella pertussis
gccgccccaggcguacga

SEQ ID NO: 312194 - RNA, 16 nt, Bordetella pertussis
gccgcccccagcgcgc

SEQ ID NO: 312195 - RNA, 18 nt, Bordetella pertussis
gccgcccccagcgcgccu

SEQ ID NO: 312196 - RNA, 16 nt, Bordetella pertussis
gccgcccccgcccagc

SEQ ID NO: 312197 - RNA, 17 nt, Bordetella pertussis
gccgcccccgcccagca

SEQ ID NO: 312198 - RNA, 20 nt, Bordetella pertussis
gccgcccccgcccagcaucc

SEQ ID NO: 312199 - RNA, 20 nt, Bordetella pertussis
gccgccccggcgcggcgcgc

SEQ ID NO: 312200 - RNA, 21 nt, Bordetella pertussis
gccgccccggcgcggcgcgcg

SEQ ID NO: 312201 - RNA, 21 nt, Bordetella pertussis
gccgcccgaauccagggccac

SEQ ID NO: 312202 - RNA, 20 nt, Bordetella pertussis
gccgcccgacagcacgcccg

SEQ ID NO: 312203 - RNA, 20 nt, Bordetella pertussis
gccgcccgcacgaagcggca

SEQ ID NO: 312204 - RNA, 13 nt, Bordetella pertussis
gccgcccgcaggc

SEQ ID NO: 312205 - RNA, 13 nt, Bordetella pertussis
gccgcccgcaugc

SEQ ID NO: 312206 - RNA, 13 nt, Bordetella pertussis
gccgcccgccagg

SEQ ID NO: 312207 - RNA, 14 nt, Bordetella pertussis
gccgcccgccaggc

SEQ ID NO: 312208 - RNA, 14 nt, Bordetella pertussis
gccgcccgccaugc

SEQ ID NO: 312209 - RNA, 19 nt, Bordetella pertussis
gccgcccgccccggcgcau

SEQ ID NO: 312210 - RNA, 12 nt, Bordetella pertussis
gccgcccgcggc

SEQ ID NO: 312211 - RNA, 13 nt, Bordetella pertussis
gccgcccgcggcc

SEQ ID NO: 312212 - RNA, 14 nt, Bordetella pertussis
gccgcccgcggcca

SEQ ID NO: 312213 - RNA, 15 nt, Bordetella pertussis
gccgcccgcggccag

SEQ ID NO: 312214 - RNA, 14 nt, Bordetella pertussis
gccgcccgcggccu

SEQ ID NO: 312215 - RNA, 15 nt, Bordetella pertussis
gccgcccgagcuggc

SEQ ID NO: 312216 - RNA, 23 nt, Bordetella pertussis
gccgcccgagcuggccggcgacu

SEQ ID NO: 312217 - RNA, 16 nt, Bordetella pertussis
gccgcccgcggcggcc

SEQ ID NO: 312218 - RNA, 11 nt, Bordetella pertussis
gccgcccggau

SEQ ID NO: 312219 - RNA, 19 nt, Bordetella pertussis
gccgcccggaugggcggcc

SEQ ID NO: 312220 - RNA, 13 nt, Bordetella pertussis
gccgcccgcuucu

SEQ ID NO: 312221 - RNA, 16 nt, Bordetella pertussis
gccgcccggccggcac

SEQ ID NO: 312222 - RNA, 17 nt, Bordetella pertussis
gccgcccggccggcacg

SEQ ID NO: 312223 - RNA, 15 nt, Bordetella pertussis
gccgcccggccggcc

SEQ ID NO: 312224 - RNA, 22 nt, Bordetella pertussis
gccgcccggccggcccgcgcgc

SEQ ID NO: 312225 - RNA, 13 nt, Bordetella pertussis
gccgcccugcugc

SEQ ID NO: 312226 - RNA, 13 nt, Bordetella pertussis
gccgcccuggccg

SEQ ID NO: 312227 - RNA, 14 nt, Bordetella pertussis
gccgcccuggccgc

SEQ ID NO: 312228 - RNA, 19 nt, Bordetella pertussis
gccgcccuggucaucgcca

SEQ ID NO: 312229 - RNA, 15 nt, Bordetella pertussis
gccgcccuggcgcag

SEQ ID NO: 312230 - RNA, 20 nt, Bordetella pertussis
gccgcccuggcgcagggcau

SEQ ID NO: 312231 - RNA, 13 nt, Bordetella pertussis
gccgcccuugcgc

SEQ ID NO: 312232 - RNA, 13 nt, Bordetella pertussis
gccgccgaaccag

SEQ ID NO: 312233 - RNA, 15 nt, Bordetella pertussis
gccgccgaaccagcg

SEQ ID NO: 312234 - RNA, 20 nt, Bordetella pertussis
gccgccgaaccagcgcacca

SEQ ID NO: 312235 - RNA, 17 nt, Bordetella pertussis
gccgccgaacgaggcgc

SEQ ID NO: 312236 - RNA, 18 nt, Bordetella pertussis
gccgccgaacgaggcgcg

SEQ ID NO: 312237 - RNA, 20 nt, Bordetella pertussis
gccgccgaacggcagcagcg

SEQ ID NO: 312238 - RNA, 15 nt, Bordetella pertussis
gccgccgaacggggc

SEQ ID NO: 312239 - RNA, 17 nt, Bordetella pertussis
gccgccgaacggggccg

SEQ ID NO: 312240 - RNA, 19 nt, Bordetella pertussis
gccgccgaccucgucgggc

SEQ ID NO: 312241 - RNA, 16 nt, Bordetella pertussis
gccgccgacgaugacc

SEQ ID NO: 312242 - RNA, 20 nt, Bordetella pertussis
gccgccgacggcauggcggc

SEQ ID NO: 312243 - RNA, 21 nt, Bordetella pertussis
gccgccgacggcauggcggcc

SEQ ID NO: 312244 - RNA, 22 nt, Bordetella pertussis
gccgccgacggcauggcggcca

SEQ ID NO: 312245 - RNA, 18 nt, Bordetella pertussis
gccgccgacgccgccacg

SEQ ID NO: 312246 - RNA, 19 nt, Bordetella pertussis
gccgccgacgccgccacgc

SEQ ID NO: 312247 - RNA, 14 nt, Bordetella pertussis
gccgccgagcaggg

SEQ ID NO: 312248 - RNA, 14 nt, Bordetella pertussis
gccgccgcacagcg

SEQ ID NO: 312249 - RNA, 14 nt, Bordetella pertussis
gccgccgcagccgc

SEQ ID NO: 312250 - RNA, 17 nt, Bordetella pertussis
gccgccgcagccgccag

SEQ ID NO: 312251 - RNA, 12 nt, Bordetella pertussis
gccgccgcaggc

SEQ ID NO: 312252 - RNA, 15 nt, Bordetella pertussis
gccgccgcaugccgg

SEQ ID NO: 312253 - RNA, 19 nt, Bordetella pertussis
gccgccgccaccagcggcg

SEQ ID NO: 312254 - RNA, 14 nt, Bordetella pertussis
gccgccgccagccu

SEQ ID NO: 312255 - RNA, 19 nt, Bordetella pertussis
gccgccgccauagcugcgc

SEQ ID NO: 312256 - RNA, 14 nt, Bordetella pertussis
gccgccgccauggu

SEQ ID NO: 312257 - RNA, 14 nt, Bordetella pertussis
gccgccgcgcagcc

SEQ ID NO: 312258 - RNA, 21 nt, Bordetella pertussis
gccgccgcgcagccgacaggc

SEQ ID NO: 312259 - RNA, 13 nt, Bordetella pertussis
gccgccgcgcagg

SEQ ID NO: 312260 - RNA, 13 nt, Bordetella pertussis
gccgccgcgcacc

SEQ ID NO: 312261 - RNA, 15 nt, Bordetella pertussis
gccgccgcgcccagc

SEQ ID NO: 312262 - RNA, 15 nt, Bordetella pertussis
gccgccgcgcgccgc

SEQ ID NO: 312263 - RNA, 16 nt, Bordetella pertussis
gccgccgcgcgccgcg

SEQ ID NO: 312264 - RNA, 13 nt, Bordetella pertussis
gccgccgcgcgcg

SEQ ID NO: 312265 - RNA, 15 nt, Bordetella pertussis
gccgccgcgcgcugg

SEQ ID NO: 312266 - RNA, 21 nt, Bordetella pertussis
gccgccgcgcgcuggcugugc

SEQ ID NO: 312267 - RNA, 14 nt, Bordetella pertussis
gccgccgcgcggcg

SEQ ID NO: 312268 - RNA, 17 nt, Bordetella pertussis
gccgccgcgcggcggau

SEQ ID NO: 312269 - RNA, 17 nt, Bordetella pertussis
gccgccgcgccgaacgc

SEQ ID NO: 312270 - RNA, 16 nt, Bordetella pertussis
gccgccgcgcgcggca

SEQ ID NO: 312271 - RNA, 17 nt, Bordetella pertussis
gccgccgcgcgcggcaa

SEQ ID NO: 312272 - RNA, 13 nt, Bordetella pertussis
gccgccgcgcugu

SEQ ID NO: 312273 - RNA, 15 nt, Bordetella pertussis
gccgcugcaggcccu

SEQ ID NO: 312274 - RNA, 18 nt, Bordetella pertussis
gccgcugcaugggcggcc

SEQ ID NO: 312275 - RNA, 13 nt, Bordetella pertussis
gccgcugcccacc

SEQ ID NO: 312276 - RNA, 13 nt, Bordetella pertussis
gccgcugcccagc

SEQ ID NO: 312277 - RNA, 13 nt, Bordetella pertussis
gccgcugccggcc

SEQ ID NO: 312278 - RNA, 21 nt, Bordetella pertussis
gccgcugccggccgaccggcg

SEQ ID NO: 312279 - RNA, 23 nt, Bordetella pertussis
gccgcugccgggcucggccacca

SEQ ID NO: 312280 - RNA, 13 nt, Bordetella pertussis
gccgcugccgcgc

SEQ ID NO: 312281 - RNA, 15 nt, Bordetella pertussis
gccgcugccgcgcgc

SEQ ID NO: 312282 - RNA, 14 nt, Bordetella pertussis
gccgcugcgcuggc

SEQ ID NO: 312283 - RNA, 15 nt, Bordetella pertussis
gccgcugcgcuggcc

SEQ ID NO: 312284 - RNA, 17 nt, Bordetella pertussis
gccgcugcgcgcggccu

SEQ ID NO: 312285 - RNA, 19 nt, Bordetella pertussis
gccgcugcgcgcggccugg

SEQ ID NO: 312286 - RNA, 21 nt, Bordetella pertussis
gccgcugcgcgcggccuggcg

SEQ ID NO: 312287 - RNA, 16 nt, Bordetella pertussis
gccgcugcgcggucac

SEQ ID NO: 312288 - RNA, 23 nt, Bordetella pertussis
gccgcuggacagauccagcgcgg

SEQ ID NO: 312289 - RNA, 16 nt, Bordetella pertussis
gccgcuggacgcgccg

SEQ ID NO: 312290 - RNA, 15 nt, Bordetella pertussis
gccgcuggccagccg

SEQ ID NO: 312291 - RNA, 16 nt, Bordetella pertussis
gccgcuggcgaucagg

SEQ ID NO: 312292 - RNA, 21 nt, Bordetella pertussis
gccgcuggcgaucaggccgcc

SEQ ID NO: 312293 - RNA, 12 nt, Bordetella pertussis
gccgcuggcggc

SEQ ID NO: 312294 - RNA, 14 nt, Bordetella pertussis
gccgcuggcggccg

SEQ ID NO: 312295 - RNA, 17 nt, Bordetella pertussis
gccgcuggcggccgcgg

SEQ ID NO: 312296 - RNA, 19 nt, Bordetella pertussis
gccgcuggcggccgcgggc

SEQ ID NO: 312297 - RNA, 23 nt, Bordetella pertussis
gccgcuggcggccgcgggcgugc

SEQ ID NO: 312298 - RNA, 14 nt, Bordetella pertussis
gccgcuggcgucca

SEQ ID NO: 312299 - RNA, 17 nt, Bordetella pertussis
gccgcuggcguccaggu

SEQ ID NO: 312300 - RNA, 13 nt, Bordetella pertussis
gccgcuggcgucg

SEQ ID NO: 312301 - RNA, 12 nt, Bordetella pertussis
gccgcugggcac

SEQ ID NO: 312302 - RNA, 13 nt, Bordetella pertussis
gccgcugggcaca

SEQ ID NO: 312303 - RNA, 18 nt, Bordetella pertussis
gccgcugggcacauccag

SEQ ID NO: 312304 - RNA, 12 nt, Bordetella pertussis
gccgcuggcgcg

SEQ ID NO: 312305 - RNA, 16 nt, Bordetella pertussis
gccgcuggucaccgcc

SEQ ID NO: 312306 - RNA, 21 nt, Bordetella pertussis
gccgcuggugaucugcugcgu

SEQ ID NO: 312307 - RNA, 22 nt, Bordetella pertussis
gccgcuguagaaguaguucggc

SEQ ID NO: 312308 - RNA, 14 nt, Bordetella pertussis
gccgcugucgaccu

SEQ ID NO: 312309 - RNA, 19 nt, Bordetella pertussis
gccgcugucgcaggcgcug

SEQ ID NO: 312310 - RNA, 16 nt, Bordetella pertussis
gccgcugucgcugauc

SEQ ID NO: 312311 - RNA, 19 nt, Bordetella pertussis
gccgcugucgcugaucugc

SEQ ID NO: 312312 - RNA, 20 nt, Bordetella pertussis
gccgcuguggacgccgccgg

SEQ ID NO: 312313 - RNA, 15 nt, Bordetella pertussis
gccgcuguggcgcgc

SEQ ID NO: 312314 - RNA, 17 nt, Bordetella pertussis
gccgcuguggcgcgcca

SEQ ID NO: 312315 - RNA, 22 nt, Bordetella pertussis
gccgcuguucggcgagccgggc

SEQ ID NO: 312316 - RNA, 17 nt, Bordetella pertussis
gccgcuguugcccacca

SEQ ID NO: 312317 - RNA, 18 nt, Bordetella pertussis
gccgcuguugcccaccag

SEQ ID NO: 312318 - RNA, 20 nt, Bordetella pertussis
gccgcuguugcccaccagcc

SEQ ID NO: 312319 - RNA, 15 nt, Bordetella pertussis
gccgcuuccggcaug

SEQ ID NO: 312320 - RNA, 14 nt, Bordetella pertussis
gccgcuuccggccg

SEQ ID NO: 312321 - RNA, 16 nt, Bordetella pertussis
gccgcuuccggccgga

SEQ ID NO: 312322 - RNA, 19 nt, Bordetella pertussis
gccgcuucgaugcuggcgg

SEQ ID NO: 312323 - RNA, 16 nt, Bordetella pertussis
gccgcuucggcggcca

SEQ ID NO: 312324 - RNA, 16 nt, Bordetella pertussis
gccgcuucgugcggcc

SEQ ID NO: 312325 - RNA, 19 nt, Bordetella pertussis
gccgcuucgugcggccgca

SEQ ID NO: 312326 - RNA, 22 nt, Bordetella pertussis
gccgcuucgugcggccgcagca

SEQ ID NO: 312327 - RNA, 16 nt, Bordetella pertussis
gccgcuugcggccagg

SEQ ID NO: 312328 - RNA, 17 nt, Bordetella pertussis
gccgcuugucgaugacg

SEQ ID NO: 312329 - RNA, 19 nt, Bordetella pertussis
gccgcuugucgaugacgcg

SEQ ID NO: 312330 - RNA, 20 nt, Bordetella pertussis
gccgcuugucgaugacgcgc

SEQ ID NO: 312331 - RNA, 21 nt, Bordetella pertussis
gccgcuuggccugcgccaccg

SEQ ID NO: 312332 - RNA, 19 nt, Bordetella pertussis
gccgcuuucgaccagcgac

SEQ ID NO: 312333 - RNA, 20 nt, Bordetella pertussis
gccgcuuucgaccuugcuga

SEQ ID NO: 312334 - RNA, 22 nt, Bordetella pertussis
gccgcuuucgaccuugcugacg

SEQ ID NO: 312335 - RNA, 18 nt, Bordetella pertussis
gccgcuuucucccgccgc

SEQ ID NO: 312336 - RNA, 14 nt, Bordetella pertussis
gccggaaacgcggu

SEQ ID NO: 312337 - RNA, 14 nt, Bordetella pertussis
gccggaacagcguc

SEQ ID NO: 312338 - RNA, 16 nt, Bordetella pertussis
gccggaaaugccgcgc

SEQ ID NO: 312339 - RNA, 15 nt, Bordetella pertussis
gccggaauccuggcg

SEQ ID NO: 312340 - RNA, 17 nt, Bordetella pertussis
gccggaauccuggcgac

SEQ ID NO: 312341 - RNA, 16 nt, Bordetella pertussis
gccggaaugcaccacg

SEQ ID NO: 312342 - RNA, 22 nt, Bordetella pertussis
gccggacacguacaaccgcgcc

SEQ ID NO: 312343 - RNA, 23 nt, Bordetella pertussis
gccggacacguacaaccgcgccg

SEQ ID NO: 312344 - RNA, 15 nt, Bordetella pertussis
gccggacagggccgc

SEQ ID NO: 312345 - RNA, 17 nt, Bordetella pertussis
gccggacagggccgcga

SEQ ID NO: 312346 - RNA, 21 nt, Bordetella pertussis
gccggacccgcgccgcaggcc

SEQ ID NO: 312347 - RNA, 17 nt, Bordetella pertussis
gccggaccgcugugcgc

SEQ ID NO: 312348 - RNA, 13 nt, Bordetella pertussis
gccggaccugggc

SEQ ID NO: 312349 - RNA, 17 nt, Bordetella pertussis
gccggacgccgacuggg

SEQ ID NO: 312350 - RNA, 18 nt, Bordetella pertussis
gccggacguagucgcacg

SEQ ID NO: 312351 - RNA, 16 nt, Bordetella pertussis
gccggacgugggcgcc

SEQ ID NO: 312352 - RNA, 14 nt, Bordetella pertussis
gccggacgcgggga

SEQ ID NO: 312353 - RNA, 14 nt, Bordetella pertussis
gccggacucgucca

SEQ ID NO: 312354 - RNA, 20 nt, Bordetella pertussis
gccggacuggauauggcgcc

SEQ ID NO: 312355 - RNA, 13 nt, Bordetella pertussis
gccggacuggcgc

SEQ ID NO: 312356 - RNA, 14 nt, Bordetella pertussis
gccggacuggcgcg

SEQ ID NO: 312357 - RNA, 19 nt, Bordetella pertussis
gccggacuggcgcgcacca

SEQ ID NO: 312358 - RNA, 19 nt, Bordetella pertussis
gccggagauccggccuucc

SEQ ID NO: 312359 - RNA, 14 nt, Bordetella pertussis
gccggagcagcagc

SEQ ID NO: 312360 - RNA, 15 nt, Bordetella pertussis
gccggagcagcagcg

SEQ ID NO: 312361 - RNA, 16 nt, Bordetella pertussis
gccggagcagucgcgc

SEQ ID NO: 312362 - RNA, 17 nt, Bordetella pertussis
gccggagccagguaaua

SEQ ID NO: 312363 - RNA, 15 nt, Bordetella pertussis
gccggaggcgcgcag

SEQ ID NO: 312364 - RNA, 17 nt, Bordetella pertussis
gccggaggcgcgcagcu

SEQ ID NO: 312365 - RNA, 15 nt, Bordetella pertussis
gccggaucagcgccu

SEQ ID NO: 312366 - RNA, 14 nt, Bordetella pertussis
gccggauccagcug

SEQ ID NO: 312367 - RNA, 20 nt, Bordetella pertussis
gccggaucgcacacaccgcg

SEQ ID NO: 312368 - RNA, 15 nt, Bordetella pertussis
gccggaucggccggc

SEQ ID NO: 312369 - RNA, 17 nt, Bordetella pertussis
gccggaucggccggcag

SEQ ID NO: 312370 - RNA, 12 nt, Bordetella pertussis
gccggaucugca

SEQ ID NO: 312371 - RNA, 13 nt, Bordetella pertussis
gccggaugcgcag

SEQ ID NO: 312372 - RNA, 14 nt, Bordetella pertussis
gccggaugcgcagg

SEQ ID NO: 312373 - RNA, 20 nt, Bordetella pertussis
gccggaugcgcaggacggcg

SEQ ID NO: 312374 - RNA, 21 nt, Bordetella pertussis
gccggaugcgcaggacggcgc

SEQ ID NO: 312375 - RNA, 17 nt, Bordetella pertussis
gccggaugcgcguggcg

SEQ ID NO: 312376 - RNA, 18 nt, Bordetella pertussis
gccggaugcgcguggcgc

SEQ ID NO: 312377 - RNA, 19 nt, Bordetella pertussis
gccggaugcgcguggcgcg

SEQ ID NO: 312378 - RNA, 21 nt, Bordetella pertussis
gccggaugguagaugcgcgcg

SEQ ID NO: 312379 - RNA, 24 nt, Bordetella pertussis
gccggaugguagaugcgcgcgacc

SEQ ID NO: 312380 - RNA, 12 nt, Bordetella pertussis
gccggauggcgu

SEQ ID NO: 312381 - RNA, 14 nt, Bordetella pertussis
gccggauggcgucc

SEQ ID NO: 312382 - RNA, 21 nt, Bordetella pertussis
gccggauugcuugacgccgcc

SEQ ID NO: 312383 - RNA, 22 nt, Bordetella pertussis
gccggauugcuugacgccgccg

SEQ ID NO: 312384 - RNA, 16 nt, Bordetella pertussis
gccggauuggcgcugc

SEQ ID NO: 312385 - RNA, 18 nt, Bordetella pertussis
gccggcaagcacgaacag

SEQ ID NO: 312386 - RNA, 20 nt, Bordetella pertussis
gccggcaagccagggcagga

SEQ ID NO: 312387 - RNA, 19 nt, Bordetella pertussis
gccggcaaggggccagccu

SEQ ID NO: 312388 - RNA, 20 nt, Bordetella pertussis
gccggcaaggggccagccug

SEQ ID NO: 312389 - RNA, 18 nt, Bordetella pertussis
gccggcaccacgaccggc

SEQ ID NO: 312390 - RNA, 20 nt, Bordetella pertussis
gccggcaccacgaccggcuc

SEQ ID NO: 312391 - RNA, 22 nt, Bordetella pertussis
gccggcaccacgaccggcucgg

SEQ ID NO: 312392 - RNA, 15 nt, Bordetella pertussis
gccggcaccagcgcc

SEQ ID NO: 312393 - RNA, 20 nt, Bordetella pertussis
gccggcaccagcgccacgcc

SEQ ID NO: 312394 - RNA, 22 nt, Bordetella pertussis
gccggcaccaggauccccagca

SEQ ID NO: 312395 - RNA, 13 nt, Bordetella pertussis
gccggcaccaucu

SEQ ID NO: 312396 - RNA, 21 nt, Bordetella pertussis
gccggcaccaucugcgucgcg

SEQ ID NO: 312397 - RNA, 13 nt, Bordetella pertussis
gccggcacgccca

SEQ ID NO: 312398 - RNA, 14 nt, Bordetella pertussis
gccggcacgcccag

SEQ ID NO: 312399 - RNA, 15 nt, Bordetella pertussis
gccggcacgcccagc

SEQ ID NO: 312400 - RNA, 16 nt, Bordetella pertussis
gccggcacgcccagcc

SEQ ID NO: 312401 - RNA, 17 nt, Bordetella pertussis
gccggcacgcccagccg

SEQ ID NO: 312402 - RNA, 19 nt, Bordetella pertussis
gccggcacgcccagccgca

SEQ ID NO: 312403 - RNA, 14 nt, Bordetella pertussis
gccggcacgccugc

SEQ ID NO: 312404 - RNA, 15 nt, Bordetella pertussis
gccggcacgccugcc

SEQ ID NO: 312405 - RNA, 18 nt, Bordetella pertussis
gccggcacgccugccgcg

SEQ ID NO: 312406 - RNA, 22 nt, Bordetella pertussis
gccggcacgccugccgcgcccg

SEQ ID NO: 312407 - RNA, 20 nt, Bordetella pertussis
gccggcacgcugaucgccgg

SEQ ID NO: 312408 - RNA, 17 nt, Bordetella pertussis
gccggcacguaccaggc

SEQ ID NO: 312409 - RNA, 19 nt, Bordetella pertussis
gccggcacguaccaggcgc

SEQ ID NO: 312410 - RNA, 18 nt, Bordetella pertussis
gccggcagaucggcgcug

SEQ ID NO: 312411 - RNA, 19 nt, Bordetella pertussis
gccggcagaucggcgcugg

SEQ ID NO: 312412 - RNA, 20 nt, Bordetella pertussis
gccggcagaucggcgcuggc

SEQ ID NO: 312413 - RNA, 16 nt, Bordetella pertussis
gccggcagccccagcg

SEQ ID NO: 312414 - RNA, 18 nt, Bordetella pertussis
gccggcagccccagcgcc

SEQ ID NO: 312415 - RNA, 16 nt, Bordetella pertussis
gccggcagcgccuugc

SEQ ID NO: 312416 - RNA, 21 nt, Bordetella pertussis
gccggcagcgccuugccuucc

SEQ ID NO: 312417 - RNA, 16 nt, Bordetella pertussis
gccggcagcgcgaccg

SEQ ID NO: 312418 - RNA, 14 nt, Bordetella pertussis
gccggcagcggcgc

SEQ ID NO: 312419 - RNA, 16 nt, Bordetella pertussis
gccggcagcggcgcca

SEQ ID NO: 312420 - RNA, 19 nt, Bordetella pertussis
gccggcagcggcgccaugc

SEQ ID NO: 312421 - RNA, 20 nt, Bordetella pertussis
gccggcagcggcgccaugcg

SEQ ID NO: 312422 - RNA, 12 nt, Bordetella pertussis
gccggcaggccg

SEQ ID NO: 312423 - RNA, 16 nt, Bordetella pertussis
gccggcaggccggcca

SEQ ID NO: 312424 - RNA, 17 nt, Bordetella pertussis
gccggcaggccggccag

SEQ ID NO: 312425 - RNA, 19 nt, Bordetella pertussis
gccggcaggccggccagca

SEQ ID NO: 312426 - RNA, 16 nt, Bordetella pertussis
gccggcaggcgcgcca

SEQ ID NO: 312427 - RNA, 18 nt, Bordetella pertussis
gccggcaggcgcgccagc

SEQ ID NO: 312428 - RNA, 19 nt, Bordetella pertussis
gccggcaggcgcgccagcc

SEQ ID NO: 312429 - RNA, 20 nt, Bordetella pertussis
gccggcaggcgcgccagccc

SEQ ID NO: 312430 - RNA, 20 nt, Bordetella pertussis
gccggcagggccagcgccag

SEQ ID NO: 312431 - RNA, 22 nt, Bordetella pertussis
gccggcagggccagcgccagca

SEQ ID NO: 312432 - RNA, 14 nt, Bordetella pertussis
gccggcagggcggc

SEQ ID NO: 312433 - RNA, 16 nt, Bordetella pertussis
gccggcagggcggcca

SEQ ID NO: 312434 - RNA, 19 nt, Bordetella pertussis
gccggcagggcggccaggc

SEQ ID NO: 312435 - RNA, 22 nt, Bordetella pertussis
gccggcagggugcuguucaggc

SEQ ID NO: 312436 - RNA, 15 nt, Bordetella pertussis
gccggcaggucgaug

SEQ ID NO: 312437 - RNA, 21 nt, Bordetella pertussis
gccggcauaggcggcgcaggc

SEQ ID NO: 312438 - RNA, 22 nt, Bordetella pertussis
gccggcauaggcggcgcaggcc

SEQ ID NO: 312439 - RNA, 15 nt, Bordetella pertussis
gccggcaucgcgcug

SEQ ID NO: 312440 - RNA, 17 nt, Bordetella pertussis
gccggcaucgcgcugac

SEQ ID NO: 312441 - RNA, 15 nt, Bordetella pertussis
gccggcaucggcggc

SEQ ID NO: 312442 - RNA, 17 nt, Bordetella pertussis
gccggcaugaagcgcag

SEQ ID NO: 312443 - RNA, 21 nt, Bordetella pertussis
gccggcaugcgccggcccggc

SEQ ID NO: 312444 - RNA, 16 nt, Bordetella pertussis
gccggcauguugccgc

SEQ ID NO: 312445 - RNA, 19 nt, Bordetella pertussis
gccggcauguugccgcugg

SEQ ID NO: 312446 - RNA, 22 nt, Bordetella pertussis
gccggcauguugccgcuggugc

SEQ ID NO: 312447 - RNA, 16 nt, Bordetella pertussis
gccggcauugcccacc

SEQ ID NO: 312448 - RNA, 17 nt, Bordetella pertussis
gccggcauugcccacca

SEQ ID NO: 312449 - RNA, 22 nt, Bordetella pertussis
gccggcauuucgcugggcgcgc

SEQ ID NO: 312450 - RNA, 18 nt, Bordetella pertussis
gccggccaacagcucgcg

SEQ ID NO: 312451 - RNA, 21 nt, Bordetella pertussis
gccggccaacagcucgcgcca

SEQ ID NO: 312452 - RNA, 22 nt, Bordetella pertussis
gccggccaacagcucgcgccag

SEQ ID NO: 312453 - RNA, 13 nt, Bordetella pertussis
gccggccaccagc

SEQ ID NO: 312454 - RNA, 22 nt, Bordetella pertussis
gccggccaccagcggcgccgga

SEQ ID NO: 312455 - RNA, 16 nt, Bordetella pertussis
gccggccacgcgcugc

SEQ ID NO: 312456 - RNA, 19 nt, Bordetella pertussis
gccggccacgaacggcgcg

SEQ ID NO: 312457 - RNA, 12 nt, Bordetella pertussis
gccggccagcaa

SEQ ID NO: 312458 - RNA, 13 nt, Bordetella pertussis
gccggccagcacg

SEQ ID NO: 312459 - RNA, 12 nt, Bordetella pertussis
gccggccagcag

SEQ ID NO: 312460 - RNA, 13 nt, Bordetella pertussis
gccggccagcagc

SEQ ID NO: 312461 - RNA, 14 nt, Bordetella pertussis
gccggccagcagcg

SEQ ID NO: 312462 - RNA, 22 nt, Bordetella pertussis
gccggccagccauugccgcacg

SEQ ID NO: 312463 - RNA, 22 nt, Bordetella pertussis
gccggccagccugcccgucgac

SEQ ID NO: 312464 - RNA, 19 nt, Bordetella pertussis
gccggccagccugugcgcc

SEQ ID NO: 312465 - RNA, 13 nt, Bordetella pertussis
gccggccagcgcc

SEQ ID NO: 312466 - RNA, 14 nt, Bordetella pertussis
gccggccagcgcca

SEQ ID NO: 312467 - RNA, 16 nt, Bordetella pertussis
gccggccagcgccacc

SEQ ID NO: 312468 - RNA, 14 nt, Bordetella pertussis
gccggccagcgccu

SEQ ID NO: 312469 - RNA, 16 nt, Bordetella pertussis
gccggccagcgccugg

SEQ ID NO: 312470 - RNA, 19 nt, Bordetella pertussis
gccggccagcgccugggcg

SEQ ID NO: 312471 - RNA, 23 nt, Bordetella pertussis
gccggccagcgcgccggccaggg

SEQ ID NO: 312472 - RNA, 24 nt, Bordetella pertussis
gccggccagcgcgccggccagggc

SEQ ID NO: 312473 - RNA, 14 nt, Bordetella pertussis
gccggccagcgcgg

SEQ ID NO: 312474 - RNA, 16 nt, Bordetella pertussis
gccggccagcgcggca

SEQ ID NO: 312475 - RNA, 15 nt, Bordetella pertussis
gccggccagcgcggu

SEQ ID NO: 312476 - RNA, 12 nt, Bordetella pertussis
gccggccagcgg

SEQ ID NO: 312477 - RNA, 15 nt, Bordetella pertussis
gccggccagcggcag

SEQ ID NO: 312478 - RNA, 16 nt, Bordetella pertussis
gccggccagcggcagg

SEQ ID NO: 312479 - RNA, 13 nt, Bordetella pertussis
gccggccagcugc

SEQ ID NO: 312480 - RNA, 13 nt, Bordetella pertussis
gccggccagcuug

SEQ ID NO: 312481 - RNA, 17 nt, Bordetella pertussis
gccggccagggccacca

SEQ ID NO: 312482 - RNA, 19 nt, Bordetella pertussis
gccggccagggccaccacg

SEQ ID NO: 312483 - RNA, 14 nt, Bordetella pertussis
gccggccaggcgcc

SEQ ID NO: 312484 - RNA, 22 nt, Bordetella pertussis
gccggccaggcgccgcucagcg

SEQ ID NO: 312485 - RNA, 18 nt, Bordetella pertussis
gccggccaggucggcggc

SEQ ID NO: 312486 - RNA, 23 nt, Bordetella pertussis
gccggccaggucggcggccagcg

SEQ ID NO: 312487 - RNA, 15 nt, Bordetella pertussis
gccggccaguggcgc

SEQ ID NO: 312488 - RNA, 16 nt, Bordetella pertussis
gccggccaguggcgcg

SEQ ID NO: 312489 - RNA, 17 nt, Bordetella pertussis
gccggccaugcucagca

SEQ ID NO: 312490 - RNA, 23 nt, Bordetella pertussis
gccggccaugcucagcagcaccg

SEQ ID NO: 312491 - RNA, 19 nt, Bordetella pertussis
gccggccauggcggccggc

SEQ ID NO: 312492 - RNA, 22 nt, Bordetella pertussis
gccggcccaaggccccgcgacc

SEQ ID NO: 312493 - RNA, 13 nt, Bordetella pertussis
gccggcccagcac

SEQ ID NO: 312494 - RNA, 14 nt, Bordetella pertussis
gccggcccagcacg

SEQ ID NO: 312495 - RNA, 15 nt, Bordetella pertussis
gccggcccagcacgc

SEQ ID NO: 312496 - RNA, 16 nt, Bordetella pertussis
gccggcccagcacgcc

SEQ ID NO: 312497 - RNA, 19 nt, Bordetella pertussis
gccggcccagcacgccgcg

SEQ ID NO: 312498 - RNA, 18 nt, Bordetella pertussis
gccggcccaggauggcgc

SEQ ID NO: 312499 - RNA, 19 nt, Bordetella pertussis
gccggcccaggauggcgcc

SEQ ID NO: 312500 - RNA, 20 nt, Bordetella pertussis
gccggcccaggauggcgcca

SEQ ID NO: 312501 - RNA, 21 nt, Bordetella pertussis
gccggcccaggauggcgccag

SEQ ID NO: 312502 - RNA, 23 nt, Bordetella pertussis
gccggcccaggauggcgccagcc

SEQ ID NO: 312503 - RNA, 13 nt, Bordetella pertussis
gccggcccaggcg

SEQ ID NO: 312504 - RNA, 19 nt, Bordetella pertussis
gccggcccaggcgcgcugg

SEQ ID NO: 312505 - RNA, 23 nt, Bordetella pertussis
gccggcccaucuguacggccggc

SEQ ID NO: 312506 - RNA, 21 nt, Bordetella pertussis
gccggccccauccucaucgug

SEQ ID NO: 312507 - RNA, 13 nt, Bordetella pertussis
gccggccccgcaa

SEQ ID NO: 312508 - RNA, 22 nt, Bordetella pertussis
gccggccccgcaaggggccggc

SEQ ID NO: 312509 - RNA, 22 nt, Bordetella pertussis
gccggcccgcaccugaacaccg

SEQ ID NO: 312510 - RNA, 15 nt, Bordetella pertussis
gccggcccgccacgc

SEQ ID NO: 312511 - RNA, 20 nt, Bordetella pertussis
gccggcccgccacgcgggcc

SEQ ID NO: 312512 - RNA, 19 nt, Bordetella pertussis
gccggcccgccccacggcg

SEQ ID NO: 312513 - RNA, 13 nt, Bordetella pertussis
gccggcccgccuc

SEQ ID NO: 312514 - RNA, 23 nt, Bordetella pertussis
gccggcccggaauaccgccagcu

SEQ ID NO: 312515 - RNA, 15 nt, Bordetella pertussis
gccggcccugccgcc

SEQ ID NO: 312516 - RNA, 19 nt, Bordetella pertussis
gccggcccugccgcccugg

SEQ ID NO: 312517 - RNA, 21 nt, Bordetella pertussis
gccggcccgugcgcaacgcgc

SEQ ID NO: 312518 - RNA, 17 nt, Bordetella pertussis
gccggccgacggcgcug

SEQ ID NO: 312519 - RNA, 17 nt, Bordetella pertussis
gccggccgauagccgcg

SEQ ID NO: 312520 - RNA, 20 nt, Bordetella pertussis
gccggccgaugacaucgccg

SEQ ID NO: 312521 - RNA, 21 nt, Bordetella pertussis
gccggccgaugacaucgccgc

SEQ ID NO: 312522 - RNA, 16 nt, Bordetella pertussis
gccggccgccauggcc

SEQ ID NO: 312523 - RNA, 19 nt, Bordetella pertussis
gccggccgccauggccggc

SEQ ID NO: 312524 - RNA, 22 nt, Bordetella pertussis
gccggccgccauggccggcguu

SEQ ID NO: 312525 - RNA, 12 nt, Bordetella pertussis
gccggccgccca

SEQ ID NO: 312526 - RNA, 14 nt, Bordetella pertussis
gccggccgcccagg

SEQ ID NO: 312527 - RNA, 17 nt, Bordetella pertussis
gccggccgcccaggcgc

SEQ ID NO: 312528 - RNA, 14 nt, Bordetella pertussis
gccggccgccgaac

SEQ ID NO: 312529 - RNA, 17 nt, Bordetella pertussis
gccggccgccgaacgag

SEQ ID NO: 312530 - RNA, 14 nt, Bordetella pertussis
gccggccgccggcg

SEQ ID NO: 312531 - RNA, 16 nt, Bordetella pertussis
gccggccgccggcggc

SEQ ID NO: 312532 - RNA, 14 nt, Bordetella pertussis
gccggccgccgggc

SEQ ID NO: 312533 - RNA, 22 nt, Bordetella pertussis
gccggccgccgggccgcgacca

SEQ ID NO: 312534 - RNA, 13 nt, Bordetella pertussis
gccggccgcgccc

SEQ ID NO: 312535 - RNA, 14 nt, Bordetella pertussis
gccggccgcgccca

SEQ ID NO: 312536 - RNA, 17 nt, Bordetella pertussis
gccggccgcgcccaugc

SEQ ID NO: 312537 - RNA, 23 nt, Bordetella pertussis
gccggccgcgcccaugcgcuggc

SEQ ID NO: 312538 - RNA, 14 nt, Bordetella pertussis
gccggccgcgcccg

SEQ ID NO: 312539 - RNA, 15 nt, Bordetella pertussis
gccggccgcgcccga

SEQ ID NO: 312540 - RNA, 20 nt, Bordetella pertussis
gccggccgcgccgcgccggu

SEQ ID NO: 312541 - RNA, 18 nt, Bordetella pertussis
gccggccgcgcgcgccag

SEQ ID NO: 312542 - RNA, 16 nt, Bordetella pertussis
gccggccgcgcggccg

SEQ ID NO: 312543 - RNA, 18 nt, Bordetella pertussis
gccggccgcgcggccguc

SEQ ID NO: 312544 - RNA, 15 nt, Bordetella pertussis
gccggccgcguggcc

SEQ ID NO: 312545 - RNA, 13 nt, Bordetella pertussis
gccggccggccag

SEQ ID NO: 312546 - RNA, 14 nt, Bordetella pertussis
gccggccggccagu

SEQ ID NO: 312547 - RNA, 16 nt, Bordetella pertussis
gccggccgggccgcgc

SEQ ID NO: 312548 - RNA, 20 nt, Bordetella pertussis
gccggccgggcgcggcgccc

SEQ ID NO: 312549 - RNA, 17 nt, Bordetella pertussis
gccggccggguugucgc

SEQ ID NO: 312550 - RNA, 22 nt, Bordetella pertussis
gccggccggugcaucggccggc

SEQ ID NO: 312551 - RNA, 19 nt, Bordetella pertussis
gccggccgucuugaggaua

SEQ ID NO: 312552 - RNA, 23 nt, Bordetella pertussis
gccggccuccagcaucgccgcca

SEQ ID NO: 312553 - RNA, 16 nt, Bordetella pertussis
gccggccucggccaug

SEQ ID NO: 312554 - RNA, 20 nt, Bordetella pertussis
gccggccucuucgucgccgg

SEQ ID NO: 312555 - RNA, 22 nt, Bordetella pertussis
gccggccucuucgucgccggcg

SEQ ID NO: 312556 - RNA, 16 nt, Bordetella pertussis
gccggccugacgcgca

SEQ ID NO: 312557 - RNA, 18 nt, Bordetella pertussis
gccggccugacgcgcaag

SEQ ID NO: 312558 - RNA, 14 nt, Bordetella pertussis
gccggccugcaaug

SEQ ID NO: 312559 - RNA, 23 nt, Bordetella pertussis
gccggccugcaaugcggccaggc

SEQ ID NO: 312560 - RNA, 17 nt, Bordetella pertussis
gccggccugcgccgggc

SEQ ID NO: 312561 - RNA, 18 nt, Bordetella pertussis
gccggccugcgccgggcg

SEQ ID NO: 312562 - RNA, 20 nt, Bordetella pertussis
gccggccugcgccgggcgcg

SEQ ID NO: 312563 - RNA, 16 nt, Bordetella pertussis
gccggccugccggcgc

SEQ ID NO: 312564 - RNA, 12 nt, Bordetella pertussis
gccggccugcgc

SEQ ID NO: 312565 - RNA, 16 nt, Bordetella pertussis
gccggccugcgucgcc

SEQ ID NO: 312566 - RNA, 20 nt, Bordetella pertussis
gccggccugcgucgccaccu

SEQ ID NO: 312567 - RNA, 14 nt, Bordetella pertussis
gccggccugcuugg

SEQ ID NO: 312568 - RNA, 13 nt, Bordetella pertussis
gccggccuggcgc

SEQ ID NO: 312569 - RNA, 14 nt, Bordetella pertussis
gccggccuggcgcg

SEQ ID NO: 312570 - RNA, 15 nt, Bordetella pertussis
gccggccuggcgggc

SEQ ID NO: 312571 - RNA, 17 nt, Bordetella pertussis
gccggccuggcgggccg

SEQ ID NO: 312572 - RNA, 18 nt, Bordetella pertussis
gccggccuggcgggccga

SEQ ID NO: 312573 - RNA, 12 nt, Bordetella pertussis
gccggccugggc

SEQ ID NO: 312574 - RNA, 19 nt, Bordetella pertussis
gccggccuuccggcaucag

SEQ ID NO: 312575 - RNA, 20 nt, Bordetella pertussis
gccggccugggcggcggcga

SEQ ID NO: 312576 - RNA, 11 nt, Bordetella pertussis
gccggccuguu

SEQ ID NO: 312577 - RNA, 22 nt, Bordetella pertussis
aagcagaccuaccaggccgacg

SEQ ID NO: 312578 - RNA, 20 nt, Bordetella pertussis
aagcagcccagcacgacgaa

SEQ ID NO: 312579 - RNA, 12 nt, Bordetella pertussis
aagcagccggcc

SEQ ID NO: 312580 - RNA, 18 nt, Bordetella pertussis
aagcaggugaugcgcgcg

SEQ ID NO: 312581 - RNA, 22 nt, Bordetella pertussis
gccggccuuggccauguccugg

SEQ ID NO: 312582 - RNA, 23 nt, Bordetella pertussis
gccggccuuggccauguccuggc

SEQ ID NO: 312583 - RNA, 12 nt, Bordetella pertussis
gccggcgacaua

SEQ ID NO: 312584 - RNA, 13 nt, Bordetella pertussis
gccggcgacauag

SEQ ID NO: 312585 - RNA, 23 nt, Bordetella pertussis
gccggcgacauagaucuccggcg

SEQ ID NO: 312586 - RNA, 18 nt, Bordetella pertussis
gccggcgaaugccggccg

SEQ ID NO: 312587 - RNA, 20 nt, Bordetella pertussis
gccggcgaaugccggccgau

SEQ ID NO: 312588 - RNA, 15 nt, Bordetella pertussis
gccggcgacgccgcg

SEQ ID NO: 312589 - RNA, 16 nt, Bordetella pertussis
gccggcgacgccgcgg

SEQ ID NO: 312590 - RNA, 14 nt, Bordetella pertussis
gccggcgacggcau

SEQ ID NO: 312591 - RNA, 19 nt, Bordetella pertussis
gccggcgagacgucggcga

SEQ ID NO: 312592 - RNA, 14 nt, Bordetella pertussis
gccggcgacguggu

SEQ ID NO: 312593 - RNA, 13 nt, Bordetella pertussis
gccggcgaucacg

SEQ ID NO: 312594 - RNA, 15 nt, Bordetella pertussis
gccggcgaucacgcc

SEQ ID NO: 312595 - RNA, 21 nt, Bordetella pertussis
gccggcgaugaagucgcggcc

SEQ ID NO: 312596 - RNA, 18 nt, Bordetella pertussis
gccggcgaugaucgccuc

SEQ ID NO: 312597 - RNA, 19 nt, Bordetella pertussis
gccggcgaugauggggucg

SEQ ID NO: 312598 - RNA, 16 nt, Bordetella pertussis
gccggcgauggacacg

SEQ ID NO: 312599 - RNA, 21 nt, Bordetella pertussis
gccggcgauugcgccagcgcu

SEQ ID NO: 312600 - RNA, 17 nt, Bordetella pertussis
gccggcgcaacgggccg

SEQ ID NO: 312601 - RNA, 18 nt, Bordetella pertussis
gccggcgcacaaucugcg

SEQ ID NO: 312602 - RNA, 21 nt, Bordetella pertussis
gccggcgcacaaucugcgucg

SEQ ID NO: 312603 - RNA, 17 nt, Bordetella pertussis
gccggcgcacgccggac

SEQ ID NO: 312604 - RNA, 19 nt, Bordetella pertussis
gccggcgccagccgcucca

SEQ ID NO: 312605 - RNA, 16 nt, Bordetella pertussis
gccggcgcccccagca

SEQ ID NO: 312606 - RNA, 19 nt, Bordetella pertussis
gccggcgcccccagcagcg

SEQ ID NO: 312607 - RNA, 13 nt, Bordetella pertussis
gccggcgccagca

SEQ ID NO: 312608 - RNA, 14 nt, Bordetella pertussis
gccggcgcccggca

SEQ ID NO: 312609 - RNA, 20 nt, Bordetella pertussis
gccggcgccgccucaggccg

SEQ ID NO: 312610 - RNA, 16 nt, Bordetella pertussis
gccggcgccgggcagc

SEQ ID NO: 312611 - RNA, 23 nt, Bordetella pertussis
gccggcgccgggcagcccgcgca

SEQ ID NO: 312612 - RNA, 14 nt, Bordetella pertussis
gccggcgccggcaa

SEQ ID NO: 312613 - RNA, 14 nt, Bordetella pertussis
gccggcgccggcga

SEQ ID NO: 312614 - RNA, 19 nt, Bordetella pertussis
gccggcgccggcgcgccgc

SEQ ID NO: 312615 - RNA, 22 nt, Bordetella pertussis
gccggcgccgguguccacgguc

SEQ ID NO: 312616 - RNA, 11 nt, Bordetella pertussis
gccggcgccgu

SEQ ID NO: 312617 - RNA, 13 nt, Bordetella pertussis
gccggcgccguuc

SEQ ID NO: 312618 - RNA, 18 nt, Bordetella pertussis
gccggcgccguucaugcg

SEQ ID NO: 312619 - RNA, 22 nt, Bordetella pertussis
gccggcgccguuuucagcgcag

SEQ ID NO: 312620 - RNA, 16 nt, Bordetella pertussis
gccggcgccuggggcg

SEQ ID NO: 312621 - RNA, 18 nt, Bordetella pertussis
gccggcgccuuggccugg

SEQ ID NO: 312622 - RNA, 13 nt, Bordetella pertussis
gccggcgcgaacc

SEQ ID NO: 312623 - RNA, 13 nt, Bordetella pertussis
gccggcgcgcauc

SEQ ID NO: 312624 - RNA, 15 nt, Bordetella pertussis
gccggcgcgcauccg

SEQ ID NO: 312625 - RNA, 14 nt, Bordetella pertussis
gccggcgcgcccag

SEQ ID NO: 312626 - RNA, 22 nt, Bordetella pertussis
gccggcgcgcccaggggccggc

SEQ ID NO: 312627 - RNA, 13 nt, Bordetella pertussis
gccggcgcgcccu

SEQ ID NO: 312628 - RNA, 12 nt, Bordetella pertussis
gccggcgcgccg

SEQ ID NO: 312629 - RNA, 14 nt, Bordetella pertussis
gccggcgcgccgcg

SEQ ID NO: 312630 - RNA, 14 nt, Bordetella pertussis
gccggcgcgccggc

SEQ ID NO: 312631 - RNA, 15 nt, Bordetella pertussis
gccggcgcgccggcc

SEQ ID NO: 312632 - RNA, 16 nt, Bordetella pertussis
gccggcgcgccggccu

SEQ ID NO: 312633 - RNA, 18 nt, Bordetella pertussis
gccggcgcgccgggccag

SEQ ID NO: 312634 - RNA, 17 nt, Bordetella pertussis
gccggcgcgccucggcg

SEQ ID NO: 312635 - RNA, 18 nt, Bordetella pertussis
gccggcgcgccucggcgc

SEQ ID NO: 312636 - RNA, 15 nt, Bordetella pertussis
gccggcgcgccugcc

SEQ ID NO: 312637 - RNA, 22 nt, Bordetella pertussis
gccggcgcgcgaucucgggcag

SEQ ID NO: 312638 - RNA, 19 nt, Bordetella pertussis
gccggcgcgcgcaggcgcu

SEQ ID NO: 312639 - RNA, 21 nt, Bordetella pertussis
gccggcgcgcgcaggcgcucg

SEQ ID NO: 312640 - RNA, 14 nt, Bordetella pertussis
gccggcgcgcgcga

SEQ ID NO: 312641 - RNA, 16 nt, Bordetella pertussis
gccggcgcgcgcgacc

SEQ ID NO: 312642 - RNA, 15 nt, Bordetella pertussis
gccggcgcgcgcgcg

SEQ ID NO: 312643 - RNA, 17 nt, Bordetella pertussis
gccggcgcgcgcgcgcc

SEQ ID NO: 312644 - RNA, 22 nt, Bordetella pertussis
gccggcgcgcgcgcgccgcacg

SEQ ID NO: 312645 - RNA, 21 nt, Bordetella pertussis
gccggcgcgcgcguacagccg

SEQ ID NO: 312646 - RNA, 21 nt, Bordetella pertussis
gccggcgcgcggaugaucgcg

SEQ ID NO: 312647 - RNA, 22 nt, Bordetella pertussis
gccggcgcgcggaugaucgcgc

SEQ ID NO: 312648 - RNA, 15 nt, Bordetella pertussis
gccggcgcgcggccg

SEQ ID NO: 312649 - RNA, 14 nt, Bordetella pertussis
gccggcgcgcucgc

SEQ ID NO: 312650 - RNA, 19 nt, Bordetella pertussis
gccggcgcgcucgcugccg

SEQ ID NO: 312651 - RNA, 15 nt, Bordetella pertussis
gccggcgcgcucggc

SEQ ID NO: 312652 - RNA, 13 nt, Bordetella pertussis
gccggcgcggcag

SEQ ID NO: 312653 - RNA, 14 nt, Bordetella pertussis
gccggcgcggcugc

SEQ ID NO: 312654 - RNA, 20 nt, Bordetella pertussis
gccggcgcggcugcugggca

SEQ ID NO: 312655 - RNA, 16 nt, Bordetella pertussis
gccggcgcgggcgcag

SEQ ID NO: 312656 - RNA, 17 nt, Bordetella pertussis
gccggcgcgggcgcagg

SEQ ID NO: 312657 - RNA, 13 nt, Bordetella pertussis
gccggcgcgucca

SEQ ID NO: 312658 - RNA, 21 nt, Bordetella pertussis
gccggcgcguccacgccgugg

SEQ ID NO: 312659 - RNA, 17 nt, Bordetella pertussis
gccggcgcgucgccggc

SEQ ID NO: 312660 - RNA, 19 nt, Bordetella pertussis
gccggcgcgucgccggcga

SEQ ID NO: 312661 - RNA, 14 nt, Bordetella pertussis
gccggcgcgucgcg

SEQ ID NO: 312662 - RNA, 15 nt, Bordetella pertussis
gccggcgcgucgcgc

SEQ ID NO: 312663 - RNA, 19 nt, Bordetella pertussis
gccggcgcgucgcgcggcg

SEQ ID NO: 312664 - RNA, 21 nt, Bordetella pertussis
gccggcgcucagcgacgcgcg

SEQ ID NO: 312665 - RNA, 23 nt, Bordetella pertussis
gccggcgcucagcgacgcgcgcc

SEQ ID NO: 312666 - RNA, 15 nt, Bordetella pertussis
gccggcgcucgcgca

SEQ ID NO: 312667 - RNA, 20 nt, Bordetella pertussis
gccggcgcucgcgcaccgca

SEQ ID NO: 312668 - RNA, 18 nt, Bordetella pertussis
gccggcgcgugcuggcgc

SEQ ID NO: 312669 - RNA, 20 nt, Bordetella pertussis
gccggcgcgugcuggcgcag

SEQ ID NO: 312670 - RNA, 12 nt, Bordetella pertussis
gccggcgcugcg

SEQ ID NO: 312671 - RNA, 19 nt, Bordetella pertussis
gccggcgcugcugucgcgc

SEQ ID NO: 312672 - RNA, 17 nt, Bordetella pertussis
gccggcgcugcggucgc

SEQ ID NO: 312673 - RNA, 23 nt, Bordetella pertussis
gccggcggauuugcucgcgucua

SEQ ID NO: 312674 - RNA, 23 nt, Bordetella pertussis
gccggcggcaagguagccgauga

SEQ ID NO: 312675 - RNA, 17 nt, Bordetella pertussis
gccggcggcaccgcgca

SEQ ID NO: 312676 - RNA, 13 nt, Bordetella pertussis
gccggcggccagc

SEQ ID NO: 312677 - RNA, 14 nt, Bordetella pertussis
gccggcggccagcg

SEQ ID NO: 312678 - RNA, 15 nt, Bordetella pertussis
gccggcggccagcgc

SEQ ID NO: 312679 - RNA, 18 nt, Bordetella pertussis
gccggcggccagcgcgcc

SEQ ID NO: 312680 - RNA, 15 nt, Bordetella pertussis
gccggcggccagcuu

SEQ ID NO: 312681 - RNA, 14 nt, Bordetella pertussis
gccggcggccgguc

SEQ ID NO: 312682 - RNA, 15 nt, Bordetella pertussis
gccggcggccgguca

SEQ ID NO: 312683 - RNA, 14 nt, Bordetella pertussis
gccggcggccuccg

SEQ ID NO: 312684 - RNA, 19 nt, Bordetella pertussis
gccggcggccuccgcgcac

SEQ ID NO: 312685 - RNA, 23 nt, Bordetella pertussis
gccggcggccuccgcgcacagcg

SEQ ID NO: 312686 - RNA, 19 nt, Bordetella pertussis
gccggcggccugcaggccg

SEQ ID NO: 312687 - RNA, 13 nt, Bordetella pertussis
gccggcggccugg

SEQ ID NO: 312688 - RNA, 14 nt, Bordetella pertussis
gccggcggcgagcg

SEQ ID NO: 312689 - RNA, 17 nt, Bordetella pertussis
gccggcggcgagcgcgg

SEQ ID NO: 312690 - RNA, 20 nt, Bordetella pertussis
gccggcggcgaugcgggcca

SEQ ID NO: 312691 - RNA, 14 nt, Bordetella pertussis
gccggcggcgcacc

SEQ ID NO: 312692 - RNA, 20 nt, Bordetella pertussis
gccggcggcaugcgccagcc

SEQ ID NO: 312693 - RNA, 15 nt, Bordetella pertussis
gccggcggcgccggc

SEQ ID NO: 312694 - RNA, 13 nt, Bordetella pertussis
gccggcggcgccu

SEQ ID NO: 312695 - RNA, 15 nt, Bordetella pertussis
gccggcggcgcggau

SEQ ID NO: 312696 - RNA, 14 nt, Bordetella pertussis
gccggcggcgcugg

SEQ ID NO: 312697 - RNA, 11 nt, Bordetella pertussis
gccggcggcgu

SEQ ID NO: 312698 - RNA, 20 nt, Bordetella pertussis
gccggcggcgugcccugcgg

SEQ ID NO: 312699 - RNA, 14 nt, Bordetella pertussis
gccggcggcguggc

SEQ ID NO: 312700 - RNA, 22 nt, Bordetella pertussis
gccggcggcguggccgugcugg

SEQ ID NO: 312701 - RNA, 14 nt, Bordetella pertussis
gccggcggcgucgg

SEQ ID NO: 312702 - RNA, 17 nt, Bordetella pertussis
gccggcggcgucggcgc

SEQ ID NO: 312703 - RNA, 16 nt, Bordetella pertussis
gccggcgggcaggcgg

SEQ ID NO: 312704 - RNA, 21 nt, Bordetella pertussis
gccggcgggcaggcgggccag

SEQ ID NO: 312705 - RNA, 16 nt, Bordetella pertussis
gccggcgggcaugacg

SEQ ID NO: 312706 - RNA, 22 nt, Bordetella pertussis
gccggcgggcaugacgaccgcg

SEQ ID NO: 312707 - RNA, 22 nt, Bordetella pertussis
gccggcgggcgcugccugccgg

SEQ ID NO: 312708 - RNA, 12 nt, Bordetella pertussis
gccggcgggcgg

SEQ ID NO: 312709 - RNA, 19 nt, Bordetella pertussis
gccggcgggcggcugcccg

SEQ ID NO: 312710 - RNA, 20 nt, Bordetella pertussis
gccggcgggcggcugcccgg

SEQ ID NO: 312711 - RNA, 21 nt, Bordetella pertussis
gccggcgggcggcugcccggg

SEQ ID NO: 312712 - RNA, 20 nt, Bordetella pertussis
gccggcggucacgccgauga

SEQ ID NO: 312713 - RNA, 17 nt, Bordetella pertussis
gccggcggucgcgcugg

SEQ ID NO: 312714 - RNA, 18 nt, Bordetella pertussis
gccggcggucgcgcuggc

SEQ ID NO: 312715 - RNA, 19 nt, Bordetella pertussis
gccggcggucgcgcuggcc

SEQ ID NO: 312716 - RNA, 21 nt, Bordetella pertussis
gccggcggucgcgcuggcccg

SEQ ID NO: 312717 - RNA, 22 nt, Bordetella pertussis
gccggcgucuggagcggccugg

SEQ ID NO: 312718 - RNA, 15 nt, Bordetella pertussis
gccggcgugcugucc

SEQ ID NO: 312719 - RNA, 20 nt, Bordetella pertussis
gccggcguggaacgaccacg

SEQ ID NO: 312720 - RNA, 13 nt, Bordetella pertussis
gccggcguggccu

SEQ ID NO: 312721 - RNA, 17 nt, Bordetella pertussis
gccggcguggccugccc

SEQ ID NO: 312722 - RNA, 22 nt, Bordetella pertussis
gccggcguggccugcccgucgg

SEQ ID NO: 312723 - RNA, 15 nt, Bordetella pertussis
gccggcguggcgcgc

SEQ ID NO: 312724 - RNA, 16 nt, Bordetella pertussis
gccggcguggcgcgca

SEQ ID NO: 312725 - RNA, 18 nt, Bordetella pertussis
gccggcguggcgcgcaac

SEQ ID NO: 312726 - RNA, 19 nt, Bordetella pertussis
gccggcguguucagcgcgc

SEQ ID NO: 312727 - RNA, 21 nt, Bordetella pertussis
gccggcguguucagcgcgcgc

SEQ ID NO: 312728 - RNA, 16 nt, Bordetella pertussis
gccggcguucaccagg

SEQ ID NO: 312729 - RNA, 20 nt, Bordetella pertussis
gccggcuccagucccgcacc

SEQ ID NO: 312730 - RNA, 21 nt, Bordetella pertussis
gccggcuccagucccgcaccg

SEQ ID NO: 312731 - RNA, 17 nt, Bordetella pertussis
gccggcucccgcgcugc

SEQ ID NO: 312732 - RNA, 20 nt, Bordetella pertussis
gccggcucccgcgcugccgc

SEQ ID NO: 312733 - RNA, 22 nt, Bordetella pertussis
gccggcucccgcgcugccgcug

SEQ ID NO: 312734 - RNA, 24 nt, Bordetella pertussis
gccggcucccgcgcugccgcugca

SEQ ID NO: 312735 - RNA, 18 nt, Bordetella pertussis
gccggcuccgauagcggc

SEQ ID NO: 312736 - RNA, 21 nt, Bordetella pertussis
gccggcuccgauagcggcgcc

SEQ ID NO: 312737 - RNA, 22 nt, Bordetella pertussis
gccggcuccgauagcggcgccg

SEQ ID NO: 312738 - RNA, 12 nt, Bordetella pertussis
gccggcucggcg

SEQ ID NO: 312739 - RNA, 15 nt, Bordetella pertussis
gccggcucggcggca

SEQ ID NO: 312740 - RNA, 18 nt, Bordetella pertussis
gccggcucggcggcaucg

SEQ ID NO: 312741 - RNA, 19 nt, Bordetella pertussis
gccggcucguaggcgaggu

SEQ ID NO: 312742 - RNA, 20 nt, Bordetella pertussis
gccggcugaauuggcgccca

SEQ ID NO: 312743 - RNA, 20 nt, Bordetella pertussis
gccggcugcaagacgcccag

SEQ ID NO: 312744 - RNA, 22 nt, Bordetella pertussis
gccggcugcaagacgcccaggc

SEQ ID NO: 312745 - RNA, 15 nt, Bordetella pertussis
gccggcugcaccagc

SEQ ID NO: 312746 - RNA, 15 nt, Bordetella pertussis
gccggcugcgcgccg

SEQ ID NO: 312747 - RNA, 17 nt, Bordetella pertussis
gccggcugcgcgccgac

SEQ ID NO: 312748 - RNA, 19 nt, Bordetella pertussis
gccggcugcgcgccgacca

SEQ ID NO: 312749 - RNA, 15 nt, Bordetella pertussis
gccgggauccacgcc

SEQ ID NO: 312750 - RNA, 19 nt, Bordetella pertussis
gccgggauccacgccgccg

SEQ ID NO: 312751 - RNA, 22 nt, Bordetella pertussis
gccgggauccacgccgccggcc

SEQ ID NO: 312752 - RNA, 18 nt, Bordetella pertussis
gccgggcaagcagauggc

SEQ ID NO: 312753 - RNA, 20 nt, Bordetella pertussis
gccggguggguucgggcguu

SEQ ID NO: 312754 - RNA, 18 nt, Bordetella pertussis
gccggguggucgcgcccg

SEQ ID NO: 312755 - RNA, 18 nt, Bordetella pertussis
gccggguguuccggcgcg

SEQ ID NO: 312756 - RNA, 15 nt, Bordetella pertussis
gccggguuucggcau

SEQ ID NO: 312757 - RNA, 19 nt, Bordetella pertussis
gccgguaaccgacgcagcg

SEQ ID NO: 312758 - RNA, 21 nt, Bordetella pertussis
gccgguaaccgacgcagcgca

SEQ ID NO: 312759 - RNA, 13 nt, Bordetella pertussis
gccgguaucgacg

SEQ ID NO: 312760 - RNA, 17 nt, Bordetella pertussis
gccgguaucgacgcgcg

SEQ ID NO: 312761 - RNA, 16 nt, Bordetella pertussis
gccgguaucgcggcgc

SEQ ID NO: 312762 - RNA, 18 nt, Bordetella pertussis
gccgguaucgcggcgcag

SEQ ID NO: 312763 - RNA, 19 nt, Bordetella pertussis
gccgguaucgcggcgcagg

SEQ ID NO: 312764 - RNA, 16 nt, Bordetella pertussis
gccgguaucggccucg

SEQ ID NO: 312765 - RNA, 16 nt, Bordetella pertussis
gccggucaccgccgcc

SEQ ID NO: 312766 - RNA, 15 nt, Bordetella pertussis
gccggucacgcuggu

SEQ ID NO: 312767 - RNA, 19 nt, Bordetella pertussis
gccggucacgcugguggcc

SEQ ID NO: 312768 - RNA, 23 nt, Bordetella pertussis
gccggucacgcugguggccacca

SEQ ID NO: 312769 - RNA, 20 nt, Bordetella pertussis
gccggucacugccgaaacgc

SEQ ID NO: 312770 - RNA, 16 nt, Bordetella pertussis
gccggucagcccaggc

SEQ ID NO: 312771 - RNA, 13 nt, Bordetella pertussis
gccgguccgacgg

SEQ ID NO: 312772 - RNA, 14 nt, Bordetella pertussis
gccggucgccagcg

SEQ ID NO: 312773 - RNA, 15 nt, Bordetella pertussis
gccggucgccagcga

SEQ ID NO: 312774 - RNA, 23 nt, Bordetella pertussis
gccggugaacaccaggguggcgc

SEQ ID NO: 312775 - RNA, 16 nt, Bordetella pertussis
gccggugaccgccagc

SEQ ID NO: 312776 - RNA, 19 nt, Bordetella pertussis
gccggugauaugcgccagg

SEQ ID NO: 312777 - RNA, 23 nt, Bordetella pertussis
gccggugauaugcgccaggcccu

SEQ ID NO: 312778 - RNA, 14 nt, Bordetella pertussis
gccggugaugcccg

SEQ ID NO: 312779 - RNA, 15 nt, Bordetella pertussis
gccggugaugcggcg

SEQ ID NO: 312780 - RNA, 16 nt, Bordetella pertussis
gccggugaugcggcgc

SEQ ID NO: 312781 - RNA, 22 nt, Bordetella pertussis
gccggugaugcggcgcgccgcg

SEQ ID NO: 312782 - RNA, 14 nt, Bordetella pertussis
gccggugcaccagg

SEQ ID NO: 312783 - RNA, 17 nt, Bordetella pertussis
gccggugcaccaggcca

SEQ ID NO: 312784 - RNA, 14 nt, Bordetella pertussis
gccggugcagguca

SEQ ID NO: 312785 - RNA, 12 nt, Bordetella pertussis
gccggugcucgg

SEQ ID NO: 312786 - RNA, 14 nt, Bordetella pertussis
gccgguggacggcc

SEQ ID NO: 312787 - RNA, 16 nt, Bordetella pertussis
gccgguggacggccag

SEQ ID NO: 312788 - RNA, 19 nt, Bordetella pertussis
gccgguggacggccagcag

SEQ ID NO: 312789 - RNA, 14 nt, Bordetella pertussis
gccgguggccagca

SEQ ID NO: 312790 - RNA, 20 nt, Bordetella pertussis
gccgguggugcccaucgcgc

SEQ ID NO: 312791 - RNA, 19 nt, Bordetella pertussis
gccggugucggggccgggc

SEQ ID NO: 312792 - RNA, 19 nt, Bordetella pertussis
gccguacgagugcaggccc

SEQ ID NO: 312793 - RNA, 13 nt, Bordetella pertussis
gccguacgccauc

SEQ ID NO: 312794 - RNA, 18 nt, Bordetella pertussis
gccguacgccaucgacgc

SEQ ID NO: 312795 - RNA, 20 nt, Bordetella pertussis
gccguacucgaucgccauga

SEQ ID NO: 312796 - RNA, 16 nt, Bordetella pertussis
gccguacucgccgguc

SEQ ID NO: 312797 - RNA, 14 nt, Bordetella pertussis
gccguaccccagca

SEQ ID NO: 312798 - RNA, 16 nt, Bordetella pertussis
gccguaccccagcaug

SEQ ID NO: 312799 - RNA, 19 nt, Bordetella pertussis
gccguacuuggcgauggcc

SEQ ID NO: 312800 - RNA, 21 nt, Bordetella pertussis
gccguacuuggcgauggccgc

SEQ ID NO: 312801 - RNA, 23 nt, Bordetella pertussis
gccguaucgcguggcgcgccagc

SEQ ID NO: 312802 - RNA, 20 nt, Bordetella pertussis
gccgucaagcguucauggcg

SEQ ID NO: 312803 - RNA, 17 nt, Bordetella pertussis
gccgucagcagcgcggc

SEQ ID NO: 312804 - RNA, 15 nt, Bordetella pertussis
gccgucagcagcagg

SEQ ID NO: 312805 - RNA, 14 nt, Bordetella pertussis
gccgucagcgacau

SEQ ID NO: 312806 - RNA, 18 nt, Bordetella pertussis
gccgucagcucgaucagg

SEQ ID NO: 312807 - RNA, 19 nt, Bordetella pertussis
gccgucagcucgaucaggc

SEQ ID NO: 312808 - RNA, 16 nt, Bordetella pertussis
gccgucaggaucaggc

SEQ ID NO: 312809 - RNA, 18 nt, Bordetella pertussis
gccgucaggaucaggccg

SEQ ID NO: 312810 - RNA, 14 nt, Bordetella pertussis
gccgucauggcggu

SEQ ID NO: 312811 - RNA, 21 nt, Bordetella pertussis
gccguccaaaacagacaggcc

SEQ ID NO: 312812 - RNA, 19 nt, Bordetella pertussis
gccguccacgaaggcagca

SEQ ID NO: 312813 - RNA, 14 nt, Bordetella pertussis
gccguccacgccca

SEQ ID NO: 312814 - RNA, 15 nt, Bordetella pertussis
gccguccacgccgcg

SEQ ID NO: 312815 - RNA, 18 nt, Bordetella pertussis
gccguccacgccgcgcgc

SEQ ID NO: 312816 - RNA, 23 nt, Bordetella pertussis
gccguccagcgcggcaugccgcu

SEQ ID NO: 312817 - RNA, 19 nt, Bordetella pertussis
gccguccagcgcggcgcca

SEQ ID NO: 312818 - RNA, 20 nt, Bordetella pertussis
gccguccaggaagcagccca

SEQ ID NO: 312819 - RNA, 23 nt, Bordetella pertussis
gccguccaggaagcagcccagca

SEQ ID NO: 312820 - RNA, 21 nt, Bordetella pertussis
gccguccaggcgccgcacgcc

SEQ ID NO: 312821 - RNA, 19 nt, Bordetella pertussis
gccguccgagcccgacgcg

SEQ ID NO: 312822 - RNA, 21 nt, Bordetella pertussis
gccguccgagcccgacgcgag

SEQ ID NO: 312823 - RNA, 15 nt, Bordetella pertussis
gccguccgcaucgcg

SEQ ID NO: 312824 - RNA, 18 nt, Bordetella pertussis
gccguccgcaucgcgcaa

SEQ ID NO: 312825 - RNA, 19 nt, Bordetella pertussis
gccguccggccgugccgcc

SEQ ID NO: 312826 - RNA, 18 nt, Bordetella pertussis
gccguccgggccgguuuc

SEQ ID NO: 312827 - RNA, 22 nt, Bordetella pertussis
gccguccucgcgggccuggcgg

SEQ ID NO: 312828 - RNA, 14 nt, Bordetella pertussis
gccguccuggccgu

SEQ ID NO: 312829 - RNA, 14 nt, Bordetella pertussis
gccguccuggcgac

SEQ ID NO: 312830 - RNA, 16 nt, Bordetella pertussis
gccguccuggcgaccg

SEQ ID NO: 312831 - RNA, 17 nt, Bordetella pertussis
gccguccuugugccagg

SEQ ID NO: 312832 - RNA, 19 nt, Bordetella pertussis
gccguccuugugccaggug

SEQ ID NO: 312833 - RNA, 18 nt, Bordetella pertussis
gccguccuuggcgccggc

SEQ ID NO: 312834 - RNA, 21 nt, Bordetella pertussis
gccguccuuggcgccggcgau

SEQ ID NO: 312835 - RNA, 22 nt, Bordetella pertussis
gccguccuuggcgccggcgaug

SEQ ID NO: 312836 - RNA, 18 nt, Bordetella pertussis
gccguccuugagggcgcg

SEQ ID NO: 312837 - RNA, 17 nt, Bordetella pertussis
gccgucgaaggccgcaa

SEQ ID NO: 312838 - RNA, 15 nt, Bordetella pertussis
gccgucgaagccggc

SEQ ID NO: 312839 - RNA, 20 nt, Bordetella pertussis
gccgucgaagccggcgccau

SEQ ID NO: 312840 - RNA, 20 nt, Bordetella pertussis
gccgucgaccccgucgaccg

SEQ ID NO: 312841 - RNA, 15 nt, Bordetella pertussis
gccgucgaccgacag

SEQ ID NO: 312842 - RNA, 18 nt, Bordetella pertussis
gccgucgaccgacagcac

SEQ ID NO: 312843 - RNA, 18 nt, Bordetella pertussis
gccgucgccaaagcgcag

SEQ ID NO: 312844 - RNA, 20 nt, Bordetella pertussis
gccgucgccaaagcgcagcg

SEQ ID NO: 312845 - RNA, 13 nt, Bordetella pertussis
gccgucgccagcg

SEQ ID NO: 312846 - RNA, 14 nt, Bordetella pertussis
gccgucgccagcga

SEQ ID NO: 312847 - RNA, 13 nt, Bordetella pertussis
gccgucgcccugg

SEQ ID NO: 312848 - RNA, 18 nt, Bordetella pertussis
gccgucgccgcccacggc

SEQ ID NO: 312849 - RNA, 20 nt, Bordetella pertussis
gccgucgccgcccaugcgca

SEQ ID NO: 312850 - RNA, 17 nt, Bordetella pertussis
gccgucgccgcccugcu

SEQ ID NO: 312851 - RNA, 13 nt, Bordetella pertussis
gccgucgccgauc

SEQ ID NO: 312852 - RNA, 12 nt, Bordetella pertussis
gccgucgccgcc

SEQ ID NO: 312853 - RNA, 13 nt, Bordetella pertussis
gccgucgccgcgc

SEQ ID NO: 312854 - RNA, 17 nt, Bordetella pertussis
gccgucgccgcgcggcg

SEQ ID NO: 312855 - RNA, 21 nt, Bordetella pertussis
gccgucggcguugugccggcg

SEQ ID NO: 312856 - RNA, 14 nt, Bordetella pertussis
gccgucgggcgccg

SEQ ID NO: 312857 - RNA, 18 nt, Bordetella pertussis
gccgucgggguggcgucg

SEQ ID NO: 312858 - RNA, 19 nt, Bordetella pertussis
gccgucggugguggugacg

SEQ ID NO: 312859 - RNA, 17 nt, Bordetella pertussis
gccgucgucguccaggc

SEQ ID NO: 312860 - RNA, 21 nt, Bordetella pertussis
gccgucgucguccaggcgcac

SEQ ID NO: 312861 - RNA, 18 nt, Bordetella pertussis
gccgucugcgccgccgcg

SEQ ID NO: 312862 - RNA, 12 nt, Bordetella pertussis
gccgucuggcgg

SEQ ID NO: 312863 - RNA, 22 nt, Bordetella pertussis
gccgucuggcggcagcucgcgc

SEQ ID NO: 312864 - RNA, 12 nt, Bordetella pertussis
gccgucugggcg

SEQ ID NO: 312865 - RNA, 22 nt, Bordetella pertussis
gccgucugugcgccccgcuggc

SEQ ID NO: 312866 - RNA, 23 nt, Bordetella pertussis
gccgucugugcgccccgcuggcc

SEQ ID NO: 312867 - RNA, 20 nt, Bordetella pertussis
gccgucuugaggauaucggc

SEQ ID NO: 312868 - RNA, 16 nt, Bordetella pertussis
gccgucuuggcgggcu

SEQ ID NO: 312869 - RNA, 21 nt, Bordetella pertussis
gccgucuuggcgggcuagcug

SEQ ID NO: 312870 - RNA, 18 nt, Bordetella pertussis
gccgugaaugcgccuggc

SEQ ID NO: 312871 - RNA, 21 nt, Bordetella pertussis
gccgugaaugcgccuggcguu

SEQ ID NO: 312872 - RNA, 22 nt, Bordetella pertussis
gccgugacgcugauggccgcca

SEQ ID NO: 312873 - RNA, 19 nt, Bordetella pertussis
gccgugacuucggccgcca

SEQ ID NO: 312874 - RNA, 22 nt, Bordetella pertussis
gccgugacuucggccgccagcc

SEQ ID NO: 312875 - RNA, 13 nt, Bordetella pertussis
gccgugccgggcc

SEQ ID NO: 312876 - RNA, 16 nt, Bordetella pertussis
gccgugccgggccugg

SEQ ID NO: 312877 - RNA, 17 nt, Bordetella pertussis
gccgugccgggccuggu

SEQ ID NO: 312878 - RNA, 20 nt, Bordetella pertussis
gccgugccucaacuggccgg

SEQ ID NO: 312879 - RNA, 22 nt, Bordetella pertussis
gccgugccucaacuggccggcc

SEQ ID NO: 312880 - RNA, 14 nt, Bordetella pertussis
gccgugcgccagcg

SEQ ID NO: 312881 - RNA, 19 nt, Bordetella pertussis
gccgugcgcgggcgcggca

SEQ ID NO: 312882 - RNA, 16 nt, Bordetella pertussis
gccgugcgccagcgcc

SEQ ID NO: 312883 - RNA, 23 nt, Bordetella pertussis
gccgugcugaucgacaugcuggc

SEQ ID NO: 312884 - RNA, 16 nt, Bordetella pertussis
gccgugcugggcggcc

SEQ ID NO: 312885 - RNA, 20 nt, Bordetella pertussis
gccgugcugggcggccaggc

SEQ ID NO: 312886 - RNA, 23 nt, Bordetella pertussis
gccgugcuggucauugaccugcu

SEQ ID NO: 312887 - RNA, 15 nt, Bordetella pertussis
gccguggaggcggcg

SEQ ID NO: 312888 - RNA, 18 nt, Bordetella pertussis
gccguggcgugcaggccg

SEQ ID NO: 312889 - RNA, 18 nt, Bordetella pertussis
gccguggcguugacggcc

SEQ ID NO: 312890 - RNA, 23 nt, Bordetella pertussis
gccguggcguugacggcccagcu

SEQ ID NO: 312891 - RNA, 17 nt, Bordetella pertussis
gccgugggacaggcacu

SEQ ID NO: 312892 - RNA, 18 nt, Bordetella pertussis
gccgugggacaggcacuc

SEQ ID NO: 312893 - RNA, 17 nt, Bordetella pertussis
gccgugggcgaacuggu

SEQ ID NO: 312894 - RNA, 14 nt, Bordetella pertussis
gccgugguacgugg

SEQ ID NO: 312895 - RNA, 23 nt, Bordetella pertussis
gccguucuggcagugcgccuggc

SEQ ID NO: 312896 - RNA, 20 nt, Bordetella pertussis
gccguucuggcugcgcgccu

SEQ ID NO: 312897 - RNA, 20 nt, Bordetella pertussis
gccguugcgccagcggcgac

SEQ ID NO: 312898 - RNA, 15 nt, Bordetella pertussis
gccguugcgccugcc

SEQ ID NO: 312899 - RNA, 16 nt, Bordetella pertussis
gccguugcggcccgcc

SEQ ID NO: 312900 - RNA, 16 nt, Bordetella pertussis
gccguugcuccagcca

SEQ ID NO: 312901 - RNA, 19 nt, Bordetella pertussis
gccguugcuccagccaggc

SEQ ID NO: 312902 - RNA, 22 nt, Bordetella pertussis
gccguugcuccagccaggcgcg

SEQ ID NO: 312903 - RNA, 14 nt, Bordetella pertussis
gccguuggccagcg

SEQ ID NO: 312904 - RNA, 16 nt, Bordetella pertussis
gccguuggccagcgcc

SEQ ID NO: 312905 - RNA, 18 nt, Bordetella pertussis
gccguuggccagcgccgc

SEQ ID NO: 312906 - RNA, 13 nt, Bordetella pertussis
gccguuggccgcg

SEQ ID NO: 312907 - RNA, 17 nt, Bordetella pertussis
gccguuggccgcgcggu

SEQ ID NO: 312908 - RNA, 21 nt, Bordetella pertussis
gccguuggccgcgcgguacgc

SEQ ID NO: 312909 - RNA, 21 nt, Bordetella pertussis
gccguuggcgauggcgcggcc

SEQ ID NO: 312910 - RNA, 16 nt, Bordetella pertussis
gccguuggcgcccagc

SEQ ID NO: 312911 - RNA, 21 nt, Bordetella pertussis
gccguuggcgcccagcgccau

SEQ ID NO: 312912 - RNA, 15 nt, Bordetella pertussis
gccguuggcgcgccu

SEQ ID NO: 312913 - RNA, 14 nt, Bordetella pertussis
gccuacacgguggc

SEQ ID NO: 312914 - RNA, 15 nt, Bordetella pertussis
gccuacacgguggcg

SEQ ID NO: 312915 - RNA, 16 nt, Bordetella pertussis
gccuacacgguggcgg

SEQ ID NO: 312916 - RNA, 22 nt, Bordetella pertussis
gccuacacgguggcggugcucg

SEQ ID NO: 312917 - RNA, 20 nt, Bordetella pertussis
gccuacagcagcggcucgag

SEQ ID NO: 312918 - RNA, 23 nt, Bordetella pertussis
gccuaccgcuauuuuucgacacc

SEQ ID NO: 312919 - RNA, 18 nt, Bordetella pertussis
gccuaccggcgccgacgc

SEQ ID NO: 312920 - RNA, 20 nt, Bordetella pertussis
aagccagcgccugcgcggcc

SEQ ID NO: 312921 - RNA, 21 nt, Bordetella pertussis
aagcccacaccaucaagauga

SEQ ID NO: 312922 - RNA, 15 nt, Bordetella pertussis
aagcccaccgggccg

SEQ ID NO: 312923 - RNA, 17 nt, Bordetella pertussis
aagcccaccgggccggc

SEQ ID NO: 312924 - RNA, 18 nt, Bordetella pertussis
aagcccaccgggccggcc

SEQ ID NO: 312925 - RNA, 19 nt, Bordetella pertussis
gccuccggcaggaucugca

SEQ ID NO: 312926 - RNA, 13 nt, Bordetella pertussis
gccucgacgcccg

SEQ ID NO: 312927 - RNA, 15 nt, Bordetella pertussis
gccucgacggccgcc

SEQ ID NO: 312928 - RNA, 21 nt, Bordetella pertussis
gccucgagguauucgcgcgau

SEQ ID NO: 312929 - RNA, 18 nt, Bordetella pertussis
gccucgaucgccaggucg

SEQ ID NO: 312930 - RNA, 20 nt, Bordetella pertussis
gccucgcgcucgagcgcggc

SEQ ID NO: 312931 - RNA, 20 nt, Bordetella pertussis
gccucgcgcucgcgcucggc

SEQ ID NO: 312932 - RNA, 14 nt, Bordetella pertussis
gccucgcggcgcag

SEQ ID NO: 312933 - RNA, 16 nt, Bordetella pertussis
gccucgcggcgcagca

SEQ ID NO: 312934 - RNA, 21 nt, Bordetella pertussis
gccucgcggcgcguauccgcc

SEQ ID NO: 312935 - RNA, 15 nt, Bordetella pertussis
gccucgcugccaggg

SEQ ID NO: 312936 - RNA, 18 nt, Bordetella pertussis
gccucgcuggagaccggc

SEQ ID NO: 312937 - RNA, 19 nt, Bordetella pertussis
gccucgcuggagaccggca

SEQ ID NO: 312938 - RNA, 23 nt, Bordetella pertussis
gccucgcuggagaccggcauggu

SEQ ID NO: 312939 - RNA, 12 nt, Bordetella pertussis
gccucgcuggcg

SEQ ID NO: 312940 - RNA, 14 nt, Bordetella pertussis
gccucggacgccug

SEQ ID NO: 312941 - RNA, 16 nt, Bordetella pertussis
gccucggacgccuggc

SEQ ID NO: 312942 - RNA, 17 nt, Bordetella pertussis
gccucggcaaacggcug

SEQ ID NO: 312943 - RNA, 16 nt, Bordetella pertussis
gccucggccaccuggc

SEQ ID NO: 312944 - RNA, 18 nt, Bordetella pertussis
gccucggccaccuggcgc

SEQ ID NO: 312945 - RNA, 17 nt, Bordetella pertussis
gccucggcauggcgcgc

SEQ ID NO: 312946 - RNA, 19 nt, Bordetella pertussis
gccucggcauggcgcgcgc

SEQ ID NO: 312947 - RNA, 13 nt, Bordetella pertussis
gccucggccggca

SEQ ID NO: 312948 - RNA, 15 nt, Bordetella pertussis
gccucggccggcagg

SEQ ID NO: 312949 - RNA, 23 nt, Bordetella pertussis
gccucggcgaagugcccgcuggc

SEQ ID NO: 312950 - RNA, 14 nt, Bordetella pertussis
gccucggcgcgcgc

SEQ ID NO: 312951 - RNA, 16 nt, Bordetella pertussis
gccucggcggccagcg

SEQ ID NO: 312952 - RNA, 18 nt, Bordetella pertussis
gccucggcggccagcgcg

SEQ ID NO: 312953 - RNA, 20 nt, Bordetella pertussis
gccucggcggccagcgcgcc

SEQ ID NO: 312954 - RNA, 22 nt, Bordetella pertussis
gccucggcggccagcgcgcccu

SEQ ID NO: 312955 - RNA, 13 nt, Bordetella pertussis
gccucggcggcca

SEQ ID NO: 312956 - RNA, 15 nt, Bordetella pertussis
gccucggcggccagc

SEQ ID NO: 312957 - RNA, 13 nt, Bordetella pertussis
gccucggcggccu

SEQ ID NO: 312958 - RNA, 15 nt, Bordetella pertussis
gccucggcggccucc

SEQ ID NO: 312959 - RNA, 22 nt, Bordetella pertussis
gccucggcgggcggcgccagcg

SEQ ID NO: 312960 - RNA, 23 nt, Bordetella pertussis
gccucggcgggcggcgccagcgg

SEQ ID NO: 312961 - RNA, 17 nt, Bordetella pertussis
gccucggcuccgccauu

SEQ ID NO: 312962 - RNA, 18 nt, Bordetella pertussis
gccucggcuccgccauug

SEQ ID NO: 312963 - RNA, 13 nt, Bordetella pertussis
gccucgggcacgg

SEQ ID NO: 312964 - RNA, 23 nt, Bordetella pertussis
gccugacccagucgcaguucggc

SEQ ID NO: 312965 - RNA, 22 nt, Bordetella pertussis
gccugacgcgcaagcggcccca

SEQ ID NO: 312966 - RNA, 21 nt, Bordetella pertussis
gccugacgcucauccaggcgc

SEQ ID NO: 312967 - RNA, 20 nt, Bordetella pertussis
gccugacgugcgccacagca

SEQ ID NO: 312968 - RNA, 13 nt, Bordetella pertussis
gccugacguucgg

SEQ ID NO: 312969 - RNA, 20 nt, Bordetella pertussis
gccugacguucggggcgucg

SEQ ID NO: 312970 - RNA, 21 nt, Bordetella pertussis
gccugacguucggggcgucgc

SEQ ID NO: 312971 - RNA, 22 nt, Bordetella pertussis
gccugacggccccguugucgcc

SEQ ID NO: 312972 - RNA, 16 nt, Bordetella pertussis
gccugaugcgcagacg

SEQ ID NO: 312973 - RNA, 17 nt, Bordetella pertussis
gccugauucccaggccc

SEQ ID NO: 312974 - RNA, 19 nt, Bordetella pertussis
gccugauucccaggcccgg

SEQ ID NO: 312975 - RNA, 22 nt, Bordetella pertussis
gccugcaaaaaacaagcucgcg

SEQ ID NO: 312976 - RNA, 14 nt, Bordetella pertussis
gccugcaaccuggu

SEQ ID NO: 312977 - RNA, 22 nt, Bordetella pertussis
gccugccagaacagccgcgagg

SEQ ID NO: 312978 - RNA, 16 nt, Bordetella pertussis
gccugccagcccacca

SEQ ID NO: 312979 - RNA, 19 nt, Bordetella pertussis
gccugccagcccaccagcg

SEQ ID NO: 312980 - RNA, 22 nt, Bordetella pertussis
gccugccagcccaccagcgcca

SEQ ID NO: 312981 - RNA, 16 nt, Bordetella pertussis
gccugccagccugcca

SEQ ID NO: 312982 - RNA, 14 nt, Bordetella pertussis
gccugccauccggc

SEQ ID NO: 312983 - RNA, 18 nt, Bordetella pertussis
gccugccauccggccgca

SEQ ID NO: 312984 - RNA, 23 nt, Bordetella pertussis
gccugccauucgucguagccgcc

SEQ ID NO: 312985 - RNA, 16 nt, Bordetella pertussis
gccugcccaggccagc

SEQ ID NO: 312986 - RNA, 17 nt, Bordetella pertussis
gccugcccaggccagcg

SEQ ID NO: 312987 - RNA, 16 nt, Bordetella pertussis
gccugcccauggccug

SEQ ID NO: 312988 - RNA, 20 nt, Bordetella pertussis
gccugccccgauacaaggug

SEQ ID NO: 312989 - RNA, 24 nt, Bordetella pertussis
gccugccccugcggggacaggcac

SEQ ID NO: 312990 - RNA, 20 nt, Bordetella pertussis
gccugcccgcacgggccgac

SEQ ID NO: 312991 - RNA, 18 nt, Bordetella pertussis
gccugcccgggcaccagg

SEQ ID NO: 312992 - RNA, 16 nt, Bordetella pertussis
gccugcccgggcggga

SEQ ID NO: 312993 - RNA, 20 nt, Bordetella pertussis
gccugcccguucacgcgcag

SEQ ID NO: 312994 - RNA, 21 nt, Bordetella pertussis
gccugcccguucacgcgcagc

SEQ ID NO: 312995 - RNA, 22 nt, Bordetella pertussis
gccugcccguucacgcgcagcg

SEQ ID NO: 312996 - RNA, 20 nt, Bordetella pertussis
gccugccgagcgcugcgcca

SEQ ID NO: 312997 - RNA, 15 nt, Bordetella pertussis
gccugccgaucgugc

SEQ ID NO: 312998 - RNA, 13 nt, Bordetella pertussis
gccugccgccugc

SEQ ID NO: 312999 - RNA, 16 nt, Bordetella pertussis
gccugccgcgcccggc

SEQ ID NO: 313000 - RNA, 17 nt, Bordetella pertussis
gccugccgcgcccggcg

SEQ ID NO: 313001 - RNA, 21 nt, Bordetella pertussis
gccugccgcgcccggcggcca

SEQ ID NO: 313002 - RNA, 15 nt, Bordetella pertussis
gccugccgcgccgac

SEQ ID NO: 313003 - RNA, 16 nt, Bordetella pertussis
gccugccggccggcca

SEQ ID NO: 313004 - RNA, 19 nt, Bordetella pertussis
gccugccggccggccagua

SEQ ID NO: 313005 - RNA, 15 nt, Bordetella pertussis
gccugccggcgcaca

SEQ ID NO: 313006 - RNA, 15 nt, Bordetella pertussis
gccugccggcggccu

SEQ ID NO: 313007 - RNA, 15 nt, Bordetella pertussis
gccugcgaacgcccg

SEQ ID NO: 313008 - RNA, 16 nt, Bordetella pertussis
gccugcgaacgcccgg

SEQ ID NO: 313009 - RNA, 13 nt, Bordetella pertussis
gccugcgccacca

SEQ ID NO: 313010 - RNA, 15 nt, Bordetella pertussis
gccugcgccaccagc

SEQ ID NO: 313011 - RNA, 21 nt, Bordetella pertussis
gccugcgccaccagcuugcgc

SEQ ID NO: 313012 - RNA, 24 nt, Bordetella pertussis
gccugcgccaccagcuugcgcgcc

SEQ ID NO: 313013 - RNA, 15 nt, Bordetella pertussis
gccugcgccaccugg

SEQ ID NO: 313014 - RNA, 17 nt, Bordetella pertussis
gccugcgccaccuggcg

SEQ ID NO: 313015 - RNA, 19 nt, Bordetella pertussis
gccugcgccaccuggcgcc

SEQ ID NO: 313016 - RNA, 16 nt, Bordetella pertussis
gccugcgccacgucca

SEQ ID NO: 313017 - RNA, 21 nt, Bordetella pertussis
gccugcgccacguccagcacg

SEQ ID NO: 313018 - RNA, 23 nt, Bordetella pertussis
gccugcgccacguccagcacggc

SEQ ID NO: 313019 - RNA, 16 nt, Bordetella pertussis
gccugcgccagccgcg

SEQ ID NO: 313020 - RNA, 19 nt, Bordetella pertussis
gccugcgccagcuccagcc

SEQ ID NO: 313021 - RNA, 18 nt, Bordetella pertussis
gccugcgccauggcgcgc

SEQ ID NO: 313022 - RNA, 12 nt, Bordetella pertussis
gccugcgccgcc

SEQ ID NO: 313023 - RNA, 14 nt, Bordetella pertussis
gccugcgccgggcg

SEQ ID NO: 313024 - RNA, 20 nt, Bordetella pertussis
gccugcgccgggcgcggcca

SEQ ID NO: 313025 - RNA, 21 nt, Bordetella pertussis
gccugcgccggguccggccgc

SEQ ID NO: 313026 - RNA, 22 nt, Bordetella pertussis
gccugcgccggguccggccgcg

SEQ ID NO: 313027 - RNA, 20 nt, Bordetella pertussis
gccugcgccgucugcgccgc

SEQ ID NO: 313028 - RNA, 18 nt, Bordetella pertussis
gccugcgccgccgcgcgc

SEQ ID NO: 313029 - RNA, 19 nt, Bordetella pertussis
gccugcgccgccgcgcgcu

SEQ ID NO: 313030 - RNA, 22 nt, Bordetella pertussis
gccugcgcgccgaccaggucgg

SEQ ID NO: 313031 - RNA, 13 nt, Bordetella pertussis
gccugcgcgccgg

SEQ ID NO: 313032 - RNA, 16 nt, Bordetella pertussis
gccugcgcgccggguu

SEQ ID NO: 313033 - RNA, 19 nt, Bordetella pertussis
gccugcggacggcgggcgc

SEQ ID NO: 313034 - RNA, 18 nt, Bordetella pertussis
gccugcggcaggccgcag

SEQ ID NO: 313035 - RNA, 20 nt, Bordetella pertussis
gccugcggcaggccgcagcg

SEQ ID NO: 313036 - RNA, 16 nt, Bordetella pertussis
gccugcggcgccagcg

SEQ ID NO: 313037 - RNA, 19 nt, Bordetella pertussis
gccugcggcgccagcgccg

SEQ ID NO: 313038 - RNA, 20 nt, Bordetella pertussis
gccugcggcgccagcgccgc

SEQ ID NO: 313039 - RNA, 15 nt, Bordetella pertussis
gccugcggcgcggcc

SEQ ID NO: 313040 - RNA, 12 nt, Bordetella pertussis
gccugcggcguc

SEQ ID NO: 313041 - RNA, 18 nt, Bordetella pertussis
gccugcggcgucaggccg

SEQ ID NO: 313042 - RNA, 15 nt, Bordetella pertussis
gccugcggcucgagg

SEQ ID NO: 313043 - RNA, 22 nt, Bordetella pertussis
gccugcggcucgaggaaccagc

SEQ ID NO: 313044 - RNA, 13 nt, Bordetella pertussis
gccugcgggccgg

SEQ ID NO: 313045 - RNA, 15 nt, Bordetella pertussis
gccugcgggcgccgc

SEQ ID NO: 313046 - RNA, 16 nt, Bordetella pertussis
gccugcgggcgccgcg

SEQ ID NO: 313047 - RNA, 23 nt, Bordetella pertussis
gccugcgggcugaugcaggccug

SEQ ID NO: 313048 - RNA, 18 nt, Bordetella pertussis
gccugcgggugcgccugc

SEQ ID NO: 313049 - RNA, 20 nt, Bordetella pertussis
gccugcgggugcgccugcag

SEQ ID NO: 313050 - RNA, 23 nt, Bordetella pertussis
gccugcguggcgggccgcgccgc

SEQ ID NO: 313051 - RNA, 16 nt, Bordetella pertussis
gccugcucacgccccg

SEQ ID NO: 313052 - RNA, 16 nt, Bordetella pertussis
gccugcucgaccugcu

SEQ ID NO: 313053 - RNA, 15 nt, Bordetella pertussis
gccugcucgcaggcc

SEQ ID NO: 313054 - RNA, 19 nt, Bordetella pertussis
gccugcucgcaggccugcu

SEQ ID NO: 313055 - RNA, 22 nt, Bordetella pertussis
gccugcucgccggccagcgcgg

SEQ ID NO: 313056 - RNA, 15 nt, Bordetella pertussis
gccugcugcgccugg

SEQ ID NO: 313057 - RNA, 16 nt, Bordetella pertussis
gccugcugcgccuggc

SEQ ID NO: 313058 - RNA, 18 nt, Bordetella pertussis
gccugcugcgccuggccg

SEQ ID NO: 313059 - RNA, 20 nt, Bordetella pertussis
gccugcuugaagacgcccag

SEQ ID NO: 313060 - RNA, 18 nt, Bordetella pertussis
gccugcuugcaggaagcg

SEQ ID NO: 313061 - RNA, 17 nt, Bordetella pertussis
gccugcuuggcgcgcag

SEQ ID NO: 313062 - RNA, 19 nt, Bordetella pertussis
gccugcuuggcgcgcagca

SEQ ID NO: 313063 - RNA, 18 nt, Bordetella pertussis
gccugcuuguacaggcgc

SEQ ID NO: 313064 - RNA, 20 nt, Bordetella pertussis
gccugcuuguacaggcgcgg

SEQ ID NO: 313065 - RNA, 17 nt, Bordetella pertussis
gccuggaagcuggccag

SEQ ID NO: 313066 - RNA, 19 nt, Bordetella pertussis
gccuggaagcuggccagcg

SEQ ID NO: 313067 - RNA, 22 nt, Bordetella pertussis
gccuggaagugaugccgccggc

SEQ ID NO: 313068 - RNA, 13 nt, Bordetella pertussis
gccuggaccggcu

SEQ ID NO: 313069 - RNA, 14 nt, Bordetella pertussis
gccuggaccggcuc

SEQ ID NO: 313070 - RNA, 19 nt, Bordetella pertussis
gccuggaccugacccccga

SEQ ID NO: 313071 - RNA, 15 nt, Bordetella pertussis
gccuggaccuggacg

SEQ ID NO: 313072 - RNA, 18 nt, Bordetella pertussis
gccuggacgcgcuggccg

SEQ ID NO: 313073 - RNA, 20 nt, Bordetella pertussis
gccuggacgcgcuggccgac

SEQ ID NO: 313074 - RNA, 21 nt, Bordetella pertussis
gccuggacgcgcuggccgaca

SEQ ID NO: 313075 - RNA, 17 nt, Bordetella pertussis
gccuggaggccgagcgc

SEQ ID NO: 313076 - RNA, 20 nt, Bordetella pertussis
gccuggcaaugcguggccgg

SEQ ID NO: 313077 - RNA, 16 nt, Bordetella pertussis
gccuggcacaucggcc

SEQ ID NO: 313078 - RNA, 18 nt, Bordetella pertussis
gccuggcacaucggcccu

SEQ ID NO: 313079 - RNA, 20 nt, Bordetella pertussis
gccuggcacaucggcccugg

SEQ ID NO: 313080 - RNA, 17 nt, Bordetella pertussis
gccuggcacgacguggc

SEQ ID NO: 313081 - RNA, 15 nt, Bordetella pertussis
gccuggcagaugcgc

SEQ ID NO: 313082 - RNA, 19 nt, Bordetella pertussis
gccuggcagaugcgcgcca

SEQ ID NO: 313083 - RNA, 21 nt, Bordetella pertussis
gccuggcagaugcgcgccagg

SEQ ID NO: 313084 - RNA, 22 nt, Bordetella pertussis
gccuggcagaugcgcgccaggc

SEQ ID NO: 313085 - RNA, 20 nt, Bordetella pertussis
gccuggcccacaucgucgcg

SEQ ID NO: 313086 - RNA, 15 nt, Bordetella pertussis
gccuggcccgaacgg

SEQ ID NO: 313087 - RNA, 14 nt, Bordetella pertussis
gccuggccgagcgc

SEQ ID NO: 313088 - RNA, 19 nt, Bordetella pertussis
gccuggccgagcgcggcau

SEQ ID NO: 313089 - RNA, 22 nt, Bordetella pertussis
gccuggccgagcgcggcaugcg

SEQ ID NO: 313090 - RNA, 19 nt, Bordetella pertussis
gccuggcccagcuccagcu

SEQ ID NO: 313091 - RNA, 15 nt, Bordetella pertussis
gccuggccccaggcg

SEQ ID NO: 313092 - RNA, 18 nt, Bordetella pertussis
gccuggccgccggcggcg

SEQ ID NO: 313093 - RNA, 23 nt, Bordetella pertussis
gccuggccgccggcggcgcacca

SEQ ID NO: 313094 - RNA, 14 nt, Bordetella pertussis
gccuggccgcgcgc

SEQ ID NO: 313095 - RNA, 19 nt, Bordetella pertussis
gccuggccgcgcgccugcu

SEQ ID NO: 313096 - RNA, 14 nt, Bordetella pertussis
gccuggccgcgcuc

SEQ ID NO: 313097 - RNA, 12 nt, Bordetella pertussis
gccuggccggcu

SEQ ID NO: 313098 - RNA, 17 nt, Bordetella pertussis
gccuggccugcgccgcc

SEQ ID NO: 313099 - RNA, 20 nt, Bordetella pertussis
gccuggcgccaacccgccau

SEQ ID NO: 313100 - RNA, 13 nt, Bordetella pertussis
gccuggcgccgcg

SEQ ID NO: 313101 - RNA, 12 nt, Bordetella pertussis
gccuggcgcgca

SEQ ID NO: 313102 - RNA, 15 nt, Bordetella pertussis
gccuggcgcgcaucg

SEQ ID NO: 313103 - RNA, 16 nt, Bordetella pertussis
gccuggcgcgcaucgg

SEQ ID NO: 313104 - RNA, 15 nt, Bordetella pertussis
gccuggcgcgcccac

SEQ ID NO: 313105 - RNA, 13 nt, Bordetella pertussis
gccuggcgcgcgg

SEQ ID NO: 313106 - RNA, 13 nt, Bordetella pertussis
gccuggcgcggcc

SEQ ID NO: 313107 - RNA, 18 nt, Bordetella pertussis
gccuggcgcggcgccugc

SEQ ID NO: 313108 - RNA, 13 nt, Bordetella pertussis
gccuggcgcauga

SEQ ID NO: 313109 - RNA, 12 nt, Bordetella pertussis
gccuggcgcucc

SEQ ID NO: 313110 - RNA, 13 nt, Bordetella pertussis
gccuggcgcuccu

SEQ ID NO: 313111 - RNA, 21 nt, Bordetella pertussis
gccuggcgcuccucgcgcgcg

SEQ ID NO: 313112 - RNA, 22 nt, Bordetella pertussis
gccuggcgcuccucgcgcgcgg

SEQ ID NO: 313113 - RNA, 16 nt, Bordetella pertussis
gccuggcggaucucgg

SEQ ID NO: 313114 - RNA, 20 nt, Bordetella pertussis
gccuggcguagggcugcacg

SEQ ID NO: 313115 - RNA, 17 nt, Bordetella pertussis
gccuggcggcuggucaa

SEQ ID NO: 313116 - RNA, 13 nt, Bordetella pertussis
gccuggcgggccg

SEQ ID NO: 313117 - RNA, 22 nt, Bordetella pertussis
gccuggcguucaaucgcgcuuc

SEQ ID NO: 313118 - RNA, 16 nt, Bordetella pertussis
gccuggcuuacaggcc

SEQ ID NO: 313119 - RNA, 18 nt, Bordetella pertussis
gccuggcuuacaggccca

SEQ ID NO: 313120 - RNA, 21 nt, Bordetella pertussis
gccuggcuuacaggcccagua

SEQ ID NO: 313121 - RNA, 22 nt, Bordetella pertussis
gccuggcuucccgguccaggcc

SEQ ID NO: 313122 - RNA, 23 nt, Bordetella pertussis
gccuggcuucccgguccaggccg

SEQ ID NO: 313123 - RNA, 20 nt, Bordetella pertussis
gccuggcuugcgccacgccc

SEQ ID NO: 313124 - RNA, 21 nt, Bordetella pertussis
gccuggcuuucgccgcgggcc

SEQ ID NO: 313125 - RNA, 18 nt, Bordetella pertussis
gccuggcucaggccugca

SEQ ID NO: 313126 - RNA, 16 nt, Bordetella pertussis
gccuggcucagucggc

SEQ ID NO: 313127 - RNA, 23 nt, Bordetella pertussis
gccuggcucagucggccuggcgc

SEQ ID NO: 313128 - RNA, 18 nt, Bordetella pertussis
gccugggccgacaugccg

SEQ ID NO: 313129 - RNA, 12 nt, Bordetella pertussis
gccugggccugu

SEQ ID NO: 313130 - RNA, 15 nt, Bordetella pertussis
gccugggcgccuggc

SEQ ID NO: 313131 - RNA, 13 nt, Bordetella pertussis
gccugggcgcgcg

SEQ ID NO: 313132 - RNA, 15 nt, Bordetella pertussis
gccugggcgcgcgcc

SEQ ID NO: 313133 - RNA, 16 nt, Bordetella pertussis
gccugggcgcgcgccc

SEQ ID NO: 313134 - RNA, 23 nt, Bordetella pertussis
gccugggcgcgcgcccaggccag

SEQ ID NO: 313135 - RNA, 18 nt, Bordetella pertussis
gccugggcggcgcagucg

SEQ ID NO: 313136 - RNA, 13 nt, Bordetella pertussis
gccugggcggcgg

SEQ ID NO: 313137 - RNA, 22 nt, Bordetella pertussis
gccugggcggcggcgaugccgc

SEQ ID NO: 313138 - RNA, 18 nt, Bordetella pertussis
gccugggcgggccguugc

SEQ ID NO: 313139 - RNA, 19 nt, Bordetella pertussis
gccugggcgucgagcggcg

SEQ ID NO: 313140 - RNA, 18 nt, Bordetella pertussis
gccuggggcgggcgcugc

SEQ ID NO: 313141 - RNA, 19 nt, Bordetella pertussis
gccuggggcgggcgcugcg

SEQ ID NO: 313142 - RNA, 18 nt, Bordetella pertussis
gccugggggcuggaggcg

SEQ ID NO: 313143 - RNA, 15 nt, Bordetella pertussis
gccugggcggccacg

SEQ ID NO: 313144 - RNA, 18 nt, Bordetella pertussis
gccugggugcuggugcgc

SEQ ID NO: 313145 - RNA, 16 nt, Bordetella pertussis
gccugguacaggccga

SEQ ID NO: 313146 - RNA, 19 nt, Bordetella pertussis
gccugguaguaaucgcgcg

SEQ ID NO: 313147 - RNA, 21 nt, Bordetella pertussis
gccugguaguaaucgcgcgcc

SEQ ID NO: 313148 - RNA, 22 nt, Bordetella pertussis
gccugguaguaaucgcgcgcca

SEQ ID NO: 313149 - RNA, 16 nt, Bordetella pertussis
gccuggucagcgccga

SEQ ID NO: 313150 - RNA, 21 nt, Bordetella pertussis
gccuggucagguugcgccggc

SEQ ID NO: 313151 - RNA, 13 nt, Bordetella pertussis
gccuggucgaagu

SEQ ID NO: 313152 - RNA, 19 nt, Bordetella pertussis
gccuggucgacgccggcga

SEQ ID NO: 313153 - RNA, 21 nt, Bordetella pertussis
gccuggucgacgccggcgacg

SEQ ID NO: 313154 - RNA, 15 nt, Bordetella pertussis
gccuggucgcgcgcc

SEQ ID NO: 313155 - RNA, 16 nt, Bordetella pertussis
gccuggugcccgacgc

SEQ ID NO: 313156 - RNA, 16 nt, Bordetella pertussis
gccugguuagagcagc

SEQ ID NO: 313157 - RNA, 18 nt, Bordetella pertussis
gccugguuggccgccugg

SEQ ID NO: 313158 - RNA, 15 nt, Bordetella pertussis
gccuguaucagcgcc

SEQ ID NO: 313159 - RNA, 18 nt, Bordetella pertussis
gccuguaucagcgccugc

SEQ ID NO: 313160 - RNA, 20 nt, Bordetella pertussis
gccuguaucagcgccugcag

SEQ ID NO: 313161 - RNA, 20 nt, Bordetella pertussis
gccugucacaccccaccacg

SEQ ID NO: 313162 - RNA, 14 nt, Bordetella pertussis
gccugucccagcgg

SEQ ID NO: 313163 - RNA, 16 nt, Bordetella pertussis
gccugucccagcgggg

SEQ ID NO: 313164 - RNA, 19 nt, Bordetella pertussis
gccugucccagcggggaca

SEQ ID NO: 313165 - RNA, 20 nt, Bordetella pertussis
gccugucccagcggggacag

SEQ ID NO: 313166 - RNA, 19 nt, Bordetella pertussis
gccugucccaggcgcucgc

SEQ ID NO: 313167 - RNA, 18 nt, Bordetella pertussis
gccuguccccacaggggg

SEQ ID NO: 313168 - RNA, 20 nt, Bordetella pertussis
gccuguccccaccgggacag

SEQ ID NO: 313169 - RNA, 24 nt, Bordetella pertussis
gccuguccccacguggacaggcac

SEQ ID NO: 313170 - RNA, 14 nt, Bordetella pertussis
gccuguccccgaac

SEQ ID NO: 313171 - RNA, 15 nt, Bordetella pertussis
gccuguccccgcacg

SEQ ID NO: 313172 - RNA, 16 nt, Bordetella pertussis
gccuguccccgcacgg

SEQ ID NO: 313173 - RNA, 21 nt, Bordetella pertussis
gccuguccccgcacggggaca

SEQ ID NO: 313174 - RNA, 21 nt, Bordetella pertussis
gccuguccccgcacggggacu

SEQ ID NO: 313175 - RNA, 20 nt, Bordetella pertussis
gccuguccccgcagggacag

SEQ ID NO: 313176 - RNA, 15 nt, Bordetella pertussis
gccuguccccgcaug

SEQ ID NO: 313177 - RNA, 15 nt, Bordetella pertussis
gccuguccccgccgg

SEQ ID NO: 313178 - RNA, 20 nt, Bordetella pertussis
gccuguccccgccgggacag

SEQ ID NO: 313179 - RNA, 20 nt, Bordetella pertussis
gccuguccccgccggggcag

SEQ ID NO: 313180 - RNA, 15 nt, Bordetella pertussis
gccuguccccgcggg

SEQ ID NO: 313181 - RNA, 24 nt, Bordetella pertussis
gccuguccccgcggggacaggcac

SEQ ID NO: 313182 - RNA, 23 nt, Bordetella pertussis
gccuguccccgcggggacuggcu

SEQ ID NO: 313183 - RNA, 15 nt, Bordetella pertussis
gccuguccccgcugc

SEQ ID NO: 313184 - RNA, 19 nt, Bordetella pertussis
gccuguccccgcugggaca

SEQ ID NO: 313185 - RNA, 19 nt, Bordetella pertussis
gccuguccccguggggaca

SEQ ID NO: 313186 - RNA, 20 nt, Bordetella pertussis
gccuguccccguggggacag

SEQ ID NO: 313187 - RNA, 20 nt, Bordetella pertussis
gccugucccgacggggacag

SEQ ID NO: 313188 - RNA, 14 nt, Bordetella pertussis
gccugucccggcug

SEQ ID NO: 313189 - RNA, 20 nt, Bordetella pertussis
gccugucccggcugggacag

SEQ ID NO: 313190 - RNA, 19 nt, Bordetella pertussis
gccugucccugaacguggc

SEQ ID NO: 313191 - RNA, 15 nt, Bordetella pertussis
gccugucccugccgg

SEQ ID NO: 313192 - RNA, 20 nt, Bordetella pertussis
gccugucccugccgggacag

SEQ ID NO: 313193 - RNA, 19 nt, Bordetella pertussis
gccugucccugcggggacu

SEQ ID NO: 313194 - RNA, 19 nt, Bordetella pertussis
gccugucccugcgggggca

SEQ ID NO: 313195 - RNA, 22 nt, Bordetella pertussis
gccugucccugcgggggcaggc

SEQ ID NO: 313196 - RNA, 18 nt, Bordetella pertussis
gccuguuuuggcgcacgc

SEQ ID NO: 313197 - RNA, 18 nt, Bordetella pertussis
gccuuacgcggcgcgcgc

SEQ ID NO: 313198 - RNA, 20 nt, Bordetella pertussis
gccuuacgcgguccgcagcg

SEQ ID NO: 313199 - RNA, 21 nt, Bordetella pertussis
gccuuacuucuugcgcaucgg

SEQ ID NO: 313200 - RNA, 18 nt, Bordetella pertussis
gccuuccggcagcggcca

SEQ ID NO: 313201 - RNA, 17 nt, Bordetella pertussis
gccuucgaccugcccga

SEQ ID NO: 313202 - RNA, 18 nt, Bordetella pertussis
gccuucgaccugcccgag

SEQ ID NO: 313203 - RNA, 21 nt, Bordetella pertussis
gccuuccuugaacugcgcggu

SEQ ID NO: 313204 - RNA, 22 nt, Bordetella pertussis
gccuucgaacucgauggccucg

SEQ ID NO: 313205 - RNA, 20 nt, Bordetella pertussis
gccuucgagcaccaugccgg

SEQ ID NO: 313206 - RNA, 18 nt, Bordetella pertussis
gccuucgcgauccagcag

SEQ ID NO: 313207 - RNA, 14 nt, Bordetella pertussis
gccuucggcgcgca

SEQ ID NO: 313208 - RNA, 16 nt, Bordetella pertussis
gccuucggcgcgcacg

SEQ ID NO: 313209 - RNA, 20 nt, Bordetella pertussis
gccuucggccggcugcgcgc

SEQ ID NO: 313210 - RNA, 18 nt, Bordetella pertussis
gcgacacaaggcggccgc

SEQ ID NO: 313211 - RNA, 20 nt, Bordetella pertussis
gcgacacaaggcggccgcgc

SEQ ID NO: 313212 - RNA, 21 nt, Bordetella pertussis
gcgacacccccagggcgcgcc

SEQ ID NO: 313213 - RNA, 15 nt, Bordetella pertussis
gcgacaccgcggccu

SEQ ID NO: 313214 - RNA, 13 nt, Bordetella pertussis
gcgacagcgcugg

SEQ ID NO: 313215 - RNA, 16 nt, Bordetella pertussis
gcgacaggcccgcggc

SEQ ID NO: 313216 - RNA, 18 nt, Bordetella pertussis
gcgacaggcccgcggccg

SEQ ID NO: 313217 - RNA, 15 nt, Bordetella pertussis
gcgacaggcgcagcu

SEQ ID NO: 313218 - RNA, 14 nt, Bordetella pertussis
gcgacaggcggugc

SEQ ID NO: 313219 - RNA, 22 nt, Bordetella pertussis
gcgacaggcggugcgcgcggcc

SEQ ID NO: 313220 - RNA, 21 nt, Bordetella pertussis
gcgacauagaucuccggcgcc

SEQ ID NO: 313221 - RNA, 16 nt, Bordetella pertussis
gcgacauagcgcugga

SEQ ID NO: 313222 - RNA, 16 nt, Bordetella pertussis
gcgaccaccaggucgu

SEQ ID NO: 313223 - RNA, 21 nt, Bordetella pertussis
gcgaccaccaggucguacagc

SEQ ID NO: 313224 - RNA, 16 nt, Bordetella pertussis
gcgaccaccagcacca

SEQ ID NO: 313225 - RNA, 19 nt, Bordetella pertussis
gcgaccacuaucagcgcgu

SEQ ID NO: 313226 - RNA, 18 nt, Bordetella pertussis
gcgacccagaacccggcc

SEQ ID NO: 313227 - RNA, 20 nt, Bordetella pertussis
gcgacccagaacccggccgg

SEQ ID NO: 313228 - RNA, 21 nt, Bordetella pertussis
gcgacccagaacccggccggc

SEQ ID NO: 313229 - RNA, 23 nt, Bordetella pertussis
gcgacccagaacccggccggcgc

SEQ ID NO: 313230 - RNA, 16 nt, Bordetella pertussis
gcgacccagcaccgag

SEQ ID NO: 313231 - RNA, 12 nt, Bordetella pertussis
gcgaccgacggc

SEQ ID NO: 313232 - RNA, 13 nt, Bordetella pertussis
gcgaccgccgccu

SEQ ID NO: 313233 - RNA, 14 nt, Bordetella pertussis
gcgaccgccggccg

SEQ ID NO: 313234 - RNA, 19 nt, Bordetella pertussis
gcgaccgccuccagcgcgg

SEQ ID NO: 313235 - RNA, 14 nt, Bordetella pertussis
gcgaccgcgaaccg

SEQ ID NO: 313236 - RNA, 13 nt, Bordetella pertussis
gcgaccgugcgcc

SEQ ID NO: 313237 - RNA, 16 nt, Bordetella pertussis
gcgaccucggcggcgu

SEQ ID NO: 313238 - RNA, 18 nt, Bordetella pertussis
gcgaccucggcggcgucg

SEQ ID NO: 313239 - RNA, 19 nt, Bordetella pertussis
gcgaccucggcggcgucgc

SEQ ID NO: 313240 - RNA, 14 nt, Bordetella pertussis
gcgaccucggcggc

SEQ ID NO: 313241 - RNA, 17 nt, Bordetella pertussis
gcgacgaacugaucggc

SEQ ID NO: 313242 - RNA, 23 nt, Bordetella pertussis
gcgacgaacugaucggcaaggcg

SEQ ID NO: 313243 - RNA, 18 nt, Bordetella pertussis
gcgacgaauggguccgcg

SEQ ID NO: 313244 - RNA, 15 nt, Bordetella pertussis
gcgacgaccccgccg

SEQ ID NO: 313245 - RNA, 22 nt, Bordetella pertussis
gcgacgauccggcgaccgacgg

SEQ ID NO: 313246 - RNA, 23 nt, Bordetella pertussis
gcgacgauccggcgaccgacggc

SEQ ID NO: 313247 - RNA, 18 nt, Bordetella pertussis
gcgacgcauauccaggcg

SEQ ID NO: 313248 - RNA, 19 nt, Bordetella pertussis
gcgacgcauauccaggcgg

SEQ ID NO: 313249 - RNA, 22 nt, Bordetella pertussis
gcgacgcauauccaggcggcgc

SEQ ID NO: 313250 - RNA, 13 nt, Bordetella pertussis
gcgacgcuguugg

SEQ ID NO: 313251 - RNA, 18 nt, Bordetella pertussis
gcgacgcuguuggucagg

SEQ ID NO: 313252 - RNA, 15 nt, Bordetella pertussis
gcgacggcagaugga

SEQ ID NO: 313253 - RNA, 17 nt, Bordetella pertussis
gcgacggccccagcgcc

SEQ ID NO: 313254 - RNA, 19 nt, Bordetella pertussis
gcgacggccccagcgccgc

SEQ ID NO: 313255 - RNA, 20 nt, Bordetella pertussis
gcgacggccccagcgccgcg

SEQ ID NO: 313256 - RNA, 21 nt, Bordetella pertussis
gcgacggccccagcgccgcga

SEQ ID NO: 313257 - RNA, 14 nt, Bordetella pertussis
gcgacggcaucgau

SEQ ID NO: 313258 - RNA, 14 nt, Bordetella pertussis
gcgacggccugcca

SEQ ID NO: 313259 - RNA, 17 nt, Bordetella pertussis
gcgacggccucccgccg

SEQ ID NO: 313260 - RNA, 22 nt, Bordetella pertussis
gcgacggccucccgccgcccgg

SEQ ID NO: 313261 - RNA, 12 nt, Bordetella pertussis
gcgacggcggcc

SEQ ID NO: 313262 - RNA, 13 nt, Bordetella pertussis
gcgacggcggcgu

SEQ ID NO: 313263 - RNA, 18 nt, Bordetella pertussis
gcgacggcgucggccugg

SEQ ID NO: 313264 - RNA, 19 nt, Bordetella pertussis
gcgacgugacccgaugcgc

SEQ ID NO: 313265 - RNA, 15 nt, Bordetella pertussis
gcgacgugucggcca

SEQ ID NO: 313266 - RNA, 21 nt, Bordetella pertussis
gcgacugccccagcggcuggc

SEQ ID NO: 313267 - RNA, 21 nt, Bordetella pertussis
gcgacuuccgcuuccggccgg

SEQ ID NO: 313268 - RNA, 14 nt, Bordetella pertussis
gcgacuucgccgau

SEQ ID NO: 313269 - RNA, 19 nt, Bordetella pertussis
gcgacuucgccgaucgagc

SEQ ID NO: 313270 - RNA, 14 nt, Bordetella pertussis
gcgacuucggcggc

SEQ ID NO: 313271 - RNA, 15 nt, Bordetella pertussis
gcgacuucggcggcc

SEQ ID NO: 313272 - RNA, 19 nt, Bordetella pertussis
gcgagaccagcggaucgcc

SEQ ID NO: 313273 - RNA, 19 nt, Bordetella pertussis
gcgagacgaaggcgccggc

SEQ ID NO: 313274 - RNA, 20 nt, Bordetella pertussis
gcgagacgaaggcgccggcc

SEQ ID NO: 313275 - RNA, 21 nt, Bordetella pertussis
gcgagacgaaggcgccggcca

SEQ ID NO: 313276 - RNA, 17 nt, Bordetella pertussis
gcgagagauagcccagc

SEQ ID NO: 313277 - RNA, 13 nt, Bordetella pertussis
gcgagagcgccac

SEQ ID NO: 313278 - RNA, 13 nt, Bordetella pertussis
gcgagaucagcac

SEQ ID NO: 313279 - RNA, 17 nt, Bordetella pertussis
gcgagaucagccaccgg

SEQ ID NO: 313280 - RNA, 18 nt, Bordetella pertussis
gcgagcagaugcaccggc

SEQ ID NO: 313281 - RNA, 14 nt, Bordetella pertussis
gcgagcagggcauc

SEQ ID NO: 313282 - RNA, 21 nt, Bordetella pertussis
gcgagcagggcaucaccaucg

SEQ ID NO: 313283 - RNA, 17 nt, Bordetella pertussis
gcgagcagucgaccacg

SEQ ID NO: 313284 - RNA, 19 nt, Bordetella pertussis
gcgagcauggcgguggcca

SEQ ID NO: 313285 - RNA, 22 nt, Bordetella pertussis
gcgagcauggcgguggccagcg

SEQ ID NO: 313286 - RNA, 19 nt, Bordetella pertussis
gcgagcaugcgcagcgcgu

SEQ ID NO: 313287 - RNA, 20 nt, Bordetella pertussis
gcgagccgauggcauggggc

SEQ ID NO: 313288 - RNA, 14 nt, Bordetella pertussis
gcgagccgcccacg

SEQ ID NO: 313289 - RNA, 15 nt, Bordetella pertussis
gcgagccgcccacgg

SEQ ID NO: 313290 - RNA, 14 nt, Bordetella pertussis
gcgagccggccagc

SEQ ID NO: 313291 - RNA, 17 nt, Bordetella pertussis
gcgagccggccagcgcc

SEQ ID NO: 313292 - RNA, 15 nt, Bordetella pertussis
gcgagccgggcaccg

SEQ ID NO: 313293 - RNA, 22 nt, Bordetella pertussis
gcgagccgggcaccgagccgca

SEQ ID NO: 313294 - RNA, 16 nt, Bordetella pertussis
gcgagccuucggccgg

SEQ ID NO: 313295 - RNA, 22 nt, Bordetella pertussis
gcgagcgaaagccgucggccac

SEQ ID NO: 313296 - RNA, 14 nt, Bordetella pertussis
gcgagcgaugcccu

SEQ ID NO: 313297 - RNA, 17 nt, Bordetella pertussis
gcgagcgcaagcaccgc

SEQ ID NO: 313298 - RNA, 22 nt, Bordetella pertussis
gcgagcgcacaggcggcgccgg

SEQ ID NO: 313299 - RNA, 15 nt, Bordetella pertussis
gcgaggacaggccag

SEQ ID NO: 313300 - RNA, 20 nt, Bordetella pertussis
gcgaggaggugcgccgcucg

SEQ ID NO: 313301 - RNA, 13 nt, Bordetella pertussis
gcgaggcccggcc

SEQ ID NO: 313302 - RNA, 21 nt, Bordetella pertussis
gcgagggcucgaccgccgcca

SEQ ID NO: 313303 - RNA, 15 nt, Bordetella pertussis
gcgagguagggcgcg

SEQ ID NO: 313304 - RNA, 18 nt, Bordetella pertussis
gcgagguagggcgcggcc

SEQ ID NO: 313305 - RNA, 17 nt, Bordetella pertussis
gcgagguauuggccuug

SEQ ID NO: 313306 - RNA, 19 nt, Bordetella pertussis
gcgaggugccggacgccga

SEQ ID NO: 313307 - RNA, 16 nt, Bordetella pertussis
gcgagguggcgcucgc

SEQ ID NO: 313308 - RNA, 20 nt, Bordetella pertussis
gcgagguugcaggccaggcu

SEQ ID NO: 313309 - RNA, 16 nt, Bordetella pertussis
gcgauauccaucggcg

SEQ ID NO: 313310 - RNA, 22 nt, Bordetella pertussis
gcgauauccuugcgcucgccca

SEQ ID NO: 313311 - RNA, 13 nt, Bordetella pertussis
gcgaucagcgcgg

SEQ ID NO: 313312 - RNA, 17 nt, Bordetella pertussis
gcgaucagcgcggccgc

SEQ ID NO: 313313 - RNA, 19 nt, Bordetella pertussis
gcgaucaugcaguacaggc

SEQ ID NO: 313314 - RNA, 21 nt, Bordetella pertussis
gcgaucaugcaguacaggcgc

SEQ ID NO: 313315 - RNA, 15 nt, Bordetella pertussis
gcgaucaugccgccg

SEQ ID NO: 313316 - RNA, 15 nt, Bordetella pertussis
gcgauccagcagcgu

SEQ ID NO: 313317 - RNA, 17 nt, Bordetella pertussis
gcgauccagcagcgugg

SEQ ID NO: 313318 - RNA, 12 nt, Bordetella pertussis
gcgauccaggcc

SEQ ID NO: 313319 - RNA, 15 nt, Bordetella pertussis
gcgauccgccgcggc

SEQ ID NO: 313320 - RNA, 16 nt, Bordetella pertussis
gcgauccgcgccaggc

SEQ ID NO: 313321 - RNA, 15 nt, Bordetella pertussis
gcgauccuggggcag

SEQ ID NO: 313322 - RNA, 17 nt, Bordetella pertussis
gcgauccuucgcggccg

SEQ ID NO: 313323 - RNA, 18 nt, Bordetella pertussis
gcgauccuucgcggccgu

SEQ ID NO: 313324 - RNA, 23 nt, Bordetella pertussis
gcgaucgaacgacucgucgacca

SEQ ID NO: 313325 - RNA, 17 nt, Bordetella pertussis
gcgaucgaacgcggcca

SEQ ID NO: 313326 - RNA, 19 nt, Bordetella pertussis
gcgaucgaacgcggccaga

SEQ ID NO: 313327 - RNA, 18 nt, Bordetella pertussis
gcgauccugcccaccgcc

SEQ ID NO: 313328 - RNA, 20 nt, Bordetella pertussis
gcgaucgaguggugcgcggu

SEQ ID NO: 313329 - RNA, 14 nt, Bordetella pertussis
gcgaucgccagcag

SEQ ID NO: 313330 - RNA, 20 nt, Bordetella pertussis
gcgaucgccgcaugggcgcg

SEQ ID NO: 313331 - RNA, 21 nt, Bordetella pertussis
gcgaucgccgcaugggcgcgc

SEQ ID NO: 313332 - RNA, 21 nt, Bordetella pertussis
gcgaucgccuguaucugcgcc

SEQ ID NO: 313333 - RNA, 21 nt, Bordetella pertussis
gcgaucggagaaaucgccgcc

SEQ ID NO: 313334 - RNA, 14 nt, Bordetella pertussis
gcgaucggccucgg

SEQ ID NO: 313335 - RNA, 14 nt, Bordetella pertussis
gcgaucgucgaccg

SEQ ID NO: 313336 - RNA, 21 nt, Bordetella pertussis
gcgaucgucgaccgcgaagcc

SEQ ID NO: 313337 - RNA, 23 nt, Bordetella pertussis
gcgaucgucgaccgcgaagccgc

SEQ ID NO: 313338 - RNA, 20 nt, Bordetella pertussis
gcgaucgucgcugcgcggcg

SEQ ID NO: 313339 - RNA, 18 nt, Bordetella pertussis
gcgaucucagccaucauc

SEQ ID NO: 313340 - RNA, 21 nt, Bordetella pertussis
gcgaucucagccaucaucauc

SEQ ID NO: 313341 - RNA, 19 nt, Bordetella pertussis
gcgaucucgcgcagggugg

SEQ ID NO: 313342 - RNA, 14 nt, Bordetella pertussis
gcgaucucgcgcgc

SEQ ID NO: 313343 - RNA, 19 nt, Bordetella pertussis
gcgaucucgggcaggucgg

SEQ ID NO: 313344 - RNA, 16 nt, Bordetella pertussis
gcgaucucgucgaccg

SEQ ID NO: 313345 - RNA, 18 nt, Bordetella pertussis
gcgaucucguggcccagc

SEQ ID NO: 313346 - RNA, 15 nt, Bordetella pertussis
gcgaucugcgcggcg

SEQ ID NO: 313347 - RNA, 23 nt, Bordetella pertussis
gcgaucuugccggccuggcgggc

SEQ ID NO: 313348 - RNA, 20 nt, Bordetella pertussis
gcgaugaagucgcggcccgc

SEQ ID NO: 313349 - RNA, 20 nt, Bordetella pertussis
gcgaugaccucggcgagcgc

SEQ ID NO: 313350 - RNA, 17 nt, Bordetella pertussis
gcgaugcacccaggcgc

SEQ ID NO: 313351 - RNA, 19 nt, Bordetella pertussis
gcgaugcacccaggcgccg

SEQ ID NO: 313352 - RNA, 17 nt, Bordetella pertussis
gcgaugcauucggcggc

SEQ ID NO: 313353 - RNA, 18 nt, Bordetella pertussis
gcgaugcauucggcggcc

SEQ ID NO: 313354 - RNA, 16 nt, Bordetella pertussis
gcgaugcccaccagcc

SEQ ID NO: 313355 - RNA, 19 nt, Bordetella pertussis
gcgaugcccaccagccgcc

SEQ ID NO: 313356 - RNA, 22 nt, Bordetella pertussis
gcgaugcccaccagccgcccgg

SEQ ID NO: 313357 - RNA, 15 nt, Bordetella pertussis
gcgaugcccagcgcc

SEQ ID NO: 313358 - RNA, 18 nt, Bordetella pertussis
gcgaugcccagcgccgcc

SEQ ID NO: 313359 - RNA, 21 nt, Bordetella pertussis
gcgaugcccagcgccgccgac

SEQ ID NO: 313360 - RNA, 19 nt, Bordetella pertussis
gcgaugcccgcgcaccagg

SEQ ID NO: 313361 - RNA, 21 nt, Bordetella pertussis
gcgaugcccgcgcaccaggcg

SEQ ID NO: 313362 - RNA, 17 nt, Bordetella pertussis
gcgaugcccuggauggc

SEQ ID NO: 313363 - RNA, 12 nt, Bordetella pertussis
gcgaugccgauc

SEQ ID NO: 313364 - RNA, 15 nt, Bordetella pertussis
gcgaugccggccagc

SEQ ID NO: 313365 - RNA, 17 nt, Bordetella pertussis
gcgaugccggccagcag

SEQ ID NO: 313366 - RNA, 16 nt, Bordetella pertussis
gcgaugccggcgcugc

SEQ ID NO: 313367 - RNA, 19 nt, Bordetella pertussis
gcgaugccggcguggcgcg

SEQ ID NO: 313368 - RNA, 21 nt, Bordetella pertussis
gcgaugccggcguggcgcgca

SEQ ID NO: 313369 - RNA, 13 nt, Bordetella pertussis
gcgaugccggcca

SEQ ID NO: 313370 - RNA, 13 nt, Bordetella pertussis
gcgaugcgcagca

SEQ ID NO: 313371 - RNA, 14 nt, Bordetella pertussis
gcgaugcgcagcag

SEQ ID NO: 313372 - RNA, 23 nt, Bordetella pertussis
gcgaugcgcgcgcgggccagcag

SEQ ID NO: 313373 - RNA, 13 nt, Bordetella pertussis
gcgaugcgcggcc

SEQ ID NO: 313374 - RNA, 14 nt, Bordetella pertussis
gcgaugcgcggccc

SEQ ID NO: 313375 - RNA, 15 nt, Bordetella pertussis
gcgaugcgcggcccg

SEQ ID NO: 313376 - RNA, 18 nt, Bordetella pertussis
gcgaugcgcggcccggcc

SEQ ID NO: 313377 - RNA, 16 nt, Bordetella pertussis
gcgaugcgccaggcgc

SEQ ID NO: 313378 - RNA, 19 nt, Bordetella pertussis
gcgaugcgccaggcgcucg

SEQ ID NO: 313379 - RNA, 19 nt, Bordetella pertussis
gcgaugcgggccacgccgg

SEQ ID NO: 313380 - RNA, 16 nt, Bordetella pertussis
gcgaugcgggcggcgg

SEQ ID NO: 313381 - RNA, 23 nt, Bordetella pertussis
gcgauggaacucguuggccagcg

SEQ ID NO: 313382 - RNA, 15 nt, Bordetella pertussis
gcgaugcucacgccc

SEQ ID NO: 313383 - RNA, 20 nt, Bordetella pertussis
gcgauggacucauaggcauc

SEQ ID NO: 313384 - RNA, 18 nt, Bordetella pertussis
gcgauggcacggcacgcc

SEQ ID NO: 313385 - RNA, 15 nt, Bordetella pertussis
gcgauggccacgcgc

SEQ ID NO: 313386 - RNA, 20 nt, Bordetella pertussis
gcgauggcccgguaggccac

SEQ ID NO: 313387 - RNA, 23 nt, Bordetella pertussis
gcgauggcccgguaggccacgcg

SEQ ID NO: 313388 - RNA, 15 nt, Bordetella pertussis
gcgauggccgacaug

SEQ ID NO: 313389 - RNA, 20 nt, Bordetella pertussis
gcgauggccgggagcggcca

SEQ ID NO: 313390 - RNA, 15 nt, Bordetella pertussis
gcgauggcgccggcc

SEQ ID NO: 313391 - RNA, 12 nt, Bordetella pertussis
gcgauggcgcgc

SEQ ID NO: 313392 - RNA, 16 nt, Bordetella pertussis
gcgauggcgcgcgcca

SEQ ID NO: 313393 - RNA, 15 nt, Bordetella pertussis
gcgauggcgcggccg

SEQ ID NO: 313394 - RNA, 12 nt, Bordetella pertussis
gcgauggcgcgu

SEQ ID NO: 313395 - RNA, 12 nt, Bordetella pertussis
gcgauggcggca

SEQ ID NO: 313396 - RNA, 19 nt, Bordetella pertussis
gcgauggcguugcgcacca

SEQ ID NO: 313397 - RNA, 16 nt, Bordetella pertussis
gcgaugggcaccugcu

SEQ ID NO: 313398 - RNA, 16 nt, Bordetella pertussis
gcgaugggccugccca

SEQ ID NO: 313399 - RNA, 15 nt, Bordetella pertussis
gcgauggucggccgg

SEQ ID NO: 313400 - RNA, 17 nt, Bordetella pertussis
gcgauggucaccacccg

SEQ ID NO: 313401 - RNA, 23 nt, Bordetella pertussis
gcgauggucaccacccgcacgcc

SEQ ID NO: 313402 - RNA, 21 nt, Bordetella pertussis
gcgaugguggauccgccggug

SEQ ID NO: 313403 - RNA, 17 nt, Bordetella pertussis
gcgauguagggcagcuc

SEQ ID NO: 313404 - RNA, 18 nt, Bordetella pertussis
gcgauguccagcuccagc

SEQ ID NO: 313405 - RNA, 19 nt, Bordetella pertussis
gcgauguccagcuccagcg

SEQ ID NO: 313406 - RNA, 21 nt, Bordetella pertussis
gcgaugugacggcucgaugca

SEQ ID NO: 313407 - RNA, 15 nt, Bordetella pertussis
gcgauguggcgcgcc

SEQ ID NO: 313408 - RNA, 16 nt, Bordetella pertussis
gcgauguggcgcgcca

SEQ ID NO: 313409 - RNA, 22 nt, Bordetella pertussis
gcgauguucaggccggcccgcc

SEQ ID NO: 313410 - RNA, 16 nt, Bordetella pertussis
gcgauguugaagccgu

SEQ ID NO: 313411 - RNA, 17 nt, Bordetella pertussis
gcgauucccuggcgcgc

SEQ ID NO: 313412 - RNA, 18 nt, Bordetella pertussis
gcgauucccuggcgcgcc

SEQ ID NO: 313413 - RNA, 23 nt, Bordetella pertussis
gcgauugaguucgcgcgccggca

SEQ ID NO: 313414 - RNA, 23 nt, Bordetella pertussis
gcgauugcagguggccagcccgg

SEQ ID NO: 313415 - RNA, 20 nt, Bordetella pertussis
gcgauuuccuugcgccgccc

SEQ ID NO: 313416 - RNA, 21 nt, Bordetella pertussis
gcgauuugccgcagcccgcgc

SEQ ID NO: 313417 - RNA, 16 nt, Bordetella pertussis
gcgcaaaccacgucgg

SEQ ID NO: 313418 - RNA, 20 nt, Bordetella pertussis
gcgcaaacgggggcaggccg

SEQ ID NO: 313419 - RNA, 16 nt, Bordetella pertussis
gcgcaacccacggcgu

SEQ ID NO: 313420 - RNA, 13 nt, Bordetella pertussis
gcgcaacccggcc

SEQ ID NO: 313421 - RNA, 16 nt, Bordetella pertussis
gcgcaacccggccucg

SEQ ID NO: 313422 - RNA, 22 nt, Bordetella pertussis
gcgcaacccggccucgcugcgg

SEQ ID NO: 313423 - RNA, 12 nt, Bordetella pertussis
gcgcaaccggcc

SEQ ID NO: 313424 - RNA, 14 nt, Bordetella pertussis
gcgcaaccggcccg

SEQ ID NO: 313425 - RNA, 22 nt, Bordetella pertussis
gcgcaacgcaugcgcgaucucg

SEQ ID NO: 313426 - RNA, 15 nt, Bordetella pertussis
gcgcaacgccggccg

SEQ ID NO: 313427 - RNA, 12 nt, Bordetella pertussis
gcgcaacgcgcg

SEQ ID NO: 313428 - RNA, 16 nt, Bordetella pertussis
gcgcaacuccagcaua

SEQ ID NO: 313429 - RNA, 16 nt, Bordetella pertussis
gcgcaacucggccacc

SEQ ID NO: 313430 - RNA, 16 nt, Bordetella pertussis
gcgcaagcaccgccug

SEQ ID NO: 313431 - RNA, 17 nt, Bordetella pertussis
gcgcaagcaccgccugc

SEQ ID NO: 313432 - RNA, 14 nt, Bordetella pertussis
gcgcaagaucugga

SEQ ID NO: 313433 - RNA, 20 nt, Bordetella pertussis
gcgcaagcagggaugccggu

SEQ ID NO: 313434 - RNA, 14 nt, Bordetella pertussis
gcgcaagccgcugg

SEQ ID NO: 313435 - RNA, 21 nt, Bordetella pertussis
gcgcaagccgcuggauuucgc

SEQ ID NO: 313436 - RNA, 15 nt, Bordetella pertussis
gcgcaagccggccgc

SEQ ID NO: 313437 - RNA, 16 nt, Bordetella pertussis
gcgcaagccggccgcg

SEQ ID NO: 313438 - RNA, 19 nt, Bordetella pertussis
gcgcaagccggccgcgcgg

SEQ ID NO: 313439 - RNA, 13 nt, Bordetella pertussis
gcgcaagcgcgcc

SEQ ID NO: 313440 - RNA, 14 nt, Bordetella pertussis
gcgcaaggcggccc

SEQ ID NO: 313441 - RNA, 18 nt, Bordetella pertussis
gcgcaaggcgggcugguc

SEQ ID NO: 313442 - RNA, 14 nt, Bordetella pertussis
gcgcaaggcgucgg

SEQ ID NO: 313443 - RNA, 17 nt, Bordetella pertussis
gcgcaaggcgucgggca

SEQ ID NO: 313444 - RNA, 18 nt, Bordetella pertussis
gcgcaaggcgucgggcac

SEQ ID NO: 313445 - RNA, 16 nt, Bordetella pertussis
gcgcaagggccagucg

SEQ ID NO: 313446 - RNA, 20 nt, Bordetella pertussis
gcgcaaggacgcguccucgg

SEQ ID NO: 313447 - RNA, 20 nt, Bordetella pertussis
gcgcaaggcaugcgccagcg

SEQ ID NO: 313448 - RNA, 23 nt, Bordetella pertussis
gcgcaagguggcggugguggcca

SEQ ID NO: 313449 - RNA, 20 nt, Bordetella pertussis
gcgcaaguguggcgcaccgc

SEQ ID NO: 313450 - RNA, 22 nt, Bordetella pertussis
gcgcaaguucaucaucgccgac

SEQ ID NO: 313451 - RNA, 23 nt, Bordetella pertussis
gcgcaaguucaucaucgccgacg

SEQ ID NO: 313452 - RNA, 21 nt, Bordetella pertussis
gcgcaauccccgcuuccugcu

SEQ ID NO: 313453 - RNA, 17 nt, Bordetella pertussis
gcgcacauuggaguagu

SEQ ID NO: 313454 - RNA, 21 nt, Bordetella pertussis
gcgcaccaccaccaugugcuu

SEQ ID NO: 313455 - RNA, 14 nt, Bordetella pertussis
gcgcaccaccagca

SEQ ID NO: 313456 - RNA, 15 nt, Bordetella pertussis
gcgcaccagcccgcc

SEQ ID NO: 313457 - RNA, 20 nt, Bordetella pertussis
gcgcaccagcccgcccgcgc

SEQ ID NO: 313458 - RNA, 18 nt, Bordetella pertussis
gcgcaccagcgaggcggc

SEQ ID NO: 313459 - RNA, 19 nt, Bordetella pertussis
gcgcaccagcgaggcggca

SEQ ID NO: 313460 - RNA, 15 nt, Bordetella pertussis
gcgcaccagcgcgcc

SEQ ID NO: 313461 - RNA, 20 nt, Bordetella pertussis
gcgcaccagcgcgccgauca

SEQ ID NO: 313462 - RNA, 22 nt, Bordetella pertussis
gcgcaccaggcccaugaaggcg

SEQ ID NO: 313463 - RNA, 20 nt, Bordetella pertussis
gcgcaccaaucuugccaggc

SEQ ID NO: 313464 - RNA, 17 nt, Bordetella pertussis
gcgcaccaggcgcggcg

SEQ ID NO: 313465 - RNA, 20 nt, Bordetella pertussis
gcgcaccgcaugggccaggc

SEQ ID NO: 313466 - RNA, 14 nt, Bordetella pertussis
gcgcaccgcgcugg

SEQ ID NO: 313467 - RNA, 16 nt, Bordetella pertussis
gcgcaccgcgcuggga

SEQ ID NO: 313468 - RNA, 21 nt, Bordetella pertussis
gcgcaccgcuucuucgucgcg

SEQ ID NO: 313469 - RNA, 20 nt, Bordetella pertussis
gcgcaccggcacgcgccagc

SEQ ID NO: 313470 - RNA, 12 nt, Bordetella pertussis
gcgcaccggcca

SEQ ID NO: 313471 - RNA, 14 nt, Bordetella pertussis
gcgcaccggccagg

SEQ ID NO: 313472 - RNA, 18 nt, Bordetella pertussis
gcgcaccuguucggcggc

SEQ ID NO: 313473 - RNA, 21 nt, Bordetella pertussis
gcgcaccuguucggcggcgcc

SEQ ID NO: 313474 - RNA, 23 nt, Bordetella pertussis
gcgcaccuguucggcggcgccca

SEQ ID NO: 313475 - RNA, 13 nt, Bordetella pertussis
gcgcaccuugccc

SEQ ID NO: 313476 - RNA, 22 nt, Bordetella pertussis
gcgcaccuugcccacgccaucg

SEQ ID NO: 313477 - RNA, 20 nt, Bordetella pertussis
gcgcaccuugucgcgcagcg

SEQ ID NO: 313478 - RNA, 19 nt, Bordetella pertussis
gcgcacgaaguacucgccg

SEQ ID NO: 313479 - RNA, 18 nt, Bordetella pertussis
gcgcacgaccaccagcgc

SEQ ID NO: 313480 - RNA, 14 nt, Bordetella pertussis
gcgcacgauggggc

SEQ ID NO: 313481 - RNA, 19 nt, Bordetella pertussis
gcgcacgauggggcagcca

SEQ ID NO: 313482 - RNA, 22 nt, Bordetella pertussis
gcgcacgauggggccgucgccg

SEQ ID NO: 313483 - RNA, 21 nt, Bordetella pertussis
gcgcacgauugucgucgcgcg

SEQ ID NO: 313484 - RNA, 17 nt, Bordetella pertussis
gcgcacgcaccgcgcca

SEQ ID NO: 313485 - RNA, 19 nt, Bordetella pertussis
gcgcacgcaccgcgccagc

SEQ ID NO: 313486 - RNA, 13 nt, Bordetella pertussis
gcgcacgcagcgc

SEQ ID NO: 313487 - RNA, 14 nt, Bordetella pertussis
gcgcacgcagcgcu

SEQ ID NO: 313488 - RNA, 17 nt, Bordetella pertussis
gcgcacgccccgacgcg

SEQ ID NO: 313489 - RNA, 23 nt, Bordetella pertussis
gcgcacgccccgacgcggucgcc

SEQ ID NO: 313490 - RNA, 14 nt, Bordetella pertussis
gcgcacgccgcgcc

SEQ ID NO: 313491 - RNA, 16 nt, Bordetella pertussis
gcgcacgccgcgccgg

SEQ ID NO: 313492 - RNA, 12 nt, Bordetella pertussis
gcgcacgcgcag

SEQ ID NO: 313493 - RNA, 14 nt, Bordetella pertussis
gcgcacgcgcagca

SEQ ID NO: 313494 - RNA, 16 nt, Bordetella pertussis
gcgcacgcgcagcacg

SEQ ID NO: 313495 - RNA, 19 nt, Bordetella pertussis
gcgcacgcgcagcacgcug

SEQ ID NO: 313496 - RNA, 22 nt, Bordetella pertussis
gcgcacguugagauccaggaac

SEQ ID NO: 313497 - RNA, 12 nt, Bordetella pertussis
gcgcacgccggg

SEQ ID NO: 313498 - RNA, 15 nt, Bordetella pertussis
gcgcacgccgggcgc

SEQ ID NO: 313499 - RNA, 15 nt, Bordetella pertussis
gcgcacucgaccgcc

SEQ ID NO: 313500 - RNA, 16 nt, Bordetella pertussis
gcgcacucgaccgccg

SEQ ID NO: 313501 - RNA, 24 nt, Bordetella pertussis
gcgcacucgaccgccgggacaggc

SEQ ID NO: 313502 - RNA, 21 nt, Bordetella pertussis
gcgcacugagaaaggccgcca

SEQ ID NO: 313503 - RNA, 19 nt, Bordetella pertussis
gcgcaggucggcgaugcgc

SEQ ID NO: 313504 - RNA, 17 nt, Bordetella pertussis
gcgcaggucguggccgu

SEQ ID NO: 313505 - RNA, 17 nt, Bordetella pertussis
gcgcaggugugccagcc

SEQ ID NO: 313506 - RNA, 18 nt, Bordetella pertussis
gcgcaggugugccagccg

SEQ ID NO: 313507 - RNA, 17 nt, Bordetella pertussis
gcgcaguaucccggcca

SEQ ID NO: 313508 - RNA, 18 nt, Bordetella pertussis
gcgcaguaucccggccag

SEQ ID NO: 313509 - RNA, 21 nt, Bordetella pertussis
gcgcaguaucccggccaggcg

SEQ ID NO: 313510 - RNA, 22 nt, Bordetella pertussis
gcgcaguaucuggugcgcgucc

SEQ ID NO: 313511 - RNA, 12 nt, Bordetella pertussis
gcgcaguccagc

SEQ ID NO: 313512 - RNA, 16 nt, Bordetella pertussis
gcgcaguccagcgugg

SEQ ID NO: 313513 - RNA, 16 nt, Bordetella pertussis
gcgcagucgcgcacga

SEQ ID NO: 313514 - RNA, 23 nt, Bordetella pertussis
gcgcauagacccacagguuggcc

SEQ ID NO: 313515 - RNA, 20 nt, Bordetella pertussis
gcgcauauggagccaggcgg

SEQ ID NO: 313516 - RNA, 14 nt, Bordetella pertussis
gcgcaucagcgcgc

SEQ ID NO: 313517 - RNA, 15 nt, Bordetella pertussis
gcgcaucaugaggcg

SEQ ID NO: 313518 - RNA, 21 nt, Bordetella pertussis
gcgcaucccagacagccacgc

SEQ ID NO: 313519 - RNA, 22 nt, Bordetella pertussis
gcgcaucccagacagccacgcg

SEQ ID NO: 313520 - RNA, 20 nt, Bordetella pertussis
gcgcaucgaucucggccucg

SEQ ID NO: 313521 - RNA, 21 nt, Bordetella pertussis
gcgcaucgaucucggccucgg

SEQ ID NO: 313522 - RNA, 15 nt, Bordetella pertussis
gcgcaucgacagcgc

SEQ ID NO: 313523 - RNA, 18 nt, Bordetella pertussis
gcgcaucgagcuccugca

SEQ ID NO: 313524 - RNA, 19 nt, Bordetella pertussis
gcgcaucgagcuccugcag

SEQ ID NO: 313525 - RNA, 17 nt, Bordetella pertussis
gcgcaucgccgcaggcg

SEQ ID NO: 313526 - RNA, 18 nt, Bordetella pertussis
gcgcaucgccgcaggcgu

SEQ ID NO: 313527 - RNA, 14 nt, Bordetella pertussis
gcgcaugagccggc

SEQ ID NO: 313528 - RNA, 23 nt, Bordetella pertussis
gcgcaugagccggcagaucggcg

SEQ ID NO: 313529 - RNA, 17 nt, Bordetella pertussis
gcgcaugaugcugccgg

SEQ ID NO: 313530 - RNA, 19 nt, Bordetella pertussis
gcgcaugaugcugccgggc

SEQ ID NO: 313531 - RNA, 20 nt, Bordetella pertussis
gcgcaugaugcugccgggca

SEQ ID NO: 313532 - RNA, 21 nt, Bordetella pertussis
gcgcaugauuccugucgcgcu

SEQ ID NO: 313533 - RNA, 21 nt, Bordetella pertussis
gcgcaugccagcuugcaggcg

SEQ ID NO: 313534 - RNA, 22 nt, Bordetella pertussis
gcgcaugccauggccgcgcggc

SEQ ID NO: 313535 - RNA, 13 nt, Bordetella pertussis
gcgcaugcgcacg

SEQ ID NO: 313536 - RNA, 21 nt, Bordetella pertussis
gcgcaugcgccugucccaggc

SEQ ID NO: 313537 - RNA, 22 nt, Bordetella pertussis
gcgcaugcgccugucccaggcg

SEQ ID NO: 313538 - RNA, 19 nt, Bordetella pertussis
gcgcaugcugcgcgaggug

SEQ ID NO: 313539 - RNA, 15 nt, Bordetella pertussis
gcgcauggacgccgc

SEQ ID NO: 313540 - RNA, 17 nt, Bordetella pertussis
gcgcauggacugcaggc

SEQ ID NO: 313541 - RNA, 18 nt, Bordetella pertussis
gcgcauggacugcaggcg

SEQ ID NO: 313542 - RNA, 20 nt, Bordetella pertussis
gcgcauggacugcaggcgcu

SEQ ID NO: 313543 - RNA, 14 nt, Bordetella pertussis
gcgcauggccagca

SEQ ID NO: 313544 - RNA, 14 nt, Bordetella pertussis
gcgcauggccggcg

SEQ ID NO: 313545 - RNA, 14 nt, Bordetella pertussis
gcgcauggcugguc

SEQ ID NO: 313546 - RNA, 21 nt, Bordetella pertussis
gcgcauggcuggucccugcgc

SEQ ID NO: 313547 - RNA, 19 nt, Bordetella pertussis
gcgcaugggaaauccgccg

SEQ ID NO: 313548 - RNA, 15 nt, Bordetella pertussis
gcgcaugggcgcagg

SEQ ID NO: 313549 - RNA, 18 nt, Bordetella pertussis
gcgcaugggcgcaggccg

SEQ ID NO: 313550 - RNA, 20 nt, Bordetella pertussis
gcgcaugggcgcaggccgcc

SEQ ID NO: 313551 - RNA, 16 nt, Bordetella pertussis
gcgccaaaaggcagca

SEQ ID NO: 313552 - RNA, 20 nt, Bordetella pertussis
gcgccaaaaggcagcaggcu

SEQ ID NO: 313553 - RNA, 15 nt, Bordetella pertussis
gcgcauggugagggc

SEQ ID NO: 313554 - RNA, 20 nt, Bordetella pertussis
gcgccaaagcacaggauggc

SEQ ID NO: 313555 - RNA, 18 nt, Bordetella pertussis
gcgccaacccggccucag

SEQ ID NO: 313556 - RNA, 16 nt, Bordetella pertussis
gcgccaagcggcaggc

SEQ ID NO: 313557 - RNA, 19 nt, Bordetella pertussis
gcgccaagcggcaggcggc

SEQ ID NO: 313558 - RNA, 22 nt, Bordetella pertussis
gcgccaagggcgugcgcuugcg

SEQ ID NO: 313559 - RNA, 23 nt, Bordetella pertussis
gcgccaaucagauggcgcagcgg

SEQ ID NO: 313560 - RNA, 21 nt, Bordetella pertussis
gcgccaauuguccuggucgac

SEQ ID NO: 313561 - RNA, 16 nt, Bordetella pertussis
gcgccacacgggcgcc

SEQ ID NO: 313562 - RNA, 15 nt, Bordetella pertussis
gcgccaccuggcgcc

SEQ ID NO: 313563 - RNA, 18 nt, Bordetella pertussis
gcgccaccuggcgcccgg

SEQ ID NO: 313564 - RNA, 20 nt, Bordetella pertussis
gcgccaccuggcgcccggcg

SEQ ID NO: 313565 - RNA, 15 nt, Bordetella pertussis
gcgccacgacgccgu

SEQ ID NO: 313566 - RNA, 20 nt, Bordetella pertussis
gcgccacgacguagucggcg

SEQ ID NO: 313567 - RNA, 23 nt, Bordetella pertussis
gcgccacgaucccgucauggcgg

SEQ ID NO: 313568 - RNA, 13 nt, Bordetella pertussis
gcgccacgccagc

SEQ ID NO: 313569 - RNA, 16 nt, Bordetella pertussis
gcgccacgccagcggc

SEQ ID NO: 313570 - RNA, 17 nt, Bordetella pertussis
gcgccacgccagcggcg

SEQ ID NO: 313571 - RNA, 12 nt, Bordetella pertussis
gcgccacgccca

SEQ ID NO: 313572 - RNA, 13 nt, Bordetella pertussis
gcgccacgcccac

SEQ ID NO: 313573 - RNA, 18 nt, Bordetella pertussis
gcgccacgcccaggccgc

SEQ ID NO: 313574 - RNA, 12 nt, Bordetella pertussis
gcgccacgcccg

SEQ ID NO: 313575 - RNA, 18 nt, Bordetella pertussis
gcgccacgcccuggcggu

SEQ ID NO: 313576 - RNA, 15 nt, Bordetella pertussis
gcgccacgccggcca

SEQ ID NO: 313577 - RNA, 16 nt, Bordetella pertussis
gcgccacgccggccag

SEQ ID NO: 313578 - RNA, 17 nt, Bordetella pertussis
gcgccacgccgucagcg

SEQ ID NO: 313579 - RNA, 21 nt, Bordetella pertussis
gcgccacgcgagcccgcguca

SEQ ID NO: 313580 - RNA, 14 nt, Bordetella pertussis
gcgccacggcgaug

SEQ ID NO: 313581 - RNA, 16 nt, Bordetella pertussis
gcgccacggcggugau

SEQ ID NO: 313582 - RNA, 17 nt, Bordetella pertussis
gcgccacggcgucgccg

SEQ ID NO: 313583 - RNA, 13 nt, Bordetella pertussis
gcgccacggcuuc

SEQ ID NO: 313584 - RNA, 19 nt, Bordetella pertussis
gcgccagaugcgccgcacg

SEQ ID NO: 313585 - RNA, 13 nt, Bordetella pertussis
gcgccagcaccgg

SEQ ID NO: 313586 - RNA, 15 nt, Bordetella pertussis
gcgccagcaccggca

SEQ ID NO: 313587 - RNA, 14 nt, Bordetella pertussis
gcgccagcacggca

SEQ ID NO: 313588 - RNA, 12 nt, Bordetella pertussis
gcgccagcacga

SEQ ID NO: 313589 - RNA, 15 nt, Bordetella pertussis
gcgccagcacgauca

SEQ ID NO: 313590 - RNA, 16 nt, Bordetella pertussis
gcgccagcacgguggc

SEQ ID NO: 313591 - RNA, 18 nt, Bordetella pertussis
gcgccagcagcaggccgu

SEQ ID NO: 313592 - RNA, 21 nt, Bordetella pertussis
gcgccagcagcaggccguaac

SEQ ID NO: 313593 - RNA, 12 nt, Bordetella pertussis
gcgccagcagcg

SEQ ID NO: 313594 - RNA, 13 nt, Bordetella pertussis
gcgccagcagcgc

SEQ ID NO: 313595 - RNA, 18 nt, Bordetella pertussis
gcgccagcagcgccgguu

SEQ ID NO: 313596 - RNA, 14 nt, Bordetella pertussis
gcgccagcaggguc

SEQ ID NO: 313597 - RNA, 16 nt, Bordetella pertussis
gcgccagcaugcgcgc

SEQ ID NO: 313598 - RNA, 18 nt, Bordetella pertussis
gcgccagcaugcgcgcgg

SEQ ID NO: 313599 - RNA, 13 nt, Bordetella pertussis
gcgccagccagcg

SEQ ID NO: 313600 - RNA, 21 nt, Bordetella pertussis
gcgccagccagcgcaugccgu

SEQ ID NO: 313601 - RNA, 18 nt, Bordetella pertussis
gcgccagcccgccgcugg

SEQ ID NO: 313602 - RNA, 21 nt, Bordetella pertussis
gcgccagcccgccgcuggucg

SEQ ID NO: 313603 - RNA, 18 nt, Bordetella pertussis
gcgccagcccgcugccga

SEQ ID NO: 313604 - RNA, 15 nt, Bordetella pertussis
gcgccagcccgcccg

SEQ ID NO: 313605 - RNA, 18 nt, Bordetella pertussis
gcgccagcccgcccgcga

SEQ ID NO: 313606 - RNA, 13 nt, Bordetella pertussis
gcgccagccgcug

SEQ ID NO: 313607 - RNA, 18 nt, Bordetella pertussis
gcgccagccgcugcagcg

SEQ ID NO: 313608 - RNA, 21 nt, Bordetella pertussis
gcgccagccgcugcagcgacu

SEQ ID NO: 313609 - RNA, 19 nt, Bordetella pertussis
gcgccagccgcgcgaccuu

SEQ ID NO: 313610 - RNA, 13 nt, Bordetella pertussis
gcgccagcgccac

SEQ ID NO: 313611 - RNA, 15 nt, Bordetella pertussis
gcgccagcgccacgc

SEQ ID NO: 313612 - RNA, 16 nt, Bordetella pertussis
gcgccagcgccacgcg

SEQ ID NO: 313613 - RNA, 17 nt, Bordetella pertussis
gcgccagcgccagcguc

SEQ ID NO: 313614 - RNA, 14 nt, Bordetella pertussis
gcgccagcgccccg

SEQ ID NO: 313615 - RNA, 20 nt, Bordetella pertussis
gcgccagcgccccggcguau

SEQ ID NO: 313616 - RNA, 12 nt, Bordetella pertussis
gcgccagcgccg

SEQ ID NO: 313617 - RNA, 16 nt, Bordetella pertussis
gcgccagcgccgcgcg

SEQ ID NO: 313618 - RNA, 16 nt, Bordetella pertussis
gcgccagcgccgcguc

SEQ ID NO: 313619 - RNA, 13 nt, Bordetella pertussis
gcgccagcgccgg

SEQ ID NO: 313620 - RNA, 15 nt, Bordetella pertussis
gcgccagcgccggcg

SEQ ID NO: 313621 - RNA, 17 nt, Bordetella pertussis
gcgccagcgccggcgcg

SEQ ID NO: 313622 - RNA, 13 nt, Bordetella pertussis
gcgccagcgcggc

SEQ ID NO: 313623 - RNA, 17 nt, Bordetella pertussis
gcgccagcgcggccagc

SEQ ID NO: 313624 - RNA, 18 nt, Bordetella pertussis
gcgccagcgcggccagcg

SEQ ID NO: 313625 - RNA, 14 nt, Bordetella pertussis
gcgccagcgcggcg

SEQ ID NO: 313626 - RNA, 12 nt, Bordetella pertussis
gcgccagcgcgc

SEQ ID NO: 313627 - RNA, 19 nt, Bordetella pertussis
gcgccagcgcuguccaggc

SEQ ID NO: 313628 - RNA, 16 nt, Bordetella pertussis
gcgccagcggauggug

SEQ ID NO: 313629 - RNA, 12 nt, Bordetella pertussis
gcgccagcggca

SEQ ID NO: 313630 - RNA, 18 nt, Bordetella pertussis
gcgccagcggcauugccc

SEQ ID NO: 313631 - RNA, 17 nt, Bordetella pertussis
gcgccagcggcugcuug

SEQ ID NO: 313632 - RNA, 14 nt, Bordetella pertussis
gcgccagcggccgu

SEQ ID NO: 313633 - RNA, 18 nt, Bordetella pertussis
gcgccagcggcgacugcc

SEQ ID NO: 313634 - RNA, 18 nt, Bordetella pertussis
gcgccagcguucggccac

SEQ ID NO: 313635 - RNA, 18 nt, Bordetella pertussis
gcgccagcuccagccgca

SEQ ID NO: 313636 - RNA, 12 nt, Bordetella pertussis
gcgccagcucgc

SEQ ID NO: 313637 - RNA, 19 nt, Bordetella pertussis
gcgccagcucgcgcagcag

SEQ ID NO: 313638 - RNA, 15 nt, Bordetella pertussis
gcgccagcugcgcag

SEQ ID NO: 313639 - RNA, 18 nt, Bordetella pertussis
gcgccagcugcgcagcga

SEQ ID NO: 313640 - RNA, 20 nt, Bordetella pertussis
gcgccagcugcgcagcgacu

SEQ ID NO: 313641 - RNA, 18 nt, Bordetella pertussis
gcgccagcuggaccgccu

SEQ ID NO: 313642 - RNA, 19 nt, Bordetella pertussis
gcgccagcuggaccgccug

SEQ ID NO: 313643 - RNA, 23 nt, Bordetella pertussis
gcgccagcuggaccgccuggccu

SEQ ID NO: 313644 - RNA, 13 nt, Bordetella pertussis
gcgccagcugggc

SEQ ID NO: 313645 - RNA, 14 nt, Bordetella pertussis
gcgccagcugggcg

SEQ ID NO: 313646 - RNA, 15 nt, Bordetella pertussis
gcgccagcugggcga

SEQ ID NO: 313647 - RNA, 15 nt, Bordetella pertussis
gcgccagcuugcgcg

SEQ ID NO: 313648 - RNA, 17 nt, Bordetella pertussis
gcgccagcuugcgcgcc

SEQ ID NO: 313649 - RNA, 15 nt, Bordetella pertussis
gcgccaggaacagcg

SEQ ID NO: 313650 - RNA, 17 nt, Bordetella pertussis
gcgccaggaacagcgcc

SEQ ID NO: 313651 - RNA, 19 nt, Bordetella pertussis
gcgccaggaacagcgccgg

SEQ ID NO: 313652 - RNA, 21 nt, Bordetella pertussis
gcgccaggaacagcgccggca

SEQ ID NO: 313653 - RNA, 17 nt, Bordetella pertussis
gcgccaggaagcgcgcc

SEQ ID NO: 313654 - RNA, 18 nt, Bordetella pertussis
gcgccaggaagcgcgccg

SEQ ID NO: 313655 - RNA, 22 nt, Bordetella pertussis
gcgccaggauggccacgaccac

SEQ ID NO: 313656 - RNA, 21 nt, Bordetella pertussis
gcgccaggcaaaggcccaggc

SEQ ID NO: 313657 - RNA, 13 nt, Bordetella pertussis
gcgccaggcccag

SEQ ID NO: 313658 - RNA, 16 nt, Bordetella pertussis
gcgccaggccccgccg

SEQ ID NO: 313659 - RNA, 12 nt, Bordetella pertussis
gcgccaggccgc

SEQ ID NO: 313660 - RNA, 13 nt, Bordetella pertussis
gcgccaggccgcg

SEQ ID NO: 313661 - RNA, 14 nt, Bordetella pertussis
gcgccaggccgcgc

SEQ ID NO: 313662 - RNA, 16 nt, Bordetella pertussis
gcgccaggccgcgcag

SEQ ID NO: 313663 - RNA, 13 nt, Bordetella pertussis
gcgccaggccggc

SEQ ID NO: 313664 - RNA, 18 nt, Bordetella pertussis
gcgccaggccggcggcga

SEQ ID NO: 313665 - RNA, 20 nt, Bordetella pertussis
gcgccaggccuucgacgucc

SEQ ID NO: 313666 - RNA, 14 nt, Bordetella pertussis
gcgccaggcgcgca

SEQ ID NO: 313667 - RNA, 15 nt, Bordetella pertussis
gcgccaggcgcgcau

SEQ ID NO: 313668 - RNA, 20 nt, Bordetella pertussis
gcgccaggcgcgcaucgcgc

SEQ ID NO: 313669 - RNA, 16 nt, Bordetella pertussis
gcgccaggcgcucggc

SEQ ID NO: 313670 - RNA, 16 nt, Bordetella pertussis
gcgccaggcgguacag

SEQ ID NO: 313671 - RNA, 18 nt, Bordetella pertussis
gcgccaggcgguacaggc

SEQ ID NO: 313672 - RNA, 22 nt, Bordetella pertussis
gcgccaggcgguacaggccggc

SEQ ID NO: 313673 - RNA, 15 nt, Bordetella pertussis
gcgccaggcggucau

SEQ ID NO: 313674 - RNA, 13 nt, Bordetella pertussis
gcgccaggcguug

SEQ ID NO: 313675 - RNA, 23 nt, Bordetella pertussis
gcgccaggcguugaccuggucga

SEQ ID NO: 313676 - RNA, 22 nt, Bordetella pertussis
gcgccaggcugaaugccgccgu

SEQ ID NO: 313677 - RNA, 14 nt, Bordetella pertussis
gcgccaggcgccgg

SEQ ID NO: 313678 - RNA, 18 nt, Bordetella pertussis
gcgccaggcugucgucgu

SEQ ID NO: 313679 - RNA, 16 nt, Bordetella pertussis
gcgccaggcuuugggc

SEQ ID NO: 313680 - RNA, 13 nt, Bordetella pertussis
gcgccagggccag

SEQ ID NO: 313681 - RNA, 15 nt, Bordetella pertussis
gcgccagggccaggc

SEQ ID NO: 313682 - RNA, 16 nt, Bordetella pertussis
gcgccagggccaggcc

SEQ ID NO: 313683 - RNA, 17 nt, Bordetella pertussis
gcgccagggccaggccg

SEQ ID NO: 313684 - RNA, 19 nt, Bordetella pertussis
gcgccagggccaggccgcc

SEQ ID NO: 313685 - RNA, 21 nt, Bordetella pertussis
gcgccagggccccuccggcgc

SEQ ID NO: 313686 - RNA, 23 nt, Bordetella pertussis
gcgccagggccccuccggcgccg

SEQ ID NO: 313687 - RNA, 15 nt, Bordetella pertussis
gcgccagggccgccg

SEQ ID NO: 313688 - RNA, 18 nt, Bordetella pertussis
gcgccagggccgccgcgc

SEQ ID NO: 313689 - RNA, 16 nt, Bordetella pertussis
gcgccaggggaugacg

SEQ ID NO: 313690 - RNA, 12 nt, Bordetella pertussis
gcgccagggugc

SEQ ID NO: 313691 - RNA, 13 nt, Bordetella pertussis
gcgccagggugcc

SEQ ID NO: 313692 - RNA, 20 nt, Bordetella pertussis
gcgccagggugccgaaaccc

SEQ ID NO: 313693 - RNA, 18 nt, Bordetella pertussis
gcgccagguaggccggcg

SEQ ID NO: 313694 - RNA, 19 nt, Bordetella pertussis
gcgccagguaggccggcgc

SEQ ID NO: 313695 - RNA, 22 nt, Bordetella pertussis
gcgccagguaggccggcgcgac

SEQ ID NO: 313696 - RNA, 19 nt, Bordetella pertussis
gcgccaggucgcgcaccag

SEQ ID NO: 313697 - RNA, 21 nt, Bordetella pertussis
gcgccaggucgcgcaccaggu

SEQ ID NO: 313698 - RNA, 18 nt, Bordetella pertussis
gcgccaugaucgccggca

SEQ ID NO: 313699 - RNA, 16 nt, Bordetella pertussis
gcgccaugaugucgcg

SEQ ID NO: 313700 - RNA, 21 nt, Bordetella pertussis
gcgccaugaugucgcgcgccu

SEQ ID NO: 313701 - RNA, 22 nt, Bordetella pertussis
gcgccaugcaacacgaccagca

SEQ ID NO: 313702 - RNA, 23 nt, Bordetella pertussis
gcgccaugcaacacgaccagcag

SEQ ID NO: 313703 - RNA, 14 nt, Bordetella pertussis
gcgccaugccggga

SEQ ID NO: 313704 - RNA, 18 nt, Bordetella pertussis
gcgccaugccgggauggg

SEQ ID NO: 313705 - RNA, 16 nt, Bordetella pertussis
gcgccaugcgacagcc

SEQ ID NO: 313706 - RNA, 20 nt, Bordetella pertussis
gcgccaugcgacagcccggg

SEQ ID NO: 313707 - RNA, 15 nt, Bordetella pertussis
gcgccaugcgcacca

SEQ ID NO: 313708 - RNA, 16 nt, Bordetella pertussis
gcgccaugcgcaccac

SEQ ID NO: 313709 - RNA, 18 nt, Bordetella pertussis
gcgccaugcgcaccaccg

SEQ ID NO: 313710 - RNA, 20 nt, Bordetella pertussis
gcgccaugcgcaccaccgcc

SEQ ID NO: 313711 - RNA, 14 nt, Bordetella pertussis
gcgccaugcgcccg

SEQ ID NO: 313712 - RNA, 18 nt, Bordetella pertussis
gcgccaugcgcccggcca

SEQ ID NO: 313713 - RNA, 21 nt, Bordetella pertussis
gcgccaugcggaugaacgacc

SEQ ID NO: 313714 - RNA, 22 nt, Bordetella pertussis
gcgccaugcucgcgcacagcgc

SEQ ID NO: 313715 - RNA, 17 nt, Bordetella pertussis
gcgccaugcuggccgcc

SEQ ID NO: 313716 - RNA, 17 nt, Bordetella pertussis
gcgccauggccggccgc

SEQ ID NO: 313717 - RNA, 23 nt, Bordetella pertussis
gcgccauggucucccccucggcc

SEQ ID NO: 313718 - RNA, 20 nt, Bordetella pertussis
gcgccaugucgacgaucucg

SEQ ID NO: 313719 - RNA, 17 nt, Bordetella pertussis
gcgccaugugcguugcc

SEQ ID NO: 313720 - RNA, 15 nt, Bordetella pertussis
gcgccauguggcgac

SEQ ID NO: 313721 - RNA, 13 nt, Bordetella pertussis
gcgcccacggccg

SEQ ID NO: 313722 - RNA, 15 nt, Bordetella pertussis
gcgcccacggccgca

SEQ ID NO: 313723 - RNA, 13 nt, Bordetella pertussis
gcgcccacggccu

SEQ ID NO: 313724 - RNA, 16 nt, Bordetella pertussis
gcgcccagaucgaucc

SEQ ID NO: 313725 - RNA, 13 nt, Bordetella pertussis
gcgcccagcagcg

SEQ ID NO: 313726 - RNA, 15 nt, Bordetella pertussis
gcgcccagcagcgcc

SEQ ID NO: 313727 - RNA, 16 nt, Bordetella pertussis
gcgcccagcagcgcca

SEQ ID NO: 313728 - RNA, 12 nt, Bordetella pertussis
gcgcccagccgc

SEQ ID NO: 313729 - RNA, 16 nt, Bordetella pertussis
gcgcccagccgcgcca

SEQ ID NO: 313730 - RNA, 21 nt, Bordetella pertussis
gcgcccagccgcgccaucacg

SEQ ID NO: 313731 - RNA, 15 nt, Bordetella pertussis
gcgcccagcgagcug

SEQ ID NO: 313732 - RNA, 20 nt, Bordetella pertussis
gcgcccagcgagcugcgcug

SEQ ID NO: 313733 - RNA, 13 nt, Bordetella pertussis
gcgcccagcgcgg

SEQ ID NO: 313734 - RNA, 15 nt, Bordetella pertussis
gcgcccagcgcggcc

SEQ ID NO: 313735 - RNA, 16 nt, Bordetella pertussis
gcgcccagcgcggccu

SEQ ID NO: 313736 - RNA, 13 nt, Bordetella pertussis
gcgcccagcgcgu

SEQ ID NO: 313737 - RNA, 19 nt, Bordetella pertussis
gcgcccagcgcgucggcca

SEQ ID NO: 313738 - RNA, 16 nt, Bordetella pertussis
gcgcccagcggcaggc

SEQ ID NO: 313739 - RNA, 22 nt, Bordetella pertussis
gcgcccagcggcaggcuggccg

SEQ ID NO: 313740 - RNA, 19 nt, Bordetella pertussis
gcgcccagcgcgccggggg

SEQ ID NO: 313741 - RNA, 14 nt, Bordetella pertussis
gcgcccauggcgcg

SEQ ID NO: 313742 - RNA, 16 nt, Bordetella pertussis
gcgcccauggcgcgca

SEQ ID NO: 313743 - RNA, 17 nt, Bordetella pertussis
gcgcccauuucgauggc

SEQ ID NO: 313744 - RNA, 22 nt, Bordetella pertussis
gcgcccauuucgauggccaggg

SEQ ID NO: 313745 - RNA, 19 nt, Bordetella pertussis
gcgccccaacgcggccagc

SEQ ID NO: 313746 - RNA, 13 nt, Bordetella pertussis
gcgccccacccgg

SEQ ID NO: 313747 - RNA, 17 nt, Bordetella pertussis
gcgcccccagcgccguc

SEQ ID NO: 313748 - RNA, 18 nt, Bordetella pertussis
gcgcccccagcgccguca

SEQ ID NO: 313749 - RNA, 17 nt, Bordetella pertussis
gcgccccgaucggcgcc

SEQ ID NO: 313750 - RNA, 15 nt, Bordetella pertussis
gcgcccgccgcgcca

SEQ ID NO: 313751 - RNA, 16 nt, Bordetella pertussis
gcgcccgccgcgccau

SEQ ID NO: 313752 - RNA, 18 nt, Bordetella pertussis
gcgcccgccgcgccaugc

SEQ ID NO: 313753 - RNA, 21 nt, Bordetella pertussis
gcgcccgccgcgucggcgccg

SEQ ID NO: 313754 - RNA, 17 nt, Bordetella pertussis
gcgcccccacgccgcug

SEQ ID NO: 313755 - RNA, 13 nt, Bordetella pertussis
gcgcccgccuuca

SEQ ID NO: 313756 - RNA, 15 nt, Bordetella pertussis
gcgcccgccuucagc

SEQ ID NO: 313757 - RNA, 18 nt, Bordetella pertussis
gcgcccgcgccaucgcgu

SEQ ID NO: 313758 - RNA, 19 nt, Bordetella pertussis
gcgcccgcgccaucgcguc

SEQ ID NO: 313759 - RNA, 19 nt, Bordetella pertussis
gcgcccgcgcgcgagcugc

SEQ ID NO: 313760 - RNA, 21 nt, Bordetella pertussis
gcgcccgcgcgcgagcugcgc

SEQ ID NO: 313761 - RNA, 20 nt, Bordetella pertussis
gcgcccgccugcgccagccg

SEQ ID NO: 313762 - RNA, 14 nt, Bordetella pertussis
gcgcccgcuugcgc

SEQ ID NO: 313763 - RNA, 15 nt, Bordetella pertussis
gcgcccggcgccgcg

SEQ ID NO: 313764 - RNA, 18 nt, Bordetella pertussis
gcgcccggcgccgcgcgc

SEQ ID NO: 313765 - RNA, 12 nt, Bordetella pertussis
gcgcccggcggc

SEQ ID NO: 313766 - RNA, 16 nt, Bordetella pertussis
gcgcccggcggccagg

SEQ ID NO: 313767 - RNA, 17 nt, Bordetella pertussis
gcgcccggcggcgcgcu

SEQ ID NO: 313768 - RNA, 20 nt, Bordetella pertussis
gcgcccggcgugacgcugac

SEQ ID NO: 313769 - RNA, 14 nt, Bordetella pertussis
gcgcccgggcugcc

SEQ ID NO: 313770 - RNA, 16 nt, Bordetella pertussis
gcgcccggugcgcgca

SEQ ID NO: 313771 - RNA, 16 nt, Bordetella pertussis
gcgcccguccacggcc

SEQ ID NO: 313772 - RNA, 18 nt, Bordetella pertussis
gcgcccguccacggccug

SEQ ID NO: 313773 - RNA, 19 nt, Bordetella pertussis
gcgcccucaguccagcugg

SEQ ID NO: 313774 - RNA, 20 nt, Bordetella pertussis
gcgcccucguugacgccgac

SEQ ID NO: 313775 - RNA, 21 nt, Bordetella pertussis
gcgcccucguugacgccgacg

SEQ ID NO: 313776 - RNA, 18 nt, Bordetella pertussis
gcgcccucuuucgccgcg

SEQ ID NO: 313777 - RNA, 21 nt, Bordetella pertussis
gcgcccucuuucgccgcgcgc

SEQ ID NO: 313778 - RNA, 15 nt, Bordetella pertussis
gcgcccugcacgcgc

SEQ ID NO: 313779 - RNA, 22 nt, Bordetella pertussis
gcgcccugcacgcgcgcgugca

SEQ ID NO: 313780 - RNA, 16 nt, Bordetella pertussis
gcgcccugcagggcau

SEQ ID NO: 313781 - RNA, 19 nt, Bordetella pertussis
gcgcccugcagggcauggg

SEQ ID NO: 313782 - RNA, 22 nt, Bordetella pertussis
gcgcccugcgaacccgccgcga

SEQ ID NO: 313783 - RNA, 21 nt, Bordetella pertussis
gcgcccuggcgccgcggccgg

SEQ ID NO: 313784 - RNA, 21 nt, Bordetella pertussis
gcgcccuggcgcggcggcguc

SEQ ID NO: 313785 - RNA, 21 nt, Bordetella pertussis
gcgcccuggggcgcgguccgg

SEQ ID NO: 313786 - RNA, 13 nt, Bordetella pertussis
gcgccgaacgcgc

SEQ ID NO: 313787 - RNA, 14 nt, Bordetella pertussis
gcgccgaacgcgca

SEQ ID NO: 313788 - RNA, 15 nt, Bordetella pertussis
gcgccgaagcgcagg

SEQ ID NO: 313789 - RNA, 15 nt, Bordetella pertussis
gcgccgaaggcggcg

SEQ ID NO: 313790 - RNA, 14 nt, Bordetella pertussis
gcgccgaagucggc

SEQ ID NO: 313791 - RNA, 14 nt, Bordetella pertussis
gcgccgacaacggc

SEQ ID NO: 313792 - RNA, 19 nt, Bordetella pertussis
gcgccgacaacggcgugcu

SEQ ID NO: 313793 - RNA, 22 nt, Bordetella pertussis
gcgccgacagguaggcgccggu

SEQ ID NO: 313794 - RNA, 12 nt, Bordetella pertussis
gcgccgaccacg

SEQ ID NO: 313795 - RNA, 18 nt, Bordetella pertussis
gcgccgaccacgcugggc

SEQ ID NO: 313796 - RNA, 21 nt, Bordetella pertussis
gcgccgaccacgcugggccag

SEQ ID NO: 313797 - RNA, 16 nt, Bordetella pertussis
gcgccgacggcauggc

SEQ ID NO: 313798 - RNA, 17 nt, Bordetella pertussis
gcgccgacggcauggcc

SEQ ID NO: 313799 - RNA, 17 nt, Bordetella pertussis
gcgccgacggcggcgcg

SEQ ID NO: 313800 - RNA, 18 nt, Bordetella pertussis
gcgccgacgggccgguca

SEQ ID NO: 313801 - RNA, 17 nt, Bordetella pertussis
gcgccgagauggacgcg

SEQ ID NO: 313802 - RNA, 13 nt, Bordetella pertussis
gcgccgagcgcca

SEQ ID NO: 313803 - RNA, 14 nt, Bordetella pertussis
gcgccgagcgccag

SEQ ID NO: 313804 - RNA, 22 nt, Bordetella pertussis
gcgccgaggaucuggccggcgc

SEQ ID NO: 313805 - RNA, 24 nt, Bordetella pertussis
gcgccgagggccgcgcgauccugg

SEQ ID NO: 313806 - RNA, 13 nt, Bordetella pertussis
gcgccgaugcgcc

SEQ ID NO: 313807 - RNA, 13 nt, Bordetella pertussis
gcgccgauggcgc

SEQ ID NO: 313808 - RNA, 14 nt, Bordetella pertussis
gcgccgauggcgcc

SEQ ID NO: 313809 - RNA, 18 nt, Bordetella pertussis
gcgccgauggugcgggcg

SEQ ID NO: 313810 - RNA, 17 nt, Bordetella pertussis
gcgccgcaacgccgccg

SEQ ID NO: 313811 - RNA, 21 nt, Bordetella pertussis
gcgccgcaacgccgccggcag

SEQ ID NO: 313812 - RNA, 16 nt, Bordetella pertussis
gcgccgcaacgccggg

SEQ ID NO: 313813 - RNA, 19 nt, Bordetella pertussis
gcgccgcaacaggcagcug

SEQ ID NO: 313814 - RNA, 16 nt, Bordetella pertussis
gcgccgcaauagauca

SEQ ID NO: 313815 - RNA, 14 nt, Bordetella pertussis
gcgccgcaugcggc

SEQ ID NO: 313816 - RNA, 21 nt, Bordetella pertussis
gcgccgccacaggcugacgcc

SEQ ID NO: 313817 - RNA, 21 nt, Bordetella pertussis
gcgccgccagcauggcggcca

SEQ ID NO: 313818 - RNA, 12 nt, Bordetella pertussis
gcgccgccagcc

SEQ ID NO: 313819 - RNA, 13 nt, Bordetella pertussis
gcgccgccagccg

SEQ ID NO: 313820 - RNA, 15 nt, Bordetella pertussis
gcgccgccagccgcu

SEQ ID NO: 313821 - RNA, 20 nt, Bordetella pertussis
gcgccgccagccgcuggcgc

SEQ ID NO: 313822 - RNA, 21 nt, Bordetella pertussis
gcgccgccagccgcuggcgcg

SEQ ID NO: 313823 - RNA, 13 nt, Bordetella pertussis
gcgccgccaccuc

SEQ ID NO: 313824 - RNA, 19 nt, Bordetella pertussis
gcgccgccagcgcgcgcga

SEQ ID NO: 313825 - RNA, 14 nt, Bordetella pertussis
gcgccgccaggccg

SEQ ID NO: 313826 - RNA, 22 nt, Bordetella pertussis
gcgccgcgggcugcgacaggcg

SEQ ID NO: 313827 - RNA, 14 nt, Bordetella pertussis
gcgccgcgucaacu

SEQ ID NO: 313828 - RNA, 19 nt, Bordetella pertussis
gcgccgcgucauggcgugc

SEQ ID NO: 313829 - RNA, 15 nt, Bordetella pertussis
gcgccgcguccggcg

SEQ ID NO: 313830 - RNA, 16 nt, Bordetella pertussis
gcgccgcguccggcgc

SEQ ID NO: 313831 - RNA, 18 nt, Bordetella pertussis
gcgccgcguccggcgccc

SEQ ID NO: 313832 - RNA, 18 nt, Bordetella pertussis
gcgccgcgucgagcgcga

SEQ ID NO: 313833 - RNA, 19 nt, Bordetella pertussis
gcgccgcgugguggcgcag

SEQ ID NO: 313834 - RNA, 23 nt, Bordetella pertussis
gcgccgcgugguggcgcagaugg

SEQ ID NO: 313835 - RNA, 23 nt, Bordetella pertussis
gcgccgcguucacgccggcgcgc

SEQ ID NO: 313836 - RNA, 16 nt, Bordetella pertussis
gcgccgcgucuucggc

SEQ ID NO: 313837 - RNA, 19 nt, Bordetella pertussis
gcgccgcgucuucggcgcg

SEQ ID NO: 313838 - RNA, 14 nt, Bordetella pertussis
gcgccgcuacgcgg

SEQ ID NO: 313839 - RNA, 13 nt, Bordetella pertussis
gcgccgcucagcg

SEQ ID NO: 313840 - RNA, 14 nt, Bordetella pertussis
gcgccgcucagcgc

SEQ ID NO: 313841 - RNA, 16 nt, Bordetella pertussis
gcgccgcucagcgcgg

SEQ ID NO: 313842 - RNA, 16 nt, Bordetella pertussis
gcgccgcucuuggcgu

SEQ ID NO: 313843 - RNA, 18 nt, Bordetella pertussis
gcgccgcucuuggcgugu

SEQ ID NO: 313844 - RNA, 14 nt, Bordetella pertussis
gcgccgcugcagcg

SEQ ID NO: 313845 - RNA, 16 nt, Bordetella pertussis
gcgccgcugcagcgcu

SEQ ID NO: 313846 - RNA, 18 nt, Bordetella pertussis
gcgccgcugcagcgcugg

SEQ ID NO: 313847 - RNA, 17 nt, Bordetella pertussis
gcgccgcuggcggccgc

SEQ ID NO: 313848 - RNA, 22 nt, Bordetella pertussis
gcgccgcuggcggccgcgggcg

SEQ ID NO: 313849 - RNA, 13 nt, Bordetella pertussis
gcgccgcuggcgu

SEQ ID NO: 313850 - RNA, 15 nt, Bordetella pertussis
gcgccgcuggcgucc

SEQ ID NO: 313851 - RNA, 18 nt, Bordetella pertussis
gcgccgcuggcguccagg

SEQ ID NO: 313852 - RNA, 13 nt, Bordetella pertussis
gcgccgcuggcca

SEQ ID NO: 313853 - RNA, 12 nt, Bordetella pertussis
gcgccgcuggcg

SEQ ID NO: 313854 - RNA, 15 nt, Bordetella pertussis
gcgccgcuuccggca

SEQ ID NO: 313855 - RNA, 21 nt, Bordetella pertussis
gcgccgcuguggacgccgccg

SEQ ID NO: 313856 - RNA, 18 nt, Bordetella pertussis
gcgccgcuguugcccacc

SEQ ID NO: 313857 - RNA, 18 nt, Bordetella pertussis
gcgccggaacauggcggu

SEQ ID NO: 313858 - RNA, 19 nt, Bordetella pertussis
gcgccgcuuucucccgccg

SEQ ID NO: 313859 - RNA, 17 nt, Bordetella pertussis
gcgccggacaucagcca

SEQ ID NO: 313860 - RNA, 23 nt, Bordetella pertussis
gcgccggacaucagccauugcgu

SEQ ID NO: 313861 - RNA, 13 nt, Bordetella pertussis
gcgccggcagccc

SEQ ID NO: 313862 - RNA, 22 nt, Bordetella pertussis
gcgccggcagccccagcgccca

SEQ ID NO: 313863 - RNA, 14 nt, Bordetella pertussis
gcgccggcagcgca

SEQ ID NO: 313864 - RNA, 13 nt, Bordetella pertussis
gcgccggcagggc

SEQ ID NO: 313865 - RNA, 15 nt, Bordetella pertussis
gcgccggcagggcgg

SEQ ID NO: 313866 - RNA, 18 nt, Bordetella pertussis
gcgccggcagggcggcca

SEQ ID NO: 313867 - RNA, 22 nt, Bordetella pertussis
gcgccggcagggcggccaggcc

SEQ ID NO: 313868 - RNA, 23 nt, Bordetella pertussis
gcgccggcagggcggccaggccg

SEQ ID NO: 313869 - RNA, 18 nt, Bordetella pertussis
gcgccggcagggugcugu

SEQ ID NO: 313870 - RNA, 17 nt, Bordetella pertussis
gcgccggcaucggcggc

SEQ ID NO: 313871 - RNA, 19 nt, Bordetella pertussis
gcgccggcaucggcggcuu

SEQ ID NO: 313872 - RNA, 22 nt, Bordetella pertussis
gcgccggcaugaagcgcagcag

SEQ ID NO: 313873 - RNA, 13 nt, Bordetella pertussis
gcgccggcauggc

SEQ ID NO: 313874 - RNA, 15 nt, Bordetella pertussis
gcgccggcauggcca

SEQ ID NO: 313875 - RNA, 16 nt, Bordetella pertussis
gcgccggccagcgcgc

SEQ ID NO: 313876 - RNA, 19 nt, Bordetella pertussis
gcgccggccagcgcgccgg

SEQ ID NO: 313877 - RNA, 20 nt, Bordetella pertussis
gcgccggccagcgcgccggc

SEQ ID NO: 313878 - RNA, 15 nt, Bordetella pertussis
gcgccggccaggaug

SEQ ID NO: 313879 - RNA, 22 nt, Bordetella pertussis
gcgccggccaggaugagggcga

SEQ ID NO: 313880 - RNA, 13 nt, Bordetella pertussis
gcgccggccaggc

SEQ ID NO: 313881 - RNA, 13 nt, Bordetella pertussis
gcgccggccaggg

SEQ ID NO: 313882 - RNA, 16 nt, Bordetella pertussis
gcgccggccagggcca

SEQ ID NO: 313883 - RNA, 19 nt, Bordetella pertussis
gcgccggccagggccacca

SEQ ID NO: 313884 - RNA, 12 nt, Bordetella pertussis
gcgccggcccag

SEQ ID NO: 313885 - RNA, 13 nt, Bordetella pertussis
gcgccggccgcca

SEQ ID NO: 313886 - RNA, 21 nt, Bordetella pertussis
gcgccggccgccagcaaggcg

SEQ ID NO: 313887 - RNA, 13 nt, Bordetella pertussis
gcgccggccgccc

SEQ ID NO: 313888 - RNA, 13 nt, Bordetella pertussis
gcgccggccgcgc

SEQ ID NO: 313889 - RNA, 15 nt, Bordetella pertussis
gcgccggccgcgcgc

SEQ ID NO: 313890 - RNA, 17 nt, Bordetella pertussis
gcgccggccgcgcgcgc

SEQ ID NO: 313891 - RNA, 17 nt, Bordetella pertussis
gcgccggcccaggcgcg

SEQ ID NO: 313892 - RNA, 12 nt, Bordetella pertussis
gcgccggcccgc

SEQ ID NO: 313893 - RNA, 18 nt, Bordetella pertussis
gcgccggccgacaggugg

SEQ ID NO: 313894 - RNA, 12 nt, Bordetella pertussis
gcgccggccgcc

SEQ ID NO: 313895 - RNA, 16 nt, Bordetella pertussis
gcgccggccgcggggc

SEQ ID NO: 313896 - RNA, 20 nt, Bordetella pertussis
gcgccggccgcggggcuggc

SEQ ID NO: 313897 - RNA, 13 nt, Bordetella pertussis
gcgccggccguca

SEQ ID NO: 313898 - RNA, 12 nt, Bordetella pertussis
gcgccggccugc

SEQ ID NO: 313899 - RNA, 18 nt, Bordetella pertussis
gcgccggccugcgccggg

SEQ ID NO: 313900 - RNA, 20 nt, Bordetella pertussis
gcgccggccugcgccgggcg

SEQ ID NO: 313901 - RNA, 13 nt, Bordetella pertussis
gcgccggccuggc

SEQ ID NO: 313902 - RNA, 15 nt, Bordetella pertussis
gcgccggccuggcgc

SEQ ID NO: 313903 - RNA, 18 nt, Bordetella pertussis
gcgccggccuggcgcgac

SEQ ID NO: 313904 - RNA, 16 nt, Bordetella pertussis
gcgccggccugggcgg

SEQ ID NO: 313905 - RNA, 12 nt, Bordetella pertussis
gcgccggcgcau

SEQ ID NO: 313906 - RNA, 14 nt, Bordetella pertussis
gcgccggcgcauga

SEQ ID NO: 313907 - RNA, 21 nt, Bordetella pertussis
gcgccggcgcaugagccggca

SEQ ID NO: 313908 - RNA, 13 nt, Bordetella pertussis
gcgccggcgcccg

SEQ ID NO: 313909 - RNA, 18 nt, Bordetella pertussis
gcgccggcgccggcgcgc

SEQ ID NO: 313910 - RNA, 16 nt, Bordetella pertussis
gcgccggcgccuuggc

SEQ ID NO: 313911 - RNA, 14 nt, Bordetella pertussis
gcgccggcgcgcga

SEQ ID NO: 313912 - RNA, 19 nt, Bordetella pertussis
gcgccggcgcgcgaucucg

SEQ ID NO: 313913 - RNA, 15 nt, Bordetella pertussis
gcgccggcgcggcgg

SEQ ID NO: 313914 - RNA, 19 nt, Bordetella pertussis
gcgccggcuaccgcgccau

SEQ ID NO: 313915 - RNA, 15 nt, Bordetella pertussis
gcgccggcucagccc

SEQ ID NO: 313916 - RNA, 20 nt, Bordetella pertussis
gcgccggcuccgauagcggc

SEQ ID NO: 313917 - RNA, 18 nt, Bordetella pertussis
gcgccggcucccgcgcug

SEQ ID NO: 313918 - RNA, 12 nt, Bordetella pertussis
gcgccggcuggc

SEQ ID NO: 313919 - RNA, 19 nt, Bordetella pertussis
gcgccggcuggcaugcggc

SEQ ID NO: 313920 - RNA, 15 nt, Bordetella pertussis
gcgccggcugggcgu

SEQ ID NO: 313921 - RNA, 21 nt, Bordetella pertussis
gcgccgggaaaaagagccugu

SEQ ID NO: 313922 - RNA, 14 nt, Bordetella pertussis
gcgccgggcagccc

SEQ ID NO: 313923 - RNA, 14 nt, Bordetella pertussis
gcgccgggccacga

SEQ ID NO: 313924 - RNA, 13 nt, Bordetella pertussis
gcgccgggccaga

SEQ ID NO: 313925 - RNA, 15 nt, Bordetella pertussis
gcgccgggccagacc

SEQ ID NO: 313926 - RNA, 14 nt, Bordetella pertussis
gcgccgggccggcg

SEQ ID NO: 313927 - RNA, 15 nt, Bordetella pertussis
gcgccgggcgaaccg

SEQ ID NO: 313928 - RNA, 13 nt, Bordetella pertussis
gcgccgggcggau

SEQ ID NO: 313929 - RNA, 14 nt, Bordetella pertussis
gcgccgggcgacgg

SEQ ID NO: 313930 - RNA, 15 nt, Bordetella pertussis
gcgccgggcgacggc

SEQ ID NO: 313931 - RNA, 16 nt, Bordetella pertussis
gcgccgggcgccgcgc

SEQ ID NO: 313932 - RNA, 17 nt, Bordetella pertussis
gcgccgggcgccgcgcc

SEQ ID NO: 313933 - RNA, 20 nt, Bordetella pertussis
gcgccgggcgcggccaggcg

SEQ ID NO: 313934 - RNA, 21 nt, Bordetella pertussis
gcgccgggcgcggccaggcgc

SEQ ID NO: 313935 - RNA, 21 nt, Bordetella pertussis
gcgccggguguuccggcgcgc

SEQ ID NO: 313936 - RNA, 14 nt, Bordetella pertussis
gcgccggucaggcg

SEQ ID NO: 313937 - RNA, 15 nt, Bordetella pertussis
gcgccggucaggcgu

SEQ ID NO: 313938 - RNA, 13 nt, Bordetella pertussis
gcgccgguccagc

SEQ ID NO: 313939 - RNA, 19 nt, Bordetella pertussis
gcgccgguccagcgcccga

SEQ ID NO: 313940 - RNA, 15 nt, Bordetella pertussis
gcgccggucgccgcg

SEQ ID NO: 313941 - RNA, 18 nt, Bordetella pertussis
gcgccguccgagcccgac

SEQ ID NO: 313942 - RNA, 20 nt, Bordetella pertussis
gcgccguccgagcccgacgc

SEQ ID NO: 313943 - RNA, 15 nt, Bordetella pertussis
gcgccguccucaggc

SEQ ID NO: 313944 - RNA, 20 nt, Bordetella pertussis
gcgccgucgaacuccugcag

SEQ ID NO: 313945 - RNA, 14 nt, Bordetella pertussis
gcgccgucgaagcc

SEQ ID NO: 313946 - RNA, 21 nt, Bordetella pertussis
gcgccgucgaagccggcgcca

SEQ ID NO: 313947 - RNA, 21 nt, Bordetella pertussis
gcgccgucgaucccaucgcgc

SEQ ID NO: 313948 - RNA, 14 nt, Bordetella pertussis
gcgccgucgcgcug

SEQ ID NO: 313949 - RNA, 17 nt, Bordetella pertussis
gcgccgugcagacggcg

SEQ ID NO: 313950 - RNA, 22 nt, Bordetella pertussis
gcgccgugcagacggcggcugg

SEQ ID NO: 313951 - RNA, 17 nt, Bordetella pertussis
gcgccgugacguugagc

SEQ ID NO: 313952 - RNA, 18 nt, Bordetella pertussis
gcgccgugacguugagcg

SEQ ID NO: 313953 - RNA, 14 nt, Bordetella pertussis
gcgccgugcccgac

SEQ ID NO: 313954 - RNA, 16 nt, Bordetella pertussis
gcgccgugcccgacgg

SEQ ID NO: 313955 - RNA, 15 nt, Bordetella pertussis
gcgccgugcccggcg

SEQ ID NO: 313956 - RNA, 19 nt, Bordetella pertussis
gcgccgugcuggaggugcc

SEQ ID NO: 313957 - RNA, 22 nt, Bordetella pertussis
gcgccguucagggacgggccag

SEQ ID NO: 313958 - RNA, 22 nt, Bordetella pertussis
gcgccguucaugcgucgaacgg

SEQ ID NO: 313959 - RNA, 21 nt, Bordetella pertussis
gcgccguuccugcagcgugcu

SEQ ID NO: 313960 - RNA, 17 nt, Bordetella pertussis
gcgccguucggaguagu

SEQ ID NO: 313961 - RNA, 23 nt, Bordetella pertussis
gcgccguucggaguaguugucgu

SEQ ID NO: 313962 - RNA, 20 nt, Bordetella pertussis
gcgccguucgucgcgcagca

SEQ ID NO: 313963 - RNA, 20 nt, Bordetella pertussis
gcgccguugcgggcugcgcg

SEQ ID NO: 313964 - RNA, 19 nt, Bordetella pertussis
gcgccguuuucagcgcagg

SEQ ID NO: 313965 - RNA, 19 nt, Bordetella pertussis
gcgccuacacgguggcggu

SEQ ID NO: 313966 - RNA, 13 nt, Bordetella pertussis
gcgccuaccggcg

SEQ ID NO: 313967 - RNA, 14 nt, Bordetella pertussis
gcgccuaccggcgc

SEQ ID NO: 313968 - RNA, 15 nt, Bordetella pertussis
gcgccuaccggcgcc

SEQ ID NO: 313969 - RNA, 14 nt, Bordetella pertussis
gcgccuacggcggc

SEQ ID NO: 313970 - RNA, 20 nt, Bordetella pertussis
gcgccuacggcggcggccau

SEQ ID NO: 313971 - RNA, 21 nt, Bordetella pertussis
gcgccuauaucgacggcgccu

SEQ ID NO: 313972 - RNA, 18 nt, Bordetella pertussis
gcgccuauugcgacgccg

SEQ ID NO: 313973 - RNA, 19 nt, Bordetella pertussis
gcgccuauugcgacgccgc

SEQ ID NO: 313974 - RNA, 22 nt, Bordetella pertussis
gcgccuauugcgacgccgccga

SEQ ID NO: 313975 - RNA, 22 nt, Bordetella pertussis
gcgccucaucguucugcgucaa

SEQ ID NO: 313976 - RNA, 12 nt, Bordetella pertussis
gcgccuccagcu

SEQ ID NO: 313977 - RNA, 21 nt, Bordetella pertussis
gcgccuccagcuccagcgcgc

SEQ ID NO: 313978 - RNA, 18 nt, Bordetella pertussis
gcgccucgaacguccgcc

SEQ ID NO: 313979 - RNA, 18 nt, Bordetella pertussis
gcgccucgaugauggcgu

SEQ ID NO: 313980 - RNA, 18 nt, Bordetella pertussis
gcgccucgcaucggccug

SEQ ID NO: 313981 - RNA, 19 nt, Bordetella pertussis
gcgccucgcaucggccugc

SEQ ID NO: 313982 - RNA, 14 nt, Bordetella pertussis
gcgccucggacgcc

SEQ ID NO: 313983 - RNA, 18 nt, Bordetella pertussis
gcgccucggacgccuggc

SEQ ID NO: 313984 - RNA, 15 nt, Bordetella pertussis
gcgccucgguccagc

SEQ ID NO: 313985 - RNA, 16 nt, Bordetella pertussis
gcgccucgguccagcg

SEQ ID NO: 313986 - RNA, 23 nt, Bordetella pertussis
gcgccucguccugcaggcggcgc

SEQ ID NO: 313987 - RNA, 16 nt, Bordetella pertussis
gcgccucgucgcgcaa

SEQ ID NO: 313988 - RNA, 14 nt, Bordetella pertussis
gcgccucggcggau

SEQ ID NO: 313989 - RNA, 18 nt, Bordetella pertussis
gcgccucgugcgaggcca

SEQ ID NO: 313990 - RNA, 18 nt, Bordetella pertussis
gcgccugagccgauacag

SEQ ID NO: 313991 - RNA, 14 nt, Bordetella pertussis
gcgccugagcugcc

SEQ ID NO: 313992 - RNA, 19 nt, Bordetella pertussis
gcgccugcaagauggcguc

SEQ ID NO: 313993 - RNA, 21 nt, Bordetella pertussis
gcgccugcagcacggccacgg

SEQ ID NO: 313994 - RNA, 18 nt, Bordetella pertussis
gcgccugcagcagcggca

SEQ ID NO: 313995 - RNA, 18 nt, Bordetella pertussis
gcgccugcagcagcgugg

SEQ ID NO: 313996 - RNA, 23 nt, Bordetella pertussis
gcgccugcagcagcguggccgcc

SEQ ID NO: 313997 - RNA, 13 nt, Bordetella pertussis
gcgccugcagcgc

SEQ ID NO: 313998 - RNA, 16 nt, Bordetella pertussis
gcgccugcagcgccgc

SEQ ID NO: 313999 - RNA, 17 nt, Bordetella pertussis
gcgccugcagcgccgcc

SEQ ID NO: 314000 - RNA, 18 nt, Bordetella pertussis
gcgccugcauccggccca

SEQ ID NO: 314001 - RNA, 21 nt, Bordetella pertussis
gcgccugcauccggcccagcg

SEQ ID NO: 314002 - RNA, 22 nt, Bordetella pertussis
gcgccugcaugccauagucgcg

SEQ ID NO: 314003 - RNA, 23 nt, Bordetella pertussis
gcgccugcaugccauagucgcgc

SEQ ID NO: 314004 - RNA, 21 nt, Bordetella pertussis
gcgccugcauguccagcggcg

SEQ ID NO: 314005 - RNA, 17 nt, Bordetella pertussis
gcgccugcccaggccag

SEQ ID NO: 314006 - RNA, 19 nt, Bordetella pertussis
gcgccugcccaggccagcg

SEQ ID NO: 314007 - RNA, 23 nt, Bordetella pertussis
gcgccugcccaggccagcgccgc

SEQ ID NO: 314008 - RNA, 18 nt, Bordetella pertussis
gcgccugccccgccggga

SEQ ID NO: 314009 - RNA, 21 nt, Bordetella pertussis
gcgccugcccgcaacgccgcc

SEQ ID NO: 314010 - RNA, 22 nt, Bordetella pertussis
gcgccugcccgcaacgccgccc

SEQ ID NO: 314011 - RNA, 18 nt, Bordetella pertussis
gcgccugccgaucgugca

SEQ ID NO: 314012 - RNA, 16 nt, Bordetella pertussis
gcgccugccgcauccc

SEQ ID NO: 314013 - RNA, 13 nt, Bordetella pertussis
gcgccugccgcgu

SEQ ID NO: 314014 - RNA, 19 nt, Bordetella pertussis
gcgccugccugccgagcgc

SEQ ID NO: 314015 - RNA, 23 nt, Bordetella pertussis
gcgccugcgagagauagcccagc

SEQ ID NO: 314016 - RNA, 13 nt, Bordetella pertussis
gcgccugcgccac

SEQ ID NO: 314017 - RNA, 22 nt, Bordetella pertussis
gcgccugcgccaccuggcgccc

SEQ ID NO: 314018 - RNA, 14 nt, Bordetella pertussis
gcgccugcgccacg

SEQ ID NO: 314019 - RNA, 22 nt, Bordetella pertussis
gcgccugcgccauguggcgacg

SEQ ID NO: 314020 - RNA, 14 nt, Bordetella pertussis
gcgccugcgcgccg

SEQ ID NO: 314021 - RNA, 15 nt, Bordetella pertussis
gcgccugcgcgcgcu

SEQ ID NO: 314022 - RNA, 14 nt, Bordetella pertussis
gcgccugcgcgcgg

SEQ ID NO: 314023 - RNA, 14 nt, Bordetella pertussis
gcgccugcgcggcc

SEQ ID NO: 314024 - RNA, 17 nt, Bordetella pertussis
gcgccugcgcggccucg

SEQ ID NO: 314025 - RNA, 13 nt, Bordetella pertussis
gcgccugcggcag

SEQ ID NO: 314026 - RNA, 15 nt, Bordetella pertussis
gcgccugcggcaggc

SEQ ID NO: 314027 - RNA, 18 nt, Bordetella pertussis
gcgccugcgucguugccc

SEQ ID NO: 314028 - RNA, 14 nt, Bordetella pertussis
gcgccugcucacgc

SEQ ID NO: 314029 - RNA, 13 nt, Bordetella pertussis
gcgccuggccgcc

SEQ ID NO: 314030 - RNA, 18 nt, Bordetella pertussis
gcgccuggccgcccagcg

SEQ ID NO: 314031 - RNA, 14 nt, Bordetella pertussis
gcgccuggccgcgc

SEQ ID NO: 314032 - RNA, 12 nt, Bordetella pertussis
gcgccuggccgu

SEQ ID NO: 314033 - RNA, 20 nt, Bordetella pertussis
gcgccuggcccagaucugcc

SEQ ID NO: 314034 - RNA, 19 nt, Bordetella pertussis
gcgccuggcgcaugacggc

SEQ ID NO: 314035 - RNA, 12 nt, Bordetella pertussis
gcgccuggcgcg

SEQ ID NO: 314036 - RNA, 13 nt, Bordetella pertussis
gcgccuggcgcgc

SEQ ID NO: 314037 - RNA, 17 nt, Bordetella pertussis
gcgccuggcgcgcccac

SEQ ID NO: 314038 - RNA, 21 nt, Bordetella pertussis
gcgccuggcggacgauggccu

SEQ ID NO: 314039 - RNA, 23 nt, Bordetella pertussis
gcgccuggcggcugucgggcggc

SEQ ID NO: 314040 - RNA, 17 nt, Bordetella pertussis
gcgccuggcgggccugg

SEQ ID NO: 314041 - RNA, 14 nt, Bordetella pertussis
gcgccuggcugagg

SEQ ID NO: 314042 - RNA, 16 nt, Bordetella pertussis
gcgccugggcggcgca

SEQ ID NO: 314043 - RNA, 18 nt, Bordetella pertussis
gcgccugggcggcgcagu

SEQ ID NO: 314044 - RNA, 24 nt, Bordetella pertussis
gcgccugggcggcgcagucgcgca

SEQ ID NO: 314045 - RNA, 15 nt, Bordetella pertussis
gcgccuggucgcgcg

SEQ ID NO: 314046 - RNA, 16 nt, Bordetella pertussis
gcgccuggucgcgcgc

SEQ ID NO: 314047 - RNA, 18 nt, Bordetella pertussis
gcgccuggucgcgcgccu

SEQ ID NO: 314048 - RNA, 17 nt, Bordetella pertussis
gcgccuggggcgugccc

SEQ ID NO: 314049 - RNA, 15 nt, Bordetella pertussis
gcgccugucccaggc

SEQ ID NO: 314050 - RNA, 18 nt, Bordetella pertussis
gcgccugucccaggcgcu

SEQ ID NO: 314051 - RNA, 22 nt, Bordetella pertussis
gcgccuguccccgcaugggggc

SEQ ID NO: 314052 - RNA, 19 nt, Bordetella pertussis
gcgccuguccccgcugcgg

SEQ ID NO: 314053 - RNA, 21 nt, Bordetella pertussis
gcgccuguccccgcugcggca

SEQ ID NO: 314054 - RNA, 16 nt, Bordetella pertussis
gcgccuuacgcggcgc

SEQ ID NO: 314055 - RNA, 17 nt, Bordetella pertussis
gcgccuuacgcggcgcg

SEQ ID NO: 314056 - RNA, 18 nt, Bordetella pertussis
gcgccuuacuucuugcgc

SEQ ID NO: 314057 - RNA, 20 nt, Bordetella pertussis
gcgccuuccggcagcggcca

SEQ ID NO: 314058 - RNA, 22 nt, Bordetella pertussis
gcgccuuccggcagcggccagc

SEQ ID NO: 314059 - RNA, 19 nt, Bordetella pertussis
gcgccuuccugggcgccgg

SEQ ID NO: 314060 - RNA, 16 nt, Bordetella pertussis
gcgccuucgaggccgg

SEQ ID NO: 314061 - RNA, 21 nt, Bordetella pertussis
gcgccuucggcaggcgccggc

SEQ ID NO: 314062 - RNA, 14 nt, Bordetella pertussis
gcgccuucggcgcg

SEQ ID NO: 314063 - RNA, 17 nt, Bordetella pertussis
gcgccuucggcgcgcac

SEQ ID NO: 314064 - RNA, 19 nt, Bordetella pertussis
gcgccuucggcgcgcacgc

SEQ ID NO: 314065 - RNA, 15 nt, Bordetella pertussis
gcgccuucggcgcgg

SEQ ID NO: 314066 - RNA, 19 nt, Bordetella pertussis
gcgccuugaaccccggcug

SEQ ID NO: 314067 - RNA, 20 nt, Bordetella pertussis
gcgccuugaaccccggcugc

SEQ ID NO: 314068 - RNA, 22 nt, Bordetella pertussis
gcgccuugaaccccggcugcgc

SEQ ID NO: 314069 - RNA, 18 nt, Bordetella pertussis
gcgccuugacgcugcucu

SEQ ID NO: 314070 - RNA, 13 nt, Bordetella pertussis
gcgccuugccgcc

SEQ ID NO: 314071 - RNA, 14 nt, Bordetella pertussis
gcgccuugccgccg

SEQ ID NO: 314072 - RNA, 17 nt, Bordetella pertussis
gcgccuugccgccgcgc

SEQ ID NO: 314073 - RNA, 17 nt, Bordetella pertussis
gcgccuugccgccgugc

SEQ ID NO: 314074 - RNA, 18 nt, Bordetella pertussis
gcgccuugccgccgugcg

SEQ ID NO: 314075 - RNA, 23 nt, Bordetella pertussis
gcgccuugcggcgcuuggcguag

SEQ ID NO: 314076 - RNA, 14 nt, Bordetella pertussis
gcgccuuggcgcgc

SEQ ID NO: 314077 - RNA, 18 nt, Bordetella pertussis
gcgccuuucccgcgccga

SEQ ID NO: 314078 - RNA, 20 nt, Bordetella pertussis
gcgccuuucccgcgccgagc

SEQ ID NO: 314079 - RNA, 21 nt, Bordetella pertussis
gcgccuuucccgcgccgagcg

SEQ ID NO: 314080 - RNA, 17 nt, Bordetella pertussis
gcgcgaaaacccgcggc

SEQ ID NO: 314081 - RNA, 15 nt, Bordetella pertussis
gcgcgaaacccccug

SEQ ID NO: 314082 - RNA, 16 nt, Bordetella pertussis
gcgcgaaacggccggg

SEQ ID NO: 314083 - RNA, 15 nt, Bordetella pertussis
gcgcgaaauccagcg

SEQ ID NO: 314084 - RNA, 18 nt, Bordetella pertussis
gcgcgaaauccagcgcgc

SEQ ID NO: 314085 - RNA, 21 nt, Bordetella pertussis
gcgcgaaauccagcgcgcccg

SEQ ID NO: 314086 - RNA, 22 nt, Bordetella pertussis
gcgcgaaauccagcgcgcccga

SEQ ID NO: 314087 - RNA, 15 nt, Bordetella pertussis
gcgcgaaaugcccag

SEQ ID NO: 314088 - RNA, 17 nt, Bordetella pertussis
gcgcgaaaugcccagcg

SEQ ID NO: 314089 - RNA, 15 nt, Bordetella pertussis
gcgcgaacaccggca

SEQ ID NO: 314090 - RNA, 16 nt, Bordetella pertussis
gcgcgaacaccggcag

SEQ ID NO: 314091 - RNA, 18 nt, Bordetella pertussis
gcgcgaacaccggcaggc

SEQ ID NO: 314092 - RNA, 22 nt, Bordetella pertussis
gcgcgaacaccggcaggccgcg

SEQ ID NO: 314093 - RNA, 16 nt, Bordetella pertussis
gcgcgaacgcgcgccg

SEQ ID NO: 314094 - RNA, 20 nt, Bordetella pertussis
gcgcgaacgcgcgccggcca

SEQ ID NO: 314095 - RNA, 23 nt, Bordetella pertussis
gcgcgaacgcgcgccggccagcg

SEQ ID NO: 314096 - RNA, 15 nt, Bordetella pertussis
gcgcgaacgcggcca

SEQ ID NO: 314097 - RNA, 20 nt, Bordetella pertussis
gcgcgaacggcuugauggcg

SEQ ID NO: 314098 - RNA, 23 nt, Bordetella pertussis
gcgcgaacggcuugauggcgaug

SEQ ID NO: 314099 - RNA, 22 nt, Bordetella pertussis
gcgcgaacggggguugccagau

SEQ ID NO: 314100 - RNA, 13 nt, Bordetella pertussis
gcgcgaagcgcug

SEQ ID NO: 314101 - RNA, 14 nt, Bordetella pertussis
gcgcgaagcgcugg

SEQ ID NO: 314102 - RNA, 15 nt, Bordetella pertussis
gcgcgaagcgcuggg

SEQ ID NO: 314103 - RNA, 14 nt, Bordetella pertussis
gcgcgacagcaggc

SEQ ID NO: 314104 - RNA, 17 nt, Bordetella pertussis
gcgcgacagcaggccgg

SEQ ID NO: 314105 - RNA, 22 nt, Bordetella pertussis
gcgcgacagcaggccggucagg

SEQ ID NO: 314106 - RNA, 13 nt, Bordetella pertussis
gcgcgacagccgc

SEQ ID NO: 314107 - RNA, 18 nt, Bordetella pertussis
gcgcgacagccgcgccag

SEQ ID NO: 314108 - RNA, 19 nt, Bordetella pertussis
gcgcgacagccgcgccagc

SEQ ID NO: 314109 - RNA, 21 nt, Bordetella pertussis
gcgcgacagccgcgccagcgc

SEQ ID NO: 314110 - RNA, 15 nt, Bordetella pertussis
gcgcgacaggcggug

SEQ ID NO: 314111 - RNA, 22 nt, Bordetella pertussis
gcgcgacaggcggugcgcgcgg

SEQ ID NO: 314112 - RNA, 14 nt, Bordetella pertussis
gcgcgacaggcccg

SEQ ID NO: 314113 - RNA, 18 nt, Bordetella pertussis
gcgcgacaggcccgcggc

SEQ ID NO: 314114 - RNA, 17 nt, Bordetella pertussis
gcgcgaccacuggcaga

SEQ ID NO: 314115 - RNA, 14 nt, Bordetella pertussis
gcgcgaccaggcug

SEQ ID NO: 314116 - RNA, 19 nt, Bordetella pertussis
gcgcgaccacgaccuuggc

SEQ ID NO: 314117 - RNA, 14 nt, Bordetella pertussis
gcgcgaccgccgcg

SEQ ID NO: 314118 - RNA, 15 nt, Bordetella pertussis
gcgcgaccuccggca

SEQ ID NO: 314119 - RNA, 21 nt, Bordetella pertussis
gcgcgaggcggcgacgcagca

SEQ ID NO: 314120 - RNA, 14 nt, Bordetella pertussis
gcgcgaggcggcgg

SEQ ID NO: 314121 - RNA, 14 nt, Bordetella pertussis
gcgcgagggcauca

SEQ ID NO: 314122 - RNA, 17 nt, Bordetella pertussis
gcgcgagggcaucagcg

SEQ ID NO: 314123 - RNA, 21 nt, Bordetella pertussis
gcgcgagguggcgcucgcgcc

SEQ ID NO: 314124 - RNA, 21 nt, Bordetella pertussis
gcgcgaguaucccuaccgccu

SEQ ID NO: 314125 - RNA, 20 nt, Bordetella pertussis
gcgcgaguauucacgccgcg

SEQ ID NO: 314126 - RNA, 19 nt, Bordetella pertussis
gcgcgauagcgcuugccug

SEQ ID NO: 314127 - RNA, 20 nt, Bordetella pertussis
gcgcgaucucguggcccagc

SEQ ID NO: 314128 - RNA, 18 nt, Bordetella pertussis
gcgcgaugcgcggcccgg

SEQ ID NO: 314129 - RNA, 21 nt, Bordetella pertussis
gcgcgauguucaggccggccc

SEQ ID NO: 314130 - RNA, 20 nt, Bordetella pertussis
gcgcgauguucggaugcgcg

SEQ ID NO: 314131 - RNA, 17 nt, Bordetella pertussis
gcgcgauucccuggcgc

SEQ ID NO: 314132 - RNA, 20 nt, Bordetella pertussis
gcgcgcaccugggaggggcc

SEQ ID NO: 314133 - RNA, 16 nt, Bordetella pertussis
gcgcgcacgaccacca

SEQ ID NO: 314134 - RNA, 19 nt, Bordetella pertussis
gcgcgcacgaccaccagcg

SEQ ID NO: 314135 - RNA, 18 nt, Bordetella pertussis
gcgcgcacgcgcucgggc

SEQ ID NO: 314136 - RNA, 15 nt, Bordetella pertussis
gcgcgcacgcugggc

SEQ ID NO: 314137 - RNA, 14 nt, Bordetella pertussis
gcgcgcagacgcga

SEQ ID NO: 314138 - RNA, 20 nt, Bordetella pertussis
gcgcgcagacgcgcucaggc

SEQ ID NO: 314139 - RNA, 14 nt, Bordetella pertussis
gcgcgcagcacgcc

SEQ ID NO: 314140 - RNA, 12 nt, Bordetella pertussis
gcgcgcagcagg

SEQ ID NO: 314141 - RNA, 16 nt, Bordetella pertussis
gcgcgcagcaggccca

SEQ ID NO: 314142 - RNA, 23 nt, Bordetella pertussis
gcgcgcagauugcgcucggucau

SEQ ID NO: 314143 - RNA, 16 nt, Bordetella pertussis
gcgcgcagccgcgcca

SEQ ID NO: 314144 - RNA, 18 nt, Bordetella pertussis
gcgcgcagcgaggccucg

SEQ ID NO: 314145 - RNA, 13 nt, Bordetella pertussis
gcgcgcagcgccu

SEQ ID NO: 314146 - RNA, 17 nt, Bordetella pertussis
gcgcgcagcgccugcag

SEQ ID NO: 314147 - RNA, 14 nt, Bordetella pertussis
gcgcgcagcgcgcc

SEQ ID NO: 314148 - RNA, 15 nt, Bordetella pertussis
gcgcgcagcgcgccg

SEQ ID NO: 314149 - RNA, 18 nt, Bordetella pertussis
gcgcgcagcgcgccggac

SEQ ID NO: 314150 - RNA, 21 nt, Bordetella pertussis
gcgcgcagcucccccacgccg

SEQ ID NO: 314151 - RNA, 12 nt, Bordetella pertussis
gcgcgcaggccu

SEQ ID NO: 314152 - RNA, 23 nt, Bordetella pertussis
gcgcgcagggcgaacguggccug

SEQ ID NO: 314153 - RNA, 14 nt, Bordetella pertussis
gcgcgcagggcggc

SEQ ID NO: 314154 - RNA, 17 nt, Bordetella pertussis
gcgcgcagggcggccgg

SEQ ID NO: 314155 - RNA, 13 nt, Bordetella pertussis
gcgcgcaggucgu

SEQ ID NO: 314156 - RNA, 13 nt, Bordetella pertussis
gcgcgcauccagg

SEQ ID NO: 314157 - RNA, 16 nt, Bordetella pertussis
gcgcgcauccaggugc

SEQ ID NO: 314158 - RNA, 14 nt, Bordetella pertussis
gcgcgcaucgccga

SEQ ID NO: 314159 - RNA, 20 nt, Bordetella pertussis
gcgcgcaucgccgaacaggg

SEQ ID NO: 314160 - RNA, 13 nt, Bordetella pertussis
gcgcgcaucggcc

SEQ ID NO: 314161 - RNA, 22 nt, Bordetella pertussis
gcgcgcaucggccggauccagc

SEQ ID NO: 314162 - RNA, 17 nt, Bordetella pertussis
gcgcgcaucggcgccga

SEQ ID NO: 314163 - RNA, 19 nt, Bordetella pertussis
gcgcgcaucggcgccgagc

SEQ ID NO: 314164 - RNA, 22 nt, Bordetella pertussis
gcgcgcaucgucaggcaggcgc

SEQ ID NO: 314165 - RNA, 13 nt, Bordetella pertussis
gcgcgcaucgcgc

SEQ ID NO: 314166 - RNA, 20 nt, Bordetella pertussis
gcgcucgccgucgacgccga

SEQ ID NO: 314167 - RNA, 13 nt, Bordetella pertussis
gcgcucgcgccag

SEQ ID NO: 314168 - RNA, 19 nt, Bordetella pertussis
gcgcucgcgccaggccccg

SEQ ID NO: 314169 - RNA, 17 nt, Bordetella pertussis
gcgcucgcgcgcgugcu

SEQ ID NO: 314170 - RNA, 17 nt, Bordetella pertussis
gcgcucgcgcucggcca

SEQ ID NO: 314171 - RNA, 16 nt, Bordetella pertussis
gcgcucgcgcugcagg

SEQ ID NO: 314172 - RNA, 19 nt, Bordetella pertussis
gcgcucgcgggugcgcagc

SEQ ID NO: 314173 - RNA, 23 nt, Bordetella pertussis
gcgcucgcucacggggcugucgc

SEQ ID NO: 314174 - RNA, 14 nt, Bordetella pertussis
gcgcucgcugccgg

SEQ ID NO: 314175 - RNA, 16 nt, Bordetella pertussis
gcgcucgcugccggcg

SEQ ID NO: 314176 - RNA, 13 nt, Bordetella pertussis
gcgcucggacgcc

SEQ ID NO: 314177 - RNA, 16 nt, Bordetella pertussis
gcgcucggacgccgcg

SEQ ID NO: 314178 - RNA, 14 nt, Bordetella pertussis
gcgcucggccagcg

SEQ ID NO: 314179 - RNA, 21 nt, Bordetella pertussis
gcgcucggccagcgcgcggcc

SEQ ID NO: 314180 - RNA, 18 nt, Bordetella pertussis
gcgcucggccucggucag

SEQ ID NO: 314181 - RNA, 12 nt, Bordetella pertussis
gcgcucggcgcu

SEQ ID NO: 314182 - RNA, 17 nt, Bordetella pertussis
gcgcucggcgcugccgg

SEQ ID NO: 314183 - RNA, 14 nt, Bordetella pertussis
gcgcucgggcucgc

SEQ ID NO: 314184 - RNA, 18 nt, Bordetella pertussis
gcgcucgggcucgcgcgc

SEQ ID NO: 314185 - RNA, 20 nt, Bordetella pertussis
gcgcucggucauguccagcg

SEQ ID NO: 314186 - RNA, 19 nt, Bordetella pertussis
gcgcucgguccagacgggc

SEQ ID NO: 314187 - RNA, 21 nt, Bordetella pertussis
gcgcucguccaugccggccau

SEQ ID NO: 314188 - RNA, 23 nt, Bordetella pertussis
gcgcucgucgaauacgaaacagg

SEQ ID NO: 314189 - RNA, 13 nt, Bordetella pertussis
gcgcucguugcgc

SEQ ID NO: 314190 - RNA, 16 nt, Bordetella pertussis
gcgcucguugcgcgug

SEQ ID NO: 314191 - RNA, 18 nt, Bordetella pertussis
gcgcugaauccggggugc

SEQ ID NO: 314192 - RNA, 16 nt, Bordetella pertussis
gcgcugacagcgcucu

SEQ ID NO: 314193 - RNA, 21 nt, Bordetella pertussis
gcgcugaccugcacgauggcg

SEQ ID NO: 314194 - RNA, 14 nt, Bordetella pertussis
gcgcugcacgcagc

SEQ ID NO: 314195 - RNA, 18 nt, Bordetella pertussis
gcgcugcacgcagcgcag

SEQ ID NO: 314196 - RNA, 16 nt, Bordetella pertussis
gcgcugcacgcggccg

SEQ ID NO: 314197 - RNA, 20 nt, Bordetella pertussis
gcgcugcacgcggccgcgca

SEQ ID NO: 314198 - RNA, 23 nt, Bordetella pertussis
gcgcugcacgcggccgcgcagga

SEQ ID NO: 314199 - RNA, 15 nt, Bordetella pertussis
gcgcugcagcgcagg

SEQ ID NO: 314200 - RNA, 16 nt, Bordetella pertussis
gcgcugcagcgcagga

SEQ ID NO: 314201 - RNA, 20 nt, Bordetella pertussis
gcgcugcagcgcaggauggg

SEQ ID NO: 314202 - RNA, 13 nt, Bordetella pertussis
gcgcugcagcaug

SEQ ID NO: 314203 - RNA, 12 nt, Bordetella pertussis
gcgcugcagcca

SEQ ID NO: 314204 - RNA, 22 nt, Bordetella pertussis
gcgcugcaggaucgcggccagc

SEQ ID NO: 314205 - RNA, 15 nt, Bordetella pertussis
gcgcugcaggcgucc

SEQ ID NO: 314206 - RNA, 22 nt, Bordetella pertussis
gcgcugcauacgccgcugaugg

SEQ ID NO: 314207 - RNA, 13 nt, Bordetella pertussis
gcgcugccagcca

SEQ ID NO: 314208 - RNA, 16 nt, Bordetella pertussis
gcgcugcccaccgccg

SEQ ID NO: 314209 - RNA, 20 nt, Bordetella pertussis
gcgcugcccgucgcuggcgc

SEQ ID NO: 314210 - RNA, 22 nt, Bordetella pertussis
gcgcugccugaaaccgcaggca

SEQ ID NO: 314211 - RNA, 17 nt, Bordetella pertussis
gcgcugccugccggccg

SEQ ID NO: 314212 - RNA, 15 nt, Bordetella pertussis
gcgcugcgcagcagg

SEQ ID NO: 314213 - RNA, 13 nt, Bordetella pertussis
gcgcugcgccgcg

SEQ ID NO: 314214 - RNA, 15 nt, Bordetella pertussis
gcgcugcgccgcggc

SEQ ID NO: 314215 - RNA, 18 nt, Bordetella pertussis
gcgcugcgccgcggcgcu

SEQ ID NO: 314216 - RNA, 13 nt, Bordetella pertussis
gcgcugcgccggc

SEQ ID NO: 314217 - RNA, 18 nt, Bordetella pertussis
gcgcugcgccggcggcac

SEQ ID NO: 314218 - RNA, 15 nt, Bordetella pertussis
gcgcugcgccuuggc

SEQ ID NO: 314219 - RNA, 17 nt, Bordetella pertussis
gcgcugcgccuuggcgc

SEQ ID NO: 314220 - RNA, 21 nt, Bordetella pertussis
gcgcugcgccuuggcgcgcag

SEQ ID NO: 314221 - RNA, 23 nt, Bordetella pertussis
gcgcugcgccuuggcgcgcagac

SEQ ID NO: 314222 - RNA, 20 nt, Bordetella pertussis
gcgcugcgcgaaacggccgg

SEQ ID NO: 314223 - RNA, 20 nt, Bordetella pertussis
gcgcugcgcgaacgcggcca

SEQ ID NO: 314224 - RNA, 13 nt, Bordetella pertussis
gcgcugcgcgccg

SEQ ID NO: 314225 - RNA, 14 nt, Bordetella pertussis
gcgcugcgcgccgc

SEQ ID NO: 314226 - RNA, 16 nt, Bordetella pertussis
gcgcugcugcaggccg

SEQ ID NO: 314227 - RNA, 15 nt, Bordetella pertussis
gcgcugcugccgucg

SEQ ID NO: 314228 - RNA, 17 nt, Bordetella pertussis
gcgcugcuggaggccgg

SEQ ID NO: 314229 - RNA, 16 nt, Bordetella pertussis
gcgcugcuggccggcc

SEQ ID NO: 314230 - RNA, 19 nt, Bordetella pertussis
gcgcugcuggccggccagc

SEQ ID NO: 314231 - RNA, 21 nt, Bordetella pertussis
gcgcugcugucgcgcgacugg

SEQ ID NO: 314232 - RNA, 17 nt, Bordetella pertussis
gcgcugcugucgcgcug

SEQ ID NO: 314233 - RNA, 22 nt, Bordetella pertussis
gcgcugcugucgcgcugcccgu

SEQ ID NO: 314234 - RNA, 13 nt, Bordetella pertussis
gcgcugcugcugg

SEQ ID NO: 314235 - RNA, 21 nt, Bordetella pertussis
gcgcugcugcuggcugcccug

SEQ ID NO: 314236 - RNA, 15 nt, Bordetella pertussis
gcgcuggaagacgug

SEQ ID NO: 314237 - RNA, 17 nt, Bordetella pertussis
gcgcuggaagacguggc

SEQ ID NO: 314238 - RNA, 19 nt, Bordetella pertussis
gcgcuggacgcccuggcgc

SEQ ID NO: 314239 - RNA, 21 nt, Bordetella pertussis
gcgcuggacgcccuggcgcag

SEQ ID NO: 314240 - RNA, 22 nt, Bordetella pertussis
gcgcuggacgcccuggcgcagg

SEQ ID NO: 314241 - RNA, 20 nt, Bordetella pertussis
gcgcuggaucccggcgauca

SEQ ID NO: 314242 - RNA, 22 nt, Bordetella pertussis
gcgcuggaucccggcgaucaug

SEQ ID NO: 314243 - RNA, 16 nt, Bordetella pertussis
gcgcuggauggcucgg

SEQ ID NO: 314244 - RNA, 23 nt, Bordetella pertussis
gcgcuggauggucacgcccaggc

SEQ ID NO: 314245 - RNA, 17 nt, Bordetella pertussis
gcgcuggcaggcgccuu

SEQ ID NO: 314246 - RNA, 14 nt, Bordetella pertussis
gcgcuggccaucac

SEQ ID NO: 314247 - RNA, 22 nt, Bordetella pertussis
gcgcuggcccaguucgcgcagc

SEQ ID NO: 314248 - RNA, 17 nt, Bordetella pertussis
gcgcuggccccagaugc

SEQ ID NO: 314249 - RNA, 14 nt, Bordetella pertussis
gcgcuggcccgcgc

SEQ ID NO: 314250 - RNA, 16 nt, Bordetella pertussis
gcgcuggcccgcgcga

SEQ ID NO: 314251 - RNA, 15 nt, Bordetella pertussis
gcgcuggcccgucau

SEQ ID NO: 314252 - RNA, 17 nt, Bordetella pertussis
gcgcuggccgccauggc

SEQ ID NO: 314253 - RNA, 14 nt, Bordetella pertussis
gcgcuggccgcccg

SEQ ID NO: 314254 - RNA, 20 nt, Bordetella pertussis
gcgcuggccgcccgcggccu

SEQ ID NO: 314255 - RNA, 18 nt, Bordetella pertussis
gcgcuggccugccgcgcc

SEQ ID NO: 314256 - RNA, 20 nt, Bordetella pertussis
gcgcuggccugccgcgccga

SEQ ID NO: 314257 - RNA, 18 nt, Bordetella pertussis
gcgcuggccuggccgccg

SEQ ID NO: 314258 - RNA, 14 nt, Bordetella pertussis
gcgcuggccggccg

SEQ ID NO: 314259 - RNA, 22 nt, Bordetella pertussis
gcgcuggcgaagaacaccgccg

SEQ ID NO: 314260 - RNA, 19 nt, Bordetella pertussis
gcgcuggcgaugcgggcca

SEQ ID NO: 314261 - RNA, 19 nt, Bordetella pertussis
gcgcuggcgcaaggacgcg

SEQ ID NO: 314262 - RNA, 11 nt, Bordetella pertussis
gcgcuggcgca

SEQ ID NO: 314263 - RNA, 21 nt, Bordetella pertussis
gcgcuggcgcagcaggcgcgc

SEQ ID NO: 314264 - RNA, 13 nt, Bordetella pertussis
gcgcuggcgcagg

SEQ ID NO: 314265 - RNA, 14 nt, Bordetella pertussis
gcgcuggcgcccgg

SEQ ID NO: 314266 - RNA, 14 nt, Bordetella pertussis
gcgcuggcgccgcg

SEQ ID NO: 314267 - RNA, 17 nt, Bordetella pertussis
gcgcuggcgccgcgcgc

SEQ ID NO: 314268 - RNA, 11 nt, Bordetella pertussis
gcgcuggcgcg

SEQ ID NO: 314269 - RNA, 12 nt, Bordetella pertussis
gcgcuggcgcga

SEQ ID NO: 314270 - RNA, 14 nt, Bordetella pertussis
gcgcuggcgcgcga

SEQ ID NO: 314271 - RNA, 15 nt, Bordetella pertussis
gcgcuggcgcgcgac

SEQ ID NO: 314272 - RNA, 21 nt, Bordetella pertussis
gcgcuggcgcgcgacggcgcc

SEQ ID NO: 314273 - RNA, 22 nt, Bordetella pertussis
gcgcuggcgcgcgacggcgccg

SEQ ID NO: 314274 - RNA, 17 nt, Bordetella pertussis
gcgcuggcgcgcggccg

SEQ ID NO: 314275 - RNA, 18 nt, Bordetella pertussis
gcgcuggcgcgcggccgc

SEQ ID NO: 314276 - RNA, 16 nt, Bordetella pertussis
gcgcuggcgcgcggcu

SEQ ID NO: 314277 - RNA, 19 nt, Bordetella pertussis
gcgcuggcgcgcuguucgg

SEQ ID NO: 314278 - RNA, 11 nt, Bordetella pertussis
gcgcuggcgcu

SEQ ID NO: 314279 - RNA, 16 nt, Bordetella pertussis
gcgcuggcggcgcagg

SEQ ID NO: 314280 - RNA, 20 nt, Bordetella pertussis
gcgcuggcggcgcaggccgc

SEQ ID NO: 314281 - RNA, 21 nt, Bordetella pertussis
gcgcuggcggcugcgcgacga

SEQ ID NO: 314282 - RNA, 15 nt, Bordetella pertussis
gcgcuggcggcgcag

SEQ ID NO: 314283 - RNA, 22 nt, Bordetella pertussis
gcgcuggcguccagccugcccg

SEQ ID NO: 314284 - RNA, 18 nt, Bordetella pertussis
gcgcugggcaggcuggcg

SEQ ID NO: 314285 - RNA, 20 nt, Bordetella pertussis
gcgcugggcaggcuggcgcg

SEQ ID NO: 314286 - RNA, 14 nt, Bordetella pertussis
gcgcugggcauggg

SEQ ID NO: 314287 - RNA, 18 nt, Bordetella pertussis
gcgcugggcaugggcggc

SEQ ID NO: 314288 - RNA, 17 nt, Bordetella pertussis
gcgcugggccaggccgg

SEQ ID NO: 314289 - RNA, 20 nt, Bordetella pertussis
gcgcugggccaggccggccu

SEQ ID NO: 314290 - RNA, 19 nt, Bordetella pertussis
gcgcuggcuggacgcgcgc

SEQ ID NO: 314291 - RNA, 17 nt, Bordetella pertussis
gcgcuggcugggccugc

SEQ ID NO: 314292 - RNA, 19 nt, Bordetella pertussis
gcgcuggcuucggcguacu

SEQ ID NO: 314293 - RNA, 16 nt, Bordetella pertussis
gcgcugggcgccagca

SEQ ID NO: 314294 - RNA, 20 nt, Bordetella pertussis
gcgcugggcgccagcagcac

SEQ ID NO: 314295 - RNA, 14 nt, Bordetella pertussis
gcgcugggcgcugc

SEQ ID NO: 314296 - RNA, 15 nt, Bordetella pertussis
gcgcugggcgcugcu

SEQ ID NO: 314297 - RNA, 13 nt, Bordetella pertussis
gcgcugggcgugg

SEQ ID NO: 314298 - RNA, 20 nt, Bordetella pertussis
gcgcugggcguggcgcgcgu

SEQ ID NO: 314299 - RNA, 15 nt, Bordetella pertussis
gcgcuggggcagcag

SEQ ID NO: 314300 - RNA, 18 nt, Bordetella pertussis
gcgcuggggcaggacgcc

SEQ ID NO: 314301 - RNA, 20 nt, Bordetella pertussis
gcgcuggggcugucgcgcua

SEQ ID NO: 314302 - RNA, 21 nt, Bordetella pertussis
gcgcugggcgguugcgcugcu

SEQ ID NO: 314303 - RNA, 23 nt, Bordetella pertussis
gcgcugggucaggucgcugccca

SEQ ID NO: 314304 - RNA, 16 nt, Bordetella pertussis
gcgcuggucgcgcagc

SEQ ID NO: 314305 - RNA, 17 nt, Bordetella pertussis
gcgcuggucgcgcagca

SEQ ID NO: 314306 - RNA, 19 nt, Bordetella pertussis
gcgcuggucgcgcagcacg

SEQ ID NO: 314307 - RNA, 20 nt, Bordetella pertussis
gcgcuggucgcgcagcacga

SEQ ID NO: 314308 - RNA, 21 nt, Bordetella pertussis
gcgcuggucgggaugccccgc

SEQ ID NO: 314309 - RNA, 15 nt, Bordetella pertussis
gcgcugguggccaga

SEQ ID NO: 314310 - RNA, 19 nt, Bordetella pertussis
gcgcuguaggcgccggcgc

SEQ ID NO: 314311 - RNA, 15 nt, Bordetella pertussis
gcgcuguccaggccg

SEQ ID NO: 314312 - RNA, 19 nt, Bordetella pertussis
gcgcuguccgaugcgcugc

SEQ ID NO: 314313 - RNA, 22 nt, Bordetella pertussis
gcgcuguccggcgcucgccccg

SEQ ID NO: 314314 - RNA, 19 nt, Bordetella pertussis
gcgcugugcgacgauccgg

SEQ ID NO: 314315 - RNA, 21 nt, Bordetella pertussis
gcgcuguucgauacggccacg

SEQ ID NO: 314316 - RNA, 15 nt, Bordetella pertussis
gcgcuguuccagcca

SEQ ID NO: 314317 - RNA, 17 nt, Bordetella pertussis
gcgcuguugcuccaggc

SEQ ID NO: 314318 - RNA, 17 nt, Bordetella pertussis
gcgcuguuuccgggccu

SEQ ID NO: 314319 - RNA, 23 nt, Bordetella pertussis
gcgcuguuuccgggccuggccug

SEQ ID NO: 314320 - RNA, 18 nt, Bordetella pertussis
gcgcuuaccgcgccggcu

SEQ ID NO: 314321 - RNA, 18 nt, Bordetella pertussis
gcgcuucaggcgccgcag

SEQ ID NO: 314322 - RNA, 23 nt, Bordetella pertussis
gcgcuucaggcgccgcagauggc

SEQ ID NO: 314323 - RNA, 17 nt, Bordetella pertussis
gcgcuucgucggccgcc

SEQ ID NO: 314324 - RNA, 21 nt, Bordetella pertussis
gcgcuucgucggccgccagcc

SEQ ID NO: 314325 - RNA, 17 nt, Bordetella pertussis
gcgcuucuuggcgacca

SEQ ID NO: 314326 - RNA, 23 nt, Bordetella pertussis
gcgcuugaaaugcguggcgugcc

SEQ ID NO: 314327 - RNA, 22 nt, Bordetella pertussis
gcgcuugaacuccgcggcgucg

SEQ ID NO: 314328 - RNA, 12 nt, Bordetella pertussis
gcgcuugacggc

SEQ ID NO: 314329 - RNA, 21 nt, Bordetella pertussis
gcgcuugagcggcucgccucc

SEQ ID NO: 314330 - RNA, 17 nt, Bordetella pertussis
gcgcuugaggcugguga

SEQ ID NO: 314331 - RNA, 16 nt, Bordetella pertussis
gcgcuugaccgccucg

SEQ ID NO: 314332 - RNA, 13 nt, Bordetella pertussis
gcgcuugcacgcc

SEQ ID NO: 314333 - RNA, 14 nt, Bordetella pertussis
gcgcuugcacgcca

SEQ ID NO: 314334 - RNA, 19 nt, Bordetella pertussis
gcgcuugccgaccuccagg

SEQ ID NO: 314335 - RNA, 15 nt, Bordetella pertussis
gcgcuugcgcgccac

SEQ ID NO: 314336 - RNA, 12 nt, Bordetella pertussis
gcgcuugcgcag

SEQ ID NO: 314337 - RNA, 19 nt, Bordetella pertussis
gcgcuugcgcagggcgggc

SEQ ID NO: 314338 - RNA, 15 nt, Bordetella pertussis
gcgcuuggccagcug

SEQ ID NO: 314339 - RNA, 18 nt, Bordetella pertussis
gcgcuuggccagcuggcg

SEQ ID NO: 314340 - RNA, 19 nt, Bordetella pertussis
gcgcuuggccagcuggcgc

SEQ ID NO: 314341 - RNA, 19 nt, Bordetella pertussis
gcgcuuggcccugcagcgg

SEQ ID NO: 314342 - RNA, 16 nt, Bordetella pertussis
gcgcuugucgccgcug

SEQ ID NO: 314343 - RNA, 14 nt, Bordetella pertussis
gcgcuugugcgucg

SEQ ID NO: 314344 - RNA, 18 nt, Bordetella pertussis
gcgcuuuuccccgcccag

SEQ ID NO: 314345 - RNA, 20 nt, Bordetella pertussis
gcgcuuuuccccgcccagcg

SEQ ID NO: 314346 - RNA, 19 nt, Bordetella pertussis
gcggaaaacagcaccagca

SEQ ID NO: 314347 - RNA, 14 nt, Bordetella pertussis
gcggaaagcuggcg

SEQ ID NO: 314348 - RNA, 19 nt, Bordetella pertussis
gcggaaauccgggcgcugc

SEQ ID NO: 314349 - RNA, 20 nt, Bordetella pertussis
gcggaaauccgggcgcugcg

SEQ ID NO: 314350 - RNA, 19 nt, Bordetella pertussis
gcggaaggcuuguacccca

SEQ ID NO: 314351 - RNA, 20 nt, Bordetella pertussis
gcggaagucgggcaccagca

SEQ ID NO: 314352 - RNA, 23 nt, Bordetella pertussis
gcggaaguauucgcgcggcgaca

SEQ ID NO: 314353 - RNA, 21 nt, Bordetella pertussis
gcggaaugaugguggggcugg

SEQ ID NO: 314354 - RNA, 20 nt, Bordetella pertussis
gcggaaugcggcgacagggc

SEQ ID NO: 314355 - RNA, 18 nt, Bordetella pertussis
gcggaauguugccgaaga

SEQ ID NO: 314356 - RNA, 23 nt, Bordetella pertussis
gcggacacgcccuggccguacau

SEQ ID NO: 314357 - RNA, 23 nt, Bordetella pertussis
gcggaccagcgguugcgccagcu

SEQ ID NO: 314358 - RNA, 16 nt, Bordetella pertussis
gcggacccaggccucg

SEQ ID NO: 314359 - RNA, 21 nt, Bordetella pertussis
gcggacccaguucggccgcca

SEQ ID NO: 314360 - RNA, 17 nt, Bordetella pertussis
gcggaccgaacggccgg

SEQ ID NO: 314361 - RNA, 15 nt, Bordetella pertussis
gcggaccuccugguc

SEQ ID NO: 314362 - RNA, 18 nt, Bordetella pertussis
gcggacgauguagaucug

SEQ ID NO: 314363 - RNA, 22 nt, Bordetella pertussis
gcggacgauguagaucuggcgc

SEQ ID NO: 314364 - RNA, 13 nt, Bordetella pertussis
gcggacgccagcc

SEQ ID NO: 314365 - RNA, 14 nt, Bordetella pertussis
gcggacgccagccc

SEQ ID NO: 314366 - RNA, 16 nt, Bordetella pertussis
gcggacggcgggcgcc

SEQ ID NO: 314367 - RNA, 13 nt, Bordetella pertussis
gcggacgggccag

SEQ ID NO: 314368 - RNA, 14 nt, Bordetella pertussis
gcggacgggccagg

SEQ ID NO: 314369 - RNA, 15 nt, Bordetella pertussis
gcggacgggccaggc

SEQ ID NO: 314370 - RNA, 20 nt, Bordetella pertussis
gcggacgggccaggccgaug

SEQ ID NO: 314371 - RNA, 17 nt, Bordetella pertussis
gcggacgguagcgcacg

SEQ ID NO: 314372 - RNA, 21 nt, Bordetella pertussis
gcggacucuaugcgguguugc

SEQ ID NO: 314373 - RNA, 15 nt, Bordetella pertussis
gcggacugcgccgca

SEQ ID NO: 314374 - RNA, 15 nt, Bordetella pertussis
gcggacuggccgcgc

SEQ ID NO: 314375 - RNA, 21 nt, Bordetella pertussis
gcggacuucgcuuucgguggc

SEQ ID NO: 314376 - RNA, 22 nt, Bordetella pertussis
gcggacuucgcuuucgguggcg

SEQ ID NO: 314377 - RNA, 22 nt, Bordetella pertussis
gcggagccgcgcacacauggcg

SEQ ID NO: 314378 - RNA, 23 nt, Bordetella pertussis
gcggagccgcgcacacauggcgc

SEQ ID NO: 314379 - RNA, 14 nt, Bordetella pertussis
gcggagcgacggca

SEQ ID NO: 314380 - RNA, 13 nt, Bordetella pertussis
gcggaggcggccg

SEQ ID NO: 314381 - RNA, 19 nt, Bordetella pertussis
gcggaggcggccgcgggcg

SEQ ID NO: 314382 - RNA, 14 nt, Bordetella pertussis
gcggagucgauaug

SEQ ID NO: 314383 - RNA, 14 nt, Bordetella pertussis
gcggagucgccccg

SEQ ID NO: 314384 - RNA, 18 nt, Bordetella pertussis
gcggauaacaucaugggc

SEQ ID NO: 314385 - RNA, 20 nt, Bordetella pertussis
gcggauacgaaaccaggccg

SEQ ID NO: 314386 - RNA, 23 nt, Bordetella pertussis
gcggauacgaaaccaggccgggg

SEQ ID NO: 314387 - RNA, 17 nt, Bordetella pertussis
gcggaucaagcggcccg

SEQ ID NO: 314388 - RNA, 20 nt, Bordetella pertussis
gcggaucaagcggcccgcgc

SEQ ID NO: 314389 - RNA, 22 nt, Bordetella pertussis
gcggaucaagcggcccgcgccc

SEQ ID NO: 314390 - RNA, 19 nt, Bordetella pertussis
gcggaucacccagcggcug

SEQ ID NO: 314391 - RNA, 18 nt, Bordetella pertussis
gcggauccagcgaggcau

SEQ ID NO: 314392 - RNA, 17 nt, Bordetella pertussis
gcggaucgaaaccggcg

SEQ ID NO: 314393 - RNA, 18 nt, Bordetella pertussis
gcggaucgaacgccucgg

SEQ ID NO: 314394 - RNA, 12 nt, Bordetella pertussis
gcggaucgccga

SEQ ID NO: 314395 - RNA, 14 nt, Bordetella pertussis
gcggaucgccgggc

SEQ ID NO: 314396 - RNA, 14 nt, Bordetella pertussis
gcggaucgccggua

SEQ ID NO: 314397 - RNA, 22 nt, Bordetella pertussis
gcggaucgccgguagcgcuggg

SEQ ID NO: 314398 - RNA, 15 nt, Bordetella pertussis
gcggaucgugcgcca

SEQ ID NO: 314399 - RNA, 17 nt, Bordetella pertussis
gcggaucucggccagca

SEQ ID NO: 314400 - RNA, 20 nt, Bordetella pertussis
gcggaucucggccagcagcg

SEQ ID NO: 314401 - RNA, 15 nt, Bordetella pertussis
gcggaucugacgggu

SEQ ID NO: 314402 - RNA, 16 nt, Bordetella pertussis
gcggaugaagggcugg

SEQ ID NO: 314403 - RNA, 18 nt, Bordetella pertussis
gcggaugaacgaccagca

SEQ ID NO: 314404 - RNA, 21 nt, Bordetella pertussis
gcggaugaccugcgccaggug

SEQ ID NO: 314405 - RNA, 19 nt, Bordetella pertussis
gcggaugagcaggccgggu

SEQ ID NO: 314406 - RNA, 15 nt, Bordetella pertussis
gcggaugaucgcgca

SEQ ID NO: 314407 - RNA, 17 nt, Bordetella pertussis
gcggaugaucgcgcagc

SEQ ID NO: 314408 - RNA, 15 nt, Bordetella pertussis
gcggaugaugcggcg

SEQ ID NO: 314409 - RNA, 18 nt, Bordetella pertussis
gcggaugccguccacgcc

SEQ ID NO: 314410 - RNA, 14 nt, Bordetella pertussis
gcggaugcgccgcc

SEQ ID NO: 314411 - RNA, 15 nt, Bordetella pertussis
gcggaugcgccgccc

SEQ ID NO: 314412 - RNA, 14 nt, Bordetella pertussis
gcggaugcgcgccu

SEQ ID NO: 314413 - RNA, 22 nt, Bordetella pertussis
gcggaugguaguacucgcugcg

SEQ ID NO: 314414 - RNA, 15 nt, Bordetella pertussis
gcggauggucgagcg

SEQ ID NO: 314415 - RNA, 22 nt, Bordetella pertussis
gcggauucaggcgauccugccc

SEQ ID NO: 314416 - RNA, 16 nt, Bordetella pertussis
gcggauugaugucgcg

SEQ ID NO: 314417 - RNA, 22 nt, Bordetella pertussis
gcggauugaugucgcgcaccgc

SEQ ID NO: 314418 - RNA, 23 nt, Bordetella pertussis
gcggauugaugucgcgcaccgcc

SEQ ID NO: 314419 - RNA, 15 nt, Bordetella pertussis
gcggauugaccagcg

SEQ ID NO: 314420 - RNA, 20 nt, Bordetella pertussis
gcggauugaccagcgcggcc

SEQ ID NO: 314421 - RNA, 14 nt, Bordetella pertussis
gcggauugccgucc

SEQ ID NO: 314422 - RNA, 19 nt, Bordetella pertussis
gcggauugccguccuggcg

SEQ ID NO: 314423 - RNA, 21 nt, Bordetella pertussis
gcggcaaaaaaaaccgcgcgc

SEQ ID NO: 314424 - RNA, 17 nt, Bordetella pertussis
gcggcaaacccggcgaa

SEQ ID NO: 314425 - RNA, 15 nt, Bordetella pertussis
gcggcaaagccgcug

SEQ ID NO: 314426 - RNA, 19 nt, Bordetella pertussis
gcggcaaagccgcugcgcu

SEQ ID NO: 314427 - RNA, 22 nt, Bordetella pertussis
gcggcaaagccgcugcgcuggc

SEQ ID NO: 314428 - RNA, 23 nt, Bordetella pertussis
gcggcaaaguagugcccccacgc

SEQ ID NO: 314429 - RNA, 19 nt, Bordetella pertussis
gcggcaaagucggggcgcc

SEQ ID NO: 314430 - RNA, 22 nt, Bordetella pertussis
gcggcaaauggggcggccggga

SEQ ID NO: 314431 - RNA, 14 nt, Bordetella pertussis
gcggcaacgugcag

SEQ ID NO: 314432 - RNA, 16 nt, Bordetella pertussis
gcggcaagcagccgga

SEQ ID NO: 314433 - RNA, 13 nt, Bordetella pertussis
gcggcaagcggcg

SEQ ID NO: 314434 - RNA, 19 nt, Bordetella pertussis
gcggcaagguagccgauga

SEQ ID NO: 314435 - RNA, 18 nt, Bordetella pertussis
gcggcaaguucgcugccg

SEQ ID NO: 314436 - RNA, 16 nt, Bordetella pertussis
gcggcaauaucggcac

SEQ ID NO: 314437 - RNA, 18 nt, Bordetella pertussis
aagccgaguggcgggcca

SEQ ID NO: 314438 - RNA, 16 nt, Bordetella pertussis
aagccgcaccaugcgg

SEQ ID NO: 314439 - RNA, 15 nt, Bordetella pertussis
aagccgcagcggcag

SEQ ID NO: 314440 - RNA, 16 nt, Bordetella pertussis
aagccgccggcgcgcg

SEQ ID NO: 314441 - RNA, 19 nt, Bordetella pertussis
aagccgcugcgcuggccgc

SEQ ID NO: 314442 - RNA, 19 nt, Bordetella pertussis
aagccggaauccuggcgac

SEQ ID NO: 314443 - RNA, 21 nt, Bordetella pertussis
aagccggaauccuggcgacgg

SEQ ID NO: 314444 - RNA, 14 nt, Bordetella pertussis
aagccggccgcgcc

SEQ ID NO: 314445 - RNA, 22 nt, Bordetella pertussis
aagccggguugucgaucaucag

SEQ ID NO: 314446 - RNA, 22 nt, Bordetella pertussis
aagccguccuugagggcgcggg

SEQ ID NO: 314447 - RNA, 14 nt, Bordetella pertussis
gcggcaaugcgcgc

SEQ ID NO: 314448 - RNA, 17 nt, Bordetella pertussis
gcggcacaaccuggcgc

SEQ ID NO: 314449 - RNA, 13 nt, Bordetella pertussis
gcggcaccagcag

SEQ ID NO: 314450 - RNA, 17 nt, Bordetella pertussis
gcggcaccagcaggccg

SEQ ID NO: 314451 - RNA, 22 nt, Bordetella pertussis
gcggcaccauugccggcgcgca

SEQ ID NO: 314452 - RNA, 14 nt, Bordetella pertussis
gcggcaccgcgcag

SEQ ID NO: 314453 - RNA, 16 nt, Bordetella pertussis
gcggcaccgcgcagcc

SEQ ID NO: 314454 - RNA, 15 nt, Bordetella pertussis
gcggcaccucggccg

SEQ ID NO: 314455 - RNA, 17 nt, Bordetella pertussis
gcggcaccucggccggg

SEQ ID NO: 314456 - RNA, 18 nt, Bordetella pertussis
gcggcacgaaaagccgcg

SEQ ID NO: 314457 - RNA, 17 nt, Bordetella pertussis
gcggcacgacgucgucg

SEQ ID NO: 314458 - RNA, 18 nt, Bordetella pertussis
gcggcacgaucggcgccu

SEQ ID NO: 314459 - RNA, 14 nt, Bordetella pertussis
gcggcacgcacagc

SEQ ID NO: 314460 - RNA, 15 nt, Bordetella pertussis
gcggcacgcacagca

SEQ ID NO: 314461 - RNA, 23 nt, Bordetella pertussis
gcggcacgauuucgccgauccgg

SEQ ID NO: 314462 - RNA, 13 nt, Bordetella pertussis
gcggcacgccggc

SEQ ID NO: 314463 - RNA, 12 nt, Bordetella pertussis
gcggcacgcgcg

SEQ ID NO: 314464 - RNA, 21 nt, Bordetella pertussis
gcggcagacgaucauccaggc

SEQ ID NO: 314465 - RNA, 16 nt, Bordetella pertussis
gcggcagcacgauggc

SEQ ID NO: 314466 - RNA, 17 nt, Bordetella pertussis
gcggcagcagcagcgcg

SEQ ID NO: 314467 - RNA, 13 nt, Bordetella pertussis
gcggcagcagcga

SEQ ID NO: 314468 - RNA, 13 nt, Bordetella pertussis
gcggcagcaggcg

SEQ ID NO: 314469 - RNA, 18 nt, Bordetella pertussis
gcggcagcagggccacgc

SEQ ID NO: 314470 - RNA, 14 nt, Bordetella pertussis
gcggcagcauggcg

SEQ ID NO: 314471 - RNA, 13 nt, Bordetella pertussis
aagccuugcggcc

SEQ ID NO: 314472 - RNA, 14 nt, Bordetella pertussis
gcggcagcccggca

SEQ ID NO: 314473 - RNA, 16 nt, Bordetella pertussis
gcggcagcccggcacg

SEQ ID NO: 314474 - RNA, 14 nt, Bordetella pertussis
gcggcagccggcca

SEQ ID NO: 314475 - RNA, 21 nt, Bordetella pertussis
gcggcagccggccauggccgc

SEQ ID NO: 314476 - RNA, 20 nt, Bordetella pertussis
gcggcagcgcaccgucgcca

SEQ ID NO: 314477 - RNA, 21 nt, Bordetella pertussis
gcggcagcgcaccgucgccag

SEQ ID NO: 314478 - RNA, 14 nt, Bordetella pertussis
gcggcagcgcgcag

SEQ ID NO: 314479 - RNA, 12 nt, Bordetella pertussis
gcggcagccugg

SEQ ID NO: 314480 - RNA, 22 nt, Bordetella pertussis
gcggcagcgcguauuccggguc

SEQ ID NO: 314481 - RNA, 19 nt, Bordetella pertussis
gcggcagggccuccugcag

SEQ ID NO: 314482 - RNA, 18 nt, Bordetella pertussis
gcggcagggugugccugu

SEQ ID NO: 314483 - RNA, 13 nt, Bordetella pertussis
gcggcaggucgcg

SEQ ID NO: 314484 - RNA, 13 nt, Bordetella pertussis
gcggcagggcguc

SEQ ID NO: 314485 - RNA, 14 nt, Bordetella pertussis
gcggcaggugcgcc

SEQ ID NO: 314486 - RNA, 16 nt, Bordetella pertussis
gcggcaggugcgccag

SEQ ID NO: 314487 - RNA, 17 nt, Bordetella pertussis
gcggcaggugcgucacg

SEQ ID NO: 314488 - RNA, 24 nt, Bordetella pertussis
gcggcaggugcgucacgcacagca

SEQ ID NO: 314489 - RNA, 18 nt, Bordetella pertussis
gcggcagguucugcgcgu

SEQ ID NO: 314490 - RNA, 20 nt, Bordetella pertussis
gcggcagguucugcgcgucc

SEQ ID NO: 314491 - RNA, 17 nt, Bordetella pertussis
gcggcaucguucaggcg

SEQ ID NO: 314492 - RNA, 18 nt, Bordetella pertussis
gcggcaucuugccuuggc

SEQ ID NO: 314493 - RNA, 13 nt, Bordetella pertussis
gcggcaugccgcu

SEQ ID NO: 314494 - RNA, 14 nt, Bordetella pertussis
gcggcaugccgcug

SEQ ID NO: 314495 - RNA, 16 nt, Bordetella pertussis
gcggcaugccgcugca

SEQ ID NO: 314496 - RNA, 18 nt, Bordetella pertussis
gcggcaugccgcugcagg

SEQ ID NO: 314497 - RNA, 15 nt, Bordetella pertussis
gcggcaugcgcaugc

SEQ ID NO: 314498 - RNA, 14 nt, Bordetella pertussis
gcggcaugcgccag

SEQ ID NO: 314499 - RNA, 15 nt, Bordetella pertussis
gcggcaugcgccagc

SEQ ID NO: 314500 - RNA, 13 nt, Bordetella pertussis
gcggcauggcgcc

SEQ ID NO: 314501 - RNA, 13 nt, Bordetella pertussis
aagcgcggccggg

SEQ ID NO: 314502 - RNA, 21 nt, Bordetella pertussis
gcggcauggugugccuguccc

SEQ ID NO: 314503 - RNA, 16 nt, Bordetella pertussis
gcggcauugcccaggu

SEQ ID NO: 314504 - RNA, 18 nt, Bordetella pertussis
gcggcauugcccagguug

SEQ ID NO: 314505 - RNA, 13 nt, Bordetella pertussis
gcggccgagcucc

SEQ ID NO: 314506 - RNA, 17 nt, Bordetella pertussis
gcggccgaggccagcgu

SEQ ID NO: 314507 - RNA, 14 nt, Bordetella pertussis
gcggccgauagccg

SEQ ID NO: 314508 - RNA, 19 nt, Bordetella pertussis
gcggccgauagccgugacc

SEQ ID NO: 314509 - RNA, 20 nt, Bordetella pertussis
gcggccgauagccgugaccu

SEQ ID NO: 314510 - RNA, 23 nt, Bordetella pertussis
gcggccgauagccgugaccugcu

SEQ ID NO: 314511 - RNA, 12 nt, Bordetella pertussis
gcggccgccagc

SEQ ID NO: 314512 - RNA, 15 nt, Bordetella pertussis
gcggccgccagcgcc

SEQ ID NO: 314513 - RNA, 13 nt, Bordetella pertussis
gcggccgcccagc

SEQ ID NO: 314514 - RNA, 13 nt, Bordetella pertussis
gcggccgccagcg

SEQ ID NO: 314515 - RNA, 13 nt, Bordetella pertussis
gcggccgccgcca

SEQ ID NO: 314516 - RNA, 15 nt, Bordetella pertussis
gcggccgccgccagc

SEQ ID NO: 314517 - RNA, 16 nt, Bordetella pertussis
gcggccgccgccagcg

SEQ ID NO: 314518 - RNA, 13 nt, Bordetella pertussis
gcggccgccugcg

SEQ ID NO: 314519 - RNA, 16 nt, Bordetella pertussis
gcggccgccugcgccg

SEQ ID NO: 314520 - RNA, 20 nt, Bordetella pertussis
gcggccgccuugacgguggc

SEQ ID NO: 314521 - RNA, 20 nt, Bordetella pertussis
gcggccgcugccgcgcgccg

SEQ ID NO: 314522 - RNA, 20 nt, Bordetella pertussis
gcggccgcuugucgaugacg

SEQ ID NO: 314523 - RNA, 20 nt, Bordetella pertussis
gcggccggacagggccgcga

SEQ ID NO: 314524 - RNA, 18 nt, Bordetella pertussis
gcggccggaggccgccca

SEQ ID NO: 314525 - RNA, 16 nt, Bordetella pertussis
gcggccggcacgccga

SEQ ID NO: 314526 - RNA, 14 nt, Bordetella pertussis
gcggccggccagcc

SEQ ID NO: 314527 - RNA, 13 nt, Bordetella pertussis
gcggccggccagc

SEQ ID NO: 314528 - RNA, 13 nt, Bordetella pertussis
gcggccggcaggc

SEQ ID NO: 314529 - RNA, 22 nt, Bordetella pertussis
gcggccggcaggccggccagca

SEQ ID NO: 314530 - RNA, 16 nt, Bordetella pertussis
gcggccgggcucaggc

SEQ ID NO: 314531 - RNA, 20 nt, Bordetella pertussis
gcggccgggucggccugcca

SEQ ID NO: 314532 - RNA, 18 nt, Bordetella pertussis
gcggccggguggccgcgg

SEQ ID NO: 314533 - RNA, 20 nt, Bordetella pertussis
gcggccggugaucuugccga

SEQ ID NO: 314534 - RNA, 12 nt, Bordetella pertussis
gcggccgguggc

SEQ ID NO: 314535 - RNA, 15 nt, Bordetella pertussis
gcggccgucaccgcc

SEQ ID NO: 314536 - RNA, 15 nt, Bordetella pertussis
gcggccgucaggcgu

SEQ ID NO: 314537 - RNA, 22 nt, Bordetella pertussis
gcggccgucgaccgacagcaca

SEQ ID NO: 314538 - RNA, 13 nt, Bordetella pertussis
gcggccgucgccg

SEQ ID NO: 314539 - RNA, 17 nt, Bordetella pertussis
gcggccgucgccgccca

SEQ ID NO: 314540 - RNA, 20 nt, Bordetella pertussis
gcggccgucgccgcccaugc

SEQ ID NO: 314541 - RNA, 17 nt, Bordetella pertussis
gcggccucgacgauggc

SEQ ID NO: 314542 - RNA, 15 nt, Bordetella pertussis
gcggccucgacggcc

SEQ ID NO: 314543 - RNA, 17 nt, Bordetella pertussis
gcggccucgacggccgc

SEQ ID NO: 314544 - RNA, 19 nt, Bordetella pertussis
gcggccucgacggccgccg

SEQ ID NO: 314545 - RNA, 20 nt, Bordetella pertussis
gcggccucgacggccgccgg

SEQ ID NO: 314546 - RNA, 19 nt, Bordetella pertussis
gcggccgucgccuucggcg

SEQ ID NO: 314547 - RNA, 15 nt, Bordetella pertussis
gcggccgucggcgcu

SEQ ID NO: 314548 - RNA, 16 nt, Bordetella pertussis
gcggccucgccggccu

SEQ ID NO: 314549 - RNA, 18 nt, Bordetella pertussis
gcggccucgccggccugg

SEQ ID NO: 314550 - RNA, 19 nt, Bordetella pertussis
gcggccucgccggccuggc

SEQ ID NO: 314551 - RNA, 20 nt, Bordetella pertussis
gcggccucgccggccuggcg

SEQ ID NO: 314552 - RNA, 22 nt, Bordetella pertussis
gcggccucgccggccuggcgcg

SEQ ID NO: 314553 - RNA, 18 nt, Bordetella pertussis
gcggccucggcgggcggc

SEQ ID NO: 314554 - RNA, 17 nt, Bordetella pertussis
gcggccugcagaccagc

SEQ ID NO: 314555 - RNA, 15 nt, Bordetella pertussis
gcggccugcgccggc

SEQ ID NO: 314556 - RNA, 16 nt, Bordetella pertussis
gcggccugcgcguccc

SEQ ID NO: 314557 - RNA, 21 nt, Bordetella pertussis
gcggcgaacacgucgcgggcg

SEQ ID NO: 314558 - RNA, 17 nt, Bordetella pertussis
gcggcgaaggcgcggcu

SEQ ID NO: 314559 - RNA, 20 nt, Bordetella pertussis
gcggcgacacccccagggcg

SEQ ID NO: 314560 - RNA, 14 nt, Bordetella pertussis
gcggcgacagggcg

SEQ ID NO: 314561 - RNA, 19 nt, Bordetella pertussis
gcggcgacagggcgucguc

SEQ ID NO: 314562 - RNA, 18 nt, Bordetella pertussis
gcggcgacugccccagcg

SEQ ID NO: 314563 - RNA, 23 nt, Bordetella pertussis
gcggcgacuucgccgaugaccag

SEQ ID NO: 314564 - RNA, 19 nt, Bordetella pertussis
gcggcgagcaauccgucag

SEQ ID NO: 314565 - RNA, 16 nt, Bordetella pertussis
gcggcgagcacggccu

SEQ ID NO: 314566 - RNA, 13 nt, Bordetella pertussis
gcggcgagccgcg

SEQ ID NO: 314567 - RNA, 16 nt, Bordetella pertussis
gcggcgagcgccgcca

SEQ ID NO: 314568 - RNA, 20 nt, Bordetella pertussis
gcggcgagcgccgccaggcc

SEQ ID NO: 314569 - RNA, 14 nt, Bordetella pertussis
gcggcgagcgcggc

SEQ ID NO: 314570 - RNA, 19 nt, Bordetella pertussis
gcggcgagcucggcauggc

SEQ ID NO: 314571 - RNA, 14 nt, Bordetella pertussis
gcggcgagcuggcc

SEQ ID NO: 314572 - RNA, 18 nt, Bordetella pertussis
gcggcgaggcguccagcc

SEQ ID NO: 314573 - RNA, 19 nt, Bordetella pertussis
gcggcgaggcguccagccc

SEQ ID NO: 314574 - RNA, 21 nt, Bordetella pertussis
gcggcgauacgcgccgccugg

SEQ ID NO: 314575 - RNA, 22 nt, Bordetella pertussis
gcggcgauacgcgccgccuggc

SEQ ID NO: 314576 - RNA, 20 nt, Bordetella pertussis
gcggcgaucaacgugcgcca

SEQ ID NO: 314577 - RNA, 21 nt, Bordetella pertussis
gcggcgaucaacgugcgccag

SEQ ID NO: 314578 - RNA, 23 nt, Bordetella pertussis
gcggcgaucaacgugcgccaggc

SEQ ID NO: 314579 - RNA, 16 nt, Bordetella pertussis
gcggcgaucacgccgu

SEQ ID NO: 314580 - RNA, 17 nt, Bordetella pertussis
gcggcgaucacgccguc

SEQ ID NO: 314581 - RNA, 18 nt, Bordetella pertussis
gcggcgaucacgccgucg

SEQ ID NO: 314582 - RNA, 16 nt, Bordetella pertussis
gcggcgauccgccgcg

SEQ ID NO: 314583 - RNA, 17 nt, Bordetella pertussis
gcggcgauccgccgcgg

SEQ ID NO: 314584 - RNA, 22 nt, Bordetella pertussis
gcggcgauccgccgcggccagc

SEQ ID NO: 314585 - RNA, 23 nt, Bordetella pertussis
gcggcgaucucgcgcgcgcgguc

SEQ ID NO: 314586 - RNA, 16 nt, Bordetella pertussis
gcggcgaucucgucga

SEQ ID NO: 314587 - RNA, 23 nt, Bordetella pertussis
gcggcgaucucgucgaccgccuc

SEQ ID NO: 314588 - RNA, 18 nt, Bordetella pertussis
gcggcgaugcacccaggc

SEQ ID NO: 314589 - RNA, 22 nt, Bordetella pertussis
gcggcgaugcacccaggcgccg

SEQ ID NO: 314590 - RNA, 12 nt, Bordetella pertussis
gcggcgaugccc

SEQ ID NO: 314591 - RNA, 14 nt, Bordetella pertussis
gcggcgaugccgcu

SEQ ID NO: 314592 - RNA, 19 nt, Bordetella pertussis
gcggcgaugccgcuggcga

SEQ ID NO: 314593 - RNA, 16 nt, Bordetella pertussis
gcggcgaugccggcca

SEQ ID NO: 314594 - RNA, 17 nt, Bordetella pertussis
gcggcgaugccggccag

SEQ ID NO: 314595 - RNA, 19 nt, Bordetella pertussis
gcggcgaugccggccagca

SEQ ID NO: 314596 - RNA, 21 nt, Bordetella pertussis
gcggcgaugccggccagcagc

SEQ ID NO: 314597 - RNA, 23 nt, Bordetella pertussis
gcggcgaugccggccagcagcga

SEQ ID NO: 314598 - RNA, 16 nt, Bordetella pertussis
gcggcgaugcgggcca

SEQ ID NO: 314599 - RNA, 19 nt, Bordetella pertussis
gcggcgauguggcgcgcca

SEQ ID NO: 314600 - RNA, 23 nt, Bordetella pertussis
gcggcgauugcggcccgcggccu

SEQ ID NO: 314601 - RNA, 19 nt, Bordetella pertussis
gcggcgauuucuacgccga

SEQ ID NO: 314602 - RNA, 15 nt, Bordetella pertussis
gcggcgcacagggcg

SEQ ID NO: 314603 - RNA, 19 nt, Bordetella pertussis
gcggcgcacagggcgucgc

SEQ ID NO: 314604 - RNA, 14 nt, Bordetella pertussis
gcggcgcaccagcg

SEQ ID NO: 314605 - RNA, 17 nt, Bordetella pertussis
gcggcgcaccgacagca

SEQ ID NO: 314606 - RNA, 23 nt, Bordetella pertussis
gcggcgcaccgacagcaagggca

SEQ ID NO: 314607 - RNA, 16 nt, Bordetella pertussis
gcggcgcagcaccagg

SEQ ID NO: 314608 - RNA, 16 nt, Bordetella pertussis
gcggcgcagcccagcg

SEQ ID NO: 314609 - RNA, 22 nt, Bordetella pertussis
gcggcgcagcccagcgcgaugu

SEQ ID NO: 314610 - RNA, 15 nt, Bordetella pertussis
gcggcgcagccgcca

SEQ ID NO: 314611 - RNA, 15 nt, Bordetella pertussis
gcggcgcagccggcc

SEQ ID NO: 314612 - RNA, 14 nt, Bordetella pertussis
gcggcgcagcgcgu

SEQ ID NO: 314613 - RNA, 17 nt, Bordetella pertussis
gcggcgcagcgcguccu

SEQ ID NO: 314614 - RNA, 23 nt, Bordetella pertussis
gcggcgcagcaucuugcgccgcu

SEQ ID NO: 314615 - RNA, 16 nt, Bordetella pertussis
gcggcgcaggccagcg

SEQ ID NO: 314616 - RNA, 17 nt, Bordetella pertussis
gcggcgcaggcgggcga

SEQ ID NO: 314617 - RNA, 17 nt, Bordetella pertussis
gcggcgcagucgcgcac

SEQ ID NO: 314618 - RNA, 18 nt, Bordetella pertussis
gcggcgcagucgcgcacg

SEQ ID NO: 314619 - RNA, 13 nt, Bordetella pertussis
gcggcgcaucagc

SEQ ID NO: 314620 - RNA, 14 nt, Bordetella pertussis
gcggcgcaucagcg

SEQ ID NO: 314621 - RNA, 17 nt, Bordetella pertussis
gcggcgcaucagcgcgc

SEQ ID NO: 314622 - RNA, 20 nt, Bordetella pertussis
gcggcgcaucagcgcgcccg

SEQ ID NO: 314623 - RNA, 18 nt, Bordetella pertussis
gcggcgcagcgcccaggc

SEQ ID NO: 314624 - RNA, 15 nt, Bordetella pertussis
gcggcgcaugcugcg

SEQ ID NO: 314625 - RNA, 16 nt, Bordetella pertussis
gcggcgcaugcugcgc

SEQ ID NO: 314626 - RNA, 22 nt, Bordetella pertussis
gcggcgcauugccgucggccgc

SEQ ID NO: 314627 - RNA, 16 nt, Bordetella pertussis
gcggcgccgaccaggu

SEQ ID NO: 314628 - RNA, 15 nt, Bordetella pertussis
gcggcgccgccggcg

SEQ ID NO: 314629 - RNA, 14 nt, Bordetella pertussis
gcggcgccgcuggc

SEQ ID NO: 314630 - RNA, 15 nt, Bordetella pertussis
gcggcgccgcuggcc

SEQ ID NO: 314631 - RNA, 19 nt, Bordetella pertussis
gcggcgccgcuggccacgu

SEQ ID NO: 314632 - RNA, 20 nt, Bordetella pertussis
gcggcgccggaucggccggc

SEQ ID NO: 314633 - RNA, 13 nt, Bordetella pertussis
gcggcgccggccg

SEQ ID NO: 314634 - RNA, 14 nt, Bordetella pertussis
gcggcgccggccgc

SEQ ID NO: 314635 - RNA, 18 nt, Bordetella pertussis
gcggcgccggccuccagc

SEQ ID NO: 314636 - RNA, 18 nt, Bordetella pertussis
gcggcgcgcacgggcgag

SEQ ID NO: 314637 - RNA, 16 nt, Bordetella pertussis
gcggcgcgccagcgcg

SEQ ID NO: 314638 - RNA, 22 nt, Bordetella pertussis
gcggcgcgccagcgcggccagc

SEQ ID NO: 314639 - RNA, 13 nt, Bordetella pertussis
gcggcgcgcccac

SEQ ID NO: 314640 - RNA, 20 nt, Bordetella pertussis
gcggcgcgcccaccagggug

SEQ ID NO: 314641 - RNA, 14 nt, Bordetella pertussis
gcggcgcgccgccg

SEQ ID NO: 314642 - RNA, 19 nt, Bordetella pertussis
gcggcgcgccgccgggccu

SEQ ID NO: 314643 - RNA, 15 nt, Bordetella pertussis
gcggcgcgccgcguc

SEQ ID NO: 314644 - RNA, 14 nt, Bordetella pertussis
gcggcgcgcgcagg

SEQ ID NO: 314645 - RNA, 15 nt, Bordetella pertussis
gcggcgcgcgcaggu

SEQ ID NO: 314646 - RNA, 16 nt, Bordetella pertussis
gcggcgcgcgcagguc

SEQ ID NO: 314647 - RNA, 13 nt, Bordetella pertussis
gcggcgcgcgcca

SEQ ID NO: 314648 - RNA, 18 nt, Bordetella pertussis
gcggcgcgcgccguucag

SEQ ID NO: 314649 - RNA, 13 nt, Bordetella pertussis
gcggcgcgcgccu

SEQ ID NO: 314650 - RNA, 16 nt, Bordetella pertussis
gcggcgcgcgccugca

SEQ ID NO: 314651 - RNA, 18 nt, Bordetella pertussis
gcggcgcgcgcgccgccu

SEQ ID NO: 314652 - RNA, 21 nt, Bordetella pertussis
gcggcgcgcgcgccgccuacc

SEQ ID NO: 314653 - RNA, 21 nt, Bordetella pertussis
gcggcgcgcggaucgaaaccg

SEQ ID NO: 314654 - RNA, 13 nt, Bordetella pertussis
gcggcgcgcgccg

SEQ ID NO: 314655 - RNA, 14 nt, Bordetella pertussis
gcggcgcgcgccag

SEQ ID NO: 314656 - RNA, 16 nt, Bordetella pertussis
gcggcgcgcggcuggg

SEQ ID NO: 314657 - RNA, 13 nt, Bordetella pertussis
gcggcgcgcugga

SEQ ID NO: 314658 - RNA, 12 nt, Bordetella pertussis
gcggcgcggcca

SEQ ID NO: 314659 - RNA, 15 nt, Bordetella pertussis
gcggcgcggccagca

SEQ ID NO: 314660 - RNA, 17 nt, Bordetella pertussis
gcggcgcggccagcagc

SEQ ID NO: 314661 - RNA, 14 nt, Bordetella pertussis
gcggcgcggccggc

SEQ ID NO: 314662 - RNA, 16 nt, Bordetella pertussis
gcggcgcggccggcuu

SEQ ID NO: 314663 - RNA, 12 nt, Bordetella pertussis
gcggcgcggccu

SEQ ID NO: 314664 - RNA, 11 nt, Bordetella pertussis
gcggcgcggcg

SEQ ID NO: 314665 - RNA, 17 nt, Bordetella pertussis
gcggcgcggcgagcacg

SEQ ID NO: 314666 - RNA, 13 nt, Bordetella pertussis
gcggcgcggcgca

SEQ ID NO: 314667 - RNA, 14 nt, Bordetella pertussis
gcggcgcggcgcca

SEQ ID NO: 314668 - RNA, 16 nt, Bordetella pertussis
gcggcgcggcgccagc

SEQ ID NO: 314669 - RNA, 13 nt, Bordetella pertussis
gcggcgcggcgcu

SEQ ID NO: 314670 - RNA, 15 nt, Bordetella pertussis
gcggcgcggcgcugg

SEQ ID NO: 314671 - RNA, 16 nt, Bordetella pertussis
gcggcgcggcgcuggc

SEQ ID NO: 314672 - RNA, 16 nt, Bordetella pertussis
gcggcgcggcggugcc

SEQ ID NO: 314673 - RNA, 13 nt, Bordetella pertussis
gcggcgcggcugg

SEQ ID NO: 314674 - RNA, 19 nt, Bordetella pertussis
gcggcgcgggcggcuaggc

SEQ ID NO: 314675 - RNA, 15 nt, Bordetella pertussis
gcggcgcggucagca

SEQ ID NO: 314676 - RNA, 22 nt, Bordetella pertussis
gcggcgcuggccugccgcgccg

SEQ ID NO: 314677 - RNA, 13 nt, Bordetella pertussis
gcggcgcuggcga

SEQ ID NO: 314678 - RNA, 14 nt, Bordetella pertussis
gcggcgcuggcgcc

SEQ ID NO: 314679 - RNA, 17 nt, Bordetella pertussis
gcggcgcuggcgccgcg

SEQ ID NO: 314680 - RNA, 18 nt, Bordetella pertussis
gcggcgcuggcuggacgc

SEQ ID NO: 314681 - RNA, 15 nt, Bordetella pertussis
gcggcggaaugugcg

SEQ ID NO: 314682 - RNA, 13 nt, Bordetella pertussis
gcggcggccaggc

SEQ ID NO: 314683 - RNA, 14 nt, Bordetella pertussis
gcggcggccaggcg

SEQ ID NO: 314684 - RNA, 22 nt, Bordetella pertussis
gcggcggccaucgccauggcca

SEQ ID NO: 314685 - RNA, 18 nt, Bordetella pertussis
gcggcggccgcguccagc

SEQ ID NO: 314686 - RNA, 14 nt, Bordetella pertussis
gcggcggcguuccu

SEQ ID NO: 314687 - RNA, 13 nt, Bordetella pertussis
gcggcggccgggg

SEQ ID NO: 314688 - RNA, 15 nt, Bordetella pertussis
gcggcggccuccagc

SEQ ID NO: 314689 - RNA, 13 nt, Bordetella pertussis
gcggcggcgucgc

SEQ ID NO: 314690 - RNA, 13 nt, Bordetella pertussis
gcggcggcuucgc

SEQ ID NO: 314691 - RNA, 19 nt, Bordetella pertussis
gcggcggcuucgcgcagca

SEQ ID NO: 314692 - RNA, 18 nt, Bordetella pertussis
gcggcggcuugccgucga

SEQ ID NO: 314693 - RNA, 20 nt, Bordetella pertussis
gcggcgggaccgugccgccg

SEQ ID NO: 314694 - RNA, 15 nt, Bordetella pertussis
gcggcgggacggcca

SEQ ID NO: 314695 - RNA, 13 nt, Bordetella pertussis
gcggcggucagcg

SEQ ID NO: 314696 - RNA, 20 nt, Bordetella pertussis
gcggcgguccucgccgguca

SEQ ID NO: 314697 - RNA, 15 nt, Bordetella pertussis
gcggcggugccagcg

SEQ ID NO: 314698 - RNA, 16 nt, Bordetella pertussis
gcggcggugccgccca

SEQ ID NO: 314699 - RNA, 16 nt, Bordetella pertussis
gcggcguccgcgccga

SEQ ID NO: 314700 - RNA, 15 nt, Bordetella pertussis
gcggcguccugccgc

SEQ ID NO: 314701 - RNA, 17 nt, Bordetella pertussis
gcggcguccugccgcga

SEQ ID NO: 314702 - RNA, 20 nt, Bordetella pertussis
gcggcgucgaaggccgccgg

SEQ ID NO: 314703 - RNA, 22 nt, Bordetella pertussis
gcggcgucgaaggccgccggac

SEQ ID NO: 314704 - RNA, 15 nt, Bordetella pertussis
gcggcgucgaccgcg

SEQ ID NO: 314705 - RNA, 19 nt, Bordetella pertussis
gcggcgucgaccgcgggcg

SEQ ID NO: 314706 - RNA, 16 nt, Bordetella pertussis
gcggcgucgacgcccg

SEQ ID NO: 314707 - RNA, 22 nt, Bordetella pertussis
gcggcgucgaucggcgcgcccg

SEQ ID NO: 314708 - RNA, 13 nt, Bordetella pertussis
gcggcgucgcguc

SEQ ID NO: 314709 - RNA, 15 nt, Bordetella pertussis
gcggcgucgcguccu

SEQ ID NO: 314710 - RNA, 16 nt, Bordetella pertussis
gcggcgucgcuggcag

SEQ ID NO: 314711 - RNA, 14 nt, Bordetella pertussis
gcggcgucgccgcg

SEQ ID NO: 314712 - RNA, 16 nt, Bordetella pertussis
gcggcgucgccgcgca

SEQ ID NO: 314713 - RNA, 15 nt, Bordetella pertussis
gcggcgucggcgccc

SEQ ID NO: 314714 - RNA, 17 nt, Bordetella pertussis
gcggcgucggcgcccgg

SEQ ID NO: 314715 - RNA, 12 nt, Bordetella pertussis
aagcugccggca

SEQ ID NO: 314716 - RNA, 19 nt, Bordetella pertussis
aagcugcugcuggaccugg

SEQ ID NO: 314717 - RNA, 19 nt, Bordetella pertussis
aagcuggccagcgguacgc

SEQ ID NO: 314718 - RNA, 16 nt, Bordetella pertussis
gcggcuaggcgcagca

SEQ ID NO: 314719 - RNA, 22 nt, Bordetella pertussis
gcggcucagagcuugccguacg

SEQ ID NO: 314720 - RNA, 22 nt, Bordetella pertussis
gcggcuugcagcggacggcgcg

SEQ ID NO: 314721 - RNA, 14 nt, Bordetella pertussis
gcggcuugccgucg

SEQ ID NO: 314722 - RNA, 15 nt, Bordetella pertussis
gcggcuugccgucga

SEQ ID NO: 314723 - RNA, 13 nt, Bordetella pertussis
gcggcuugccgcg

SEQ ID NO: 314724 - RNA, 17 nt, Bordetella pertussis
gcggcuugccgcggcgc

SEQ ID NO: 314725 - RNA, 20 nt, Bordetella pertussis
gcggcuugccgcggcgcggc

SEQ ID NO: 314726 - RNA, 22 nt, Bordetella pertussis
gcggcuugguugucgcgcaccg

SEQ ID NO: 314727 - RNA, 19 nt, Bordetella pertussis
gcggcuuucaugggccugg

SEQ ID NO: 314728 - RNA, 20 nt, Bordetella pertussis
gcggcuuucaugggccuggg

SEQ ID NO: 314729 - RNA, 21 nt, Bordetella pertussis
gcggcuuucaugggccugggc

SEQ ID NO: 314730 - RNA, 24 nt, Bordetella pertussis
gcggcuuucaugggccugggcgcc

SEQ ID NO: 314731 - RNA, 14 nt, Bordetella pertussis
gcggcuuucgccgg

SEQ ID NO: 314732 - RNA, 21 nt, Bordetella pertussis
gcggcuuucgccggaggcgcg

SEQ ID NO: 314733 - RNA, 23 nt, Bordetella pertussis
gcgggaaugucccacaggcgcgc

SEQ ID NO: 314734 - RNA, 18 nt, Bordetella pertussis
gcgggaccggcgauggcg

SEQ ID NO: 314735 - RNA, 19 nt, Bordetella pertussis
gcgggacgcaggcccagcc

SEQ ID NO: 314736 - RNA, 21 nt, Bordetella pertussis
gcgggacgcaggcccagccag

SEQ ID NO: 314737 - RNA, 21 nt, Bordetella pertussis
gcgggagaucuguaccgccgg

SEQ ID NO: 314738 - RNA, 22 nt, Bordetella pertussis
gcgggaggaagggugcggcgcc

SEQ ID NO: 314739 - RNA, 23 nt, Bordetella pertussis
gcgggaggaagggugcggcgcca

SEQ ID NO: 314740 - RNA, 23 nt, Bordetella pertussis
gcgggcacgagaucgccuggggc

SEQ ID NO: 314741 - RNA, 19 nt, Bordetella pertussis
gcgggcagcaccggggcag

SEQ ID NO: 314742 - RNA, 17 nt, Bordetella pertussis
gcgggcagcauggcgcc

SEQ ID NO: 314743 - RNA, 16 nt, Bordetella pertussis
gcgggcaggcuccaca

SEQ ID NO: 314744 - RNA, 19 nt, Bordetella pertussis
gcgggcaggcuccacagcc

SEQ ID NO: 314745 - RNA, 20 nt, Bordetella pertussis
gcgggcagggcgggggacgc

SEQ ID NO: 314746 - RNA, 17 nt, Bordetella pertussis
gcgggccagcgcggcca

SEQ ID NO: 314747 - RNA, 13 nt, Bordetella pertussis
gcgggcaucgccc

SEQ ID NO: 314748 - RNA, 12 nt, Bordetella pertussis
gcgggccaggcc

SEQ ID NO: 314749 - RNA, 15 nt, Bordetella pertussis
gcgggccaggccggu

SEQ ID NO: 314750 - RNA, 16 nt, Bordetella pertussis
gcgggcccgacagcgc

SEQ ID NO: 314751 - RNA, 20 nt, Bordetella pertussis
gcgggcccgacagcgccccg

SEQ ID NO: 314752 - RNA, 16 nt, Bordetella pertussis
gcgggcccgcaucgcg

SEQ ID NO: 314753 - RNA, 20 nt, Bordetella pertussis
gcgggcccgcaucgcgcgcc

SEQ ID NO: 314754 - RNA, 16 nt, Bordetella pertussis
gcgggcccgcucggcc

SEQ ID NO: 314755 - RNA, 19 nt, Bordetella pertussis
gcgggcgauguagggcagc

SEQ ID NO: 314756 - RNA, 17 nt, Bordetella pertussis
gcgggcgcaagccagca

SEQ ID NO: 314757 - RNA, 12 nt, Bordetella pertussis
gcgggcgcagcg

SEQ ID NO: 314758 - RNA, 14 nt, Bordetella pertussis
gcgggcgccaucgc

SEQ ID NO: 314759 - RNA, 14 nt, Bordetella pertussis
gcgggcgcccggcc

SEQ ID NO: 314760 - RNA, 16 nt, Bordetella pertussis
gcgggcgcccggccgg

SEQ ID NO: 314761 - RNA, 15 nt, Bordetella pertussis
gcgggcggccggcgc

SEQ ID NO: 314762 - RNA, 23 nt, Bordetella pertussis
gcgggcggccuaucaccugggca

SEQ ID NO: 314763 - RNA, 24 nt, Bordetella pertussis
gcgggcggccgacgggcggcugcu

SEQ ID NO: 314764 - RNA, 16 nt, Bordetella pertussis
gcgggcggccugggag

SEQ ID NO: 314765 - RNA, 13 nt, Bordetella pertussis
gcgggcggcgcca

SEQ ID NO: 314766 - RNA, 16 nt, Bordetella pertussis
gcgggcggcgccagcg

SEQ ID NO: 314767 - RNA, 15 nt, Bordetella pertussis
gcgggcggcgccggc

SEQ ID NO: 314768 - RNA, 16 nt, Bordetella pertussis
gcgggcggcgccggcc

SEQ ID NO: 314769 - RNA, 20 nt, Bordetella pertussis
gcgggcggcgcgcccagcgg

SEQ ID NO: 314770 - RNA, 22 nt, Bordetella pertussis
gcgggcggcgcgcccagcggca

SEQ ID NO: 314771 - RNA, 13 nt, Bordetella pertussis
gcgggcggcgcgg

SEQ ID NO: 314772 - RNA, 15 nt, Bordetella pertussis
gcgggcggcgcggcc

SEQ ID NO: 314773 - RNA, 16 nt, Bordetella pertussis
gcgggcggcgcggcca

SEQ ID NO: 314774 - RNA, 11 nt, Bordetella pertussis
gcgggcggcgc

SEQ ID NO: 314775 - RNA, 20 nt, Bordetella pertussis
gcgggcggcuaggcgcagca

SEQ ID NO: 314776 - RNA, 16 nt, Bordetella pertussis
gcgggcggcugcccgg

SEQ ID NO: 314777 - RNA, 15 nt, Bordetella pertussis
gcgggcgggccgcgg

SEQ ID NO: 314778 - RNA, 16 nt, Bordetella pertussis
gcgggcggugcggccu

SEQ ID NO: 314779 - RNA, 17 nt, Bordetella pertussis
gcgggcggugcggccuc

SEQ ID NO: 314780 - RNA, 17 nt, Bordetella pertussis
gcgggcguacccgucga

SEQ ID NO: 314781 - RNA, 19 nt, Bordetella pertussis
gcgggcgugaugccgacca

SEQ ID NO: 314782 - RNA, 22 nt, Bordetella pertussis
gcgggcgugaugccgaccaggc

SEQ ID NO: 314783 - RNA, 23 nt, Bordetella pertussis
gcgggcgugaugccgaccaggcc

SEQ ID NO: 314784 - RNA, 21 nt, Bordetella pertussis
gcgggcucagcccgccuggcg

SEQ ID NO: 314785 - RNA, 22 nt, Bordetella pertussis
gcgggcucagcccgccuggcgc

SEQ ID NO: 314786 - RNA, 15 nt, Bordetella pertussis
gcgggcugcgcgggu

SEQ ID NO: 314787 - RNA, 22 nt, Bordetella pertussis
gcgggcuuguuuuccaucagcu

SEQ ID NO: 314788 - RNA, 17 nt, Bordetella pertussis
gcggggaauucgaccgg

SEQ ID NO: 314789 - RNA, 15 nt, Bordetella pertussis
gcggggacaggcaca

SEQ ID NO: 314790 - RNA, 17 nt, Bordetella pertussis
gcggggacaggcaccga

SEQ ID NO: 314791 - RNA, 18 nt, Bordetella pertussis
gcggggacaggcaccgcc

SEQ ID NO: 314792 - RNA, 15 nt, Bordetella pertussis
gcggggacaggcgcc

SEQ ID NO: 314793 - RNA, 20 nt, Bordetella pertussis
gcggggacaggcucccgcug

SEQ ID NO: 314794 - RNA, 15 nt, Bordetella pertussis
gcggggacuggcucc

SEQ ID NO: 314795 - RNA, 18 nt, Bordetella pertussis
gcggggauguuccggcug

SEQ ID NO: 314796 - RNA, 20 nt, Bordetella pertussis
gcggggauguuccggcugga

SEQ ID NO: 314797 - RNA, 13 nt, Bordetella pertussis
gcggggcaccgga

SEQ ID NO: 314798 - RNA, 15 nt, Bordetella pertussis
gcggggccaggcgca

SEQ ID NO: 314799 - RNA, 16 nt, Bordetella pertussis
gcggggccaggcgcag

SEQ ID NO: 314800 - RNA, 14 nt, Bordetella pertussis
gcggggcaggccga

SEQ ID NO: 314801 - RNA, 22 nt, Bordetella pertussis
gcggggccgcuucggccugcgc

SEQ ID NO: 314802 - RNA, 14 nt, Bordetella pertussis
gcggggcgcccagc

SEQ ID NO: 314803 - RNA, 15 nt, Bordetella pertussis
gcggggcgcccagcg

SEQ ID NO: 314804 - RNA, 17 nt, Bordetella pertussis
gcggggcgcccagcgcg

SEQ ID NO: 314805 - RNA, 13 nt, Bordetella pertussis
gcggggcggcagg

SEQ ID NO: 314806 - RNA, 17 nt, Bordetella pertussis
gcggggcuggccagcug

SEQ ID NO: 314807 - RNA, 16 nt, Bordetella pertussis
gcgggggacgcccgcc

SEQ ID NO: 314808 - RNA, 12 nt, Bordetella pertussis
gcgggggugcgc

SEQ ID NO: 314809 - RNA, 14 nt, Bordetella pertussis
gcgggggugcgcga

SEQ ID NO: 314810 - RNA, 21 nt, Bordetella pertussis
gcgggguaggccucgaccgcg

SEQ ID NO: 314811 - RNA, 13 nt, Bordetella pertussis
gcggggugccugc

SEQ ID NO: 314812 - RNA, 16 nt, Bordetella pertussis
gcggggugccuguccc

SEQ ID NO: 314813 - RNA, 19 nt, Bordetella pertussis
gcgggguuggccgccagga

SEQ ID NO: 314814 - RNA, 17 nt, Bordetella pertussis
gcgggucaaggcggggc

SEQ ID NO: 314815 - RNA, 18 nt, Bordetella pertussis
gcgggucaaggcggggcu

SEQ ID NO: 314816 - RNA, 22 nt, Bordetella pertussis
gcgggucaaguccggcgccgcc

SEQ ID NO: 314817 - RNA, 17 nt, Bordetella pertussis
gcggguauucgaaggca

SEQ ID NO: 314818 - RNA, 13 nt, Bordetella pertussis
gcgggucaggccg

SEQ ID NO: 314819 - RNA, 21 nt, Bordetella pertussis
gcggguccacguggcgacguc

SEQ ID NO: 314820 - RNA, 12 nt, Bordetella pertussis
gcggguccagca

SEQ ID NO: 314821 - RNA, 14 nt, Bordetella pertussis
gcggguccaggccc

SEQ ID NO: 314822 - RNA, 20 nt, Bordetella pertussis
gcgggucgaguugcgcgcca

SEQ ID NO: 314823 - RNA, 16 nt, Bordetella pertussis
gcgggucggcgccaug

SEQ ID NO: 314824 - RNA, 18 nt, Bordetella pertussis
gcgggucgucccagcgca

SEQ ID NO: 314825 - RNA, 20 nt, Bordetella pertussis
gcgggucgucccagcgcacg

SEQ ID NO: 314826 - RNA, 22 nt, Bordetella pertussis
gcgggucuugagcggcccgggc

SEQ ID NO: 314827 - RNA, 14 nt, Bordetella pertussis
gcgggugccugucc

SEQ ID NO: 314828 - RNA, 22 nt, Bordetella pertussis
gcgggugcgggcaaacggcggc

SEQ ID NO: 314829 - RNA, 19 nt, Bordetella pertussis
gcgggugcugcagcgcacc

SEQ ID NO: 314830 - RNA, 20 nt, Bordetella pertussis
gcgggugcugcagcgcacca

SEQ ID NO: 314831 - RNA, 14 nt, Bordetella pertussis
gcggguggccucgc

SEQ ID NO: 314832 - RNA, 16 nt, Bordetella pertussis
gcggguggccucgccc

SEQ ID NO: 314833 - RNA, 18 nt, Bordetella pertussis
gcgggugggcauccagcg

SEQ ID NO: 314834 - RNA, 16 nt, Bordetella pertussis
gcgggugggcgcgccg

SEQ ID NO: 314835 - RNA, 15 nt, Bordetella pertussis
gcggguggugcugcu

SEQ ID NO: 314836 - RNA, 17 nt, Bordetella pertussis
gcggguucgacgccggc

SEQ ID NO: 314837 - RNA, 19 nt, Bordetella pertussis
gcggguucgacgccggcag

SEQ ID NO: 314838 - RNA, 14 nt, Bordetella pertussis
gcggguucgcccgg

SEQ ID NO: 314839 - RNA, 15 nt, Bordetella pertussis
gcggguugcgcgcca

SEQ ID NO: 314840 - RNA, 16 nt, Bordetella pertussis
gcggguugcgcgccag

SEQ ID NO: 314841 - RNA, 13 nt, Bordetella pertussis
gcggguugcggca

SEQ ID NO: 314842 - RNA, 23 nt, Bordetella pertussis
gcggguuggucgucagcgccgcg

SEQ ID NO: 314843 - RNA, 14 nt, Bordetella pertussis
gcggguugugcccg

SEQ ID NO: 314844 - RNA, 14 nt, Bordetella pertussis
gcgguacgcaccgc

SEQ ID NO: 314845 - RNA, 18 nt, Bordetella pertussis
gcgguacgcaccgccgcc

SEQ ID NO: 314846 - RNA, 15 nt, Bordetella pertussis
gcgguacgcccagcu

SEQ ID NO: 314847 - RNA, 16 nt, Bordetella pertussis
gcgguacgcccagcug

SEQ ID NO: 314848 - RNA, 14 nt, Bordetella pertussis
gcgguacugcggcg

SEQ ID NO: 314849 - RNA, 16 nt, Bordetella pertussis
gcgguacugcggcgcc

SEQ ID NO: 314850 - RNA, 17 nt, Bordetella pertussis
gcgguacugcggcgccu

SEQ ID NO: 314851 - RNA, 15 nt, Bordetella pertussis
gcgguagacgccggg

SEQ ID NO: 314852 - RNA, 21 nt, Bordetella pertussis
gcgguaucccaccugcagcca

SEQ ID NO: 314853 - RNA, 15 nt, Bordetella pertussis
gcgguaugcggcgcc

SEQ ID NO: 314854 - RNA, 16 nt, Bordetella pertussis
gcgguaugcggcgccc

SEQ ID NO: 314855 - RNA, 18 nt, Bordetella pertussis
gcgguaugcggcgcccag

SEQ ID NO: 314856 - RNA, 20 nt, Bordetella pertussis
gcgguaugcggcgcccaggc

SEQ ID NO: 314857 - RNA, 13 nt, Bordetella pertussis
gcgguauggccgc

SEQ ID NO: 314858 - RNA, 19 nt, Bordetella pertussis
gcgguauggccgcccagca

SEQ ID NO: 314859 - RNA, 20 nt, Bordetella pertussis
gcgguauggccgcccagcau

SEQ ID NO: 314860 - RNA, 15 nt, Bordetella pertussis
gcgguauucggcgac

SEQ ID NO: 314861 - RNA, 14 nt, Bordetella pertussis
gcgguauugcgcca

SEQ ID NO: 314862 - RNA, 14 nt, Bordetella pertussis
gcggucaaugcggc

SEQ ID NO: 314863 - RNA, 15 nt, Bordetella pertussis
gcggucaaugcggcg

SEQ ID NO: 314864 - RNA, 19 nt, Bordetella pertussis
gcggucaaugcggcggcgc

SEQ ID NO: 314865 - RNA, 22 nt, Bordetella pertussis
gcggucaauguauuuggcggcu

SEQ ID NO: 314866 - RNA, 22 nt, Bordetella pertussis
gcggucagucgggacggcgcgg

SEQ ID NO: 314867 - RNA, 18 nt, Bordetella pertussis
gcggucaugccgaacagc

SEQ ID NO: 314868 - RNA, 21 nt, Bordetella pertussis
gcggucaugccgaacagcaug

SEQ ID NO: 314869 - RNA, 13 nt, Bordetella pertussis
gcgguccacagcc

SEQ ID NO: 314870 - RNA, 16 nt, Bordetella pertussis
gcgguccacagcccgg

SEQ ID NO: 314871 - RNA, 18 nt, Bordetella pertussis
gcgguccacagcccggcc

SEQ ID NO: 314872 - RNA, 22 nt, Bordetella pertussis
gcgguccacagcccggccccca

SEQ ID NO: 314873 - RNA, 23 nt, Bordetella pertussis
gcgguccaccucgucguccagcg

SEQ ID NO: 314874 - RNA, 12 nt, Bordetella pertussis
gcgguccacgcc

SEQ ID NO: 314875 - RNA, 20 nt, Bordetella pertussis
gcgguccagcaccagggcgc

SEQ ID NO: 314876 - RNA, 13 nt, Bordetella pertussis
gcgguccagcacg

SEQ ID NO: 314877 - RNA, 20 nt, Bordetella pertussis
gcgguccgguucgcccacca

SEQ ID NO: 314878 - RNA, 18 nt, Bordetella pertussis
gcgguccugaccggcggc

SEQ ID NO: 314879 - RNA, 18 nt, Bordetella pertussis
gcggucgagacgauggcc

SEQ ID NO: 314880 - RNA, 15 nt, Bordetella pertussis
gcggucgaggcgcag

SEQ ID NO: 314881 - RNA, 17 nt, Bordetella pertussis
gcggucgaggcgcaguc

SEQ ID NO: 314882 - RNA, 17 nt, Bordetella pertussis
gcguagccgaucuggcc

SEQ ID NO: 314883 - RNA, 19 nt, Bordetella pertussis
gcguagccggugcgcagca

SEQ ID NO: 314884 - RNA, 13 nt, Bordetella pertussis
gcguagcgcggcc

SEQ ID NO: 314885 - RNA, 15 nt, Bordetella pertussis
gcguagcgcggccgg

SEQ ID NO: 314886 - RNA, 15 nt, Bordetella pertussis
gcguagcugcgccgc

SEQ ID NO: 314887 - RNA, 16 nt, Bordetella pertussis
gcguaggccucgcgcu

SEQ ID NO: 314888 - RNA, 13 nt, Bordetella pertussis
gcguaggcgcgcg

SEQ ID NO: 314889 - RNA, 20 nt, Bordetella pertussis
gcguaggucaggcccacgcc

SEQ ID NO: 314890 - RNA, 13 nt, Bordetella pertussis
gcguaucgccgcc

SEQ ID NO: 314891 - RNA, 20 nt, Bordetella pertussis
gcguaugacagggugccugu

SEQ ID NO: 314892 - RNA, 17 nt, Bordetella pertussis
gcguaugcggcagcagg

SEQ ID NO: 314893 - RNA, 22 nt, Bordetella pertussis
gcguauggcccgccaccacggc

SEQ ID NO: 314894 - RNA, 20 nt, Bordetella pertussis
gcguauugcuccacaggccu

SEQ ID NO: 314895 - RNA, 12 nt, Bordetella pertussis
gcgucaccggcg

SEQ ID NO: 314896 - RNA, 13 nt, Bordetella pertussis
gcgucacgcacag

SEQ ID NO: 314897 - RNA, 12 nt, Bordetella pertussis
gcgucacgcggc

SEQ ID NO: 314898 - RNA, 18 nt, Bordetella pertussis
gcgucacgcggccgggca

SEQ ID NO: 314899 - RNA, 20 nt, Bordetella pertussis
gcgucaguugggcgcgccca

SEQ ID NO: 314900 - RNA, 15 nt, Bordetella pertussis
gcgucauacgacgcg

SEQ ID NO: 314901 - RNA, 21 nt, Bordetella pertussis
gcgucauacgacgcggcaugc

SEQ ID NO: 314902 - RNA, 15 nt, Bordetella pertussis
gcgucaugcgcaccu

SEQ ID NO: 314903 - RNA, 21 nt, Bordetella pertussis
gcgucaugcgcaccuugucgc

SEQ ID NO: 314904 - RNA, 15 nt, Bordetella pertussis
gcgucauggccuggc

SEQ ID NO: 314905 - RNA, 14 nt, Bordetella pertussis
gcgucauguccgag

SEQ ID NO: 314906 - RNA, 18 nt, Bordetella pertussis
gcguccaagcagacccgc

SEQ ID NO: 314907 - RNA, 19 nt, Bordetella pertussis
gcguccaccaccaggccgg

SEQ ID NO: 314908 - RNA, 21 nt, Bordetella pertussis
gcguccaccaccaggccggcc

SEQ ID NO: 314909 - RNA, 23 nt, Bordetella pertussis
gcguccaccaccaggccggccag

SEQ ID NO: 314910 - RNA, 14 nt, Bordetella pertussis
gcguccaccgccga

SEQ ID NO: 314911 - RNA, 20 nt, Bordetella pertussis
gcguccacgccguggcgcaa

SEQ ID NO: 314912 - RNA, 12 nt, Bordetella pertussis
gcguccacggca

SEQ ID NO: 314913 - RNA, 21 nt, Bordetella pertussis
gcguccacggcaucggccagc

SEQ ID NO: 314914 - RNA, 22 nt, Bordetella pertussis
gcguccaccuugacgcgcaggc

SEQ ID NO: 314915 - RNA, 12 nt, Bordetella pertussis
gcguccagcagc

SEQ ID NO: 314916 - RNA, 13 nt, Bordetella pertussis
gcguccagccgag

SEQ ID NO: 314917 - RNA, 15 nt, Bordetella pertussis
gcguccagccgcccg

SEQ ID NO: 314918 - RNA, 22 nt, Bordetella pertussis
gcguccagccugcccgggcagc

SEQ ID NO: 314919 - RNA, 13 nt, Bordetella pertussis
gcguccgccgugc

SEQ ID NO: 314920 - RNA, 17 nt, Bordetella pertussis
gcguccgccgugcaggc

SEQ ID NO: 314921 - RNA, 15 nt, Bordetella pertussis
gcguccgcgcgccgc

SEQ ID NO: 314922 - RNA, 16 nt, Bordetella pertussis
gcguccgcgcgccgcu

SEQ ID NO: 314923 - RNA, 19 nt, Bordetella pertussis
gcguccgcucaugccggca

SEQ ID NO: 314924 - RNA, 20 nt, Bordetella pertussis
gcguccggccccaggaugcg

SEQ ID NO: 314925 - RNA, 17 nt, Bordetella pertussis
gcguccgcgucgccgcc

SEQ ID NO: 314926 - RNA, 18 nt, Bordetella pertussis
gcguccgcgucgccgccg

SEQ ID NO: 314927 - RNA, 20 nt, Bordetella pertussis
gcguccugggccgagcgcgc

SEQ ID NO: 314928 - RNA, 21 nt, Bordetella pertussis
gcguccugggccgagcgcgcc

SEQ ID NO: 314929 - RNA, 15 nt, Bordetella pertussis
gcguccuuggcggcc

SEQ ID NO: 314930 - RNA, 20 nt, Bordetella pertussis
gcgucgaaacgcugcgcgau

SEQ ID NO: 314931 - RNA, 18 nt, Bordetella pertussis
gcgucgaacggccgggcg

SEQ ID NO: 314932 - RNA, 22 nt, Bordetella pertussis
gcgucgaacggccgggcgccca

SEQ ID NO: 314933 - RNA, 16 nt, Bordetella pertussis
gcgucgaaggccgccg

SEQ ID NO: 314934 - RNA, 20 nt, Bordetella pertussis
gcgucgaaggcggccggcag

SEQ ID NO: 314935 - RNA, 13 nt, Bordetella pertussis
gcgucgagcacgc

SEQ ID NO: 314936 - RNA, 19 nt, Bordetella pertussis
gcgucgagcagcgcaucga

SEQ ID NO: 314937 - RNA, 19 nt, Bordetella pertussis
gcgucgagcaggccggcgu

SEQ ID NO: 314938 - RNA, 16 nt, Bordetella pertussis
gcgucgagcggcgugu

SEQ ID NO: 314939 - RNA, 17 nt, Bordetella pertussis
gcgucgagcugacgaag

SEQ ID NO: 314940 - RNA, 12 nt, Bordetella pertussis
gcgucgaucagc

SEQ ID NO: 314941 - RNA, 22 nt, Bordetella pertussis
gcgucgaucaugaugcgcuggg

SEQ ID NO: 314942 - RNA, 23 nt, Bordetella pertussis
gcgucgauccggcagcagcagcg

SEQ ID NO: 314943 - RNA, 20 nt, Bordetella pertussis
gcgucgaucggcgcgcccgc

SEQ ID NO: 314944 - RNA, 22 nt, Bordetella pertussis
gcgucgaucggcgcgcccgcca

SEQ ID NO: 314945 - RNA, 18 nt, Bordetella pertussis
gcgucgaucuucgccugc

SEQ ID NO: 314946 - RNA, 22 nt, Bordetella pertussis
gcgucgaucuucgccugcaugg

SEQ ID NO: 314947 - RNA, 19 nt, Bordetella pertussis
gcgucgccgcuggccagcc

SEQ ID NO: 314948 - RNA, 20 nt, Bordetella pertussis
gcgucgccgcuggccagccg

SEQ ID NO: 314949 - RNA, 12 nt, Bordetella pertussis
gcgucgccggcc

SEQ ID NO: 314950 - RNA, 14 nt, Bordetella pertussis
gcgucgccggccag

SEQ ID NO: 314951 - RNA, 17 nt, Bordetella pertussis
gcgucgccggccaggca

SEQ ID NO: 314952 - RNA, 18 nt, Bordetella pertussis
gcgucgccggcgaugacg

SEQ ID NO: 314953 - RNA, 20 nt, Bordetella pertussis
gcgucgcgaugcgccaggcg

SEQ ID NO: 314954 - RNA, 20 nt, Bordetella pertussis
gcgucgcugcuggcggcgcu

SEQ ID NO: 314955 - RNA, 23 nt, Bordetella pertussis
gcgucgcugcuggcggcgcuggu

SEQ ID NO: 314956 - RNA, 16 nt, Bordetella pertussis
gcgucggacgcgcgcc

SEQ ID NO: 314957 - RNA, 17 nt, Bordetella pertussis
gcgucggacgcgcgccg

SEQ ID NO: 314958 - RNA, 13 nt, Bordetella pertussis
gcgucggccacgu

SEQ ID NO: 314959 - RNA, 17 nt, Bordetella pertussis
gcgucggccacgucgcc

SEQ ID NO: 314960 - RNA, 19 nt, Bordetella pertussis
gcgucggccaaggccggcg

SEQ ID NO: 314961 - RNA, 12 nt, Bordetella pertussis
gcgucggccagg

SEQ ID NO: 314962 - RNA, 15 nt, Bordetella pertussis
gcgucggccaggccg

SEQ ID NO: 314963 - RNA, 14 nt, Bordetella pertussis
gcgucggccaggcg

SEQ ID NO: 314964 - RNA, 15 nt, Bordetella pertussis
gcgucggccaggcgc

SEQ ID NO: 314965 - RNA, 17 nt, Bordetella pertussis
gcgucggccaggcgcca

SEQ ID NO: 314966 - RNA, 14 nt, Bordetella pertussis
gcgucggccgcgcc

SEQ ID NO: 314967 - RNA, 21 nt, Bordetella pertussis
gcgucggccucaucgagcgcc

SEQ ID NO: 314968 - RNA, 13 nt, Bordetella pertussis
gcgucggccugca

SEQ ID NO: 314969 - RNA, 14 nt, Bordetella pertussis
gcgucggccugcca

SEQ ID NO: 314970 - RNA, 15 nt, Bordetella pertussis
gcgucggccugccag

SEQ ID NO: 314971 - RNA, 18 nt, Bordetella pertussis
gcgucggccugccagccu

SEQ ID NO: 314972 - RNA, 16 nt, Bordetella pertussis
gcgucggcgcccggcg

SEQ ID NO: 314973 - RNA, 17 nt, Bordetella pertussis
gcgucggcgcccggcgc

SEQ ID NO: 314974 - RNA, 19 nt, Bordetella pertussis
gcgucgucgcgguccagca

SEQ ID NO: 314975 - RNA, 18 nt, Bordetella pertussis
gcgucgucgggaccggcg

SEQ ID NO: 314976 - RNA, 15 nt, Bordetella pertussis
gcgucgucguuuccc

SEQ ID NO: 314977 - RNA, 19 nt, Bordetella pertussis
gcgucgucguuucccagca

SEQ ID NO: 314978 - RNA, 18 nt, Bordetella pertussis
gcgucguggggcgcggcg

SEQ ID NO: 314979 - RNA, 20 nt, Bordetella pertussis
gcgucguugcgccgaucgcg

SEQ ID NO: 314980 - RNA, 19 nt, Bordetella pertussis
gcgucuccagcgccggcag

SEQ ID NO: 314981 - RNA, 16 nt, Bordetella pertussis
gcgucuccagcgcggc

SEQ ID NO: 314982 - RNA, 17 nt, Bordetella pertussis
gcgucuccagcgcggcg

SEQ ID NO: 314983 - RNA, 18 nt, Bordetella pertussis
gcgucucgcccacccccg

SEQ ID NO: 314984 - RNA, 22 nt, Bordetella pertussis
gcgucucgggcugggugaagcc

SEQ ID NO: 314985 - RNA, 20 nt, Bordetella pertussis
gcgucugcccgcgguccagc

SEQ ID NO: 314986 - RNA, 21 nt, Bordetella pertussis
gcgucugcccgcgguccagca

SEQ ID NO: 314987 - RNA, 23 nt, Bordetella pertussis
gcgucugcccgcgguccagcacg

SEQ ID NO: 314988 - RNA, 20 nt, Bordetella pertussis
gcgucugcuacaccgugcug

SEQ ID NO: 314989 - RNA, 24 nt, Bordetella pertussis
gcgucugcuacaccgugcuggccg

SEQ ID NO: 314990 - RNA, 21 nt, Bordetella pertussis
gcgucugcucgccguucuucg

SEQ ID NO: 314991 - RNA, 20 nt, Bordetella pertussis
gcgugaacgcgcauucgucg

SEQ ID NO: 314992 - RNA, 18 nt, Bordetella pertussis
gcgugaagcccauggcgu

SEQ ID NO: 314993 - RNA, 18 nt, Bordetella pertussis
gcgugaaggucggcacga

SEQ ID NO: 314994 - RNA, 14 nt, Bordetella pertussis
gcgugaagucggcc

SEQ ID NO: 314995 - RNA, 15 nt, Bordetella pertussis
gcgugaagucggccg

SEQ ID NO: 314996 - RNA, 20 nt, Bordetella pertussis
gcgugaccagcugcaccagg

SEQ ID NO: 314997 - RNA, 22 nt, Bordetella pertussis
gcgugaccagcugcaccaggcu

SEQ ID NO: 314998 - RNA, 15 nt, Bordetella pertussis
gcgugaccgacaggc

SEQ ID NO: 314999 - RNA, 16 nt, Bordetella pertussis
gcgugaccgacaggcc

SEQ ID NO: 315000 - RNA, 19 nt, Bordetella pertussis
gcgugaccgacaggccugg

SEQ ID NO: 315001 - RNA, 20 nt, Bordetella pertussis
gcgugaccgacaggccuggc

SEQ ID NO: 315002 - RNA, 13 nt, Bordetella pertussis
gcgugcaggccgc

SEQ ID NO: 315003 - RNA, 15 nt, Bordetella pertussis
gcgugcaggccggcg

SEQ ID NO: 315004 - RNA, 19 nt, Bordetella pertussis
gcgugcagguaggacggcg

SEQ ID NO: 315005 - RNA, 13 nt, Bordetella pertussis
gcgugccagcagg

SEQ ID NO: 315006 - RNA, 12 nt, Bordetella pertussis
gcgugcccagcg

SEQ ID NO: 315007 - RNA, 18 nt, Bordetella pertussis
gcgugcccagggccacga

SEQ ID NO: 315008 - RNA, 22 nt, Bordetella pertussis
gcgugcccaguuucgcgaccac

SEQ ID NO: 315009 - RNA, 12 nt, Bordetella pertussis
gcgugccaggug

SEQ ID NO: 315010 - RNA, 21 nt, Bordetella pertussis
gcgugcccguugccgcgcgcg

SEQ ID NO: 315011 - RNA, 22 nt, Bordetella pertussis
gcgugcccguugccgcgcgcga

SEQ ID NO: 315012 - RNA, 17 nt, Bordetella pertussis
gcgugcccuugaccgac

SEQ ID NO: 315013 - RNA, 21 nt, Bordetella pertussis
gcgugcccuugggggcccaca

SEQ ID NO: 315014 - RNA, 12 nt, Bordetella pertussis
gcgugccgccca

SEQ ID NO: 315015 - RNA, 13 nt, Bordetella pertussis
gcgugccgccggc

SEQ ID NO: 315016 - RNA, 14 nt, Bordetella pertussis
gcgugccgccggcg

SEQ ID NO: 315017 - RNA, 11 nt, Bordetella pertussis
gcgugccgcgc

SEQ ID NO: 315018 - RNA, 19 nt, Bordetella pertussis
gcgugccgcgcaggucggc

SEQ ID NO: 315019 - RNA, 22 nt, Bordetella pertussis
gcgugccgcgcugggcgcugcu

SEQ ID NO: 315020 - RNA, 22 nt, Bordetella pertussis
gcgugccgggaugcugcucggc

SEQ ID NO: 315021 - RNA, 23 nt, Bordetella pertussis
gcgugcgagcagaugcaccggcc

SEQ ID NO: 315022 - RNA, 12 nt, Bordetella pertussis
gcgugcgcagcu

SEQ ID NO: 315023 - RNA, 14 nt, Bordetella pertussis
gcgugcgcagcugu

SEQ ID NO: 315024 - RNA, 15 nt, Bordetella pertussis
gcgugcgcaucagcg

SEQ ID NO: 315025 - RNA, 16 nt, Bordetella pertussis
gcgugcgcccauggcg

SEQ ID NO: 315026 - RNA, 19 nt, Bordetella pertussis
gcgugcgcccauggcgcgc

SEQ ID NO: 315027 - RNA, 20 nt, Bordetella pertussis
gcgugcgcccauggcgcgca

SEQ ID NO: 315028 - RNA, 22 nt, Bordetella pertussis
gcgugcgccgggcuguccgcca

SEQ ID NO: 315029 - RNA, 17 nt, Bordetella pertussis
gcgugcgcgaccuccgg

SEQ ID NO: 315030 - RNA, 13 nt, Bordetella pertussis
gcgugcgcgcgcc

SEQ ID NO: 315031 - RNA, 12 nt, Bordetella pertussis
gcgugcgcggcc

SEQ ID NO: 315032 - RNA, 19 nt, Bordetella pertussis
gcgugcgcggccgcgcgcu

SEQ ID NO: 315033 - RNA, 23 nt, Bordetella pertussis
gcgugcgcgggcgccaucgcggu

SEQ ID NO: 315034 - RNA, 21 nt, Bordetella pertussis
gcgugcggauggucgagcgcc

SEQ ID NO: 315035 - RNA, 24 nt, Bordetella pertussis
gcgugcggauggucgagcgccugc

SEQ ID NO: 315036 - RNA, 14 nt, Bordetella pertussis
gcgugcggcccagc

SEQ ID NO: 315037 - RNA, 15 nt, Bordetella pertussis
gcgugcggcccagcc

SEQ ID NO: 315038 - RNA, 16 nt, Bordetella pertussis
gcguggccgccacgcc

SEQ ID NO: 315039 - RNA, 15 nt, Bordetella pertussis
gcguggccgcgcugc

SEQ ID NO: 315040 - RNA, 23 nt, Bordetella pertussis
gcguggccguucggugcgcagcg

SEQ ID NO: 315041 - RNA, 15 nt, Bordetella pertussis
gcguggcgacgcgcu

SEQ ID NO: 315042 - RNA, 18 nt, Bordetella pertussis
gcguggcgacgcgcugcc

SEQ ID NO: 315043 - RNA, 22 nt, Bordetella pertussis
gcguggcgcagucgagcaccgc

SEQ ID NO: 315044 - RNA, 13 nt, Bordetella pertussis
gcguggcgcagug

SEQ ID NO: 315045 - RNA, 22 nt, Bordetella pertussis
gcguggcgcgaugugacggcuc

SEQ ID NO: 315046 - RNA, 20 nt, Bordetella pertussis
gcguggcgcgcacacuggcc

SEQ ID NO: 315047 - RNA, 12 nt, Bordetella pertussis
gcguggcgcgcc

SEQ ID NO: 315048 - RNA, 13 nt, Bordetella pertussis
gcguggcgcgcca

SEQ ID NO: 315049 - RNA, 16 nt, Bordetella pertussis
gcguggcgcgccagcg

SEQ ID NO: 315050 - RNA, 17 nt, Bordetella pertussis
gcguggcgcgcccgcac

SEQ ID NO: 315051 - RNA, 13 nt, Bordetella pertussis
gcguggcgcgcgc

SEQ ID NO: 315052 - RNA, 14 nt, Bordetella pertussis
gcguggcgcgcgcc

SEQ ID NO: 315053 - RNA, 15 nt, Bordetella pertussis
gcguggcgcgcgccg

SEQ ID NO: 315054 - RNA, 20 nt, Bordetella pertussis
gcguggcgcgcgccgaugcg

SEQ ID NO: 315055 - RNA, 16 nt, Bordetella pertussis
gcguggcgcgcgugcu

SEQ ID NO: 315056 - RNA, 15 nt, Bordetella pertussis
gcguggcggccaggc

SEQ ID NO: 315057 - RNA, 16 nt, Bordetella pertussis
gcguggcggccaggcc

SEQ ID NO: 315058 - RNA, 12 nt, Bordetella pertussis
gcguggcggcgc

SEQ ID NO: 315059 - RNA, 20 nt, Bordetella pertussis
gcguggcggcgcagcgccca

SEQ ID NO: 315060 - RNA, 19 nt, Bordetella pertussis
gcguggcgggccgcgccgc

SEQ ID NO: 315061 - RNA, 19 nt, Bordetella pertussis
gcguggcggggauggcugg

SEQ ID NO: 315062 - RNA, 23 nt, Bordetella pertussis
gcguggcggggauggcuggccga

SEQ ID NO: 315063 - RNA, 21 nt, Bordetella pertussis
gcguggcgguguuggcgucca

SEQ ID NO: 315064 - RNA, 15 nt, Bordetella pertussis
gcguggugcccugcu

SEQ ID NO: 315065 - RNA, 14 nt, Bordetella pertussis
gcgugguggccuug

SEQ ID NO: 315066 - RNA, 18 nt, Bordetella pertussis
gcgugguggccuugcugc

SEQ ID NO: 315067 - RNA, 23 nt, Bordetella pertussis
gcgugguggccuugcugcccgac

SEQ ID NO: 315068 - RNA, 14 nt, Bordetella pertussis
gcguguagagcagg

SEQ ID NO: 315069 - RNA, 17 nt, Bordetella pertussis
gcguguagagcaggccg

SEQ ID NO: 315070 - RNA, 18 nt, Bordetella pertussis
gcguguccagcggcgcca

SEQ ID NO: 315071 - RNA, 20 nt, Bordetella pertussis
gcguguccagcggcgccagc

SEQ ID NO: 315072 - RNA, 21 nt, Bordetella pertussis
gcguguccagcggcgccagcg

SEQ ID NO: 315073 - RNA, 17 nt, Bordetella pertussis
gcgugucgaacaccagg

SEQ ID NO: 315074 - RNA, 19 nt, Bordetella pertussis
gcgugugcccagcaccagg

SEQ ID NO: 315075 - RNA, 22 nt, Bordetella pertussis
gcgugugcccagcaccaggccg

SEQ ID NO: 315076 - RNA, 23 nt, Bordetella pertussis
gcgugugcccagcaccaggccga

SEQ ID NO: 315077 - RNA, 16 nt, Bordetella pertussis
gcgugugccgccagcg

SEQ ID NO: 315078 - RNA, 14 nt, Bordetella pertussis
gcgugugguuggcg

SEQ ID NO: 315079 - RNA, 19 nt, Bordetella pertussis
gcgugugguuggcgcugcu

SEQ ID NO: 315080 - RNA, 16 nt, Bordetella pertussis
gcgugugucccggcgg

SEQ ID NO: 315081 - RNA, 20 nt, Bordetella pertussis
gcguguucagcgcgcgcgcc

SEQ ID NO: 315082 - RNA, 21 nt, Bordetella pertussis
gcguguucagcgcgcgcgccg

SEQ ID NO: 315083 - RNA, 17 nt, Bordetella pertussis
gcguuccagcagaucgc

SEQ ID NO: 315084 - RNA, 20 nt, Bordetella pertussis
gcguuccagcagaucgcggc

SEQ ID NO: 315085 - RNA, 16 nt, Bordetella pertussis
gcguuccuggcgcugu

SEQ ID NO: 315086 - RNA, 16 nt, Bordetella pertussis
gcguuccugggcacgc

SEQ ID NO: 315087 - RNA, 15 nt, Bordetella pertussis
gcguucgacgggcag

SEQ ID NO: 315088 - RNA, 23 nt, Bordetella pertussis
gcguucgacgggcaggcccagcc

SEQ ID NO: 315089 - RNA, 16 nt, Bordetella pertussis
gcguucgacuucgucc

SEQ ID NO: 315090 - RNA, 20 nt, Bordetella pertussis
gcguucgacuucguccggcg

SEQ ID NO: 315091 - RNA, 17 nt, Bordetella pertussis
gcguucgcccgugccgc

SEQ ID NO: 315092 - RNA, 15 nt, Bordetella pertussis
gcguucgccgcagcc

SEQ ID NO: 315093 - RNA, 16 nt, Bordetella pertussis
gcguucgccgcagccg

SEQ ID NO: 315094 - RNA, 15 nt, Bordetella pertussis
gcguucggcaccggc

SEQ ID NO: 315095 - RNA, 17 nt, Bordetella pertussis
gcguucgggacgcagga

SEQ ID NO: 315096 - RNA, 15 nt, Bordetella pertussis
gcguucgggcggcag

SEQ ID NO: 315097 - RNA, 22 nt, Bordetella pertussis
gcguucucgacccgcucggcca

SEQ ID NO: 315098 - RNA, 17 nt, Bordetella pertussis
gcguugaccgccucgau

SEQ ID NO: 315099 - RNA, 21 nt, Bordetella pertussis
gcguugaccggcuggcgcacg

SEQ ID NO: 315100 - RNA, 15 nt, Bordetella pertussis
gcguugagcagcaug

SEQ ID NO: 315101 - RNA, 23 nt, Bordetella pertussis
gcguugagcagcaugugcucggg

SEQ ID NO: 315102 - RNA, 16 nt, Bordetella pertussis
gcguugaucaucggcc

SEQ ID NO: 315103 - RNA, 13 nt, Bordetella pertussis
gcguugcaccgcg

SEQ ID NO: 315104 - RNA, 13 nt, Bordetella pertussis
gcguugcgcgacu

SEQ ID NO: 315105 - RNA, 16 nt, Bordetella pertussis
gcguugcgcaucgcgc

SEQ ID NO: 315106 - RNA, 14 nt, Bordetella pertussis
gcguugcgcugccc

SEQ ID NO: 315107 - RNA, 15 nt, Bordetella pertussis
gcguugcggcagcgg

SEQ ID NO: 315108 - RNA, 15 nt, Bordetella pertussis
gcguugcgguagcgc

SEQ ID NO: 315109 - RNA, 21 nt, Bordetella pertussis
gcguugcuggcaaagcgcgcg

SEQ ID NO: 315110 - RNA, 21 nt, Bordetella pertussis
gcguuggccgggucgcgcagc

SEQ ID NO: 315111 - RNA, 17 nt, Bordetella pertussis
gcguuggcggccggcca

SEQ ID NO: 315112 - RNA, 21 nt, Bordetella pertussis
gcguuggcggccggccagcca

SEQ ID NO: 315113 - RNA, 18 nt, Bordetella pertussis
gcguuggucugcaaggug

SEQ ID NO: 315114 - RNA, 13 nt, Bordetella pertussis
gcguugugccggc

SEQ ID NO: 315115 - RNA, 18 nt, Bordetella pertussis
gcguugugccggcgcagg

SEQ ID NO: 315116 - RNA, 19 nt, Bordetella pertussis
gcguuguucgggccggcug

SEQ ID NO: 315117 - RNA, 17 nt, Bordetella pertussis
gcguuucccucggugcu

SEQ ID NO: 315118 - RNA, 22 nt, Bordetella pertussis
gcguuucgaugaauuccagcca

SEQ ID NO: 315119 - RNA, 16 nt, Bordetella pertussis
gcuacagcucgccggc

SEQ ID NO: 315120 - RNA, 17 nt, Bordetella pertussis
gcuacagcucgccggcg

SEQ ID NO: 315121 - RNA, 18 nt, Bordetella pertussis
gcuacagggugccgcgcc

SEQ ID NO: 315122 - RNA, 19 nt, Bordetella pertussis
gcuaccacguggucuggaa

SEQ ID NO: 315123 - RNA, 12 nt, Bordetella pertussis
gcuaccaggcgc

SEQ ID NO: 315124 - RNA, 16 nt, Bordetella pertussis
gcuaccaggcgcgcgc

SEQ ID NO: 315125 - RNA, 23 nt, Bordetella pertussis
gcuacccccugaccggcggcguc

SEQ ID NO: 315126 - RNA, 18 nt, Bordetella pertussis
gcuacgacgagaucgcgc

SEQ ID NO: 315127 - RNA, 20 nt, Bordetella pertussis
gcuacgacgagaucgcgccu

SEQ ID NO: 315128 - RNA, 21 nt, Bordetella pertussis
gcuacgcauagguaucggccc

SEQ ID NO: 315129 - RNA, 16 nt, Bordetella pertussis
gcuacgccgccgaugg

SEQ ID NO: 315130 - RNA, 21 nt, Bordetella pertussis
gcuacggcaagguccaggcgc

SEQ ID NO: 315131 - RNA, 23 nt, Bordetella pertussis
gcuacggcaagguccaggcgcgc

SEQ ID NO: 315132 - RNA, 16 nt, Bordetella pertussis
gcuacguguccugccg

SEQ ID NO: 315133 - RNA, 13 nt, Bordetella pertussis
gcuaggaucgcga

SEQ ID NO: 315134 - RNA, 13 nt, Bordetella pertussis
gcuaggcgcagca

SEQ ID NO: 315135 - RNA, 21 nt, Bordetella pertussis
gcuaggcgcagcaggccagga

SEQ ID NO: 315136 - RNA, 18 nt, Bordetella pertussis
gcuaguacaccgucgcgc

SEQ ID NO: 315137 - RNA, 17 nt, Bordetella pertussis
gcuaucauccgcgcaug

SEQ ID NO: 315138 - RNA, 22 nt, Bordetella pertussis
gcuaucguggcuggcgaggacc

SEQ ID NO: 315139 - RNA, 16 nt, Bordetella pertussis
gcuaugcagcugcgcc

SEQ ID NO: 315140 - RNA, 17 nt, Bordetella pertussis
gcuaugcagcugcgcca

SEQ ID NO: 315141 - RNA, 16 nt, Bordetella pertussis
gcuaugggggcgagcg

SEQ ID NO: 315142 - RNA, 18 nt, Bordetella pertussis
gcuaugggggcgagcggg

SEQ ID NO: 315143 - RNA, 22 nt, Bordetella pertussis
gcuaugggggcgagcgggccgg

SEQ ID NO: 315144 - RNA, 23 nt, Bordetella pertussis
gcucaacgaagaacagccgcugc

SEQ ID NO: 315145 - RNA, 15 nt, Bordetella pertussis
gcucaacggccacca

SEQ ID NO: 315146 - RNA, 18 nt, Bordetella pertussis
gcucaaccucgacgcgca

SEQ ID NO: 315147 - RNA, 20 nt, Bordetella pertussis
gcucaaccucgacgcgcauu

SEQ ID NO: 315148 - RNA, 16 nt, Bordetella pertussis
gcucaauucggccuga

SEQ ID NO: 315149 - RNA, 16 nt, Bordetella pertussis
gcucaccgagggccgg

SEQ ID NO: 315150 - RNA, 16 nt, Bordetella pertussis
gcucaccucgcgcuug

SEQ ID NO: 315151 - RNA, 16 nt, Bordetella pertussis
gcucacggggcugucg

SEQ ID NO: 315152 - RNA, 22 nt, Bordetella pertussis
gcucacggggcugucgcgcgca

SEQ ID NO: 315153 - RNA, 20 nt, Bordetella pertussis
gcuccgauucucaccagcgc

SEQ ID NO: 315154 - RNA, 21 nt, Bordetella pertussis
gcuccgauucucaccagcgca

SEQ ID NO: 315155 - RNA, 19 nt, Bordetella pertussis
gcuccgccauggaggcgca

SEQ ID NO: 315156 - RNA, 19 nt, Bordetella pertussis
gcuccgguacgccugcacc

SEQ ID NO: 315157 - RNA, 21 nt, Bordetella pertussis
gcuccgggucgagcgccgaag

SEQ ID NO: 315158 - RNA, 18 nt, Bordetella pertussis
gcuccguuccgaugcugg

SEQ ID NO: 315159 - RNA, 18 nt, Bordetella pertussis
gcuccucgcgcgcggacu

SEQ ID NO: 315160 - RNA, 16 nt, Bordetella pertussis
gcuccucggccugccg

SEQ ID NO: 315161 - RNA, 19 nt, Bordetella pertussis
gcuccucggccugccggcg

SEQ ID NO: 315162 - RNA, 22 nt, Bordetella pertussis
gcuccucggccugccggcgcgc

SEQ ID NO: 315163 - RNA, 14 nt, Bordetella pertussis
gcuccugccaggcg

SEQ ID NO: 315164 - RNA, 13 nt, Bordetella pertussis
gcucgaccgucag

SEQ ID NO: 315165 - RNA, 20 nt, Bordetella pertussis
gcucgaccuugucgcccgau

SEQ ID NO: 315166 - RNA, 21 nt, Bordetella pertussis
gcucgacgccaucucgcgcgc

SEQ ID NO: 315167 - RNA, 22 nt, Bordetella pertussis
gcucgacgccaucucgcgcgcu

SEQ ID NO: 315168 - RNA, 21 nt, Bordetella pertussis
gcucgacuucgucgggcucgg

SEQ ID NO: 315169 - RNA, 18 nt, Bordetella pertussis
gcucgagcaagggccaga

SEQ ID NO: 315170 - RNA, 15 nt, Bordetella pertussis
gcucgaucgccgccg

SEQ ID NO: 315171 - RNA, 17 nt, Bordetella pertussis
gcucgaucgccgccggc

SEQ ID NO: 315172 - RNA, 17 nt, Bordetella pertussis
gcucgaucaggcgcucc

SEQ ID NO: 315173 - RNA, 19 nt, Bordetella pertussis
gcucgaucaggcgcuccau

SEQ ID NO: 315174 - RNA, 22 nt, Bordetella pertussis
gcucgaucuucucgacggcgcg

SEQ ID NO: 315175 - RNA, 15 nt, Bordetella pertussis
gcucgaugaccagca

SEQ ID NO: 315176 - RNA, 17 nt, Bordetella pertussis
gcucgaugaccagcagc

SEQ ID NO: 315177 - RNA, 19 nt, Bordetella pertussis
gcucgaugaccagcagcga

SEQ ID NO: 315178 - RNA, 19 nt, Bordetella pertussis
gcucgaucugguuggccac

SEQ ID NO: 315179 - RNA, 22 nt, Bordetella pertussis
gcucgaugccggccucggccau

SEQ ID NO: 315180 - RNA, 14 nt, Bordetella pertussis
gcucgcccucgcgc

SEQ ID NO: 315181 - RNA, 16 nt, Bordetella pertussis
gcucgcccucgcgcca

SEQ ID NO: 315182 - RNA, 22 nt, Bordetella pertussis
gcucgcccuugagcacggcgcg

SEQ ID NO: 315183 - RNA, 18 nt, Bordetella pertussis
gcucgccgagccgggcca

SEQ ID NO: 315184 - RNA, 19 nt, Bordetella pertussis
gcucgccgcgcacgggcgc

SEQ ID NO: 315185 - RNA, 12 nt, Bordetella pertussis
gcucgccggcca

SEQ ID NO: 315186 - RNA, 16 nt, Bordetella pertussis
gcucgccggccagcgc

SEQ ID NO: 315187 - RNA, 18 nt, Bordetella pertussis
gcucgccggcgauggcgu

SEQ ID NO: 315188 - RNA, 13 nt, Bordetella pertussis
gcucgccggcgcg

SEQ ID NO: 315189 - RNA, 14 nt, Bordetella pertussis
gcucgccggcgcgc

SEQ ID NO: 315190 - RNA, 15 nt, Bordetella pertussis
gcucgccggcgcgca

SEQ ID NO: 315191 - RNA, 15 nt, Bordetella pertussis
gcucgccgucgacgc

SEQ ID NO: 315192 - RNA, 17 nt, Bordetella pertussis
gcucgccgucgacgccg

SEQ ID NO: 315193 - RNA, 18 nt, Bordetella pertussis
gcucgccgucgacgccga

SEQ ID NO: 315194 - RNA, 23 nt, Bordetella pertussis
gcucgcgcagcguggcggcgacg

SEQ ID NO: 315195 - RNA, 18 nt, Bordetella pertussis
gcucgcgcaugucccgca

SEQ ID NO: 315196 - RNA, 13 nt, Bordetella pertussis
gcucgcgccaggc

SEQ ID NO: 315197 - RNA, 15 nt, Bordetella pertussis
gcucgcgccagggcc

SEQ ID NO: 315198 - RNA, 15 nt, Bordetella pertussis
gcucgcgcgccagca

SEQ ID NO: 315199 - RNA, 16 nt, Bordetella pertussis
gcucgcgcgcgcgggc

SEQ ID NO: 315200 - RNA, 21 nt, Bordetella pertussis
gcucgcgcgcgcgggcgcgca

SEQ ID NO: 315201 - RNA, 15 nt, Bordetella pertussis
gcucgcgcgcgugcu

SEQ ID NO: 315202 - RNA, 16 nt, Bordetella pertussis
gcucgcgcucggccag

SEQ ID NO: 315203 - RNA, 18 nt, Bordetella pertussis
gcucgcgucuaucaggau

SEQ ID NO: 315204 - RNA, 23 nt, Bordetella pertussis
gcucgcgucuaucaggaucaccg

SEQ ID NO: 315205 - RNA, 17 nt, Bordetella pertussis
gcucgcugucgugccgc

SEQ ID NO: 315206 - RNA, 18 nt, Bordetella pertussis
gcucggccacgcgcaacg

SEQ ID NO: 315207 - RNA, 17 nt, Bordetella pertussis
gcucggccacgcgcugc

SEQ ID NO: 315208 - RNA, 16 nt, Bordetella pertussis
gcucggccagcagugu

SEQ ID NO: 315209 - RNA, 13 nt, Bordetella pertussis
gcucggccagcau

SEQ ID NO: 315210 - RNA, 12 nt, Bordetella pertussis
gcucggccagcg

SEQ ID NO: 315211 - RNA, 13 nt, Bordetella pertussis
gcucggccagcga

SEQ ID NO: 315212 - RNA, 14 nt, Bordetella pertussis
gcucggccagcgag

SEQ ID NO: 315213 - RNA, 14 nt, Bordetella pertussis
gcucggccagcgcg

SEQ ID NO: 315214 - RNA, 15 nt, Bordetella pertussis
gcucggccagcgcgc

SEQ ID NO: 315215 - RNA, 16 nt, Bordetella pertussis
gcucggccagcgcgcg

SEQ ID NO: 315216 - RNA, 15 nt, Bordetella pertussis
gcucggccaggugcg

SEQ ID NO: 315217 - RNA, 21 nt, Bordetella pertussis
gcucggcgacggucaggggca

SEQ ID NO: 315218 - RNA, 20 nt, Bordetella pertussis
gcucggcgaucugcgcggcg

SEQ ID NO: 315219 - RNA, 15 nt, Bordetella pertussis
gcucggcgaugcgcc

SEQ ID NO: 315220 - RNA, 13 nt, Bordetella pertussis
gcucgggcucgac

SEQ ID NO: 315221 - RNA, 17 nt, Bordetella pertussis
gcucgggcucgcgcgcg

SEQ ID NO: 315222 - RNA, 14 nt, Bordetella pertussis
gcucgggcugcggc

SEQ ID NO: 315223 - RNA, 20 nt, Bordetella pertussis
gcucggucauguccagcgcc

SEQ ID NO: 315224 - RNA, 21 nt, Bordetella pertussis
gcucggucauguccagcgcca

SEQ ID NO: 315225 - RNA, 21 nt, Bordetella pertussis
gcucggucggaaacacgucca

SEQ ID NO: 315226 - RNA, 16 nt, Bordetella pertussis
gcucggucucgcccau

SEQ ID NO: 315227 - RNA, 21 nt, Bordetella pertussis
gcucggugaugauggccaggu

SEQ ID NO: 315228 - RNA, 15 nt, Bordetella pertussis
gcucggugcagccca

SEQ ID NO: 315229 - RNA, 16 nt, Bordetella pertussis
gcucggugcgggccgg

SEQ ID NO: 315230 - RNA, 15 nt, Bordetella pertussis
gcucggugcucuggc

SEQ ID NO: 315231 - RNA, 13 nt, Bordetella pertussis
gcucguaucgccc

SEQ ID NO: 315232 - RNA, 13 nt, Bordetella pertussis
gcucguaggcgag

SEQ ID NO: 315233 - RNA, 21 nt, Bordetella pertussis
gcucguaggcgagguccaggc

SEQ ID NO: 315234 - RNA, 17 nt, Bordetella pertussis
gcucgucaugaucccgc

SEQ ID NO: 315235 - RNA, 18 nt, Bordetella pertussis
gcucgucaugaucccgcg

SEQ ID NO: 315236 - RNA, 20 nt, Bordetella pertussis
gcucguccagguugcccgag

SEQ ID NO: 315237 - RNA, 21 nt, Bordetella pertussis
gcucguccagguugcccgagc

SEQ ID NO: 315238 - RNA, 15 nt, Bordetella pertussis
gcucguccaugccgg

SEQ ID NO: 315239 - RNA, 18 nt, Bordetella pertussis
gcucguccaugccggcca

SEQ ID NO: 315240 - RNA, 17 nt, Bordetella pertussis
gcucgucgacgcggccg

SEQ ID NO: 315241 - RNA, 14 nt, Bordetella pertussis
gcucgucgccaugc

SEQ ID NO: 315242 - RNA, 16 nt, Bordetella pertussis
gcucgucgccaugcgg

SEQ ID NO: 315243 - RNA, 18 nt, Bordetella pertussis
gcucgucgccaugcggcu

SEQ ID NO: 315244 - RNA, 19 nt, Bordetella pertussis
gcucgucgccgcuggacag

SEQ ID NO: 315245 - RNA, 20 nt, Bordetella pertussis
gcucgugcaucaucugggcg

SEQ ID NO: 315246 - RNA, 21 nt, Bordetella pertussis
gcucgugcgcauacagggcgg

SEQ ID NO: 315247 - RNA, 15 nt, Bordetella pertussis
gcucgugcuggccgg

SEQ ID NO: 315248 - RNA, 15 nt, Bordetella pertussis
gcucguggcgcgccu

SEQ ID NO: 315249 - RNA, 23 nt, Bordetella pertussis
gcucuggcacaccagcgccagga

SEQ ID NO: 315250 - RNA, 18 nt, Bordetella pertussis
gcucuucgacagcgcgca

SEQ ID NO: 315251 - RNA, 16 nt, Bordetella pertussis
gcucuucgagcgcggc

SEQ ID NO: 315252 - RNA, 20 nt, Bordetella pertussis
gcucuugaccugggccagca

SEQ ID NO: 315253 - RNA, 19 nt, Bordetella pertussis
gcucuugcgcgcgccggac

SEQ ID NO: 315254 - RNA, 22 nt, Bordetella pertussis
gcucuuggcaaccucgccgcgc

SEQ ID NO: 315255 - RNA, 19 nt, Bordetella pertussis
gcucuugguggugccugcu

SEQ ID NO: 315256 - RNA, 23 nt, Bordetella pertussis
gcugaacguguaggucagcgccu

SEQ ID NO: 315257 - RNA, 17 nt, Bordetella pertussis
gcugaagaagcccggcu

SEQ ID NO: 315258 - RNA, 13 nt, Bordetella pertussis
gcugaagcgccgc

SEQ ID NO: 315259 - RNA, 14 nt, Bordetella pertussis
gcugaccgaagcgc

SEQ ID NO: 315260 - RNA, 19 nt, Bordetella pertussis
gcugaccgaagcgggcgag

SEQ ID NO: 315261 - RNA, 18 nt, Bordetella pertussis
gcugaccgacgugcgccg

SEQ ID NO: 315262 - RNA, 23 nt, Bordetella pertussis
gcugaccgagggcgcguccaagc

SEQ ID NO: 315263 - RNA, 14 nt, Bordetella pertussis
gcugaccggccugg

SEQ ID NO: 315264 - RNA, 18 nt, Bordetella pertussis
gcugaccggccuggucau

SEQ ID NO: 315265 - RNA, 22 nt, Bordetella pertussis
gcugaccggccuggucaugacg

SEQ ID NO: 315266 - RNA, 21 nt, Bordetella pertussis
gcugaccggcggcacggccgg

SEQ ID NO: 315267 - RNA, 23 nt, Bordetella pertussis
gcugaccggcggcacggccggcc

SEQ ID NO: 315268 - RNA, 22 nt, Bordetella pertussis
gcugaccggcguauggcccgcc

SEQ ID NO: 315269 - RNA, 20 nt, Bordetella pertussis
gcugaccugcacgauggcgc

SEQ ID NO: 315270 - RNA, 21 nt, Bordetella pertussis
gcugaccugcacgauggcgcc

SEQ ID NO: 315271 - RNA, 12 nt, Bordetella pertussis
gcugaccuggug

SEQ ID NO: 315272 - RNA, 19 nt, Bordetella pertussis
gcugaccuggugugccugu

SEQ ID NO: 315273 - RNA, 20 nt, Bordetella pertussis
gcugaccucgcccaggccgg

SEQ ID NO: 315274 - RNA, 21 nt, Bordetella pertussis
gcugacgaagggauagcgccg

SEQ ID NO: 315275 - RNA, 18 nt, Bordetella pertussis
gcugacgauguucaggcc

SEQ ID NO: 315276 - RNA, 20 nt, Bordetella pertussis
gcugacgcccggcucgcugu

SEQ ID NO: 315277 - RNA, 14 nt, Bordetella pertussis
gcugacggugccgg

SEQ ID NO: 315278 - RNA, 18 nt, Bordetella pertussis
gcugacggugccggccag

SEQ ID NO: 315279 - RNA, 20 nt, Bordetella pertussis
gcugacggugccggccagcc

SEQ ID NO: 315280 - RNA, 18 nt, Bordetella pertussis
gcugacugcggugccugu

SEQ ID NO: 315281 - RNA, 14 nt, Bordetella pertussis
gcugaugcgcggcg

SEQ ID NO: 315282 - RNA, 17 nt, Bordetella pertussis
gcugaugcgcggcgggc

SEQ ID NO: 315283 - RNA, 12 nt, Bordetella pertussis
gcugaugcgcgu

SEQ ID NO: 315284 - RNA, 15 nt, Bordetella pertussis
gcugaugcucgcccu

SEQ ID NO: 315285 - RNA, 14 nt, Bordetella pertussis
gcugaugcuggcau

SEQ ID NO: 315286 - RNA, 12 nt, Bordetella pertussis
gcugauggccgc

SEQ ID NO: 315287 - RNA, 12 nt, Bordetella pertussis
gcugauuucgau

SEQ ID NO: 315288 - RNA, 17 nt, Bordetella pertussis
gcugcaccugccugccg

SEQ ID NO: 315289 - RNA, 20 nt, Bordetella pertussis
gcugcacgauguugccgccg

SEQ ID NO: 315290 - RNA, 14 nt, Bordetella pertussis
gcugcacgcagcgc

SEQ ID NO: 315291 - RNA, 12 nt, Bordetella pertussis
gcugcacgcgcg

SEQ ID NO: 315292 - RNA, 12 nt, Bordetella pertussis
gcugcacgcggc

SEQ ID NO: 315293 - RNA, 14 nt, Bordetella pertussis
gcugcacgcggccg

SEQ ID NO: 315294 - RNA, 15 nt, Bordetella pertussis
gcugcacgguggaca

SEQ ID NO: 315295 - RNA, 16 nt, Bordetella pertussis
gcugcagcgucuggca

SEQ ID NO: 315296 - RNA, 23 nt, Bordetella pertussis
gcugcagcgugauggggccgggc

SEQ ID NO: 315297 - RNA, 21 nt, Bordetella pertussis
gcugcagcugcuugcccaggc

SEQ ID NO: 315298 - RNA, 16 nt, Bordetella pertussis
gcugcaggaucgcggc

SEQ ID NO: 315299 - RNA, 18 nt, Bordetella pertussis
gcugcaggaucgcggcca

SEQ ID NO: 315300 - RNA, 22 nt, Bordetella pertussis
gcugcaggaucgcggccagcgg

SEQ ID NO: 315301 - RNA, 21 nt, Bordetella pertussis
gcugcaggcccuggagaucgc

SEQ ID NO: 315302 - RNA, 17 nt, Bordetella pertussis
gcugcaggccggcgcgc

SEQ ID NO: 315303 - RNA, 18 nt, Bordetella pertussis
gcugcaggccggcgcgca

SEQ ID NO: 315304 - RNA, 12 nt, Bordetella pertussis
gcugcaggcgcg

SEQ ID NO: 315305 - RNA, 22 nt, Bordetella pertussis
gcugcaguaugcaaccggcacg

SEQ ID NO: 315306 - RNA, 14 nt, Bordetella pertussis
gcugcagggccugg

SEQ ID NO: 315307 - RNA, 21 nt, Bordetella pertussis
gcugcauacgccgcugauggc

SEQ ID NO: 315308 - RNA, 14 nt, Bordetella pertussis
gcugccagccaugu

SEQ ID NO: 315309 - RNA, 18 nt, Bordetella pertussis
gcugccaggcuaucgugg

SEQ ID NO: 315310 - RNA, 23 nt, Bordetella pertussis
gcugccaggcuaucguggcuggc

SEQ ID NO: 315311 - RNA, 19 nt, Bordetella pertussis
gcugccagggugcaccagg

SEQ ID NO: 315312 - RNA, 20 nt, Bordetella pertussis
gcugccagugguccaucagg

SEQ ID NO: 315313 - RNA, 20 nt, Bordetella pertussis
gcugccaguuguaguggugu

SEQ ID NO: 315314 - RNA, 14 nt, Bordetella pertussis
gcugccaugccgcg

SEQ ID NO: 315315 - RNA, 16 nt, Bordetella pertussis
gcugccaugccgcgcg

SEQ ID NO: 315316 - RNA, 18 nt, Bordetella pertussis
gcugccaugccgcgcgcc

SEQ ID NO: 315317 - RNA, 19 nt, Bordetella pertussis
gcugcccgaagcgcagcac

SEQ ID NO: 315318 - RNA, 18 nt, Bordetella pertussis
gcugcccgacggcgccga

SEQ ID NO: 315319 - RNA, 19 nt, Bordetella pertussis
gcugcccgccgccgcccac

SEQ ID NO: 315320 - RNA, 23 nt, Bordetella pertussis
gcugcccgccggcagugccugcg

SEQ ID NO: 315321 - RNA, 23 nt, Bordetella pertussis
gcugccguagcccagguccagcg

SEQ ID NO: 315322 - RNA, 21 nt, Bordetella pertussis
gcugccguccuugugccaggu

SEQ ID NO: 315323 - RNA, 14 nt, Bordetella pertussis
gcugccgucggcca

SEQ ID NO: 315324 - RNA, 13 nt, Bordetella pertussis
gcugccgucggcg

SEQ ID NO: 315325 - RNA, 13 nt, Bordetella pertussis
gcugccgucguau

SEQ ID NO: 315326 - RNA, 17 nt, Bordetella pertussis
gcugccgucgucgucca

SEQ ID NO: 315327 - RNA, 23 nt, Bordetella pertussis
gcugccgucgucguccaggcgca

SEQ ID NO: 315328 - RNA, 21 nt, Bordetella pertussis
gcugccguuucucaacccgcc

SEQ ID NO: 315329 - RNA, 22 nt, Bordetella pertussis
gcugccguuucucaacccgccg

SEQ ID NO: 315330 - RNA, 23 nt, Bordetella pertussis
gcugccguuucucaacccgccgg

SEQ ID NO: 315331 - RNA, 19 nt, Bordetella pertussis
gcugccguuuucgaucagg

SEQ ID NO: 315332 - RNA, 15 nt, Bordetella pertussis
gcugccugagcaccg

SEQ ID NO: 315333 - RNA, 17 nt, Bordetella pertussis
gcugccugagcaccgcc

SEQ ID NO: 315334 - RNA, 14 nt, Bordetella pertussis
gcugccugccggcc

SEQ ID NO: 315335 - RNA, 22 nt, Bordetella pertussis
gcugcgaaaaagcccgcgccac

SEQ ID NO: 315336 - RNA, 23 nt, Bordetella pertussis
gcugcgaaaggccgagccauugu

SEQ ID NO: 315337 - RNA, 17 nt, Bordetella pertussis
gcugcgacagcagcaug

SEQ ID NO: 315338 - RNA, 18 nt, Bordetella pertussis
gcugcgacagcagggcca

SEQ ID NO: 315339 - RNA, 20 nt, Bordetella pertussis
gcugcgacagcagggccagg

SEQ ID NO: 315340 - RNA, 21 nt, Bordetella pertussis
gcugcgacagcagggccaggc

SEQ ID NO: 315341 - RNA, 23 nt, Bordetella pertussis
gcugcgacagcagggccaggccc

SEQ ID NO: 315342 - RNA, 14 nt, Bordetella pertussis
gcugcgacaggcgc

SEQ ID NO: 315343 - RNA, 18 nt, Bordetella pertussis
gcugcgacaggcgcagcu

SEQ ID NO: 315344 - RNA, 22 nt, Bordetella pertussis
gcugcgcaagggagaccggguu

SEQ ID NO: 315345 - RNA, 15 nt, Bordetella pertussis
gcugcgcacgcuggc

SEQ ID NO: 315346 - RNA, 17 nt, Bordetella pertussis
gcugcgcacgcuggcgc

SEQ ID NO: 315347 - RNA, 16 nt, Bordetella pertussis
gcugcgcagcagcgcg

SEQ ID NO: 315348 - RNA, 15 nt, Bordetella pertussis
gcugcgcaggucggc

SEQ ID NO: 315349 - RNA, 19 nt, Bordetella pertussis
gcugcgcaggucggccagg

SEQ ID NO: 315350 - RNA, 14 nt, Bordetella pertussis
gcugcgcaggcgcg

SEQ ID NO: 315351 - RNA, 22 nt, Bordetella pertussis
gcugcgcgugcacgaccugcca

SEQ ID NO: 315352 - RNA, 16 nt, Bordetella pertussis
gcugcgcuugaccgcc

SEQ ID NO: 315353 - RNA, 22 nt, Bordetella pertussis
gcugcggauacgaaaccaggcc

SEQ ID NO: 315354 - RNA, 20 nt, Bordetella pertussis
gcugcggcaagggugccugu

SEQ ID NO: 315355 - RNA, 16 nt, Bordetella pertussis
gcugcggcacgauuuc

SEQ ID NO: 315356 - RNA, 18 nt, Bordetella pertussis
gcugcggcacggccagcg

SEQ ID NO: 315357 - RNA, 20 nt, Bordetella pertussis
gcugcggcacggccagcggc

SEQ ID NO: 315358 - RNA, 17 nt, Bordetella pertussis
gcugcggcagccaggug

SEQ ID NO: 315359 - RNA, 18 nt, Bordetella pertussis
gcugcggccccggcacca

SEQ ID NO: 315360 - RNA, 23 nt, Bordetella pertussis
gcugcggccccggcaccaucgcc

SEQ ID NO: 315361 - RNA, 14 nt, Bordetella pertussis
gcugcggcgcggcg

SEQ ID NO: 315362 - RNA, 15 nt, Bordetella pertussis
gcugcggcguggcgc

SEQ ID NO: 315363 - RNA, 17 nt, Bordetella pertussis
gcugcggcguggcgccg

SEQ ID NO: 315364 - RNA, 19 nt, Bordetella pertussis
gcugcggcuccugcuggcg

SEQ ID NO: 315365 - RNA, 20 nt, Bordetella pertussis
gcugcggcuccugcuggcgc

SEQ ID NO: 315366 - RNA, 21 nt, Bordetella pertussis
gcugcggcuccugcuggcgcg

SEQ ID NO: 315367 - RNA, 17 nt, Bordetella pertussis
gcugcggcugaucaccg

SEQ ID NO: 315368 - RNA, 14 nt, Bordetella pertussis
gcugcgggccggcg

SEQ ID NO: 315369 - RNA, 17 nt, Bordetella pertussis
gcugcgggcgcaagcca

SEQ ID NO: 315370 - RNA, 13 nt, Bordetella pertussis
gcugcgggcggcc

SEQ ID NO: 315371 - RNA, 15 nt, Bordetella pertussis
gcugcgggcggccug

SEQ ID NO: 315372 - RNA, 15 nt, Bordetella pertussis
gcugcugcaggccgg

SEQ ID NO: 315373 - RNA, 15 nt, Bordetella pertussis
gcugcugcaggcgcg

SEQ ID NO: 315374 - RNA, 15 nt, Bordetella pertussis
gcugcugcccgaagc

SEQ ID NO: 315375 - RNA, 17 nt, Bordetella pertussis
gcugcugauccucgcca

SEQ ID NO: 315376 - RNA, 16 nt, Bordetella pertussis
gcugcugcuggcuucg

SEQ ID NO: 315377 - RNA, 22 nt, Bordetella pertussis
gcugcuggccaagcgcgccggc

SEQ ID NO: 315378 - RNA, 17 nt, Bordetella pertussis
gcugcuggcccagacca

SEQ ID NO: 315379 - RNA, 15 nt, Bordetella pertussis
gcugcuggccggcca

SEQ ID NO: 315380 - RNA, 15 nt, Bordetella pertussis
gcugcuggccggccc

SEQ ID NO: 315381 - RNA, 23 nt, Bordetella pertussis
gcugcuggaacggugcgagaucu

SEQ ID NO: 315382 - RNA, 15 nt, Bordetella pertussis
gcugcuggagaucgc

SEQ ID NO: 315383 - RNA, 18 nt, Bordetella pertussis
gcugcuggagaucgccga

SEQ ID NO: 315384 - RNA, 12 nt, Bordetella pertussis
gcugcuggcgcg

SEQ ID NO: 315385 - RNA, 15 nt, Bordetella pertussis
gcugcuggcgcgcca

SEQ ID NO: 315386 - RNA, 18 nt, Bordetella pertussis
gcugcuggcgcgccaggc

SEQ ID NO: 315387 - RNA, 19 nt, Bordetella pertussis
gcugcugggccggcgcgcg

SEQ ID NO: 315388 - RNA, 16 nt, Bordetella pertussis
gcugcugggcgccaug

SEQ ID NO: 315389 - RNA, 14 nt, Bordetella pertussis
gcugcugugcgccg

SEQ ID NO: 315390 - RNA, 19 nt, Bordetella pertussis
gcugcuguucgccacgcug

SEQ ID NO: 315391 - RNA, 22 nt, Bordetella pertussis
gcugcuugcccaggccggcgcg

SEQ ID NO: 315392 - RNA, 17 nt, Bordetella pertussis
gcuggaacaccaugccc

SEQ ID NO: 315393 - RNA, 12 nt, Bordetella pertussis
gcuggaacgcgc

SEQ ID NO: 315394 - RNA, 20 nt, Bordetella pertussis
gcuggaacgcgccgcuggcg

SEQ ID NO: 315395 - RNA, 22 nt, Bordetella pertussis
gcuggaacguuugcggacgggc

SEQ ID NO: 315396 - RNA, 14 nt, Bordetella pertussis
gcuggaagcgcgcc

SEQ ID NO: 315397 - RNA, 15 nt, Bordetella pertussis
gcuggaagcgcgcca

SEQ ID NO: 315398 - RNA, 15 nt, Bordetella pertussis
gcuggaagacguggc

SEQ ID NO: 315399 - RNA, 21 nt, Bordetella pertussis
gcuggaagacguggcccgcgu

SEQ ID NO: 315400 - RNA, 17 nt, Bordetella pertussis
gcuggacagauccagcg

SEQ ID NO: 315401 - RNA, 18 nt, Bordetella pertussis
gcuggacagauccagcgc

SEQ ID NO: 315402 - RNA, 20 nt, Bordetella pertussis
gcuggacagauccagcgcgg

SEQ ID NO: 315403 - RNA, 22 nt, Bordetella pertussis
gcuggacagauccagcgcggcc

SEQ ID NO: 315404 - RNA, 23 nt, Bordetella pertussis
gcuggacagauccagcgcggcca

SEQ ID NO: 315405 - RNA, 19 nt, Bordetella pertussis
gcuggacccgcugcgaccc

SEQ ID NO: 315406 - RNA, 22 nt, Bordetella pertussis
gcuggacgcgccgaacaccagc

SEQ ID NO: 315407 - RNA, 23 nt, Bordetella pertussis
gcuggacgcgccgaacaccagcu

SEQ ID NO: 315408 - RNA, 17 nt, Bordetella pertussis
gcuggacgcgcgcggcg

SEQ ID NO: 315409 - RNA, 22 nt, Bordetella pertussis
gcuggacgcuuucggggcgcaa

SEQ ID NO: 315410 - RNA, 16 nt, Bordetella pertussis
gcuggacgaggcgaug

SEQ ID NO: 315411 - RNA, 17 nt, Bordetella pertussis
gcuggacuauggccugg

SEQ ID NO: 315412 - RNA, 18 nt, Bordetella pertussis
gcuggacuguccggcaac

SEQ ID NO: 315413 - RNA, 16 nt, Bordetella pertussis
gcuggagaagcgccgc

SEQ ID NO: 315414 - RNA, 13 nt, Bordetella pertussis
gcuggagauggcg

SEQ ID NO: 315415 - RNA, 18 nt, Bordetella pertussis
gcuggaggccggcgugcu

SEQ ID NO: 315416 - RNA, 20 nt, Bordetella pertussis
gcuggaggccuuccaccagc

SEQ ID NO: 315417 - RNA, 17 nt, Bordetella pertussis
gcuggagucgggcugcu

SEQ ID NO: 315418 - RNA, 23 nt, Bordetella pertussis
gcuggaucccggcgaucaugccg

SEQ ID NO: 315419 - RNA, 17 nt, Bordetella pertussis
gcuggauggccugcucg

SEQ ID NO: 315420 - RNA, 19 nt, Bordetella pertussis
gcuggauggugccgccgcc

SEQ ID NO: 315421 - RNA, 15 nt, Bordetella pertussis
gcuggcaaagcgcgc

SEQ ID NO: 315422 - RNA, 15 nt, Bordetella pertussis
gcuggcagcgaccgc

SEQ ID NO: 315423 - RNA, 15 nt, Bordetella pertussis
gcuggcaucgucgcg

SEQ ID NO: 315424 - RNA, 13 nt, Bordetella pertussis
gcuggcaugcggc

SEQ ID NO: 315425 - RNA, 17 nt, Bordetella pertussis
gcuggccaacgccacgc

SEQ ID NO: 315426 - RNA, 15 nt, Bordetella pertussis
gcuggccaagcgcgc

SEQ ID NO: 315427 - RNA, 19 nt, Bordetella pertussis
gcuggccacccgacagcuc

SEQ ID NO: 315428 - RNA, 19 nt, Bordetella pertussis
gcuggccaccgaagcggcg

SEQ ID NO: 315429 - RNA, 16 nt, Bordetella pertussis
gcuggccaccgucgcc

SEQ ID NO: 315430 - RNA, 17 nt, Bordetella pertussis
gcuggccaccgucgcca

SEQ ID NO: 315431 - RNA, 12 nt, Bordetella pertussis
gcuggccacguu

SEQ ID NO: 315432 - RNA, 18 nt, Bordetella pertussis
gcuggccacuggccgcgc

SEQ ID NO: 315433 - RNA, 24 nt, Bordetella pertussis
gcuggccacuggccgcgcucaggc

SEQ ID NO: 315434 - RNA, 13 nt, Bordetella pertussis
gcuggccagccgc

SEQ ID NO: 315435 - RNA, 14 nt, Bordetella pertussis
gcuggccagccggc

SEQ ID NO: 315436 - RNA, 15 nt, Bordetella pertussis
gcuggccagccggcc

SEQ ID NO: 315437 - RNA, 21 nt, Bordetella pertussis
gcuggccagcuggcggcgcag

SEQ ID NO: 315438 - RNA, 12 nt, Bordetella pertussis
gcuggccagcgg

SEQ ID NO: 315439 - RNA, 18 nt, Bordetella pertussis
gcuggcccacucggugcg

SEQ ID NO: 315440 - RNA, 22 nt, Bordetella pertussis
gcuggcccacucggugcgcgcg

SEQ ID NO: 315441 - RNA, 16 nt, Bordetella pertussis
gcuggcccagcugggc

SEQ ID NO: 315442 - RNA, 17 nt, Bordetella pertussis
gcuggcccaggaaaccg

SEQ ID NO: 315443 - RNA, 19 nt, Bordetella pertussis
gcuggcccaggaaaccggc

SEQ ID NO: 315444 - RNA, 21 nt, Bordetella pertussis
gcuggcccaguucgcgcagca

SEQ ID NO: 315445 - RNA, 14 nt, Bordetella pertussis
gcuggccaugccgu

SEQ ID NO: 315446 - RNA, 20 nt, Bordetella pertussis
gcuggccaugccgucgcgca

SEQ ID NO: 315447 - RNA, 23 nt, Bordetella pertussis
gcuggccaugccgucgcgcacca

SEQ ID NO: 315448 - RNA, 16 nt, Bordetella pertussis
gcuggcccgccagcaa

SEQ ID NO: 315449 - RNA, 13 nt, Bordetella pertussis
gcuggcccggguu

SEQ ID NO: 315450 - RNA, 18 nt, Bordetella pertussis
gcuggccgacgcgcuggu

SEQ ID NO: 315451 - RNA, 14 nt, Bordetella pertussis
gcuggccgccgcgc

SEQ ID NO: 315452 - RNA, 15 nt, Bordetella pertussis
gcuggccgccgcggc

SEQ ID NO: 315453 - RNA, 15 nt, Bordetella pertussis
gcuggccgccggcgc

SEQ ID NO: 315454 - RNA, 15 nt, Bordetella pertussis
gcuggccgccugcug

SEQ ID NO: 315455 - RNA, 18 nt, Bordetella pertussis
gcuggccggccaacagcu

SEQ ID NO: 315456 - RNA, 21 nt, Bordetella pertussis
gcuggccggccaacagcucgc

SEQ ID NO: 315457 - RNA, 16 nt, Bordetella pertussis
gcuggccggcgacuuc

SEQ ID NO: 315458 - RNA, 13 nt, Bordetella pertussis
gcuggccgucgcc

SEQ ID NO: 315459 - RNA, 14 nt, Bordetella pertussis
gcuggccgucgccg

SEQ ID NO: 315460 - RNA, 23 nt, Bordetella pertussis
gcuggccgucgccgcccugcugc

SEQ ID NO: 315461 - RNA, 19 nt, Bordetella pertussis
gcuggccggauauuucgcc

SEQ ID NO: 315462 - RNA, 19 nt, Bordetella pertussis
gcuggcgaagaacaccgcc

SEQ ID NO: 315463 - RNA, 22 nt, Bordetella pertussis
gcuggcgaagaacaccgccgcg

SEQ ID NO: 315464 - RNA, 23 nt, Bordetella pertussis
gcuggcgaagaacaccgccgcgc

SEQ ID NO: 315465 - RNA, 20 nt, Bordetella pertussis
gcuggccugccgcgccgacc

SEQ ID NO: 315466 - RNA, 18 nt, Bordetella pertussis
gcuggccuggccgccggc

SEQ ID NO: 315467 - RNA, 19 nt, Bordetella pertussis
gcuggcgaugcccaccagc

SEQ ID NO: 315468 - RNA, 24 nt, Bordetella pertussis
gcuggcgaugcccaccagccgccc

SEQ ID NO: 315469 - RNA, 15 nt, Bordetella pertussis
gcuggcgaugcgggc

SEQ ID NO: 315470 - RNA, 17 nt, Bordetella pertussis
gcuggcgaugcgggcca

SEQ ID NO: 315471 - RNA, 22 nt, Bordetella pertussis
gcuggcgaugguggauccgccg

SEQ ID NO: 315472 - RNA, 16 nt, Bordetella pertussis
gcuggcgcacgaugag

SEQ ID NO: 315473 - RNA, 15 nt, Bordetella pertussis
gcuggcgcacgucca

SEQ ID NO: 315474 - RNA, 17 nt, Bordetella pertussis
gcuggcgcacguccaga

SEQ ID NO: 315475 - RNA, 15 nt, Bordetella pertussis
gcuggcgcagcaggc

SEQ ID NO: 315476 - RNA, 23 nt, Bordetella pertussis
gcuggcgcagcaggcgcgcggcc

SEQ ID NO: 315477 - RNA, 15 nt, Bordetella pertussis
gcuggcgcagguccu

SEQ ID NO: 315478 - RNA, 20 nt, Bordetella pertussis
gcuggcgcaguaucccggcc

SEQ ID NO: 315479 - RNA, 21 nt, Bordetella pertussis
gcuggcgcaguaucccggcca

SEQ ID NO: 315480 - RNA, 14 nt, Bordetella pertussis
gcuggcgcccacgc

SEQ ID NO: 315481 - RNA, 14 nt, Bordetella pertussis
gcuggcgcccggcc

SEQ ID NO: 315482 - RNA, 12 nt, Bordetella pertussis
gcuggcgccgcg

SEQ ID NO: 315483 - RNA, 15 nt, Bordetella pertussis
gcuggcgccgcgcgc

SEQ ID NO: 315484 - RNA, 17 nt, Bordetella pertussis
gcuggcgccgcgcgcca

SEQ ID NO: 315485 - RNA, 22 nt, Bordetella pertussis
gcuggcgccguucgucgcgcag

SEQ ID NO: 315486 - RNA, 21 nt, Bordetella pertussis
gcuggcgcgagaaccaggcca

SEQ ID NO: 315487 - RNA, 13 nt, Bordetella pertussis
gcuggcgcgccag

SEQ ID NO: 315488 - RNA, 14 nt, Bordetella pertussis
gcuggcgcgccgcc

SEQ ID NO: 315489 - RNA, 12 nt, Bordetella pertussis
gcuggcgcggcc

SEQ ID NO: 315490 - RNA, 12 nt, Bordetella pertussis
gcuggcgcggcu

SEQ ID NO: 315491 - RNA, 14 nt, Bordetella pertussis
gcuggcgcggucca

SEQ ID NO: 315492 - RNA, 23 nt, Bordetella pertussis
gcuggcgcguugcgcaucgcgca

SEQ ID NO: 315493 - RNA, 14 nt, Bordetella pertussis
gcuggcgcgcggcc

SEQ ID NO: 315494 - RNA, 12 nt, Bordetella pertussis
gcuggcgcugcu

SEQ ID NO: 315495 - RNA, 15 nt, Bordetella pertussis
gcuggcgcuuggcca

SEQ ID NO: 315496 - RNA, 18 nt, Bordetella pertussis
gcuggcgcuuggccagcu

SEQ ID NO: 315497 - RNA, 20 nt, Bordetella pertussis
gcuggcgcucgggcgcggca

SEQ ID NO: 315498 - RNA, 21 nt, Bordetella pertussis
ggaacaccaccuccaccgcca

SEQ ID NO: 315499 - RNA, 20 nt, Bordetella pertussis
ggaacaccagcaagccggcg

SEQ ID NO: 315500 - RNA, 19 nt, Bordetella pertussis
ggaacagcguccagccgcc

SEQ ID NO: 315501 - RNA, 17 nt, Bordetella pertussis
ggaacaggcgcgccagc

SEQ ID NO: 315502 - RNA, 16 nt, Bordetella pertussis
ggaacaggucguugag

SEQ ID NO: 315503 - RNA, 11 nt, Bordetella pertussis
ggaacauggcg

SEQ ID NO: 315504 - RNA, 13 nt, Bordetella pertussis
ggaaccagccguc

SEQ ID NO: 315505 - RNA, 17 nt, Bordetella pertussis
ggaaccagcggcuggcg

SEQ ID NO: 315506 - RNA, 18 nt, Bordetella pertussis
ggaaccgguuggccagcu

SEQ ID NO: 315507 - RNA, 18 nt, Bordetella pertussis
ggaacgugccgucgggcg

SEQ ID NO: 315508 - RNA, 18 nt, Bordetella pertussis
ggaacucguuggccagcg

SEQ ID NO: 315509 - RNA, 15 nt, Bordetella pertussis
ggaacugaugccgac

SEQ ID NO: 315510 - RNA, 23 nt, Bordetella pertussis
ggaacugaugccgaccgaagagg

SEQ ID NO: 315511 - RNA, 13 nt, Bordetella pertussis
ggaacugggcgcc

SEQ ID NO: 315512 - RNA, 17 nt, Bordetella pertussis
ggaacugggcgccggcc

SEQ ID NO: 315513 - RNA, 20 nt, Bordetella pertussis
ggaacuugaacggcgcggcc

SEQ ID NO: 315514 - RNA, 20 nt, Bordetella pertussis
ggaacuugggaucggccagg

SEQ ID NO: 315515 - RNA, 23 nt, Bordetella pertussis
ggaagacguggcccgcgugacgg

SEQ ID NO: 315516 - RNA, 15 nt, Bordetella pertussis
ggaagagcuggcgcu

SEQ ID NO: 315517 - RNA, 17 nt, Bordetella pertussis
ggaagagggcggggcgu

SEQ ID NO: 315518 - RNA, 18 nt, Bordetella pertussis
ggaagagggcggggcgug

SEQ ID NO: 315519 - RNA, 16 nt, Bordetella pertussis
ggaagaucggcccggc

SEQ ID NO: 315520 - RNA, 17 nt, Bordetella pertussis
ggaagaucggcccggcg

SEQ ID NO: 315521 - RNA, 15 nt, Bordetella pertussis
ggaagccugcgcgcg

SEQ ID NO: 315522 - RNA, 15 nt, Bordetella pertussis
ggaagcgcagguuca

SEQ ID NO: 315523 - RNA, 18 nt, Bordetella pertussis
ggaagcgcgccaggcgca

SEQ ID NO: 315524 - RNA, 15 nt, Bordetella pertussis
ggaagcgcuggcccg

SEQ ID NO: 315525 - RNA, 13 nt, Bordetella pertussis
ggaagcgggccug

SEQ ID NO: 315526 - RNA, 14 nt, Bordetella pertussis
ggaagcgggccugc

SEQ ID NO: 315527 - RNA, 19 nt, Bordetella pertussis
ggaagcugacgaaacgcgc

SEQ ID NO: 315528 - RNA, 15 nt, Bordetella pertussis
ggaagcuggccagcg

SEQ ID NO: 315529 - RNA, 16 nt, Bordetella pertussis
ggaaggcccggucgug

SEQ ID NO: 315530 - RNA, 22 nt, Bordetella pertussis
ggaaggggcggcuucaggcgcg

SEQ ID NO: 315531 - RNA, 23 nt, Bordetella pertussis
ggaaggggcggcuucaggcgcgc

SEQ ID NO: 315532 - RNA, 17 nt, Bordetella pertussis
ggaagggugcggcgcca

SEQ ID NO: 315533 - RNA, 22 nt, Bordetella pertussis
ggaaguccugcaucgccaugcc

SEQ ID NO: 315534 - RNA, 15 nt, Bordetella pertussis
ggaaguucagggcga

SEQ ID NO: 315535 - RNA, 16 nt, Bordetella pertussis
ggaaucauuggccagc

SEQ ID NO: 315536 - RNA, 17 nt, Bordetella pertussis
ggaauccuggcgacggc

SEQ ID NO: 315537 - RNA, 13 nt, Bordetella pertussis
ggaaucgucgacc

SEQ ID NO: 315538 - RNA, 15 nt, Bordetella pertussis
ggaauggggcccgca

SEQ ID NO: 315539 - RNA, 14 nt, Bordetella pertussis
ggacaacgcgcgcc

SEQ ID NO: 315540 - RNA, 13 nt, Bordetella pertussis
ggacaaggcgcgc

SEQ ID NO: 315541 - RNA, 13 nt, Bordetella pertussis
ggacaaggcgcgu

SEQ ID NO: 315542 - RNA, 15 nt, Bordetella pertussis
ggacaacugcgcgaa

SEQ ID NO: 315543 - RNA, 18 nt, Bordetella pertussis
ggacacacgcucuugcgc

SEQ ID NO: 315544 - RNA, 20 nt, Bordetella pertussis
ggacacacgcucuugcgcgc

SEQ ID NO: 315545 - RNA, 14 nt, Bordetella pertussis
ggacacagcggcgc

SEQ ID NO: 315546 - RNA, 15 nt, Bordetella pertussis
ggacaccgcaggugc

SEQ ID NO: 315547 - RNA, 16 nt, Bordetella pertussis
ggacacgcccuggccg

SEQ ID NO: 315548 - RNA, 16 nt, Bordetella pertussis
ggacagcaccgacagg

SEQ ID NO: 315549 - RNA, 17 nt, Bordetella pertussis
ggacagcaccgacaggc

SEQ ID NO: 315550 - RNA, 19 nt, Bordetella pertussis
ggacagauaccgucuuggc

SEQ ID NO: 315551 - RNA, 14 nt, Bordetella pertussis
ggacagccccagca

SEQ ID NO: 315552 - RNA, 16 nt, Bordetella pertussis
ggacagcgccagcccg

SEQ ID NO: 315553 - RNA, 16 nt, Bordetella pertussis
ggacagcgcguuggcg

SEQ ID NO: 315554 - RNA, 22 nt, Bordetella pertussis
ggacaggcaccccagcaccccg

SEQ ID NO: 315555 - RNA, 15 nt, Bordetella pertussis
ggacaggcacccccg

SEQ ID NO: 315556 - RNA, 14 nt, Bordetella pertussis
ggacaggcaccccg

SEQ ID NO: 315557 - RNA, 21 nt, Bordetella pertussis
ggacaggcaccccggcgccgc

SEQ ID NO: 315558 - RNA, 17 nt, Bordetella pertussis
ggacaggcacccgcacg

SEQ ID NO: 315559 - RNA, 18 nt, Bordetella pertussis
ggacaggcacccuugccg

SEQ ID NO: 315560 - RNA, 22 nt, Bordetella pertussis
ggacaggcacccuugccgcagc

SEQ ID NO: 315561 - RNA, 22 nt, Bordetella pertussis
ggacaggcacccuugccgcggg

SEQ ID NO: 315562 - RNA, 23 nt, Bordetella pertussis
ggacaggcaccgaacgggcgugg

SEQ ID NO: 315563 - RNA, 17 nt, Bordetella pertussis
ggacaggcaccuuggcc

SEQ ID NO: 315564 - RNA, 22 nt, Bordetella pertussis
ggacaggcaccuuggcccggcg

SEQ ID NO: 315565 - RNA, 13 nt, Bordetella pertussis
ggacaggcccagc

SEQ ID NO: 315566 - RNA, 16 nt, Bordetella pertussis
ggacaggcccagcccg

SEQ ID NO: 315567 - RNA, 18 nt, Bordetella pertussis
ggacaggcccucggugcg

SEQ ID NO: 315568 - RNA, 21 nt, Bordetella pertussis
ggacaggcgcccgugcgcggc

SEQ ID NO: 315569 - RNA, 22 nt, Bordetella pertussis
ggacaggcgcccgugcgcggcg

SEQ ID NO: 315570 - RNA, 17 nt, Bordetella pertussis
ggacaggcuccgaggga

SEQ ID NO: 315571 - RNA, 22 nt, Bordetella pertussis
ggacaggcucuuuuucccggcg

SEQ ID NO: 315572 - RNA, 16 nt, Bordetella pertussis
ggacagggccgcgagc

SEQ ID NO: 315573 - RNA, 22 nt, Bordetella pertussis
ggacaggucggcgcccacgccg

SEQ ID NO: 315574 - RNA, 22 nt, Bordetella pertussis
ggaccaccccgagauaggcggc

SEQ ID NO: 315575 - RNA, 20 nt, Bordetella pertussis
ggaccagcaguugcgccagu

SEQ ID NO: 315576 - RNA, 20 nt, Bordetella pertussis
ggaccagcgguugcgccagc

SEQ ID NO: 315577 - RNA, 22 nt, Bordetella pertussis
ggaccccuugcggccgccgaac

SEQ ID NO: 315578 - RNA, 18 nt, Bordetella pertussis
ggaccgaacggccgguca

SEQ ID NO: 315579 - RNA, 13 nt, Bordetella pertussis
ggaccgcgcgcga

SEQ ID NO: 315580 - RNA, 16 nt, Bordetella pertussis
ggaccggcgauggcgu

SEQ ID NO: 315581 - RNA, 21 nt, Bordetella pertussis
ggaccggcgauggcguugaug

SEQ ID NO: 315582 - RNA, 16 nt, Bordetella pertussis
ggaccguccgcgacgg

SEQ ID NO: 315583 - RNA, 14 nt, Bordetella pertussis
ggaccucgcgccgg

SEQ ID NO: 315584 - RNA, 18 nt, Bordetella pertussis
ggaccucgcgccggucac

SEQ ID NO: 315585 - RNA, 13 nt, Bordetella pertussis
ggaccuggccacc

SEQ ID NO: 315586 - RNA, 19 nt, Bordetella pertussis
ggaccugcucgagcggcgg

SEQ ID NO: 315587 - RNA, 17 nt, Bordetella pertussis
ggaccuguacuggcugg

SEQ ID NO: 315588 - RNA, 22 nt, Bordetella pertussis
ggaccuugcgaggcccggccug

SEQ ID NO: 315589 - RNA, 23 nt, Bordetella pertussis
ggaccuuggcggcuggcgcggcc

SEQ ID NO: 315590 - RNA, 19 nt, Bordetella pertussis
ggacgaauacgcuggcgcg

SEQ ID NO: 315591 - RNA, 21 nt, Bordetella pertussis
ggacgaccaacucgaggcggc

SEQ ID NO: 315592 - RNA, 14 nt, Bordetella pertussis
ggacgagacaggcg

SEQ ID NO: 315593 - RNA, 17 nt, Bordetella pertussis
ggacgagacaggcgcgc

SEQ ID NO: 315594 - RNA, 19 nt, Bordetella pertussis
ggacgaggcgauggucggc

SEQ ID NO: 315595 - RNA, 22 nt, Bordetella pertussis
ggacgaggcgauggucggccgg

SEQ ID NO: 315596 - RNA, 16 nt, Bordetella pertussis
ggacgagggccgcggc

SEQ ID NO: 315597 - RNA, 15 nt, Bordetella pertussis
ggacgagggccggcg

SEQ ID NO: 315598 - RNA, 18 nt, Bordetella pertussis
ggacgaugcgcgaagcgc

SEQ ID NO: 315599 - RNA, 17 nt, Bordetella pertussis
ggacgcaaaaacgcccg

SEQ ID NO: 315600 - RNA, 20 nt, Bordetella pertussis
ggacgcaaaaacgcccggcg

SEQ ID NO: 315601 - RNA, 22 nt, Bordetella pertussis
ggacgcaaccggucggccggca

SEQ ID NO: 315602 - RNA, 22 nt, Bordetella pertussis
ggacgcaccuuucugcugcucg

SEQ ID NO: 315603 - RNA, 21 nt, Bordetella pertussis
ggacgccaagaccgcggccgc

SEQ ID NO: 315604 - RNA, 18 nt, Bordetella pertussis
ggacgccauggcggcggc

SEQ ID NO: 315605 - RNA, 19 nt, Bordetella pertussis
ggacgcccgcccgcugacc

SEQ ID NO: 315606 - RNA, 19 nt, Bordetella pertussis
ggacgccagcccgccggcg

SEQ ID NO: 315607 - RNA, 22 nt, Bordetella pertussis
ggacgcccuggcgcaggccggc

SEQ ID NO: 315608 - RNA, 14 nt, Bordetella pertussis
ggacgcccgcccgc

SEQ ID NO: 315609 - RNA, 14 nt, Bordetella pertussis
ggacgccgccggcc

SEQ ID NO: 315610 - RNA, 14 nt, Bordetella pertussis
ggacgccggcgccg

SEQ ID NO: 315611 - RNA, 19 nt, Bordetella pertussis
ggacgccggcgggcaggcg

SEQ ID NO: 315612 - RNA, 15 nt, Bordetella pertussis
ggacgccucgccggu

SEQ ID NO: 315613 - RNA, 16 nt, Bordetella pertussis
ggacgccucgccggug

SEQ ID NO: 315614 - RNA, 20 nt, Bordetella pertussis
ggacgcgaagaucccgccgg

SEQ ID NO: 315615 - RNA, 13 nt, Bordetella pertussis
ggacgcgccgggc

SEQ ID NO: 315616 - RNA, 20 nt, Bordetella pertussis
ggacgcgccgggcgaaccgg

SEQ ID NO: 315617 - RNA, 14 nt, Bordetella pertussis
ggacgcgcuggccg

SEQ ID NO: 315618 - RNA, 19 nt, Bordetella pertussis
ggacgcgcuguaggcgccg

SEQ ID NO: 315619 - RNA, 13 nt, Bordetella pertussis
ggacgcggccggc

SEQ ID NO: 315620 - RNA, 14 nt, Bordetella pertussis
ggacgcggccggca

SEQ ID NO: 315621 - RNA, 16 nt, Bordetella pertussis
ggacgcgggccacgcg

SEQ ID NO: 315622 - RNA, 19 nt, Bordetella pertussis
ggacgcgggccacgcgccg

SEQ ID NO: 315623 - RNA, 21 nt, Bordetella pertussis
ggacgcguccucggccagccg

SEQ ID NO: 315624 - RNA, 16 nt, Bordetella pertussis
ggacggaaguccugca

SEQ ID NO: 315625 - RNA, 15 nt, Bordetella pertussis
ggacggcagcaccgc

SEQ ID NO: 315626 - RNA, 21 nt, Bordetella pertussis
ggacggcagcaccgccaugug

SEQ ID NO: 315627 - RNA, 17 nt, Bordetella pertussis
ggacggccagcaggagc

SEQ ID NO: 315628 - RNA, 12 nt, Bordetella pertussis
ggacggccaggg

SEQ ID NO: 315629 - RNA, 15 nt, Bordetella pertussis
ggacggcgcgggcac

SEQ ID NO: 315630 - RNA, 12 nt, Bordetella pertussis
ggacggcgcugg

SEQ ID NO: 315631 - RNA, 14 nt, Bordetella pertussis
ggacggcgggcgcc

SEQ ID NO: 315632 - RNA, 15 nt, Bordetella pertussis
ggacgggaaagcggc

SEQ ID NO: 315633 - RNA, 18 nt, Bordetella pertussis
ggacgggccagccccggc

SEQ ID NO: 315634 - RNA, 17 nt, Bordetella pertussis
ggacggggaacaggcgc

SEQ ID NO: 315635 - RNA, 15 nt, Bordetella pertussis
ggacggugucgcuga

SEQ ID NO: 315636 - RNA, 19 nt, Bordetella pertussis
ggacguagucgcacgcggc

SEQ ID NO: 315637 - RNA, 17 nt, Bordetella pertussis
ggacguaguugguggca

SEQ ID NO: 315638 - RNA, 14 nt, Bordetella pertussis
ggacgugcgcgacc

SEQ ID NO: 315639 - RNA, 22 nt, Bordetella pertussis
ggacgugggcgccuacggcggc

SEQ ID NO: 315640 - RNA, 13 nt, Bordetella pertussis
ggacucgauggcg

SEQ ID NO: 315641 - RNA, 20 nt, Bordetella pertussis
ggacucgauggcgcaggcgc

SEQ ID NO: 315642 - RNA, 22 nt, Bordetella pertussis
ggacucgauggcgcaggcgcgc

SEQ ID NO: 315643 - RNA, 16 nt, Bordetella pertussis
ggacugcaggcgcugc

SEQ ID NO: 315644 - RNA, 12 nt, Bordetella pertussis
ggacugccagau

SEQ ID NO: 315645 - RNA, 13 nt, Bordetella pertussis
ggacuggccgcga

SEQ ID NO: 315646 - RNA, 12 nt, Bordetella pertussis
ggacuggcgcgc

SEQ ID NO: 315647 - RNA, 17 nt, Bordetella pertussis
ggacuggcucccaccgg

SEQ ID NO: 315648 - RNA, 13 nt, Bordetella pertussis
ggacugggcgucg

SEQ ID NO: 315649 - RNA, 22 nt, Bordetella pertussis
ggacuuagaaguccaugccgcc

SEQ ID NO: 315650 - RNA, 20 nt, Bordetella pertussis
ggacuucgucgaucauggcg

SEQ ID NO: 315651 - RNA, 21 nt, Bordetella pertussis
ggacuucguguucgcggccgg

SEQ ID NO: 315652 - RNA, 16 nt, Bordetella pertussis
ggagaaaucgccgccg

SEQ ID NO: 315653 - RNA, 14 nt, Bordetella pertussis
ggagaacaggcggc

SEQ ID NO: 315654 - RNA, 17 nt, Bordetella pertussis
ggagaaggagcgagcga

SEQ ID NO: 315655 - RNA, 16 nt, Bordetella pertussis
ggagaauccgcaggcg

SEQ ID NO: 315656 - RNA, 20 nt, Bordetella pertussis
ggagacacgcuagggcgugg

SEQ ID NO: 315657 - RNA, 16 nt, Bordetella pertussis
ggagaccggcgccugc

SEQ ID NO: 315658 - RNA, 17 nt, Bordetella pertussis
ggagaccggguugcccg

SEQ ID NO: 315659 - RNA, 20 nt, Bordetella pertussis
ggagacguagccgcugccgu

SEQ ID NO: 315660 - RNA, 13 nt, Bordetella pertussis
ggagagggccugg

SEQ ID NO: 315661 - RNA, 13 nt, Bordetella pertussis
ggagauacuggcc

SEQ ID NO: 315662 - RNA, 19 nt, Bordetella pertussis
ggagauggguacagcgcgc

SEQ ID NO: 315663 - RNA, 15 nt, Bordetella pertussis
ggagcagcagcgggc

SEQ ID NO: 315664 - RNA, 19 nt, Bordetella pertussis
ggagccaguccccgcaggg

SEQ ID NO: 315665 - RNA, 21 nt, Bordetella pertussis
ggagccaguccccgcagggac

SEQ ID NO: 315666 - RNA, 20 nt, Bordetella pertussis
ggagccgcgcacacauggcg

SEQ ID NO: 315667 - RNA, 17 nt, Bordetella pertussis
ggagccggcgggcggcu

SEQ ID NO: 315668 - RNA, 22 nt, Bordetella pertussis
ggagccggcgggcggcugcccg

SEQ ID NO: 315669 - RNA, 17 nt, Bordetella pertussis
ggagcgacacccgcggc

SEQ ID NO: 315670 - RNA, 23 nt, Bordetella pertussis
aaggcaagcagcgagagcgccac

SEQ ID NO: 315671 - RNA, 22 nt, Bordetella pertussis
aaggcagcaccucggacgagac

SEQ ID NO: 315672 - RNA, 17 nt, Bordetella pertussis
aaggcauuggcgccgcg

SEQ ID NO: 315673 - RNA, 15 nt, Bordetella pertussis
aaggccaugaucagg

SEQ ID NO: 315674 - RNA, 21 nt, Bordetella pertussis
aaggccaugaucaggccgaac

SEQ ID NO: 315675 - RNA, 20 nt, Bordetella pertussis
aaggcccggauauggccggc

SEQ ID NO: 315676 - RNA, 21 nt, Bordetella pertussis
aaggcccggauauggccggcg

SEQ ID NO: 315677 - RNA, 14 nt, Bordetella pertussis
aaggccgaggccag

SEQ ID NO: 315678 - RNA, 15 nt, Bordetella pertussis
aaggccgccggccac

SEQ ID NO: 315679 - RNA, 11 nt, Bordetella pertussis
aaggccgcgcc

SEQ ID NO: 315680 - RNA, 11 nt, Bordetella pertussis
ggagcgcggcc

SEQ ID NO: 315681 - RNA, 15 nt, Bordetella pertussis
ggagcgcggcgcugg

SEQ ID NO: 315682 - RNA, 17 nt, Bordetella pertussis
ggagcgcggcgcuggcg

SEQ ID NO: 315683 - RNA, 13 nt, Bordetella pertussis
ggagcgcggcggc

SEQ ID NO: 315684 - RNA, 23 nt, Bordetella pertussis
ggagcugcugugcgccggggcgc

SEQ ID NO: 315685 - RNA, 15 nt, Bordetella pertussis
ggaggaacugggcgc

SEQ ID NO: 315686 - RNA, 22 nt, Bordetella pertussis
ggaggcacuccgucauggcgcc

SEQ ID NO: 315687 - RNA, 14 nt, Bordetella pertussis
ggaggccgagcgcg

SEQ ID NO: 315688 - RNA, 22 nt, Bordetella pertussis
ggaggccgagcgcgagcagggc

SEQ ID NO: 315689 - RNA, 21 nt, Bordetella pertussis
ggaggcggcgcgugaugucga

SEQ ID NO: 315690 - RNA, 14 nt, Bordetella pertussis
ggaggcggccgcgg

SEQ ID NO: 315691 - RNA, 23 nt, Bordetella pertussis
ggaggcuuuguggcgucgggggc

SEQ ID NO: 315692 - RNA, 22 nt, Bordetella pertussis
ggagguaugcacgaccaggccg

SEQ ID NO: 315693 - RNA, 16 nt, Bordetella pertussis
ggagguugcccgcccg

SEQ ID NO: 315694 - RNA, 23 nt, Bordetella pertussis
ggagguugcccgcccgacgagga

SEQ ID NO: 315695 - RNA, 17 nt, Bordetella pertussis
ggagucgugcaggaugg

SEQ ID NO: 315696 - RNA, 18 nt, Bordetella pertussis
ggagucgugcaggauggc

SEQ ID NO: 315697 - RNA, 16 nt, Bordetella pertussis
ggauacggccagcgcc

SEQ ID NO: 315698 - RNA, 15 nt, Bordetella pertussis
ggauagcgccguacc

SEQ ID NO: 315699 - RNA, 18 nt, Bordetella pertussis
ggauagcggugcaggggc

SEQ ID NO: 315700 - RNA, 16 nt, Bordetella pertussis
ggauaucggccaggcg

SEQ ID NO: 315701 - RNA, 13 nt, Bordetella pertussis
ggaucaccgccgg

SEQ ID NO: 315702 - RNA, 19 nt, Bordetella pertussis
ggaucagcuugaugccggc

SEQ ID NO: 315703 - RNA, 21 nt, Bordetella pertussis
ggaucagcuugaugccggcgu

SEQ ID NO: 315704 - RNA, 12 nt, Bordetella pertussis
ggaucaggguga

SEQ ID NO: 315705 - RNA, 22 nt, Bordetella pertussis
ggauccagccauggaagcggca

SEQ ID NO: 315706 - RNA, 13 nt, Bordetella pertussis
ggauccagccgcu

SEQ ID NO: 315707 - RNA, 16 nt, Bordetella pertussis
ggaucccaggccggcu

SEQ ID NO: 315708 - RNA, 21 nt, Bordetella pertussis
ggaucccggcgccagccagau

SEQ ID NO: 315709 - RNA, 16 nt, Bordetella pertussis
ggauccugcggcgcgg

SEQ ID NO: 315710 - RNA, 17 nt, Bordetella pertussis
ggauccugcggcgcggu

SEQ ID NO: 315711 - RNA, 23 nt, Bordetella pertussis
ggaucgaaaccggcgcgcgcggc

SEQ ID NO: 315712 - RNA, 15 nt, Bordetella pertussis
ggaucgaacgccucg

SEQ ID NO: 315713 - RNA, 18 nt, Bordetella pertussis
ggaucgaaggcagcgcgg

SEQ ID NO: 315714 - RNA, 16 nt, Bordetella pertussis
ggcaacaaggccacga

SEQ ID NO: 315715 - RNA, 13 nt, Bordetella pertussis
ggcaagcggcgug

SEQ ID NO: 315716 - RNA, 14 nt, Bordetella pertussis
ggcaagcggcgugg

SEQ ID NO: 315717 - RNA, 22 nt, Bordetella pertussis
ggcaagcugcuggcgcgccagg

SEQ ID NO: 315718 - RNA, 18 nt, Bordetella pertussis
ggcaaggcccgccgcggc

SEQ ID NO: 315719 - RNA, 19 nt, Bordetella pertussis
ggcaaggcccgccgcggca

SEQ ID NO: 315720 - RNA, 14 nt, Bordetella pertussis
ggcaaggggccagc

SEQ ID NO: 315721 - RNA, 20 nt, Bordetella pertussis
ggcaagucgacgcugaucgg

SEQ ID NO: 315722 - RNA, 19 nt, Bordetella pertussis
ggcaaucagccccaggcgc

SEQ ID NO: 315723 - RNA, 14 nt, Bordetella pertussis
ggcaaucagcccgg

SEQ ID NO: 315724 - RNA, 14 nt, Bordetella pertussis
ggcaaucccggcga

SEQ ID NO: 315725 - RNA, 16 nt, Bordetella pertussis
ggcaaucccggcgaca

SEQ ID NO: 315726 - RNA, 19 nt, Bordetella pertussis
ggcaaucgaugaucacgcg

SEQ ID NO: 315727 - RNA, 17 nt, Bordetella pertussis
ggcacaccacgcgaugc

SEQ ID NO: 315728 - RNA, 16 nt, Bordetella pertussis
ggcacaccccgggcgg

SEQ ID NO: 315729 - RNA, 16 nt, Bordetella pertussis
ggcacaccgucacgcg

SEQ ID NO: 315730 - RNA, 18 nt, Bordetella pertussis
ggcacaccgucacgcgca

SEQ ID NO: 315731 - RNA, 19 nt, Bordetella pertussis
ggcacaccgugccgcagau

SEQ ID NO: 315732 - RNA, 22 nt, Bordetella pertussis
ggcacaccguggcaugccaugc

SEQ ID NO: 315733 - RNA, 18 nt, Bordetella pertussis
ggcacacgaccggcuugc

SEQ ID NO: 315734 - RNA, 16 nt, Bordetella pertussis
ggcaccagcgccacgc

SEQ ID NO: 315735 - RNA, 19 nt, Bordetella pertussis
ggcaccaggauccccagca

SEQ ID NO: 315736 - RNA, 21 nt, Bordetella pertussis
ggcaccaggauuccugcgagg

SEQ ID NO: 315737 - RNA, 20 nt, Bordetella pertussis
ggcacccgcuaccccggcag

SEQ ID NO: 315738 - RNA, 13 nt, Bordetella pertussis
ggcacccuugccg

SEQ ID NO: 315739 - RNA, 15 nt, Bordetella pertussis
ggcacccuugccgcg

SEQ ID NO: 315740 - RNA, 22 nt, Bordetella pertussis
ggcacccuugcucagucgggca

SEQ ID NO: 315741 - RNA, 17 nt, Bordetella pertussis
ggcacccuuuugccgca

SEQ ID NO: 315742 - RNA, 17 nt, Bordetella pertussis
ggcaccgaacgggcgug

SEQ ID NO: 315743 - RNA, 17 nt, Bordetella pertussis
ggcaccgacacgcuggc

SEQ ID NO: 315744 - RNA, 19 nt, Bordetella pertussis
ggcaccgacacgcuggcgg

SEQ ID NO: 315745 - RNA, 20 nt, Bordetella pertussis
ggcaccggcaaacuuccccg

SEQ ID NO: 315746 - RNA, 21 nt, Bordetella pertussis
ggcaccgugaugcgcgccgcu

SEQ ID NO: 315747 - RNA, 18 nt, Bordetella pertussis
ggcacgacgcgaaccagg

SEQ ID NO: 315748 - RNA, 21 nt, Bordetella pertussis
ggcacgacgcugaugcccagc

SEQ ID NO: 315749 - RNA, 22 nt, Bordetella pertussis
ggcacgacgcugaugcccagcc

SEQ ID NO: 315750 - RNA, 21 nt, Bordetella pertussis
ggcacgacggccuccgcgccg

SEQ ID NO: 315751 - RNA, 22 nt, Bordetella pertussis
ggcacgacggccuccgcgccga

SEQ ID NO: 315752 - RNA, 17 nt, Bordetella pertussis
ggcacgagaucgccugg

SEQ ID NO: 315753 - RNA, 18 nt, Bordetella pertussis
ggcacgaucaccgccgcg

SEQ ID NO: 315754 - RNA, 21 nt, Bordetella pertussis
ggcacgaucaccgccgcggcg

SEQ ID NO: 315755 - RNA, 17 nt, Bordetella pertussis
ggcacgauuucgccgau

SEQ ID NO: 315756 - RNA, 20 nt, Bordetella pertussis
ggcacgauuucgccgauccg

SEQ ID NO: 315757 - RNA, 14 nt, Bordetella pertussis
ggcacgcacagcau

SEQ ID NO: 315758 - RNA, 22 nt, Bordetella pertussis
ggcacgcccagccgcagcaggc

SEQ ID NO: 315759 - RNA, 17 nt, Bordetella pertussis
ggcacgccggccuugcu

SEQ ID NO: 315760 - RNA, 12 nt, Bordetella pertussis
ggcacgccggcg

SEQ ID NO: 315761 - RNA, 19 nt, Bordetella pertussis
ggcacgccggcggcgcugg

SEQ ID NO: 315762 - RNA, 14 nt, Bordetella pertussis
ggcacggccggcca

SEQ ID NO: 315763 - RNA, 16 nt, Bordetella pertussis
ggcacggccggccagg

SEQ ID NO: 315764 - RNA, 14 nt, Bordetella pertussis
ggcacggccggccu

SEQ ID NO: 315765 - RNA, 17 nt, Bordetella pertussis
ggcacggccggccugca

SEQ ID NO: 315766 - RNA, 12 nt, Bordetella pertussis
ggcacggcggca

SEQ ID NO: 315767 - RNA, 14 nt, Bordetella pertussis
ggcacggggcauca

SEQ ID NO: 315768 - RNA, 17 nt, Bordetella pertussis
ggcacguaguacagcag

SEQ ID NO: 315769 - RNA, 20 nt, Bordetella pertussis
ggcacgguucagaacgcgua

SEQ ID NO: 315770 - RNA, 16 nt, Bordetella pertussis
ggcacguaccaggcgc

SEQ ID NO: 315771 - RNA, 22 nt, Bordetella pertussis
ggcacgugauaguccacccccg

SEQ ID NO: 315772 - RNA, 23 nt, Bordetella pertussis
ggcacgugccggauggcgcggau

SEQ ID NO: 315773 - RNA, 21 nt, Bordetella pertussis
ggcagaacggaaacgcccagc

SEQ ID NO: 315774 - RNA, 22 nt, Bordetella pertussis
ggcagcaaccggaacaccagca

SEQ ID NO: 315775 - RNA, 15 nt, Bordetella pertussis
ggcagcacccagcgu

SEQ ID NO: 315776 - RNA, 13 nt, Bordetella pertussis
ggcagcaccgcca

SEQ ID NO: 315777 - RNA, 15 nt, Bordetella pertussis
ggcagcaccgccacc

SEQ ID NO: 315778 - RNA, 13 nt, Bordetella pertussis
ggcagcacgcgca

SEQ ID NO: 315779 - RNA, 18 nt, Bordetella pertussis
ggcagcacgcgcaccagg

SEQ ID NO: 315780 - RNA, 23 nt, Bordetella pertussis
ggcagcacgcgcaccaggccugc

SEQ ID NO: 315781 - RNA, 14 nt, Bordetella pertussis
ggcagcagcacgcc

SEQ ID NO: 315782 - RNA, 17 nt, Bordetella pertussis
ggcagcagcacgcccau

SEQ ID NO: 315783 - RNA, 13 nt, Bordetella pertussis
ggcagcagcagcg

SEQ ID NO: 315784 - RNA, 22 nt, Bordetella pertussis
ggcagcagcagcgugcggucgu

SEQ ID NO: 315785 - RNA, 14 nt, Bordetella pertussis
ggcagcagcagggc

SEQ ID NO: 315786 - RNA, 23 nt, Bordetella pertussis
ggcagcagcgagaacagccacac

SEQ ID NO: 315787 - RNA, 13 nt, Bordetella pertussis
ggcagcagcgcgc

SEQ ID NO: 315788 - RNA, 13 nt, Bordetella pertussis
ggcagcaggcgcg

SEQ ID NO: 315789 - RNA, 19 nt, Bordetella pertussis
ggcagcaggcugccgccgg

SEQ ID NO: 315790 - RNA, 20 nt, Bordetella pertussis
ggcagccauccucgcccagc

SEQ ID NO: 315791 - RNA, 21 nt, Bordetella pertussis
ggcagccauccucgcccagcg

SEQ ID NO: 315792 - RNA, 22 nt, Bordetella pertussis
ggcagccauccucgcccagcgg

SEQ ID NO: 315793 - RNA, 13 nt, Bordetella pertussis
ggcagccaggugg

SEQ ID NO: 315794 - RNA, 20 nt, Bordetella pertussis
ggcagccccagcgcccaggc

SEQ ID NO: 315795 - RNA, 13 nt, Bordetella pertussis
ggcagcccgcgca

SEQ ID NO: 315796 - RNA, 16 nt, Bordetella pertussis
ggcagcccgcgcacgc

SEQ ID NO: 315797 - RNA, 12 nt, Bordetella pertussis
ggcagcccggca

SEQ ID NO: 315798 - RNA, 15 nt, Bordetella pertussis
ggcagccggccccgc

SEQ ID NO: 315799 - RNA, 16 nt, Bordetella pertussis
ggcagccggccccgca

SEQ ID NO: 315800 - RNA, 22 nt, Bordetella pertussis
ggcagcgaggcgcagcgcagcu

SEQ ID NO: 315801 - RNA, 15 nt, Bordetella pertussis
ggcagcgaggcgcgg

SEQ ID NO: 315802 - RNA, 21 nt, Bordetella pertussis
ggcagcgaggcgcgggcgaug

SEQ ID NO: 315803 - RNA, 14 nt, Bordetella pertussis
ggcagcgcccgcgc

SEQ ID NO: 315804 - RNA, 21 nt, Bordetella pertussis
ggcagcgcgaacggcgggcgg

SEQ ID NO: 315805 - RNA, 17 nt, Bordetella pertussis
ggcagcgggucgaucgu

SEQ ID NO: 315806 - RNA, 16 nt, Bordetella pertussis
ggcagcguacgcacgc

SEQ ID NO: 315807 - RNA, 19 nt, Bordetella pertussis
ggcagcgucaauccgccgc

SEQ ID NO: 315808 - RNA, 20 nt, Bordetella pertussis
ggcagcgucaauccgccgcc

SEQ ID NO: 315809 - RNA, 23 nt, Bordetella pertussis
ggcagcgucaauccgccgccagc

SEQ ID NO: 315810 - RNA, 20 nt, Bordetella pertussis
ggcaggcucagcccggcgag

SEQ ID NO: 315811 - RNA, 20 nt, Bordetella pertussis
ggcaggcgucggccagcgcg

SEQ ID NO: 315812 - RNA, 21 nt, Bordetella pertussis
ggcaggcuccucgccacacgc

SEQ ID NO: 315813 - RNA, 18 nt, Bordetella pertussis
ggcaggcuggccggcgug

SEQ ID NO: 315814 - RNA, 19 nt, Bordetella pertussis
ggcaggcuggccggcgugg

SEQ ID NO: 315815 - RNA, 16 nt, Bordetella pertussis
ggcagggccagcgcca

SEQ ID NO: 315816 - RNA, 13 nt, Bordetella pertussis
ggcagggcgccgc

SEQ ID NO: 315817 - RNA, 15 nt, Bordetella pertussis
ggcagggcggccagg

SEQ ID NO: 315818 - RNA, 14 nt, Bordetella pertussis
ggcagggcgggcgg

SEQ ID NO: 315819 - RNA, 16 nt, Bordetella pertussis
ggcagggcgggcggga

SEQ ID NO: 315820 - RNA, 16 nt, Bordetella pertussis
ggcaggggcucgcgcc

SEQ ID NO: 315821 - RNA, 17 nt, Bordetella pertussis
ggcaggggcucgcgccc

SEQ ID NO: 315822 - RNA, 13 nt, Bordetella pertussis
ggcagggucucgg

SEQ ID NO: 315823 - RNA, 16 nt, Bordetella pertussis
ggcagggucucggcca

SEQ ID NO: 315824 - RNA, 17 nt, Bordetella pertussis
ggcagggugacgggcug

SEQ ID NO: 315825 - RNA, 18 nt, Bordetella pertussis
ggcagggugacgggcugg

SEQ ID NO: 315826 - RNA, 13 nt, Bordetella pertussis
ggcaggucgcgcg

SEQ ID NO: 315827 - RNA, 20 nt, Bordetella pertussis
ggcagucaaccguucauggc

SEQ ID NO: 315828 - RNA, 13 nt, Bordetella pertussis
ggcagucagccgu

SEQ ID NO: 315829 - RNA, 14 nt, Bordetella pertussis
ggcagugcgccugg

SEQ ID NO: 315830 - RNA, 15 nt, Bordetella pertussis
ggcagugguggugca

SEQ ID NO: 315831 - RNA, 19 nt, Bordetella pertussis
ggcagugguggugcagcgg

SEQ ID NO: 315832 - RNA, 17 nt, Bordetella pertussis
ggcauaggcggcgcagg

SEQ ID NO: 315833 - RNA, 16 nt, Bordetella pertussis
ggcaucagcgcgaaca

SEQ ID NO: 315834 - RNA, 15 nt, Bordetella pertussis
ggcaucagggcgaug

SEQ ID NO: 315835 - RNA, 15 nt, Bordetella pertussis
ggcaucagguuugcg

SEQ ID NO: 315836 - RNA, 19 nt, Bordetella pertussis
ggcauccagcucggcgaug

SEQ ID NO: 315837 - RNA, 18 nt, Bordetella pertussis
ggcaucccugcuugcgcg

SEQ ID NO: 315838 - RNA, 12 nt, Bordetella pertussis
ggcaucgaaggc

SEQ ID NO: 315839 - RNA, 17 nt, Bordetella pertussis
ggcaucgaaggcgaccg

SEQ ID NO: 315840 - RNA, 17 nt, Bordetella pertussis
ggcaucgaccacgcgcg

SEQ ID NO: 315841 - RNA, 18 nt, Bordetella pertussis
ggcaucgagaaaccagcc

SEQ ID NO: 315842 - RNA, 21 nt, Bordetella pertussis
ggcaucgagaaaccagccgcc

SEQ ID NO: 315843 - RNA, 23 nt, Bordetella pertussis
ggcaucgauuucucgcugcugac

SEQ ID NO: 315844 - RNA, 14 nt, Bordetella pertussis
ggcaucgccgcggg

SEQ ID NO: 315845 - RNA, 19 nt, Bordetella pertussis
ggcaucgcgcugacagcgc

SEQ ID NO: 315846 - RNA, 14 nt, Bordetella pertussis
ggcaucgcuuccuu

SEQ ID NO: 315847 - RNA, 16 nt, Bordetella pertussis
ggcaucggccagcaua

SEQ ID NO: 315848 - RNA, 19 nt, Bordetella pertussis
ggcaucggcgccgcgcgcu

SEQ ID NO: 315849 - RNA, 22 nt, Bordetella pertussis
ggcaucgggguuccacagcgcc

SEQ ID NO: 315850 - RNA, 22 nt, Bordetella pertussis
ggcaugcaccgcguggcgcugc

SEQ ID NO: 315851 - RNA, 13 nt, Bordetella pertussis
ggcaugcgcaugc

SEQ ID NO: 315852 - RNA, 16 nt, Bordetella pertussis
ggcaugcgccagccag

SEQ ID NO: 315853 - RNA, 19 nt, Bordetella pertussis
ggcaugcgccggcccggca

SEQ ID NO: 315854 - RNA, 12 nt, Bordetella pertussis
ggcaugcugcgu

SEQ ID NO: 315855 - RNA, 13 nt, Bordetella pertussis
ggcauggcagcag

SEQ ID NO: 315856 - RNA, 19 nt, Bordetella pertussis
ggccacauggucgcccagc

SEQ ID NO: 315857 - RNA, 13 nt, Bordetella pertussis
ggccaccaccagg

SEQ ID NO: 315858 - RNA, 19 nt, Bordetella pertussis
ggccaccacgcccaucugc

SEQ ID NO: 315859 - RNA, 18 nt, Bordetella pertussis
ggccaccagcggcgccgg

SEQ ID NO: 315860 - RNA, 23 nt, Bordetella pertussis
ggccaccagcguguagagcaggc

SEQ ID NO: 315861 - RNA, 14 nt, Bordetella pertussis
ggccaccaggcgcg

SEQ ID NO: 315862 - RNA, 13 nt, Bordetella pertussis
ggccaccaggcgc

SEQ ID NO: 315863 - RNA, 13 nt, Bordetella pertussis
ggccaccgcggcg

SEQ ID NO: 315864 - RNA, 19 nt, Bordetella pertussis
ggccaccgcggugccgcgc

SEQ ID NO: 315865 - RNA, 20 nt, Bordetella pertussis
ggccaccgcggugccgcgcg

SEQ ID NO: 315866 - RNA, 23 nt, Bordetella pertussis
ggccaccgcguugagcgccgacg

SEQ ID NO: 315867 - RNA, 15 nt, Bordetella pertussis
ggccaccgcggcgga

SEQ ID NO: 315868 - RNA, 17 nt, Bordetella pertussis
ggccacgaccggcucga

SEQ ID NO: 315869 - RNA, 22 nt, Bordetella pertussis
ggccacgaauuccucgccgccc

SEQ ID NO: 315870 - RNA, 21 nt, Bordetella pertussis
ggccacgagcaguacacgcgc

SEQ ID NO: 315871 - RNA, 20 nt, Bordetella pertussis
ggccacgaugauggaggcca

SEQ ID NO: 315872 - RNA, 17 nt, Bordetella pertussis
ggccacgaccaccagcg

SEQ ID NO: 315873 - RNA, 18 nt, Bordetella pertussis
ggccacgcccacgcgccg

SEQ ID NO: 315874 - RNA, 20 nt, Bordetella pertussis
ggccacgcccacgcgccgcc

SEQ ID NO: 315875 - RNA, 22 nt, Bordetella pertussis
ggccacgcccacgcgccgccag

SEQ ID NO: 315876 - RNA, 22 nt, Bordetella pertussis
ggccacguccggguuggcgaug

SEQ ID NO: 315877 - RNA, 13 nt, Bordetella pertussis
ggccacgucggcg

SEQ ID NO: 315878 - RNA, 17 nt, Bordetella pertussis
ggccacgucggcggccg

SEQ ID NO: 315879 - RNA, 19 nt, Bordetella pertussis
ggccacgucggcggccgcc

SEQ ID NO: 315880 - RNA, 20 nt, Bordetella pertussis
ggccacgucggcggccgccu

SEQ ID NO: 315881 - RNA, 14 nt, Bordetella pertussis
ggccacgucggucg

SEQ ID NO: 315882 - RNA, 13 nt, Bordetella pertussis
ggccacgucgccc

SEQ ID NO: 315883 - RNA, 17 nt, Bordetella pertussis
ggccacguguggcaggc

SEQ ID NO: 315884 - RNA, 21 nt, Bordetella pertussis
ggccacguguggcaggccagc

SEQ ID NO: 315885 - RNA, 15 nt, Bordetella pertussis
ggccacucgaugggc

SEQ ID NO: 315886 - RNA, 17 nt, Bordetella pertussis
ggccacucgaugggcgc

SEQ ID NO: 315887 - RNA, 12 nt, Bordetella pertussis
ggccacuggccg

SEQ ID NO: 315888 - RNA, 15 nt, Bordetella pertussis
ggccacuggccgcgc

SEQ ID NO: 315889 - RNA, 17 nt, Bordetella pertussis
ggccacuuccagcgccu

SEQ ID NO: 315890 - RNA, 19 nt, Bordetella pertussis
ggccacuuccuggugggcg

SEQ ID NO: 315891 - RNA, 14 nt, Bordetella pertussis
ggccacuucgccgg

SEQ ID NO: 315892 - RNA, 20 nt, Bordetella pertussis
ggccagcacauacgccgccg

SEQ ID NO: 315893 - RNA, 16 nt, Bordetella pertussis
ggccagcaccggcccg

SEQ ID NO: 315894 - RNA, 15 nt, Bordetella pertussis
ggccagcaccggccg

SEQ ID NO: 315895 - RNA, 17 nt, Bordetella pertussis
ggccagcaccggccgcc

SEQ ID NO: 315896 - RNA, 18 nt, Bordetella pertussis
ggccagcaccggccgccg

SEQ ID NO: 315897 - RNA, 19 nt, Bordetella pertussis
ggccagcaccggccgccgc

SEQ ID NO: 315898 - RNA, 13 nt, Bordetella pertussis
ggccagcacgccg

SEQ ID NO: 315899 - RNA, 18 nt, Bordetella pertussis
ggccagcacgccggccag

SEQ ID NO: 315900 - RNA, 16 nt, Bordetella pertussis
ggccagcacgccggcg

SEQ ID NO: 315901 - RNA, 18 nt, Bordetella pertussis
ggccagcacgggcgaagu

SEQ ID NO: 315902 - RNA, 14 nt, Bordetella pertussis
ggccagcagcgacg

SEQ ID NO: 315903 - RNA, 18 nt, Bordetella pertussis
ggccagcaggucguuggc

SEQ ID NO: 315904 - RNA, 19 nt, Bordetella pertussis
ggccagcaggucguuggcc

SEQ ID NO: 315905 - RNA, 21 nt, Bordetella pertussis
ggccagcaguguuucggccug

SEQ ID NO: 315906 - RNA, 23 nt, Bordetella pertussis
ggccagcaguguuucggccugcu

SEQ ID NO: 315907 - RNA, 20 nt, Bordetella pertussis
ggccagcauacccugcgcgc

SEQ ID NO: 315908 - RNA, 14 nt, Bordetella pertussis
ggccagcaggucgu

SEQ ID NO: 315909 - RNA, 23 nt, Bordetella pertussis
ggccagcaucggcacccagccgg

SEQ ID NO: 315910 - RNA, 20 nt, Bordetella pertussis
ggccagcaucguaucgggcg

SEQ ID NO: 315911 - RNA, 15 nt, Bordetella pertussis
ggccagccagcgccg

SEQ ID NO: 315912 - RNA, 16 nt, Bordetella pertussis
ggccagccagcgccgc

SEQ ID NO: 315913 - RNA, 18 nt, Bordetella pertussis
ggccagccagcgccgcag

SEQ ID NO: 315914 - RNA, 19 nt, Bordetella pertussis
ggccagccacgccggcgcg

SEQ ID NO: 315915 - RNA, 18 nt, Bordetella pertussis
ggccagccgggcgaucgc

SEQ ID NO: 315916 - RNA, 17 nt, Bordetella pertussis
ggccagccauugccgca

SEQ ID NO: 315917 - RNA, 20 nt, Bordetella pertussis
ggccagccauugccgcacga

SEQ ID NO: 315918 - RNA, 17 nt, Bordetella pertussis
ggccagccugccgcggc

SEQ ID NO: 315919 - RNA, 19 nt, Bordetella pertussis
ggccagccugccgcggccg

SEQ ID NO: 315920 - RNA, 15 nt, Bordetella pertussis
ggccagccuggccuu

SEQ ID NO: 315921 - RNA, 18 nt, Bordetella pertussis
ggccagccuggccuugcg

SEQ ID NO: 315922 - RNA, 13 nt, Bordetella pertussis
ggccagccuggcg

SEQ ID NO: 315923 - RNA, 13 nt, Bordetella pertussis
ggccagcgccacc

SEQ ID NO: 315924 - RNA, 17 nt, Bordetella pertussis
ggccagcgccaccaccg

SEQ ID NO: 315925 - RNA, 18 nt, Bordetella pertussis
ggccagcgccaccaccgg

SEQ ID NO: 315926 - RNA, 12 nt, Bordetella pertussis
ggccagcgccag

SEQ ID NO: 315927 - RNA, 13 nt, Bordetella pertussis
ggccagcgccaga

SEQ ID NO: 315928 - RNA, 13 nt, Bordetella pertussis
ggccagcgccagc

SEQ ID NO: 315929 - RNA, 15 nt, Bordetella pertussis
ggccagcgccagccg

SEQ ID NO: 315930 - RNA, 16 nt, Bordetella pertussis
ggccagcgccgccagc

SEQ ID NO: 315931 - RNA, 17 nt, Bordetella pertussis
ggccagcgcgucgagca

SEQ ID NO: 315932 - RNA, 21 nt, Bordetella pertussis
ggccagcgcgguugacugcag

SEQ ID NO: 315933 - RNA, 11 nt, Bordetella pertussis
ggccagcggca

SEQ ID NO: 315934 - RNA, 19 nt, Bordetella pertussis
ggccagcggcaggcccagc

SEQ ID NO: 315935 - RNA, 23 nt, Bordetella pertussis
ggccagcggcgcuuaccgcgccg

SEQ ID NO: 315936 - RNA, 19 nt, Bordetella pertussis
ggccagcucggcggccgcc

SEQ ID NO: 315937 - RNA, 18 nt, Bordetella pertussis
ggccagcugcaugcgcac

SEQ ID NO: 315938 - RNA, 19 nt, Bordetella pertussis
ggccagcugcaugcgcacg

SEQ ID NO: 315939 - RNA, 23 nt, Bordetella pertussis
ggccagcuggcgcguggccgcca

SEQ ID NO: 315940 - RNA, 18 nt, Bordetella pertussis
ggccagcuggcggcgcag

SEQ ID NO: 315941 - RNA, 23 nt, Bordetella pertussis
ggccagcuggcggcgcagcacca

SEQ ID NO: 315942 - RNA, 16 nt, Bordetella pertussis
ggccagcuugaccgcc

SEQ ID NO: 315943 - RNA, 19 nt, Bordetella pertussis
ggccagcuugaccgccagc

SEQ ID NO: 315944 - RNA, 21 nt, Bordetella pertussis
ggccagcuugacguccagcca

SEQ ID NO: 315945 - RNA, 14 nt, Bordetella pertussis
ggccagcuugccgc

SEQ ID NO: 315946 - RNA, 22 nt, Bordetella pertussis
ggccagcuuguagcggccaucg

SEQ ID NO: 315947 - RNA, 22 nt, Bordetella pertussis
ggccagggaggaacugggcgcc

SEQ ID NO: 315948 - RNA, 23 nt, Bordetella pertussis
ggccagggcaagcgcgucgaugg

SEQ ID NO: 315949 - RNA, 16 nt, Bordetella pertussis
ggccagggccaccacg

SEQ ID NO: 315950 - RNA, 19 nt, Bordetella pertussis
ggccagggccacgccggcc

SEQ ID NO: 315951 - RNA, 20 nt, Bordetella pertussis
ggccagggccacgccggccg

SEQ ID NO: 315952 - RNA, 23 nt, Bordetella pertussis
ggccagggccacgccggccgccu

SEQ ID NO: 315953 - RNA, 13 nt, Bordetella pertussis
ggccagggccugc

SEQ ID NO: 315954 - RNA, 22 nt, Bordetella pertussis
ggccagggcgaugcggcggccg

SEQ ID NO: 315955 - RNA, 14 nt, Bordetella pertussis
ggccagggcugcgg

SEQ ID NO: 315956 - RNA, 14 nt, Bordetella pertussis
ggccaggggcagcu

SEQ ID NO: 315957 - RNA, 15 nt, Bordetella pertussis
ggccaggggcgcugg

SEQ ID NO: 315958 - RNA, 19 nt, Bordetella pertussis
ggccagggugccccgccgg

SEQ ID NO: 315959 - RNA, 19 nt, Bordetella pertussis
ggccagguacaggccgccg

SEQ ID NO: 315960 - RNA, 21 nt, Bordetella pertussis
ggccagguacaggccgccggu

SEQ ID NO: 315961 - RNA, 20 nt, Bordetella pertussis
ggccagguauucggcgguga

SEQ ID NO: 315962 - RNA, 18 nt, Bordetella pertussis
ggccagguauugcggggc

SEQ ID NO: 315963 - RNA, 21 nt, Bordetella pertussis
ggccagguauugcggggcggc

SEQ ID NO: 315964 - RNA, 17 nt, Bordetella pertussis
ggccaggucgcgcauca

SEQ ID NO: 315965 - RNA, 19 nt, Bordetella pertussis
ggccaggucggcggccagc

SEQ ID NO: 315966 - RNA, 23 nt, Bordetella pertussis
ggccaggucggcggccagcgcgc

SEQ ID NO: 315967 - RNA, 19 nt, Bordetella pertussis
ggccaggugcacagcgucc

SEQ ID NO: 315968 - RNA, 14 nt, Bordetella pertussis
ggccagguggcggc

SEQ ID NO: 315969 - RNA, 15 nt, Bordetella pertussis
ggccagguggcggcg

SEQ ID NO: 315970 - RNA, 15 nt, Bordetella pertussis
ggccaggugcgccau

SEQ ID NO: 315971 - RNA, 17 nt, Bordetella pertussis
ggccaggugcgccaugc

SEQ ID NO: 315972 - RNA, 21 nt, Bordetella pertussis
ggccagguugggugcgccgcc

SEQ ID NO: 315973 - RNA, 22 nt, Bordetella pertussis
ggccagguugggugcgccgccg

SEQ ID NO: 315974 - RNA, 15 nt, Bordetella pertussis
ggccaguccgcagcg

SEQ ID NO: 315975 - RNA, 16 nt, Bordetella pertussis
ggccaguccgcagcgc

SEQ ID NO: 315976 - RNA, 18 nt, Bordetella pertussis
ggccagugauggccugcu

SEQ ID NO: 315977 - RNA, 22 nt, Bordetella pertussis
ggccagugccuggacgcgcugg

SEQ ID NO: 315978 - RNA, 16 nt, Bordetella pertussis
ggccaguggcgcggcg

SEQ ID NO: 315979 - RNA, 20 nt, Bordetella pertussis
ggccaguuccgugcgcgccc

SEQ ID NO: 315980 - RNA, 23 nt, Bordetella pertussis
ggccaguuccgugcgcgcccgau

SEQ ID NO: 315981 - RNA, 19 nt, Bordetella pertussis
ggccaguucgcggcgcagc

SEQ ID NO: 315982 - RNA, 16 nt, Bordetella pertussis
ggccaguucggcuugc

SEQ ID NO: 315983 - RNA, 21 nt, Bordetella pertussis
ggccaguucggcuugcacgcc

SEQ ID NO: 315984 - RNA, 15 nt, Bordetella pertussis
ggccaucaccgccuc

SEQ ID NO: 315985 - RNA, 17 nt, Bordetella pertussis
ggccaucaccgccuccg

SEQ ID NO: 315986 - RNA, 13 nt, Bordetella pertussis
ggccaucacgccg

SEQ ID NO: 315987 - RNA, 16 nt, Bordetella pertussis
ggccaucacgccgauc

SEQ ID NO: 315988 - RNA, 13 nt, Bordetella pertussis
ggccaucgacgcc

SEQ ID NO: 315989 - RNA, 14 nt, Bordetella pertussis
ggccaucgccaugg

SEQ ID NO: 315990 - RNA, 13 nt, Bordetella pertussis
ggccaucgccgcc

SEQ ID NO: 315991 - RNA, 14 nt, Bordetella pertussis
ggccaucgccgcca

SEQ ID NO: 315992 - RNA, 14 nt, Bordetella pertussis
ggccaucgccgccg

SEQ ID NO: 315993 - RNA, 17 nt, Bordetella pertussis
ggccaucgccgccgccg

SEQ ID NO: 315994 - RNA, 13 nt, Bordetella pertussis
ggccaucggcgcc

SEQ ID NO: 315995 - RNA, 17 nt, Bordetella pertussis
ggccaucggcgccaagc

SEQ ID NO: 315996 - RNA, 16 nt, Bordetella pertussis
ggccaucgggcugcgg

SEQ ID NO: 315997 - RNA, 12 nt, Bordetella pertussis
ggccaucguacg

SEQ ID NO: 315998 - RNA, 20 nt, Bordetella pertussis
ggccaucgcggucgaugacc

SEQ ID NO: 315999 - RNA, 12 nt, Bordetella pertussis
ggccaugacggc

SEQ ID NO: 316000 - RNA, 14 nt, Bordetella pertussis
ggccaugacggcca

SEQ ID NO: 316001 - RNA, 22 nt, Bordetella pertussis
ggccaugacgggaauccgcugc

SEQ ID NO: 316002 - RNA, 19 nt, Bordetella pertussis
ggccaugcccaggcccagu

SEQ ID NO: 316003 - RNA, 23 nt, Bordetella pertussis
ggccaugccgacggauucgccca

SEQ ID NO: 316004 - RNA, 16 nt, Bordetella pertussis
ggccaugccggguugc

SEQ ID NO: 316005 - RNA, 16 nt, Bordetella pertussis
ggccaugccguccugc

SEQ ID NO: 316006 - RNA, 21 nt, Bordetella pertussis
ggccaugccguccugcugcgg

SEQ ID NO: 316007 - RNA, 19 nt, Bordetella pertussis
ggccaugccgucgcgcacc

SEQ ID NO: 316008 - RNA, 15 nt, Bordetella pertussis
ggccaugcgcgccag

SEQ ID NO: 316009 - RNA, 16 nt, Bordetella pertussis
ggccaugcgcgccagc

SEQ ID NO: 316010 - RNA, 17 nt, Bordetella pertussis
ggccaugcgcgccagca

SEQ ID NO: 316011 - RNA, 20 nt, Bordetella pertussis
ggccaugcgggucaggccgc

SEQ ID NO: 316012 - RNA, 22 nt, Bordetella pertussis
ggccaugcgggucaggccgccg

SEQ ID NO: 316013 - RNA, 18 nt, Bordetella pertussis
ggccaugcggugcgccgc

SEQ ID NO: 316014 - RNA, 18 nt, Bordetella pertussis
ggccaugcucagcagcac

SEQ ID NO: 316015 - RNA, 15 nt, Bordetella pertussis
ggccaugcucgucca

SEQ ID NO: 316016 - RNA, 14 nt, Bordetella pertussis
ggccauggcacagg

SEQ ID NO: 316017 - RNA, 20 nt, Bordetella pertussis
ggccauggcacaggccaucg

SEQ ID NO: 316018 - RNA, 18 nt, Bordetella pertussis
ggccauggcagggcgccg

SEQ ID NO: 316019 - RNA, 14 nt, Bordetella pertussis
ggccauggccagcu

SEQ ID NO: 316020 - RNA, 18 nt, Bordetella pertussis
ggccauggcccuugccgc

SEQ ID NO: 316021 - RNA, 12 nt, Bordetella pertussis
ggccauggccgc

SEQ ID NO: 316022 - RNA, 15 nt, Bordetella pertussis
ggccauggcggccgg

SEQ ID NO: 316023 - RNA, 22 nt, Bordetella pertussis
ggccauggcgcuguuggccggc

SEQ ID NO: 316024 - RNA, 16 nt, Bordetella pertussis
ggccauggugccccau

SEQ ID NO: 316025 - RNA, 20 nt, Bordetella pertussis
ggccauggugccccaugcgc

SEQ ID NO: 316026 - RNA, 15 nt, Bordetella pertussis
ggccauguccagcag

SEQ ID NO: 316027 - RNA, 14 nt, Bordetella pertussis
ggccauguccuggc

SEQ ID NO: 316028 - RNA, 21 nt, Bordetella pertussis
ggccauguccuggcaggccgc

SEQ ID NO: 316029 - RNA, 19 nt, Bordetella pertussis
ggccauugaaagcgcgagc

SEQ ID NO: 316030 - RNA, 14 nt, Bordetella pertussis
ggccauugcuggcg

SEQ ID NO: 316031 - RNA, 22 nt, Bordetella pertussis
ggccauuugcggaugcccggga

SEQ ID NO: 316032 - RNA, 14 nt, Bordetella pertussis
ggcccacaaugccc

SEQ ID NO: 316033 - RNA, 14 nt, Bordetella pertussis
ggcccacagcgccc

SEQ ID NO: 316034 - RNA, 17 nt, Bordetella pertussis
ggcccaccagggccagc

SEQ ID NO: 316035 - RNA, 16 nt, Bordetella pertussis
ggcccaccggcaugcc

SEQ ID NO: 316036 - RNA, 23 nt, Bordetella pertussis
ggcccacgacgaacaacacgaug

SEQ ID NO: 316037 - RNA, 12 nt, Bordetella pertussis
ggcccacgccca

SEQ ID NO: 316038 - RNA, 13 nt, Bordetella pertussis
ggcccacgccgcc

SEQ ID NO: 316039 - RNA, 14 nt, Bordetella pertussis
ggcccacgccgccg

SEQ ID NO: 316040 - RNA, 22 nt, Bordetella pertussis
ggcccacgcgcacgacgucgcg

SEQ ID NO: 316041 - RNA, 18 nt, Bordetella pertussis
ggcccacgaugcgggcau

SEQ ID NO: 316042 - RNA, 14 nt, Bordetella pertussis
ggcccacggcaucg

SEQ ID NO: 316043 - RNA, 17 nt, Bordetella pertussis
ggcccacggcaucgccg

SEQ ID NO: 316044 - RNA, 17 nt, Bordetella pertussis
ggcccacucggugcgcg

SEQ ID NO: 316045 - RNA, 22 nt, Bordetella pertussis
ggcccacucggugcgcgcgccc

SEQ ID NO: 316046 - RNA, 20 nt, Bordetella pertussis
ggcccacuggaucgccgauc

SEQ ID NO: 316047 - RNA, 16 nt, Bordetella pertussis
ggcccagaccaagcgc

SEQ ID NO: 316048 - RNA, 19 nt, Bordetella pertussis
ggcccagaccaagcgccac

SEQ ID NO: 316049 - RNA, 16 nt, Bordetella pertussis
ggcccagcaccgccgc

SEQ ID NO: 316050 - RNA, 19 nt, Bordetella pertussis
ggcccagcaccgccgccag

SEQ ID NO: 316051 - RNA, 21 nt, Bordetella pertussis
ggcccagcacgccgcgcucgu

SEQ ID NO: 316052 - RNA, 15 nt, Bordetella pertussis
ggcccagcacgcgcg

SEQ ID NO: 316053 - RNA, 17 nt, Bordetella pertussis
ggcccagcacgcgcgcc

SEQ ID NO: 316054 - RNA, 23 nt, Bordetella pertussis
ggcccagcacgcgcgccagcugg

SEQ ID NO: 316055 - RNA, 12 nt, Bordetella pertussis
ggcccagcauca

SEQ ID NO: 316056 - RNA, 16 nt, Bordetella pertussis
ggcccagcaugccgau

SEQ ID NO: 316057 - RNA, 12 nt, Bordetella pertussis
ggcccagccagc

SEQ ID NO: 316058 - RNA, 20 nt, Bordetella pertussis
ggcccagccagcccuggccc

SEQ ID NO: 316059 - RNA, 20 nt, Bordetella pertussis
ggcccagccagcggugcgcg

SEQ ID NO: 316060 - RNA, 21 nt, Bordetella pertussis
ggcccagccagcggugcgcgg

SEQ ID NO: 316061 - RNA, 17 nt, Bordetella pertussis
ggcccagcccgccgauc

SEQ ID NO: 316062 - RNA, 18 nt, Bordetella pertussis
ggcccagccgcucggcca

SEQ ID NO: 316063 - RNA, 23 nt, Bordetella pertussis
ggcccagccgcucggccacgcgc

SEQ ID NO: 316064 - RNA, 14 nt, Bordetella pertussis
ggcccagcccgccg

SEQ ID NO: 316065 - RNA, 15 nt, Bordetella pertussis
ggcccagcgccagca

SEQ ID NO: 316066 - RNA, 17 nt, Bordetella pertussis
ggcccagcgccagcagc

SEQ ID NO: 316067 - RNA, 14 nt, Bordetella pertussis
ggcccagcuccagc

SEQ ID NO: 316068 - RNA, 15 nt, Bordetella pertussis
ggcccagcuccagcu

SEQ ID NO: 316069 - RNA, 21 nt, Bordetella pertussis
ggcccagcuccagcuggcgca

SEQ ID NO: 316070 - RNA, 22 nt, Bordetella pertussis
ggcccagcuccagcuggcgcac

SEQ ID NO: 316071 - RNA, 22 nt, Bordetella pertussis
ggcccagcucugguccaggcgg

SEQ ID NO: 316072 - RNA, 19 nt, Bordetella pertussis
ggcccagcugggcggcgug

SEQ ID NO: 316073 - RNA, 20 nt, Bordetella pertussis
ggcccagcugggcggcguga

SEQ ID NO: 316074 - RNA, 18 nt, Bordetella pertussis
ggcccaggauggcgccag

SEQ ID NO: 316075 - RNA, 19 nt, Bordetella pertussis
ggcccaggauggcgccagc

SEQ ID NO: 316076 - RNA, 20 nt, Bordetella pertussis
ggcccaggauggcgccagcc

SEQ ID NO: 316077 - RNA, 18 nt, Bordetella pertussis
ggcccaggcaaugcgcag

SEQ ID NO: 316078 - RNA, 20 nt, Bordetella pertussis
ggcccaggcaaugcgcaggc

SEQ ID NO: 316079 - RNA, 23 nt, Bordetella pertussis
ggcccaggcgcgcuggcgcucgg

SEQ ID NO: 316080 - RNA, 20 nt, Bordetella pertussis
ggcccaggucaucgccaggc

SEQ ID NO: 316081 - RNA, 17 nt, Bordetella pertussis
ggcccaguacggccugc

SEQ ID NO: 316082 - RNA, 14 nt, Bordetella pertussis
ggcccaguccaggg

SEQ ID NO: 316083 - RNA, 23 nt, Bordetella pertussis
ggcccaguugaaucggcgcgagc

SEQ ID NO: 316084 - RNA, 16 nt, Bordetella pertussis
ggccccggcccggcgg

SEQ ID NO: 316085 - RNA, 23 nt, Bordetella pertussis
ggccccggccucccggaccagca

SEQ ID NO: 316086 - RNA, 18 nt, Bordetella pertussis
ggccccucaaggggugga

SEQ ID NO: 316087 - RNA, 13 nt, Bordetella pertussis
ggccccguugucg

SEQ ID NO: 316088 - RNA, 19 nt, Bordetella pertussis
ggcccgaacggcccaucca

SEQ ID NO: 316089 - RNA, 14 nt, Bordetella pertussis
ggcccgacagcgcc

SEQ ID NO: 316090 - RNA, 13 nt, Bordetella pertussis
ggccgcaugcgug

SEQ ID NO: 316091 - RNA, 17 nt, Bordetella pertussis
ggccgcauggcggcccu

SEQ ID NO: 316092 - RNA, 21 nt, Bordetella pertussis
ggccgcauugggacgcggccu

SEQ ID NO: 316093 - RNA, 14 nt, Bordetella pertussis
ggccgccaacgcca

SEQ ID NO: 316094 - RNA, 17 nt, Bordetella pertussis
ggccgccaccagcgcgu

SEQ ID NO: 316095 - RNA, 20 nt, Bordetella pertussis
ggccgccaccagcgcgucgc

SEQ ID NO: 316096 - RNA, 22 nt, Bordetella pertussis
ggccgccaccagcgcgucgccg

SEQ ID NO: 316097 - RNA, 22 nt, Bordetella pertussis
ggccgccacccaggcggcaggc

SEQ ID NO: 316098 - RNA, 16 nt, Bordetella pertussis
ggccgccaccagcgcg

SEQ ID NO: 316099 - RNA, 21 nt, Bordetella pertussis
ggccgccaccugggccgccug

SEQ ID NO: 316100 - RNA, 16 nt, Bordetella pertussis
ggccgccacgcccugg

SEQ ID NO: 316101 - RNA, 22 nt, Bordetella pertussis
ggccgccacuugcggcaggugc

SEQ ID NO: 316102 - RNA, 23 nt, Bordetella pertussis
ggccgccagcaaggcgucggcca

SEQ ID NO: 316103 - RNA, 21 nt, Bordetella pertussis
ggccgccagcauggcgucgaa

SEQ ID NO: 316104 - RNA, 13 nt, Bordetella pertussis
ggccgccagcccg

SEQ ID NO: 316105 - RNA, 14 nt, Bordetella pertussis
ggccgccagccggc

SEQ ID NO: 316106 - RNA, 13 nt, Bordetella pertussis
ggccgccagccgg

SEQ ID NO: 316107 - RNA, 11 nt, Bordetella pertussis
ggccgccagcg

SEQ ID NO: 316108 - RNA, 13 nt, Bordetella pertussis
ggccgccagcgcc

SEQ ID NO: 316109 - RNA, 16 nt, Bordetella pertussis
ggccgccagcgccaug

SEQ ID NO: 316110 - RNA, 23 nt, Bordetella pertussis
ggccgccagcgccaugaugucgc

SEQ ID NO: 316111 - RNA, 12 nt, Bordetella pertussis
ggccgccagcgg

SEQ ID NO: 316112 - RNA, 19 nt, Bordetella pertussis
ggccgccagcggcuggcgc

SEQ ID NO: 316113 - RNA, 12 nt, Bordetella pertussis
ggccgccaggua

SEQ ID NO: 316114 - RNA, 17 nt, Bordetella pertussis
ggccgccaggucggcca

SEQ ID NO: 316115 - RNA, 23 nt, Bordetella pertussis
ggccgccauggccggcguugccg

SEQ ID NO: 316116 - RNA, 19 nt, Bordetella pertussis
ggccgccagggcggcugcc

SEQ ID NO: 316117 - RNA, 20 nt, Bordetella pertussis
ggccgccagggcggcugccg

SEQ ID NO: 316118 - RNA, 16 nt, Bordetella pertussis
ggccgcccagcagaug

SEQ ID NO: 316119 - RNA, 14 nt, Bordetella pertussis
ggccgcccagcauu

SEQ ID NO: 316120 - RNA, 13 nt, Bordetella pertussis
ggccgcccagccg

SEQ ID NO: 316121 - RNA, 19 nt, Bordetella pertussis
ggccgcccagccgcgccag

SEQ ID NO: 316122 - RNA, 12 nt, Bordetella pertussis
ggccgcccagcg

SEQ ID NO: 316123 - RNA, 14 nt, Bordetella pertussis
ggccgcccagcgca

SEQ ID NO: 316124 - RNA, 14 nt, Bordetella pertussis
ggccgcccagucgu

SEQ ID NO: 316125 - RNA, 19 nt, Bordetella pertussis
ggccgcccccagcgcgccu

SEQ ID NO: 316126 - RNA, 21 nt, Bordetella pertussis
ggccgcccaggcgcagccgcg

SEQ ID NO: 316127 - RNA, 17 nt, Bordetella pertussis
ggccgcccagcgccugc

SEQ ID NO: 316128 - RNA, 14 nt, Bordetella pertussis
ggccgcccgccugc

SEQ ID NO: 316129 - RNA, 15 nt, Bordetella pertussis
ggccgcccgccugcc

SEQ ID NO: 316130 - RNA, 17 nt, Bordetella pertussis
ggccgcccgccugccgg

SEQ ID NO: 316131 - RNA, 18 nt, Bordetella pertussis
ggccgccgaacggcagca

SEQ ID NO: 316132 - RNA, 18 nt, Bordetella pertussis
ggccgccgcgcccagccg

SEQ ID NO: 316133 - RNA, 20 nt, Bordetella pertussis
ggccgccgcgcccagccgcg

SEQ ID NO: 316134 - RNA, 21 nt, Bordetella pertussis
ggccgccgcgcccagccgcgc

SEQ ID NO: 316135 - RNA, 15 nt, Bordetella pertussis
ggccgccgcgcgccg

SEQ ID NO: 316136 - RNA, 12 nt, Bordetella pertussis
ggccgccgcggg

SEQ ID NO: 316137 - RNA, 15 nt, Bordetella pertussis
ggccgccgcgggcgc

SEQ ID NO: 316138 - RNA, 23 nt, Bordetella pertussis
ggccgccgcgggcgccgcgcacg

SEQ ID NO: 316139 - RNA, 12 nt, Bordetella pertussis
ggccgccggacg

SEQ ID NO: 316140 - RNA, 19 nt, Bordetella pertussis
ggccgccggccaccagcgg

SEQ ID NO: 316141 - RNA, 14 nt, Bordetella pertussis
ggccgccggccagc

SEQ ID NO: 316142 - RNA, 15 nt, Bordetella pertussis
ggccgccggcgcggu

SEQ ID NO: 316143 - RNA, 23 nt, Bordetella pertussis
ggccgccggcggcgucggcgccc

SEQ ID NO: 316144 - RNA, 19 nt, Bordetella pertussis
ggccgcgauauccuugcgc

SEQ ID NO: 316145 - RNA, 19 nt, Bordetella pertussis
ggccgcgauauugaaggcc

SEQ ID NO: 316146 - RNA, 22 nt, Bordetella pertussis
ggccgcgaucgaguggugcgcg

SEQ ID NO: 316147 - RNA, 17 nt, Bordetella pertussis
ggccgcgaugucgcgcg

SEQ ID NO: 316148 - RNA, 18 nt, Bordetella pertussis
ggccgcgaugucgcgcgc

SEQ ID NO: 316149 - RNA, 17 nt, Bordetella pertussis
ggccgcgcaaggccugc

SEQ ID NO: 316150 - RNA, 15 nt, Bordetella pertussis
ggccgcgcagcacgc

SEQ ID NO: 316151 - RNA, 13 nt, Bordetella pertussis
ggccgcgcagggc

SEQ ID NO: 316152 - RNA, 12 nt, Bordetella pertussis
ggccgcgccagc

SEQ ID NO: 316153 - RNA, 11 nt, Bordetella pertussis
ggccgcgccca

SEQ ID NO: 316154 - RNA, 12 nt, Bordetella pertussis
ggccgcgcccac

SEQ ID NO: 316155 - RNA, 17 nt, Bordetella pertussis
ggccgcgcgccggcgcc

SEQ ID NO: 316156 - RNA, 18 nt, Bordetella pertussis
ggccgcgcgccugcucgu

SEQ ID NO: 316157 - RNA, 16 nt, Bordetella pertussis
ggccgcgcgcgccagg

SEQ ID NO: 316158 - RNA, 15 nt, Bordetella pertussis
ggccgcgcgcgccau

SEQ ID NO: 316159 - RNA, 15 nt, Bordetella pertussis
ggccgcgcgcgggcg

SEQ ID NO: 316160 - RNA, 17 nt, Bordetella pertussis
ggccgcgcggcgccugc

SEQ ID NO: 316161 - RNA, 17 nt, Bordetella pertussis
ggccgcgcgggccuggc

SEQ ID NO: 316162 - RNA, 18 nt, Bordetella pertussis
ggccgcgcgggcggcccg

SEQ ID NO: 316163 - RNA, 20 nt, Bordetella pertussis
ggccgcgcgggcggcccgca

SEQ ID NO: 316164 - RNA, 22 nt, Bordetella pertussis
ggccgcgcucgaauggcugcgc

SEQ ID NO: 316165 - RNA, 15 nt, Bordetella pertussis
ggccgcgcugccagc

SEQ ID NO: 316166 - RNA, 17 nt, Bordetella pertussis
ggccgcgcugccagcca

SEQ ID NO: 316167 - RNA, 13 nt, Bordetella pertussis
ggccgcgcugcug

SEQ ID NO: 316168 - RNA, 22 nt, Bordetella pertussis
ggccgcgcugcugcaggccggc

SEQ ID NO: 316169 - RNA, 14 nt, Bordetella pertussis
ggccgcgcuggcgc

SEQ ID NO: 316170 - RNA, 21 nt, Bordetella pertussis
ggccgcgcuggcggcgcaggc

SEQ ID NO: 316171 - RNA, 12 nt, Bordetella pertussis
ggccgcgggcgg

SEQ ID NO: 316172 - RNA, 16 nt, Bordetella pertussis
ggccgcgggcggcgcg

SEQ ID NO: 316173 - RNA, 17 nt, Bordetella pertussis
ggccgcggggcuggcca

SEQ ID NO: 316174 - RNA, 19 nt, Bordetella pertussis
ggccgcggggcuggccagc

SEQ ID NO: 316175 - RNA, 22 nt, Bordetella pertussis
ggccgcggggcuggccagcugg

SEQ ID NO: 316176 - RNA, 15 nt, Bordetella pertussis
ggccgcggucagcca

SEQ ID NO: 316177 - RNA, 16 nt, Bordetella pertussis
ggccgcggucagccag

SEQ ID NO: 316178 - RNA, 14 nt, Bordetella pertussis
ggccgcgguccggg

SEQ ID NO: 316179 - RNA, 22 nt, Bordetella pertussis
ggccgcgguaaugacgcagccg

SEQ ID NO: 316180 - RNA, 21 nt, Bordetella pertussis
ggccgcguacuuccucgacca

SEQ ID NO: 316181 - RNA, 15 nt, Bordetella pertussis
ggccgcguagcccau

SEQ ID NO: 316182 - RNA, 19 nt, Bordetella pertussis
ggccgcguacaacgccgcg

SEQ ID NO: 316183 - RNA, 22 nt, Bordetella pertussis
ggccgcguaggcggucagcugg

SEQ ID NO: 316184 - RNA, 20 nt, Bordetella pertussis
ggccgcgucauacgacgcgg

SEQ ID NO: 316185 - RNA, 20 nt, Bordetella pertussis
ggccgcgucgaucagcgcgg

SEQ ID NO: 316186 - RNA, 17 nt, Bordetella pertussis
ggccgcuacggcggucu

SEQ ID NO: 316187 - RNA, 17 nt, Bordetella pertussis
ggccgcuaggccuugcc

SEQ ID NO: 316188 - RNA, 16 nt, Bordetella pertussis
ggccgcuccagagcgc

SEQ ID NO: 316189 - RNA, 15 nt, Bordetella pertussis
ggccgcuccgccaug

SEQ ID NO: 316190 - RNA, 17 nt, Bordetella pertussis
ggccgcuccgccaugga

SEQ ID NO: 316191 - RNA, 12 nt, Bordetella pertussis
ggccgcuggccc

SEQ ID NO: 316192 - RNA, 14 nt, Bordetella pertussis
ggccgcuggcccgg

SEQ ID NO: 316193 - RNA, 16 nt, Bordetella pertussis
ggccgcuggcccgggu

SEQ ID NO: 316194 - RNA, 21 nt, Bordetella pertussis
ggccgcugggcacauccagcg

SEQ ID NO: 316195 - RNA, 17 nt, Bordetella pertussis
ggccggcaugcgccggc

SEQ ID NO: 316196 - RNA, 14 nt, Bordetella pertussis
ggccggccagcaag

SEQ ID NO: 316197 - RNA, 12 nt, Bordetella pertussis
ggccggccagcc

SEQ ID NO: 316198 - RNA, 12 nt, Bordetella pertussis
ggccggccaggg

SEQ ID NO: 316199 - RNA, 22 nt, Bordetella pertussis
ggccggccagggccacgccggc

SEQ ID NO: 316200 - RNA, 19 nt, Bordetella pertussis
ggccggcccaguccagggu

SEQ ID NO: 316201 - RNA, 14 nt, Bordetella pertussis
ggccggcccgcgcg

SEQ ID NO: 316202 - RNA, 20 nt, Bordetella pertussis
ggccggcccgugcgcaacgc

SEQ ID NO: 316203 - RNA, 15 nt, Bordetella pertussis
ggccggccgccgggc

SEQ ID NO: 316204 - RNA, 13 nt, Bordetella pertussis
ggccggccgccgg

SEQ ID NO: 316205 - RNA, 14 nt, Bordetella pertussis
ggccggcgccgaca

SEQ ID NO: 316206 - RNA, 13 nt, Bordetella pertussis
ggccggcgccggc

SEQ ID NO: 316207 - RNA, 13 nt, Bordetella pertussis
ggccggcgcgccc

SEQ ID NO: 316208 - RNA, 15 nt, Bordetella pertussis
ggccggcgcgccggc

SEQ ID NO: 316209 - RNA, 16 nt, Bordetella pertussis
ggccggcgcgccggcc

SEQ ID NO: 316210 - RNA, 19 nt, Bordetella pertussis
ggccggcgcgccggccugc

SEQ ID NO: 316211 - RNA, 15 nt, Bordetella pertussis
ggccggcgcgccugc

SEQ ID NO: 316212 - RNA, 17 nt, Bordetella pertussis
ggccggcgcgccugccg

SEQ ID NO: 316213 - RNA, 18 nt, Bordetella pertussis
ggccggcgcgccugccgu

SEQ ID NO: 316214 - RNA, 17 nt, Bordetella pertussis
ggccggcgcgcgcaggc

SEQ ID NO: 316215 - RNA, 17 nt, Bordetella pertussis
ggccggcgcgcgcgacc

SEQ ID NO: 316216 - RNA, 15 nt, Bordetella pertussis
ggccggcgcgcgcgu

SEQ ID NO: 316217 - RNA, 15 nt, Bordetella pertussis
ggccggcgcgcucgc

SEQ ID NO: 316218 - RNA, 20 nt, Bordetella pertussis
ggccggcgcgcucggccucg

SEQ ID NO: 316219 - RNA, 14 nt, Bordetella pertussis
ggccggcgccggug

SEQ ID NO: 316220 - RNA, 13 nt, Bordetella pertussis
ggccggcgccugg

SEQ ID NO: 316221 - RNA, 20 nt, Bordetella pertussis
ggccggcgccuggggcgggc

SEQ ID NO: 316222 - RNA, 21 nt, Bordetella pertussis
ggccggcgccuggggcgggcg

SEQ ID NO: 316223 - RNA, 13 nt, Bordetella pertussis
ggccggcgcgacc

SEQ ID NO: 316224 - RNA, 14 nt, Bordetella pertussis
ggccggcgcgucgc

SEQ ID NO: 316225 - RNA, 22 nt, Bordetella pertussis
ggccggcgcgucgccggcgaug

SEQ ID NO: 316226 - RNA, 13 nt, Bordetella pertussis
ggccggcgcuggg

SEQ ID NO: 316227 - RNA, 18 nt, Bordetella pertussis
ggccggcgcugggcaggc

SEQ ID NO: 316228 - RNA, 19 nt, Bordetella pertussis
ggccggcgcugggcaggcu

SEQ ID NO: 316229 - RNA, 16 nt, Bordetella pertussis
ggccggcggcagccgg

SEQ ID NO: 316230 - RNA, 15 nt, Bordetella pertussis
ggccggcggccagcg

SEQ ID NO: 316231 - RNA, 20 nt, Bordetella pertussis
ggccggcggccagcgcgccg

SEQ ID NO: 316232 - RNA, 14 nt, Bordetella pertussis
ggccggcggcgucu

SEQ ID NO: 316233 - RNA, 14 nt, Bordetella pertussis
ggccggcgggcaug

SEQ ID NO: 316234 - RNA, 13 nt, Bordetella pertussis
ggccggcggucgc

SEQ ID NO: 316235 - RNA, 19 nt, Bordetella pertussis
ggccggcgucuggagcggc

SEQ ID NO: 316236 - RNA, 14 nt, Bordetella pertussis
ggccggcguggccu

SEQ ID NO: 316237 - RNA, 18 nt, Bordetella pertussis
ggccggcguggccugccc

SEQ ID NO: 316238 - RNA, 17 nt, Bordetella pertussis
ggccggcguucaccagg

SEQ ID NO: 316239 - RNA, 21 nt, Bordetella pertussis
ggccggcuacagcucgccggc

SEQ ID NO: 316240 - RNA, 23 nt, Bordetella pertussis
ggccggcuacagcucgccggcga

SEQ ID NO: 316241 - RNA, 18 nt, Bordetella pertussis
ggccggcucauucggcgc

SEQ ID NO: 316242 - RNA, 16 nt, Bordetella pertussis
ggccggcugcaccagc

SEQ ID NO: 316243 - RNA, 22 nt, Bordetella pertussis
ggccggcugcaccagcgcgccg

SEQ ID NO: 316244 - RNA, 15 nt, Bordetella pertussis
ggccggcugcgcgcc

SEQ ID NO: 316245 - RNA, 19 nt, Bordetella pertussis
ggccggcugcgcgccgacc

SEQ ID NO: 316246 - RNA, 13 nt, Bordetella pertussis
ggccggcugggcg

SEQ ID NO: 316247 - RNA, 22 nt, Bordetella pertussis
ggccggcugggcggccuuggcc

SEQ ID NO: 316248 - RNA, 20 nt, Bordetella pertussis
ggccggcuugcgcaagccgg

SEQ ID NO: 316249 - RNA, 23 nt, Bordetella pertussis
ggccggcuugcgcaagccggccg

SEQ ID NO: 316250 - RNA, 17 nt, Bordetella pertussis
ggccggcuuuggacagg

SEQ ID NO: 316251 - RNA, 18 nt, Bordetella pertussis
ggccggcuuuggacaggc

SEQ ID NO: 316252 - RNA, 14 nt, Bordetella pertussis
ggccggcucgcccc

SEQ ID NO: 316253 - RNA, 17 nt, Bordetella pertussis
ggccgggaaggcgggac

SEQ ID NO: 316254 - RNA, 16 nt, Bordetella pertussis
ggccgggaccuuggcg

SEQ ID NO: 316255 - RNA, 17 nt, Bordetella pertussis
ggccgggagcggccagc

SEQ ID NO: 316256 - RNA, 23 nt, Bordetella pertussis
ggccgggcacaccgucacgcgca

SEQ ID NO: 316257 - RNA, 15 nt, Bordetella pertussis
ggccgggcaggccgc

SEQ ID NO: 316258 - RNA, 13 nt, Bordetella pertussis
ggccgggccagcg

SEQ ID NO: 316259 - RNA, 13 nt, Bordetella pertussis
ggccgggccagua

SEQ ID NO: 316260 - RNA, 16 nt, Bordetella pertussis
ggccgggcccggcgcg

SEQ ID NO: 316261 - RNA, 12 nt, Bordetella pertussis
ggccgggcgcca

SEQ ID NO: 316262 - RNA, 13 nt, Bordetella pertussis
ggccgggcgccag

SEQ ID NO: 316263 - RNA, 14 nt, Bordetella pertussis
ggccgggcgccagg

SEQ ID NO: 316264 - RNA, 16 nt, Bordetella pertussis
ggccgggcgccaggcu

SEQ ID NO: 316265 - RNA, 17 nt, Bordetella pertussis
ggccgggcgcccagcgu

SEQ ID NO: 316266 - RNA, 14 nt, Bordetella pertussis
ggccgggcgcggcg

SEQ ID NO: 316267 - RNA, 17 nt, Bordetella pertussis
ggccgggcgcggcgccc

SEQ ID NO: 316268 - RNA, 13 nt, Bordetella pertussis
ggccggggccgcc

SEQ ID NO: 316269 - RNA, 17 nt, Bordetella pertussis
ggccggggccgcccagc

SEQ ID NO: 316270 - RNA, 18 nt, Bordetella pertussis
ggccggggccgcccagca

SEQ ID NO: 316271 - RNA, 17 nt, Bordetella pertussis
ggccggggccgcccugc

SEQ ID NO: 316272 - RNA, 19 nt, Bordetella pertussis
ggccggggaaacggccaag

SEQ ID NO: 316273 - RNA, 19 nt, Bordetella pertussis
ggccggguugucgcccacc

SEQ ID NO: 316274 - RNA, 20 nt, Bordetella pertussis
ggccggguugucgcccacca

SEQ ID NO: 316275 - RNA, 18 nt, Bordetella pertussis
ggccgguaucgacgcgcg

SEQ ID NO: 316276 - RNA, 22 nt, Bordetella pertussis
ggccggugccagucuccaggcu

SEQ ID NO: 316277 - RNA, 22 nt, Bordetella pertussis
ggccggugaugcggcgcgccgc

SEQ ID NO: 316278 - RNA, 22 nt, Bordetella pertussis
ggccguagcguuggcggccggc

SEQ ID NO: 316279 - RNA, 24 nt, Bordetella pertussis
ggccguagcguuggcggccggcca

SEQ ID NO: 316280 - RNA, 14 nt, Bordetella pertussis
ggccgucaacggcu

SEQ ID NO: 316281 - RNA, 16 nt, Bordetella pertussis
ggccgucaagcgucga

SEQ ID NO: 316282 - RNA, 14 nt, Bordetella pertussis
ggccgucaccgccg

SEQ ID NO: 316283 - RNA, 15 nt, Bordetella pertussis
ggccgucaccgccgc

SEQ ID NO: 316284 - RNA, 17 nt, Bordetella pertussis
ggccgucagcagcaggc

SEQ ID NO: 316285 - RNA, 23 nt, Bordetella pertussis
ggccgucagcagcaggcuggcca

SEQ ID NO: 316286 - RNA, 18 nt, Bordetella pertussis
ggccgucaggcguugcgc

SEQ ID NO: 316287 - RNA, 17 nt, Bordetella pertussis
ggccgucauccacaggu

SEQ ID NO: 316288 - RNA, 17 nt, Bordetella pertussis
ggccgucaugcgccguc

SEQ ID NO: 316289 - RNA, 17 nt, Bordetella pertussis
ggccgucauggcggucu

SEQ ID NO: 316290 - RNA, 13 nt, Bordetella pertussis
ggccgucugggcg

SEQ ID NO: 316291 - RNA, 15 nt, Bordetella pertussis
ggccgugagcgccgc

SEQ ID NO: 316292 - RNA, 18 nt, Bordetella pertussis
ggccgugagcgccgccgc

SEQ ID NO: 316293 - RNA, 23 nt, Bordetella pertussis
ggccgugaucuugaugccgccca

SEQ ID NO: 316294 - RNA, 16 nt, Bordetella pertussis
ggccuacuugccggcg

SEQ ID NO: 316295 - RNA, 18 nt, Bordetella pertussis
ggccuacuugccggcgcu

SEQ ID NO: 316296 - RNA, 22 nt, Bordetella pertussis
ggccuacuugccggcgcucagc

SEQ ID NO: 316297 - RNA, 15 nt, Bordetella pertussis
ggccuagcccggcgc

SEQ ID NO: 316298 - RNA, 17 nt, Bordetella pertussis
ggccuagcccggcgcca

SEQ ID NO: 316299 - RNA, 19 nt, Bordetella pertussis
ggccuagcccggcgccacc

SEQ ID NO: 316300 - RNA, 15 nt, Bordetella pertussis
ggccuaucaccuggg

SEQ ID NO: 316301 - RNA, 19 nt, Bordetella pertussis
ggccuauuuggcggccugg

SEQ ID NO: 316302 - RNA, 20 nt, Bordetella pertussis
ggccuauuuggcggccuggc

SEQ ID NO: 316303 - RNA, 16 nt, Bordetella pertussis
ggccucgaagcccggc

SEQ ID NO: 316304 - RNA, 17 nt, Bordetella pertussis
ggccucgaagcccggca

SEQ ID NO: 316305 - RNA, 14 nt, Bordetella pertussis
ggccucgacggccg

SEQ ID NO: 316306 - RNA, 18 nt, Bordetella pertussis
ggccucgacggccgccgg

SEQ ID NO: 316307 - RNA, 13 nt, Bordetella pertussis
ggccucgcgcagg

SEQ ID NO: 316308 - RNA, 15 nt, Bordetella pertussis
ggccucgcgcagggc

SEQ ID NO: 316309 - RNA, 19 nt, Bordetella pertussis
ggccucgcgcagggcggcc

SEQ ID NO: 316310 - RNA, 20 nt, Bordetella pertussis
ggccucgcgcagggcggccu

SEQ ID NO: 316311 - RNA, 19 nt, Bordetella pertussis
ggccucgcgcucgaacauc

SEQ ID NO: 316312 - RNA, 22 nt, Bordetella pertussis
ggccucgcgcucgaacaucgcg

SEQ ID NO: 316313 - RNA, 14 nt, Bordetella pertussis
ggccucgcgcucgc

SEQ ID NO: 316314 - RNA, 16 nt, Bordetella pertussis
ggccucgcgcucgcgc

SEQ ID NO: 316315 - RNA, 20 nt, Bordetella pertussis
ggccucgcgcucgcgcucgg

SEQ ID NO: 316316 - RNA, 19 nt, Bordetella pertussis
ggccucgcggcgcagcaug

SEQ ID NO: 316317 - RNA, 14 nt, Bordetella pertussis
ggccucgcggcgcg

SEQ ID NO: 316318 - RNA, 19 nt, Bordetella pertussis
ggccucgcgggccuuggcc

SEQ ID NO: 316319 - RNA, 22 nt, Bordetella pertussis
ggccucgcgggccuuggccagc

SEQ ID NO: 316320 - RNA, 19 nt, Bordetella pertussis
ggccucgcuggagaccggc

SEQ ID NO: 316321 - RNA, 22 nt, Bordetella pertussis
ggccucgcuggagaccggcaug

SEQ ID NO: 316322 - RNA, 14 nt, Bordetella pertussis
ggccucggccagcu

SEQ ID NO: 316323 - RNA, 16 nt, Bordetella pertussis
ggccucggccagcugg

SEQ ID NO: 316324 - RNA, 23 nt, Bordetella pertussis
ggccucggccagcugggaggcgu

SEQ ID NO: 316325 - RNA, 13 nt, Bordetella pertussis
ggccucggccagg

SEQ ID NO: 316326 - RNA, 14 nt, Bordetella pertussis
ggccucggcggccu

SEQ ID NO: 316327 - RNA, 22 nt, Bordetella pertussis
ggccucggcgggcggcgccagc

SEQ ID NO: 316328 - RNA, 13 nt, Bordetella pertussis
ggccucggcuugc

SEQ ID NO: 316329 - RNA, 14 nt, Bordetella pertussis
ggccucguccacgu

SEQ ID NO: 316330 - RNA, 15 nt, Bordetella pertussis
ggccucgugcugcug

SEQ ID NO: 316331 - RNA, 23 nt, Bordetella pertussis
ggccucgugcugcugcaggcgcg

SEQ ID NO: 316332 - RNA, 17 nt, Bordetella pertussis
ggccucuucgucgccgg

SEQ ID NO: 316333 - RNA, 19 nt, Bordetella pertussis
ggccugaaccaggccgcca

SEQ ID NO: 316334 - RNA, 20 nt, Bordetella pertussis
ggccugaaccaggccgccag

SEQ ID NO: 316335 - RNA, 19 nt, Bordetella pertussis
ggccugggcggcggcgaug

SEQ ID NO: 316336 - RNA, 17 nt, Bordetella pertussis
ggccuggggacgggcgc

SEQ ID NO: 316337 - RNA, 23 nt, Bordetella pertussis
ggccugggugcgguaggcgcccg

SEQ ID NO: 316338 - RNA, 16 nt, Bordetella pertussis
ggccuggguggccagc

SEQ ID NO: 316339 - RNA, 13 nt, Bordetella pertussis
aaggcgagcgcgg

SEQ ID NO: 316340 - RNA, 18 nt, Bordetella pertussis
aaggcgaucugcggcgug

SEQ ID NO: 316341 - RNA, 19 nt, Bordetella pertussis
aaggcggcccggccgccgc

SEQ ID NO: 316342 - RNA, 12 nt, Bordetella pertussis
aaggcggccggc

SEQ ID NO: 316343 - RNA, 20 nt, Bordetella pertussis
aaggcgggcuggucgcgccg

SEQ ID NO: 316344 - RNA, 15 nt, Bordetella pertussis
ggccuggucagcgcc

SEQ ID NO: 316345 - RNA, 16 nt, Bordetella pertussis
ggccuggucagcgccg

SEQ ID NO: 316346 - RNA, 20 nt, Bordetella pertussis
ggccuggucaugacgggcgg

SEQ ID NO: 316347 - RNA, 19 nt, Bordetella pertussis
ggccuggugcccgacgccg

SEQ ID NO: 316348 - RNA, 22 nt, Bordetella pertussis
ggccuggugcccgacgccgcgc

SEQ ID NO: 316349 - RNA, 23 nt, Bordetella pertussis
ggccuggucggggucggccacca

SEQ ID NO: 316350 - RNA, 21 nt, Bordetella pertussis
ggccugucacaccccaccacg

SEQ ID NO: 316351 - RNA, 20 nt, Bordetella pertussis
ggccugucugguggcgaucc

SEQ ID NO: 316352 - RNA, 22 nt, Bordetella pertussis
ggccugugcggcccaugucacg

SEQ ID NO: 316353 - RNA, 15 nt, Bordetella pertussis
ggccuguucggacgc

SEQ ID NO: 316354 - RNA, 22 nt, Bordetella pertussis
ggccuucaccccgccaccgccc

SEQ ID NO: 316355 - RNA, 21 nt, Bordetella pertussis
ggccuucagguucaugaccau

SEQ ID NO: 316356 - RNA, 15 nt, Bordetella pertussis
ggccuuccggcauca

SEQ ID NO: 316357 - RNA, 15 nt, Bordetella pertussis
ggccuuccugcugac

SEQ ID NO: 316358 - RNA, 18 nt, Bordetella pertussis
ggccuucgacguccagcc

SEQ ID NO: 316359 - RNA, 20 nt, Bordetella pertussis
ggccuucgacguccagcccg

SEQ ID NO: 316360 - RNA, 22 nt, Bordetella pertussis
ggccuucgacguccagcccgug

SEQ ID NO: 316361 - RNA, 20 nt, Bordetella pertussis
ggccuucgcgguaggacggc

SEQ ID NO: 316362 - RNA, 14 nt, Bordetella pertussis
ggccuucgcugccc

SEQ ID NO: 316363 - RNA, 18 nt, Bordetella pertussis
ggccuucugcgccagcgg

SEQ ID NO: 316364 - RNA, 14 nt, Bordetella pertussis
ggccuugacggcgc

SEQ ID NO: 316365 - RNA, 22 nt, Bordetella pertussis
ggccuugagcaucugcggcacg

SEQ ID NO: 316366 - RNA, 17 nt, Bordetella pertussis
ggccuugcaugcgccgc

SEQ ID NO: 316367 - RNA, 22 nt, Bordetella pertussis
ggccuugccgguggacggccag

SEQ ID NO: 316368 - RNA, 15 nt, Bordetella pertussis
ggccuugcgcgucca

SEQ ID NO: 316369 - RNA, 14 nt, Bordetella pertussis
ggccuugcgggccg

SEQ ID NO: 316370 - RNA, 17 nt, Bordetella pertussis
ggccuugcgggccggcu

SEQ ID NO: 316371 - RNA, 20 nt, Bordetella pertussis
ggccuugcucgcccauggca

SEQ ID NO: 316372 - RNA, 23 nt, Bordetella pertussis
ggccuugcugaaccugcuggccg

SEQ ID NO: 316373 - RNA, 15 nt, Bordetella pertussis
ggccuuggccagcag

SEQ ID NO: 316374 - RNA, 12 nt, Bordetella pertussis
ggccuuggcggc

SEQ ID NO: 316375 - RNA, 14 nt, Bordetella pertussis
ggccuuggcggccc

SEQ ID NO: 316376 - RNA, 19 nt, Bordetella pertussis
ggccuuggcggccccgcgu

SEQ ID NO: 316377 - RNA, 15 nt, Bordetella pertussis
ggccuuggccuuggc

SEQ ID NO: 316378 - RNA, 22 nt, Bordetella pertussis
ggccuuggccuuggcggccccg

SEQ ID NO: 316379 - RNA, 16 nt, Bordetella pertussis
ggccuugugcgccagc

SEQ ID NO: 316380 - RNA, 19 nt, Bordetella pertussis
ggccuugugcgccagcgcg

SEQ ID NO: 316381 - RNA, 14 nt, Bordetella pertussis
ggccuugugcgccg

SEQ ID NO: 316382 - RNA, 20 nt, Bordetella pertussis
ggccuuuuccaggcgugccc

SEQ ID NO: 316383 - RNA, 16 nt, Bordetella pertussis
ggcgaaacggccagcg

SEQ ID NO: 316384 - RNA, 17 nt, Bordetella pertussis
ggcgaaagcgucggcuu

SEQ ID NO: 316385 - RNA, 18 nt, Bordetella pertussis
ggcgaaaggcaccgagca

SEQ ID NO: 316386 - RNA, 18 nt, Bordetella pertussis
ggcgaaacuggccgacga

SEQ ID NO: 316387 - RNA, 21 nt, Bordetella pertussis
ggcgaaauacaccuuguuggc

SEQ ID NO: 316388 - RNA, 20 nt, Bordetella pertussis
ggcgaacaguugcaccagug

SEQ ID NO: 316389 - RNA, 14 nt, Bordetella pertussis
ggcgaaccgcggcg

SEQ ID NO: 316390 - RNA, 13 nt, Bordetella pertussis
ggcgaaccuggcg

SEQ ID NO: 316391 - RNA, 22 nt, Bordetella pertussis
ggcgaacgacagaccguagcgc

SEQ ID NO: 316392 - RNA, 17 nt, Bordetella pertussis
ggcgaacguggccugcu

SEQ ID NO: 316393 - RNA, 15 nt, Bordetella pertussis
ggcgaacugcucgug

SEQ ID NO: 316394 - RNA, 15 nt, Bordetella pertussis
ggcgaagaccgugau

SEQ ID NO: 316395 - RNA, 16 nt, Bordetella pertussis
ggcgaagacgauggcg

SEQ ID NO: 316396 - RNA, 20 nt, Bordetella pertussis
ggcgaagagccguacucgau

SEQ ID NO: 316397 - RNA, 21 nt, Bordetella pertussis
ggcgaagccaucgacaagcgc

SEQ ID NO: 316398 - RNA, 20 nt, Bordetella pertussis
ggcgaagccgcagcggcagc

SEQ ID NO: 316399 - RNA, 22 nt, Bordetella pertussis
ggcgaagccuugcgcggccagc

SEQ ID NO: 316400 - RNA, 14 nt, Bordetella pertussis
ggcgaagccggcac

SEQ ID NO: 316401 - RNA, 15 nt, Bordetella pertussis
ggcgaagccggcacg

SEQ ID NO: 316402 - RNA, 21 nt, Bordetella pertussis
ggcgaagccggcacgccugcc

SEQ ID NO: 316403 - RNA, 21 nt, Bordetella pertussis
ggcgaagcuguccuucguggc

SEQ ID NO: 316404 - RNA, 17 nt, Bordetella pertussis
ggcgaaggccagcgccu

SEQ ID NO: 316405 - RNA, 14 nt, Bordetella pertussis
ggcgaaggcgcggc

SEQ ID NO: 316406 - RNA, 11 nt, Bordetella pertussis
ggcgaaggcgu

SEQ ID NO: 316407 - RNA, 17 nt, Bordetella pertussis
ggcgaaggcgucggcca

SEQ ID NO: 316408 - RNA, 22 nt, Bordetella pertussis
ggcgaaggcgucggccauggcg

SEQ ID NO: 316409 - RNA, 18 nt, Bordetella pertussis
ggcgaaguccugcaugcc

SEQ ID NO: 316410 - RNA, 23 nt, Bordetella pertussis
ggcgaagugcccgcuggccaugc

SEQ ID NO: 316411 - RNA, 22 nt, Bordetella pertussis
ggcgaaucaguucgcgcaggcg

SEQ ID NO: 316412 - RNA, 17 nt, Bordetella pertussis
ggcgaauccaccggcgc

SEQ ID NO: 316413 - RNA, 19 nt, Bordetella pertussis
ggcgacagcaaugacgacg

SEQ ID NO: 316414 - RNA, 13 nt, Bordetella pertussis
ggcgacagggcgu

SEQ ID NO: 316415 - RNA, 14 nt, Bordetella pertussis
ggcgacagggcguc

SEQ ID NO: 316416 - RNA, 16 nt, Bordetella pertussis
ggcgacagggcgucgu

SEQ ID NO: 316417 - RNA, 23 nt, Bordetella pertussis
ggcgacauagaucuccggcgccu

SEQ ID NO: 316418 - RNA, 13 nt, Bordetella pertussis
ggcgaccaggccc

SEQ ID NO: 316419 - RNA, 22 nt, Bordetella pertussis
ggcgaccaggcccacgacgaac

SEQ ID NO: 316420 - RNA, 19 nt, Bordetella pertussis
ggcgaccaggugcgggccg

SEQ ID NO: 316421 - RNA, 13 nt, Bordetella pertussis
ggcgaccgccggc

SEQ ID NO: 316422 - RNA, 15 nt, Bordetella pertussis
ggcgaccgccggccg

SEQ ID NO: 316423 - RNA, 16 nt, Bordetella pertussis
ggcgaccgcgaaccgg

SEQ ID NO: 316424 - RNA, 19 nt, Bordetella pertussis
ggcgaccggcaccugggcc

SEQ ID NO: 316425 - RNA, 14 nt, Bordetella pertussis
ggcgaccggcggca

SEQ ID NO: 316426 - RNA, 17 nt, Bordetella pertussis
ggcgacgaacccgggcg

SEQ ID NO: 316427 - RNA, 19 nt, Bordetella pertussis
ggcgacgaacccgggcgug

SEQ ID NO: 316428 - RNA, 20 nt, Bordetella pertussis
ggcgacgaacccgggcguga

SEQ ID NO: 316429 - RNA, 20 nt, Bordetella pertussis
ggcgacgacuacgcgcuggc

SEQ ID NO: 316430 - RNA, 22 nt, Bordetella pertussis
ggcgacgacuacgcgcuggcgc

SEQ ID NO: 316431 - RNA, 23 nt, Bordetella pertussis
ggcgacgacuacgcgcuggcgca

SEQ ID NO: 316432 - RNA, 16 nt, Bordetella pertussis
ggcgacgaucccgacg

SEQ ID NO: 316433 - RNA, 16 nt, Bordetella pertussis
ggcgacgcccagccug

SEQ ID NO: 316434 - RNA, 14 nt, Bordetella pertussis
ggcgacgccgcggu

SEQ ID NO: 316435 - RNA, 14 nt, Bordetella pertussis
ggcgacgcgcugcc

SEQ ID NO: 316436 - RNA, 15 nt, Bordetella pertussis
ggcgacgcgcugccg

SEQ ID NO: 316437 - RNA, 18 nt, Bordetella pertussis
ggcgacgcggcguacugg

SEQ ID NO: 316438 - RNA, 13 nt, Bordetella pertussis
ggcgacggccugc

SEQ ID NO: 316439 - RNA, 16 nt, Bordetella pertussis
ggcgacggcgccuggc

SEQ ID NO: 316440 - RNA, 13 nt, Bordetella pertussis
ggcgacggcgccu

SEQ ID NO: 316441 - RNA, 14 nt, Bordetella pertussis
ggcgacggcgucgg

SEQ ID NO: 316442 - RNA, 20 nt, Bordetella pertussis
aaggcuucucgaccaggcgg

SEQ ID NO: 316443 - RNA, 14 nt, Bordetella pertussis
aaggcuuucugcuu

SEQ ID NO: 316444 - RNA, 16 nt, Bordetella pertussis
ggcgacggucaggggc

SEQ ID NO: 316445 - RNA, 14 nt, Bordetella pertussis
aagggauagcgccg

SEQ ID NO: 316446 - RNA, 15 nt, Bordetella pertussis
ggcgacgucccaggc

SEQ ID NO: 316447 - RNA, 14 nt, Bordetella pertussis
ggcgacgucgggca

SEQ ID NO: 316448 - RNA, 20 nt, Bordetella pertussis
ggcgacgucgggcagggcga

SEQ ID NO: 316449 - RNA, 18 nt, Bordetella pertussis
ggcgacuuccagcagauu

SEQ ID NO: 316450 - RNA, 20 nt, Bordetella pertussis
ggcgacuucggcggccaugc

SEQ ID NO: 316451 - RNA, 17 nt, Bordetella pertussis
ggcgacuucggcggccu

SEQ ID NO: 316452 - RNA, 19 nt, Bordetella pertussis
ggcgagaacgcggccgcga

SEQ ID NO: 316453 - RNA, 15 nt, Bordetella pertussis
ggcgagacgucggcg

SEQ ID NO: 316454 - RNA, 20 nt, Bordetella pertussis
ggcgagaugccgucgaaggc

SEQ ID NO: 316455 - RNA, 20 nt, Bordetella pertussis
ggcgagcacccgcaggcggc

SEQ ID NO: 316456 - RNA, 16 nt, Bordetella pertussis
ggcgagcauggcaucg

SEQ ID NO: 316457 - RNA, 15 nt, Bordetella pertussis
ggcgagcacggccug

SEQ ID NO: 316458 - RNA, 21 nt, Bordetella pertussis
ggcgagcccagguugcucgcc

SEQ ID NO: 316459 - RNA, 18 nt, Bordetella pertussis
ggcgagccgcgcgcaugc

SEQ ID NO: 316460 - RNA, 12 nt, Bordetella pertussis
ggcgagccgggc

SEQ ID NO: 316461 - RNA, 12 nt, Bordetella pertussis
ggcgagcgccgc

SEQ ID NO: 316462 - RNA, 14 nt, Bordetella pertussis
ggcgagcgccgcgc

SEQ ID NO: 316463 - RNA, 18 nt, Bordetella pertussis
ggcgagcgcggcgauacg

SEQ ID NO: 316464 - RNA, 19 nt, Bordetella pertussis
ggcgagcgcggcgcgcgcc

SEQ ID NO: 316465 - RNA, 13 nt, Bordetella pertussis
ggcgagcgccgcc

SEQ ID NO: 316466 - RNA, 17 nt, Bordetella pertussis
ggcgagcgccgccaggc

SEQ ID NO: 316467 - RNA, 20 nt, Bordetella pertussis
ggcgagcguuuuggcgagca

SEQ ID NO: 316468 - RNA, 17 nt, Bordetella pertussis
ggcgagcucggcauggc

SEQ ID NO: 316469 - RNA, 15 nt, Bordetella pertussis
ggcgcaacccggccu

SEQ ID NO: 316470 - RNA, 12 nt, Bordetella pertussis
aagggcagcagc

SEQ ID NO: 316471 - RNA, 13 nt, Bordetella pertussis
aagggcagcagca

SEQ ID NO: 316472 - RNA, 12 nt, Bordetella pertussis
aagggcgugcgc

SEQ ID NO: 316473 - RNA, 16 nt, Bordetella pertussis
aaggggguucgcggaa

SEQ ID NO: 316474 - RNA, 16 nt, Bordetella pertussis
aagggugcggcgccac

SEQ ID NO: 316475 - RNA, 15 nt, Bordetella pertussis
ggcgcaaccggcccg

SEQ ID NO: 316476 - RNA, 13 nt, Bordetella pertussis
ggcgcaacgccgg

SEQ ID NO: 316477 - RNA, 14 nt, Bordetella pertussis
ggcgcaacgccggc

SEQ ID NO: 316478 - RNA, 15 nt, Bordetella pertussis
ggcgcaacgccggcc

SEQ ID NO: 316479 - RNA, 23 nt, Bordetella pertussis
ggcgcaacgccggccgccauggc

SEQ ID NO: 316480 - RNA, 15 nt, Bordetella pertussis
ggcgcaacgggccga

SEQ ID NO: 316481 - RNA, 17 nt, Bordetella pertussis
ggcgcaagcgcgccgac

SEQ ID NO: 316482 - RNA, 20 nt, Bordetella pertussis
ggcgcaaggacgcguccucg

SEQ ID NO: 316483 - RNA, 15 nt, Bordetella pertussis
ggcgcaaggcgucgg

SEQ ID NO: 316484 - RNA, 19 nt, Bordetella pertussis
ggcgcaaggcgucgggcac

SEQ ID NO: 316485 - RNA, 21 nt, Bordetella pertussis
ggcgcacaaucugcgucgccu

SEQ ID NO: 316486 - RNA, 14 nt, Bordetella pertussis
ggcgcacaccauca

SEQ ID NO: 316487 - RNA, 19 nt, Bordetella pertussis
ggcgcacaccaucagcugg

SEQ ID NO: 316488 - RNA, 16 nt, Bordetella pertussis
ggcgcaauaggccgcg

SEQ ID NO: 316489 - RNA, 17 nt, Bordetella pertussis
ggcgcaauaggccgcga

SEQ ID NO: 316490 - RNA, 15 nt, Bordetella pertussis
ggcgcacagggcguc

SEQ ID NO: 316491 - RNA, 23 nt, Bordetella pertussis
ggcgcacaguugcaggccaugcu

SEQ ID NO: 316492 - RNA, 12 nt, Bordetella pertussis
ggcgcagcggcg

SEQ ID NO: 316493 - RNA, 24 nt, Bordetella pertussis
ggcgcagcuccgggucgagcgccg

SEQ ID NO: 316494 - RNA, 20 nt, Bordetella pertussis
ggcgcaggaacucagcgcac

SEQ ID NO: 316495 - RNA, 13 nt, Bordetella pertussis
ggcgcaggaugcg

SEQ ID NO: 316496 - RNA, 20 nt, Bordetella pertussis
ggcgcaggaugcgcuggccg

SEQ ID NO: 316497 - RNA, 22 nt, Bordetella pertussis
ggcgcaggaugcgcuggccggc

SEQ ID NO: 316498 - RNA, 13 nt, Bordetella pertussis
ggcgcaggccagc

SEQ ID NO: 316499 - RNA, 14 nt, Bordetella pertussis
ggcgcaggccagcg

SEQ ID NO: 316500 - RNA, 19 nt, Bordetella pertussis
ggcgcaggccagcgccgcg

SEQ ID NO: 316501 - RNA, 21 nt, Bordetella pertussis
ggcgcaggccagcgccgcggu

SEQ ID NO: 316502 - RNA, 12 nt, Bordetella pertussis
ggcgcaggccga

SEQ ID NO: 316503 - RNA, 15 nt, Bordetella pertussis
ggcgcaggccgacgc

SEQ ID NO: 316504 - RNA, 14 nt, Bordetella pertussis
ggcgcaggccgcca

SEQ ID NO: 316505 - RNA, 17 nt, Bordetella pertussis
ggcgcaggccgccacuu

SEQ ID NO: 316506 - RNA, 13 nt, Bordetella pertussis
ggcgcaggccgcg

SEQ ID NO: 316507 - RNA, 14 nt, Bordetella pertussis
ggcgcaggccgcgc

SEQ ID NO: 316508 - RNA, 19 nt, Bordetella pertussis
ggcgcaggccgcgcgcauc

SEQ ID NO: 316509 - RNA, 16 nt, Bordetella pertussis
ggcgcaggccugcggc

SEQ ID NO: 316510 - RNA, 12 nt, Bordetella pertussis
ggcgcaggcgcg

SEQ ID NO: 316511 - RNA, 13 nt, Bordetella pertussis
ggcgcaggcgcga

SEQ ID NO: 316512 - RNA, 16 nt, Bordetella pertussis
ggcgcaggccggcggc

SEQ ID NO: 316513 - RNA, 13 nt, Bordetella pertussis
ggcgcagggugcg

SEQ ID NO: 316514 - RNA, 18 nt, Bordetella pertussis
ggcgcaguaucccggcca

SEQ ID NO: 316515 - RNA, 19 nt, Bordetella pertussis
ggcgcaguaucccggccag

SEQ ID NO: 316516 - RNA, 20 nt, Bordetella pertussis
ggcgcaguaucccggccagg

SEQ ID NO: 316517 - RNA, 23 nt, Bordetella pertussis
ggcgcaguaucccggccaggcgc

SEQ ID NO: 316518 - RNA, 16 nt, Bordetella pertussis
ggcgcagucgagcacc

SEQ ID NO: 316519 - RNA, 18 nt, Bordetella pertussis
ggcgcagucgagcaccgc

SEQ ID NO: 316520 - RNA, 15 nt, Bordetella pertussis
ggcgcagucgcgcac

SEQ ID NO: 316521 - RNA, 22 nt, Bordetella pertussis
ggcgcaguuccggcgggccgca

SEQ ID NO: 316522 - RNA, 17 nt, Bordetella pertussis
ggcgccacagggccuga

SEQ ID NO: 316523 - RNA, 18 nt, Bordetella pertussis
ggcgccacagggccugac

SEQ ID NO: 316524 - RNA, 14 nt, Bordetella pertussis
ggcgccacaggugc

SEQ ID NO: 316525 - RNA, 18 nt, Bordetella pertussis
ggcgccacaggugcgcgg

SEQ ID NO: 316526 - RNA, 22 nt, Bordetella pertussis
ggcgccacaggugcgcggcgcg

SEQ ID NO: 316527 - RNA, 23 nt, Bordetella pertussis
ggcgccaccccguagcgcaucgc

SEQ ID NO: 316528 - RNA, 18 nt, Bordetella pertussis
ggcgccaccuucgccgcg

SEQ ID NO: 316529 - RNA, 22 nt, Bordetella pertussis
ggcgccaccuucgccgcgcaca

SEQ ID NO: 316530 - RNA, 24 nt, Bordetella pertussis
ggcgccaccuucgccgcgcacagc

SEQ ID NO: 316531 - RNA, 18 nt, Bordetella pertussis
ggcgccacggcuugcgcg

SEQ ID NO: 316532 - RNA, 16 nt, Bordetella pertussis
ggcgccacugccaggc

SEQ ID NO: 316533 - RNA, 20 nt, Bordetella pertussis
ggcgccacugccaggcgccc

SEQ ID NO: 316534 - RNA, 13 nt, Bordetella pertussis
ggcgccagcagca

SEQ ID NO: 316535 - RNA, 16 nt, Bordetella pertussis
ggcgccagcagcacgu

SEQ ID NO: 316536 - RNA, 16 nt, Bordetella pertussis
ggcgccagcagcgggc

SEQ ID NO: 316537 - RNA, 19 nt, Bordetella pertussis
ggcgccagcaugcgcgcgg

SEQ ID NO: 316538 - RNA, 22 nt, Bordetella pertussis
ggcgccagcaugcgcgcggccu

SEQ ID NO: 316539 - RNA, 13 nt, Bordetella pertussis
ggcgccagcccgc

SEQ ID NO: 316540 - RNA, 12 nt, Bordetella pertussis
ggcgccagcccg

SEQ ID NO: 316541 - RNA, 14 nt, Bordetella pertussis
ggcgccagcgccgc

SEQ ID NO: 316542 - RNA, 21 nt, Bordetella pertussis
ggcgccagcuggaccgccugg

SEQ ID NO: 316543 - RNA, 22 nt, Bordetella pertussis
ggcgccagcuggaccgccuggc

SEQ ID NO: 316544 - RNA, 15 nt, Bordetella pertussis
ggcgccagcugggcg

SEQ ID NO: 316545 - RNA, 22 nt, Bordetella pertussis
ggcgccagcugggcgaucuuca

SEQ ID NO: 316546 - RNA, 12 nt, Bordetella pertussis
ggcgcccgccac

SEQ ID NO: 316547 - RNA, 23 nt, Bordetella pertussis
ggcgccagcgccgcgucgagcgc

SEQ ID NO: 316548 - RNA, 14 nt, Bordetella pertussis
ggcgccagcggcau

SEQ ID NO: 316549 - RNA, 12 nt, Bordetella pertussis
ggcgcccgccgc

SEQ ID NO: 316550 - RNA, 12 nt, Bordetella pertussis
ggcgcccgccug

SEQ ID NO: 316551 - RNA, 13 nt, Bordetella pertussis
ggcgcccgccugc

SEQ ID NO: 316552 - RNA, 17 nt, Bordetella pertussis
ggcgcccgccugcgugg

SEQ ID NO: 316553 - RNA, 22 nt, Bordetella pertussis
ggcgcccgcuucucacugcccg

SEQ ID NO: 316554 - RNA, 16 nt, Bordetella pertussis
ggcgcccggcagccga

SEQ ID NO: 316555 - RNA, 13 nt, Bordetella pertussis
ggcgcccggccug

SEQ ID NO: 316556 - RNA, 12 nt, Bordetella pertussis
ggcgcccggcgg

SEQ ID NO: 316557 - RNA, 18 nt, Bordetella pertussis
ggcgcccggcggcgcgcu

SEQ ID NO: 316558 - RNA, 14 nt, Bordetella pertussis
ggcgcccggcguga

SEQ ID NO: 316559 - RNA, 15 nt, Bordetella pertussis
ggcgcccggcgugac

SEQ ID NO: 316560 - RNA, 17 nt, Bordetella pertussis
ggcgcccggcgugacgc

SEQ ID NO: 316561 - RNA, 17 nt, Bordetella pertussis
ggcgcccggugcgcgca

SEQ ID NO: 316562 - RNA, 21 nt, Bordetella pertussis
ggcgcccggugcgcgcagggc

SEQ ID NO: 316563 - RNA, 17 nt, Bordetella pertussis
ggcgccgaaggcggcgc

SEQ ID NO: 316564 - RNA, 17 nt, Bordetella pertussis
ggcgccgcacaucgucg

SEQ ID NO: 316565 - RNA, 15 nt, Bordetella pertussis
ggcgccgcacccgau

SEQ ID NO: 316566 - RNA, 12 nt, Bordetella pertussis
ggcgccgcacgc

SEQ ID NO: 316567 - RNA, 16 nt, Bordetella pertussis
ggcgccgcacgccggu

SEQ ID NO: 316568 - RNA, 21 nt, Bordetella pertussis
ggcgccgcauuuccucgacca

SEQ ID NO: 316569 - RNA, 12 nt, Bordetella pertussis
ggcgccgccccg

SEQ ID NO: 316570 - RNA, 14 nt, Bordetella pertussis
ggcgccgccgcccg

SEQ ID NO: 316571 - RNA, 14 nt, Bordetella pertussis
ggcgccgccggcca

SEQ ID NO: 316572 - RNA, 13 nt, Bordetella pertussis
ggcgccgccggcg

SEQ ID NO: 316573 - RNA, 12 nt, Bordetella pertussis
ggcgccggccgc

SEQ ID NO: 316574 - RNA, 17 nt, Bordetella pertussis
ggcgccggccgcgcgcg

SEQ ID NO: 316575 - RNA, 23 nt, Bordetella pertussis
ggcgccggccgcgcgcgccaugu

SEQ ID NO: 316576 - RNA, 14 nt, Bordetella pertussis
ggcgccggccgccc

SEQ ID NO: 316577 - RNA, 13 nt, Bordetella pertussis
ggcgccggccuca

SEQ ID NO: 316578 - RNA, 21 nt, Bordetella pertussis
ggcgccggccuccagcaucgc

SEQ ID NO: 316579 - RNA, 18 nt, Bordetella pertussis
ggcgccggcgacgccgcg

SEQ ID NO: 316580 - RNA, 14 nt, Bordetella pertussis
ggcgccggcggcga

SEQ ID NO: 316581 - RNA, 14 nt, Bordetella pertussis
ggcgccggcgguaa

SEQ ID NO: 316582 - RNA, 23 nt, Bordetella pertussis
ggcgccggcuccgauagcggcgc

SEQ ID NO: 316583 - RNA, 13 nt, Bordetella pertussis
ggcgccggcuucg

SEQ ID NO: 316584 - RNA, 16 nt, Bordetella pertussis
ggcgccggcuucguca

SEQ ID NO: 316585 - RNA, 19 nt, Bordetella pertussis
ggcgccggcuucgucaugg

SEQ ID NO: 316586 - RNA, 14 nt, Bordetella pertussis
ggcgccgggccgcu

SEQ ID NO: 316587 - RNA, 15 nt, Bordetella pertussis
ggcgccgggcgacgg

SEQ ID NO: 316588 - RNA, 16 nt, Bordetella pertussis
ggcgccgucgcgcugu

SEQ ID NO: 316589 - RNA, 19 nt, Bordetella pertussis
ggcgccgucuucgguggcc

SEQ ID NO: 316590 - RNA, 22 nt, Bordetella pertussis
ggcgccgucuucgguggcccgc

SEQ ID NO: 316591 - RNA, 23 nt, Bordetella pertussis
ggcgccgugaaugcgccuggcgu

SEQ ID NO: 316592 - RNA, 13 nt, Bordetella pertussis
ggcgccgugcccg

SEQ ID NO: 316593 - RNA, 18 nt, Bordetella pertussis
ggcgccguuccugcagcg

SEQ ID NO: 316594 - RNA, 14 nt, Bordetella pertussis
ggcgccguucgucg

SEQ ID NO: 316595 - RNA, 20 nt, Bordetella pertussis
ggcgccguucgucgcgcagc

SEQ ID NO: 316596 - RNA, 14 nt, Bordetella pertussis
ggcgccgugcugga

SEQ ID NO: 316597 - RNA, 20 nt, Bordetella pertussis
ggcgccguuuuuuucguugc

SEQ ID NO: 316598 - RNA, 18 nt, Bordetella pertussis
ggcgccuacacgguggcg

SEQ ID NO: 316599 - RNA, 16 nt, Bordetella pertussis
ggcgccuacggcggcg

SEQ ID NO: 316600 - RNA, 21 nt, Bordetella pertussis
ggcgccuacggcggcggccau

SEQ ID NO: 316601 - RNA, 21 nt, Bordetella pertussis
ggcgccuauugcgacgccgcc

SEQ ID NO: 316602 - RNA, 14 nt, Bordetella pertussis
ggcgcgagcgccgg

SEQ ID NO: 316603 - RNA, 17 nt, Bordetella pertussis
ggcgcgagcgccgggcg

SEQ ID NO: 316604 - RNA, 18 nt, Bordetella pertussis
ggcgcgagcgccgggcgc

SEQ ID NO: 316605 - RNA, 19 nt, Bordetella pertussis
ggcgcgagcgccgggcgcc

SEQ ID NO: 316606 - RNA, 21 nt, Bordetella pertussis
ggcgcgaguauucacgccgcg

SEQ ID NO: 316607 - RNA, 22 nt, Bordetella pertussis
ggcgcgauagcgcuugccugac

SEQ ID NO: 316608 - RNA, 16 nt, Bordetella pertussis
ggcgcgaugggccugc

SEQ ID NO: 316609 - RNA, 19 nt, Bordetella pertussis
ggcgcgaugggccugccca

SEQ ID NO: 316610 - RNA, 20 nt, Bordetella pertussis
ggcgcgauguucggaugcgc

SEQ ID NO: 316611 - RNA, 22 nt, Bordetella pertussis
ggcgcgcaaaccgacgcggcca

SEQ ID NO: 316612 - RNA, 24 nt, Bordetella pertussis
ggcgcgcaaaccgacgcggccagc

SEQ ID NO: 316613 - RNA, 17 nt, Bordetella pertussis
ggcgcgcaacacgcgcg

SEQ ID NO: 316614 - RNA, 23 nt, Bordetella pertussis
ggcgcgcaacacgcgcgacgccg

SEQ ID NO: 316615 - RNA, 20 nt, Bordetella pertussis
ggcgcgcaaccaggggcggc

SEQ ID NO: 316616 - RNA, 21 nt, Bordetella pertussis
ggcgcgcaagguggcgguggu

SEQ ID NO: 316617 - RNA, 14 nt, Bordetella pertussis
ggcgcgcacaagcg

SEQ ID NO: 316618 - RNA, 17 nt, Bordetella pertussis
ggcgcgcacaagcgcga

SEQ ID NO: 316619 - RNA, 17 nt, Bordetella pertussis
ggcgcgcaccagcccgc

SEQ ID NO: 316620 - RNA, 20 nt, Bordetella pertussis
ggcgcgcaccagcccgcccg

SEQ ID NO: 316621 - RNA, 18 nt, Bordetella pertussis
ggcgcgcaccaucgccga

SEQ ID NO: 316622 - RNA, 14 nt, Bordetella pertussis
ggcgcgcaccaucg

SEQ ID NO: 316623 - RNA, 18 nt, Bordetella pertussis
ggcgcgcacgggcgaggc

SEQ ID NO: 316624 - RNA, 13 nt, Bordetella pertussis
ggcgcgcagcaca

SEQ ID NO: 316625 - RNA, 18 nt, Bordetella pertussis
ggcgcgcagcacgccgau

SEQ ID NO: 316626 - RNA, 14 nt, Bordetella pertussis
ggcgcgcagcaggc

SEQ ID NO: 316627 - RNA, 17 nt, Bordetella pertussis
ggcgcgcagcaggccca

SEQ ID NO: 316628 - RNA, 21 nt, Bordetella pertussis
ggcgcgcagauugcgcucggu

SEQ ID NO: 316629 - RNA, 11 nt, Bordetella pertussis
ggcgcgcagca

SEQ ID NO: 316630 - RNA, 16 nt, Bordetella pertussis
ggcgcgcagcgccugc

SEQ ID NO: 316631 - RNA, 22 nt, Bordetella pertussis
ggcgcgcagcgcgaccgggcaa

SEQ ID NO: 316632 - RNA, 19 nt, Bordetella pertussis
ggcgcgcaucgcgcggcau

SEQ ID NO: 316633 - RNA, 15 nt, Bordetella pertussis
ggcgcgcaucggcgc

SEQ ID NO: 316634 - RNA, 18 nt, Bordetella pertussis
ggcgcgcaucggcgccga

SEQ ID NO: 316635 - RNA, 23 nt, Bordetella pertussis
ggcgcgcaucgucaggcaggcgc

SEQ ID NO: 316636 - RNA, 22 nt, Bordetella pertussis
ggcgcgcaguuguucgcgcaac

SEQ ID NO: 316637 - RNA, 17 nt, Bordetella pertussis
ggcgcgccaccggucgc

SEQ ID NO: 316638 - RNA, 19 nt, Bordetella pertussis
ggcgcgccaccggucgccg

SEQ ID NO: 316639 - RNA, 18 nt, Bordetella pertussis
ggcgcgccagcccgccgc

SEQ ID NO: 316640 - RNA, 22 nt, Bordetella pertussis
ggcgcgccagcccgccgcuggu

SEQ ID NO: 316641 - RNA, 14 nt, Bordetella pertussis
ggcgcgccagccgc

SEQ ID NO: 316642 - RNA, 23 nt, Bordetella pertussis
ggcgcgccagccgcgcgaacauc

SEQ ID NO: 316643 - RNA, 21 nt, Bordetella pertussis
ggcgcgccaggaagcgcgccg

SEQ ID NO: 316644 - RNA, 23 nt, Bordetella pertussis
ggcgcgccaggaagcgcgccgcg

SEQ ID NO: 316645 - RNA, 14 nt, Bordetella pertussis
ggcgcgccaggcga

SEQ ID NO: 316646 - RNA, 23 nt, Bordetella pertussis
ggcgcgccaggcgauggccggga

SEQ ID NO: 316647 - RNA, 23 nt, Bordetella pertussis
ggcgcgccaggggaugacgggcg

SEQ ID NO: 316648 - RNA, 12 nt, Bordetella pertussis
ggcgcgccaucc

SEQ ID NO: 316649 - RNA, 17 nt, Bordetella pertussis
ggcgcgccaugucgggg

SEQ ID NO: 316650 - RNA, 23 nt, Bordetella pertussis
ggcgcgcccaccagggugccgcc

SEQ ID NO: 316651 - RNA, 17 nt, Bordetella pertussis
ggcgcgcccagccccgc

SEQ ID NO: 316652 - RNA, 23 nt, Bordetella pertussis
ggcgcgcccagcggcaggcuggc

SEQ ID NO: 316653 - RNA, 22 nt, Bordetella pertussis
ggcgcgcccaggggccggcgcg

SEQ ID NO: 316654 - RNA, 13 nt, Bordetella pertussis
ggcgcgcccgcca

SEQ ID NO: 316655 - RNA, 22 nt, Bordetella pertussis
ggcgcgcccgccgcgucggcgc

SEQ ID NO: 316656 - RNA, 15 nt, Bordetella pertussis
ggcgcgcccgccuuc

SEQ ID NO: 316657 - RNA, 22 nt, Bordetella pertussis
ggcgcgcccgcguacagcccga

SEQ ID NO: 316658 - RNA, 12 nt, Bordetella pertussis
ggcgcgcccggc

SEQ ID NO: 316659 - RNA, 13 nt, Bordetella pertussis
ggcgcgcccggcg

SEQ ID NO: 316660 - RNA, 14 nt, Bordetella pertussis
ggcgcgcccggcga

SEQ ID NO: 316661 - RNA, 15 nt, Bordetella pertussis
ggcgcgcccggcgcg

SEQ ID NO: 316662 - RNA, 15 nt, Bordetella pertussis
ggcgcgcccuugccg

SEQ ID NO: 316663 - RNA, 24 nt, Bordetella pertussis
ggcgcgcccuugccguuguccgcc

SEQ ID NO: 316664 - RNA, 15 nt, Bordetella pertussis
ggcgcgccgcgccgc

SEQ ID NO: 316665 - RNA, 20 nt, Bordetella pertussis
ggcgcgccgcggcgggcuug

SEQ ID NO: 316666 - RNA, 23 nt, Bordetella pertussis
ggcgcgccgcggcgggcuuggcg

SEQ ID NO: 316667 - RNA, 17 nt, Bordetella pertussis
ggcgcgccggccgcggg

SEQ ID NO: 316668 - RNA, 14 nt, Bordetella pertussis
ggcgcgccggccgg

SEQ ID NO: 316669 - RNA, 14 nt, Bordetella pertussis
ggcgcgccggccug

SEQ ID NO: 316670 - RNA, 15 nt, Bordetella pertussis
ggcgcgccggccugc

SEQ ID NO: 316671 - RNA, 18 nt, Bordetella pertussis
ggcgcgccggccugcgcc

SEQ ID NO: 316672 - RNA, 12 nt, Bordetella pertussis
ggcgcgccggcg

SEQ ID NO: 316673 - RNA, 22 nt, Bordetella pertussis
ggcgcgccgggccuagcccggc

SEQ ID NO: 316674 - RNA, 18 nt, Bordetella pertussis
ggcgcgccgcugcagcgc

SEQ ID NO: 316675 - RNA, 19 nt, Bordetella pertussis
ggcgcgccggcgggcgcug

SEQ ID NO: 316676 - RNA, 18 nt, Bordetella pertussis
ggcgcgccuccagcucca

SEQ ID NO: 316677 - RNA, 20 nt, Bordetella pertussis
ggcgcgccuccagcuccagc

SEQ ID NO: 316678 - RNA, 21 nt, Bordetella pertussis
ggcgcgccuccagcuccagcg

SEQ ID NO: 316679 - RNA, 19 nt, Bordetella pertussis
ggcgcgccuggcgcgccca

SEQ ID NO: 316680 - RNA, 21 nt, Bordetella pertussis
ggcgcgccuucggcaggcgcc

SEQ ID NO: 316681 - RNA, 13 nt, Bordetella pertussis
ggcgcgcgcacgc

SEQ ID NO: 316682 - RNA, 19 nt, Bordetella pertussis
ggcgcgcgcaggcgcucga

SEQ ID NO: 316683 - RNA, 13 nt, Bordetella pertussis
ggcgcgcgccagg

SEQ ID NO: 316684 - RNA, 18 nt, Bordetella pertussis
ggcgcgcgccagggcgcc

SEQ ID NO: 316685 - RNA, 21 nt, Bordetella pertussis
ggcgcgcgccagggcgccgcg

SEQ ID NO: 316686 - RNA, 23 nt, Bordetella pertussis
ggcgcgcgccagggcgccgcggg

SEQ ID NO: 316687 - RNA, 22 nt, Bordetella pertussis
ggcgcgcgccaucgacgggcgg

SEQ ID NO: 316688 - RNA, 22 nt, Bordetella pertussis
ggcgcgcgcccaggccagccag

SEQ ID NO: 316689 - RNA, 12 nt, Bordetella pertussis
ggcgcgcgccag

SEQ ID NO: 316690 - RNA, 15 nt, Bordetella pertussis
ggcgcgcgccagcgg

SEQ ID NO: 316691 - RNA, 12 nt, Bordetella pertussis
ggcgcgcgccga

SEQ ID NO: 316692 - RNA, 14 nt, Bordetella pertussis
ggcgcgcgccggcg

SEQ ID NO: 316693 - RNA, 21 nt, Bordetella pertussis
ggcgcgcgccggcggccugca

SEQ ID NO: 316694 - RNA, 14 nt, Bordetella pertussis
ggcgcgcgccggcu

SEQ ID NO: 316695 - RNA, 18 nt, Bordetella pertussis
ggcgcggauugaugucgc

SEQ ID NO: 316696 - RNA, 19 nt, Bordetella pertussis
ggcgcggauuucgcgaugc

SEQ ID NO: 316697 - RNA, 12 nt, Bordetella pertussis
ggcgcggcaggc

SEQ ID NO: 316698 - RNA, 14 nt, Bordetella pertussis
ggcgcggccagcag

SEQ ID NO: 316699 - RNA, 16 nt, Bordetella pertussis
ggcgcggccagcagcg

SEQ ID NO: 316700 - RNA, 17 nt, Bordetella pertussis
ggcgcggccagcagcgc

SEQ ID NO: 316701 - RNA, 15 nt, Bordetella pertussis
ggcgcggccaggcgc

SEQ ID NO: 316702 - RNA, 21 nt, Bordetella pertussis
ggcgcggccagggucaggggc

SEQ ID NO: 316703 - RNA, 15 nt, Bordetella pertussis
ggcgcggcccgccac

SEQ ID NO: 316704 - RNA, 14 nt, Bordetella pertussis
ggcgcggcccggcg

SEQ ID NO: 316705 - RNA, 15 nt, Bordetella pertussis
ggcgcggcccggcgu

SEQ ID NO: 316706 - RNA, 17 nt, Bordetella pertussis
ggcgcggcauggcgccg

SEQ ID NO: 316707 - RNA, 19 nt, Bordetella pertussis
ggcgcggcauggcgccgcg

SEQ ID NO: 316708 - RNA, 12 nt, Bordetella pertussis
ggcgcggccgac

SEQ ID NO: 316709 - RNA, 15 nt, Bordetella pertussis
ggcgcggccgccagc

SEQ ID NO: 316710 - RNA, 14 nt, Bordetella pertussis
ggcgcggccgccgc

SEQ ID NO: 316711 - RNA, 17 nt, Bordetella pertussis
ggcgcggccgccgcccg

SEQ ID NO: 316712 - RNA, 14 nt, Bordetella pertussis
ggcgcggccgggcu

SEQ ID NO: 316713 - RNA, 13 nt, Bordetella pertussis
ggcgcggcgagca

SEQ ID NO: 316714 - RNA, 17 nt, Bordetella pertussis
ggcgcggcgccagcgcc

SEQ ID NO: 316715 - RNA, 14 nt, Bordetella pertussis
ggcgcggcgccaug

SEQ ID NO: 316716 - RNA, 15 nt, Bordetella pertussis
ggcgcggcgccaugc

SEQ ID NO: 316717 - RNA, 22 nt, Bordetella pertussis
ggcgcggcgccaugccgcgccc

SEQ ID NO: 316718 - RNA, 12 nt, Bordetella pertussis
ggcgcggcgccc

SEQ ID NO: 316719 - RNA, 14 nt, Bordetella pertussis
ggcgcggcgcccgc

SEQ ID NO: 316720 - RNA, 17 nt, Bordetella pertussis
ggcgcggcgcccgccug

SEQ ID NO: 316721 - RNA, 17 nt, Bordetella pertussis
ggcgcggcgccguccag

SEQ ID NO: 316722 - RNA, 12 nt, Bordetella pertussis
ggcgcggcgccu

SEQ ID NO: 316723 - RNA, 14 nt, Bordetella pertussis
ggcgcggcgccugc

SEQ ID NO: 316724 - RNA, 12 nt, Bordetella pertussis
ggcgcggcgcgc

SEQ ID NO: 316725 - RNA, 15 nt, Bordetella pertussis
ggcgcggcgcgcgcc

SEQ ID NO: 316726 - RNA, 16 nt, Bordetella pertussis
ggcgcggcgcgcgccg

SEQ ID NO: 316727 - RNA, 17 nt, Bordetella pertussis
ggcgcggcgcgcgccga

SEQ ID NO: 316728 - RNA, 17 nt, Bordetella pertussis
ggcgcggcgcgugccag

SEQ ID NO: 316729 - RNA, 24 nt, Bordetella pertussis
ggcgcggcgcuacgccgccgaugg

SEQ ID NO: 316730 - RNA, 23 nt, Bordetella pertussis
ggcgcggcgaucggcccgggcgu

SEQ ID NO: 316731 - RNA, 12 nt, Bordetella pertussis
ggcgcggcgcca

SEQ ID NO: 316732 - RNA, 17 nt, Bordetella pertussis
ggcgcggcgcuggcgcc

SEQ ID NO: 316733 - RNA, 13 nt, Bordetella pertussis
ggcgcggcggcca

SEQ ID NO: 316734 - RNA, 14 nt, Bordetella pertussis
ggcgcggcggccag

SEQ ID NO: 316735 - RNA, 13 nt, Bordetella pertussis
ggcgcggcggccu

SEQ ID NO: 316736 - RNA, 15 nt, Bordetella pertussis
ggcgcggcggccugg

SEQ ID NO: 316737 - RNA, 20 nt, Bordetella pertussis
ggcgcggcggcggccaugac

SEQ ID NO: 316738 - RNA, 20 nt, Bordetella pertussis
ggcgcggcgggcucagcccg

SEQ ID NO: 316739 - RNA, 20 nt, Bordetella pertussis
ggcgcggcgguccucgccgg

SEQ ID NO: 316740 - RNA, 15 nt, Bordetella pertussis
ggcgcggcucgccgg

SEQ ID NO: 316741 - RNA, 22 nt, Bordetella pertussis
ggcgcguccaagcagacccgcg

SEQ ID NO: 316742 - RNA, 15 nt, Bordetella pertussis
ggcgcguccacgccg

SEQ ID NO: 316743 - RNA, 20 nt, Bordetella pertussis
ggcgcguccacgccguggcg

SEQ ID NO: 316744 - RNA, 13 nt, Bordetella pertussis
ggcgcgucgaccu

SEQ ID NO: 316745 - RNA, 15 nt, Bordetella pertussis
ggcgcgucgccgcgc

SEQ ID NO: 316746 - RNA, 20 nt, Bordetella pertussis
ggcgcgucgcgcgaucaggc

SEQ ID NO: 316747 - RNA, 15 nt, Bordetella pertussis
ggcgcgucgcgcgcc

SEQ ID NO: 316748 - RNA, 18 nt, Bordetella pertussis
ggcgcgucgcgcgccagg

SEQ ID NO: 316749 - RNA, 14 nt, Bordetella pertussis
ggcgcgucgcgcgg

SEQ ID NO: 316750 - RNA, 13 nt, Bordetella pertussis
ggcgcggcugcga

SEQ ID NO: 316751 - RNA, 14 nt, Bordetella pertussis
ggcgcgucggcgcg

SEQ ID NO: 316752 - RNA, 20 nt, Bordetella pertussis
ggcgcgucggcgcgcgcgac

SEQ ID NO: 316753 - RNA, 20 nt, Bordetella pertussis
ggcgcgugcgcgcgccaugg

SEQ ID NO: 316754 - RNA, 22 nt, Bordetella pertussis
ggcgcgugcggaugcagcagcg

SEQ ID NO: 316755 - RNA, 15 nt, Bordetella pertussis
ggcgcgugcuggcgc

SEQ ID NO: 316756 - RNA, 19 nt, Bordetella pertussis
ggcgcgugcuggcgcagca

SEQ ID NO: 316757 - RNA, 22 nt, Bordetella pertussis
ggcgcgugcuggcgcagcagcg

SEQ ID NO: 316758 - RNA, 19 nt, Bordetella pertussis
ggcgcguggcccgcgccgc

SEQ ID NO: 316759 - RNA, 18 nt, Bordetella pertussis
ggcgcguggccgccacgc

SEQ ID NO: 316760 - RNA, 17 nt, Bordetella pertussis
ggcgcguggcgcccagc

SEQ ID NO: 316761 - RNA, 17 nt, Bordetella pertussis
ggcgcgugggcaggugc

SEQ ID NO: 316762 - RNA, 16 nt, Bordetella pertussis
ggcgcgugccagcagg

SEQ ID NO: 316763 - RNA, 17 nt, Bordetella pertussis
aaggugccggacgcccu

SEQ ID NO: 316764 - RNA, 14 nt, Bordetella pertussis
ggcgcucagcgcgc

SEQ ID NO: 316765 - RNA, 17 nt, Bordetella pertussis
ggcgcucagcgcgccga

SEQ ID NO: 316766 - RNA, 13 nt, Bordetella pertussis
ggcgcucagcgua

SEQ ID NO: 316767 - RNA, 19 nt, Bordetella pertussis
ggcgcucaggaaccagcgg

SEQ ID NO: 316768 - RNA, 23 nt, Bordetella pertussis
ggcggaaaacagcaccagcaugc

SEQ ID NO: 316769 - RNA, 17 nt, Bordetella pertussis
ggcggaaauucauccgg

SEQ ID NO: 316770 - RNA, 15 nt, Bordetella pertussis
ggcggacacgcaugc

SEQ ID NO: 316771 - RNA, 12 nt, Bordetella pertussis
ggcggacacgcc

SEQ ID NO: 316772 - RNA, 14 nt, Bordetella pertussis
ggcggacugcgccg

SEQ ID NO: 316773 - RNA, 16 nt, Bordetella pertussis
ggcggacuggccgcgc

SEQ ID NO: 316774 - RNA, 20 nt, Bordetella pertussis
ggcggcaaagucggggcgcc

SEQ ID NO: 316775 - RNA, 14 nt, Bordetella pertussis
ggcggcaagcagcc

SEQ ID NO: 316776 - RNA, 16 nt, Bordetella pertussis
ggcggcaagcagccgg

SEQ ID NO: 316777 - RNA, 14 nt, Bordetella pertussis
ggcggcaccagcag

SEQ ID NO: 316778 - RNA, 21 nt, Bordetella pertussis
ggcggcaccauugccggcgcg

SEQ ID NO: 316779 - RNA, 23 nt, Bordetella pertussis
ggcggcaccauugccggcgcgca

SEQ ID NO: 316780 - RNA, 16 nt, Bordetella pertussis
ggcggcaccgcgcagc

SEQ ID NO: 316781 - RNA, 21 nt, Bordetella pertussis
ggcggcaccgcgcagcccggc

SEQ ID NO: 316782 - RNA, 13 nt, Bordetella pertussis
ggcggcacgcgcg

SEQ ID NO: 316783 - RNA, 15 nt, Bordetella pertussis
ggcggcacgcgcgcc

SEQ ID NO: 316784 - RNA, 16 nt, Bordetella pertussis
ggcggcacgcgcgccg

SEQ ID NO: 316785 - RNA, 14 nt, Bordetella pertussis
ggcggcacgcugcg

SEQ ID NO: 316786 - RNA, 13 nt, Bordetella pertussis
ggcggcacggccg

SEQ ID NO: 316787 - RNA, 18 nt, Bordetella pertussis
ggcggcaauaucggcacc

SEQ ID NO: 316788 - RNA, 19 nt, Bordetella pertussis
ggcggcaugcgccagccag

SEQ ID NO: 316789 - RNA, 22 nt, Bordetella pertussis
ggcggcaugcgccagccagcgc

SEQ ID NO: 316790 - RNA, 20 nt, Bordetella pertussis
ggcggccaccaccaggccca

SEQ ID NO: 316791 - RNA, 12 nt, Bordetella pertussis
ggcggccagccg

SEQ ID NO: 316792 - RNA, 16 nt, Bordetella pertussis
ggcggccagcagcggc

SEQ ID NO: 316793 - RNA, 13 nt, Bordetella pertussis
ggcggccagcaug

SEQ ID NO: 316794 - RNA, 14 nt, Bordetella pertussis
ggcggccagcgcgc

SEQ ID NO: 316795 - RNA, 15 nt, Bordetella pertussis
ggcggccagcgcgca

SEQ ID NO: 316796 - RNA, 23 nt, Bordetella pertussis
ggcggccagcuuguagcggccau

SEQ ID NO: 316797 - RNA, 20 nt, Bordetella pertussis
ggcggccaggaucgcggcca

SEQ ID NO: 316798 - RNA, 12 nt, Bordetella pertussis
ggcggccaggcc

SEQ ID NO: 316799 - RNA, 17 nt, Bordetella pertussis
ggcggccaggccgaacg

SEQ ID NO: 316800 - RNA, 16 nt, Bordetella pertussis
ggcggccaggccggcg

SEQ ID NO: 316801 - RNA, 17 nt, Bordetella pertussis
ggcggccaggccggcga

SEQ ID NO: 316802 - RNA, 13 nt, Bordetella pertussis
ggcggccaggcgc

SEQ ID NO: 316803 - RNA, 14 nt, Bordetella pertussis
ggcggccaggcgua

SEQ ID NO: 316804 - RNA, 21 nt, Bordetella pertussis
ggcggccagggaaggggcggc

SEQ ID NO: 316805 - RNA, 12 nt, Bordetella pertussis
ggcggccggcca

SEQ ID NO: 316806 - RNA, 21 nt, Bordetella pertussis
ggcggccggggccgcccuggu

SEQ ID NO: 316807 - RNA, 13 nt, Bordetella pertussis
ggcggccggcgcg

SEQ ID NO: 316808 - RNA, 14 nt, Bordetella pertussis
ggcggccggucagg

SEQ ID NO: 316809 - RNA, 19 nt, Bordetella pertussis
ggcggccuaucaccugggc

SEQ ID NO: 316810 - RNA, 20 nt, Bordetella pertussis
ggcggccuaugugcaggcca

SEQ ID NO: 316811 - RNA, 16 nt, Bordetella pertussis
ggcggccuccgcgcac

SEQ ID NO: 316812 - RNA, 15 nt, Bordetella pertussis
ggcggccuccggcag

SEQ ID NO: 316813 - RNA, 17 nt, Bordetella pertussis
ggcggccucggccagcu

SEQ ID NO: 316814 - RNA, 23 nt, Bordetella pertussis
ggcggcgaacacgucgcgggcga

SEQ ID NO: 316815 - RNA, 14 nt, Bordetella pertussis
ggcggcgaccggcg

SEQ ID NO: 316816 - RNA, 21 nt, Bordetella pertussis
ggcggcgacgaacccgggcgu

SEQ ID NO: 316817 - RNA, 23 nt, Bordetella pertussis
ggcggcgacgaacccgggcguga

SEQ ID NO: 316818 - RNA, 16 nt, Bordetella pertussis
ggcggcgacggcgucg

SEQ ID NO: 316819 - RNA, 12 nt, Bordetella pertussis
ggcggcgccugg

SEQ ID NO: 316820 - RNA, 21 nt, Bordetella pertussis
ggcggcgccuggucgcgcgcc

SEQ ID NO: 316821 - RNA, 13 nt, Bordetella pertussis
ggcggcgccggcc

SEQ ID NO: 316822 - RNA, 12 nt, Bordetella pertussis
ggcggcgcgccc

SEQ ID NO: 316823 - RNA, 13 nt, Bordetella pertussis
ggcggcgcgcccg

SEQ ID NO: 316824 - RNA, 14 nt, Bordetella pertussis
ggcggcgcgcggcu

SEQ ID NO: 316825 - RNA, 21 nt, Bordetella pertussis
ggcggcgcgcuuggucagcau

SEQ ID NO: 316826 - RNA, 15 nt, Bordetella pertussis
ggcggcgcgcucucc

SEQ ID NO: 316827 - RNA, 15 nt, Bordetella pertussis
ggcggcgcggcgcca

SEQ ID NO: 316828 - RNA, 14 nt, Bordetella pertussis
ggcggcgcgggcgg

SEQ ID NO: 316829 - RNA, 15 nt, Bordetella pertussis
ggcggcgcgggcggc

SEQ ID NO: 316830 - RNA, 14 nt, Bordetella pertussis
ggcggcgcucauca

SEQ ID NO: 316831 - RNA, 19 nt, Bordetella pertussis
ggcggcgcuggccugccgc

SEQ ID NO: 316832 - RNA, 23 nt, Bordetella pertussis
ggcggcgcuggcgaugcgggcca

SEQ ID NO: 316833 - RNA, 12 nt, Bordetella pertussis
ggcggcgcuggu

SEQ ID NO: 316834 - RNA, 14 nt, Bordetella pertussis
ggcggcggccacga

SEQ ID NO: 316835 - RNA, 14 nt, Bordetella pertussis
ggcggcggccaucg

SEQ ID NO: 316836 - RNA, 15 nt, Bordetella pertussis
ggcggcggcgcgcgc

SEQ ID NO: 316837 - RNA, 12 nt, Bordetella pertussis
ggcggcggcgcg

SEQ ID NO: 316838 - RNA, 20 nt, Bordetella pertussis
ggcggcguggccgugcuggu

SEQ ID NO: 316839 - RNA, 23 nt, Bordetella pertussis
ggcggcguggccgugcuggucau

SEQ ID NO: 316840 - RNA, 22 nt, Bordetella pertussis
ggcggcguuccugggcacgccg

SEQ ID NO: 316841 - RNA, 17 nt, Bordetella pertussis
ggcggcuaggcgcagca

SEQ ID NO: 316842 - RNA, 20 nt, Bordetella pertussis
ggcggcuaggcgcagcaggc

SEQ ID NO: 316843 - RNA, 19 nt, Bordetella pertussis
ggcgggaauauccuggucg

SEQ ID NO: 316844 - RNA, 23 nt, Bordetella pertussis
ggcgggaaugucccacaggcgcg

SEQ ID NO: 316845 - RNA, 14 nt, Bordetella pertussis
ggcgggacgcaggc

SEQ ID NO: 316846 - RNA, 21 nt, Bordetella pertussis
ggcgggacgcaggcccagcca

SEQ ID NO: 316847 - RNA, 16 nt, Bordetella pertussis
ggcgggacuggcgagc

SEQ ID NO: 316848 - RNA, 19 nt, Bordetella pertussis
ggcgggacuguaccgcgcg

SEQ ID NO: 316849 - RNA, 19 nt, Bordetella pertussis
ggcgggcacaacccgcccg

SEQ ID NO: 316850 - RNA, 18 nt, Bordetella pertussis
ggcgggcaccaugcgcga

SEQ ID NO: 316851 - RNA, 15 nt, Bordetella pertussis
ggcgggcagcauggc

SEQ ID NO: 316852 - RNA, 12 nt, Bordetella pertussis
ggcgggcagcgg

SEQ ID NO: 316853 - RNA, 15 nt, Bordetella pertussis
ggcgggcagcggcga

SEQ ID NO: 316854 - RNA, 23 nt, Bordetella pertussis
ggcgggcgccccgaucggcgccg

SEQ ID NO: 316855 - RNA, 24 nt, Bordetella pertussis
ggcgggcgccugcggcaggccgca

SEQ ID NO: 316856 - RNA, 13 nt, Bordetella pertussis
ggcgggcgcuggc

SEQ ID NO: 316857 - RNA, 15 nt, Bordetella pertussis
ggcgggcgcuggcgc

SEQ ID NO: 316858 - RNA, 15 nt, Bordetella pertussis
ggcgggcggccggcg

SEQ ID NO: 316859 - RNA, 13 nt, Bordetella pertussis
ggcgggcggcgcc

SEQ ID NO: 316860 - RNA, 14 nt, Bordetella pertussis
ggcgggcggcgcca

SEQ ID NO: 316861 - RNA, 17 nt, Bordetella pertussis
ggcgggcggcgcggcca

SEQ ID NO: 316862 - RNA, 14 nt, Bordetella pertussis
ggcgggcgggcgca

SEQ ID NO: 316863 - RNA, 23 nt, Bordetella pertussis
ggcgggcgugaugccgaccaggc

SEQ ID NO: 316864 - RNA, 15 nt, Bordetella pertussis
ggcgggcucggcgcc

SEQ ID NO: 316865 - RNA, 13 nt, Bordetella pertussis
ggcgggcuggucg

SEQ ID NO: 316866 - RNA, 12 nt, Bordetella pertussis
ggcggggccaca

SEQ ID NO: 316867 - RNA, 14 nt, Bordetella pertussis
ggcggggcgcauca

SEQ ID NO: 316868 - RNA, 17 nt, Bordetella pertussis
ggcgggguuggccgcca

SEQ ID NO: 316869 - RNA, 19 nt, Bordetella pertussis
ggcgggugcugcagcgcac

SEQ ID NO: 316870 - RNA, 20 nt, Bordetella pertussis
ggcggguucagucgucgccg

SEQ ID NO: 316871 - RNA, 17 nt, Bordetella pertussis
ggcgguacaggccggcg

SEQ ID NO: 316872 - RNA, 21 nt, Bordetella pertussis
ggcgguacaggccggcggcga

SEQ ID NO: 316873 - RNA, 15 nt, Bordetella pertussis
ggcgguaccguccug

SEQ ID NO: 316874 - RNA, 18 nt, Bordetella pertussis
ggcgguagcgcucgucca

SEQ ID NO: 316875 - RNA, 14 nt, Bordetella pertussis
ggcggucaccaacg

SEQ ID NO: 316876 - RNA, 22 nt, Bordetella pertussis
ggcggucaccaacgcgaucuca

SEQ ID NO: 316877 - RNA, 15 nt, Bordetella pertussis
ggcggucacgccgau

SEQ ID NO: 316878 - RNA, 18 nt, Bordetella pertussis
ggcgguccgguucgccca

SEQ ID NO: 316879 - RNA, 17 nt, Bordetella pertussis
ggcggucgcgcuggccc

SEQ ID NO: 316880 - RNA, 22 nt, Bordetella pertussis
ggcggucuucgaugcuggcgcg

SEQ ID NO: 316881 - RNA, 14 nt, Bordetella pertussis
ggcggugaccacca

SEQ ID NO: 316882 - RNA, 18 nt, Bordetella pertussis
ggcggugaccaccaggcc

SEQ ID NO: 316883 - RNA, 17 nt, Bordetella pertussis
ggcggugaccaugcgca

SEQ ID NO: 316884 - RNA, 16 nt, Bordetella pertussis
ggcggugacgcccugc

SEQ ID NO: 316885 - RNA, 15 nt, Bordetella pertussis
ggcggugccagcgca

SEQ ID NO: 316886 - RNA, 20 nt, Bordetella pertussis
ggcggugccagcgcaagggu

SEQ ID NO: 316887 - RNA, 20 nt, Bordetella pertussis
ggcggugcgcucgaagcgca

SEQ ID NO: 316888 - RNA, 16 nt, Bordetella pertussis
ggcgguggccagcgug

SEQ ID NO: 316889 - RNA, 17 nt, Bordetella pertussis
ggcgguggccucgucca

SEQ ID NO: 316890 - RNA, 15 nt, Bordetella pertussis
ggcgguggcuuggcg

SEQ ID NO: 316891 - RNA, 16 nt, Bordetella pertussis
ggcgguggcuuggcgc

SEQ ID NO: 316892 - RNA, 19 nt, Bordetella pertussis
ggcgguggucaucgaugcg

SEQ ID NO: 316893 - RNA, 17 nt, Bordetella pertussis
ggcgguguagaccacca

SEQ ID NO: 316894 - RNA, 15 nt, Bordetella pertussis
ggcgguguucgcguc

SEQ ID NO: 316895 - RNA, 20 nt, Bordetella pertussis
ggcgguucaggccccggccg

SEQ ID NO: 316896 - RNA, 22 nt, Bordetella pertussis
ggcgguucguccucgucggcca

SEQ ID NO: 316897 - RNA, 23 nt, Bordetella pertussis
ggcgguucguccucgucggccau

SEQ ID NO: 316898 - RNA, 17 nt, Bordetella pertussis
ggcgguuucggccggga

SEQ ID NO: 316899 - RNA, 23 nt, Bordetella pertussis
ggcgguuucguagaugggcaggc

SEQ ID NO: 316900 - RNA, 18 nt, Bordetella pertussis
ggcgguuucuuccagcag

SEQ ID NO: 316901 - RNA, 20 nt, Bordetella pertussis
ggcgguuuuucuuuggccgc

SEQ ID NO: 316902 - RNA, 22 nt, Bordetella pertussis
ggcgguuuuucuuuggccgcgc

SEQ ID NO: 316903 - RNA, 20 nt, Bordetella pertussis
ggcguaaggccgccggccac

SEQ ID NO: 316904 - RNA, 16 nt, Bordetella pertussis
ggcguacgcuuaucgc

SEQ ID NO: 316905 - RNA, 13 nt, Bordetella pertussis
ggcguacggcgcg

SEQ ID NO: 316906 - RNA, 15 nt, Bordetella pertussis
ggcguacggcgcggu

SEQ ID NO: 316907 - RNA, 14 nt, Bordetella pertussis
ggcguacgaggacc

SEQ ID NO: 316908 - RNA, 17 nt, Bordetella pertussis
ggcguacuggcgcggcg

SEQ ID NO: 316909 - RNA, 23 nt, Bordetella pertussis
ggcguagcccuuguggccgccga

SEQ ID NO: 316910 - RNA, 14 nt, Bordetella pertussis
ggcguagcugcgcc

SEQ ID NO: 316911 - RNA, 17 nt, Bordetella pertussis
ggcguagcugcgccgca

SEQ ID NO: 316912 - RNA, 13 nt, Bordetella pertussis
ggcguaggccucg

SEQ ID NO: 316913 - RNA, 16 nt, Bordetella pertussis
ggcguaguaggcggug

SEQ ID NO: 316914 - RNA, 21 nt, Bordetella pertussis
ggcguagucguugccggccag

SEQ ID NO: 316915 - RNA, 20 nt, Bordetella pertussis
ggcguaucgagguuuccgcc

SEQ ID NO: 316916 - RNA, 14 nt, Bordetella pertussis
ggcguauggcccgc

SEQ ID NO: 316917 - RNA, 15 nt, Bordetella pertussis
ggcgucaaugccagu

SEQ ID NO: 316918 - RNA, 23 nt, Bordetella pertussis
ggcgucaagccagcggcgcggcg

SEQ ID NO: 316919 - RNA, 13 nt, Bordetella pertussis
ggcgucagcgccc

SEQ ID NO: 316920 - RNA, 15 nt, Bordetella pertussis
ggcgucaggccgucg

SEQ ID NO: 316921 - RNA, 21 nt, Bordetella pertussis
ggcguccaccgccgaugccgc

SEQ ID NO: 316922 - RNA, 23 nt, Bordetella pertussis
ggcguccacggcaucggccagca

SEQ ID NO: 316923 - RNA, 20 nt, Bordetella pertussis
gggacgccagcccgccggcg

SEQ ID NO: 316924 - RNA, 12 nt, Bordetella pertussis
gggacgccggcg

SEQ ID NO: 316925 - RNA, 14 nt, Bordetella pertussis
gggacgggccagcc

SEQ ID NO: 316926 - RNA, 15 nt, Bordetella pertussis
gggacuugguuggcc

SEQ ID NO: 316927 - RNA, 16 nt, Bordetella pertussis
gggagccuguccccga

SEQ ID NO: 316928 - RNA, 20 nt, Bordetella pertussis
gggagccuguccccgcgggg

SEQ ID NO: 316929 - RNA, 19 nt, Bordetella pertussis
gggaguucugguaggugug

SEQ ID NO: 316930 - RNA, 14 nt, Bordetella pertussis
gggauaccgcuggc

SEQ ID NO: 316931 - RNA, 14 nt, Bordetella pertussis
gggauaggccucgg

SEQ ID NO: 316932 - RNA, 16 nt, Bordetella pertussis
gggaucaccagcccgg

SEQ ID NO: 316933 - RNA, 13 nt, Bordetella pertussis
gggaucgcgccag

SEQ ID NO: 316934 - RNA, 21 nt, Bordetella pertussis
gggaucguggcgccgcgggcc

SEQ ID NO: 316935 - RNA, 18 nt, Bordetella pertussis
gggaugccgguucgggcg

SEQ ID NO: 316936 - RNA, 19 nt, Bordetella pertussis
gggauguccgcgucggccg

SEQ ID NO: 316937 - RNA, 21 nt, Bordetella pertussis
gggaugucggugaaggccacg

SEQ ID NO: 316938 - RNA, 21 nt, Bordetella pertussis
gggcaaagaaauugggcgugg

SEQ ID NO: 316939 - RNA, 14 nt, Bordetella pertussis
gggcaacgacgcag

SEQ ID NO: 316940 - RNA, 22 nt, Bordetella pertussis
gggcaauaccuucggcaugguc

SEQ ID NO: 316941 - RNA, 22 nt, Bordetella pertussis
gggcacaccgucacgcgcaagg

SEQ ID NO: 316942 - RNA, 15 nt, Bordetella pertussis
gggcacaucggccac

SEQ ID NO: 316943 - RNA, 20 nt, Bordetella pertussis
gggcaccaucucccgcaggc

SEQ ID NO: 316944 - RNA, 21 nt, Bordetella pertussis
gggcacccaggcgggcuggcg

SEQ ID NO: 316945 - RNA, 18 nt, Bordetella pertussis
gggcaccgacacgcuggc

SEQ ID NO: 316946 - RNA, 21 nt, Bordetella pertussis
gggcaccgacacgcuggcgga

SEQ ID NO: 316947 - RNA, 20 nt, Bordetella pertussis
gggcaccgugaugcgcgccg

SEQ ID NO: 316948 - RNA, 12 nt, Bordetella pertussis
gggcacgauggc

SEQ ID NO: 316949 - RNA, 15 nt, Bordetella pertussis
gggcacggccagcac

SEQ ID NO: 316950 - RNA, 20 nt, Bordetella pertussis
gggcacguaguacagcagca

SEQ ID NO: 316951 - RNA, 20 nt, Bordetella pertussis
gggcagauugaugcccaugc

SEQ ID NO: 316952 - RNA, 12 nt, Bordetella pertussis
gggcagcacgcg

SEQ ID NO: 316953 - RNA, 21 nt, Bordetella pertussis
gggcagcagcagggccaggcc

SEQ ID NO: 316954 - RNA, 13 nt, Bordetella pertussis
gggcagcaucacg

SEQ ID NO: 316955 - RNA, 19 nt, Bordetella pertussis
gggcagcgcccgcgccauc

SEQ ID NO: 316956 - RNA, 16 nt, Bordetella pertussis
gggcagcggcgacggc

SEQ ID NO: 316957 - RNA, 13 nt, Bordetella pertussis
gggcaggacgccg

SEQ ID NO: 316958 - RNA, 15 nt, Bordetella pertussis
gggcaggacgccggc

SEQ ID NO: 316959 - RNA, 17 nt, Bordetella pertussis
gggcaggauggccaugc

SEQ ID NO: 316960 - RNA, 14 nt, Bordetella pertussis
gggcaggccugguc

SEQ ID NO: 316961 - RNA, 15 nt, Bordetella pertussis
gggcaggccuggucg

SEQ ID NO: 316962 - RNA, 14 nt, Bordetella pertussis
gggcaggcgcacgc

SEQ ID NO: 316963 - RNA, 15 nt, Bordetella pertussis
gggcaggcgcagcgg

SEQ ID NO: 316964 - RNA, 14 nt, Bordetella pertussis
gggcaggcgccugc

SEQ ID NO: 316965 - RNA, 15 nt, Bordetella pertussis
gggcaggcucagccc

SEQ ID NO: 316966 - RNA, 18 nt, Bordetella pertussis
gggcaggcuggcgcgguc

SEQ ID NO: 316967 - RNA, 15 nt, Bordetella pertussis
gggcagggcgacguc

SEQ ID NO: 316968 - RNA, 15 nt, Bordetella pertussis
gggcagggcgccguc

SEQ ID NO: 316969 - RNA, 15 nt, Bordetella pertussis
gggcaggucgccagc

SEQ ID NO: 316970 - RNA, 19 nt, Bordetella pertussis
gggcaggucgccagcaggc

SEQ ID NO: 316971 - RNA, 17 nt, Bordetella pertussis
gggcaggucggccagcg

SEQ ID NO: 316972 - RNA, 18 nt, Bordetella pertussis
gggcaggcccagccagcg

SEQ ID NO: 316973 - RNA, 13 nt, Bordetella pertussis
gggcaggccgaug

SEQ ID NO: 316974 - RNA, 23 nt, Bordetella pertussis
gggcaggugccccacgccgaugc

SEQ ID NO: 316975 - RNA, 14 nt, Bordetella pertussis
gggcagugcgccgg

SEQ ID NO: 316976 - RNA, 22 nt, Bordetella pertussis
gggcaucaauagcccgugcggg

SEQ ID NO: 316977 - RNA, 23 nt, Bordetella pertussis
gggcaucaccaucgauguggccu

SEQ ID NO: 316978 - RNA, 14 nt, Bordetella pertussis
gggcaugacgauca

SEQ ID NO: 316979 - RNA, 17 nt, Bordetella pertussis
gggcauggcccggcucg

SEQ ID NO: 316980 - RNA, 20 nt, Bordetella pertussis
gggcauugggcagcggacgg

SEQ ID NO: 316981 - RNA, 17 nt, Bordetella pertussis
gggcauuucccagccgu

SEQ ID NO: 316982 - RNA, 23 nt, Bordetella pertussis
gggccacagggcgaaggccagcg

SEQ ID NO: 316983 - RNA, 15 nt, Bordetella pertussis
gggccacgcccaggc

SEQ ID NO: 316984 - RNA, 17 nt, Bordetella pertussis
gggccacgcccaggccg

SEQ ID NO: 316985 - RNA, 20 nt, Bordetella pertussis
gggccacgcccaggccgugg

SEQ ID NO: 316986 - RNA, 15 nt, Bordetella pertussis
gggccacgccggccg

SEQ ID NO: 316987 - RNA, 16 nt, Bordetella pertussis
gggccaccuugguggg

SEQ ID NO: 316988 - RNA, 22 nt, Bordetella pertussis
gggccagcaacuggugcccgua

SEQ ID NO: 316989 - RNA, 17 nt, Bordetella pertussis
gggccagcagcuggcgc

SEQ ID NO: 316990 - RNA, 18 nt, Bordetella pertussis
gggccagcagcuggcgca

SEQ ID NO: 316991 - RNA, 19 nt, Bordetella pertussis
gggccagcagcuggcgcag

SEQ ID NO: 316992 - RNA, 13 nt, Bordetella pertussis
gggccagccagcg

SEQ ID NO: 316993 - RNA, 15 nt, Bordetella pertussis
gggccagcgccagca

SEQ ID NO: 316994 - RNA, 19 nt, Bordetella pertussis
gggccagcgccagcacgau

SEQ ID NO: 316995 - RNA, 12 nt, Bordetella pertussis
gggccagccugg

SEQ ID NO: 316996 - RNA, 16 nt, Bordetella pertussis
gggccagcgcggccag

SEQ ID NO: 316997 - RNA, 23 nt, Bordetella pertussis
gggccagcuugacguccagccag

SEQ ID NO: 316998 - RNA, 21 nt, Bordetella pertussis
gggccaggaccgaggugccag

SEQ ID NO: 316999 - RNA, 16 nt, Bordetella pertussis
gggccagcgcgaucuc

SEQ ID NO: 317000 - RNA, 15 nt, Bordetella pertussis
gggccaggccggccc

SEQ ID NO: 317001 - RNA, 13 nt, Bordetella pertussis
gggccaggcgcag

SEQ ID NO: 317002 - RNA, 18 nt, Bordetella pertussis
gggccaggcgcuccagca

SEQ ID NO: 317003 - RNA, 17 nt, Bordetella pertussis
gggccagggccucgcgg

SEQ ID NO: 317004 - RNA, 14 nt, Bordetella pertussis
gggccaguccgcag

SEQ ID NO: 317005 - RNA, 19 nt, Bordetella pertussis
gggccaguccgcagcgcag

SEQ ID NO: 317006 - RNA, 17 nt, Bordetella pertussis
gggccagucguucagcg

SEQ ID NO: 317007 - RNA, 20 nt, Bordetella pertussis
gggccauccguccgccagga

SEQ ID NO: 317008 - RNA, 15 nt, Bordetella pertussis
gggccauggcagggc

SEQ ID NO: 317009 - RNA, 16 nt, Bordetella pertussis
gggccauguggcgcag

SEQ ID NO: 317010 - RNA, 17 nt, Bordetella pertussis
gggccccucgcggggcc

SEQ ID NO: 317011 - RNA, 19 nt, Bordetella pertussis
gggcccggcguagcugcgc

SEQ ID NO: 317012 - RNA, 13 nt, Bordetella pertussis
gggcccgggcgcg

SEQ ID NO: 317013 - RNA, 22 nt, Bordetella pertussis
gggcccuggcguucgcgcgcgg

SEQ ID NO: 317014 - RNA, 13 nt, Bordetella pertussis
gggccgaccaggc

SEQ ID NO: 317015 - RNA, 20 nt, Bordetella pertussis
gggccgacggccucggccag

SEQ ID NO: 317016 - RNA, 20 nt, Bordetella pertussis
gggccgagcccgcgucggcg

SEQ ID NO: 317017 - RNA, 17 nt, Bordetella pertussis
gggccgagcgcgccagc

SEQ ID NO: 317018 - RNA, 19 nt, Bordetella pertussis
gggccgagcgcgccagcac

SEQ ID NO: 317019 - RNA, 16 nt, Bordetella pertussis
gggccgcagcgaacgg

SEQ ID NO: 317020 - RNA, 21 nt, Bordetella pertussis
gggccgcacgcgcggcagcgc

SEQ ID NO: 317021 - RNA, 22 nt, Bordetella pertussis
gggccgcacgcgcggcagcgcc

SEQ ID NO: 317022 - RNA, 12 nt, Bordetella pertussis
gggccgccaugu

SEQ ID NO: 317023 - RNA, 20 nt, Bordetella pertussis
gggccgcccagcaccuuggc

SEQ ID NO: 317024 - RNA, 12 nt, Bordetella pertussis
gggccgccaggg

SEQ ID NO: 317025 - RNA, 22 nt, Bordetella pertussis
gggccgccucggcggccagcgc

SEQ ID NO: 317026 - RNA, 19 nt, Bordetella pertussis
gggccgcgccgcggcacgg

SEQ ID NO: 317027 - RNA, 12 nt, Bordetella pertussis
gggccgcgccgg

SEQ ID NO: 317028 - RNA, 13 nt, Bordetella pertussis
gggccgcgccggc

SEQ ID NO: 317029 - RNA, 16 nt, Bordetella pertussis
gggccgcgcgauccug

SEQ ID NO: 317030 - RNA, 13 nt, Bordetella pertussis
gggccgcgcugga

SEQ ID NO: 317031 - RNA, 16 nt, Bordetella pertussis
gggccggacuggcgcg

SEQ ID NO: 317032 - RNA, 23 nt, Bordetella pertussis
gggccggccgcgcgcgccaggcc

SEQ ID NO: 317033 - RNA, 23 nt, Bordetella pertussis
gggccggcgaugaagucgcggcc

SEQ ID NO: 317034 - RNA, 12 nt, Bordetella pertussis
gggccggcgcca

SEQ ID NO: 317035 - RNA, 13 nt, Bordetella pertussis
gggccggcgccag

SEQ ID NO: 317036 - RNA, 14 nt, Bordetella pertussis
gggccggcgccagc

SEQ ID NO: 317037 - RNA, 15 nt, Bordetella pertussis
gggccggcgccagca

SEQ ID NO: 317038 - RNA, 14 nt, Bordetella pertussis
gggccggcgcgccg

SEQ ID NO: 317039 - RNA, 22 nt, Bordetella pertussis
gggccggcgcgccgcgccgccc

SEQ ID NO: 317040 - RNA, 13 nt, Bordetella pertussis
gggccggcgccgg

SEQ ID NO: 317041 - RNA, 20 nt, Bordetella pertussis
gggccggcucauucggcgcg

SEQ ID NO: 317042 - RNA, 21 nt, Bordetella pertussis
gggccggcucauucggcgcgc

SEQ ID NO: 317043 - RNA, 14 nt, Bordetella pertussis
gggccggcugggcg

SEQ ID NO: 317044 - RNA, 15 nt, Bordetella pertussis
gggccggcugggcgg

SEQ ID NO: 317045 - RNA, 18 nt, Bordetella pertussis
gggccggucgcgauccgg

SEQ ID NO: 317046 - RNA, 16 nt, Bordetella pertussis
gggccgucaugcgccg

SEQ ID NO: 317047 - RNA, 18 nt, Bordetella pertussis
gggccgucaugcgccguc

SEQ ID NO: 317048 - RNA, 19 nt, Bordetella pertussis
gggccgguuucggccugca

SEQ ID NO: 317049 - RNA, 22 nt, Bordetella pertussis
gggccguccggccgugccgccc

SEQ ID NO: 317050 - RNA, 13 nt, Bordetella pertussis
gggccgucgugcg

SEQ ID NO: 317051 - RNA, 19 nt, Bordetella pertussis
gggccgucgugcgccuggc

SEQ ID NO: 317052 - RNA, 17 nt, Bordetella pertussis
gggccguggcgauccag

SEQ ID NO: 317053 - RNA, 19 nt, Bordetella pertussis
gggccucgaagcccggcag

SEQ ID NO: 317054 - RNA, 13 nt, Bordetella pertussis
gggccucggccag

SEQ ID NO: 317055 - RNA, 22 nt, Bordetella pertussis
gggccugcaguucggccgccag

SEQ ID NO: 317056 - RNA, 18 nt, Bordetella pertussis
gggccugcccauggccug

SEQ ID NO: 317057 - RNA, 19 nt, Bordetella pertussis
gggccuggaagcuggccag

SEQ ID NO: 317058 - RNA, 18 nt, Bordetella pertussis
gggccuggcagaugcgcg

SEQ ID NO: 317059 - RNA, 17 nt, Bordetella pertussis
gggccuggccugcgccg

SEQ ID NO: 317060 - RNA, 20 nt, Bordetella pertussis
gggccuggcucaggccugca

SEQ ID NO: 317061 - RNA, 17 nt, Bordetella pertussis
gggccugguacaggccg

SEQ ID NO: 317062 - RNA, 17 nt, Bordetella pertussis
gggccuggucagcgccg

SEQ ID NO: 317063 - RNA, 17 nt, Bordetella pertussis
gggcgaaacggccagcg

SEQ ID NO: 317064 - RNA, 18 nt, Bordetella pertussis
gggcgaaccgcggcgcag

SEQ ID NO: 317065 - RNA, 19 nt, Bordetella pertussis
gggcgaaccgguggccaug

SEQ ID NO: 317066 - RNA, 13 nt, Bordetella pertussis
gggcgaagcgcgc

SEQ ID NO: 317067 - RNA, 23 nt, Bordetella pertussis
gggcgacgcggcguacuggcgcg

SEQ ID NO: 317068 - RNA, 19 nt, Bordetella pertussis
gggcgacggcggcguggac

SEQ ID NO: 317069 - RNA, 13 nt, Bordetella pertussis
gggcgacuccagc

SEQ ID NO: 317070 - RNA, 15 nt, Bordetella pertussis
gggcgacuccagccc

SEQ ID NO: 317071 - RNA, 12 nt, Bordetella pertussis
gggcgagcaggc

SEQ ID NO: 317072 - RNA, 14 nt, Bordetella pertussis
gggcgagcgggccg

SEQ ID NO: 317073 - RNA, 17 nt, Bordetella pertussis
gggcgagcgggccgguc

SEQ ID NO: 317074 - RNA, 15 nt, Bordetella pertussis
gggcgagguagggcg

SEQ ID NO: 317075 - RNA, 21 nt, Bordetella pertussis
gggcgagguagggcgcggcca

SEQ ID NO: 317076 - RNA, 15 nt, Bordetella pertussis
gggcgaggucagccc

SEQ ID NO: 317077 - RNA, 16 nt, Bordetella pertussis
gggcgaucagcaccgc

SEQ ID NO: 317078 - RNA, 18 nt, Bordetella pertussis
gggcgaucuucagcacca

SEQ ID NO: 317079 - RNA, 22 nt, Bordetella pertussis
gggcgaugaccggcaagcgcuc

SEQ ID NO: 317080 - RNA, 12 nt, Bordetella pertussis
gggcgauggcgc

SEQ ID NO: 317081 - RNA, 13 nt, Bordetella pertussis
gggcgauggcgcg

SEQ ID NO: 317082 - RNA, 17 nt, Bordetella pertussis
gggcgauggcgcgucgc

SEQ ID NO: 317083 - RNA, 14 nt, Bordetella pertussis
gggcgcaagcgcgc

SEQ ID NO: 317084 - RNA, 16 nt, Bordetella pertussis
gggcgcaaguguggcg

SEQ ID NO: 317085 - RNA, 13 nt, Bordetella pertussis
gggcgcaccaugc

SEQ ID NO: 317086 - RNA, 14 nt, Bordetella pertussis
gggcgcacgccgcg

SEQ ID NO: 317087 - RNA, 23 nt, Bordetella pertussis
gggcgcacgccgcgccggcgcgc

SEQ ID NO: 317088 - RNA, 14 nt, Bordetella pertussis
gggcgcaccugguc

SEQ ID NO: 317089 - RNA, 14 nt, Bordetella pertussis
gggcgccagcagca

SEQ ID NO: 317090 - RNA, 22 nt, Bordetella pertussis
gggcgccaggcugaaugccgcc

SEQ ID NO: 317091 - RNA, 20 nt, Bordetella pertussis
gggcgcccagcgcgucggcc

SEQ ID NO: 317092 - RNA, 16 nt, Bordetella pertussis
gggcgcccgcgcgcga

SEQ ID NO: 317093 - RNA, 14 nt, Bordetella pertussis
gggcgccgauccag

SEQ ID NO: 317094 - RNA, 16 nt, Bordetella pertussis
gggcgccgcgcacgca

SEQ ID NO: 317095 - RNA, 13 nt, Bordetella pertussis
gggcgccgcgccg

SEQ ID NO: 317096 - RNA, 13 nt, Bordetella pertussis
gggcgccggcgua

SEQ ID NO: 317097 - RNA, 22 nt, Bordetella pertussis
gggcgccggcgucacgcggccg

SEQ ID NO: 317098 - RNA, 21 nt, Bordetella pertussis
gggcgccgcggggguggacgc

SEQ ID NO: 317099 - RNA, 12 nt, Bordetella pertussis
gggcgccggcca

SEQ ID NO: 317100 - RNA, 18 nt, Bordetella pertussis
gggcgccuacacgguggc

SEQ ID NO: 317101 - RNA, 19 nt, Bordetella pertussis
gggcgccuacacgguggcg

SEQ ID NO: 317102 - RNA, 18 nt, Bordetella pertussis
gggcgccugccccggcag

SEQ ID NO: 317103 - RNA, 19 nt, Bordetella pertussis
gggcgcgaugggccugccc

SEQ ID NO: 317104 - RNA, 22 nt, Bordetella pertussis
gggcgcgacgccagcgcgccau

SEQ ID NO: 317105 - RNA, 13 nt, Bordetella pertussis
gggcgcgcccagc

SEQ ID NO: 317106 - RNA, 17 nt, Bordetella pertussis
gggcgcgcccagccccg

SEQ ID NO: 317107 - RNA, 23 nt, Bordetella pertussis
gggcgcgcccagccccgcggccg

SEQ ID NO: 317108 - RNA, 21 nt, Bordetella pertussis
gggcgcgccgcugcagcgcug

SEQ ID NO: 317109 - RNA, 17 nt, Bordetella pertussis
gggcgcgccggcgggcg

SEQ ID NO: 317110 - RNA, 21 nt, Bordetella pertussis
gggcgcgcgcccaggccagcc

SEQ ID NO: 317111 - RNA, 15 nt, Bordetella pertussis
gggcgcgcgccggcg

SEQ ID NO: 317112 - RNA, 17 nt, Bordetella pertussis
gggcgcgcucagcgcca

SEQ ID NO: 317113 - RNA, 12 nt, Bordetella pertussis
gggcgcgcugcc

SEQ ID NO: 317114 - RNA, 13 nt, Bordetella pertussis
gggcgcggcgccg

SEQ ID NO: 317115 - RNA, 17 nt, Bordetella pertussis
gggcgcggcgcgcgccg

SEQ ID NO: 317116 - RNA, 12 nt, Bordetella pertussis
gggcgcggcggc

SEQ ID NO: 317117 - RNA, 16 nt, Bordetella pertussis
gggcgcggccaggguc

SEQ ID NO: 317118 - RNA, 13 nt, Bordetella pertussis
gggcgcggccggu

SEQ ID NO: 317119 - RNA, 15 nt, Bordetella pertussis
gggcgcgggccagcu

SEQ ID NO: 317120 - RNA, 18 nt, Bordetella pertussis
gggcgcgggcugucgcag

SEQ ID NO: 317121 - RNA, 23 nt, Bordetella pertussis
gggcgcguaguagucgguggccu

SEQ ID NO: 317122 - RNA, 14 nt, Bordetella pertussis
gggcgcugcgccgg

SEQ ID NO: 317123 - RNA, 16 nt, Bordetella pertussis
gggcgcugcgccggcg

SEQ ID NO: 317124 - RNA, 18 nt, Bordetella pertussis
gggcgcugcacgcagcgc

SEQ ID NO: 317125 - RNA, 16 nt, Bordetella pertussis
gggcgcuggcgcgcgg

SEQ ID NO: 317126 - RNA, 13 nt, Bordetella pertussis
gggcgcuucgucg

SEQ ID NO: 317127 - RNA, 18 nt, Bordetella pertussis
gggcgcuuggcccugcag

SEQ ID NO: 317128 - RNA, 23 nt, Bordetella pertussis
gggcgcuuggcccugcagcggcc

SEQ ID NO: 317129 - RNA, 18 nt, Bordetella pertussis
gggcggaaaacagcacca

SEQ ID NO: 317130 - RNA, 18 nt, Bordetella pertussis
gggcggaugagcaggccg

SEQ ID NO: 317131 - RNA, 22 nt, Bordetella pertussis
gggcggaucgccgaagucggcg

SEQ ID NO: 317132 - RNA, 18 nt, Bordetella pertussis
gggcggcaggugcgccag

SEQ ID NO: 317133 - RNA, 21 nt, Bordetella pertussis
gggcggcaggugcgccagcac

SEQ ID NO: 317134 - RNA, 14 nt, Bordetella pertussis
gggcggccaggccg

SEQ ID NO: 317135 - RNA, 13 nt, Bordetella pertussis
gggcggcccgcau

SEQ ID NO: 317136 - RNA, 13 nt, Bordetella pertussis
gggcggcccggcc

SEQ ID NO: 317137 - RNA, 21 nt, Bordetella pertussis
gggcggccuaucaccugggca

SEQ ID NO: 317138 - RNA, 11 nt, Bordetella pertussis
gggcggccugg

SEQ ID NO: 317139 - RNA, 21 nt, Bordetella pertussis
gggcggccugggaggcgcuga

SEQ ID NO: 317140 - RNA, 21 nt, Bordetella pertussis
gggcggcgauuugagcagcgu

SEQ ID NO: 317141 - RNA, 14 nt, Bordetella pertussis
gggcggcgcggcca

SEQ ID NO: 317142 - RNA, 21 nt, Bordetella pertussis
gggcggcggcgcccgcaugga

SEQ ID NO: 317143 - RNA, 12 nt, Bordetella pertussis
gggcggcgggca

SEQ ID NO: 317144 - RNA, 15 nt, Bordetella pertussis
gggcggcggguggcg

SEQ ID NO: 317145 - RNA, 18 nt, Bordetella pertussis
gggcggcuucaggcgcgc

SEQ ID NO: 317146 - RNA, 16 nt, Bordetella pertussis
gggcgggcugguggug

SEQ ID NO: 317147 - RNA, 17 nt, Bordetella pertussis
gggcggggcgugagcag

SEQ ID NO: 317148 - RNA, 15 nt, Bordetella pertussis
gggcgggcgggcgca

SEQ ID NO: 317149 - RNA, 16 nt, Bordetella pertussis
gggcggucaaugcggc

SEQ ID NO: 317150 - RNA, 20 nt, Bordetella pertussis
gggcgguaccguccuggcag

SEQ ID NO: 317151 - RNA, 22 nt, Bordetella pertussis
gggcgguccgguucgcccacca

SEQ ID NO: 317152 - RNA, 22 nt, Bordetella pertussis
gggcggucggcgcggcgccguc

SEQ ID NO: 317153 - RNA, 16 nt, Bordetella pertussis
gggcggugggcagcgc

SEQ ID NO: 317154 - RNA, 17 nt, Bordetella pertussis
gggcggugggcagcgcg

SEQ ID NO: 317155 - RNA, 17 nt, Bordetella pertussis
gggcguagcucagccug

SEQ ID NO: 317156 - RNA, 21 nt, Bordetella pertussis
gggcguagcucagccugguag

SEQ ID NO: 317157 - RNA, 16 nt, Bordetella pertussis
gggcguccaccgccga

SEQ ID NO: 317158 - RNA, 17 nt, Bordetella pertussis
gggcgucgcgaugcgcc

SEQ ID NO: 317159 - RNA, 18 nt, Bordetella pertussis
gggcgucgucgcggucca

SEQ ID NO: 317160 - RNA, 13 nt, Bordetella pertussis
gggcgucugcucg

SEQ ID NO: 317161 - RNA, 14 nt, Bordetella pertussis
gggcgugaugccga

SEQ ID NO: 317162 - RNA, 22 nt, Bordetella pertussis
gggcgugcggauggucgagcgc

SEQ ID NO: 317163 - RNA, 14 nt, Bordetella pertussis
gggcguggugcuga

SEQ ID NO: 317164 - RNA, 17 nt, Bordetella pertussis
gggcguggccgcaguca

SEQ ID NO: 317165 - RNA, 20 nt, Bordetella pertussis
gggcguuuuugcguccggcg

SEQ ID NO: 317166 - RNA, 21 nt, Bordetella pertussis
gggcuccugugggggcgcggc

SEQ ID NO: 317167 - RNA, 13 nt, Bordetella pertussis
gggcucgcgcccg

SEQ ID NO: 317168 - RNA, 21 nt, Bordetella pertussis
gggcucgcgcccgagcgccac

SEQ ID NO: 317169 - RNA, 19 nt, Bordetella pertussis
gggcucgcgcgcgcgggcg

SEQ ID NO: 317170 - RNA, 14 nt, Bordetella pertussis
gggcucggccaggu

SEQ ID NO: 317171 - RNA, 14 nt, Bordetella pertussis
gggcucgugguggg

SEQ ID NO: 317172 - RNA, 16 nt, Bordetella pertussis
gggcucuucgacagcg

SEQ ID NO: 317173 - RNA, 19 nt, Bordetella pertussis
gggcugauccgcaccggcg

SEQ ID NO: 317174 - RNA, 16 nt, Bordetella pertussis
gggcugcccucgcccg

SEQ ID NO: 317175 - RNA, 22 nt, Bordetella pertussis
gggcugcccucgcccgugcgcg

SEQ ID NO: 317176 - RNA, 13 nt, Bordetella pertussis
gggcugccggcag

SEQ ID NO: 317177 - RNA, 18 nt, Bordetella pertussis
gggcugcgacaggcgcag

SEQ ID NO: 317178 - RNA, 16 nt, Bordetella pertussis
gggcugcgaugcgggc

SEQ ID NO: 317179 - RNA, 19 nt, Bordetella pertussis
gggcugcgcggguccggcg

SEQ ID NO: 317180 - RNA, 18 nt, Bordetella pertussis
gggcugccguagcccagg

SEQ ID NO: 317181 - RNA, 20 nt, Bordetella pertussis
gggcugcugcacgcgcgcgg

SEQ ID NO: 317182 - RNA, 23 nt, Bordetella pertussis
gggcugcugcccgaagcgcagca

SEQ ID NO: 317183 - RNA, 22 nt, Bordetella pertussis
gggcuggagaacgagccggccg

SEQ ID NO: 317184 - RNA, 16 nt, Bordetella pertussis
gggcuggauccggcgc

SEQ ID NO: 317185 - RNA, 16 nt, Bordetella pertussis
gggcuggccagcuggc

SEQ ID NO: 317186 - RNA, 22 nt, Bordetella pertussis
gggcuggccgccgcggccucgg

SEQ ID NO: 317187 - RNA, 12 nt, Bordetella pertussis
gggcugggccga

SEQ ID NO: 317188 - RNA, 16 nt, Bordetella pertussis
gggcuggucgcgccgg

SEQ ID NO: 317189 - RNA, 18 nt, Bordetella pertussis
gggcuggucgcgccgguc

SEQ ID NO: 317190 - RNA, 14 nt, Bordetella pertussis
gggcuggucgggcg

SEQ ID NO: 317191 - RNA, 14 nt, Bordetella pertussis
gggcuggugcgccg

SEQ ID NO: 317192 - RNA, 10 nt, Bordetella pertussis
gggcugucgc

SEQ ID NO: 317193 - RNA, 18 nt, Bordetella pertussis
gggcugucgcagucgggg

SEQ ID NO: 317194 - RNA, 14 nt, Bordetella pertussis
gggcugucgcgcgc

SEQ ID NO: 317195 - RNA, 15 nt, Bordetella pertussis
gggcugucgcgcuac

SEQ ID NO: 317196 - RNA, 20 nt, Bordetella pertussis
gggcuugucgcugcgcaugg

SEQ ID NO: 317197 - RNA, 16 nt, Bordetella pertussis
gggcuuugacgccggc

SEQ ID NO: 317198 - RNA, 21 nt, Bordetella pertussis
gggcuuuuuugccuuggggcg

SEQ ID NO: 317199 - RNA, 22 nt, Bordetella pertussis
ggggaagauguggucggcgccg

SEQ ID NO: 317200 - RNA, 13 nt, Bordetella pertussis
ggggacuggcucc

SEQ ID NO: 317201 - RNA, 15 nt, Bordetella pertussis
ggggccgccaacgcc

SEQ ID NO: 317202 - RNA, 17 nt, Bordetella pertussis
ggggccgcggcgcgcgc

SEQ ID NO: 317203 - RNA, 15 nt, Bordetella pertussis
ggggccggcgcgccg

SEQ ID NO: 317204 - RNA, 14 nt, Bordetella pertussis
ggggccggccgcgc

SEQ ID NO: 317205 - RNA, 13 nt, Bordetella pertussis
ggggccgucgccg

SEQ ID NO: 317206 - RNA, 13 nt, Bordetella pertussis
ggggcgagcgggc

SEQ ID NO: 317207 - RNA, 15 nt, Bordetella pertussis
ggggcgagcgggccg

SEQ ID NO: 317208 - RNA, 16 nt, Bordetella pertussis
ggggcgagcgggccgg

SEQ ID NO: 317209 - RNA, 14 nt, Bordetella pertussis
ggggcgcaccggca

SEQ ID NO: 317210 - RNA, 21 nt, Bordetella pertussis
ggggcuuuuuguugcgcgccg

SEQ ID NO: 317211 - RNA, 18 nt, Bordetella pertussis
gggggacuggcaccggca

SEQ ID NO: 317212 - RNA, 12 nt, Bordetella pertussis
gggggcgggccc

SEQ ID NO: 317213 - RNA, 11 nt, Bordetella pertussis
gggggcguggc

SEQ ID NO: 317214 - RNA, 13 nt, Bordetella pertussis
ggguggcgggcgc

SEQ ID NO: 317215 - RNA, 11 nt, Bordetella pertussis
gggugguggcc

SEQ ID NO: 317216 - RNA, 22 nt, Bordetella pertussis
ggguuccacagcgccgaccgca

SEQ ID NO: 317217 - RNA, 17 nt, Bordetella pertussis
ggguucgccgcugucgc

SEQ ID NO: 317218 - RNA, 13 nt, Bordetella pertussis
ggguugcccggca

SEQ ID NO: 317219 - RNA, 18 nt, Bordetella pertussis
ggguugccgggauccacg

SEQ ID NO: 317220 - RNA, 14 nt, Bordetella pertussis
ggguugcgcgccag

SEQ ID NO: 317221 - RNA, 22 nt, Bordetella pertussis
gguacccaugcggggcggcggg

SEQ ID NO: 317222 - RNA, 15 nt, Bordetella pertussis
gguagaucagcgcgu

SEQ ID NO: 317223 - RNA, 14 nt, Bordetella pertussis
gguagaugcgcgcg

SEQ ID NO: 317224 - RNA, 17 nt, Bordetella pertussis
gguagaugcgcgcgacc

SEQ ID NO: 317225 - RNA, 23 nt, Bordetella pertussis
gguagcugaccgaagcgcgggcg

SEQ ID NO: 317226 - RNA, 14 nt, Bordetella pertussis
gguaggcaaagcgc

SEQ ID NO: 317227 - RNA, 14 nt, Bordetella pertussis
gguaggccggcgcg

SEQ ID NO: 317228 - RNA, 22 nt, Bordetella pertussis
gguaggcgcccgacggcgcgcc

SEQ ID NO: 317229 - RNA, 15 nt, Bordetella pertussis
gguaggcggcgcgcc

SEQ ID NO: 317230 - RNA, 16 nt, Bordetella pertussis
gguauccacguagcgc

SEQ ID NO: 317231 - RNA, 20 nt, Bordetella pertussis
gguauccacguagcgcacga

SEQ ID NO: 317232 - RNA, 14 nt, Bordetella pertussis
gguaucggccagca

SEQ ID NO: 317233 - RNA, 17 nt, Bordetella pertussis
gguaucugucccggcgg

SEQ ID NO: 317234 - RNA, 15 nt, Bordetella pertussis
gguaugaccggcgcg

SEQ ID NO: 317235 - RNA, 15 nt, Bordetella pertussis
gguaugcacgaccag

SEQ ID NO: 317236 - RNA, 23 nt, Bordetella pertussis
gguaugcggcgcccaggcccagc

SEQ ID NO: 317237 - RNA, 19 nt, Bordetella pertussis
gguauuccucgacgauggc

SEQ ID NO: 317238 - RNA, 22 nt, Bordetella pertussis
ggucaaccugguguucggcacc

SEQ ID NO: 317239 - RNA, 16 nt, Bordetella pertussis
ggucaacucgcccgau

SEQ ID NO: 317240 - RNA, 13 nt, Bordetella pertussis
ggucaagcggcug

SEQ ID NO: 317241 - RNA, 14 nt, Bordetella pertussis
ggucaaggcgcggc

SEQ ID NO: 317242 - RNA, 15 nt, Bordetella pertussis
ggucaaggcgcggcc

SEQ ID NO: 317243 - RNA, 18 nt, Bordetella pertussis
ggucaagggcggccaugc

SEQ ID NO: 317244 - RNA, 15 nt, Bordetella pertussis
ggucaaugcggcggc

SEQ ID NO: 317245 - RNA, 23 nt, Bordetella pertussis
ggucaauccgcccguugcggcgc

SEQ ID NO: 317246 - RNA, 24 nt, Bordetella pertussis
ggucaauccgcccguugcggcgcc

SEQ ID NO: 317247 - RNA, 22 nt, Bordetella pertussis
ggucacacugucgccacgggcg

SEQ ID NO: 317248 - RNA, 23 nt, Bordetella pertussis
ggucaccaacgcgaucucagcca

SEQ ID NO: 317249 - RNA, 20 nt, Bordetella pertussis
ggucaccacgccuucgagca

SEQ ID NO: 317250 - RNA, 22 nt, Bordetella pertussis
ggucaccacgccuucgagcacc

SEQ ID NO: 317251 - RNA, 16 nt, Bordetella pertussis
ggucacccgccgcacc

SEQ ID NO: 317252 - RNA, 20 nt, Bordetella pertussis
ggucacccggcgcaugcugg

SEQ ID NO: 317253 - RNA, 13 nt, Bordetella pertussis
ggucaccgcgccc

SEQ ID NO: 317254 - RNA, 16 nt, Bordetella pertussis
ggucacgaucuggccg

SEQ ID NO: 317255 - RNA, 18 nt, Bordetella pertussis
ggucacgaucuggccgau

SEQ ID NO: 317256 - RNA, 14 nt, Bordetella pertussis
ggucacgcuggugg

SEQ ID NO: 317257 - RNA, 16 nt, Bordetella pertussis
ggucacgcugguggcc

SEQ ID NO: 317258 - RNA, 16 nt, Bordetella pertussis
ggucacggccucggca

SEQ ID NO: 317259 - RNA, 14 nt, Bordetella pertussis
ggucacguccaguc

SEQ ID NO: 317260 - RNA, 21 nt, Bordetella pertussis
ggucacugccgaaacgcuggc

SEQ ID NO: 317261 - RNA, 19 nt, Bordetella pertussis
ggucagaacgacgaucugg

SEQ ID NO: 317262 - RNA, 23 nt, Bordetella pertussis
ggucagcaaccccagcagcgccg

SEQ ID NO: 317263 - RNA, 14 nt, Bordetella pertussis
ggucagcagcaugc

SEQ ID NO: 317264 - RNA, 19 nt, Bordetella pertussis
ggucagcagggcgccgacg

SEQ ID NO: 317265 - RNA, 20 nt, Bordetella pertussis
ggucagcagggcgccgacga

SEQ ID NO: 317266 - RNA, 15 nt, Bordetella pertussis
ggucagcccaggcgg

SEQ ID NO: 317267 - RNA, 19 nt, Bordetella pertussis
ggucagcccgccaucgcgc

SEQ ID NO: 317268 - RNA, 20 nt, Bordetella pertussis
ggucagcccgccaucgcgca

SEQ ID NO: 317269 - RNA, 16 nt, Bordetella pertussis
ggucagccugggcgcc

SEQ ID NO: 317270 - RNA, 21 nt, Bordetella pertussis
ggucagccuggggcaggcggc

SEQ ID NO: 317271 - RNA, 13 nt, Bordetella pertussis
ggucagcgccagg

SEQ ID NO: 317272 - RNA, 16 nt, Bordetella pertussis
ggucagcgccuugccg

SEQ ID NO: 317273 - RNA, 18 nt, Bordetella pertussis
ggucagcgcggcgccggc

SEQ ID NO: 317274 - RNA, 19 nt, Bordetella pertussis
ggucagcgcggcgccggcc

SEQ ID NO: 317275 - RNA, 14 nt, Bordetella pertussis
ggucagguugcgcc

SEQ ID NO: 317276 - RNA, 17 nt, Bordetella pertussis
ggucagucgggacggcg

SEQ ID NO: 317277 - RNA, 18 nt, Bordetella pertussis
ggucaguccgcccagcca

SEQ ID NO: 317278 - RNA, 20 nt, Bordetella pertussis
ggucaguccgcccagccagg

SEQ ID NO: 317279 - RNA, 22 nt, Bordetella pertussis
ggucaucagcacgaucuggcgc

SEQ ID NO: 317280 - RNA, 14 nt, Bordetella pertussis
gguccacagcccgg

SEQ ID NO: 317281 - RNA, 21 nt, Bordetella pertussis
gguccaccaccuucagggcgc

SEQ ID NO: 317282 - RNA, 16 nt, Bordetella pertussis
gguccaccucgucguc

SEQ ID NO: 317283 - RNA, 20 nt, Bordetella pertussis
gguccacgcccuggcuggcg

SEQ ID NO: 317284 - RNA, 12 nt, Bordetella pertussis
gguccacgccgg

SEQ ID NO: 317285 - RNA, 16 nt, Bordetella pertussis
gguccacggcauggcc

SEQ ID NO: 317286 - RNA, 23 nt, Bordetella pertussis
gguccagcaccagggcgcgcagc

SEQ ID NO: 317287 - RNA, 15 nt, Bordetella pertussis
gguccagcaaggcgu

SEQ ID NO: 317288 - RNA, 23 nt, Bordetella pertussis
gguccagcaggauggcgaacaug

SEQ ID NO: 317289 - RNA, 13 nt, Bordetella pertussis
gguccagcagcgu

SEQ ID NO: 317290 - RNA, 21 nt, Bordetella pertussis
gguccggggcgggcgcgguau

SEQ ID NO: 317291 - RNA, 20 nt, Bordetella pertussis
gguccguguucgacgcggcc

SEQ ID NO: 317292 - RNA, 22 nt, Bordetella pertussis
gguccguguucgacgcggccga

SEQ ID NO: 317293 - RNA, 18 nt, Bordetella pertussis
ggucgacauagacgcgca

SEQ ID NO: 317294 - RNA, 21 nt, Bordetella pertussis
ggucgacccacuugagcagcg

SEQ ID NO: 317295 - RNA, 22 nt, Bordetella pertussis
ggucgacccacuugagcagcgc

SEQ ID NO: 317296 - RNA, 13 nt, Bordetella pertussis
ggucgaccagcag

SEQ ID NO: 317297 - RNA, 13 nt, Bordetella pertussis
ggucgagcgccga

SEQ ID NO: 317298 - RNA, 17 nt, Bordetella pertussis
ggucgagcgcucgcuca

SEQ ID NO: 317299 - RNA, 14 nt, Bordetella pertussis
ggucgagcgggcgc

SEQ ID NO: 317300 - RNA, 16 nt, Bordetella pertussis
ggucgagcgggcgcca

SEQ ID NO: 317301 - RNA, 18 nt, Bordetella pertussis
ggucgagcgggcgccaga

SEQ ID NO: 317302 - RNA, 21 nt, Bordetella pertussis
ggucgaggcgcaguccagcgu

SEQ ID NO: 317303 - RNA, 17 nt, Bordetella pertussis
ggucgagguccugcucg

SEQ ID NO: 317304 - RNA, 16 nt, Bordetella pertussis
ggucgaguugguagcg

SEQ ID NO: 317305 - RNA, 14 nt, Bordetella pertussis
ggucgaugccggcg

SEQ ID NO: 317306 - RNA, 16 nt, Bordetella pertussis
ggucgaugccggcggc

SEQ ID NO: 317307 - RNA, 21 nt, Bordetella pertussis
ggucgaugccggcggccugca

SEQ ID NO: 317308 - RNA, 15 nt, Bordetella pertussis
ggucgauguccagcg

SEQ ID NO: 317309 - RNA, 22 nt, Bordetella pertussis
ggucgauguccagcgccagcag

SEQ ID NO: 317310 - RNA, 19 nt, Bordetella pertussis
ggucgcagucccaguccgg

SEQ ID NO: 317311 - RNA, 18 nt, Bordetella pertussis
ggucgcauuggccgccgc

SEQ ID NO: 317312 - RNA, 12 nt, Bordetella pertussis
ggucgccgcggg

SEQ ID NO: 317313 - RNA, 13 nt, Bordetella pertussis
ggucgccggcgca

SEQ ID NO: 317314 - RNA, 14 nt, Bordetella pertussis
ggucgccggcgcaa

SEQ ID NO: 317315 - RNA, 18 nt, Bordetella pertussis
ggucgccguacucgccgg

SEQ ID NO: 317316 - RNA, 22 nt, Bordetella pertussis
ggucgccgucaggaucaggccg

SEQ ID NO: 317317 - RNA, 23 nt, Bordetella pertussis
ggucgccgucaggaucaggccgg

SEQ ID NO: 317318 - RNA, 17 nt, Bordetella pertussis
ggucgccguccaggcgc

SEQ ID NO: 317319 - RNA, 17 nt, Bordetella pertussis
ggucgccguucuggcug

SEQ ID NO: 317320 - RNA, 12 nt, Bordetella pertussis
ggucggccagcg

SEQ ID NO: 317321 - RNA, 13 nt, Bordetella pertussis
ggucggccggcag

SEQ ID NO: 317322 - RNA, 21 nt, Bordetella pertussis
ggucggccggcagcggcgcca

SEQ ID NO: 317323 - RNA, 20 nt, Bordetella pertussis
ggucggccucggcgaagugc

SEQ ID NO: 317324 - RNA, 14 nt, Bordetella pertussis
ggucggcgaacagc

SEQ ID NO: 317325 - RNA, 22 nt, Bordetella pertussis
ggucggcuugauaugggcgagc

SEQ ID NO: 317326 - RNA, 23 nt, Bordetella pertussis
ggucggcuugauaugggcgagca

SEQ ID NO: 317327 - RNA, 18 nt, Bordetella pertussis
ggucgggauaguccagca

SEQ ID NO: 317328 - RNA, 21 nt, Bordetella pertussis
ggucgggcaguccuucagcuu

SEQ ID NO: 317329 - RNA, 18 nt, Bordetella pertussis
ggucggggucggccacca

SEQ ID NO: 317330 - RNA, 18 nt, Bordetella pertussis
ggucguggcugaccagca

SEQ ID NO: 317331 - RNA, 20 nt, Bordetella pertussis
ggucguuccagaacggcgcg

SEQ ID NO: 317332 - RNA, 18 nt, Bordetella pertussis
ggucguuguggcaggcgu

SEQ ID NO: 317333 - RNA, 19 nt, Bordetella pertussis
ggucguuguggcaggcguc

SEQ ID NO: 317334 - RNA, 13 nt, Bordetella pertussis
ggucuccagcgcg

SEQ ID NO: 317335 - RNA, 23 nt, Bordetella pertussis
ggucucccggcaugauggcccgg

SEQ ID NO: 317336 - RNA, 16 nt, Bordetella pertussis
ggucugcacgaggcgc

SEQ ID NO: 317337 - RNA, 17 nt, Bordetella pertussis
ggucugcacgccgggcg

SEQ ID NO: 317338 - RNA, 18 nt, Bordetella pertussis
ggucugcacgccgggcgc

SEQ ID NO: 317339 - RNA, 15 nt, Bordetella pertussis
ggucugcaggccgaa

SEQ ID NO: 317340 - RNA, 19 nt, Bordetella pertussis
ggucugcuggucgcgggcc

SEQ ID NO: 317341 - RNA, 13 nt, Bordetella pertussis
ggucugcuucauc

SEQ ID NO: 317342 - RNA, 18 nt, Bordetella pertussis
ggucuggcccacgcgcac

SEQ ID NO: 317343 - RNA, 14 nt, Bordetella pertussis
ggucuggccggccg

SEQ ID NO: 317344 - RNA, 23 nt, Bordetella pertussis
ggucuggccggugaugcggcgcg

SEQ ID NO: 317345 - RNA, 12 nt, Bordetella pertussis
ggucuugccgcc

SEQ ID NO: 317346 - RNA, 16 nt, Bordetella pertussis
ggucuugccgcgcagc

SEQ ID NO: 317347 - RNA, 22 nt, Bordetella pertussis
ggugaagcccucgucgcggccg

SEQ ID NO: 317348 - RNA, 19 nt, Bordetella pertussis
ggugaaggcgcccgggcug

SEQ ID NO: 317349 - RNA, 17 nt, Bordetella pertussis
ggugaccaugucgccgu

SEQ ID NO: 317350 - RNA, 13 nt, Bordetella pertussis
ggugaccggcgug

SEQ ID NO: 317351 - RNA, 14 nt, Bordetella pertussis
ggugaccggcguga

SEQ ID NO: 317352 - RNA, 16 nt, Bordetella pertussis
ggugaccggggcgucc

SEQ ID NO: 317353 - RNA, 17 nt, Bordetella pertussis
ggugaccggggcgucca

SEQ ID NO: 317354 - RNA, 17 nt, Bordetella pertussis
ggugagcaagcgcugga

SEQ ID NO: 317355 - RNA, 14 nt, Bordetella pertussis
ggugagccggccac

SEQ ID NO: 317356 - RNA, 22 nt, Bordetella pertussis
ggugagcggcacgacgucgucg

SEQ ID NO: 317357 - RNA, 21 nt, Bordetella pertussis
ggugaucgaguaggccggcac

SEQ ID NO: 317358 - RNA, 15 nt, Bordetella pertussis
ggugaucugcugcgu

SEQ ID NO: 317359 - RNA, 18 nt, Bordetella pertussis
ggugaugucgccggucac

SEQ ID NO: 317360 - RNA, 20 nt, Bordetella pertussis
ggugcaccaggugguuggcg

SEQ ID NO: 317361 - RNA, 13 nt, Bordetella pertussis
ggugcacgccgau

SEQ ID NO: 317362 - RNA, 15 nt, Bordetella pertussis
ggugcagcggcagca

SEQ ID NO: 317363 - RNA, 14 nt, Bordetella pertussis
ggugcagcggcucg

SEQ ID NO: 317364 - RNA, 20 nt, Bordetella pertussis
ggugcaggggccgcacgcgc

SEQ ID NO: 317365 - RNA, 23 nt, Bordetella pertussis
ggugcaggggccgcacgcgcggc

SEQ ID NO: 317366 - RNA, 15 nt, Bordetella pertussis
ggugcaggguuggcg

SEQ ID NO: 317367 - RNA, 17 nt, Bordetella pertussis
ggugcaggucaucgcgc

SEQ ID NO: 317368 - RNA, 20 nt, Bordetella pertussis
ggugccaguccccaugcggc

SEQ ID NO: 317369 - RNA, 23 nt, Bordetella pertussis
ggugccaguccccguucggggac

SEQ ID NO: 317370 - RNA, 17 nt, Bordetella pertussis
ggugccagucuccaggc

SEQ ID NO: 317371 - RNA, 19 nt, Bordetella pertussis
ggugcccagcgagcggggc

SEQ ID NO: 317372 - RNA, 23 nt, Bordetella pertussis
ggugcccagcgagcggggcuggu

SEQ ID NO: 317373 - RNA, 22 nt, Bordetella pertussis
ggugcccaguucgcggccggcc

SEQ ID NO: 317374 - RNA, 16 nt, Bordetella pertussis
ggugccccacgccgau

SEQ ID NO: 317375 - RNA, 19 nt, Bordetella pertussis
ggugccccggccucgcggc

SEQ ID NO: 317376 - RNA, 21 nt, Bordetella pertussis
ggugccccggccucgcggcgc

SEQ ID NO: 317377 - RNA, 22 nt, Bordetella pertussis
ggugccccggccucgcggcgcg

SEQ ID NO: 317378 - RNA, 15 nt, Bordetella pertussis
ggugccgacggcgcg

SEQ ID NO: 317379 - RNA, 20 nt, Bordetella pertussis
ggugccgcccuugggcauca

SEQ ID NO: 317380 - RNA, 16 nt, Bordetella pertussis
ggugccgccgcccgac

SEQ ID NO: 317381 - RNA, 16 nt, Bordetella pertussis
ggugccgccggcgcgg

SEQ ID NO: 317382 - RNA, 23 nt, Bordetella pertussis
ggugccgccggcgcggcugcugg

SEQ ID NO: 317383 - RNA, 14 nt, Bordetella pertussis
ggugccgcgcgcgg

SEQ ID NO: 317384 - RNA, 20 nt, Bordetella pertussis
ggugccgcgcgcggccggca

SEQ ID NO: 317385 - RNA, 13 nt, Bordetella pertussis
ggugccgcgcgcu

SEQ ID NO: 317386 - RNA, 14 nt, Bordetella pertussis
ggugccgcgcacga

SEQ ID NO: 317387 - RNA, 21 nt, Bordetella pertussis
ggugccgcguaugcggcagca

SEQ ID NO: 317388 - RNA, 14 nt, Bordetella pertussis
ggugccgcuggcgg

SEQ ID NO: 317389 - RNA, 16 nt, Bordetella pertussis
ggugccggacgccgac

SEQ ID NO: 317390 - RNA, 14 nt, Bordetella pertussis
ggugccggccagcc

SEQ ID NO: 317391 - RNA, 15 nt, Bordetella pertussis
ggugccggcggugau

SEQ ID NO: 317392 - RNA, 21 nt, Bordetella pertussis
ggugccgguggugcccaucgc

SEQ ID NO: 317393 - RNA, 14 nt, Bordetella pertussis
ggugccguccagcg

SEQ ID NO: 317394 - RNA, 17 nt, Bordetella pertussis
ggugccguccagcgcgg

SEQ ID NO: 317395 - RNA, 13 nt, Bordetella pertussis
ggugccguucggc

SEQ ID NO: 317396 - RNA, 23 nt, Bordetella pertussis
ggugccguucggccagcgcgcgg

SEQ ID NO: 317397 - RNA, 21 nt, Bordetella pertussis
ggugccguucccgccgggcuc

SEQ ID NO: 317398 - RNA, 18 nt, Bordetella pertussis
ggugccugccccugcggg

SEQ ID NO: 317399 - RNA, 21 nt, Bordetella pertussis
ggugccuguccccgccgggac

SEQ ID NO: 317400 - RNA, 18 nt, Bordetella pertussis
ggugccugucccugcggg

SEQ ID NO: 317401 - RNA, 16 nt, Bordetella pertussis
ggugccuguucccgcc

SEQ ID NO: 317402 - RNA, 21 nt, Bordetella pertussis
ggugccuguucccgccgggcc

SEQ ID NO: 317403 - RNA, 21 nt, Bordetella pertussis
ggugcgacugcaggaugaggc

SEQ ID NO: 317404 - RNA, 17 nt, Bordetella pertussis
ggugcgauagcgccgcg

SEQ ID NO: 317405 - RNA, 23 nt, Bordetella pertussis
ggugcgauagcgccgcgcaucga

SEQ ID NO: 317406 - RNA, 13 nt, Bordetella pertussis
ggugcgcaccagg

SEQ ID NO: 317407 - RNA, 20 nt, Bordetella pertussis
ggugcgcagcacaugggcgc

SEQ ID NO: 317408 - RNA, 17 nt, Bordetella pertussis
ggugcgcagcaccagca

SEQ ID NO: 317409 - RNA, 13 nt, Bordetella pertussis
ggugcgcagcagg

SEQ ID NO: 317410 - RNA, 21 nt, Bordetella pertussis
ggugcgccacgauguagccga

SEQ ID NO: 317411 - RNA, 14 nt, Bordetella pertussis
ggugcgcagcggca

SEQ ID NO: 317412 - RNA, 20 nt, Bordetella pertussis
ggugcgccgcaugcggcggc

SEQ ID NO: 317413 - RNA, 13 nt, Bordetella pertussis
ggugcgcgacagc

SEQ ID NO: 317414 - RNA, 17 nt, Bordetella pertussis
ggugcgcgccacggcgu

SEQ ID NO: 317415 - RNA, 20 nt, Bordetella pertussis
ggugcgcgccacggcgucgc

SEQ ID NO: 317416 - RNA, 22 nt, Bordetella pertussis
ggugcgcgccacggcgucgccg

SEQ ID NO: 317417 - RNA, 14 nt, Bordetella pertussis
ggugcgcgccaggu

SEQ ID NO: 317418 - RNA, 12 nt, Bordetella pertussis
ggugcgcgcggc

SEQ ID NO: 317419 - RNA, 13 nt, Bordetella pertussis
ggugcgcgcggcc

SEQ ID NO: 317420 - RNA, 12 nt, Bordetella pertussis
ggugcggccgca

SEQ ID NO: 317421 - RNA, 15 nt, Bordetella pertussis
ggugcggccucggcg

SEQ ID NO: 317422 - RNA, 11 nt, Bordetella pertussis
ggugcggcggc

SEQ ID NO: 317423 - RNA, 18 nt, Bordetella pertussis
ggugcgguaggcgcccga

SEQ ID NO: 317424 - RNA, 19 nt, Bordetella pertussis
ggugcgguaggcgcccgac

SEQ ID NO: 317425 - RNA, 15 nt, Bordetella pertussis
ggugcggucagucgg

SEQ ID NO: 317426 - RNA, 20 nt, Bordetella pertussis
gguggagaauucggcgcgua

SEQ ID NO: 317427 - RNA, 15 nt, Bordetella pertussis
gguggcacaucagcg

SEQ ID NO: 317428 - RNA, 23 nt, Bordetella pertussis
gguggcagagggcgacggcggcg

SEQ ID NO: 317429 - RNA, 16 nt, Bordetella pertussis
gguggccaccagcccc

SEQ ID NO: 317430 - RNA, 13 nt, Bordetella pertussis
gguggccacgccc

SEQ ID NO: 317431 - RNA, 13 nt, Bordetella pertussis
gguggccagcgcc

SEQ ID NO: 317432 - RNA, 19 nt, Bordetella pertussis
gguggccagcugcguggcg

SEQ ID NO: 317433 - RNA, 13 nt, Bordetella pertussis
gguggccagcccg

SEQ ID NO: 317434 - RNA, 20 nt, Bordetella pertussis
gguggcccgcaccgggcggc

SEQ ID NO: 317435 - RNA, 19 nt, Bordetella pertussis
gguuuuccuuuugcgcggc

SEQ ID NO: 317436 - RNA, 18 nt, Bordetella pertussis
gguuuugcuuugcgggcg

SEQ ID NO: 317437 - RNA, 20 nt, Bordetella pertussis
gguuuuuuuuggcguacggc

SEQ ID NO: 317438 - RNA, 19 nt, Bordetella pertussis
guaagcgcuggacgcccug

SEQ ID NO: 317439 - RNA, 24 nt, Bordetella pertussis
guaagcgcuggacgcccuggcgca

SEQ ID NO: 317440 - RNA, 15 nt, Bordetella pertussis
guaaggccgccggcc

SEQ ID NO: 317441 - RNA, 22 nt, Bordetella pertussis
guaaggccgccggccaccagcg

SEQ ID NO: 317442 - RNA, 21 nt, Bordetella pertussis
guaaggcgcuugcgcagggcg

SEQ ID NO: 317443 - RNA, 22 nt, Bordetella pertussis
guaaggucggguaaagcggugc

SEQ ID NO: 317444 - RNA, 17 nt, Bordetella pertussis
guaagugcccaggcccg

SEQ ID NO: 317445 - RNA, 18 nt, Bordetella pertussis
guaaucgaagccgggcgg

SEQ ID NO: 317446 - RNA, 18 nt, Bordetella pertussis
guaaucgcccggcgccau

SEQ ID NO: 317447 - RNA, 15 nt, Bordetella pertussis
guaaucgcgcgccac

SEQ ID NO: 317448 - RNA, 19 nt, Bordetella pertussis
guaaucgcgcgccaccgcc

SEQ ID NO: 317449 - RNA, 15 nt, Bordetella pertussis
guacaccgucgcgcg

SEQ ID NO: 317450 - RNA, 14 nt, Bordetella pertussis
guacacggccagca

SEQ ID NO: 317451 - RNA, 16 nt, Bordetella pertussis
guacacggccagcacg

SEQ ID NO: 317452 - RNA, 16 nt, Bordetella pertussis
guacaggccgccgguc

SEQ ID NO: 317453 - RNA, 23 nt, Bordetella pertussis
guacaggccggcggcgagcgcgg

SEQ ID NO: 317454 - RNA, 14 nt, Bordetella pertussis
guacaggcgcggca

SEQ ID NO: 317455 - RNA, 16 nt, Bordetella pertussis
guacaggcgcggcacg

SEQ ID NO: 317456 - RNA, 22 nt, Bordetella pertussis
guacaggcgcguggcgcccagc

SEQ ID NO: 317457 - RNA, 20 nt, Bordetella pertussis
guacaggcugccgucggcca

SEQ ID NO: 317458 - RNA, 22 nt, Bordetella pertussis
guacaucauccccagcgccgcc

SEQ ID NO: 317459 - RNA, 23 nt, Bordetella pertussis
guacauggccagguacaggccgc

SEQ ID NO: 317460 - RNA, 14 nt, Bordetella pertussis
guaccaagccugcu

SEQ ID NO: 317461 - RNA, 21 nt, Bordetella pertussis
guaccaauacaggaagcgcug

SEQ ID NO: 317462 - RNA, 23 nt, Bordetella pertussis
guaccaauacaggaagcgcuggc

SEQ ID NO: 317463 - RNA, 23 nt, Bordetella pertussis
guacccaguacgagaacgcgucg

SEQ ID NO: 317464 - RNA, 17 nt, Bordetella pertussis
guaccguacccgcgccg

SEQ ID NO: 317465 - RNA, 23 nt, Bordetella pertussis
guaccucagccugcuggugcugg

SEQ ID NO: 317466 - RNA, 20 nt, Bordetella pertussis
guaccugcagcaggcgcacc

SEQ ID NO: 317467 - RNA, 12 nt, Bordetella pertussis
guaccugcuggu

SEQ ID NO: 317468 - RNA, 20 nt, Bordetella pertussis
guacgacgagcgcaccaugg

SEQ ID NO: 317469 - RNA, 13 nt, Bordetella pertussis
guacgacggccgg

SEQ ID NO: 317470 - RNA, 14 nt, Bordetella pertussis
guacgacggccggg

SEQ ID NO: 317471 - RNA, 15 nt, Bordetella pertussis
guacgacggccgggg

SEQ ID NO: 317472 - RNA, 16 nt, Bordetella pertussis
guacgacggccggggc

SEQ ID NO: 317473 - RNA, 15 nt, Bordetella pertussis
guacgacggggugcc

SEQ ID NO: 317474 - RNA, 17 nt, Bordetella pertussis
guacgacggggugccug

SEQ ID NO: 317475 - RNA, 17 nt, Bordetella pertussis
guacgagugcaggcccg

SEQ ID NO: 317476 - RNA, 11 nt, Bordetella pertussis
guacggcgcgg

SEQ ID NO: 317477 - RNA, 16 nt, Bordetella pertussis
guacggcgcggugccu

SEQ ID NO: 317478 - RNA, 15 nt, Bordetella pertussis
guacguaccaggccg

SEQ ID NO: 317479 - RNA, 14 nt, Bordetella pertussis
guacguacgcccgg

SEQ ID NO: 317480 - RNA, 15 nt, Bordetella pertussis
guacguacgcccggc

SEQ ID NO: 317481 - RNA, 23 nt, Bordetella pertussis
guacgucggacagggccccggcc

SEQ ID NO: 317482 - RNA, 11 nt, Bordetella pertussis
guacuggcgcg

SEQ ID NO: 317483 - RNA, 18 nt, Bordetella pertussis
guacuggcgcggcggcca

SEQ ID NO: 317484 - RNA, 16 nt, Bordetella pertussis
guacuggugggccgac

SEQ ID NO: 317485 - RNA, 22 nt, Bordetella pertussis
guacuggugggccgacggcucg

SEQ ID NO: 317486 - RNA, 17 nt, Bordetella pertussis
guacuucucgucgcgca

SEQ ID NO: 317487 - RNA, 20 nt, Bordetella pertussis
guacuucucgucgcgcaugg

SEQ ID NO: 317488 - RNA, 20 nt, Bordetella pertussis
guagaccacgcgcugcgcgc

SEQ ID NO: 317489 - RNA, 23 nt, Bordetella pertussis
guagaccgcguugaccggcuggc

SEQ ID NO: 317490 - RNA, 16 nt, Bordetella pertussis
guagaccgggucgggc

SEQ ID NO: 317491 - RNA, 15 nt, Bordetella pertussis
guagaccugcgggcc

SEQ ID NO: 317492 - RNA, 14 nt, Bordetella pertussis
guagcacacgccga

SEQ ID NO: 317493 - RNA, 23 nt, Bordetella pertussis
guagccguccucgcgggccuggc

SEQ ID NO: 317494 - RNA, 17 nt, Bordetella pertussis
guagcgauccgaugccc

SEQ ID NO: 317495 - RNA, 16 nt, Bordetella pertussis
guagcgcagcaccggc

SEQ ID NO: 317496 - RNA, 17 nt, Bordetella pertussis
guagcgcagcaccggca

SEQ ID NO: 317497 - RNA, 14 nt, Bordetella pertussis
guagcgcaggcgcu

SEQ ID NO: 317498 - RNA, 14 nt, Bordetella pertussis
guagcgcggccggg

SEQ ID NO: 317499 - RNA, 19 nt, Bordetella pertussis
guagcgcucgacuucgucg

SEQ ID NO: 317500 - RNA, 23 nt, Bordetella pertussis
guagcgcucgacuucgucgggcu

SEQ ID NO: 317501 - RNA, 20 nt, Bordetella pertussis
guagcggaucgcggcgcggc

SEQ ID NO: 317502 - RNA, 18 nt, Bordetella pertussis
guagcucgaccaucaugg

SEQ ID NO: 317503 - RNA, 14 nt, Bordetella pertussis
guagcugcgccgca

SEQ ID NO: 317504 - RNA, 20 nt, Bordetella pertussis
aaguaguucggcgcgugcgg

SEQ ID NO: 317505 - RNA, 19 nt, Bordetella pertussis
aagucauguagcggccgcc

SEQ ID NO: 317506 - RNA, 14 nt, Bordetella pertussis
guaggccuucaccu

SEQ ID NO: 317507 - RNA, 23 nt, Bordetella pertussis
guaggccuucaccuugccgcugg

SEQ ID NO: 317508 - RNA, 18 nt, Bordetella pertussis
aagucgaguucggcgcgc

SEQ ID NO: 317509 - RNA, 21 nt, Bordetella pertussis
aagucggucagcucgucgccg

SEQ ID NO: 317510 - RNA, 21 nt, Bordetella pertussis
guaguccaucgcguccaggcc

SEQ ID NO: 317511 - RNA, 22 nt, Bordetella pertussis
guagucgccgcugccgggcucg

SEQ ID NO: 317512 - RNA, 18 nt, Bordetella pertussis
guagucggccaccaggcc

SEQ ID NO: 317513 - RNA, 13 nt, Bordetella pertussis
guagucggcgccc

SEQ ID NO: 317514 - RNA, 14 nt, Bordetella pertussis
guagucggcgccca

SEQ ID NO: 317515 - RNA, 19 nt, Bordetella pertussis
guagucguugccggccagc

SEQ ID NO: 317516 - RNA, 23 nt, Bordetella pertussis
guagucguugccggccagcacgg

SEQ ID NO: 317517 - RNA, 20 nt, Bordetella pertussis
guagugcccccacgcugcgc

SEQ ID NO: 317518 - RNA, 21 nt, Bordetella pertussis
guagugguaugaccggcgcgg

SEQ ID NO: 317519 - RNA, 16 nt, Bordetella pertussis
guaucgcgccagcgcc

SEQ ID NO: 317520 - RNA, 19 nt, Bordetella pertussis
guaucgcgccagcgccgcg

SEQ ID NO: 317521 - RNA, 18 nt, Bordetella pertussis
guaucgcggcgcaggcgg

SEQ ID NO: 317522 - RNA, 21 nt, Bordetella pertussis
guaucggcccgcgccagcgcc

SEQ ID NO: 317523 - RNA, 12 nt, Bordetella pertussis
guaucggccucg

SEQ ID NO: 317524 - RNA, 22 nt, Bordetella pertussis
guaucucggcgcccgcggccug

SEQ ID NO: 317525 - RNA, 17 nt, Bordetella pertussis
guaucuguccccgcggg

SEQ ID NO: 317526 - RNA, 21 nt, Bordetella pertussis
guaucugucccggcggggaca

SEQ ID NO: 317527 - RNA, 15 nt, Bordetella pertussis
guaugaccggcgcgg

SEQ ID NO: 317528 - RNA, 16 nt, Bordetella pertussis
guaugaccggcgcggc

SEQ ID NO: 317529 - RNA, 16 nt, Bordetella pertussis
guaugcaaccggcacg

SEQ ID NO: 317530 - RNA, 17 nt, Bordetella pertussis
guaugcacgaugccguc

SEQ ID NO: 317531 - RNA, 21 nt, Bordetella pertussis
guaugccguaggcgccggccu

SEQ ID NO: 317532 - RNA, 16 nt, Bordetella pertussis
guaugccugccagccc

SEQ ID NO: 317533 - RNA, 19 nt, Bordetella pertussis
guaugcaccgggccgaaca

SEQ ID NO: 317534 - RNA, 12 nt, Bordetella pertussis
guaugcggcgcc

SEQ ID NO: 317535 - RNA, 17 nt, Bordetella pertussis
guaugcggcgcccaggc

SEQ ID NO: 317536 - RNA, 12 nt, Bordetella pertussis
guauggcggcgc

SEQ ID NO: 317537 - RNA, 13 nt, Bordetella pertussis
guauggcggcgcc

SEQ ID NO: 317538 - RNA, 14 nt, Bordetella pertussis
guauggcggcgccg

SEQ ID NO: 317539 - RNA, 20 nt, Bordetella pertussis
guauucgaaggcagcaccgc

SEQ ID NO: 317540 - RNA, 13 nt, Bordetella pertussis
guauucgcgcggc

SEQ ID NO: 317541 - RNA, 19 nt, Bordetella pertussis
guauugcaugaccgccggc

SEQ ID NO: 317542 - RNA, 17 nt, Bordetella pertussis
guauugcugcugcuggc

SEQ ID NO: 317543 - RNA, 17 nt, Bordetella pertussis
guauugugcaugcgcgc

SEQ ID NO: 317544 - RNA, 16 nt, Bordetella pertussis
gucaacccgucgacgc

SEQ ID NO: 317545 - RNA, 19 nt, Bordetella pertussis
gucaacgcccugacgacca

SEQ ID NO: 317546 - RNA, 17 nt, Bordetella pertussis
gucaagccagcggcgcg

SEQ ID NO: 317547 - RNA, 17 nt, Bordetella pertussis
gucaagcagcgccggcu

SEQ ID NO: 317548 - RNA, 14 nt, Bordetella pertussis
gucaagcgucgaug

SEQ ID NO: 317549 - RNA, 18 nt, Bordetella pertussis
gucaagcgucgauggcgu

SEQ ID NO: 317550 - RNA, 21 nt, Bordetella pertussis
gucaaggccugcccgggcacc

SEQ ID NO: 317551 - RNA, 17 nt, Bordetella pertussis
gucaaggcgcggccguc

SEQ ID NO: 317552 - RNA, 14 nt, Bordetella pertussis
gucaaggcggggcu

SEQ ID NO: 317553 - RNA, 14 nt, Bordetella pertussis
gucaaggggcugua

SEQ ID NO: 317554 - RNA, 15 nt, Bordetella pertussis
gucaaguccggcgcc

SEQ ID NO: 317555 - RNA, 16 nt, Bordetella pertussis
gucaaguccggcgccg

SEQ ID NO: 317556 - RNA, 19 nt, Bordetella pertussis
gucaauccgccgccagcac

SEQ ID NO: 317557 - RNA, 20 nt, Bordetella pertussis
gucaauccgccgccagcacg

SEQ ID NO: 317558 - RNA, 22 nt, Bordetella pertussis
gucaauccgccgccagcacgcc

SEQ ID NO: 317559 - RNA, 21 nt, Bordetella pertussis
gucaaugccagucgccgcggu

SEQ ID NO: 317560 - RNA, 15 nt, Bordetella pertussis
gucaaugcggcggcg

SEQ ID NO: 317561 - RNA, 16 nt, Bordetella pertussis
gucaaugcggcggcgc

SEQ ID NO: 317562 - RNA, 19 nt, Bordetella pertussis
gucaaugcggcggcgcugg

SEQ ID NO: 317563 - RNA, 22 nt, Bordetella pertussis
gucacaccccaccacgucgcgg

SEQ ID NO: 317564 - RNA, 23 nt, Bordetella pertussis
gucacacugucgccacgggcguc

SEQ ID NO: 317565 - RNA, 12 nt, Bordetella pertussis
gucaccagcagg

SEQ ID NO: 317566 - RNA, 14 nt, Bordetella pertussis
gucaccaucgccgc

SEQ ID NO: 317567 - RNA, 21 nt, Bordetella pertussis
gucaccccgcccugcccggcg

SEQ ID NO: 317568 - RNA, 16 nt, Bordetella pertussis
gucaccccugcgcugc

SEQ ID NO: 317569 - RNA, 15 nt, Bordetella pertussis
gucacccggcgcaug

SEQ ID NO: 317570 - RNA, 16 nt, Bordetella pertussis
gucaccgacgccagca

SEQ ID NO: 317571 - RNA, 16 nt, Bordetella pertussis
gucaccgacgccagcg

SEQ ID NO: 317572 - RNA, 19 nt, Bordetella pertussis
gucaccgagaggaaauggu

SEQ ID NO: 317573 - RNA, 17 nt, Bordetella pertussis
gucaccgccgccgcgcc

SEQ ID NO: 317574 - RNA, 20 nt, Bordetella pertussis
gucaccuugggaucguccca

SEQ ID NO: 317575 - RNA, 18 nt, Bordetella pertussis
gucacgauuucggccaug

SEQ ID NO: 317576 - RNA, 14 nt, Bordetella pertussis
gucacgcccaggcg

SEQ ID NO: 317577 - RNA, 18 nt, Bordetella pertussis
gucacgcccaggcgcugg

SEQ ID NO: 317578 - RNA, 13 nt, Bordetella pertussis
gucacgccgauga

SEQ ID NO: 317579 - RNA, 19 nt, Bordetella pertussis
gucacgccgaugaccaggg

SEQ ID NO: 317580 - RNA, 14 nt, Bordetella pertussis
gucacgcugguggc

SEQ ID NO: 317581 - RNA, 18 nt, Bordetella pertussis
gucacggcaagacggcgc

SEQ ID NO: 317582 - RNA, 12 nt, Bordetella pertussis
gucacggaucag

SEQ ID NO: 317583 - RNA, 17 nt, Bordetella pertussis
gucacguucagcgccgg

SEQ ID NO: 317584 - RNA, 21 nt, Bordetella pertussis
gucacguucagcgccggcaug

SEQ ID NO: 317585 - RNA, 13 nt, Bordetella pertussis
gucagacgcgcuu

SEQ ID NO: 317586 - RNA, 18 nt, Bordetella pertussis
gucagcaaccccagcagc

SEQ ID NO: 317587 - RNA, 18 nt, Bordetella pertussis
gucagcacaucgcccggc

SEQ ID NO: 317588 - RNA, 20 nt, Bordetella pertussis
gucagcacaucgcccggcag

SEQ ID NO: 317589 - RNA, 19 nt, Bordetella pertussis
gucagcaccucggcgccca

SEQ ID NO: 317590 - RNA, 20 nt, Bordetella pertussis
gucagcaccucggcgcccag

SEQ ID NO: 317591 - RNA, 22 nt, Bordetella pertussis
gucagcacgaacgacacccggu

SEQ ID NO: 317592 - RNA, 18 nt, Bordetella pertussis
gucagcacuugccggccg

SEQ ID NO: 317593 - RNA, 19 nt, Bordetella pertussis
gucagcacuugccggccgc

SEQ ID NO: 317594 - RNA, 13 nt, Bordetella pertussis
gucagcagcacgc

SEQ ID NO: 317595 - RNA, 14 nt, Bordetella pertussis
gucagcagcacgcc

SEQ ID NO: 317596 - RNA, 15 nt, Bordetella pertussis
gucagcagcgcggcg

SEQ ID NO: 317597 - RNA, 17 nt, Bordetella pertussis
gucagcagcgcggcgcc

SEQ ID NO: 317598 - RNA, 13 nt, Bordetella pertussis
gucagcagggcgc

SEQ ID NO: 317599 - RNA, 15 nt, Bordetella pertussis
gucagcagggcgccg

SEQ ID NO: 317600 - RNA, 17 nt, Bordetella pertussis
gucagcagggcgccgac

SEQ ID NO: 317601 - RNA, 19 nt, Bordetella pertussis
gucagcagggcgccgacga

SEQ ID NO: 317602 - RNA, 21 nt, Bordetella pertussis
gucagcaugaagcugcccagc

SEQ ID NO: 317603 - RNA, 17 nt, Bordetella pertussis
gucagcccgccaucgcg

SEQ ID NO: 317604 - RNA, 13 nt, Bordetella pertussis
gucagcccggcgg

SEQ ID NO: 317605 - RNA, 14 nt, Bordetella pertussis
gucagcccggcggc

SEQ ID NO: 317606 - RNA, 14 nt, Bordetella pertussis
gucagccggugcca

SEQ ID NO: 317607 - RNA, 22 nt, Bordetella pertussis
gucagccugauucccaggcccg

SEQ ID NO: 317608 - RNA, 21 nt, Bordetella pertussis
gucagccuggggcaggcggcu

SEQ ID NO: 317609 - RNA, 14 nt, Bordetella pertussis
gucagcgccagggu

SEQ ID NO: 317610 - RNA, 21 nt, Bordetella pertussis
gucagcgccagggugccgaaa

SEQ ID NO: 317611 - RNA, 22 nt, Bordetella pertussis
gucagcgcccaaucgggcagca

SEQ ID NO: 317612 - RNA, 12 nt, Bordetella pertussis
gucagcgccgcg

SEQ ID NO: 317613 - RNA, 13 nt, Bordetella pertussis
gucagcgccggca

SEQ ID NO: 317614 - RNA, 15 nt, Bordetella pertussis
gucagcgccggcacg

SEQ ID NO: 317615 - RNA, 14 nt, Bordetella pertussis
gucagcgcggcgcc

SEQ ID NO: 317616 - RNA, 19 nt, Bordetella pertussis
gucagcgcggcgccggccu

SEQ ID NO: 317617 - RNA, 16 nt, Bordetella pertussis
gucagcgcggcgcaca

SEQ ID NO: 317618 - RNA, 13 nt, Bordetella pertussis
gucagcggccggc

SEQ ID NO: 317619 - RNA, 13 nt, Bordetella pertussis
gucagcggcgcgc

SEQ ID NO: 317620 - RNA, 15 nt, Bordetella pertussis
gucagcggcgcgccc

SEQ ID NO: 317621 - RNA, 19 nt, Bordetella pertussis
gucagcggcuucgagcgcg

SEQ ID NO: 317622 - RNA, 20 nt, Bordetella pertussis
gucagcggcuucgagcgcga

SEQ ID NO: 317623 - RNA, 23 nt, Bordetella pertussis
gucagcucaagaagaagccgggc

SEQ ID NO: 317624 - RNA, 17 nt, Bordetella pertussis
gucaggcccacgccgcc

SEQ ID NO: 317625 - RNA, 22 nt, Bordetella pertussis
gucaggcccacgccgccgaagu

SEQ ID NO: 317626 - RNA, 13 nt, Bordetella pertussis
gucaggccgggca

SEQ ID NO: 317627 - RNA, 19 nt, Bordetella pertussis
gucaggccgucgagccggg

SEQ ID NO: 317628 - RNA, 18 nt, Bordetella pertussis
gucaggccguuggcgcgc

SEQ ID NO: 317629 - RNA, 20 nt, Bordetella pertussis
gucaggccguuggcgcgccu

SEQ ID NO: 317630 - RNA, 17 nt, Bordetella pertussis
gucaggcgagcgcggcg

SEQ ID NO: 317631 - RNA, 14 nt, Bordetella pertussis
gucaggcggucgac

SEQ ID NO: 317632 - RNA, 14 nt, Bordetella pertussis
gucauagcgccagc

SEQ ID NO: 317633 - RNA, 16 nt, Bordetella pertussis
gucaucaccagggugg

SEQ ID NO: 317634 - RNA, 23 nt, Bordetella pertussis
gucaucacgcggucgaugcgcac

SEQ ID NO: 317635 - RNA, 13 nt, Bordetella pertussis
gucaucagcacga

SEQ ID NO: 317636 - RNA, 15 nt, Bordetella pertussis
gucaucgaugcgccg

SEQ ID NO: 317637 - RNA, 20 nt, Bordetella pertussis
gucaucgccaugcugccaac

SEQ ID NO: 317638 - RNA, 16 nt, Bordetella pertussis
gucaucgccgcggcgg

SEQ ID NO: 317639 - RNA, 16 nt, Bordetella pertussis
guccagucccguggcg

SEQ ID NO: 317640 - RNA, 14 nt, Bordetella pertussis
gucaucggcgacga

SEQ ID NO: 317641 - RNA, 17 nt, Bordetella pertussis
gucaucggcgcgcagca

SEQ ID NO: 317642 - RNA, 14 nt, Bordetella pertussis
gucccagauggcgc

SEQ ID NO: 317643 - RNA, 15 nt, Bordetella pertussis
gucccagccggcggc

SEQ ID NO: 317644 - RNA, 22 nt, Bordetella pertussis
gucccagccggcggcaugcgcc

SEQ ID NO: 317645 - RNA, 18 nt, Bordetella pertussis
gucccagcgcacgcagcg

SEQ ID NO: 317646 - RNA, 18 nt, Bordetella pertussis
gucccagcgcucguccac

SEQ ID NO: 317647 - RNA, 14 nt, Bordetella pertussis
gucccagcggggac

SEQ ID NO: 317648 - RNA, 13 nt, Bordetella pertussis
gucccaguccggc

SEQ ID NO: 317649 - RNA, 21 nt, Bordetella pertussis
guccccacagggggacuggca

SEQ ID NO: 317650 - RNA, 19 nt, Bordetella pertussis
guccccacggggacaggca

SEQ ID NO: 317651 - RNA, 21 nt, Bordetella pertussis
guccccacugggggacuggca

SEQ ID NO: 317652 - RNA, 20 nt, Bordetella pertussis
guccccgucgggacaggcuc

SEQ ID NO: 317653 - RNA, 19 nt, Bordetella pertussis
guccccguggggacaggca

SEQ ID NO: 317654 - RNA, 21 nt, Bordetella pertussis
guccccguucggggacaggca

SEQ ID NO: 317655 - RNA, 15 nt, Bordetella pertussis
guccccugcggggac

SEQ ID NO: 317656 - RNA, 17 nt, Bordetella pertussis
gucccgacccccggccc

SEQ ID NO: 317657 - RNA, 19 nt, Bordetella pertussis
gucccgacggggacaggcu

SEQ ID NO: 317658 - RNA, 13 nt, Bordetella pertussis
gucccgcaccggg

SEQ ID NO: 317659 - RNA, 16 nt, Bordetella pertussis
gucccgcaccgggcaa

SEQ ID NO: 317660 - RNA, 17 nt, Bordetella pertussis
gucccgcaugaccugca

SEQ ID NO: 317661 - RNA, 21 nt, Bordetella pertussis
gucccgccuucccggccgaaa

SEQ ID NO: 317662 - RNA, 14 nt, Bordetella pertussis
gucccggcggggac

SEQ ID NO: 317663 - RNA, 19 nt, Bordetella pertussis
gucccggcggggacaggcg

SEQ ID NO: 317664 - RNA, 21 nt, Bordetella pertussis
gucccggcggggcaggcgccu

SEQ ID NO: 317665 - RNA, 19 nt, Bordetella pertussis
gucccggcugggacaggca

SEQ ID NO: 317666 - RNA, 20 nt, Bordetella pertussis
guccgaaagacugcggcgcg

SEQ ID NO: 317667 - RNA, 17 nt, Bordetella pertussis
guccgacaggcagacga

SEQ ID NO: 317668 - RNA, 14 nt, Bordetella pertussis
guccgcccagccag

SEQ ID NO: 317669 - RNA, 19 nt, Bordetella pertussis
guccgcccagccaggcgcc

SEQ ID NO: 317670 - RNA, 14 nt, Bordetella pertussis
guccgccgcgacca

SEQ ID NO: 317671 - RNA, 18 nt, Bordetella pertussis
guccgccggcacgcgcgg

SEQ ID NO: 317672 - RNA, 16 nt, Bordetella pertussis
guccgccguagcgcgc

SEQ ID NO: 317673 - RNA, 18 nt, Bordetella pertussis
guccgccgugcaggcccg

SEQ ID NO: 317674 - RNA, 14 nt, Bordetella pertussis
guccgcgucggccg

SEQ ID NO: 317675 - RNA, 16 nt, Bordetella pertussis
guccgcgucggccgcg

SEQ ID NO: 317676 - RNA, 17 nt, Bordetella pertussis
guccgcucaugccggca

SEQ ID NO: 317677 - RNA, 16 nt, Bordetella pertussis
guccgcucgaggccag

SEQ ID NO: 317678 - RNA, 18 nt, Bordetella pertussis
guccgcucgaggccaggc

SEQ ID NO: 317679 - RNA, 22 nt, Bordetella pertussis
guccgcucgaggccaggcugac

SEQ ID NO: 317680 - RNA, 24 nt, Bordetella pertussis
guccgcucgaggccaggcugacca

SEQ ID NO: 317681 - RNA, 23 nt, Bordetella pertussis
guccggcaacaccaaccaacaug

SEQ ID NO: 317682 - RNA, 14 nt, Bordetella pertussis
guccggcagcaccc

SEQ ID NO: 317683 - RNA, 14 nt, Bordetella pertussis
guccggccccagga

SEQ ID NO: 317684 - RNA, 16 nt, Bordetella pertussis
guccggccccaggaug

SEQ ID NO: 317685 - RNA, 20 nt, Bordetella pertussis
guccggccccaggaugcgca

SEQ ID NO: 317686 - RNA, 17 nt, Bordetella pertussis
guccgguauccuggcgc

SEQ ID NO: 317687 - RNA, 21 nt, Bordetella pertussis
guccggucguuccagaacggc

SEQ ID NO: 317688 - RNA, 15 nt, Bordetella pertussis
guccggugcgauagc

SEQ ID NO: 317689 - RNA, 14 nt, Bordetella pertussis
guccgguucgccca

SEQ ID NO: 317690 - RNA, 23 nt, Bordetella pertussis
guccgguucgcccaccaccagcg

SEQ ID NO: 317691 - RNA, 18 nt, Bordetella pertussis
guccguaucgcggccgag

SEQ ID NO: 317692 - RNA, 20 nt, Bordetella pertussis
guccgucaccgacgccagca

SEQ ID NO: 317693 - RNA, 14 nt, Bordetella pertussis
guccguccuggcca

SEQ ID NO: 317694 - RNA, 20 nt, Bordetella pertussis
guccgucggguugccgcugc

SEQ ID NO: 317695 - RNA, 16 nt, Bordetella pertussis
guccgucucgcccagg

SEQ ID NO: 317696 - RNA, 13 nt, Bordetella pertussis
guccguggcgcgg

SEQ ID NO: 317697 - RNA, 14 nt, Bordetella pertussis
guccguggcggccg

SEQ ID NO: 317698 - RNA, 15 nt, Bordetella pertussis
guccguggcggccgc

SEQ ID NO: 317699 - RNA, 17 nt, Bordetella pertussis
guccguggcggccgcgg

SEQ ID NO: 317700 - RNA, 23 nt, Bordetella pertussis
guccguggcggccgcgggcagca

SEQ ID NO: 317701 - RNA, 20 nt, Bordetella pertussis
guccguguucgacgcggccg

SEQ ID NO: 317702 - RNA, 16 nt, Bordetella pertussis
guccguuucgucggcg

SEQ ID NO: 317703 - RNA, 17 nt, Bordetella pertussis
guccuaaauugccgcga

SEQ ID NO: 317704 - RNA, 15 nt, Bordetella pertussis
guccucaugcgggac

SEQ ID NO: 317705 - RNA, 20 nt, Bordetella pertussis
guccucaugcgggacaggcg

SEQ ID NO: 317706 - RNA, 13 nt, Bordetella pertussis
guccucgccgguc

SEQ ID NO: 317707 - RNA, 13 nt, Bordetella pertussis
guccucggccacg

SEQ ID NO: 317708 - RNA, 16 nt, Bordetella pertussis
guccucggccagccgg

SEQ ID NO: 317709 - RNA, 18 nt, Bordetella pertussis
guccucggccagccgggc

SEQ ID NO: 317710 - RNA, 14 nt, Bordetella pertussis
guccucggccuggc

SEQ ID NO: 317711 - RNA, 17 nt, Bordetella pertussis
guccucggccuggcccc

SEQ ID NO: 317712 - RNA, 21 nt, Bordetella pertussis
guccucgucggccaugcgcgc

SEQ ID NO: 317713 - RNA, 16 nt, Bordetella pertussis
guccucgucggcgaag

SEQ ID NO: 317714 - RNA, 17 nt, Bordetella pertussis
guccugaccggcggcgc

SEQ ID NO: 317715 - RNA, 16 nt, Bordetella pertussis
guccugaucgaggagc

SEQ ID NO: 317716 - RNA, 14 nt, Bordetella pertussis
guccugcagcaggg

SEQ ID NO: 317717 - RNA, 21 nt, Bordetella pertussis
guccugcagcagggucaugau

SEQ ID NO: 317718 - RNA, 19 nt, Bordetella pertussis
guccugcaggcccggcgcg

SEQ ID NO: 317719 - RNA, 20 nt, Bordetella pertussis
guccugcaggcccggcgcga

SEQ ID NO: 317720 - RNA, 22 nt, Bordetella pertussis
guccugcaggcccggcgcgacg

SEQ ID NO: 317721 - RNA, 16 nt, Bordetella pertussis
guccugcaggcggcgc

SEQ ID NO: 317722 - RNA, 22 nt, Bordetella pertussis
guccugcaggcggcgcaucagc

SEQ ID NO: 317723 - RNA, 14 nt, Bordetella pertussis
guccugcaucgcca

SEQ ID NO: 317724 - RNA, 15 nt, Bordetella pertussis
guccugcaugccaug

SEQ ID NO: 317725 - RNA, 13 nt, Bordetella pertussis
guccugcgcgccg

SEQ ID NO: 317726 - RNA, 23 nt, Bordetella pertussis
guccugcucggugcucuggcccg

SEQ ID NO: 317727 - RNA, 14 nt, Bordetella pertussis
guccugcugaucca

SEQ ID NO: 317728 - RNA, 16 nt, Bordetella pertussis
guccugcugcggcacg

SEQ ID NO: 317729 - RNA, 17 nt, Bordetella pertussis
guccugcgugauggcgu

SEQ ID NO: 317730 - RNA, 16 nt, Bordetella pertussis
guccuggacagugccc

SEQ ID NO: 317731 - RNA, 19 nt, Bordetella pertussis
guccuggacagugcccuga

SEQ ID NO: 317732 - RNA, 13 nt, Bordetella pertussis
guccuggcgaccg

SEQ ID NO: 317733 - RNA, 17 nt, Bordetella pertussis
guccuggcgaccggcgg

SEQ ID NO: 317734 - RNA, 18 nt, Bordetella pertussis
guccuggcgaccggcggc

SEQ ID NO: 317735 - RNA, 13 nt, Bordetella pertussis
guccuggcggccg

SEQ ID NO: 317736 - RNA, 22 nt, Bordetella pertussis
guccuggcggccgcccagcaga

SEQ ID NO: 317737 - RNA, 18 nt, Bordetella pertussis
guccugggccgagcgcgc

SEQ ID NO: 317738 - RNA, 14 nt, Bordetella pertussis
guccugggccguca

SEQ ID NO: 317739 - RNA, 20 nt, Bordetella pertussis
guccugggccgucaugcgcc

SEQ ID NO: 317740 - RNA, 22 nt, Bordetella pertussis
guccugguaagaaaccuggccc

SEQ ID NO: 317741 - RNA, 20 nt, Bordetella pertussis
guccugguagaucagcgcgu

SEQ ID NO: 317742 - RNA, 16 nt, Bordetella pertussis
gucgaagccggugaug

SEQ ID NO: 317743 - RNA, 16 nt, Bordetella pertussis
gucgaaggccgccgga

SEQ ID NO: 317744 - RNA, 16 nt, Bordetella pertussis
gucgaaggcggccggc

SEQ ID NO: 317745 - RNA, 18 nt, Bordetella pertussis
gucgaauuucccgggugg

SEQ ID NO: 317746 - RNA, 20 nt, Bordetella pertussis
gucgaauuucccggguggcg

SEQ ID NO: 317747 - RNA, 16 nt, Bordetella pertussis
gucgaauuccgggacg

SEQ ID NO: 317748 - RNA, 20 nt, Bordetella pertussis
gucgacaccaaccugcuggc

SEQ ID NO: 317749 - RNA, 20 nt, Bordetella pertussis
gucgacauagacgcgcagcg

SEQ ID NO: 317750 - RNA, 15 nt, Bordetella pertussis
gucgaccacgccggc

SEQ ID NO: 317751 - RNA, 18 nt, Bordetella pertussis
gucgaccacgccggcggc

SEQ ID NO: 317752 - RNA, 20 nt, Bordetella pertussis
gucgaccacgccggcggcca

SEQ ID NO: 317753 - RNA, 21 nt, Bordetella pertussis
gucgaccgacagcacauggcg

SEQ ID NO: 317754 - RNA, 14 nt, Bordetella pertussis
gucgaccaccagca

SEQ ID NO: 317755 - RNA, 23 nt, Bordetella pertussis
gucgaccgccucgacgcccgggc

SEQ ID NO: 317756 - RNA, 15 nt, Bordetella pertussis
gucgaccgcgaagcc

SEQ ID NO: 317757 - RNA, 19 nt, Bordetella pertussis
gucgaccgcgaagcgcgcc

SEQ ID NO: 317758 - RNA, 23 nt, Bordetella pertussis
gucgaccgcgaagcgcgccagca

SEQ ID NO: 317759 - RNA, 15 nt, Bordetella pertussis
gucgaccgcgggcgc

SEQ ID NO: 317760 - RNA, 14 nt, Bordetella pertussis
gucgaccggcccgc

SEQ ID NO: 317761 - RNA, 23 nt, Bordetella pertussis
gucgaccggaaucaccgccgcga

SEQ ID NO: 317762 - RNA, 16 nt, Bordetella pertussis
gucgaccucgagcacc

SEQ ID NO: 317763 - RNA, 17 nt, Bordetella pertussis
gucgaccucgagcaccu

SEQ ID NO: 317764 - RNA, 20 nt, Bordetella pertussis
gucgacgcugaucggccgac

SEQ ID NO: 317765 - RNA, 16 nt, Bordetella pertussis
gucgacguccuggugg

SEQ ID NO: 317766 - RNA, 22 nt, Bordetella pertussis
gucgacguuaugcucgcgcaug

SEQ ID NO: 317767 - RNA, 21 nt, Bordetella pertussis
gucgacguugcgcgacaggcc

SEQ ID NO: 317768 - RNA, 14 nt, Bordetella pertussis
gucgacuucgaccc

SEQ ID NO: 317769 - RNA, 21 nt, Bordetella pertussis
gucgagccgggccacgcgcac

SEQ ID NO: 317770 - RNA, 13 nt, Bordetella pertussis
gucgagccgggcg

SEQ ID NO: 317771 - RNA, 17 nt, Bordetella pertussis
gucgagccgggcgccga

SEQ ID NO: 317772 - RNA, 17 nt, Bordetella pertussis
gucgagcgccugcgcca

SEQ ID NO: 317773 - RNA, 15 nt, Bordetella pertussis
gucgagcgcgacgcg

SEQ ID NO: 317774 - RNA, 20 nt, Bordetella pertussis
gucgagcgcgacgcgcucgu

SEQ ID NO: 317775 - RNA, 13 nt, Bordetella pertussis
gucgagcgcgaug

SEQ ID NO: 317776 - RNA, 14 nt, Bordetella pertussis
gucgagcgcggcca

SEQ ID NO: 317777 - RNA, 16 nt, Bordetella pertussis
gucgagcgcggccagg

SEQ ID NO: 317778 - RNA, 17 nt, Bordetella pertussis
gucgagcgcggccaggc

SEQ ID NO: 317779 - RNA, 16 nt, Bordetella pertussis
gucgagcgcucgcuca

SEQ ID NO: 317780 - RNA, 19 nt, Bordetella pertussis
gucgagcugcucgagcaug

SEQ ID NO: 317781 - RNA, 16 nt, Bordetella pertussis
gucgaguucggcgcgc

SEQ ID NO: 317782 - RNA, 18 nt, Bordetella pertussis
gucgaguugcgcgccaug

SEQ ID NO: 317783 - RNA, 15 nt, Bordetella pertussis
gucgaucagccacgu

SEQ ID NO: 317784 - RNA, 15 nt, Bordetella pertussis
gucgaucagggcgcg

SEQ ID NO: 317785 - RNA, 19 nt, Bordetella pertussis
gucgaucagggcgcggacu

SEQ ID NO: 317786 - RNA, 18 nt, Bordetella pertussis
gucgcaggccgcggccag

SEQ ID NO: 317787 - RNA, 20 nt, Bordetella pertussis
gucgcaggccgcggccaggc

SEQ ID NO: 317788 - RNA, 14 nt, Bordetella pertussis
gucgcagucggggc

SEQ ID NO: 317789 - RNA, 17 nt, Bordetella pertussis
gucgcaguucggccuca

SEQ ID NO: 317790 - RNA, 15 nt, Bordetella pertussis
gucgcauuggccgcc

SEQ ID NO: 317791 - RNA, 12 nt, Bordetella pertussis
gucgccagcacg

SEQ ID NO: 317792 - RNA, 12 nt, Bordetella pertussis
gucgccagcagg

SEQ ID NO: 317793 - RNA, 22 nt, Bordetella pertussis
gucgccagggcgaugaccggca

SEQ ID NO: 317794 - RNA, 16 nt, Bordetella pertussis
gucgccaucggccggc

SEQ ID NO: 317795 - RNA, 17 nt, Bordetella pertussis
gucgcccggggcggcgu

SEQ ID NO: 317796 - RNA, 17 nt, Bordetella pertussis
gucgccgaucggcuugc

SEQ ID NO: 317797 - RNA, 16 nt, Bordetella pertussis
gucgccgccgcgcacc

SEQ ID NO: 317798 - RNA, 16 nt, Bordetella pertussis
gucgccgccgcgccga

SEQ ID NO: 317799 - RNA, 13 nt, Bordetella pertussis
gucgccgcgcacg

SEQ ID NO: 317800 - RNA, 13 nt, Bordetella pertussis
gucgccgcgcccg

SEQ ID NO: 317801 - RNA, 12 nt, Bordetella pertussis
gucgccgcgccg

SEQ ID NO: 317802 - RNA, 14 nt, Bordetella pertussis
gucgccgcgcggcg

SEQ ID NO: 317803 - RNA, 15 nt, Bordetella pertussis
gucgccgcggccggc

SEQ ID NO: 317804 - RNA, 23 nt, Bordetella pertussis
gucgccgcgggcaaagcccagca

SEQ ID NO: 317805 - RNA, 14 nt, Bordetella pertussis
gucgccgcugccgg

SEQ ID NO: 317806 - RNA, 22 nt, Bordetella pertussis
gucgccgcugcgcuugaccgcc

SEQ ID NO: 317807 - RNA, 23 nt, Bordetella pertussis
gucgccgcuggacagauccagcg

SEQ ID NO: 317808 - RNA, 20 nt, Bordetella pertussis
gucgccgcuggccagccgcu

SEQ ID NO: 317809 - RNA, 16 nt, Bordetella pertussis
gucgcgaccucggcgg

SEQ ID NO: 317810 - RNA, 17 nt, Bordetella pertussis
gucgcgaccucggcggc

SEQ ID NO: 317811 - RNA, 14 nt, Bordetella pertussis
gucgcgaccgccgc

SEQ ID NO: 317812 - RNA, 16 nt, Bordetella pertussis
gucgcgagcugcgcga

SEQ ID NO: 317813 - RNA, 19 nt, Bordetella pertussis
gucgcgaucgucgaccgcg

SEQ ID NO: 317814 - RNA, 13 nt, Bordetella pertussis
gucgcgaugcgcc

SEQ ID NO: 317815 - RNA, 16 nt, Bordetella pertussis
gucgcgaugcgccagg

SEQ ID NO: 317816 - RNA, 20 nt, Bordetella pertussis
gucgcgaugcgccaggcgcu

SEQ ID NO: 317817 - RNA, 15 nt, Bordetella pertussis
gucgcgcaacgccgg

SEQ ID NO: 317818 - RNA, 20 nt, Bordetella pertussis
gucgcgcaacgccgggucga

SEQ ID NO: 317819 - RNA, 17 nt, Bordetella pertussis
gucgcgcaauacgccgc

SEQ ID NO: 317820 - RNA, 20 nt, Bordetella pertussis
gucgcgcaauacgccgccgg

SEQ ID NO: 317821 - RNA, 21 nt, Bordetella pertussis
gucgcgcaauacgccgccggc

SEQ ID NO: 317822 - RNA, 22 nt, Bordetella pertussis
gucgcgcaauacgccgccggcg

SEQ ID NO: 317823 - RNA, 23 nt, Bordetella pertussis
gucgcgcaauacgccgccggcgc

SEQ ID NO: 317824 - RNA, 22 nt, Bordetella pertussis
gucgcgcaauacgugcgcgacg

SEQ ID NO: 317825 - RNA, 20 nt, Bordetella pertussis
gucgcgcacccgcaggccgu

SEQ ID NO: 317826 - RNA, 21 nt, Bordetella pertussis
gucgcgcaccuguucggcggc

SEQ ID NO: 317827 - RNA, 22 nt, Bordetella pertussis
gucgcgcaccuguucggcggcg

SEQ ID NO: 317828 - RNA, 16 nt, Bordetella pertussis
gucgcgcacgaagccg

SEQ ID NO: 317829 - RNA, 13 nt, Bordetella pertussis
gucgcgcacgcug

SEQ ID NO: 317830 - RNA, 15 nt, Bordetella pertussis
gucgcgcacgcuggc

SEQ ID NO: 317831 - RNA, 21 nt, Bordetella pertussis
gucgcgcagcagggccuggca

SEQ ID NO: 317832 - RNA, 19 nt, Bordetella pertussis
gucgcgcagcgccgccacc

SEQ ID NO: 317833 - RNA, 21 nt, Bordetella pertussis
gucgcgcagcugccugagcac

SEQ ID NO: 317834 - RNA, 22 nt, Bordetella pertussis
gucgcgcagcugccugagcacc

SEQ ID NO: 317835 - RNA, 18 nt, Bordetella pertussis
gucgcggaugcgcgccuu

SEQ ID NO: 317836 - RNA, 16 nt, Bordetella pertussis
gucgcggcccacggcc

SEQ ID NO: 317837 - RNA, 20 nt, Bordetella pertussis
gucgcggcccacggccagca

SEQ ID NO: 317838 - RNA, 17 nt, Bordetella pertussis
gucgcggcccugggcca

SEQ ID NO: 317839 - RNA, 12 nt, Bordetella pertussis
gucgcggccgag

SEQ ID NO: 317840 - RNA, 16 nt, Bordetella pertussis
gucgcgggugcgggca

SEQ ID NO: 317841 - RNA, 14 nt, Bordetella pertussis
gucgcgguccagca

SEQ ID NO: 317842 - RNA, 16 nt, Bordetella pertussis
gucgcguagcgcggcc

SEQ ID NO: 317843 - RNA, 17 nt, Bordetella pertussis
gucgcguagcgcggccg

SEQ ID NO: 317844 - RNA, 22 nt, Bordetella pertussis
gucgcguagcgcggccgggucg

SEQ ID NO: 317845 - RNA, 19 nt, Bordetella pertussis
gucgcguccuucgucggcg

SEQ ID NO: 317846 - RNA, 21 nt, Bordetella pertussis
gucgcucaggguacggcgaug

SEQ ID NO: 317847 - RNA, 20 nt, Bordetella pertussis
gucgcucaugaccagcggcg

SEQ ID NO: 317848 - RNA, 18 nt, Bordetella pertussis
gucgcugacuucgccguc

SEQ ID NO: 317849 - RNA, 14 nt, Bordetella pertussis
gucgcugcccagca

SEQ ID NO: 317850 - RNA, 14 nt, Bordetella pertussis
gucgcugcgcgacg

SEQ ID NO: 317851 - RNA, 17 nt, Bordetella pertussis
gucgcugcucgacagca

SEQ ID NO: 317852 - RNA, 13 nt, Bordetella pertussis
gucgcugcuggcg

SEQ ID NO: 317853 - RNA, 16 nt, Bordetella pertussis
gucgcugcuggcggcg

SEQ ID NO: 317854 - RNA, 17 nt, Bordetella pertussis
gucgcugcuggcggcgc

SEQ ID NO: 317855 - RNA, 17 nt, Bordetella pertussis
gucgcuggcgccggugc

SEQ ID NO: 317856 - RNA, 18 nt, Bordetella pertussis
gucgcuggcgccggugca

SEQ ID NO: 317857 - RNA, 19 nt, Bordetella pertussis
gucgcuggcgccggugcag

SEQ ID NO: 317858 - RNA, 19 nt, Bordetella pertussis
gucggaaacacguccagcg

SEQ ID NO: 317859 - RNA, 13 nt, Bordetella pertussis
gucggacaacgcc

SEQ ID NO: 317860 - RNA, 16 nt, Bordetella pertussis
gucggacaacgccagg

SEQ ID NO: 317861 - RNA, 15 nt, Bordetella pertussis
gucggacaacugcgc

SEQ ID NO: 317862 - RNA, 16 nt, Bordetella pertussis
gucggacgcgccgggc

SEQ ID NO: 317863 - RNA, 15 nt, Bordetella pertussis
gucggacgcgcgccg

SEQ ID NO: 317864 - RNA, 17 nt, Bordetella pertussis
gucggacgcgcgccgca

SEQ ID NO: 317865 - RNA, 14 nt, Bordetella pertussis
gucggagucggcgc

SEQ ID NO: 317866 - RNA, 19 nt, Bordetella pertussis
gucggcaccuucgcgcagc

SEQ ID NO: 317867 - RNA, 14 nt, Bordetella pertussis
gucggcacgacgcu

SEQ ID NO: 317868 - RNA, 13 nt, Bordetella pertussis
gucggcaggugca

SEQ ID NO: 317869 - RNA, 16 nt, Bordetella pertussis
gucggcauggccagga

SEQ ID NO: 317870 - RNA, 23 nt, Bordetella pertussis
gucggcauggccaggaagaacga

SEQ ID NO: 317871 - RNA, 18 nt, Bordetella pertussis
gucggcauggccaucgcg

SEQ ID NO: 317872 - RNA, 18 nt, Bordetella pertussis
gucggcaugucgaugccg

SEQ ID NO: 317873 - RNA, 20 nt, Bordetella pertussis
gucggccaaggccggcgcgu

SEQ ID NO: 317874 - RNA, 19 nt, Bordetella pertussis
gucggccaccaggccgucg

SEQ ID NO: 317875 - RNA, 22 nt, Bordetella pertussis
gucggccaccaggccgucggcc

SEQ ID NO: 317876 - RNA, 13 nt, Bordetella pertussis
gucggccaccagg

SEQ ID NO: 317877 - RNA, 19 nt, Bordetella pertussis
gucggccacguccggguug

SEQ ID NO: 317878 - RNA, 14 nt, Bordetella pertussis
gucggccagcgcga

SEQ ID NO: 317879 - RNA, 14 nt, Bordetella pertussis
gucggccagccggc

SEQ ID NO: 317880 - RNA, 22 nt, Bordetella pertussis
gucggccagcgugccggugacg

SEQ ID NO: 317881 - RNA, 13 nt, Bordetella pertussis
gucggccagcuug

SEQ ID NO: 317882 - RNA, 15 nt, Bordetella pertussis
gucggccaggcgcca

SEQ ID NO: 317883 - RNA, 15 nt, Bordetella pertussis
gucggccagggcggc

SEQ ID NO: 317884 - RNA, 19 nt, Bordetella pertussis
gucggccagggcggcgacu

SEQ ID NO: 317885 - RNA, 14 nt, Bordetella pertussis
gucggccaggcgcc

SEQ ID NO: 317886 - RNA, 12 nt, Bordetella pertussis
gucggccagggg

SEQ ID NO: 317887 - RNA, 14 nt, Bordetella pertussis
gucggccaggggca

SEQ ID NO: 317888 - RNA, 18 nt, Bordetella pertussis
gucggccaugcgcgccag

SEQ ID NO: 317889 - RNA, 17 nt, Bordetella pertussis
gucggccauggcgcugu

SEQ ID NO: 317890 - RNA, 18 nt, Bordetella pertussis
gucggcccugucggccga

SEQ ID NO: 317891 - RNA, 13 nt, Bordetella pertussis
gucggccgaaccg

SEQ ID NO: 317892 - RNA, 14 nt, Bordetella pertussis
gucggccgaccacu

SEQ ID NO: 317893 - RNA, 12 nt, Bordetella pertussis
gucggccgccag

SEQ ID NO: 317894 - RNA, 13 nt, Bordetella pertussis
gucggccgccagc

SEQ ID NO: 317895 - RNA, 14 nt, Bordetella pertussis
gucggccgccagcc

SEQ ID NO: 317896 - RNA, 17 nt, Bordetella pertussis
gucggccgcgcccaggu

SEQ ID NO: 317897 - RNA, 13 nt, Bordetella pertussis
gucggccgcgccg

SEQ ID NO: 317898 - RNA, 16 nt, Bordetella pertussis
gucggccgcgcgcauc

SEQ ID NO: 317899 - RNA, 15 nt, Bordetella pertussis
gucggccggcaaggu

SEQ ID NO: 317900 - RNA, 21 nt, Bordetella pertussis
gucggccggcagcggcgccau

SEQ ID NO: 317901 - RNA, 22 nt, Bordetella pertussis
gucggccggcagcggcgccaug

SEQ ID NO: 317902 - RNA, 14 nt, Bordetella pertussis
gucggccgccgccg

SEQ ID NO: 317903 - RNA, 14 nt, Bordetella pertussis
gucggccgccguga

SEQ ID NO: 317904 - RNA, 16 nt, Bordetella pertussis
gucggccucggcgaag

SEQ ID NO: 317905 - RNA, 15 nt, Bordetella pertussis
gucggccugcacgcu

SEQ ID NO: 317906 - RNA, 14 nt, Bordetella pertussis
gucggccuggcgcu

SEQ ID NO: 317907 - RNA, 19 nt, Bordetella pertussis
gucggccugguccgccgcg

SEQ ID NO: 317908 - RNA, 20 nt, Bordetella pertussis
gucggccuucugcgccagcg

SEQ ID NO: 317909 - RNA, 16 nt, Bordetella pertussis
gucggcgaugaacagg

SEQ ID NO: 317910 - RNA, 12 nt, Bordetella pertussis
gucggcgaugcg

SEQ ID NO: 317911 - RNA, 15 nt, Bordetella pertussis
gucggcgaugcgcgg

SEQ ID NO: 317912 - RNA, 22 nt, Bordetella pertussis
gucggcgaugcgcggggccggu

SEQ ID NO: 317913 - RNA, 17 nt, Bordetella pertussis
gucggcgauggcccggu

SEQ ID NO: 317914 - RNA, 21 nt, Bordetella pertussis
gucggcgauggcgcgcgccac

SEQ ID NO: 317915 - RNA, 22 nt, Bordetella pertussis
gucggcgcagauggcggcgaug

SEQ ID NO: 317916 - RNA, 19 nt, Bordetella pertussis
gucggcgccacaggugcgc

SEQ ID NO: 317917 - RNA, 23 nt, Bordetella pertussis
gucggcgccacaggugcgcggcg

SEQ ID NO: 317918 - RNA, 18 nt, Bordetella pertussis
gucggcgccaugcuggcc

SEQ ID NO: 317919 - RNA, 20 nt, Bordetella pertussis
gucggcgcccacgccgaaua

SEQ ID NO: 317920 - RNA, 12 nt, Bordetella pertussis
gucggcgcccag

SEQ ID NO: 317921 - RNA, 14 nt, Bordetella pertussis
gucggcgcgcgcca

SEQ ID NO: 317922 - RNA, 15 nt, Bordetella pertussis
gucggcgcgcgccag

SEQ ID NO: 317923 - RNA, 15 nt, Bordetella pertussis
gucggcgcggcgccg

SEQ ID NO: 317924 - RNA, 13 nt, Bordetella pertussis
gucggcgcggucg

SEQ ID NO: 317925 - RNA, 11 nt, Bordetella pertussis
gucggcgcugg

SEQ ID NO: 317926 - RNA, 12 nt, Bordetella pertussis
gucggcgcuggc

SEQ ID NO: 317927 - RNA, 14 nt, Bordetella pertussis
gucggcgcuggcca

SEQ ID NO: 317928 - RNA, 19 nt, Bordetella pertussis
gucggcgcgguauucgcgc

SEQ ID NO: 317929 - RNA, 12 nt, Bordetella pertussis
gucggcgcgguc

SEQ ID NO: 317930 - RNA, 15 nt, Bordetella pertussis
gucggcgcuggcgcg

SEQ ID NO: 317931 - RNA, 14 nt, Bordetella pertussis
gucggcggccagca

SEQ ID NO: 317932 - RNA, 20 nt, Bordetella pertussis
gucggcggccagcagcggca

SEQ ID NO: 317933 - RNA, 14 nt, Bordetella pertussis
gucggcggccagcg

SEQ ID NO: 317934 - RNA, 17 nt, Bordetella pertussis
gucggcggccagcgcgc

SEQ ID NO: 317935 - RNA, 22 nt, Bordetella pertussis
gucggcguaaggccgccggcca

SEQ ID NO: 317936 - RNA, 20 nt, Bordetella pertussis
gucggcguccauuagggccc

SEQ ID NO: 317937 - RNA, 18 nt, Bordetella pertussis
gucggcguuccuggcgcu

SEQ ID NO: 317938 - RNA, 17 nt, Bordetella pertussis
gugauaugcgccaggcc

SEQ ID NO: 317939 - RNA, 18 nt, Bordetella pertussis
gugaucaccgccauggcg

SEQ ID NO: 317940 - RNA, 20 nt, Bordetella pertussis
gugaucgaguaggccggcac

SEQ ID NO: 317941 - RNA, 15 nt, Bordetella pertussis
gugaucgccagcgcc

SEQ ID NO: 317942 - RNA, 15 nt, Bordetella pertussis
gugaucgcgcgggcu

SEQ ID NO: 317943 - RNA, 22 nt, Bordetella pertussis
gugaucugcucgccgcgcgaca

SEQ ID NO: 317944 - RNA, 19 nt, Bordetella pertussis
gugaucuugaugccgccca

SEQ ID NO: 317945 - RNA, 23 nt, Bordetella pertussis
gugaucuugccgaugcggcgcau

SEQ ID NO: 317946 - RNA, 23 nt, Bordetella pertussis
gugaugcccaggcccuggcuggc

SEQ ID NO: 317947 - RNA, 10 nt, Bordetella pertussis
gugaugccga

SEQ ID NO: 317948 - RNA, 17 nt, Bordetella pertussis
gugaugccgucgagcgc

SEQ ID NO: 317949 - RNA, 21 nt, Bordetella pertussis
gugaugccgucgagcgcggcc

SEQ ID NO: 317950 - RNA, 20 nt, Bordetella pertussis
gugaugcgcgcggccagcgc

SEQ ID NO: 317951 - RNA, 20 nt, Bordetella pertussis
gugauggauuucgaccgcau

SEQ ID NO: 317952 - RNA, 14 nt, Bordetella pertussis
gugauggcguagcc

SEQ ID NO: 317953 - RNA, 13 nt, Bordetella pertussis
gugaugggcgcau

SEQ ID NO: 317954 - RNA, 17 nt, Bordetella pertussis
gugauguccugcaggcc

SEQ ID NO: 317955 - RNA, 22 nt, Bordetella pertussis
gugauuguccugcacgaagcgg

SEQ ID NO: 317956 - RNA, 16 nt, Bordetella pertussis
gugcaagcggccggcc

SEQ ID NO: 317957 - RNA, 19 nt, Bordetella pertussis
gugcaagcggccggccugc

SEQ ID NO: 317958 - RNA, 14 nt, Bordetella pertussis
gugcacgugggcac

SEQ ID NO: 317959 - RNA, 22 nt, Bordetella pertussis
gugcacgugggcacgccggccu

SEQ ID NO: 317960 - RNA, 23 nt, Bordetella pertussis
gugcacgguggauucggacgccu

SEQ ID NO: 317961 - RNA, 16 nt, Bordetella pertussis
gugcagaucugcacgc

SEQ ID NO: 317962 - RNA, 16 nt, Bordetella pertussis
gugcagcaacgccggc

SEQ ID NO: 317963 - RNA, 17 nt, Bordetella pertussis
gugcagcaacgccggcg

SEQ ID NO: 317964 - RNA, 20 nt, Bordetella pertussis
gugcagcaacgccggcggca

SEQ ID NO: 317965 - RNA, 16 nt, Bordetella pertussis
gugcagcaagcccacc

SEQ ID NO: 317966 - RNA, 18 nt, Bordetella pertussis
gugcagccacgccuggcc

SEQ ID NO: 317967 - RNA, 13 nt, Bordetella pertussis
gugcagccagcgg

SEQ ID NO: 317968 - RNA, 17 nt, Bordetella pertussis
gugcagccagcggccga

SEQ ID NO: 317969 - RNA, 18 nt, Bordetella pertussis
gugcagccagcggccgau

SEQ ID NO: 317970 - RNA, 16 nt, Bordetella pertussis
gugcaggggccgcacg

SEQ ID NO: 317971 - RNA, 17 nt, Bordetella pertussis
gugcaggggccgcacgc

SEQ ID NO: 317972 - RNA, 21 nt, Bordetella pertussis
gugcaggggccgcacgcgcgg

SEQ ID NO: 317973 - RNA, 19 nt, Bordetella pertussis
gugcaggguuggcgcgccg

SEQ ID NO: 317974 - RNA, 19 nt, Bordetella pertussis
gugcaggggguggcggccg

SEQ ID NO: 317975 - RNA, 23 nt, Bordetella pertussis
gugcaggggguggcggccgucgg

SEQ ID NO: 317976 - RNA, 15 nt, Bordetella pertussis
gugcaucaucugggc

SEQ ID NO: 317977 - RNA, 20 nt, Bordetella pertussis
gugcaucaucugggcgucga

SEQ ID NO: 317978 - RNA, 21 nt, Bordetella pertussis
gugcaucccaauuggccgccc

SEQ ID NO: 317979 - RNA, 15 nt, Bordetella pertussis
gugccaccgcccagg

SEQ ID NO: 317980 - RNA, 21 nt, Bordetella pertussis
gugccagauauccuugaggau

SEQ ID NO: 317981 - RNA, 13 nt, Bordetella pertussis
gugcccagcacca

SEQ ID NO: 317982 - RNA, 16 nt, Bordetella pertussis
gugcccagcaccaggc

SEQ ID NO: 317983 - RNA, 18 nt, Bordetella pertussis
gugcccagcaccaggccg

SEQ ID NO: 317984 - RNA, 19 nt, Bordetella pertussis
gugcccagcaccaggccga

SEQ ID NO: 317985 - RNA, 13 nt, Bordetella pertussis
gugcccagcuggc

SEQ ID NO: 317986 - RNA, 18 nt, Bordetella pertussis
gugcccaguucgcggccg

SEQ ID NO: 317987 - RNA, 20 nt, Bordetella pertussis
gugcccaguucgcggccggc

SEQ ID NO: 317988 - RNA, 13 nt, Bordetella pertussis
gugcccaucgcgc

SEQ ID NO: 317989 - RNA, 15 nt, Bordetella pertussis
gugccccacacgcgc

SEQ ID NO: 317990 - RNA, 15 nt, Bordetella pertussis
gugccccaugcgcgg

SEQ ID NO: 317991 - RNA, 18 nt, Bordetella pertussis
gugcccccacgcugcgcc

SEQ ID NO: 317992 - RNA, 15 nt, Bordetella pertussis
gugccccgccggagg

SEQ ID NO: 317993 - RNA, 14 nt, Bordetella pertussis
gugccccggccucg

SEQ ID NO: 317994 - RNA, 17 nt, Bordetella pertussis
gugccccggccucgcgg

SEQ ID NO: 317995 - RNA, 20 nt, Bordetella pertussis
gugcccugacccgcuggcug

SEQ ID NO: 317996 - RNA, 21 nt, Bordetella pertussis
gugcccugacccgcuggcugg

SEQ ID NO: 317997 - RNA, 18 nt, Bordetella pertussis
gugccgacgaugccgccg

SEQ ID NO: 317998 - RNA, 22 nt, Bordetella pertussis
gugccgcguaugcggcagcagg

SEQ ID NO: 317999 - RNA, 23 nt, Bordetella pertussis
gugccgcguaugcggcagcaggg

SEQ ID NO: 318000 - RNA, 12 nt, Bordetella pertussis
gugccgcuggcg

SEQ ID NO: 318001 - RNA, 24 nt, Bordetella pertussis
gugccgcuggcggcccugccgauc

SEQ ID NO: 318002 - RNA, 14 nt, Bordetella pertussis
gugccggacgccga

SEQ ID NO: 318003 - RNA, 15 nt, Bordetella pertussis
gugccggacgccgac

SEQ ID NO: 318004 - RNA, 18 nt, Bordetella pertussis
gugccggacgccgacugg

SEQ ID NO: 318005 - RNA, 22 nt, Bordetella pertussis
gugccggagcccgucaggcgga

SEQ ID NO: 318006 - RNA, 16 nt, Bordetella pertussis
gugccggauggcgcgg

SEQ ID NO: 318007 - RNA, 13 nt, Bordetella pertussis
gugccggccagcc

SEQ ID NO: 318008 - RNA, 22 nt, Bordetella pertussis
gugccggccgccuccaggcggc

SEQ ID NO: 318009 - RNA, 17 nt, Bordetella pertussis
gugccguucccgccggg

SEQ ID NO: 318010 - RNA, 17 nt, Bordetella pertussis
gugccguucggccagcg

SEQ ID NO: 318011 - RNA, 21 nt, Bordetella pertussis
gugccucaacuggccggccug

SEQ ID NO: 318012 - RNA, 23 nt, Bordetella pertussis
gugccucaacuggccggccuggc

SEQ ID NO: 318013 - RNA, 20 nt, Bordetella pertussis
gugccugccccugcggggac

SEQ ID NO: 318014 - RNA, 21 nt, Bordetella pertussis
gugccugcgaacgcccggccc

SEQ ID NO: 318015 - RNA, 12 nt, Bordetella pertussis
gugccugcuugc

SEQ ID NO: 318016 - RNA, 12 nt, Bordetella pertussis
gugcgcaccagg

SEQ ID NO: 318017 - RNA, 15 nt, Bordetella pertussis
gugcgcaccaggccc

SEQ ID NO: 318018 - RNA, 22 nt, Bordetella pertussis
gugcgcacgcguucgggcggca

SEQ ID NO: 318019 - RNA, 19 nt, Bordetella pertussis
gugcgcagcaccagcaugu

SEQ ID NO: 318020 - RNA, 14 nt, Bordetella pertussis
gugcgcagccgggc

SEQ ID NO: 318021 - RNA, 24 nt, Bordetella pertussis
gugcgcagcggcaggcggcugacg

SEQ ID NO: 318022 - RNA, 15 nt, Bordetella pertussis
gugcgcaucagcgca

SEQ ID NO: 318023 - RNA, 13 nt, Bordetella pertussis
gugcgccgccggc

SEQ ID NO: 318024 - RNA, 12 nt, Bordetella pertussis
gugcgccgcgcc

SEQ ID NO: 318025 - RNA, 14 nt, Bordetella pertussis
gugcgccggcgcgg

SEQ ID NO: 318026 - RNA, 16 nt, Bordetella pertussis
gugcgccggcgcggcg

SEQ ID NO: 318027 - RNA, 17 nt, Bordetella pertussis
gugcgccgugcccggcg

SEQ ID NO: 318028 - RNA, 20 nt, Bordetella pertussis
gugcgccgugcccggcgggc

SEQ ID NO: 318029 - RNA, 17 nt, Bordetella pertussis
gugcgccugcagcgccg

SEQ ID NO: 318030 - RNA, 18 nt, Bordetella pertussis
gugcgccugcagcgccgc

SEQ ID NO: 318031 - RNA, 16 nt, Bordetella pertussis
gugcgcgaccgcgcgg

SEQ ID NO: 318032 - RNA, 22 nt, Bordetella pertussis
gugcgcgccaggucgcgcacca

SEQ ID NO: 318033 - RNA, 15 nt, Bordetella pertussis
gugcgcgcgccccca

SEQ ID NO: 318034 - RNA, 22 nt, Bordetella pertussis
gugcgcgcgcccccagcgccgu

SEQ ID NO: 318035 - RNA, 13 nt, Bordetella pertussis
gugcgcgcggccg

SEQ ID NO: 318036 - RNA, 12 nt, Bordetella pertussis
gugcgcggccgc

SEQ ID NO: 318037 - RNA, 12 nt, Bordetella pertussis
gugcgcggcgca

SEQ ID NO: 318038 - RNA, 17 nt, Bordetella pertussis
gugcgcggcgcagccca

SEQ ID NO: 318039 - RNA, 13 nt, Bordetella pertussis
gugcgcggcgccc

SEQ ID NO: 318040 - RNA, 13 nt, Bordetella pertussis
gugcgcggcgugu

SEQ ID NO: 318041 - RNA, 13 nt, Bordetella pertussis
gugcgcgggcgcg

SEQ ID NO: 318042 - RNA, 16 nt, Bordetella pertussis
gugcgcguuccggccg

SEQ ID NO: 318043 - RNA, 19 nt, Bordetella pertussis
gugcgcuggcugggccugc

SEQ ID NO: 318044 - RNA, 14 nt, Bordetella pertussis
gugcggggcggcag

SEQ ID NO: 318045 - RNA, 15 nt, Bordetella pertussis
gugcgggugggcgcg

SEQ ID NO: 318046 - RNA, 18 nt, Bordetella pertussis
gugcgguaggcgcccgac

SEQ ID NO: 318047 - RNA, 21 nt, Bordetella pertussis
gugcguuccaugacguccagc

SEQ ID NO: 318048 - RNA, 22 nt, Bordetella pertussis
gugcguuccaugacguccagcg

SEQ ID NO: 318049 - RNA, 16 nt, Bordetella pertussis
gugcguugccagccca

SEQ ID NO: 318050 - RNA, 14 nt, Bordetella pertussis
gugcuccaccacca

SEQ ID NO: 318051 - RNA, 22 nt, Bordetella pertussis
gugcugaacgccucgggcuuga

SEQ ID NO: 318052 - RNA, 21 nt, Bordetella pertussis
gugcugacgguaagcaccagg

SEQ ID NO: 318053 - RNA, 13 nt, Bordetella pertussis
gugcugcagcgca

SEQ ID NO: 318054 - RNA, 21 nt, Bordetella pertussis
gugcugccaugccgcgcgccu

SEQ ID NO: 318055 - RNA, 15 nt, Bordetella pertussis
gugcugcccugcaug

SEQ ID NO: 318056 - RNA, 16 nt, Bordetella pertussis
gugcugccgccgaugu

SEQ ID NO: 318057 - RNA, 13 nt, Bordetella pertussis
gugcugcgccgcc

SEQ ID NO: 318058 - RNA, 14 nt, Bordetella pertussis
gugcugcgccgccu

SEQ ID NO: 318059 - RNA, 22 nt, Bordetella pertussis
gugcugcgccgccucgaccggc

SEQ ID NO: 318060 - RNA, 17 nt, Bordetella pertussis
gugcugcggcagccagg

SEQ ID NO: 318061 - RNA, 19 nt, Bordetella pertussis
gugcugcucaacggccacc

SEQ ID NO: 318062 - RNA, 15 nt, Bordetella pertussis
gugcugcugcacgug

SEQ ID NO: 318063 - RNA, 19 nt, Bordetella pertussis
gugcugcuguucgccacgc

SEQ ID NO: 318064 - RNA, 14 nt, Bordetella pertussis
gugcuggacccgcu

SEQ ID NO: 318065 - RNA, 15 nt, Bordetella pertussis
gugcuggacccgcug

SEQ ID NO: 318066 - RNA, 17 nt, Bordetella pertussis
gugcuggacccgcugcg

SEQ ID NO: 318067 - RNA, 16 nt, Bordetella pertussis
gugcuggccaacgcca

SEQ ID NO: 318068 - RNA, 15 nt, Bordetella pertussis
gugcuggcgcagcag

SEQ ID NO: 318069 - RNA, 17 nt, Bordetella pertussis
gugcuggcugagcaggc

SEQ ID NO: 318070 - RNA, 20 nt, Bordetella pertussis
gugcugggcggccaggcgga

SEQ ID NO: 318071 - RNA, 14 nt, Bordetella pertussis
gugcugggcggcgg

SEQ ID NO: 318072 - RNA, 16 nt, Bordetella pertussis
gugcugggcggcgggc

SEQ ID NO: 318073 - RNA, 19 nt, Bordetella pertussis
gugcuggugcuggugccgc

SEQ ID NO: 318074 - RNA, 13 nt, Bordetella pertussis
guggccacggccg

SEQ ID NO: 318075 - RNA, 14 nt, Bordetella pertussis
guggccacggccgc

SEQ ID NO: 318076 - RNA, 22 nt, Bordetella pertussis
guggccagcacggcgcacacca

SEQ ID NO: 318077 - RNA, 14 nt, Bordetella pertussis
guggccagccaggc

SEQ ID NO: 318078 - RNA, 20 nt, Bordetella pertussis
guggccagccaggcgguggc

SEQ ID NO: 318079 - RNA, 18 nt, Bordetella pertussis
guggccagcgccgccagc

SEQ ID NO: 318080 - RNA, 20 nt, Bordetella pertussis
guggccagcgccgccagccg

SEQ ID NO: 318081 - RNA, 12 nt, Bordetella pertussis
guggccagcacg

SEQ ID NO: 318082 - RNA, 22 nt, Bordetella pertussis
guggccagcuccaccgggcuga

SEQ ID NO: 318083 - RNA, 17 nt, Bordetella pertussis
guggccagcugcguggc

SEQ ID NO: 318084 - RNA, 16 nt, Bordetella pertussis
guggccaugcaccagc

SEQ ID NO: 318085 - RNA, 16 nt, Bordetella pertussis
guggccaugcugggcg

SEQ ID NO: 318086 - RNA, 23 nt, Bordetella pertussis
guggccaugcugggcgggcuggu

SEQ ID NO: 318087 - RNA, 19 nt, Bordetella pertussis
guggccauggacagcaccg

SEQ ID NO: 318088 - RNA, 13 nt, Bordetella pertussis
guggcccaagccc

SEQ ID NO: 318089 - RNA, 14 nt, Bordetella pertussis
guggcccagcaccg

SEQ ID NO: 318090 - RNA, 17 nt, Bordetella pertussis
guggcccagcaccgccg

SEQ ID NO: 318091 - RNA, 21 nt, Bordetella pertussis
guggcccagcaccgccgccag

SEQ ID NO: 318092 - RNA, 14 nt, Bordetella pertussis
guggcccagccggu

SEQ ID NO: 318093 - RNA, 19 nt, Bordetella pertussis
guggcccagccgcaugccg

SEQ ID NO: 318094 - RNA, 22 nt, Bordetella pertussis
guggccccaggcgugaacgccc

SEQ ID NO: 318095 - RNA, 19 nt, Bordetella pertussis
guggcccgcaccgggcggc

SEQ ID NO: 318096 - RNA, 13 nt, Bordetella pertussis
guggcccgcgccg

SEQ ID NO: 318097 - RNA, 17 nt, Bordetella pertussis
guggcccgcgccgcguc

SEQ ID NO: 318098 - RNA, 20 nt, Bordetella pertussis
guggcccgcgugacggccgc

SEQ ID NO: 318099 - RNA, 17 nt, Bordetella pertussis
guggccgagcgcacccc

SEQ ID NO: 318100 - RNA, 14 nt, Bordetella pertussis
guggccgccgaacg

SEQ ID NO: 318101 - RNA, 11 nt, Bordetella pertussis
guggccgcgca

SEQ ID NO: 318102 - RNA, 15 nt, Bordetella pertussis
guggccgcgcaaggc

SEQ ID NO: 318103 - RNA, 11 nt, Bordetella pertussis
guggccgcgcu

SEQ ID NO: 318104 - RNA, 23 nt, Bordetella pertussis
guggccgcgcaaggccugcucgg

SEQ ID NO: 318105 - RNA, 13 nt, Bordetella pertussis
guggccgcuccag

SEQ ID NO: 318106 - RNA, 14 nt, Bordetella pertussis
guggccgcuccaga

SEQ ID NO: 318107 - RNA, 18 nt, Bordetella pertussis
guggccgcuccagagcgc

SEQ ID NO: 318108 - RNA, 13 nt, Bordetella pertussis
guggccggcgacg

SEQ ID NO: 318109 - RNA, 15 nt, Bordetella pertussis
guggccggcgacggc

SEQ ID NO: 318110 - RNA, 18 nt, Bordetella pertussis
guggccggcgacggcauc

SEQ ID NO: 318111 - RNA, 15 nt, Bordetella pertussis
guggccggcgcgcgg

SEQ ID NO: 318112 - RNA, 15 nt, Bordetella pertussis
guggccggcgcggca

SEQ ID NO: 318113 - RNA, 16 nt, Bordetella pertussis
guggccggcgcggcag

SEQ ID NO: 318114 - RNA, 17 nt, Bordetella pertussis
guggccgcuucggcggc

SEQ ID NO: 318115 - RNA, 19 nt, Bordetella pertussis
guggccgcuucggcggcca

SEQ ID NO: 318116 - RNA, 15 nt, Bordetella pertussis
guggccgugcugguc

SEQ ID NO: 318117 - RNA, 16 nt, Bordetella pertussis
guggccguggcggcca

SEQ ID NO: 318118 - RNA, 13 nt, Bordetella pertussis
guggccucgucca

SEQ ID NO: 318119 - RNA, 20 nt, Bordetella pertussis
guggcgaaauggugcggcca

SEQ ID NO: 318120 - RNA, 21 nt, Bordetella pertussis
guggcgacgcccagccugccg

SEQ ID NO: 318121 - RNA, 15 nt, Bordetella pertussis
guggcgauagcgcuc

SEQ ID NO: 318122 - RNA, 17 nt, Bordetella pertussis
guggcgauagcgcucca

SEQ ID NO: 318123 - RNA, 18 nt, Bordetella pertussis
guggcgauagcgcuccag

SEQ ID NO: 318124 - RNA, 20 nt, Bordetella pertussis
guggcgauagcgcuccagcg

SEQ ID NO: 318125 - RNA, 21 nt, Bordetella pertussis
guggcgauccagggccgccag

SEQ ID NO: 318126 - RNA, 22 nt, Bordetella pertussis
guggcgauccauguggccagcu

SEQ ID NO: 318127 - RNA, 16 nt, Bordetella pertussis
guggcgaugccgggca

SEQ ID NO: 318128 - RNA, 20 nt, Bordetella pertussis
guggcgcaaggcaugcgcca

SEQ ID NO: 318129 - RNA, 12 nt, Bordetella pertussis
guggcgcacccu

SEQ ID NO: 318130 - RNA, 18 nt, Bordetella pertussis
guggcgcagcuccggguc

SEQ ID NO: 318131 - RNA, 18 nt, Bordetella pertussis
guggcgcagucgagcacc

SEQ ID NO: 318132 - RNA, 19 nt, Bordetella pertussis
guggcgcagucgagcaccg

SEQ ID NO: 318133 - RNA, 18 nt, Bordetella pertussis
guggcgcagugggccagu

SEQ ID NO: 318134 - RNA, 13 nt, Bordetella pertussis
guggcgcagaugg

SEQ ID NO: 318135 - RNA, 12 nt, Bordetella pertussis
guggcgcccagc

SEQ ID NO: 318136 - RNA, 13 nt, Bordetella pertussis
guggcgcccggcg

SEQ ID NO: 318137 - RNA, 23 nt, Bordetella pertussis
guggcgccgacccugcccggcag

SEQ ID NO: 318138 - RNA, 16 nt, Bordetella pertussis
guggcgcgccagcgcc

SEQ ID NO: 318139 - RNA, 16 nt, Bordetella pertussis
guggcgcgccuccagc

SEQ ID NO: 318140 - RNA, 20 nt, Bordetella pertussis
guggcgcgcgugcugggcca

SEQ ID NO: 318141 - RNA, 20 nt, Bordetella pertussis
guggcgcuccaugcggcggc

SEQ ID NO: 318142 - RNA, 18 nt, Bordetella pertussis
guggcgcugcguccgguc

SEQ ID NO: 318143 - RNA, 12 nt, Bordetella pertussis
guggcggccagg

SEQ ID NO: 318144 - RNA, 13 nt, Bordetella pertussis
guggcggccaggc

SEQ ID NO: 318145 - RNA, 15 nt, Bordetella pertussis
guggcggccaggccg

SEQ ID NO: 318146 - RNA, 13 nt, Bordetella pertussis
guggcggccgcgg

SEQ ID NO: 318147 - RNA, 18 nt, Bordetella pertussis
guggcggccugcgccggc

SEQ ID NO: 318148 - RNA, 14 nt, Bordetella pertussis
guggcggcgacggc

SEQ ID NO: 318149 - RNA, 16 nt, Bordetella pertussis
guggcggggcguucga

SEQ ID NO: 318150 - RNA, 14 nt, Bordetella pertussis
guggcggguccacg

SEQ ID NO: 318151 - RNA, 20 nt, Bordetella pertussis
guggcgggucccaaccaggg

SEQ ID NO: 318152 - RNA, 20 nt, Bordetella pertussis
guggcguaauagcuggcggc

SEQ ID NO: 318153 - RNA, 22 nt, Bordetella pertussis
guggcguaggauucgcggugca

SEQ ID NO: 318154 - RNA, 21 nt, Bordetella pertussis
guggcguaguagcccaggccc

SEQ ID NO: 318155 - RNA, 22 nt, Bordetella pertussis
guggcguaguagcccaggccca

SEQ ID NO: 318156 - RNA, 23 nt, Bordetella pertussis
guggcguaguagcccaggcccac

SEQ ID NO: 318157 - RNA, 13 nt, Bordetella pertussis
guggcguccacgc

SEQ ID NO: 318158 - RNA, 19 nt, Bordetella pertussis
guggcguugacggcccagc

SEQ ID NO: 318159 - RNA, 15 nt, Bordetella pertussis
guggcguuggccugc

SEQ ID NO: 318160 - RNA, 19 nt, Bordetella pertussis
guggcguuggccugccauc

SEQ ID NO: 318161 - RNA, 24 nt, Bordetella pertussis
guggcguuggccugccauccggcc

SEQ ID NO: 318162 - RNA, 23 nt, Bordetella pertussis
guggcugagccauuccggcuggu

SEQ ID NO: 318163 - RNA, 22 nt, Bordetella pertussis
gugggcaccgugaugcgcgccg

SEQ ID NO: 318164 - RNA, 15 nt, Bordetella pertussis
gugggcacgccggcc

SEQ ID NO: 318165 - RNA, 18 nt, Bordetella pertussis
gugggcacgcgcgcggcg

SEQ ID NO: 318166 - RNA, 23 nt, Bordetella pertussis
gugggcagggcggaaaacagcac

SEQ ID NO: 318167 - RNA, 17 nt, Bordetella pertussis
gugggcauccagcggca

SEQ ID NO: 318168 - RNA, 21 nt, Bordetella pertussis
gugggccacucgaugggcgcg

SEQ ID NO: 318169 - RNA, 23 nt, Bordetella pertussis
gugggcggugaccaugcgcaccg

SEQ ID NO: 318170 - RNA, 14 nt, Bordetella pertussis
gugggcggcguaga

SEQ ID NO: 318171 - RNA, 14 nt, Bordetella pertussis
guggggacaggcac

SEQ ID NO: 318172 - RNA, 18 nt, Bordetella pertussis
guggggcagcaggccggc

SEQ ID NO: 318173 - RNA, 15 nt, Bordetella pertussis
guggggcgcggcggc

SEQ ID NO: 318174 - RNA, 19 nt, Bordetella pertussis
guggggcuggccgccgcgg

SEQ ID NO: 318175 - RNA, 22 nt, Bordetella pertussis
guggggcuggccgccgcggccu

SEQ ID NO: 318176 - RNA, 15 nt, Bordetella pertussis
gugggggacaggcac

SEQ ID NO: 318177 - RNA, 13 nt, Bordetella pertussis
guggugauaaggc

SEQ ID NO: 318178 - RNA, 13 nt, Bordetella pertussis
guggugcgcgguc

SEQ ID NO: 318179 - RNA, 13 nt, Bordetella pertussis
guggugccgcgca

SEQ ID NO: 318180 - RNA, 19 nt, Bordetella pertussis
guggugcugcucaacggcc

SEQ ID NO: 318181 - RNA, 17 nt, Bordetella pertussis
guggugcugggcggcgg

SEQ ID NO: 318182 - RNA, 22 nt, Bordetella pertussis
guguacagccgccuggcgcggc

SEQ ID NO: 318183 - RNA, 15 nt, Bordetella pertussis
guguaccgggccgac

SEQ ID NO: 318184 - RNA, 21 nt, Bordetella pertussis
guguaccguacccgcgccguc

SEQ ID NO: 318185 - RNA, 19 nt, Bordetella pertussis
guguagagcaggccgccca

SEQ ID NO: 318186 - RNA, 23 nt, Bordetella pertussis
gugucaggaugcccuggguggcg

SEQ ID NO: 318187 - RNA, 14 nt, Bordetella pertussis
gugugaucgccgac

SEQ ID NO: 318188 - RNA, 19 nt, Bordetella pertussis
gugugaucgccgacgaugu

SEQ ID NO: 318189 - RNA, 14 nt, Bordetella pertussis
gugugccagccgcu

SEQ ID NO: 318190 - RNA, 17 nt, Bordetella pertussis
gugugccugucccagcg

SEQ ID NO: 318191 - RNA, 22 nt, Bordetella pertussis
guguuccagcgccuggcgggcc

SEQ ID NO: 318192 - RNA, 17 nt, Bordetella pertussis
guguuccggcgcgcggu

SEQ ID NO: 318193 - RNA, 16 nt, Bordetella pertussis
guguucucgcugguga

SEQ ID NO: 318194 - RNA, 19 nt, Bordetella pertussis
guguugaccaccacgcugg

SEQ ID NO: 318195 - RNA, 21 nt, Bordetella pertussis
guguugagauuggccgagcgc

SEQ ID NO: 318196 - RNA, 21 nt, Bordetella pertussis
guuacacuggcccuggcaugu

SEQ ID NO: 318197 - RNA, 15 nt, Bordetella pertussis
guuauuuccggccgc

SEQ ID NO: 318198 - RNA, 14 nt, Bordetella pertussis
guucgacgcccaug

SEQ ID NO: 318199 - RNA, 19 nt, Bordetella pertussis
guucgacuucguccggcgc

SEQ ID NO: 318200 - RNA, 18 nt, Bordetella pertussis
guucgagcaggcgcgcgg

SEQ ID NO: 318201 - RNA, 16 nt, Bordetella pertussis
guucgauacggccacg

SEQ ID NO: 318202 - RNA, 17 nt, Bordetella pertussis
guucgauggcggccagg

SEQ ID NO: 318203 - RNA, 14 nt, Bordetella pertussis
guucgcccaccacc

SEQ ID NO: 318204 - RNA, 18 nt, Bordetella pertussis
guucgcccggcuccaggc

SEQ ID NO: 318205 - RNA, 15 nt, Bordetella pertussis
guucgccgcaccagg

SEQ ID NO: 318206 - RNA, 15 nt, Bordetella pertussis
guucgccgcugucgc

SEQ ID NO: 318207 - RNA, 23 nt, Bordetella pertussis
guucgccgucguugacggggacg

SEQ ID NO: 318208 - RNA, 16 nt, Bordetella pertussis
guucgccgugcagggc

SEQ ID NO: 318209 - RNA, 22 nt, Bordetella pertussis
guucgcgcagaucccaggcgcu

SEQ ID NO: 318210 - RNA, 14 nt, Bordetella pertussis
guucgcgcagcagg

SEQ ID NO: 318211 - RNA, 19 nt, Bordetella pertussis
guucgcgcagcaggccgcg

SEQ ID NO: 318212 - RNA, 19 nt, Bordetella pertussis
guucgcgcaggcgugcgcg

SEQ ID NO: 318213 - RNA, 20 nt, Bordetella pertussis
guucgcgcaggcgugcgcgg

SEQ ID NO: 318214 - RNA, 14 nt, Bordetella pertussis
guucgcgcgccggc

SEQ ID NO: 318215 - RNA, 19 nt, Bordetella pertussis
guucgcgcugcccaccgcc

SEQ ID NO: 318216 - RNA, 19 nt, Bordetella pertussis
guucgcgcuugcggccguc

SEQ ID NO: 318217 - RNA, 17 nt, Bordetella pertussis
guucgcggcccugggcg

SEQ ID NO: 318218 - RNA, 12 nt, Bordetella pertussis
guucgcggccgg

SEQ ID NO: 318219 - RNA, 13 nt, Bordetella pertussis
guucgcggcgcag

SEQ ID NO: 318220 - RNA, 20 nt, Bordetella pertussis
guucgcgguauucggcgacc

SEQ ID NO: 318221 - RNA, 20 nt, Bordetella pertussis
guucgcggugucgcaccgca

SEQ ID NO: 318222 - RNA, 16 nt, Bordetella pertussis
guucgcuuuccagggu

SEQ ID NO: 318223 - RNA, 14 nt, Bordetella pertussis
guucggaugcgcgu

SEQ ID NO: 318224 - RNA, 14 nt, Bordetella pertussis
guucggccagcagc

SEQ ID NO: 318225 - RNA, 18 nt, Bordetella pertussis
guucggccagcagcuugg

SEQ ID NO: 318226 - RNA, 15 nt, Bordetella pertussis
guucggccagcgcgc

SEQ ID NO: 318227 - RNA, 16 nt, Bordetella pertussis
guucggccagcgcgcg

SEQ ID NO: 318228 - RNA, 17 nt, Bordetella pertussis
guucggccagcgcgcgg

SEQ ID NO: 318229 - RNA, 15 nt, Bordetella pertussis
guucggccagcggca

SEQ ID NO: 318230 - RNA, 16 nt, Bordetella pertussis
guucggccagcggcag

SEQ ID NO: 318231 - RNA, 16 nt, Bordetella pertussis
guucggccgccagguc

SEQ ID NO: 318232 - RNA, 15 nt, Bordetella pertussis
guucggccucgccca

SEQ ID NO: 318233 - RNA, 17 nt, Bordetella pertussis
guucggccucgcccaug

SEQ ID NO: 318234 - RNA, 18 nt, Bordetella pertussis
guucggccuugccauugg

SEQ ID NO: 318235 - RNA, 17 nt, Bordetella pertussis
guucggcgaccgccggc

SEQ ID NO: 318236 - RNA, 18 nt, Bordetella pertussis
guucggcgaugcgggcgg

SEQ ID NO: 318237 - RNA, 15 nt, Bordetella pertussis
guucggcgccgggcg

SEQ ID NO: 318238 - RNA, 18 nt, Bordetella pertussis
guucggcgccgggcgacg

SEQ ID NO: 318239 - RNA, 15 nt, Bordetella pertussis
guucggcggcgccca

SEQ ID NO: 318240 - RNA, 19 nt, Bordetella pertussis
guucggcuugcacgccggc

SEQ ID NO: 318241 - RNA, 17 nt, Bordetella pertussis
guucgggcacgccguuc

SEQ ID NO: 318242 - RNA, 15 nt, Bordetella pertussis
guucgggguccagca

SEQ ID NO: 318243 - RNA, 15 nt, Bordetella pertussis
guucggucagcgcgg

SEQ ID NO: 318244 - RNA, 19 nt, Bordetella pertussis
guucggugcgcagcggcag

SEQ ID NO: 318245 - RNA, 15 nt, Bordetella pertussis
guucgguggcguggu

SEQ ID NO: 318246 - RNA, 16 nt, Bordetella pertussis
guucguagucgagcca

SEQ ID NO: 318247 - RNA, 14 nt, Bordetella pertussis
guucgucgucgcca

SEQ ID NO: 318248 - RNA, 19 nt, Bordetella pertussis
guucgucgucgccaccgcc

SEQ ID NO: 318249 - RNA, 23 nt, Bordetella pertussis
guucgugcaccagcccgaugcgc

SEQ ID NO: 318250 - RNA, 20 nt, Bordetella pertussis
guucguggaugacucgggca

SEQ ID NO: 318251 - RNA, 23 nt, Bordetella pertussis
guucguucuugagaauggcgcgg

SEQ ID NO: 318252 - RNA, 22 nt, Bordetella pertussis
guucucaggccgaggcugcgcg

SEQ ID NO: 318253 - RNA, 14 nt, Bordetella pertussis
guucuccagcgccg

SEQ ID NO: 318254 - RNA, 19 nt, Bordetella pertussis
guucucgauguggcgcugg

SEQ ID NO: 318255 - RNA, 21 nt, Bordetella pertussis
guucucgauguggcgcuggcg

SEQ ID NO: 318256 - RNA, 14 nt, Bordetella pertussis
guucugcagcgcgg

SEQ ID NO: 318257 - RNA, 24 nt, Bordetella pertussis
guucugcagcgcggugcgggugac

SEQ ID NO: 318258 - RNA, 15 nt, Bordetella pertussis
guucugcagcgugcg

SEQ ID NO: 318259 - RNA, 20 nt, Bordetella pertussis
guucugcguggcggcgucgg

SEQ ID NO: 318260 - RNA, 15 nt, Bordetella pertussis
guucugggagcgcgg

SEQ ID NO: 318261 - RNA, 16 nt, Bordetella pertussis
guugaagacgccgguc

SEQ ID NO: 318262 - RNA, 16 nt, Bordetella pertussis
guugaagcgcagccac

SEQ ID NO: 318263 - RNA, 13 nt, Bordetella pertussis
guugaaguccgga

SEQ ID NO: 318264 - RNA, 15 nt, Bordetella pertussis
guugaccaccacgcu

SEQ ID NO: 318265 - RNA, 21 nt, Bordetella pertussis
guugaccacgcccuggaucag

SEQ ID NO: 318266 - RNA, 18 nt, Bordetella pertussis
guugacccauaccagccc

SEQ ID NO: 318267 - RNA, 20 nt, Bordetella pertussis
guugccgcuguggcgcgcca

SEQ ID NO: 318268 - RNA, 14 nt, Bordetella pertussis
guugccggccagca

SEQ ID NO: 318269 - RNA, 18 nt, Bordetella pertussis
guugcgaaacccgcuggg

SEQ ID NO: 318270 - RNA, 22 nt, Bordetella pertussis
guugcgcaccgcuucuucgucg

SEQ ID NO: 318271 - RNA, 13 nt, Bordetella pertussis
guugcgccagcgg

SEQ ID NO: 318272 - RNA, 17 nt, Bordetella pertussis
guugcgccagcggcgac

SEQ ID NO: 318273 - RNA, 22 nt, Bordetella pertussis
guugcgccgcaacgccgccggc

SEQ ID NO: 318274 - RNA, 20 nt, Bordetella pertussis
guugcgcgccgucggcgucg

SEQ ID NO: 318275 - RNA, 16 nt, Bordetella pertussis
guugcuuucggcgacu

SEQ ID NO: 318276 - RNA, 21 nt, Bordetella pertussis
guuggaccccaguuccagcac

SEQ ID NO: 318277 - RNA, 13 nt, Bordetella pertussis
guuggcguccagg

SEQ ID NO: 318278 - RNA, 16 nt, Bordetella pertussis
guuggcgucgagcacc

SEQ ID NO: 318279 - RNA, 17 nt, Bordetella pertussis
guuggcgucgagcaccg

SEQ ID NO: 318280 - RNA, 17 nt, Bordetella pertussis
guuguauucguccaggu

SEQ ID NO: 318281 - RNA, 13 nt, Bordetella pertussis
guuguccagcgcg

SEQ ID NO: 318282 - RNA, 14 nt, Bordetella pertussis
guuguccagcgcgc

SEQ ID NO: 318283 - RNA, 15 nt, Bordetella pertussis
guugucgcgcgcgcg

SEQ ID NO: 318284 - RNA, 18 nt, Bordetella pertussis
guugucgcgcgcgcggau

SEQ ID NO: 318285 - RNA, 17 nt, Bordetella pertussis
guugucggcgccacagg

SEQ ID NO: 318286 - RNA, 23 nt, Bordetella pertussis
guugucguugaugguccgcaggu

SEQ ID NO: 318287 - RNA, 16 nt, Bordetella pertussis
guuguucgggccggcu

SEQ ID NO: 318288 - RNA, 20 nt, Bordetella pertussis
guuucaggccugcggcgcca

SEQ ID NO: 318289 - RNA, 17 nt, Bordetella pertussis
guuucccuuccuggcca

SEQ ID NO: 318290 - RNA, 16 nt, Bordetella pertussis
guuuccgccaugcggc

SEQ ID NO: 318291 - RNA, 19 nt, Bordetella pertussis
uaacgaaucgcugccuucg

SEQ ID NO: 318292 - RNA, 18 nt, Bordetella pertussis
uaaggagaauccgcaggc

SEQ ID NO: 318293 - RNA, 14 nt, Bordetella pertussis
uaaucgucggcaac

SEQ ID NO: 318294 - RNA, 17 nt, Bordetella pertussis
uaaugacgcagccgccc

SEQ ID NO: 318295 - RNA, 16 nt, Bordetella pertussis
uaccaggugggcgcgc

SEQ ID NO: 318296 - RNA, 19 nt, Bordetella pertussis
uaccaguacaccggcgugc

SEQ ID NO: 318297 - RNA, 17 nt, Bordetella pertussis
uacccaugcggggcggc

SEQ ID NO: 318298 - RNA, 18 nt, Bordetella pertussis
uaccccucauuggcgcgc

SEQ ID NO: 318299 - RNA, 15 nt, Bordetella pertussis
uacccgccgggcggc

SEQ ID NO: 318300 - RNA, 19 nt, Bordetella pertussis
uacccgccgggcggcgccg

SEQ ID NO: 318301 - RNA, 21 nt, Bordetella pertussis
uacccggugcagcguggcgcg

SEQ ID NO: 318302 - RNA, 21 nt, Bordetella pertussis
uaccgaagccgaguggcgggc

SEQ ID NO: 318303 - RNA, 19 nt, Bordetella pertussis
uaccgaaucgaacuuggcg

SEQ ID NO: 318304 - RNA, 19 nt, Bordetella pertussis
uaccgaucuacgacgccug

SEQ ID NO: 318305 - RNA, 22 nt, Bordetella pertussis
uaccgcaaacguggugucggcu

SEQ ID NO: 318306 - RNA, 19 nt, Bordetella pertussis
uaccgccagcucggccugc

SEQ ID NO: 318307 - RNA, 15 nt, Bordetella pertussis
uaccgccgccugcgc

SEQ ID NO: 318308 - RNA, 21 nt, Bordetella pertussis
uaccgccuugccuugcgcggc

SEQ ID NO: 318309 - RNA, 13 nt, Bordetella pertussis
uaccggagcggcu

SEQ ID NO: 318310 - RNA, 18 nt, Bordetella pertussis
uaccgggcuggucagccu

SEQ ID NO: 318311 - RNA, 13 nt, Bordetella pertussis
uaccucagcaugg

SEQ ID NO: 318312 - RNA, 15 nt, Bordetella pertussis
uaccucgauggcggu

SEQ ID NO: 318313 - RNA, 17 nt, Bordetella pertussis
uaccugcagcaggcgca

SEQ ID NO: 318314 - RNA, 22 nt, Bordetella pertussis
uacgccaucgacgcuugccggc

SEQ ID NO: 318315 - RNA, 22 nt, Bordetella pertussis
uacgccaugaacgcuugacggc

SEQ ID NO: 318316 - RNA, 15 nt, Bordetella pertussis
uacgccaugagcgcu

SEQ ID NO: 318317 - RNA, 16 nt, Bordetella pertussis
uacgccgauggcgcgg

SEQ ID NO: 318318 - RNA, 18 nt, Bordetella pertussis
uacgccguugcggcccgc

SEQ ID NO: 318319 - RNA, 14 nt, Bordetella pertussis
uacgccugcaccgc

SEQ ID NO: 318320 - RNA, 15 nt, Bordetella pertussis
uacgccugcaccgcc

SEQ ID NO: 318321 - RNA, 17 nt, Bordetella pertussis
uacgcuggaagagaccg

SEQ ID NO: 318322 - RNA, 22 nt, Bordetella pertussis
uacggcaagcagaaaggaugcc

SEQ ID NO: 318323 - RNA, 23 nt, Bordetella pertussis
uacggcagaugaucuacgcgcgc

SEQ ID NO: 318324 - RNA, 16 nt, Bordetella pertussis
uacuccuugacgcgcg

SEQ ID NO: 318325 - RNA, 17 nt, Bordetella pertussis
uacucgaugcccagcac

SEQ ID NO: 318326 - RNA, 20 nt, Bordetella pertussis
uacucgccggucgcggcguu

SEQ ID NO: 318327 - RNA, 22 nt, Bordetella pertussis
uacucggaagacauggcgcgcg

SEQ ID NO: 318328 - RNA, 11 nt, Bordetella pertussis
uacugggccac

SEQ ID NO: 318329 - RNA, 17 nt, Bordetella pertussis
uagagcaggccgcccag

SEQ ID NO: 318330 - RNA, 18 nt, Bordetella pertussis
uagccaggauuucauggc

SEQ ID NO: 318331 - RNA, 18 nt, Bordetella pertussis
uagccaugcggacgccag

SEQ ID NO: 318332 - RNA, 13 nt, Bordetella pertussis
uagcccaggcggg

SEQ ID NO: 318333 - RNA, 16 nt, Bordetella pertussis
uagcccagguccagcg

SEQ ID NO: 318334 - RNA, 17 nt, Bordetella pertussis
uagcccauguucugguc

SEQ ID NO: 318335 - RNA, 14 nt, Bordetella pertussis
uagcccggcgccac

SEQ ID NO: 318336 - RNA, 14 nt, Bordetella pertussis
uagccgcggcgccg

SEQ ID NO: 318337 - RNA, 17 nt, Bordetella pertussis
uagccgcugcgcgcggc

SEQ ID NO: 318338 - RNA, 21 nt, Bordetella pertussis
uagccgcugcgcgcggccugg

SEQ ID NO: 318339 - RNA, 17 nt, Bordetella pertussis
uagcggccggcgcgcgc

SEQ ID NO: 318340 - RNA, 12 nt, Bordetella pertussis
uagcgggcggcg

SEQ ID NO: 318341 - RNA, 21 nt, Bordetella pertussis
uagcgguccagcugcgcgcga

SEQ ID NO: 318342 - RNA, 20 nt, Bordetella pertussis
uagcgguacucgcgcggguc

SEQ ID NO: 318343 - RNA, 20 nt, Bordetella pertussis
uagcggucaaugaagggcug

SEQ ID NO: 318344 - RNA, 16 nt, Bordetella pertussis
uagcuggcggcgcgcu

SEQ ID NO: 318345 - RNA, 13 nt, Bordetella pertussis
uaguccagcaccg

SEQ ID NO: 318346 - RNA, 17 nt, Bordetella pertussis
uaguccagcagcagcgc

SEQ ID NO: 318347 - RNA, 21 nt, Bordetella pertussis
uaguccgagcccgggcgugcc

SEQ ID NO: 318348 - RNA, 15 nt, Bordetella pertussis
uagucgcacgcggcu

SEQ ID NO: 318349 - RNA, 14 nt, Bordetella pertussis
uagucgcggccgua

SEQ ID NO: 318350 - RNA, 18 nt, Bordetella pertussis
uagucgucgcuggcccac

SEQ ID NO: 318351 - RNA, 19 nt, Bordetella pertussis
uagugcaggccgcgcagca

SEQ ID NO: 318352 - RNA, 13 nt, Bordetella pertussis
uaguucggcgcgu

SEQ ID NO: 318353 - RNA, 23 nt, Bordetella pertussis
uauagggggcauggcgccgcgcg

SEQ ID NO: 318354 - RNA, 14 nt, Bordetella pertussis
uauccuggcgcgga

SEQ ID NO: 318355 - RNA, 16 nt, Bordetella pertussis
uauccuggcgcggaca

SEQ ID NO: 318356 - RNA, 22 nt, Bordetella pertussis
uaucgaacucgauccgggccug

SEQ ID NO: 318357 - RNA, 22 nt, Bordetella pertussis
uaucgacccaggccggcgccag

SEQ ID NO: 318358 - RNA, 19 nt, Bordetella pertussis
uaucgcauacucgaugccc

SEQ ID NO: 318359 - RNA, 23 nt, Bordetella pertussis
uaucgccucgacgggauccucgc

SEQ ID NO: 318360 - RNA, 15 nt, Bordetella pertussis
uaucgcgccagcgcc

SEQ ID NO: 318361 - RNA, 20 nt, Bordetella pertussis
uaucgcgccagcgccgcgcg

SEQ ID NO: 318362 - RNA, 18 nt, Bordetella pertussis
uaucgcggcgcaggcggg

SEQ ID NO: 318363 - RNA, 14 nt, Bordetella pertussis
uaucgcggcgcggc

SEQ ID NO: 318364 - RNA, 17 nt, Bordetella pertussis
uaucggccaggcgcugc

SEQ ID NO: 318365 - RNA, 12 nt, Bordetella pertussis
uaugggccugau

SEQ ID NO: 318366 - RNA, 18 nt, Bordetella pertussis
uauuccaucuugccggcc

SEQ ID NO: 318367 - RNA, 17 nt, Bordetella pertussis
uauucgggaugggccac

SEQ ID NO: 318368 - RNA, 20 nt, Bordetella pertussis
uauuuggcaaggcccgccgc

SEQ ID NO: 318369 - RNA, 12 nt, Bordetella pertussis
ucaacgggccgc

SEQ ID NO: 318370 - RNA, 17 nt, Bordetella pertussis
ucaccaagggcgccggg

SEQ ID NO: 318371 - RNA, 20 nt, Bordetella pertussis
ucaccaagggcgccgggcgg

SEQ ID NO: 318372 - RNA, 14 nt, Bordetella pertussis
ucaccaccggcaag

SEQ ID NO: 318373 - RNA, 14 nt, Bordetella pertussis
ucaccacgcccgcg

SEQ ID NO: 318374 - RNA, 19 nt, Bordetella pertussis
ucaccagcagguggcgcug

SEQ ID NO: 318375 - RNA, 21 nt, Bordetella pertussis
ucaccaggaagcgcgccugcg

SEQ ID NO: 318376 - RNA, 19 nt, Bordetella pertussis
ucacccacagcagcgcgcc

SEQ ID NO: 318377 - RNA, 21 nt, Bordetella pertussis
ucaccccgcccggcggcgcgc

SEQ ID NO: 318378 - RNA, 17 nt, Bordetella pertussis
ucaccccgccaccgccc

SEQ ID NO: 318379 - RNA, 23 nt, Bordetella pertussis
ucacccgauacgacacgccgcgc

SEQ ID NO: 318380 - RNA, 22 nt, Bordetella pertussis
ucacccuggaugccaugccggg

SEQ ID NO: 318381 - RNA, 14 nt, Bordetella pertussis
ucaccgccgcccgc

SEQ ID NO: 318382 - RNA, 17 nt, Bordetella pertussis
ucaccgccgccgccacc

SEQ ID NO: 318383 - RNA, 15 nt, Bordetella pertussis
ucaccgccgccgcgc

SEQ ID NO: 318384 - RNA, 14 nt, Bordetella pertussis
ucaccgccggcggc

SEQ ID NO: 318385 - RNA, 16 nt, Bordetella pertussis
ucaccgccggcggcgu

SEQ ID NO: 318386 - RNA, 13 nt, Bordetella pertussis
ucaccucgaucgc

SEQ ID NO: 318387 - RNA, 18 nt, Bordetella pertussis
ucacgaaagcgcccaggc

SEQ ID NO: 318388 - RNA, 17 nt, Bordetella pertussis
ucacgacacgcccagca

SEQ ID NO: 318389 - RNA, 20 nt, Bordetella pertussis
ucacgccccgcacgaucagc

SEQ ID NO: 318390 - RNA, 14 nt, Bordetella pertussis
ucacgccggcgcgc

SEQ ID NO: 318391 - RNA, 22 nt, Bordetella pertussis
ucacgccggcgcgccgggccag

SEQ ID NO: 318392 - RNA, 15 nt, Bordetella pertussis
ucacgccgguguucu

SEQ ID NO: 318393 - RNA, 18 nt, Bordetella pertussis
ucacgcgcaagccgcugg

SEQ ID NO: 318394 - RNA, 14 nt, Bordetella pertussis
ucacgcgcagcguc

SEQ ID NO: 318395 - RNA, 19 nt, Bordetella pertussis
ucacgcgcuccggcugcgc

SEQ ID NO: 318396 - RNA, 23 nt, Bordetella pertussis
ucacgcgcuccggcugcgcgcgc

SEQ ID NO: 318397 - RNA, 20 nt, Bordetella pertussis
ucacguccaguccuucgcgu

SEQ ID NO: 318398 - RNA, 18 nt, Bordetella pertussis
ucacugccgaaacgcugg

SEQ ID NO: 318399 - RNA, 20 nt, Bordetella pertussis
ucacugccgaaacgcuggcg

SEQ ID NO: 318400 - RNA, 14 nt, Bordetella pertussis
ucagcacaucgccc

SEQ ID NO: 318401 - RNA, 18 nt, Bordetella pertussis
ucagcaccacggcggcca

SEQ ID NO: 318402 - RNA, 19 nt, Bordetella pertussis
ucagcaccaggccgccggc

SEQ ID NO: 318403 - RNA, 13 nt, Bordetella pertussis
ucagcaccgcgac

SEQ ID NO: 318404 - RNA, 13 nt, Bordetella pertussis
ucagcaccgcggc

SEQ ID NO: 318405 - RNA, 16 nt, Bordetella pertussis
ucagcacggucggcgc

SEQ ID NO: 318406 - RNA, 18 nt, Bordetella pertussis
ucagcacggucggcgcgu

SEQ ID NO: 318407 - RNA, 18 nt, Bordetella pertussis
ucagcacuugccggccgc

SEQ ID NO: 318408 - RNA, 22 nt, Bordetella pertussis
ucagcacuugccggccgcccag

SEQ ID NO: 318409 - RNA, 14 nt, Bordetella pertussis
ucagcagcaccuuc

SEQ ID NO: 318410 - RNA, 17 nt, Bordetella pertussis
ucagcagcaugccuucg

SEQ ID NO: 318411 - RNA, 19 nt, Bordetella pertussis
ucagcagcgcggcgccggc

SEQ ID NO: 318412 - RNA, 13 nt, Bordetella pertussis
ucagcagggcgcc

SEQ ID NO: 318413 - RNA, 18 nt, Bordetella pertussis
ucagcagggcgccgacga

SEQ ID NO: 318414 - RNA, 19 nt, Bordetella pertussis
ucagcagggcgccgacgau

SEQ ID NO: 318415 - RNA, 14 nt, Bordetella pertussis
ucagcaggucggcg

SEQ ID NO: 318416 - RNA, 15 nt, Bordetella pertussis
ucagcaggucggcgc

SEQ ID NO: 318417 - RNA, 15 nt, Bordetella pertussis
ucagcccggcgacgu

SEQ ID NO: 318418 - RNA, 14 nt, Bordetella pertussis
ucagcccggcgcgc

SEQ ID NO: 318419 - RNA, 14 nt, Bordetella pertussis
ucagcccggcggcc

SEQ ID NO: 318420 - RNA, 16 nt, Bordetella pertussis
ucagccgcccgccggg

SEQ ID NO: 318421 - RNA, 18 nt, Bordetella pertussis
ucagccgcugcagcacgc

SEQ ID NO: 318422 - RNA, 17 nt, Bordetella pertussis
ucagccgcuuggccugc

SEQ ID NO: 318423 - RNA, 14 nt, Bordetella pertussis
ucagcgccaucauc

SEQ ID NO: 318424 - RNA, 13 nt, Bordetella pertussis
ucagcgcccaggu

SEQ ID NO: 318425 - RNA, 20 nt, Bordetella pertussis
ucagcggccgcugccgcgcg

SEQ ID NO: 318426 - RNA, 21 nt, Bordetella pertussis
ucagcggccggcccgugcgca

SEQ ID NO: 318427 - RNA, 14 nt, Bordetella pertussis
ucagcggcgcgccc

SEQ ID NO: 318428 - RNA, 23 nt, Bordetella pertussis
ucagcggcggcacgcgcgccggc

SEQ ID NO: 318429 - RNA, 19 nt, Bordetella pertussis
ucagcggcuucgagcgcga

SEQ ID NO: 318430 - RNA, 13 nt, Bordetella pertussis
ucagcgggccggc

SEQ ID NO: 318431 - RNA, 14 nt, Bordetella pertussis
ucagcgggccggca

SEQ ID NO: 318432 - RNA, 17 nt, Bordetella pertussis
ucaggcccuggggccgc

SEQ ID NO: 318433 - RNA, 19 nt, Bordetella pertussis
ucaggccgaggcugcgcgc

SEQ ID NO: 318434 - RNA, 22 nt, Bordetella pertussis
ucaggccgaggcugcgcgcgcc

SEQ ID NO: 318435 - RNA, 18 nt, Bordetella pertussis
ucaggccgccccaacggc

SEQ ID NO: 318436 - RNA, 16 nt, Bordetella pertussis
ucaggccggcccgccc

SEQ ID NO: 318437 - RNA, 15 nt, Bordetella pertussis
ucaggccggcgccug

SEQ ID NO: 318438 - RNA, 23 nt, Bordetella pertussis
ucaggccggcgccuggggcgggc

SEQ ID NO: 318439 - RNA, 18 nt, Bordetella pertussis
ucaggccgucgagccggg

SEQ ID NO: 318440 - RNA, 23 nt, Bordetella pertussis
ucaggccguuuacuccccagacg

SEQ ID NO: 318441 - RNA, 15 nt, Bordetella pertussis
ucaggccugcggcgc

SEQ ID NO: 318442 - RNA, 16 nt, Bordetella pertussis
ucaggccugcggcgcc

SEQ ID NO: 318443 - RNA, 16 nt, Bordetella pertussis
ucaggcgagcgcggcg

SEQ ID NO: 318444 - RNA, 16 nt, Bordetella pertussis
ucaggcgagcggcguc

SEQ ID NO: 318445 - RNA, 23 nt, Bordetella pertussis
ucaggcgcaucgacagcgcgccc

SEQ ID NO: 318446 - RNA, 22 nt, Bordetella pertussis
ucaggcgcgcggcagggcgucg

SEQ ID NO: 318447 - RNA, 22 nt, Bordetella pertussis
ucaggcgcuccauggcgccggc

SEQ ID NO: 318448 - RNA, 18 nt, Bordetella pertussis
ucaggcgcucgaucggau

SEQ ID NO: 318449 - RNA, 20 nt, Bordetella pertussis
ucaggcggcugcccaccuug

SEQ ID NO: 318450 - RNA, 12 nt, Bordetella pertussis
ucagggccgcca

SEQ ID NO: 318451 - RNA, 15 nt, Bordetella pertussis
ucagggcgccggcgu

SEQ ID NO: 318452 - RNA, 22 nt, Bordetella pertussis
ucagguccaugaacgccgcgcc

SEQ ID NO: 318453 - RNA, 14 nt, Bordetella pertussis
ucaggucgaugccg

SEQ ID NO: 318454 - RNA, 15 nt, Bordetella pertussis
ucaggucgaugccgg

SEQ ID NO: 318455 - RNA, 17 nt, Bordetella pertussis
ucaggucgaugccggcg

SEQ ID NO: 318456 - RNA, 16 nt, Bordetella pertussis
ucaggugaaacagcag

SEQ ID NO: 318457 - RNA, 21 nt, Bordetella pertussis
ucaggugaaacagcagcgggc

SEQ ID NO: 318458 - RNA, 21 nt, Bordetella pertussis
ucaggugcaggguuggcgcgc

SEQ ID NO: 318459 - RNA, 15 nt, Bordetella pertussis
ucagguugcgccggc

SEQ ID NO: 318460 - RNA, 16 nt, Bordetella pertussis
ucagguugcgccggcu

SEQ ID NO: 318461 - RNA, 17 nt, Bordetella pertussis
ucaguccguggcgcggc

SEQ ID NO: 318462 - RNA, 18 nt, Bordetella pertussis
ucagucgggacggcgcgg

SEQ ID NO: 318463 - RNA, 19 nt, Bordetella pertussis
ucagucgggacggcgcggg

SEQ ID NO: 318464 - RNA, 15 nt, Bordetella pertussis
ucagucgggcagcgc

SEQ ID NO: 318465 - RNA, 16 nt, Bordetella pertussis
ucaguuccaggcggau

SEQ ID NO: 318466 - RNA, 23 nt, Bordetella pertussis
ucaucaaacgcggcgccgccggc

SEQ ID NO: 318467 - RNA, 14 nt, Bordetella pertussis
ucaucacgggcgcc

SEQ ID NO: 318468 - RNA, 12 nt, Bordetella pertussis
ucauccgcgcau

SEQ ID NO: 318469 - RNA, 13 nt, Bordetella pertussis
ucaucgccgacgc

SEQ ID NO: 318470 - RNA, 22 nt, Bordetella pertussis
ucaucgccgacgcgccgggcca

SEQ ID NO: 318471 - RNA, 13 nt, Bordetella pertussis
ucaucggcgcgca

SEQ ID NO: 318472 - RNA, 14 nt, Bordetella pertussis
ucaucgggccggcg

SEQ ID NO: 318473 - RNA, 15 nt, Bordetella pertussis
ucaucgggugcggcg

SEQ ID NO: 318474 - RNA, 15 nt, Bordetella pertussis
ucaugaacgucaccc

SEQ ID NO: 318475 - RNA, 20 nt, Bordetella pertussis
ucaugaacgucaccccgccc

SEQ ID NO: 318476 - RNA, 14 nt, Bordetella pertussis
ucaugaccagcggc

SEQ ID NO: 318477 - RNA, 15 nt, Bordetella pertussis
ucaugaccaucgcgc

SEQ ID NO: 318478 - RNA, 14 nt, Bordetella pertussis
ucaugacgggcggc

SEQ ID NO: 318479 - RNA, 17 nt, Bordetella pertussis
ucaugcccgccacgguc

SEQ ID NO: 318480 - RNA, 23 nt, Bordetella pertussis
ucaugccgaacagcauggcggcg

SEQ ID NO: 318481 - RNA, 19 nt, Bordetella pertussis
ucaugccgcugcccagcgu

SEQ ID NO: 318482 - RNA, 14 nt, Bordetella pertussis
ucaugccggcaagc

SEQ ID NO: 318483 - RNA, 18 nt, Bordetella pertussis
ucaugcgggacaggcgcc

SEQ ID NO: 318484 - RNA, 20 nt, Bordetella pertussis
ucauggcgcgcgccgcgcug

SEQ ID NO: 318485 - RNA, 22 nt, Bordetella pertussis
uccaaccugguauccggcgcac

SEQ ID NO: 318486 - RNA, 21 nt, Bordetella pertussis
uccaccaccaggccggccagg

SEQ ID NO: 318487 - RNA, 15 nt, Bordetella pertussis
uccacccccgggcgc

SEQ ID NO: 318488 - RNA, 21 nt, Bordetella pertussis
uccaccccgguguaggcgggc

SEQ ID NO: 318489 - RNA, 15 nt, Bordetella pertussis
uccaccucgaacgca

SEQ ID NO: 318490 - RNA, 22 nt, Bordetella pertussis
uccaccucgucguccagcguca

SEQ ID NO: 318491 - RNA, 14 nt, Bordetella pertussis
uccaccuugacgcg

SEQ ID NO: 318492 - RNA, 23 nt, Bordetella pertussis
uccacgaagcaggugaugcgcgc

SEQ ID NO: 318493 - RNA, 23 nt, Bordetella pertussis
uccacgaggucuugccgaucggc

SEQ ID NO: 318494 - RNA, 22 nt, Bordetella pertussis
uccacgaugucguccagcucca

SEQ ID NO: 318495 - RNA, 16 nt, Bordetella pertussis
uccacgcccagcgccg

SEQ ID NO: 318496 - RNA, 20 nt, Bordetella pertussis
uccacgcccuggcuggcggc

SEQ ID NO: 318497 - RNA, 14 nt, Bordetella pertussis
uccacgccgcgcgc

SEQ ID NO: 318498 - RNA, 14 nt, Bordetella pertussis
uccacggccggcgc

SEQ ID NO: 318499 - RNA, 16 nt, Bordetella pertussis
uccacggccggcgcac

SEQ ID NO: 318500 - RNA, 21 nt, Bordetella pertussis
uccacggccggcgcacgccgg

SEQ ID NO: 318501 - RNA, 13 nt, Bordetella pertussis
uccacggccugcg

SEQ ID NO: 318502 - RNA, 14 nt, Bordetella pertussis
uccacggcggcggc

SEQ ID NO: 318503 - RNA, 13 nt, Bordetella pertussis
uccagccaggcgc

SEQ ID NO: 318504 - RNA, 15 nt, Bordetella pertussis
uccagccaggcgcgc

SEQ ID NO: 318505 - RNA, 17 nt, Bordetella pertussis
uccagcgccaccagcag

SEQ ID NO: 318506 - RNA, 18 nt, Bordetella pertussis
uccagcgccaccagcagc

SEQ ID NO: 318507 - RNA, 14 nt, Bordetella pertussis
uccagcgccagcac

SEQ ID NO: 318508 - RNA, 22 nt, Bordetella pertussis
uccagcgccagcaccggcacgc

SEQ ID NO: 318509 - RNA, 13 nt, Bordetella pertussis
uccagcgcccgaa

SEQ ID NO: 318510 - RNA, 23 nt, Bordetella pertussis
uccagcgccgccuucaccggccc

SEQ ID NO: 318511 - RNA, 14 nt, Bordetella pertussis
uccagcgccggcag

SEQ ID NO: 318512 - RNA, 15 nt, Bordetella pertussis
uccagcgccggcagc

SEQ ID NO: 318513 - RNA, 12 nt, Bordetella pertussis
uccagcgcgccc

SEQ ID NO: 318514 - RNA, 21 nt, Bordetella pertussis
uccagcgcgcccgaggcgcgc

SEQ ID NO: 318515 - RNA, 22 nt, Bordetella pertussis
uccagcgcgcgaucgccagcag

SEQ ID NO: 318516 - RNA, 13 nt, Bordetella pertussis
uccagcgcgcggc

SEQ ID NO: 318517 - RNA, 16 nt, Bordetella pertussis
uccagcgcgcggccuc

SEQ ID NO: 318518 - RNA, 15 nt, Bordetella pertussis
uccagcgcggcaugc

SEQ ID NO: 318519 - RNA, 19 nt, Bordetella pertussis
uccagcgcggcaugccgcu

SEQ ID NO: 318520 - RNA, 15 nt, Bordetella pertussis
uccagcgcggcgggc

SEQ ID NO: 318521 - RNA, 23 nt, Bordetella pertussis
uccagcgcggcgggcggcgcggc

SEQ ID NO: 318522 - RNA, 22 nt, Bordetella pertussis
uccagcgcucgggcucgcgcgc

SEQ ID NO: 318523 - RNA, 16 nt, Bordetella pertussis
uccagcugcgcgcgag

SEQ ID NO: 318524 - RNA, 21 nt, Bordetella pertussis
uccagcuggcccuggcagacg

SEQ ID NO: 318525 - RNA, 17 nt, Bordetella pertussis
uccaggaagcagcccag

SEQ ID NO: 318526 - RNA, 23 nt, Bordetella pertussis
uccaggaagcagcccagcacgac

SEQ ID NO: 318527 - RNA, 16 nt, Bordetella pertussis
uccaggaaagcgccgc

SEQ ID NO: 318528 - RNA, 14 nt, Bordetella pertussis
uccaggaugcgcga

SEQ ID NO: 318529 - RNA, 19 nt, Bordetella pertussis
uccaggcauucccgcccag

SEQ ID NO: 318530 - RNA, 19 nt, Bordetella pertussis
uccaggccgaucagcgaca

SEQ ID NO: 318531 - RNA, 22 nt, Bordetella pertussis
uccaggccgaucagcgacagca

SEQ ID NO: 318532 - RNA, 19 nt, Bordetella pertussis
uccaggcgccgcacgccgg

SEQ ID NO: 318533 - RNA, 12 nt, Bordetella pertussis
uccaggcgcguu

SEQ ID NO: 318534 - RNA, 13 nt, Bordetella pertussis
uccaggcggccac

SEQ ID NO: 318535 - RNA, 15 nt, Bordetella pertussis
uccaggcgguccugg

SEQ ID NO: 318536 - RNA, 14 nt, Bordetella pertussis
uccaggcugagcgu

SEQ ID NO: 318537 - RNA, 14 nt, Bordetella pertussis
uccaggcugccggc

SEQ ID NO: 318538 - RNA, 15 nt, Bordetella pertussis
uccagggccgccagc

SEQ ID NO: 318539 - RNA, 16 nt, Bordetella pertussis
uccagggccgccagca

SEQ ID NO: 318540 - RNA, 12 nt, Bordetella pertussis
uccagggcgcgc

SEQ ID NO: 318541 - RNA, 20 nt, Bordetella pertussis
uccagggcuugcggcgcugg

SEQ ID NO: 318542 - RNA, 21 nt, Bordetella pertussis
uccaggguguccuggucggcg

SEQ ID NO: 318543 - RNA, 14 nt, Bordetella pertussis
uccagguaggcggc

SEQ ID NO: 318544 - RNA, 18 nt, Bordetella pertussis
uccagguaggcggcgcgc

SEQ ID NO: 318545 - RNA, 20 nt, Bordetella pertussis
uccagguaggcggcgcgccc

SEQ ID NO: 318546 - RNA, 18 nt, Bordetella pertussis
ucccagcaagccgaucaa

SEQ ID NO: 318547 - RNA, 14 nt, Bordetella pertussis
ucccagccggcccc

SEQ ID NO: 318548 - RNA, 20 nt, Bordetella pertussis
ucccagcggggacaggcaca

SEQ ID NO: 318549 - RNA, 20 nt, Bordetella pertussis
ucccagcggggacaggcacc

SEQ ID NO: 318550 - RNA, 15 nt, Bordetella pertussis
ucccaggcccggccg

SEQ ID NO: 318551 - RNA, 19 nt, Bordetella pertussis
ucccaugacccugcacgau

SEQ ID NO: 318552 - RNA, 21 nt, Bordetella pertussis
uccccaacggggacgggcgcc

SEQ ID NO: 318553 - RNA, 17 nt, Bordetella pertussis
uccccaauacccgccac

SEQ ID NO: 318554 - RNA, 18 nt, Bordetella pertussis
uccccacagggggacugg

SEQ ID NO: 318555 - RNA, 22 nt, Bordetella pertussis
uccccacagggggucuggcacc

SEQ ID NO: 318556 - RNA, 20 nt, Bordetella pertussis
uccccacauggggacuggca

SEQ ID NO: 318557 - RNA, 20 nt, Bordetella pertussis
uccccaccgggacaggcacc

SEQ ID NO: 318558 - RNA, 16 nt, Bordetella pertussis
uccccacggggacagg

SEQ ID NO: 318559 - RNA, 18 nt, Bordetella pertussis
uccccacggggacaggca

SEQ ID NO: 318560 - RNA, 19 nt, Bordetella pertussis
uccccacggggacaggcac

SEQ ID NO: 318561 - RNA, 20 nt, Bordetella pertussis
uccccacggggacaggcacc

SEQ ID NO: 318562 - RNA, 18 nt, Bordetella pertussis
uccccacggggacuggcu

SEQ ID NO: 318563 - RNA, 18 nt, Bordetella pertussis
uccccacugggggacugg

SEQ ID NO: 318564 - RNA, 17 nt, Bordetella pertussis
uccccagacgcagacca

SEQ ID NO: 318565 - RNA, 19 nt, Bordetella pertussis
uccccaggccagcugcgcc

SEQ ID NO: 318566 - RNA, 22 nt, Bordetella pertussis
uccccaugcggggacuggcacc

SEQ ID NO: 318567 - RNA, 20 nt, Bordetella pertussis
uccccauguggggacaggca

SEQ ID NO: 318568 - RNA, 22 nt, Bordetella pertussis
uccccauguggggacaggcacc

SEQ ID NO: 318569 - RNA, 21 nt, Bordetella pertussis
ucccccaugcggggacaggca

SEQ ID NO: 318570 - RNA, 23 nt, Bordetella pertussis
ucccccaugcggggacaggcacu

SEQ ID NO: 318571 - RNA, 20 nt, Bordetella pertussis
uccccccauggggacuggca

SEQ ID NO: 318572 - RNA, 20 nt, Bordetella pertussis
ucccccucggccugcgcgau

SEQ ID NO: 318573 - RNA, 20 nt, Bordetella pertussis
ucccccugcggggacaggca

SEQ ID NO: 318574 - RNA, 22 nt, Bordetella pertussis
ucccccugcggggacaggcacc

SEQ ID NO: 318575 - RNA, 20 nt, Bordetella pertussis
uccccgaacggggacuggca

SEQ ID NO: 318576 - RNA, 16 nt, Bordetella pertussis
uccccgcagggacagg

SEQ ID NO: 318577 - RNA, 20 nt, Bordetella pertussis
uccccgcagggacaggcacc

SEQ ID NO: 318578 - RNA, 18 nt, Bordetella pertussis
uccccgcagggacaggcu

SEQ ID NO: 318579 - RNA, 20 nt, Bordetella pertussis
uccccgcagggacaggcucc

SEQ ID NO: 318580 - RNA, 22 nt, Bordetella pertussis
uccccgcauggagaccggcgcc

SEQ ID NO: 318581 - RNA, 18 nt, Bordetella pertussis
uccccgcauggggacugg

SEQ ID NO: 318582 - RNA, 20 nt, Bordetella pertussis
uccccgcacggggacaggca

SEQ ID NO: 318583 - RNA, 21 nt, Bordetella pertussis
uccccgcacggggacaggcac

SEQ ID NO: 318584 - RNA, 22 nt, Bordetella pertussis
uccccgcacggggacaggcacg

SEQ ID NO: 318585 - RNA, 22 nt, Bordetella pertussis
uccccgcacggggacuggcacc

SEQ ID NO: 318586 - RNA, 12 nt, Bordetella pertussis
uccccgcccagc

SEQ ID NO: 318587 - RNA, 19 nt, Bordetella pertussis
uccccgccgggacaggcac

SEQ ID NO: 318588 - RNA, 15 nt, Bordetella pertussis
uccccgcggggacag

SEQ ID NO: 318589 - RNA, 16 nt, Bordetella pertussis
uccccgcggggacaga

SEQ ID NO: 318590 - RNA, 23 nt, Bordetella pertussis
uccccgcggggacaggcaccgcc

SEQ ID NO: 318591 - RNA, 18 nt, Bordetella pertussis
uccccgcggggacaggcu

SEQ ID NO: 318592 - RNA, 14 nt, Bordetella pertussis
uccccgcugaccug

SEQ ID NO: 318593 - RNA, 16 nt, Bordetella pertussis
uccccgcugcggcaag

SEQ ID NO: 318594 - RNA, 20 nt, Bordetella pertussis
uccccgcugggacaggcacu

SEQ ID NO: 318595 - RNA, 14 nt, Bordetella pertussis
uccccgggcaccau

SEQ ID NO: 318596 - RNA, 16 nt, Bordetella pertussis
uccccgugcggggacc

SEQ ID NO: 318597 - RNA, 18 nt, Bordetella pertussis
uccccguggggacaggca

SEQ ID NO: 318598 - RNA, 19 nt, Bordetella pertussis
uccccguggggacaggcac

SEQ ID NO: 318599 - RNA, 18 nt, Bordetella pertussis
ucccgccgcccggccggc

SEQ ID NO: 318600 - RNA, 16 nt, Bordetella pertussis
ucccgcgcacgcgcuu

SEQ ID NO: 318601 - RNA, 14 nt, Bordetella pertussis
ucccgcuggcggca

SEQ ID NO: 318602 - RNA, 15 nt, Bordetella pertussis
ucccgcuggcggcac

SEQ ID NO: 318603 - RNA, 15 nt, Bordetella pertussis
ucccggaccgcgcug

SEQ ID NO: 318604 - RNA, 15 nt, Bordetella pertussis
ucccgucauggcggc

SEQ ID NO: 318605 - RNA, 14 nt, Bordetella pertussis
ucccguggcgcuca

SEQ ID NO: 318606 - RNA, 23 nt, Bordetella pertussis
ucccugaacguggcguccacgcg

SEQ ID NO: 318607 - RNA, 15 nt, Bordetella pertussis
ucccugccgggacag

SEQ ID NO: 318608 - RNA, 20 nt, Bordetella pertussis
ucccugccgggacaggcacc

SEQ ID NO: 318609 - RNA, 18 nt, Bordetella pertussis
ucccugcggggacuggcu

SEQ ID NO: 318610 - RNA, 13 nt, Bordetella pertussis
ucccugguccagc

SEQ ID NO: 318611 - RNA, 19 nt, Bordetella pertussis
ucccugugggggacaggca

SEQ ID NO: 318612 - RNA, 21 nt, Bordetella pertussis
ucccugugggggacaggcacg

SEQ ID NO: 318613 - RNA, 19 nt, Bordetella pertussis
ucccuugagcguggcgucc

SEQ ID NO: 318614 - RNA, 21 nt, Bordetella pertussis
ucccuuggucgguaugccguc

SEQ ID NO: 318615 - RNA, 14 nt, Bordetella pertussis
uccgaaucuucgau

SEQ ID NO: 318616 - RNA, 23 nt, Bordetella pertussis
uccgaauuccugaacgccgggcc

SEQ ID NO: 318617 - RNA, 18 nt, Bordetella pertussis
uccgcccguugcggcgcc

SEQ ID NO: 318618 - RNA, 22 nt, Bordetella pertussis
uccgccgagaaauccagcgcgc

SEQ ID NO: 318619 - RNA, 15 nt, Bordetella pertussis
uccgccgccagcacg

SEQ ID NO: 318620 - RNA, 14 nt, Bordetella pertussis
uccgccgugcaggc

SEQ ID NO: 318621 - RNA, 22 nt, Bordetella pertussis
uccgccgugcaggcccgggcgc

SEQ ID NO: 318622 - RNA, 19 nt, Bordetella pertussis
uccgccguugcucgcgcgc

SEQ ID NO: 318623 - RNA, 20 nt, Bordetella pertussis
uccgccugcggacggcgggc

SEQ ID NO: 318624 - RNA, 14 nt, Bordetella pertussis
uccgcgucggccgc

SEQ ID NO: 318625 - RNA, 16 nt, Bordetella pertussis
uccgcucaugccggca

SEQ ID NO: 318626 - RNA, 17 nt, Bordetella pertussis
uccgcucaugccggcaa

SEQ ID NO: 318627 - RNA, 14 nt, Bordetella pertussis
uccggcccagcgcc

SEQ ID NO: 318628 - RNA, 17 nt, Bordetella pertussis
uccggcccagcgccauc

SEQ ID NO: 318629 - RNA, 14 nt, Bordetella pertussis
uccggccgcgcaag

SEQ ID NO: 318630 - RNA, 24 nt, Bordetella pertussis
uccggccgcgcaaggcggcccggc

SEQ ID NO: 318631 - RNA, 14 nt, Bordetella pertussis
uccggccgcgccag

SEQ ID NO: 318632 - RNA, 19 nt, Bordetella pertussis
uccggccgcacgcggccgc

SEQ ID NO: 318633 - RNA, 14 nt, Bordetella pertussis
uccggccgggccag

SEQ ID NO: 318634 - RNA, 15 nt, Bordetella pertussis
uccggcgcgcgcaag

SEQ ID NO: 318635 - RNA, 15 nt, Bordetella pertussis
uccggcgcucgcccc

SEQ ID NO: 318636 - RNA, 22 nt, Bordetella pertussis
uccggcgcucgccccggcgcgc

SEQ ID NO: 318637 - RNA, 20 nt, Bordetella pertussis
uccggcggcagcgcgaacgg

SEQ ID NO: 318638 - RNA, 20 nt, Bordetella pertussis
uccggcgugacguggcccac

SEQ ID NO: 318639 - RNA, 20 nt, Bordetella pertussis
uccggcgugguaucgcgcca

SEQ ID NO: 318640 - RNA, 21 nt, Bordetella pertussis
uccggcgugguaucgcgccag

SEQ ID NO: 318641 - RNA, 14 nt, Bordetella pertussis
uccggggcgggcgc

SEQ ID NO: 318642 - RNA, 17 nt, Bordetella pertussis
uccggggcgggcgcggu

SEQ ID NO: 318643 - RNA, 14 nt, Bordetella pertussis
uccggguccagccc

SEQ ID NO: 318644 - RNA, 13 nt, Bordetella pertussis
uccgggucgagcg

SEQ ID NO: 318645 - RNA, 14 nt, Bordetella pertussis
uccguaguccagca

SEQ ID NO: 318646 - RNA, 16 nt, Bordetella pertussis
uccucgucggcgaagc

SEQ ID NO: 318647 - RNA, 14 nt, Bordetella pertussis
uccucguugcccgc

SEQ ID NO: 318648 - RNA, 14 nt, Bordetella pertussis
uccugaacgccgcg

SEQ ID NO: 318649 - RNA, 15 nt, Bordetella pertussis
uccugcaaccagcuc

SEQ ID NO: 318650 - RNA, 15 nt, Bordetella pertussis
uccugcaaggccggc

SEQ ID NO: 318651 - RNA, 22 nt, Bordetella pertussis
uccugcaaggccggcggcacgc

SEQ ID NO: 318652 - RNA, 16 nt, Bordetella pertussis
uccugcagcacgcugg

SEQ ID NO: 318653 - RNA, 17 nt, Bordetella pertussis
uccugcaggcccggcgc

SEQ ID NO: 318654 - RNA, 19 nt, Bordetella pertussis
uccugcaggcggcgcauca

SEQ ID NO: 318655 - RNA, 22 nt, Bordetella pertussis
uccugccacuccugguugaccg

SEQ ID NO: 318656 - RNA, 16 nt, Bordetella pertussis
uccugccaggcgccgc

SEQ ID NO: 318657 - RNA, 24 nt, Bordetella pertussis
uccugccggggcacccaggcgggc

SEQ ID NO: 318658 - RNA, 15 nt, Bordetella pertussis
uccugcgccaguugc

SEQ ID NO: 318659 - RNA, 14 nt, Bordetella pertussis
uccugcggcgcggu

SEQ ID NO: 318660 - RNA, 15 nt, Bordetella pertussis
uccugcgugauggcg

SEQ ID NO: 318661 - RNA, 12 nt, Bordetella pertussis
uccugcuggcgc

SEQ ID NO: 318662 - RNA, 22 nt, Bordetella pertussis
uccugcuggcgcgucggcgcgc

SEQ ID NO: 318663 - RNA, 23 nt, Bordetella pertussis
uccugcuggcgcgucggcgcgcg

SEQ ID NO: 318664 - RNA, 20 nt, Bordetella pertussis
uccuggagucugcgugugcc

SEQ ID NO: 318665 - RNA, 22 nt, Bordetella pertussis
uccuggccgauuucgcgcgcca

SEQ ID NO: 318666 - RNA, 23 nt, Bordetella pertussis
uccuggccgccgcgggcgccgcg

SEQ ID NO: 318667 - RNA, 13 nt, Bordetella pertussis
uccuggcgcgcca

SEQ ID NO: 318668 - RNA, 16 nt, Bordetella pertussis
uccuggcgcggacauc

SEQ ID NO: 318669 - RNA, 14 nt, Bordetella pertussis
uccuggcgaccggc

SEQ ID NO: 318670 - RNA, 22 nt, Bordetella pertussis
uccuggcucugaucgcgcugga

SEQ ID NO: 318671 - RNA, 13 nt, Bordetella pertussis
uccugggcgccgg

SEQ ID NO: 318672 - RNA, 15 nt, Bordetella pertussis
uccugggccgagcgc

SEQ ID NO: 318673 - RNA, 22 nt, Bordetella pertussis
uccugggccgagcgcgccagca

SEQ ID NO: 318674 - RNA, 21 nt, Bordetella pertussis
uccugguaucccucgcccagc

SEQ ID NO: 318675 - RNA, 15 nt, Bordetella pertussis
uccuggucggcgcgg

SEQ ID NO: 318676 - RNA, 16 nt, Bordetella pertussis
uccuggucggcgcggc

SEQ ID NO: 318677 - RNA, 23 nt, Bordetella pertussis
uccugguucaggcgagcggcguc

SEQ ID NO: 318678 - RNA, 16 nt, Bordetella pertussis
uccugguugccgaagg

SEQ ID NO: 318679 - RNA, 14 nt, Bordetella pertussis
uccuugagcgccag

SEQ ID NO: 318680 - RNA, 18 nt, Bordetella pertussis
uccuugccauccagccag

SEQ ID NO: 318681 - RNA, 18 nt, Bordetella pertussis
ucgaacagcugcagcgac

SEQ ID NO: 318682 - RNA, 18 nt, Bordetella pertussis
ucgaacaggccaucgccg

SEQ ID NO: 318683 - RNA, 22 nt, Bordetella pertussis
ucgaacaggccaucgccgccgc

SEQ ID NO: 318684 - RNA, 13 nt, Bordetella pertussis
ucgaagccggcgc

SEQ ID NO: 318685 - RNA, 14 nt, Bordetella pertussis
ucgaaggcagcacc

SEQ ID NO: 318686 - RNA, 18 nt, Bordetella pertussis
ucgaaggcgaccggcacc

SEQ ID NO: 318687 - RNA, 14 nt, Bordetella pertussis
ucgaaggcgccgac

SEQ ID NO: 318688 - RNA, 17 nt, Bordetella pertussis
ucgaaggcgccgacggc

SEQ ID NO: 318689 - RNA, 13 nt, Bordetella pertussis
ucgaaggcgcgcu

SEQ ID NO: 318690 - RNA, 15 nt, Bordetella pertussis
ucgaaguccgcgcgc

SEQ ID NO: 318691 - RNA, 23 nt, Bordetella pertussis
ucgaccaccggcuugggcgugcc

SEQ ID NO: 318692 - RNA, 16 nt, Bordetella pertussis
ucgaccacgcgcgcgc

SEQ ID NO: 318693 - RNA, 17 nt, Bordetella pertussis
ucgaccacgcgcgcgcc

SEQ ID NO: 318694 - RNA, 15 nt, Bordetella pertussis
ucgaccacgcguccc

SEQ ID NO: 318695 - RNA, 18 nt, Bordetella pertussis
ucgaccagcccggccgcc

SEQ ID NO: 318696 - RNA, 20 nt, Bordetella pertussis
ucgaccagcccggccgccag

SEQ ID NO: 318697 - RNA, 21 nt, Bordetella pertussis
ucgaccagcccggccgccagc

SEQ ID NO: 318698 - RNA, 15 nt, Bordetella pertussis
ucgaccagcgcacgg

SEQ ID NO: 318699 - RNA, 18 nt, Bordetella pertussis
ucgaccaggccggugcgc

SEQ ID NO: 318700 - RNA, 21 nt, Bordetella pertussis
ucgaccaggcgggcaucgccc

SEQ ID NO: 318701 - RNA, 18 nt, Bordetella pertussis
ucgaccauguccgcgccc

SEQ ID NO: 318702 - RNA, 23 nt, Bordetella pertussis
ucgaccauuucgauuucggcggc

SEQ ID NO: 318703 - RNA, 20 nt, Bordetella pertussis
ucgacccacuugagcagcgc

SEQ ID NO: 318704 - RNA, 21 nt, Bordetella pertussis
ucgacccacuugagcagcgcc

SEQ ID NO: 318705 - RNA, 18 nt, Bordetella pertussis
ucgacgacggcaagucga

SEQ ID NO: 318706 - RNA, 22 nt, Bordetella pertussis
ucgacgacggcaagucgacgcu

SEQ ID NO: 318707 - RNA, 18 nt, Bordetella pertussis
ucgacgaggggguguucu

SEQ ID NO: 318708 - RNA, 14 nt, Bordetella pertussis
ucgacgauggcggg

SEQ ID NO: 318709 - RNA, 22 nt, Bordetella pertussis
ucgacgcagccuucguccugcc

SEQ ID NO: 318710 - RNA, 14 nt, Bordetella pertussis
ucgacgcggccgug

SEQ ID NO: 318711 - RNA, 20 nt, Bordetella pertussis
ucgacgcuguagaggcgcgg

SEQ ID NO: 318712 - RNA, 18 nt, Bordetella pertussis
ucgacgcuugccggcgau

SEQ ID NO: 318713 - RNA, 19 nt, Bordetella pertussis
ucgacguaagugcccaggc

SEQ ID NO: 318714 - RNA, 15 nt, Bordetella pertussis
ucgacguccagcccg

SEQ ID NO: 318715 - RNA, 15 nt, Bordetella pertussis
ucgacguccgcccgg

SEQ ID NO: 318716 - RNA, 16 nt, Bordetella pertussis
ucgacguugcgcgaca

SEQ ID NO: 318717 - RNA, 14 nt, Bordetella pertussis
ucgacuucgacccg

SEQ ID NO: 318718 - RNA, 19 nt, Bordetella pertussis
ucgagaaguuggcgggcgc

SEQ ID NO: 318719 - RNA, 20 nt, Bordetella pertussis
ucgagagccugggcgcgcgc

SEQ ID NO: 318720 - RNA, 15 nt, Bordetella pertussis
ucgagauccgccggc

SEQ ID NO: 318721 - RNA, 19 nt, Bordetella pertussis
ucgagcaucauggcgcgcg

SEQ ID NO: 318722 - RNA, 20 nt, Bordetella pertussis
ucgagcauugccgcggcaaa

SEQ ID NO: 318723 - RNA, 24 nt, Bordetella pertussis
ucgagcaucuggcgcauggccggc

SEQ ID NO: 318724 - RNA, 16 nt, Bordetella pertussis
ucgagcaugcgggcca

SEQ ID NO: 318725 - RNA, 22 nt, Bordetella pertussis
ucgagccgcagaacagcagcgu

SEQ ID NO: 318726 - RNA, 16 nt, Bordetella pertussis
ucgagccggacguggg

SEQ ID NO: 318727 - RNA, 15 nt, Bordetella pertussis
ucgagcuggcuggcc

SEQ ID NO: 318728 - RNA, 20 nt, Bordetella pertussis
ucgaggagcugcugugcgcc

SEQ ID NO: 318729 - RNA, 18 nt, Bordetella pertussis
ucgaggaucaaggcccgg

SEQ ID NO: 318730 - RNA, 19 nt, Bordetella pertussis
ucgaggucgaucucgggau

SEQ ID NO: 318731 - RNA, 16 nt, Bordetella pertussis
ucgaguuccgcgacgc

SEQ ID NO: 318732 - RNA, 17 nt, Bordetella pertussis
ucgaguuccgcgacgcg

SEQ ID NO: 318733 - RNA, 16 nt, Bordetella pertussis
ucgaguucggcgcgcc

SEQ ID NO: 318734 - RNA, 15 nt, Bordetella pertussis
ucgaucauggccagc

SEQ ID NO: 318735 - RNA, 14 nt, Bordetella pertussis
ucgaucauggcgcc

SEQ ID NO: 318736 - RNA, 12 nt, Bordetella pertussis
ucgauccggcag

SEQ ID NO: 318737 - RNA, 16 nt, Bordetella pertussis
ucgaucgccaccagcg

SEQ ID NO: 318738 - RNA, 17 nt, Bordetella pertussis
ucgaucgccgccggcac

SEQ ID NO: 318739 - RNA, 13 nt, Bordetella pertussis
ucgaucggcgcgc

SEQ ID NO: 318740 - RNA, 14 nt, Bordetella pertussis
ucgaucggcgcgcc

SEQ ID NO: 318741 - RNA, 23 nt, Bordetella pertussis
ucgaugaaauauugggcuggucg

SEQ ID NO: 318742 - RNA, 15 nt, Bordetella pertussis
ucgaugaaggcgccg

SEQ ID NO: 318743 - RNA, 20 nt, Bordetella pertussis
ucgaugaauuccagccaggc

SEQ ID NO: 318744 - RNA, 20 nt, Bordetella pertussis
ucgaugaccagcgccggcgc

SEQ ID NO: 318745 - RNA, 15 nt, Bordetella pertussis
ucgcagcacgcccag

SEQ ID NO: 318746 - RNA, 16 nt, Bordetella pertussis
ucgcagcacgcccaga

SEQ ID NO: 318747 - RNA, 16 nt, Bordetella pertussis
ucgcagcggaugccgc

SEQ ID NO: 318748 - RNA, 19 nt, Bordetella pertussis
ucgcaggccgcggccaggc

SEQ ID NO: 318749 - RNA, 13 nt, Bordetella pertussis
ucgcaggccugcu

SEQ ID NO: 318750 - RNA, 16 nt, Bordetella pertussis
ucgcauuggccgccgc

SEQ ID NO: 318751 - RNA, 14 nt, Bordetella pertussis
ucgccaccgcccag

SEQ ID NO: 318752 - RNA, 23 nt, Bordetella pertussis
ucgccaccucgaucaccaccggc

SEQ ID NO: 318753 - RNA, 20 nt, Bordetella pertussis
ucgccacgggcgucaccggc

SEQ ID NO: 318754 - RNA, 13 nt, Bordetella pertussis
ucgccagcaggcc

SEQ ID NO: 318755 - RNA, 15 nt, Bordetella pertussis
ucgccagcaggcgcu

SEQ ID NO: 318756 - RNA, 23 nt, Bordetella pertussis
ucgccagcgccggggucagcgcc

SEQ ID NO: 318757 - RNA, 16 nt, Bordetella pertussis
ucgccagcggcagcgc

SEQ ID NO: 318758 - RNA, 17 nt, Bordetella pertussis
ucgccagcggcagcgcg

SEQ ID NO: 318759 - RNA, 18 nt, Bordetella pertussis
ucgccagcggcagcgcgc

SEQ ID NO: 318760 - RNA, 13 nt, Bordetella pertussis
ucgccaugcugcc

SEQ ID NO: 318761 - RNA, 22 nt, Bordetella pertussis
ucgcccacauagcggccggcgc

SEQ ID NO: 318762 - RNA, 20 nt, Bordetella pertussis
ucgcccaccaccagcggcgu

SEQ ID NO: 318763 - RNA, 20 nt, Bordetella pertussis
ucgcccauugcggcgggcgg

SEQ ID NO: 318764 - RNA, 20 nt, Bordetella pertussis
ucgcccccgaaggccgcgcc

SEQ ID NO: 318765 - RNA, 18 nt, Bordetella pertussis
ucgcccccgcgccgcgca

SEQ ID NO: 318766 - RNA, 14 nt, Bordetella pertussis
ucgccccgacgcgc

SEQ ID NO: 318767 - RNA, 14 nt, Bordetella pertussis
ucgccccggcgcgc

SEQ ID NO: 318768 - RNA, 19 nt, Bordetella pertussis
ucgccccggcgcgcagcgc

SEQ ID NO: 318769 - RNA, 20 nt, Bordetella pertussis
ucgcccgaccugcuggcgcg

SEQ ID NO: 318770 - RNA, 21 nt, Bordetella pertussis
ucgcccgaccugcuggcgcgc

SEQ ID NO: 318771 - RNA, 17 nt, Bordetella pertussis
ucgcccgaucggccggc

SEQ ID NO: 318772 - RNA, 14 nt, Bordetella pertussis
ucgcccugcuggcg

SEQ ID NO: 318773 - RNA, 17 nt, Bordetella pertussis
ucgcccugcuggcgcag

SEQ ID NO: 318774 - RNA, 20 nt, Bordetella pertussis
ucgcccuggauggcggccgc

SEQ ID NO: 318775 - RNA, 23 nt, Bordetella pertussis
ucgcccuggauggcggccgccag

SEQ ID NO: 318776 - RNA, 12 nt, Bordetella pertussis
ucgcccuggcgc

SEQ ID NO: 318777 - RNA, 18 nt, Bordetella pertussis
ucgccgacccgggcgggc

SEQ ID NO: 318778 - RNA, 20 nt, Bordetella pertussis
ucgccgacgaaagcggcaaa

SEQ ID NO: 318779 - RNA, 14 nt, Bordetella pertussis
ucgccgcccagccg

SEQ ID NO: 318780 - RNA, 21 nt, Bordetella pertussis
ucgccgcccugcugcccgccg

SEQ ID NO: 318781 - RNA, 19 nt, Bordetella pertussis
ucgccgccgaagccgccgc

SEQ ID NO: 318782 - RNA, 13 nt, Bordetella pertussis
ucgccgccgcgcc

SEQ ID NO: 318783 - RNA, 14 nt, Bordetella pertussis
ucgccgccgcgccg

SEQ ID NO: 318784 - RNA, 12 nt, Bordetella pertussis
ucgccgccggca

SEQ ID NO: 318785 - RNA, 14 nt, Bordetella pertussis
ucgccgcggcgggc

SEQ ID NO: 318786 - RNA, 16 nt, Bordetella pertussis
ucgccgcggcgggcga

SEQ ID NO: 318787 - RNA, 15 nt, Bordetella pertussis
ucgccgcgggccugc

SEQ ID NO: 318788 - RNA, 23 nt, Bordetella pertussis
ucgccgcgucguucaucgcccau

SEQ ID NO: 318789 - RNA, 15 nt, Bordetella pertussis
ucgccgcuggccagc

SEQ ID NO: 318790 - RNA, 13 nt, Bordetella pertussis
ucgccgcugcgca

SEQ ID NO: 318791 - RNA, 16 nt, Bordetella pertussis
ucgccgcuggccagcc

SEQ ID NO: 318792 - RNA, 15 nt, Bordetella pertussis
ucgccggccuggcgc

SEQ ID NO: 318793 - RNA, 17 nt, Bordetella pertussis
ucgccggcgaugacggc

SEQ ID NO: 318794 - RNA, 14 nt, Bordetella pertussis
ucgccggcgcaacg

SEQ ID NO: 318795 - RNA, 12 nt, Bordetella pertussis
ucgccggcgccc

SEQ ID NO: 318796 - RNA, 14 nt, Bordetella pertussis
ucgccggcgccgcc

SEQ ID NO: 318797 - RNA, 14 nt, Bordetella pertussis
ucgccggcgccguc

SEQ ID NO: 318798 - RNA, 15 nt, Bordetella pertussis
ucgccggcggcgugg

SEQ ID NO: 318799 - RNA, 18 nt, Bordetella pertussis
ucgccgucgaaacacgau

SEQ ID NO: 318800 - RNA, 19 nt, Bordetella pertussis
ucgccgucgacgucgguga

SEQ ID NO: 318801 - RNA, 19 nt, Bordetella pertussis
ucgccgucgacgccgaagg

SEQ ID NO: 318802 - RNA, 14 nt, Bordetella pertussis
ucgccgugcagggc

SEQ ID NO: 318803 - RNA, 20 nt, Bordetella pertussis
ucgccguucuggcugcgcgc

SEQ ID NO: 318804 - RNA, 18 nt, Bordetella pertussis
ucgccguucuucgaucgc

SEQ ID NO: 318805 - RNA, 22 nt, Bordetella pertussis
ucgccguucuucgaucgccugg

SEQ ID NO: 318806 - RNA, 22 nt, Bordetella pertussis
ucgccuauuuccagggcgucgc

SEQ ID NO: 318807 - RNA, 13 nt, Bordetella pertussis
ucgccucgaccuc

SEQ ID NO: 318808 - RNA, 23 nt, Bordetella pertussis
ucgccucggcuugcgcggcgcgu

SEQ ID NO: 318809 - RNA, 23 nt, Bordetella pertussis
ucgccugacguucggggcgucgc

SEQ ID NO: 318810 - RNA, 15 nt, Bordetella pertussis
ucgccuggggcgggc

SEQ ID NO: 318811 - RNA, 23 nt, Bordetella pertussis
ucgccuggggcgggcgcugcgcg

SEQ ID NO: 318812 - RNA, 15 nt, Bordetella pertussis
ucgccuugucgggga

SEQ ID NO: 318813 - RNA, 14 nt, Bordetella pertussis
ucgcgaaagcacgc

SEQ ID NO: 318814 - RNA, 13 nt, Bordetella pertussis
ucgcgaaagcggc

SEQ ID NO: 318815 - RNA, 17 nt, Bordetella pertussis
ucgcgaccgccaagcag

SEQ ID NO: 318816 - RNA, 13 nt, Bordetella pertussis
ucgcgaccgccgc

SEQ ID NO: 318817 - RNA, 13 nt, Bordetella pertussis
ucgcgaccucggc

SEQ ID NO: 318818 - RNA, 20 nt, Bordetella pertussis
ucgcgaccugcgggcgcagc

SEQ ID NO: 318819 - RNA, 16 nt, Bordetella pertussis
ucgcgaugcgccaggc

SEQ ID NO: 318820 - RNA, 23 nt, Bordetella pertussis
ucgcgaugcucgauaugcagcac

SEQ ID NO: 318821 - RNA, 16 nt, Bordetella pertussis
ucgcgcaagggccagu

SEQ ID NO: 318822 - RNA, 20 nt, Bordetella pertussis
ucgcgcaauacgccgccggc

SEQ ID NO: 318823 - RNA, 19 nt, Bordetella pertussis
ucgcgcacuuguggaccgc

SEQ ID NO: 318824 - RNA, 19 nt, Bordetella pertussis
ucgcgcagcaacccgcccg

SEQ ID NO: 318825 - RNA, 20 nt, Bordetella pertussis
ucgcgcagcaacccgcccgg

SEQ ID NO: 318826 - RNA, 14 nt, Bordetella pertussis
ucgcgcagcaccgc

SEQ ID NO: 318827 - RNA, 16 nt, Bordetella pertussis
ucgcgcagcaccgcca

SEQ ID NO: 318828 - RNA, 17 nt, Bordetella pertussis
ucgcgcagcaccgccag

SEQ ID NO: 318829 - RNA, 20 nt, Bordetella pertussis
ucgcgcagcaccgccagcgc

SEQ ID NO: 318830 - RNA, 15 nt, Bordetella pertussis
ucgcgcagcagcuug

SEQ ID NO: 318831 - RNA, 21 nt, Bordetella pertussis
ucgcgcagcagcuugccgacc

SEQ ID NO: 318832 - RNA, 18 nt, Bordetella pertussis
ucgcgcagcaggccgcgc

SEQ ID NO: 318833 - RNA, 15 nt, Bordetella pertussis
ucgcgcagcagggcc

SEQ ID NO: 318834 - RNA, 12 nt, Bordetella pertussis
ucgcgcagccac

SEQ ID NO: 318835 - RNA, 21 nt, Bordetella pertussis
ucgcgcagccacagcgcgugg

SEQ ID NO: 318836 - RNA, 13 nt, Bordetella pertussis
ucgcgcagcgagu

SEQ ID NO: 318837 - RNA, 13 nt, Bordetella pertussis
ucgcgcagcaggc

SEQ ID NO: 318838 - RNA, 22 nt, Bordetella pertussis
ucgcgccacggcuucgcccagc

SEQ ID NO: 318839 - RNA, 22 nt, Bordetella pertussis
ucgcgccagaacgacagcgaca

SEQ ID NO: 318840 - RNA, 15 nt, Bordetella pertussis
ucgcgccagcgccgc

SEQ ID NO: 318841 - RNA, 17 nt, Bordetella pertussis
ucgcgccagcgccgcgc

SEQ ID NO: 318842 - RNA, 18 nt, Bordetella pertussis
ucgcgccagcgccgcgcg

SEQ ID NO: 318843 - RNA, 21 nt, Bordetella pertussis
ucgcgccagcgccgcgcgcgu

SEQ ID NO: 318844 - RNA, 13 nt, Bordetella pertussis
ucgcgccagcggc

SEQ ID NO: 318845 - RNA, 16 nt, Bordetella pertussis
ucgcgccagcggccgu

SEQ ID NO: 318846 - RNA, 19 nt, Bordetella pertussis
ucgcgccagcggccgucgc

SEQ ID NO: 318847 - RNA, 18 nt, Bordetella pertussis
ucgcgccaggccccgccg

SEQ ID NO: 318848 - RNA, 21 nt, Bordetella pertussis
ucgcgccagggccccuccggc

SEQ ID NO: 318849 - RNA, 13 nt, Bordetella pertussis
ucgcgcccaucuc

SEQ ID NO: 318850 - RNA, 18 nt, Bordetella pertussis
ucgcgcccaucucggccg

SEQ ID NO: 318851 - RNA, 16 nt, Bordetella pertussis
ucgcgcgacuggccca

SEQ ID NO: 318852 - RNA, 20 nt, Bordetella pertussis
ucgcgcgagaauggcgcgau

SEQ ID NO: 318853 - RNA, 22 nt, Bordetella pertussis
ucgcgcgagaccagcggaucgc

SEQ ID NO: 318854 - RNA, 22 nt, Bordetella pertussis
ucgcgcgauguucaggccggcc

SEQ ID NO: 318855 - RNA, 22 nt, Bordetella pertussis
ucgcgcgccaggugcacggugg

SEQ ID NO: 318856 - RNA, 14 nt, Bordetella pertussis
ucgcgcgccgccgc

SEQ ID NO: 318857 - RNA, 16 nt, Bordetella pertussis
ucgcgcgcaucgccga

SEQ ID NO: 318858 - RNA, 11 nt, Bordetella pertussis
ucgcgcgccac

SEQ ID NO: 318859 - RNA, 19 nt, Bordetella pertussis
ucgcgcgccugcgcgccgc

SEQ ID NO: 318860 - RNA, 20 nt, Bordetella pertussis
ucgcgcgcgcgggcgcgcag

SEQ ID NO: 318861 - RNA, 15 nt, Bordetella pertussis
ucgcgcgcgcucagg

SEQ ID NO: 318862 - RNA, 21 nt, Bordetella pertussis
ucgcgcgcgcucagggggcgc

SEQ ID NO: 318863 - RNA, 21 nt, Bordetella pertussis
ucgcgcgcgugcucgcgcaac

SEQ ID NO: 318864 - RNA, 23 nt, Bordetella pertussis
ucgcgcgcgccugccccgccugc

SEQ ID NO: 318865 - RNA, 13 nt, Bordetella pertussis
ucgcgcggccggu

SEQ ID NO: 318866 - RNA, 20 nt, Bordetella pertussis
ucgcgcggcgacacccccag

SEQ ID NO: 318867 - RNA, 21 nt, Bordetella pertussis
ucgcgcggcgacacccccagg

SEQ ID NO: 318868 - RNA, 17 nt, Bordetella pertussis
ucgcgcggauccuugac

SEQ ID NO: 318869 - RNA, 15 nt, Bordetella pertussis
ucgcgcggcggcacc

SEQ ID NO: 318870 - RNA, 17 nt, Bordetella pertussis
ucgcgguaaccggcgau

SEQ ID NO: 318871 - RNA, 16 nt, Bordetella pertussis
ucgcgguacgcccagc

SEQ ID NO: 318872 - RNA, 19 nt, Bordetella pertussis
ucgcgguacgcccagcugg

SEQ ID NO: 318873 - RNA, 15 nt, Bordetella pertussis
ucgcgguaggacggc

SEQ ID NO: 318874 - RNA, 20 nt, Bordetella pertussis
ucgcgguccugaccggcggc

SEQ ID NO: 318875 - RNA, 17 nt, Bordetella pertussis
ucgcggucaucggcgac

SEQ ID NO: 318876 - RNA, 19 nt, Bordetella pertussis
ucgcguccaggcccagcgc

SEQ ID NO: 318877 - RNA, 17 nt, Bordetella pertussis
ucgcgucguugcgccga

SEQ ID NO: 318878 - RNA, 21 nt, Bordetella pertussis
ucgcgucguugcgccgaucgc

SEQ ID NO: 318879 - RNA, 17 nt, Bordetella pertussis
ucgcgucgguugcccgu

SEQ ID NO: 318880 - RNA, 19 nt, Bordetella pertussis
ucgcuaugcagcugcgcca

SEQ ID NO: 318881 - RNA, 23 nt, Bordetella pertussis
ucgcucauggaggggcgcaggca

SEQ ID NO: 318882 - RNA, 15 nt, Bordetella pertussis
ucgcugccggcgccc

SEQ ID NO: 318883 - RNA, 21 nt, Bordetella pertussis
ucgcugcgaaacagcagcgga

SEQ ID NO: 318884 - RNA, 19 nt, Bordetella pertussis
ucgcugcgcacgcuggcgc

SEQ ID NO: 318885 - RNA, 21 nt, Bordetella pertussis
ucgcugcgcacgcuggcgccc

SEQ ID NO: 318886 - RNA, 13 nt, Bordetella pertussis
ucgcugcgcggaa

SEQ ID NO: 318887 - RNA, 15 nt, Bordetella pertussis
ucgcugcgggcggcc

SEQ ID NO: 318888 - RNA, 13 nt, Bordetella pertussis
ucgcugcugaccg

SEQ ID NO: 318889 - RNA, 18 nt, Bordetella pertussis
ucgcugcugaccgacggc

SEQ ID NO: 318890 - RNA, 12 nt, Bordetella pertussis
ucgcugcuggcg

SEQ ID NO: 318891 - RNA, 16 nt, Bordetella pertussis
ucgcugcucgacagca

SEQ ID NO: 318892 - RNA, 13 nt, Bordetella pertussis
ucgcuggagaccg

SEQ ID NO: 318893 - RNA, 17 nt, Bordetella pertussis
ucgcuucgguggcgcgc

SEQ ID NO: 318894 - RNA, 21 nt, Bordetella pertussis
ucgcuuuccaggguggccagu

SEQ ID NO: 318895 - RNA, 17 nt, Bordetella pertussis
ucggacgcgccgggcga

SEQ ID NO: 318896 - RNA, 21 nt, Bordetella pertussis
ucggacgcgccgggcgaaccg

SEQ ID NO: 318897 - RNA, 13 nt, Bordetella pertussis
ucggacgccgcgc

SEQ ID NO: 318898 - RNA, 13 nt, Bordetella pertussis
ucggcaaccgcgc

SEQ ID NO: 318899 - RNA, 16 nt, Bordetella pertussis
ucggcaaccgucgcca

SEQ ID NO: 318900 - RNA, 17 nt, Bordetella pertussis
ucggcaccaucguugcc

SEQ ID NO: 318901 - RNA, 19 nt, Bordetella pertussis
ucggcaccaucguugccug

SEQ ID NO: 318902 - RNA, 14 nt, Bordetella pertussis
ucggcacccagccg

SEQ ID NO: 318903 - RNA, 22 nt, Bordetella pertussis
ucggcacccgcaugguggcgca

SEQ ID NO: 318904 - RNA, 23 nt, Bordetella pertussis
ucggcaccgaggccgaguggccg

SEQ ID NO: 318905 - RNA, 16 nt, Bordetella pertussis
ucggcauggccaggaa

SEQ ID NO: 318906 - RNA, 13 nt, Bordetella pertussis
ucggcauggccau

SEQ ID NO: 318907 - RNA, 18 nt, Bordetella pertussis
ucggcauggccaucgcgg

SEQ ID NO: 318908 - RNA, 22 nt, Bordetella pertussis
ucggcauggguaaagcgccggc

SEQ ID NO: 318909 - RNA, 19 nt, Bordetella pertussis
ucggcaugguagcggucca

SEQ ID NO: 318910 - RNA, 19 nt, Bordetella pertussis
ucggcauggucggcauggc

SEQ ID NO: 318911 - RNA, 21 nt, Bordetella pertussis
ucggccaaggcauuggcgccg

SEQ ID NO: 318912 - RNA, 17 nt, Bordetella pertussis
ucggccaaggccggcgc

SEQ ID NO: 318913 - RNA, 20 nt, Bordetella pertussis
ucggccaaggccggcgcguc

SEQ ID NO: 318914 - RNA, 17 nt, Bordetella pertussis
ucggccaaucggccugc

SEQ ID NO: 318915 - RNA, 15 nt, Bordetella pertussis
ucggccacgucggcg

SEQ ID NO: 318916 - RNA, 18 nt, Bordetella pertussis
ucggccacgucggcggcc

SEQ ID NO: 318917 - RNA, 18 nt, Bordetella pertussis
ucggccacuuccuggugg

SEQ ID NO: 318918 - RNA, 17 nt, Bordetella pertussis
ucggccacuucgcggcc

SEQ ID NO: 318919 - RNA, 20 nt, Bordetella pertussis
ucggccacuuucgcgcgcgc

SEQ ID NO: 318920 - RNA, 23 nt, Bordetella pertussis
ucggccagcacgucauccugggc

SEQ ID NO: 318921 - RNA, 19 nt, Bordetella pertussis
ucggccaggccggccugca

SEQ ID NO: 318922 - RNA, 17 nt, Bordetella pertussis
ucggccaggcgccugag

SEQ ID NO: 318923 - RNA, 15 nt, Bordetella pertussis
ucggccaggucgcgc

SEQ ID NO: 318924 - RNA, 18 nt, Bordetella pertussis
ucggccaggucgcgcauc

SEQ ID NO: 318925 - RNA, 21 nt, Bordetella pertussis
ucggcccguuccacaggcgau

SEQ ID NO: 318926 - RNA, 23 nt, Bordetella pertussis
ucggccgacucgaaacgggcggc

SEQ ID NO: 318927 - RNA, 17 nt, Bordetella pertussis
ucggccgcauggcggcc

SEQ ID NO: 318928 - RNA, 11 nt, Bordetella pertussis
ucggccgcgcc

SEQ ID NO: 318929 - RNA, 12 nt, Bordetella pertussis
ucggccgcgccc

SEQ ID NO: 318930 - RNA, 13 nt, Bordetella pertussis
ucggccgcgccca

SEQ ID NO: 318931 - RNA, 16 nt, Bordetella pertussis
ucggccgcgcgcauca

SEQ ID NO: 318932 - RNA, 22 nt, Bordetella pertussis
ucggccgcggcguugcggcagc

SEQ ID NO: 318933 - RNA, 15 nt, Bordetella pertussis
ucggccuggcgcucc

SEQ ID NO: 318934 - RNA, 13 nt, Bordetella pertussis
ucggccugggcgc

SEQ ID NO: 318935 - RNA, 15 nt, Bordetella pertussis
ucggccugggcgcga

SEQ ID NO: 318936 - RNA, 20 nt, Bordetella pertussis
ucggccuugggcgcggcggc

SEQ ID NO: 318937 - RNA, 13 nt, Bordetella pertussis
ucggcgaagccgc

SEQ ID NO: 318938 - RNA, 24 nt, Bordetella pertussis
ucggcgaagccgcagcggcagcgc

SEQ ID NO: 318939 - RNA, 22 nt, Bordetella pertussis
ucggcgaagccuugcgcggcca

SEQ ID NO: 318940 - RNA, 20 nt, Bordetella pertussis
ucggcgaagugcccgcuggc

SEQ ID NO: 318941 - RNA, 15 nt, Bordetella pertussis
ucggcgaccaggugc

SEQ ID NO: 318942 - RNA, 22 nt, Bordetella pertussis
ucggcgaccaggugcgggccgc

SEQ ID NO: 318943 - RNA, 19 nt, Bordetella pertussis
ucggcgaccgccggccggu

SEQ ID NO: 318944 - RNA, 19 nt, Bordetella pertussis
ucggcgaccgugcgccaac

SEQ ID NO: 318945 - RNA, 17 nt, Bordetella pertussis
ucggcgacuucggcggc

SEQ ID NO: 318946 - RNA, 19 nt, Bordetella pertussis
ucggcgacuucggcggccu

SEQ ID NO: 318947 - RNA, 20 nt, Bordetella pertussis
ucggcgacgugaugcucgau

SEQ ID NO: 318948 - RNA, 20 nt, Bordetella pertussis
ucggcgaucugggccucggc

SEQ ID NO: 318949 - RNA, 20 nt, Bordetella pertussis
ucggcgaucuuguaggcgau

SEQ ID NO: 318950 - RNA, 14 nt, Bordetella pertussis
ucggcgaugaacag

SEQ ID NO: 318951 - RNA, 22 nt, Bordetella pertussis
ucggcgaugccguacuuggcga

SEQ ID NO: 318952 - RNA, 13 nt, Bordetella pertussis
ucggcgaugcgcc

SEQ ID NO: 318953 - RNA, 20 nt, Bordetella pertussis
ucggcgaugcgggcggcggu

SEQ ID NO: 318954 - RNA, 17 nt, Bordetella pertussis
ucggcgauggcccggua

SEQ ID NO: 318955 - RNA, 16 nt, Bordetella pertussis
ucggcgauggcgcgcg

SEQ ID NO: 318956 - RNA, 16 nt, Bordetella pertussis
ucggcgccgcgcgcgg

SEQ ID NO: 318957 - RNA, 13 nt, Bordetella pertussis
ucggcgccgcggc

SEQ ID NO: 318958 - RNA, 16 nt, Bordetella pertussis
ucggcgccgcggcgcu

SEQ ID NO: 318959 - RNA, 14 nt, Bordetella pertussis
ucggcgccgcgcag

SEQ ID NO: 318960 - RNA, 18 nt, Bordetella pertussis
ucggcgccggcggcgcgg

SEQ ID NO: 318961 - RNA, 13 nt, Bordetella pertussis
ucggcgccggcgu

SEQ ID NO: 318962 - RNA, 20 nt, Bordetella pertussis
ucggcgccgggcgacggcgu

SEQ ID NO: 318963 - RNA, 17 nt, Bordetella pertussis
ucggcgcgagcgaugcc

SEQ ID NO: 318964 - RNA, 18 nt, Bordetella pertussis
ucggcgcgcagcagacgc

SEQ ID NO: 318965 - RNA, 19 nt, Bordetella pertussis
ucggcgcgcagcagacgcu

SEQ ID NO: 318966 - RNA, 16 nt, Bordetella pertussis
ucggcgcgcccgccac

SEQ ID NO: 318967 - RNA, 19 nt, Bordetella pertussis
ucggcgcgcccgccacguc

SEQ ID NO: 318968 - RNA, 11 nt, Bordetella pertussis
ucggcgcgcgc

SEQ ID NO: 318969 - RNA, 13 nt, Bordetella pertussis
ucggcgcgcgcca

SEQ ID NO: 318970 - RNA, 18 nt, Bordetella pertussis
ucggcgcgcgccaggccc

SEQ ID NO: 318971 - RNA, 12 nt, Bordetella pertussis
ucggcgcgcgcu

SEQ ID NO: 318972 - RNA, 19 nt, Bordetella pertussis
ucggcgcgcgcugcacggc

SEQ ID NO: 318973 - RNA, 22 nt, Bordetella pertussis
ucggcgcggcgccguccagcgc

SEQ ID NO: 318974 - RNA, 16 nt, Bordetella pertussis
ucgggaaacaggccca

SEQ ID NO: 318975 - RNA, 14 nt, Bordetella pertussis
ucgggacggcgcgg

SEQ ID NO: 318976 - RNA, 17 nt, Bordetella pertussis
ucgggagccaguccccg

SEQ ID NO: 318977 - RNA, 15 nt, Bordetella pertussis
ucgggcacggccagc

SEQ ID NO: 318978 - RNA, 16 nt, Bordetella pertussis
ucgggcacguccggau

SEQ ID NO: 318979 - RNA, 19 nt, Bordetella pertussis
ucgggcagcacgcgcacca

SEQ ID NO: 318980 - RNA, 12 nt, Bordetella pertussis
ucgggcagcgcc

SEQ ID NO: 318981 - RNA, 19 nt, Bordetella pertussis
ucgggcagcgcccgcgcca

SEQ ID NO: 318982 - RNA, 21 nt, Bordetella pertussis
ucgggcagcgcccgcgccauc

SEQ ID NO: 318983 - RNA, 17 nt, Bordetella pertussis
ucgggcagcagcagggc

SEQ ID NO: 318984 - RNA, 19 nt, Bordetella pertussis
ucgggcagcuuggcgcgcc

SEQ ID NO: 318985 - RNA, 17 nt, Bordetella pertussis
ucgggcaggauggccau

SEQ ID NO: 318986 - RNA, 21 nt, Bordetella pertussis
ucgggcagggcgacgucccag

SEQ ID NO: 318987 - RNA, 18 nt, Bordetella pertussis
ucgggcaggucggccagc

SEQ ID NO: 318988 - RNA, 16 nt, Bordetella pertussis
ucgggcaggucggcgc

SEQ ID NO: 318989 - RNA, 14 nt, Bordetella pertussis
ucgggcaugucgcg

SEQ ID NO: 318990 - RNA, 21 nt, Bordetella pertussis
ucgggcaugucgcggcccacg

SEQ ID NO: 318991 - RNA, 20 nt, Bordetella pertussis
ucgggccgcgcgcgggcgcc

SEQ ID NO: 318992 - RNA, 19 nt, Bordetella pertussis
ucgggcgacaggcgcgccc

SEQ ID NO: 318993 - RNA, 14 nt, Bordetella pertussis
ucgggcgucaugcg

SEQ ID NO: 318994 - RNA, 16 nt, Bordetella pertussis
ucgggcucgcgcgcgc

SEQ ID NO: 318995 - RNA, 13 nt, Bordetella pertussis
ucgggcugcugcc

SEQ ID NO: 318996 - RNA, 20 nt, Bordetella pertussis
ucggggaaauugacggcgcu

SEQ ID NO: 318997 - RNA, 22 nt, Bordetella pertussis
ucggggcaacgacgcaggcgcc

SEQ ID NO: 318998 - RNA, 14 nt, Bordetella pertussis
ucgggguggcgccg

SEQ ID NO: 318999 - RNA, 17 nt, Bordetella pertussis
ucggucacguucagcgc

SEQ ID NO: 319000 - RNA, 14 nt, Bordetella pertussis
ucggucagcacuug

SEQ ID NO: 319001 - RNA, 14 nt, Bordetella pertussis
ucggucagcacgaa

SEQ ID NO: 319002 - RNA, 14 nt, Bordetella pertussis
ucggucagcgcggc

SEQ ID NO: 319003 - RNA, 21 nt, Bordetella pertussis
ucggucagggcgaagcgcgcc

SEQ ID NO: 319004 - RNA, 17 nt, Bordetella pertussis
ucggucauguccagcgc

SEQ ID NO: 319005 - RNA, 18 nt, Bordetella pertussis
ucggucauguccagcgcc

SEQ ID NO: 319006 - RNA, 17 nt, Bordetella pertussis
ucggucgcuuccagcgc

SEQ ID NO: 319007 - RNA, 16 nt, Bordetella pertussis
ucggucgucagcacgc

SEQ ID NO: 319008 - RNA, 23 nt, Bordetella pertussis
ucggugguggugacguugaccuu

SEQ ID NO: 319009 - RNA, 19 nt, Bordetella pertussis
ucguagcccucgcccagga

SEQ ID NO: 319010 - RNA, 14 nt, Bordetella pertussis
ucguagccgccgac

SEQ ID NO: 319011 - RNA, 14 nt, Bordetella pertussis
ucguagugcgcgcc

SEQ ID NO: 319012 - RNA, 20 nt, Bordetella pertussis
ucguccagcacgcggcgcag

SEQ ID NO: 319013 - RNA, 20 nt, Bordetella pertussis
ucguccagcgucaugcgcac

SEQ ID NO: 319014 - RNA, 15 nt, Bordetella pertussis
ucgucgaaggcgcgc

SEQ ID NO: 319015 - RNA, 15 nt, Bordetella pertussis
ucgucgaucauggcg

SEQ ID NO: 319016 - RNA, 13 nt, Bordetella pertussis
ucgucgaugccga

SEQ ID NO: 319017 - RNA, 15 nt, Bordetella pertussis
ucgucgccaugcggc

SEQ ID NO: 319018 - RNA, 20 nt, Bordetella pertussis
ucgucgccaugcggcuggcc

SEQ ID NO: 319019 - RNA, 13 nt, Bordetella pertussis
ucgucggcgccau

SEQ ID NO: 319020 - RNA, 17 nt, Bordetella pertussis
ucgucgccaccgcccag

SEQ ID NO: 319021 - RNA, 20 nt, Bordetella pertussis
ucgucggcgcugcagcgcag

SEQ ID NO: 319022 - RNA, 19 nt, Bordetella pertussis
ucgucgggaccggcgcguu

SEQ ID NO: 319023 - RNA, 21 nt, Bordetella pertussis
ucgucggggucgucggcgcug

SEQ ID NO: 319024 - RNA, 13 nt, Bordetella pertussis
ucgucggucagcu

SEQ ID NO: 319025 - RNA, 19 nt, Bordetella pertussis
ucgucguagccgccgacgu

SEQ ID NO: 319026 - RNA, 14 nt, Bordetella pertussis
ucgucguagcgcca

SEQ ID NO: 319027 - RNA, 16 nt, Bordetella pertussis
ucgucguagcgggcgg

SEQ ID NO: 319028 - RNA, 20 nt, Bordetella pertussis
ucgucguggucgucccgcag

SEQ ID NO: 319029 - RNA, 16 nt, Bordetella pertussis
ucgucguuucccagca

SEQ ID NO: 319030 - RNA, 19 nt, Bordetella pertussis
ucgucguuucccagcaagc

SEQ ID NO: 319031 - RNA, 19 nt, Bordetella pertussis
ucgugauccugaccaucau

SEQ ID NO: 319032 - RNA, 18 nt, Bordetella pertussis
ucguggcccagcaccgcc

SEQ ID NO: 319033 - RNA, 23 nt, Bordetella pertussis
ucguggccgcuucggcggccaug

SEQ ID NO: 319034 - RNA, 13 nt, Bordetella pertussis
ucguggcgcagcu

SEQ ID NO: 319035 - RNA, 12 nt, Bordetella pertussis
ucguggcgcgcc

SEQ ID NO: 319036 - RNA, 13 nt, Bordetella pertussis
ucucccgcaggcc

SEQ ID NO: 319037 - RNA, 13 nt, Bordetella pertussis
ucucccggcgccc

SEQ ID NO: 319038 - RNA, 17 nt, Bordetella pertussis
ucuccgggagccugucc

SEQ ID NO: 319039 - RNA, 18 nt, Bordetella pertussis
ucucgacgcaaucggcga

SEQ ID NO: 319040 - RNA, 14 nt, Bordetella pertussis
ucucgacggcgcgc

SEQ ID NO: 319041 - RNA, 13 nt, Bordetella pertussis
ucucgaugcgcgc

SEQ ID NO: 319042 - RNA, 22 nt, Bordetella pertussis
ucucgaugcggucggccgcgcc

SEQ ID NO: 319043 - RNA, 20 nt, Bordetella pertussis
ucucgcccaggcccagcauc

SEQ ID NO: 319044 - RNA, 16 nt, Bordetella pertussis
ucucggaaaacuggcg

SEQ ID NO: 319045 - RNA, 20 nt, Bordetella pertussis
ucucggcaucggccacgcug

SEQ ID NO: 319046 - RNA, 14 nt, Bordetella pertussis
ucucggccagcagc

SEQ ID NO: 319047 - RNA, 21 nt, Bordetella pertussis
ucucggccucgcggcgcagca

SEQ ID NO: 319048 - RNA, 20 nt, Bordetella pertussis
ucucggcguugaccggguug

SEQ ID NO: 319049 - RNA, 19 nt, Bordetella pertussis
ucucgggcaggucggccag

SEQ ID NO: 319050 - RNA, 20 nt, Bordetella pertussis
ucucgguggaggacgccgac

SEQ ID NO: 319051 - RNA, 21 nt, Bordetella pertussis
ucugacgggucacccgccgca

SEQ ID NO: 319052 - RNA, 16 nt, Bordetella pertussis
ucugagcgccggggug

SEQ ID NO: 319053 - RNA, 17 nt, Bordetella pertussis
ucugcaaggccugcugc

SEQ ID NO: 319054 - RNA, 17 nt, Bordetella pertussis
ucugcaccuugggcgcc

SEQ ID NO: 319055 - RNA, 22 nt, Bordetella pertussis
ucugccacagcgugacggcggc

SEQ ID NO: 319056 - RNA, 18 nt, Bordetella pertussis
ucugccacaucacgccgg

SEQ ID NO: 319057 - RNA, 17 nt, Bordetella pertussis
ucugccagacggccagc

SEQ ID NO: 319058 - RNA, 23 nt, Bordetella pertussis
ucugccaguugaaccgcaacgcc

SEQ ID NO: 319059 - RNA, 22 nt, Bordetella pertussis
ucugccgcgcauuugccgcggc

SEQ ID NO: 319060 - RNA, 22 nt, Bordetella pertussis
ucugcgcaucgaugcggccuuc

SEQ ID NO: 319061 - RNA, 23 nt, Bordetella pertussis
ucugcugguacagccccagcgcc

SEQ ID NO: 319062 - RNA, 23 nt, Bordetella pertussis
ucuggcaacguugcugcagcguc

SEQ ID NO: 319063 - RNA, 22 nt, Bordetella pertussis
ucuggccggugaugcggcgcgc

SEQ ID NO: 319064 - RNA, 16 nt, Bordetella pertussis
ucuggccgucgagccg

SEQ ID NO: 319065 - RNA, 14 nt, Bordetella pertussis
ucuuccaggcgccc

SEQ ID NO: 319066 - RNA, 21 nt, Bordetella pertussis
ucuuccaguugcgggcgcacc

SEQ ID NO: 319067 - RNA, 18 nt, Bordetella pertussis
ucuucgccggacagcugc

SEQ ID NO: 319068 - RNA, 23 nt, Bordetella pertussis
ucuucgccgaccagcucgacgcc

SEQ ID NO: 319069 - RNA, 21 nt, Bordetella pertussis
ucuucgggauuucgcuggcca

SEQ ID NO: 319070 - RNA, 17 nt, Bordetella pertussis
ucuucgugcuggccauc

SEQ ID NO: 319071 - RNA, 15 nt, Bordetella pertussis
ucuucguugucgcgc

SEQ ID NO: 319072 - RNA, 17 nt, Bordetella pertussis
ucuucucgacggcgcgc

SEQ ID NO: 319073 - RNA, 15 nt, Bordetella pertussis
ucuugccgaugcggc

SEQ ID NO: 319074 - RNA, 17 nt, Bordetella pertussis
ucuugccgcgcagcguc

SEQ ID NO: 319075 - RNA, 21 nt, Bordetella pertussis
ucuuggcaaccucgccgcgcc

SEQ ID NO: 319076 - RNA, 14 nt, Bordetella pertussis
ucuuucgccgcgcg

SEQ ID NO: 319077 - RNA, 14 nt, Bordetella pertussis
ugaaaccucgauga

SEQ ID NO: 319078 - RNA, 14 nt, Bordetella pertussis
ugaaagccgccggc

SEQ ID NO: 319079 - RNA, 20 nt, Bordetella pertussis
ugaaagccgccggcgcgcgg

SEQ ID NO: 319080 - RNA, 23 nt, Bordetella pertussis
ugaaagccgccggcgcgcggaug

SEQ ID NO: 319081 - RNA, 16 nt, Bordetella pertussis
ugaaagcgaacagggc

SEQ ID NO: 319082 - RNA, 18 nt, Bordetella pertussis
ugaaauagccaugcggac

SEQ ID NO: 319083 - RNA, 19 nt, Bordetella pertussis
ugaaaugcguggcgugccg

SEQ ID NO: 319084 - RNA, 22 nt, Bordetella pertussis
ugaacaccaggguggcgccggc

SEQ ID NO: 319085 - RNA, 19 nt, Bordetella pertussis
ugaacagcuggaagcgcgc

SEQ ID NO: 319086 - RNA, 17 nt, Bordetella pertussis
ugaacauccugaccggc

SEQ ID NO: 319087 - RNA, 21 nt, Bordetella pertussis
ugaaccugcuggccgccggcg

SEQ ID NO: 319088 - RNA, 15 nt, Bordetella pertussis
ugaacgacagcgaca

SEQ ID NO: 319089 - RNA, 22 nt, Bordetella pertussis
ugaacgauucuuuccuggccgg

SEQ ID NO: 319090 - RNA, 14 nt, Bordetella pertussis
ugaacgccgcgccc

SEQ ID NO: 319091 - RNA, 14 nt, Bordetella pertussis
ugaacgccgcgcug

SEQ ID NO: 319092 - RNA, 18 nt, Bordetella pertussis
ugacccguuugcgcagcu

SEQ ID NO: 319093 - RNA, 18 nt, Bordetella pertussis
ugacccuggccgaacgcc

SEQ ID NO: 319094 - RNA, 14 nt, Bordetella pertussis
ugaccgaagcgcgg

SEQ ID NO: 319095 - RNA, 13 nt, Bordetella pertussis
ugaccgacggccu

SEQ ID NO: 319096 - RNA, 21 nt, Bordetella pertussis
ugaccgcaugcugcagcugcu

SEQ ID NO: 319097 - RNA, 22 nt, Bordetella pertussis
ugaccgccagcaggcgcucggc

SEQ ID NO: 319098 - RNA, 13 nt, Bordetella pertussis
ugaccgccgccag

SEQ ID NO: 319099 - RNA, 17 nt, Bordetella pertussis
ugaccgccgcgccggug

SEQ ID NO: 319100 - RNA, 20 nt, Bordetella pertussis
ugaccgccggcaccagcgcc

SEQ ID NO: 319101 - RNA, 17 nt, Bordetella pertussis
ugaccggccaggcgcgg

SEQ ID NO: 319102 - RNA, 12 nt, Bordetella pertussis
ugaccggcgcgg

SEQ ID NO: 319103 - RNA, 16 nt, Bordetella pertussis
ugaccggcgcggccug

SEQ ID NO: 319104 - RNA, 17 nt, Bordetella pertussis
ugaccggcgcggccugc

SEQ ID NO: 319105 - RNA, 13 nt, Bordetella pertussis
ugaccggcggcac

SEQ ID NO: 319106 - RNA, 19 nt, Bordetella pertussis
ugaccggcggcacggccgg

SEQ ID NO: 319107 - RNA, 21 nt, Bordetella pertussis
ugaccggcggcacggccggcc

SEQ ID NO: 319108 - RNA, 20 nt, Bordetella pertussis
ugaccggcguguccagcggc

SEQ ID NO: 319109 - RNA, 21 nt, Bordetella pertussis
ugaccggcuauaccgggcugg

SEQ ID NO: 319110 - RNA, 14 nt, Bordetella pertussis
ugaccggggcgucc

SEQ ID NO: 319111 - RNA, 18 nt, Bordetella pertussis
ugaccggguggcugcgca

SEQ ID NO: 319112 - RNA, 19 nt, Bordetella pertussis
ugaccuauaauucguugga

SEQ ID NO: 319113 - RNA, 15 nt, Bordetella pertussis
ugaccucggccugcg

SEQ ID NO: 319114 - RNA, 21 nt, Bordetella pertussis
ugaccugcacgauggcgccgg

SEQ ID NO: 319115 - RNA, 14 nt, Bordetella pertussis
ugaccugcgacagc

SEQ ID NO: 319116 - RNA, 16 nt, Bordetella pertussis
ugaccugcgacagcac

SEQ ID NO: 319117 - RNA, 14 nt, Bordetella pertussis
ugaccuggucgggc

SEQ ID NO: 319118 - RNA, 19 nt, Bordetella pertussis
ugaccuugagaugccagcg

SEQ ID NO: 319119 - RNA, 22 nt, Bordetella pertussis
ugacgaaacgcgcguccuuggc

SEQ ID NO: 319120 - RNA, 20 nt, Bordetella pertussis
ugacgaccuugcggccgcgc

SEQ ID NO: 319121 - RNA, 13 nt, Bordetella pertussis
ugacgacgccggc

SEQ ID NO: 319122 - RNA, 17 nt, Bordetella pertussis
ugacgaggugccugucc

SEQ ID NO: 319123 - RNA, 20 nt, Bordetella pertussis
ugacgaggugccuguccccc

SEQ ID NO: 319124 - RNA, 20 nt, Bordetella pertussis
ugacgaucucgcccugcucg

SEQ ID NO: 319125 - RNA, 13 nt, Bordetella pertussis
ugacgcagccgcc

SEQ ID NO: 319126 - RNA, 20 nt, Bordetella pertussis
ugacgcagccgcccggcagc

SEQ ID NO: 319127 - RNA, 20 nt, Bordetella pertussis
ugacgccgccgaacggggcc

SEQ ID NO: 319128 - RNA, 22 nt, Bordetella pertussis
ugacgccgccgaacggggccgc

SEQ ID NO: 319129 - RNA, 22 nt, Bordetella pertussis
ugacgccgguguagcugcccgc

SEQ ID NO: 319130 - RNA, 23 nt, Bordetella pertussis
ugacgccgguguagcugcccgcg

SEQ ID NO: 319131 - RNA, 16 nt, Bordetella pertussis
ugacgcugcucuuggc

SEQ ID NO: 319132 - RNA, 20 nt, Bordetella pertussis
ugacgcugcucuuggcgccg

SEQ ID NO: 319133 - RNA, 17 nt, Bordetella pertussis
ugacgcuggagauggcg

SEQ ID NO: 319134 - RNA, 15 nt, Bordetella pertussis
ugacggccgccacgc

SEQ ID NO: 319135 - RNA, 18 nt, Bordetella pertussis
ugacgggcggcggcgcgc

SEQ ID NO: 319136 - RNA, 20 nt, Bordetella pertussis
ugacgggcggcggcgcgcgc

SEQ ID NO: 319137 - RNA, 13 nt, Bordetella pertussis
ugacggggcggcg

SEQ ID NO: 319138 - RNA, 20 nt, Bordetella pertussis
ugacgguaagcaccagguug

SEQ ID NO: 319139 - RNA, 14 nt, Bordetella pertussis
ugacggugccggcc

SEQ ID NO: 319140 - RNA, 22 nt, Bordetella pertussis
ugacgguggugucggcggccag

SEQ ID NO: 319141 - RNA, 19 nt, Bordetella pertussis
ugacguucuccagcgccgu

SEQ ID NO: 319142 - RNA, 14 nt, Bordetella pertussis
ugacguugccgcgc

SEQ ID NO: 319143 - RNA, 16 nt, Bordetella pertussis
ugacguugccgcgcgc

SEQ ID NO: 319144 - RNA, 19 nt, Bordetella pertussis
ugagcgaaauggcggccuc

SEQ ID NO: 319145 - RNA, 15 nt, Bordetella pertussis
ugagcgccgacgggc

SEQ ID NO: 319146 - RNA, 13 nt, Bordetella pertussis
ugagcgccgccgc

SEQ ID NO: 319147 - RNA, 21 nt, Bordetella pertussis
ugagcgccggggcguggccgc

SEQ ID NO: 319148 - RNA, 13 nt, Bordetella pertussis
ugagcgcggccuc

SEQ ID NO: 319149 - RNA, 17 nt, Bordetella pertussis
ugaggaacuggacggcg

SEQ ID NO: 319150 - RNA, 22 nt, Bordetella pertussis
ugaggaugcgcgcggccauguc

SEQ ID NO: 319151 - RNA, 16 nt, Bordetella pertussis
ugaguucgcgcgccgg

SEQ ID NO: 319152 - RNA, 23 nt, Bordetella pertussis
ugauauuggcgaacgugcgcgcc

SEQ ID NO: 319153 - RNA, 22 nt, Bordetella pertussis
ugaucacccacagcagcgcgcc

SEQ ID NO: 319154 - RNA, 20 nt, Bordetella pertussis
ugaucgacaugcuggcccag

SEQ ID NO: 319155 - RNA, 16 nt, Bordetella pertussis
ugaucgaguaggccgg

SEQ ID NO: 319156 - RNA, 18 nt, Bordetella pertussis
ugaucgccgacgaugucg

SEQ ID NO: 319157 - RNA, 14 nt, Bordetella pertussis
ugaucgccggcaac

SEQ ID NO: 319158 - RNA, 19 nt, Bordetella pertussis
ugaucgcgcagcaccgcca

SEQ ID NO: 319159 - RNA, 16 nt, Bordetella pertussis
ugaucgcgccgacgac

SEQ ID NO: 319160 - RNA, 13 nt, Bordetella pertussis
ugaucggcgccau

SEQ ID NO: 319161 - RNA, 20 nt, Bordetella pertussis
ugaucuacgcgcgcgccggc

SEQ ID NO: 319162 - RNA, 22 nt, Bordetella pertussis
ugaucugcauguacucggccag

SEQ ID NO: 319163 - RNA, 18 nt, Bordetella pertussis
ugaucugcucgccgcgcg

SEQ ID NO: 319164 - RNA, 21 nt, Bordetella pertussis
ugaucugcuugaggccgcgcg

SEQ ID NO: 319165 - RNA, 20 nt, Bordetella pertussis
ugaucugguccacggcggcg

SEQ ID NO: 319166 - RNA, 16 nt, Bordetella pertussis
ugaucuugaugcggcc

SEQ ID NO: 319167 - RNA, 19 nt, Bordetella pertussis
ugaucuugccgaugcggcg

SEQ ID NO: 319168 - RNA, 15 nt, Bordetella pertussis
ugaugcgcgcggcca

SEQ ID NO: 319169 - RNA, 15 nt, Bordetella pertussis
ugaugcucgcccuug

SEQ ID NO: 319170 - RNA, 16 nt, Bordetella pertussis
ugaugcuggcauugac

SEQ ID NO: 319171 - RNA, 12 nt, Bordetella pertussis
ugaugcugguca

SEQ ID NO: 319172 - RNA, 13 nt, Bordetella pertussis
ugauggcccgggu

SEQ ID NO: 319173 - RNA, 24 nt, Bordetella pertussis
ugauggcguccgcgucgccgccgu

SEQ ID NO: 319174 - RNA, 21 nt, Bordetella pertussis
ugauggggucgccgggcagcg

SEQ ID NO: 319175 - RNA, 19 nt, Bordetella pertussis
ugaugguggggcuggccgc

SEQ ID NO: 319176 - RNA, 13 nt, Bordetella pertussis
ugauggugcugcc

SEQ ID NO: 319177 - RNA, 12 nt, Bordetella pertussis
ugcaccagccau

SEQ ID NO: 319178 - RNA, 18 nt, Bordetella pertussis
ugcaccagcgcgccgcgc

SEQ ID NO: 319179 - RNA, 19 nt, Bordetella pertussis
ugcaccaggccacccgccg

SEQ ID NO: 319180 - RNA, 18 nt, Bordetella pertussis
ugcaccaggugguuggcg

SEQ ID NO: 319181 - RNA, 22 nt, Bordetella pertussis
ugcaccaggugguuggcgugcc

SEQ ID NO: 319182 - RNA, 22 nt, Bordetella pertussis
ugcacgaccaggccguggccca

SEQ ID NO: 319183 - RNA, 22 nt, Bordetella pertussis
ugcacgacgucguagugcgcgc

SEQ ID NO: 319184 - RNA, 20 nt, Bordetella pertussis
ugcacgauauuggcgucggc

SEQ ID NO: 319185 - RNA, 17 nt, Bordetella pertussis
ugcacgaugguaucggc

SEQ ID NO: 319186 - RNA, 20 nt, Bordetella pertussis
ugcacgaugguaucggccgg

SEQ ID NO: 319187 - RNA, 20 nt, Bordetella pertussis
ugcacgauuccgccuacugg

SEQ ID NO: 319188 - RNA, 14 nt, Bordetella pertussis
ugcacgccgggcgc

SEQ ID NO: 319189 - RNA, 17 nt, Bordetella pertussis
ugcacgcgcgcgggcgc

SEQ ID NO: 319190 - RNA, 18 nt, Bordetella pertussis
ugcacgcgcgcgggcgcg

SEQ ID NO: 319191 - RNA, 13 nt, Bordetella pertussis
ugcacgcgcgcgu

SEQ ID NO: 319192 - RNA, 15 nt, Bordetella pertussis
ugcacgcggccgcgc

SEQ ID NO: 319193 - RNA, 14 nt, Bordetella pertussis
ugcacgcgggccag

SEQ ID NO: 319194 - RNA, 13 nt, Bordetella pertussis
ugcacgcgggcgc

SEQ ID NO: 319195 - RNA, 21 nt, Bordetella pertussis
ugcacggccuugucgcgcccg

SEQ ID NO: 319196 - RNA, 21 nt, Bordetella pertussis
ugcagaaacacaagaucgcau

SEQ ID NO: 319197 - RNA, 14 nt, Bordetella pertussis
ugcagaaaccccag

SEQ ID NO: 319198 - RNA, 19 nt, Bordetella pertussis
ugcagaacagggugccgcc

SEQ ID NO: 319199 - RNA, 12 nt, Bordetella pertussis
ugcagacggcgg

SEQ ID NO: 319200 - RNA, 22 nt, Bordetella pertussis
ugcagaucaucgagcaccgccu

SEQ ID NO: 319201 - RNA, 19 nt, Bordetella pertussis
ugcagcacggccacggccg

SEQ ID NO: 319202 - RNA, 23 nt, Bordetella pertussis
ugcagcacgcaccaggcgcacgg

SEQ ID NO: 319203 - RNA, 23 nt, Bordetella pertussis
ugcagcagcauuucgaugcgcac

SEQ ID NO: 319204 - RNA, 13 nt, Bordetella pertussis
ugcagcaggcgca

SEQ ID NO: 319205 - RNA, 22 nt, Bordetella pertussis
ugcagcaggcgcaccagcgcgc

SEQ ID NO: 319206 - RNA, 14 nt, Bordetella pertussis
ugcagcaugaaaug

SEQ ID NO: 319207 - RNA, 11 nt, Bordetella pertussis
ugcagcaugau

SEQ ID NO: 319208 - RNA, 15 nt, Bordetella pertussis
ugcagccacgccugg

SEQ ID NO: 319209 - RNA, 21 nt, Bordetella pertussis
ugcagccacgccuggccgcgc

SEQ ID NO: 319210 - RNA, 21 nt, Bordetella pertussis
ugcagccaguugggccagggc

SEQ ID NO: 319211 - RNA, 14 nt, Bordetella pertussis
ugcagcccggccag

SEQ ID NO: 319212 - RNA, 15 nt, Bordetella pertussis
ugcagcccggccaga

SEQ ID NO: 319213 - RNA, 15 nt, Bordetella pertussis
ugcagcccagcgcga

SEQ ID NO: 319214 - RNA, 16 nt, Bordetella pertussis
ugcagcccagcgcgau

SEQ ID NO: 319215 - RNA, 14 nt, Bordetella pertussis
ugcagccgcaccag

SEQ ID NO: 319216 - RNA, 18 nt, Bordetella pertussis
ugcagccgcaccagcgca

SEQ ID NO: 319217 - RNA, 19 nt, Bordetella pertussis
ugcagccgcaccagcgcau

SEQ ID NO: 319218 - RNA, 22 nt, Bordetella pertussis
ugcagcgcaucgccgcaggcgu

SEQ ID NO: 319219 - RNA, 21 nt, Bordetella pertussis
ugcagcgacuugucgcgcccg

SEQ ID NO: 319220 - RNA, 14 nt, Bordetella pertussis
ugcagcgccgcgcg

SEQ ID NO: 319221 - RNA, 13 nt, Bordetella pertussis
ugcagcgcgccag

SEQ ID NO: 319222 - RNA, 12 nt, Bordetella pertussis
ugcagcgcgcgc

SEQ ID NO: 319223 - RNA, 17 nt, Bordetella pertussis
ugcagcggacggcgcgg

SEQ ID NO: 319224 - RNA, 16 nt, Bordetella pertussis
ugcagcggcggcacgg

SEQ ID NO: 319225 - RNA, 15 nt, Bordetella pertussis
ugcagcgucugcugg

SEQ ID NO: 319226 - RNA, 23 nt, Bordetella pertussis
ugcagcgugauggggccgggcgc

SEQ ID NO: 319227 - RNA, 18 nt, Bordetella pertussis
ugcagcgucuggcacgcu

SEQ ID NO: 319228 - RNA, 14 nt, Bordetella pertussis
ugcagcugcgccag

SEQ ID NO: 319229 - RNA, 19 nt, Bordetella pertussis
ugcagcugcuugcccaggc

SEQ ID NO: 319230 - RNA, 17 nt, Bordetella pertussis
ugcagcuguagcccugg

SEQ ID NO: 319231 - RNA, 23 nt, Bordetella pertussis
ugcagcuguagcccuggcgcugc

SEQ ID NO: 319232 - RNA, 17 nt, Bordetella pertussis
ugcagcuugcgcgccag

SEQ ID NO: 319233 - RNA, 21 nt, Bordetella pertussis
ugcaggaacucgcacacgcgc

SEQ ID NO: 319234 - RNA, 14 nt, Bordetella pertussis
ugcaggaagcgcac

SEQ ID NO: 319235 - RNA, 22 nt, Bordetella pertussis
ugcaggaaauacucgagccggc

SEQ ID NO: 319236 - RNA, 17 nt, Bordetella pertussis
ugcaggaaggccgccgc

SEQ ID NO: 319237 - RNA, 17 nt, Bordetella pertussis
ugcaggacgaacaggcc

SEQ ID NO: 319238 - RNA, 16 nt, Bordetella pertussis
ugcaggaugcgcggca

SEQ ID NO: 319239 - RNA, 20 nt, Bordetella pertussis
ugcaggaugggccguccggc

SEQ ID NO: 319240 - RNA, 15 nt, Bordetella pertussis
ugcaggauuuccucg

SEQ ID NO: 319241 - RNA, 17 nt, Bordetella pertussis
ugcaggauuuccucguc

SEQ ID NO: 319242 - RNA, 17 nt, Bordetella pertussis
ugcaggccaccgacggc

SEQ ID NO: 319243 - RNA, 12 nt, Bordetella pertussis
ugcaggccaggc

SEQ ID NO: 319244 - RNA, 15 nt, Bordetella pertussis
ugcaggccaggcuca

SEQ ID NO: 319245 - RNA, 15 nt, Bordetella pertussis
ugcaggcccaccggc

SEQ ID NO: 319246 - RNA, 21 nt, Bordetella pertussis
ugcaggcccaccggcaugccg

SEQ ID NO: 319247 - RNA, 13 nt, Bordetella pertussis
ugcaggcccagca

SEQ ID NO: 319248 - RNA, 19 nt, Bordetella pertussis
ugcaggcccagcacgcgcg

SEQ ID NO: 319249 - RNA, 22 nt, Bordetella pertussis
ugcaggcccagcacgcgcgcca

SEQ ID NO: 319250 - RNA, 23 nt, Bordetella pertussis
ugcaggcccagcacgcgcgccag

SEQ ID NO: 319251 - RNA, 18 nt, Bordetella pertussis
ugcaggcccgggcgccug

SEQ ID NO: 319252 - RNA, 12 nt, Bordetella pertussis
ugcaggccgaaa

SEQ ID NO: 319253 - RNA, 15 nt, Bordetella pertussis
ugcaggccgaggacc

SEQ ID NO: 319254 - RNA, 14 nt, Bordetella pertussis
ugcaguucgccggc

SEQ ID NO: 319255 - RNA, 18 nt, Bordetella pertussis
ugcaucacgguaggcgcg

SEQ ID NO: 319256 - RNA, 13 nt, Bordetella pertussis
ugccacggcgggc

SEQ ID NO: 319257 - RNA, 19 nt, Bordetella pertussis
ugccacggugaagaacgcg

SEQ ID NO: 319258 - RNA, 19 nt, Bordetella pertussis
ugccagacggccagcgcgc

SEQ ID NO: 319259 - RNA, 22 nt, Bordetella pertussis
ugccagauccgguaugccugcc

SEQ ID NO: 319260 - RNA, 16 nt, Bordetella pertussis
ugccagcccccugcgg

SEQ ID NO: 319261 - RNA, 19 nt, Bordetella pertussis
ugccagcccccugcggggu

SEQ ID NO: 319262 - RNA, 22 nt, Bordetella pertussis
ugccagcggcgcagccggccgg

SEQ ID NO: 319263 - RNA, 12 nt, Bordetella pertussis
ugccauccggcc

SEQ ID NO: 319264 - RNA, 19 nt, Bordetella pertussis
ugccaucgauaugggcggc

SEQ ID NO: 319265 - RNA, 20 nt, Bordetella pertussis
ugccaucgauaugggcggcc

SEQ ID NO: 319266 - RNA, 23 nt, Bordetella pertussis
ugccaucgauaugggcggccucg

SEQ ID NO: 319267 - RNA, 18 nt, Bordetella pertussis
ugccauggaccggcgucc

SEQ ID NO: 319268 - RNA, 18 nt, Bordetella pertussis
ugccauuccagcuccggc

SEQ ID NO: 319269 - RNA, 19 nt, Bordetella pertussis
ugccauucgguggucugcc

SEQ ID NO: 319270 - RNA, 13 nt, Bordetella pertussis
ugccauugcgcgg

SEQ ID NO: 319271 - RNA, 24 nt, Bordetella pertussis
ugcccagcaauucguugaucuggc

SEQ ID NO: 319272 - RNA, 15 nt, Bordetella pertussis
ugcccagcaccgcca

SEQ ID NO: 319273 - RNA, 23 nt, Bordetella pertussis
ugcccagcccggcuucgaucaug

SEQ ID NO: 319274 - RNA, 13 nt, Bordetella pertussis
ugcccagcgccgc

SEQ ID NO: 319275 - RNA, 19 nt, Bordetella pertussis
ugcccagcguguaggcggc

SEQ ID NO: 319276 - RNA, 22 nt, Bordetella pertussis
ugcccagcguguaggcggccgg

SEQ ID NO: 319277 - RNA, 19 nt, Bordetella pertussis
ugcccagcgccgccgacgg

SEQ ID NO: 319278 - RNA, 17 nt, Bordetella pertussis
ugcccaggaucgucguc

SEQ ID NO: 319279 - RNA, 22 nt, Bordetella pertussis
ugcccaggaucgucgucaugau

SEQ ID NO: 319280 - RNA, 21 nt, Bordetella pertussis
ugcccaggauggagagggccu

SEQ ID NO: 319281 - RNA, 23 nt, Bordetella pertussis
ugcccaggauggagagggccugg

SEQ ID NO: 319282 - RNA, 18 nt, Bordetella pertussis
ugcccagcuggcaccgcg

SEQ ID NO: 319283 - RNA, 12 nt, Bordetella pertussis
ugcccaggccag

SEQ ID NO: 319284 - RNA, 14 nt, Bordetella pertussis
ugcccaggcccgcc

SEQ ID NO: 319285 - RNA, 17 nt, Bordetella pertussis
ugcccaggcccgccagg

SEQ ID NO: 319286 - RNA, 21 nt, Bordetella pertussis
ugcccaggcccgugcuccaga

SEQ ID NO: 319287 - RNA, 14 nt, Bordetella pertussis
ugcccaggccggcg

SEQ ID NO: 319288 - RNA, 16 nt, Bordetella pertussis
ugcccaggcugggcca

SEQ ID NO: 319289 - RNA, 17 nt, Bordetella pertussis
ugcccaggcugggccag

SEQ ID NO: 319290 - RNA, 17 nt, Bordetella pertussis
ugcccaguacgaugccg

SEQ ID NO: 319291 - RNA, 20 nt, Bordetella pertussis
ugcccaguacgaugccgucg

SEQ ID NO: 319292 - RNA, 18 nt, Bordetella pertussis
ugcccaguucgcggccgg

SEQ ID NO: 319293 - RNA, 20 nt, Bordetella pertussis
ugcccaguucgcggccggcc

SEQ ID NO: 319294 - RNA, 18 nt, Bordetella pertussis
ugcccaguucgucccagg

SEQ ID NO: 319295 - RNA, 20 nt, Bordetella pertussis
ugcccaguuucgcgaccacc

SEQ ID NO: 319296 - RNA, 17 nt, Bordetella pertussis
ugcccaucgcgcugacg

SEQ ID NO: 319297 - RNA, 13 nt, Bordetella pertussis
ugcccgagcgcga

SEQ ID NO: 319298 - RNA, 18 nt, Bordetella pertussis
ugcccgaggcggcgcggg

SEQ ID NO: 319299 - RNA, 16 nt, Bordetella pertussis
ugcccgagggcgcguc

SEQ ID NO: 319300 - RNA, 15 nt, Bordetella pertussis
ugcccgccacccagg

SEQ ID NO: 319301 - RNA, 22 nt, Bordetella pertussis
ugcccgcagagggagcgacacc

SEQ ID NO: 319302 - RNA, 13 nt, Bordetella pertussis
ugcccgccagcgc

SEQ ID NO: 319303 - RNA, 16 nt, Bordetella pertussis
ugcccgccagcgcggc

SEQ ID NO: 319304 - RNA, 23 nt, Bordetella pertussis
ugcccgccccauugggacgccag

SEQ ID NO: 319305 - RNA, 17 nt, Bordetella pertussis
ugcccgccccgugcacc

SEQ ID NO: 319306 - RNA, 16 nt, Bordetella pertussis
ugcccgcccgacgagg

SEQ ID NO: 319307 - RNA, 22 nt, Bordetella pertussis
ugcccgccuggucgcuggcgcc

SEQ ID NO: 319308 - RNA, 23 nt, Bordetella pertussis
ugcccgccuggucgcuggcgccg

SEQ ID NO: 319309 - RNA, 20 nt, Bordetella pertussis
ugcccgcgcaccaggcgcgg

SEQ ID NO: 319310 - RNA, 21 nt, Bordetella pertussis
ugcccgcgcaccaggcgcggc

SEQ ID NO: 319311 - RNA, 23 nt, Bordetella pertussis
ugcccgcgcaccaggcgcggcgu

SEQ ID NO: 319312 - RNA, 22 nt, Bordetella pertussis
ugcccgcgguccagcacggcga

SEQ ID NO: 319313 - RNA, 23 nt, Bordetella pertussis
ugcccgcgguccagcacggcgag

SEQ ID NO: 319314 - RNA, 18 nt, Bordetella pertussis
ugcccgcuggccaugccg

SEQ ID NO: 319315 - RNA, 14 nt, Bordetella pertussis
ugcccggcaggcac

SEQ ID NO: 319316 - RNA, 16 nt, Bordetella pertussis
ugcccggcaggcacac

SEQ ID NO: 319317 - RNA, 22 nt, Bordetella pertussis
ugcccggcaggcacacgaccgg

SEQ ID NO: 319318 - RNA, 18 nt, Bordetella pertussis
ugcccgggcagcaccgcu

SEQ ID NO: 319319 - RNA, 13 nt, Bordetella pertussis
ugcccggcgggcc

SEQ ID NO: 319320 - RNA, 17 nt, Bordetella pertussis
ugcccgguucgugccgg

SEQ ID NO: 319321 - RNA, 21 nt, Bordetella pertussis
ugcccguacgucaaggccugc

SEQ ID NO: 319322 - RNA, 18 nt, Bordetella pertussis
ugcccgucagcggcgcgc

SEQ ID NO: 319323 - RNA, 17 nt, Bordetella pertussis
ugcccgucgcuggcgcg

SEQ ID NO: 319324 - RNA, 22 nt, Bordetella pertussis
ugcccucuuccugaacgacggu

SEQ ID NO: 319325 - RNA, 17 nt, Bordetella pertussis
ugcccucuucggcggcc

SEQ ID NO: 319326 - RNA, 20 nt, Bordetella pertussis
ugcccucuucggcggccagc

SEQ ID NO: 319327 - RNA, 21 nt, Bordetella pertussis
ugcccugcggcgcggccagca

SEQ ID NO: 319328 - RNA, 12 nt, Bordetella pertussis
ugcccuggaugg

SEQ ID NO: 319329 - RNA, 15 nt, Bordetella pertussis
ugcccuggcccaggc

SEQ ID NO: 319330 - RNA, 19 nt, Bordetella pertussis
ugcccuggaucaggauggg

SEQ ID NO: 319331 - RNA, 13 nt, Bordetella pertussis
ugcccuggcgcug

SEQ ID NO: 319332 - RNA, 17 nt, Bordetella pertussis
ugccgaaaggggcugcc

SEQ ID NO: 319333 - RNA, 22 nt, Bordetella pertussis
ugccgaacagcauggcggcgcc

SEQ ID NO: 319334 - RNA, 12 nt, Bordetella pertussis
ugccgaccaggc

SEQ ID NO: 319335 - RNA, 15 nt, Bordetella pertussis
ugccgaccaggcugc

SEQ ID NO: 319336 - RNA, 21 nt, Bordetella pertussis
ugccgaccaggcugcgcgccg

SEQ ID NO: 319337 - RNA, 19 nt, Bordetella pertussis
ugccgaccuccaggcccag

SEQ ID NO: 319338 - RNA, 15 nt, Bordetella pertussis
ugccgacggcgcggg

SEQ ID NO: 319339 - RNA, 20 nt, Bordetella pertussis
ugccgcgucccgugccggcc

SEQ ID NO: 319340 - RNA, 22 nt, Bordetella pertussis
ugccgcgucccgugccggccgg

SEQ ID NO: 319341 - RNA, 15 nt, Bordetella pertussis
ugccgcgucgauccg

SEQ ID NO: 319342 - RNA, 15 nt, Bordetella pertussis
ugccgcgugcccgcg

SEQ ID NO: 319343 - RNA, 19 nt, Bordetella pertussis
ugccgcugaccagcacgau

SEQ ID NO: 319344 - RNA, 15 nt, Bordetella pertussis
ugccgcugaccggcg

SEQ ID NO: 319345 - RNA, 19 nt, Bordetella pertussis
ugccgcugcaggucgggau

SEQ ID NO: 319346 - RNA, 15 nt, Bordetella pertussis
ugccgcugcaugggc

SEQ ID NO: 319347 - RNA, 17 nt, Bordetella pertussis
ugccgcugcaugggcgg

SEQ ID NO: 319348 - RNA, 18 nt, Bordetella pertussis
ugccgcugcaugggcggc

SEQ ID NO: 319349 - RNA, 14 nt, Bordetella pertussis
ugccgcugcccagc

SEQ ID NO: 319350 - RNA, 17 nt, Bordetella pertussis
ugccgcuggacgcgccg

SEQ ID NO: 319351 - RNA, 18 nt, Bordetella pertussis
ugccgcuggacgcgccga

SEQ ID NO: 319352 - RNA, 23 nt, Bordetella pertussis
ugccgcuggacgcgccgaacacc

SEQ ID NO: 319353 - RNA, 19 nt, Bordetella pertussis
ugccgcuggcgauggccug

SEQ ID NO: 319354 - RNA, 15 nt, Bordetella pertussis
ugccggaacaggcgc

SEQ ID NO: 319355 - RNA, 16 nt, Bordetella pertussis
ugccggaacaggcgcc

SEQ ID NO: 319356 - RNA, 13 nt, Bordetella pertussis
ugccggacgccga

SEQ ID NO: 319357 - RNA, 13 nt, Bordetella pertussis
ugccggagcagca

SEQ ID NO: 319358 - RNA, 20 nt, Bordetella pertussis
ugccggagcagcagcgggcu

SEQ ID NO: 319359 - RNA, 20 nt, Bordetella pertussis
ugccggagauccggccuucc

SEQ ID NO: 319360 - RNA, 15 nt, Bordetella pertussis
ugccggauggcgucc

SEQ ID NO: 319361 - RNA, 18 nt, Bordetella pertussis
ugccggauuggcgcugca

SEQ ID NO: 319362 - RNA, 23 nt, Bordetella pertussis
ugccggcaagcacgaacagguug

SEQ ID NO: 319363 - RNA, 22 nt, Bordetella pertussis
ugccggcauaggcggcgcaggc

SEQ ID NO: 319364 - RNA, 12 nt, Bordetella pertussis
ugccggccagca

SEQ ID NO: 319365 - RNA, 13 nt, Bordetella pertussis
ugccggccagcag

SEQ ID NO: 319366 - RNA, 23 nt, Bordetella pertussis
ugccggccgaccggcgcgcgcgu

SEQ ID NO: 319367 - RNA, 20 nt, Bordetella pertussis
ugccggccgauagccgcggc

SEQ ID NO: 319368 - RNA, 14 nt, Bordetella pertussis
ugccggccgcccag

SEQ ID NO: 319369 - RNA, 16 nt, Bordetella pertussis
ugccggccuggcgggc

SEQ ID NO: 319370 - RNA, 12 nt, Bordetella pertussis
ugccggcgcaca

SEQ ID NO: 319371 - RNA, 17 nt, Bordetella pertussis
ugccggcgcgggcgcag

SEQ ID NO: 319372 - RNA, 18 nt, Bordetella pertussis
ugccggcgaucacgccga

SEQ ID NO: 319373 - RNA, 22 nt, Bordetella pertussis
ugccggcggccuaugugcaggc

SEQ ID NO: 319374 - RNA, 19 nt, Bordetella pertussis
ugccggcggccugcacggu

SEQ ID NO: 319375 - RNA, 15 nt, Bordetella pertussis
ugccggcgcgcccag

SEQ ID NO: 319376 - RNA, 22 nt, Bordetella pertussis
ugccggcggcgccuucgaucuu

SEQ ID NO: 319377 - RNA, 22 nt, Bordetella pertussis
ugccggcguccugcggcggcag

SEQ ID NO: 319378 - RNA, 15 nt, Bordetella pertussis
ugccgggaugcugcu

SEQ ID NO: 319379 - RNA, 23 nt, Bordetella pertussis
ugccgggcagcaucacggugccg

SEQ ID NO: 319380 - RNA, 16 nt, Bordetella pertussis
ugccgggccuggugcc

SEQ ID NO: 319381 - RNA, 22 nt, Bordetella pertussis
ugccgggcucgaugaccagcag

SEQ ID NO: 319382 - RNA, 22 nt, Bordetella pertussis
ugccggggcacccaggcgggcu

SEQ ID NO: 319383 - RNA, 23 nt, Bordetella pertussis
ugccggguugcaggaugcgcggc

SEQ ID NO: 319384 - RNA, 22 nt, Bordetella pertussis
ugccgguaaccgacgcagcgca

SEQ ID NO: 319385 - RNA, 16 nt, Bordetella pertussis
ugccggucaggaugcg

SEQ ID NO: 319386 - RNA, 14 nt, Bordetella pertussis
ugccggugcucggc

SEQ ID NO: 319387 - RNA, 16 nt, Bordetella pertussis
ugccgguggacggcca

SEQ ID NO: 319388 - RNA, 16 nt, Bordetella pertussis
ugccgguugcgcgccg

SEQ ID NO: 319389 - RNA, 20 nt, Bordetella pertussis
ugccgguuuuuuugcgccgc

SEQ ID NO: 319390 - RNA, 20 nt, Bordetella pertussis
ugccguccuugugccaggug

SEQ ID NO: 319391 - RNA, 14 nt, Bordetella pertussis
ugccguccuggcga

SEQ ID NO: 319392 - RNA, 18 nt, Bordetella pertussis
ugccgucgagcgcggcca

SEQ ID NO: 319393 - RNA, 14 nt, Bordetella pertussis
ugccgucggccagc

SEQ ID NO: 319394 - RNA, 16 nt, Bordetella pertussis
ugccgucggccgcgcc

SEQ ID NO: 319395 - RNA, 13 nt, Bordetella pertussis
ugccgucggccug

SEQ ID NO: 319396 - RNA, 14 nt, Bordetella pertussis
ugccgucgggcgcc

SEQ ID NO: 319397 - RNA, 14 nt, Bordetella pertussis
ugccguucccgccg

SEQ ID NO: 319398 - RNA, 16 nt, Bordetella pertussis
ugccguucccgccggg

SEQ ID NO: 319399 - RNA, 20 nt, Bordetella pertussis
ugccugucccagcggggaca

SEQ ID NO: 319400 - RNA, 20 nt, Bordetella pertussis
ugccuguccccaccgggaca

SEQ ID NO: 319401 - RNA, 22 nt, Bordetella pertussis
ugccuguccccgcacggggaca

SEQ ID NO: 319402 - RNA, 22 nt, Bordetella pertussis
ugccuguccccgcacggggacu

SEQ ID NO: 319403 - RNA, 16 nt, Bordetella pertussis
ugccuguccccgcugg

SEQ ID NO: 319404 - RNA, 20 nt, Bordetella pertussis
ugccuguccccgcugggaca

SEQ ID NO: 319405 - RNA, 20 nt, Bordetella pertussis
ugccuguccccguggggaca

SEQ ID NO: 319406 - RNA, 14 nt, Bordetella pertussis
ugccguucgcgcug

SEQ ID NO: 319407 - RNA, 17 nt, Bordetella pertussis
ugccuuacgcgguccgc

SEQ ID NO: 319408 - RNA, 15 nt, Bordetella pertussis
ugccuuggggcggcc

SEQ ID NO: 319409 - RNA, 19 nt, Bordetella pertussis
ugccuuggggcggcccagc

SEQ ID NO: 319410 - RNA, 20 nt, Bordetella pertussis
ugcgaaaaagcccgcgccac

SEQ ID NO: 319411 - RNA, 15 nt, Bordetella pertussis
ugcgaaacccgcugg

SEQ ID NO: 319412 - RNA, 16 nt, Bordetella pertussis
ugcgaaagcggccagc

SEQ ID NO: 319413 - RNA, 15 nt, Bordetella pertussis
ugcgaaaggccgagc

SEQ ID NO: 319414 - RNA, 21 nt, Bordetella pertussis
ugcgaacccgccgcgaucagc

SEQ ID NO: 319415 - RNA, 19 nt, Bordetella pertussis
ugcgagagauagcccagca

SEQ ID NO: 319416 - RNA, 20 nt, Bordetella pertussis
ugcgagagauagcccagcac

SEQ ID NO: 319417 - RNA, 16 nt, Bordetella pertussis
ugcgagcaaaggacac

SEQ ID NO: 319418 - RNA, 23 nt, Bordetella pertussis
ugcgagcaaaggacacgcgcgag

SEQ ID NO: 319419 - RNA, 12 nt, Bordetella pertussis
ugcgagcacggc

SEQ ID NO: 319420 - RNA, 16 nt, Bordetella pertussis
ugcgagcacggcgugg

SEQ ID NO: 319421 - RNA, 17 nt, Bordetella pertussis
ugcgagcacggcguggc

SEQ ID NO: 319422 - RNA, 22 nt, Bordetella pertussis
ugcgagcacggcguggcgcgca

SEQ ID NO: 319423 - RNA, 22 nt, Bordetella pertussis
ugcgagcagaugcaccggccag

SEQ ID NO: 319424 - RNA, 14 nt, Bordetella pertussis
ugcgcaacgcgcgc

SEQ ID NO: 319425 - RNA, 22 nt, Bordetella pertussis
ugcgcaacgcgcgcgcgcacag

SEQ ID NO: 319426 - RNA, 19 nt, Bordetella pertussis
ugcgcaaguucaucaucgc

SEQ ID NO: 319427 - RNA, 12 nt, Bordetella pertussis
ugcgcaagccgc

SEQ ID NO: 319428 - RNA, 15 nt, Bordetella pertussis
ugcgcaagccggccg

SEQ ID NO: 319429 - RNA, 17 nt, Bordetella pertussis
ugcgcacaucgcccgug

SEQ ID NO: 319430 - RNA, 15 nt, Bordetella pertussis
ugcgcaccaggcgcu

SEQ ID NO: 319431 - RNA, 19 nt, Bordetella pertussis
ugcgcaccccggugucgcc

SEQ ID NO: 319432 - RNA, 15 nt, Bordetella pertussis
ugcgcaccggccagg

SEQ ID NO: 319433 - RNA, 17 nt, Bordetella pertussis
ugcgcaccuugcccacg

SEQ ID NO: 319434 - RNA, 20 nt, Bordetella pertussis
ugcgcacggacagcccgcgc

SEQ ID NO: 319435 - RNA, 19 nt, Bordetella pertussis
ugcgcagacgacgcagcgu

SEQ ID NO: 319436 - RNA, 17 nt, Bordetella pertussis
ugcgccaacggugccag

SEQ ID NO: 319437 - RNA, 19 nt, Bordetella pertussis
ugcgccaauuguccugguc

SEQ ID NO: 319438 - RNA, 15 nt, Bordetella pertussis
ugcgccaccccgccg

SEQ ID NO: 319439 - RNA, 15 nt, Bordetella pertussis
ugcgccaccuggcgc

SEQ ID NO: 319440 - RNA, 16 nt, Bordetella pertussis
ugcgccaccuggcgcc

SEQ ID NO: 319441 - RNA, 20 nt, Bordetella pertussis
ugcgccaccuggcgcccggc

SEQ ID NO: 319442 - RNA, 14 nt, Bordetella pertussis
ugcgccacguccag

SEQ ID NO: 319443 - RNA, 20 nt, Bordetella pertussis
ugcgccacguccagcacggc

SEQ ID NO: 319444 - RNA, 18 nt, Bordetella pertussis
ugcgccaccgcauggggc

SEQ ID NO: 319445 - RNA, 18 nt, Bordetella pertussis
ugcgccagccacgcgcgc

SEQ ID NO: 319446 - RNA, 20 nt, Bordetella pertussis
ugcgccagccguugcgccag

SEQ ID NO: 319447 - RNA, 21 nt, Bordetella pertussis
ugcgccagccguugcgccagc

SEQ ID NO: 319448 - RNA, 15 nt, Bordetella pertussis
ugcgccagccgcgcc

SEQ ID NO: 319449 - RNA, 15 nt, Bordetella pertussis
ugcgccagcgccugg

SEQ ID NO: 319450 - RNA, 18 nt, Bordetella pertussis
ugcgccagcgcuguccag

SEQ ID NO: 319451 - RNA, 18 nt, Bordetella pertussis
ugcgccagcuugcgcgcc

SEQ ID NO: 319452 - RNA, 12 nt, Bordetella pertussis
ugcgccaggugc

SEQ ID NO: 319453 - RNA, 15 nt, Bordetella pertussis
ugcgccaguccagcg

SEQ ID NO: 319454 - RNA, 18 nt, Bordetella pertussis
ugcgccaguccagcgcgc

SEQ ID NO: 319455 - RNA, 19 nt, Bordetella pertussis
ugcgccaguccagcgcgcc

SEQ ID NO: 319456 - RNA, 15 nt, Bordetella pertussis
ugcgccauguccgag

SEQ ID NO: 319457 - RNA, 18 nt, Bordetella pertussis
ugcgccauguggcgacgc

SEQ ID NO: 319458 - RNA, 19 nt, Bordetella pertussis
ugcgccauguggcgacgcc

SEQ ID NO: 319459 - RNA, 13 nt, Bordetella pertussis
ugcgccccgccac

SEQ ID NO: 319460 - RNA, 13 nt, Bordetella pertussis
ugcgccccgccau

SEQ ID NO: 319461 - RNA, 17 nt, Bordetella pertussis
ugcgccccgccucgacg

SEQ ID NO: 319462 - RNA, 23 nt, Bordetella pertussis
ugcgccccgccucgacgaugccc

SEQ ID NO: 319463 - RNA, 15 nt, Bordetella pertussis
ugcgccgaggccugc

SEQ ID NO: 319464 - RNA, 14 nt, Bordetella pertussis
ugcgccgcaacgcc

SEQ ID NO: 319465 - RNA, 17 nt, Bordetella pertussis
ugcgccgcaccagcgcc

SEQ ID NO: 319466 - RNA, 14 nt, Bordetella pertussis
ugcgccgcagcacc

SEQ ID NO: 319467 - RNA, 14 nt, Bordetella pertussis
ugcgccggcggcac

SEQ ID NO: 319468 - RNA, 15 nt, Bordetella pertussis
ugcgccgggcgcggc

SEQ ID NO: 319469 - RNA, 13 nt, Bordetella pertussis
ugcgccgggcguc

SEQ ID NO: 319470 - RNA, 22 nt, Bordetella pertussis
ugcgccguccucaggcccgcgg

SEQ ID NO: 319471 - RNA, 22 nt, Bordetella pertussis
ugcgccgucugcgccgccgcgu

SEQ ID NO: 319472 - RNA, 15 nt, Bordetella pertussis
ugcgccgugcccggc

SEQ ID NO: 319473 - RNA, 14 nt, Bordetella pertussis
ugcgcuugccgacc

SEQ ID NO: 319474 - RNA, 15 nt, Bordetella pertussis
ugcgcuugaccgccu

SEQ ID NO: 319475 - RNA, 16 nt, Bordetella pertussis
ugcgcuuggcaggcgu

SEQ ID NO: 319476 - RNA, 18 nt, Bordetella pertussis
ugcgcuugucgccgcugc

SEQ ID NO: 319477 - RNA, 18 nt, Bordetella pertussis
ugcgcuuuuuucuccagc

SEQ ID NO: 319478 - RNA, 20 nt, Bordetella pertussis
ugcgcuuuuuucuccagcgc

SEQ ID NO: 319479 - RNA, 23 nt, Bordetella pertussis
ugcgcuuuuuucuccagcgccag

SEQ ID NO: 319480 - RNA, 23 nt, Bordetella pertussis
ugcggcaccugcugcuugaccuu

SEQ ID NO: 319481 - RNA, 21 nt, Bordetella pertussis
ugcggcacgauuucgccgauc

SEQ ID NO: 319482 - RNA, 22 nt, Bordetella pertussis
ugcggcacgcacagcaugcgcu

SEQ ID NO: 319483 - RNA, 14 nt, Bordetella pertussis
ugcggcacgugccg

SEQ ID NO: 319484 - RNA, 22 nt, Bordetella pertussis
ugcggccccggcaccaucgccg

SEQ ID NO: 319485 - RNA, 22 nt, Bordetella pertussis
ugcggccgccacccaggcggca

SEQ ID NO: 319486 - RNA, 23 nt, Bordetella pertussis
ugcggcgcuggcuggacgcgcgc

SEQ ID NO: 319487 - RNA, 23 nt, Bordetella pertussis
ugcggcgggacuguaccgcgcga

SEQ ID NO: 319488 - RNA, 20 nt, Bordetella pertussis
ugcggcggcgacucggcauc

SEQ ID NO: 319489 - RNA, 15 nt, Bordetella pertussis
ugcggcguggcgccg

SEQ ID NO: 319490 - RNA, 16 nt, Bordetella pertussis
ugcggcugaucaccgc

SEQ ID NO: 319491 - RNA, 17 nt, Bordetella pertussis
ugcggcugggugcgguc

SEQ ID NO: 319492 - RNA, 13 nt, Bordetella pertussis
ugcgggacaggca

SEQ ID NO: 319493 - RNA, 13 nt, Bordetella pertussis
ugcgggacggcca

SEQ ID NO: 319494 - RNA, 17 nt, Bordetella pertussis
ugcgggaggugccgcag

SEQ ID NO: 319495 - RNA, 22 nt, Bordetella pertussis
ugcgggcaucgcccugcucgau

SEQ ID NO: 319496 - RNA, 12 nt, Bordetella pertussis
ugcgggcgcgcu

SEQ ID NO: 319497 - RNA, 14 nt, Bordetella pertussis
ugcgggcggccugg

SEQ ID NO: 319498 - RNA, 18 nt, Bordetella pertussis
ugcggggacaggcacccg

SEQ ID NO: 319499 - RNA, 21 nt, Bordetella pertussis
ugcggggacuggcuccgaagg

SEQ ID NO: 319500 - RNA, 14 nt, Bordetella pertussis
ugcggggcggcgua

SEQ ID NO: 319501 - RNA, 15 nt, Bordetella pertussis
ugcgggggcaggcac

SEQ ID NO: 319502 - RNA, 19 nt, Bordetella pertussis
ugcggggugccuguccccg

SEQ ID NO: 319503 - RNA, 21 nt, Bordetella pertussis
ugcgggucgaguugcgcgcca

SEQ ID NO: 319504 - RNA, 22 nt, Bordetella pertussis
ugcgggucgaguugcgcgccau

SEQ ID NO: 319505 - RNA, 16 nt, Bordetella pertussis
ugcgggucggcgccau

SEQ ID NO: 319506 - RNA, 18 nt, Bordetella pertussis
ugcgggucgucccagcgc

SEQ ID NO: 319507 - RNA, 18 nt, Bordetella pertussis
ugcgggugccuguccccg

SEQ ID NO: 319508 - RNA, 21 nt, Bordetella pertussis
ugcgggugggcauccagcggc

SEQ ID NO: 319509 - RNA, 20 nt, Bordetella pertussis
ugcgguaguucagcagcgcc

SEQ ID NO: 319510 - RNA, 19 nt, Bordetella pertussis
ugcggugucccucggagcc

SEQ ID NO: 319511 - RNA, 18 nt, Bordetella pertussis
ugcgguucugggcccgau

SEQ ID NO: 319512 - RNA, 19 nt, Bordetella pertussis
ugcgguugaucagggccgc

SEQ ID NO: 319513 - RNA, 12 nt, Bordetella pertussis
ugcguccggcgc

SEQ ID NO: 319514 - RNA, 18 nt, Bordetella pertussis
ugcguccuugaggaacug

SEQ ID NO: 319515 - RNA, 16 nt, Bordetella pertussis
ugcgucgaacggccgg

SEQ ID NO: 319516 - RNA, 20 nt, Bordetella pertussis
ugcgucgaacggccgggcgc

SEQ ID NO: 319517 - RNA, 16 nt, Bordetella pertussis
ugcgucgccuggucga

SEQ ID NO: 319518 - RNA, 14 nt, Bordetella pertussis
ugcgucugcacgcu

SEQ ID NO: 319519 - RNA, 15 nt, Bordetella pertussis
ugcgucugcgugccg

SEQ ID NO: 319520 - RNA, 17 nt, Bordetella pertussis
ugcgugaagcccauggc

SEQ ID NO: 319521 - RNA, 16 nt, Bordetella pertussis
ugcgugacacggccau

SEQ ID NO: 319522 - RNA, 18 nt, Bordetella pertussis
ugcgugugccuguccccg

SEQ ID NO: 319523 - RNA, 19 nt, Bordetella pertussis
ugcucagucgggcagcgcc

SEQ ID NO: 319524 - RNA, 21 nt, Bordetella pertussis
ugcucaucggcaggccggcgc

SEQ ID NO: 319525 - RNA, 18 nt, Bordetella pertussis
ugcuccaccaccaucugc

SEQ ID NO: 319526 - RNA, 18 nt, Bordetella pertussis
ugcuccagccaggcgcgc

SEQ ID NO: 319527 - RNA, 19 nt, Bordetella pertussis
ugcuccagccaggcgcgca

SEQ ID NO: 319528 - RNA, 16 nt, Bordetella pertussis
ugcucgaaaugcgcgu

SEQ ID NO: 319529 - RNA, 21 nt, Bordetella pertussis
ugcucgacagcagcccgcugg

SEQ ID NO: 319530 - RNA, 21 nt, Bordetella pertussis
ugcucgaucuucucgacggcg

SEQ ID NO: 319531 - RNA, 13 nt, Bordetella pertussis
ugcucgaugccgg

SEQ ID NO: 319532 - RNA, 14 nt, Bordetella pertussis
ugcucgaugccggc

SEQ ID NO: 319533 - RNA, 22 nt, Bordetella pertussis
ugcucgcaggccugcugcagcg

SEQ ID NO: 319534 - RNA, 20 nt, Bordetella pertussis
ugcucgcccauggcaucgag

SEQ ID NO: 319535 - RNA, 20 nt, Bordetella pertussis
ugcucgcccuugagcacggc

SEQ ID NO: 319536 - RNA, 24 nt, Bordetella pertussis
ugcucgcccuugagcacggcgcgg

SEQ ID NO: 319537 - RNA, 14 nt, Bordetella pertussis
ugcucgccggccag

SEQ ID NO: 319538 - RNA, 17 nt, Bordetella pertussis
ugcucgccggccagcgc

SEQ ID NO: 319539 - RNA, 12 nt, Bordetella pertussis
ugcucgcgcgca

SEQ ID NO: 319540 - RNA, 20 nt, Bordetella pertussis
ugcugacggugccggccagc

SEQ ID NO: 319541 - RNA, 21 nt, Bordetella pertussis
ugcugacggugccggccagcc

SEQ ID NO: 319542 - RNA, 15 nt, Bordetella pertussis
ugcugauccaguugc

SEQ ID NO: 319543 - RNA, 18 nt, Bordetella pertussis
ugcugaucgacaugcugg

SEQ ID NO: 319544 - RNA, 21 nt, Bordetella pertussis
ugcugaucgacaugcuggccc

SEQ ID NO: 319545 - RNA, 13 nt, Bordetella pertussis
ugcugaucgaucg

SEQ ID NO: 319546 - RNA, 23 nt, Bordetella pertussis
ugcugcacgcgcgcgggcgcgcc

SEQ ID NO: 319547 - RNA, 15 nt, Bordetella pertussis
ugcugcagcgcacca

SEQ ID NO: 319548 - RNA, 21 nt, Bordetella pertussis
ugcugcggcacggccagcggc

SEQ ID NO: 319549 - RNA, 15 nt, Bordetella pertussis
ugcugcggcagccag

SEQ ID NO: 319550 - RNA, 23 nt, Bordetella pertussis
ugcugcgggucgaguugcgcgcc

SEQ ID NO: 319551 - RNA, 22 nt, Bordetella pertussis
ugcugcguaucugaucggacug

SEQ ID NO: 319552 - RNA, 17 nt, Bordetella pertussis
ugcugcucaacggccac

SEQ ID NO: 319553 - RNA, 15 nt, Bordetella pertussis
ugcugcugcagccac

SEQ ID NO: 319554 - RNA, 14 nt, Bordetella pertussis
ugcugcugggcgcc

SEQ ID NO: 319555 - RNA, 13 nt, Bordetella pertussis
ugcuggaccgcgc

SEQ ID NO: 319556 - RNA, 16 nt, Bordetella pertussis
ugcuggaggugccguc

SEQ ID NO: 319557 - RNA, 21 nt, Bordetella pertussis
ugcugugccccacacgcgcgc

SEQ ID NO: 319558 - RNA, 20 nt, Bordetella pertussis
ugcuguuggcguggcuggcg

SEQ ID NO: 319559 - RNA, 17 nt, Bordetella pertussis
ugcuucaacuccuggac

SEQ ID NO: 319560 - RNA, 13 nt, Bordetella pertussis
ugcuugccagcuc

SEQ ID NO: 319561 - RNA, 20 nt, Bordetella pertussis
ugcuugccauaggccagcgc

SEQ ID NO: 319562 - RNA, 16 nt, Bordetella pertussis
ugcuugcgcgugcgca

SEQ ID NO: 319563 - RNA, 16 nt, Bordetella pertussis
ugcuuggccgcguaca

SEQ ID NO: 319564 - RNA, 17 nt, Bordetella pertussis
ugcuuggcgcgcagcag

SEQ ID NO: 319565 - RNA, 12 nt, Bordetella pertussis
ugcuuggcgguc

SEQ ID NO: 319566 - RNA, 14 nt, Bordetella pertussis
ugcuuugcgggcgc

SEQ ID NO: 319567 - RNA, 16 nt, Bordetella pertussis
uggaaaucgugccguc

SEQ ID NO: 319568 - RNA, 18 nt, Bordetella pertussis
uggaaucauuggccagcg

SEQ ID NO: 319569 - RNA, 15 nt, Bordetella pertussis
uggacaagauacggc

SEQ ID NO: 319570 - RNA, 16 nt, Bordetella pertussis
uggacacgaugaacgc

SEQ ID NO: 319571 - RNA, 20 nt, Bordetella pertussis
uggacacgaugaacgcgcgc

SEQ ID NO: 319572 - RNA, 16 nt, Bordetella pertussis
uggacagauccagcgc

SEQ ID NO: 319573 - RNA, 19 nt, Bordetella pertussis
uggacaggaacuccggcgg

SEQ ID NO: 319574 - RNA, 19 nt, Bordetella pertussis
uggacaggcgugcgcagcu

SEQ ID NO: 319575 - RNA, 21 nt, Bordetella pertussis
uggcauugacgcccacgcuca

SEQ ID NO: 319576 - RNA, 14 nt, Bordetella pertussis
uggccaagcgcgcc

SEQ ID NO: 319577 - RNA, 15 nt, Bordetella pertussis
uggccaagggcgccg

SEQ ID NO: 319578 - RNA, 16 nt, Bordetella pertussis
uggccaagggcgccgc

SEQ ID NO: 319579 - RNA, 14 nt, Bordetella pertussis
uggccaauggccgc

SEQ ID NO: 319580 - RNA, 19 nt, Bordetella pertussis
uggccacaagcggccccag

SEQ ID NO: 319581 - RNA, 14 nt, Bordetella pertussis
uggccaccacgccc

SEQ ID NO: 319582 - RNA, 12 nt, Bordetella pertussis
uggccaccaggc

SEQ ID NO: 319583 - RNA, 16 nt, Bordetella pertussis
uggccaccaggcgcgc

SEQ ID NO: 319584 - RNA, 18 nt, Bordetella pertussis
uggccaccaggcgcgcgc

SEQ ID NO: 319585 - RNA, 21 nt, Bordetella pertussis
uggccaccagguagggcagca

SEQ ID NO: 319586 - RNA, 18 nt, Bordetella pertussis
uggccaccgaagcggcgu

SEQ ID NO: 319587 - RNA, 22 nt, Bordetella pertussis
uggccacggcgucgaugcgcgc

SEQ ID NO: 319588 - RNA, 14 nt, Bordetella pertussis
uggccacuggccgc

SEQ ID NO: 319589 - RNA, 17 nt, Bordetella pertussis
uggccacuggccgcgcu

SEQ ID NO: 319590 - RNA, 15 nt, Bordetella pertussis
uggccagcaagcgcu

SEQ ID NO: 319591 - RNA, 19 nt, Bordetella pertussis
uggccagcaagcgcucggc

SEQ ID NO: 319592 - RNA, 14 nt, Bordetella pertussis
uggccagcagcgca

SEQ ID NO: 319593 - RNA, 18 nt, Bordetella pertussis
uggccagcagcgcaucgc

SEQ ID NO: 319594 - RNA, 19 nt, Bordetella pertussis
uggccagcagcgccgccag

SEQ ID NO: 319595 - RNA, 12 nt, Bordetella pertussis
uggccagccgcu

SEQ ID NO: 319596 - RNA, 20 nt, Bordetella pertussis
uggccagccgcucgcgcgac

SEQ ID NO: 319597 - RNA, 12 nt, Bordetella pertussis
uggccagcgccg

SEQ ID NO: 319598 - RNA, 14 nt, Bordetella pertussis
uggccagcgccugg

SEQ ID NO: 319599 - RNA, 15 nt, Bordetella pertussis
uggccagcgcgccuu

SEQ ID NO: 319600 - RNA, 19 nt, Bordetella pertussis
uggccagcuccaccgggcu

SEQ ID NO: 319601 - RNA, 16 nt, Bordetella pertussis
uggccagcugcguggc

SEQ ID NO: 319602 - RNA, 17 nt, Bordetella pertussis
uggccagcugcguggcg

SEQ ID NO: 319603 - RNA, 16 nt, Bordetella pertussis
uggccagcuggcgcgu

SEQ ID NO: 319604 - RNA, 24 nt, Bordetella pertussis
uggccagcuggcgcguggccgcca

SEQ ID NO: 319605 - RNA, 17 nt, Bordetella pertussis
uggccagguggcggcgg

SEQ ID NO: 319606 - RNA, 17 nt, Bordetella pertussis
uggccaucuaugucggc

SEQ ID NO: 319607 - RNA, 19 nt, Bordetella pertussis
uggccaugcaccagcacau

SEQ ID NO: 319608 - RNA, 16 nt, Bordetella pertussis
uggcccaagcccgugg

SEQ ID NO: 319609 - RNA, 22 nt, Bordetella pertussis
uggcccagaccaagcgccacag

SEQ ID NO: 319610 - RNA, 16 nt, Bordetella pertussis
uggcccagcaccgccg

SEQ ID NO: 319611 - RNA, 22 nt, Bordetella pertussis
uggcccagcuccagcuggcgca

SEQ ID NO: 319612 - RNA, 19 nt, Bordetella pertussis
uggcccagcugggcggcgu

SEQ ID NO: 319613 - RNA, 22 nt, Bordetella pertussis
uggcccaguucgcgcagcagcu

SEQ ID NO: 319614 - RNA, 23 nt, Bordetella pertussis
uggcccaguugaaucggcgcgag

SEQ ID NO: 319615 - RNA, 22 nt, Bordetella pertussis
uggcccgcaccgggcggcccgg

SEQ ID NO: 319616 - RNA, 21 nt, Bordetella pertussis
uggcccgcagguggggcagca

SEQ ID NO: 319617 - RNA, 21 nt, Bordetella pertussis
uggcccgccauugcacgcgca

SEQ ID NO: 319618 - RNA, 19 nt, Bordetella pertussis
uggcccgcgcgagcggcgu

SEQ ID NO: 319619 - RNA, 20 nt, Bordetella pertussis
uggcccgcgcgagcggcgug

SEQ ID NO: 319620 - RNA, 20 nt, Bordetella pertussis
uggcccgcgugacggccgcc

SEQ ID NO: 319621 - RNA, 20 nt, Bordetella pertussis
uggcccggcaccguccagca

SEQ ID NO: 319622 - RNA, 14 nt, Bordetella pertussis
uggcccggcucgcc

SEQ ID NO: 319623 - RNA, 17 nt, Bordetella pertussis
uggcccgucaugggcgg

SEQ ID NO: 319624 - RNA, 16 nt, Bordetella pertussis
uggcccgucaugugca

SEQ ID NO: 319625 - RNA, 14 nt, Bordetella pertussis
uggcccugcagcgg

SEQ ID NO: 319626 - RNA, 22 nt, Bordetella pertussis
uggcccugcugggguggagcgc

SEQ ID NO: 319627 - RNA, 17 nt, Bordetella pertussis
uggccgaaccauugcag

SEQ ID NO: 319628 - RNA, 19 nt, Bordetella pertussis
uggccgacagcgucgagcu

SEQ ID NO: 319629 - RNA, 17 nt, Bordetella pertussis
uggccgacgcgcugguc

SEQ ID NO: 319630 - RNA, 15 nt, Bordetella pertussis
uggccgagaugccgu

SEQ ID NO: 319631 - RNA, 18 nt, Bordetella pertussis
uggccgaguccugguugc

SEQ ID NO: 319632 - RNA, 16 nt, Bordetella pertussis
uggccgaucaccugca

SEQ ID NO: 319633 - RNA, 20 nt, Bordetella pertussis
uggccgaucugcugggccgg

SEQ ID NO: 319634 - RNA, 16 nt, Bordetella pertussis
uggccgauuccagcgc

SEQ ID NO: 319635 - RNA, 14 nt, Bordetella pertussis
uggccgcagccggc

SEQ ID NO: 319636 - RNA, 17 nt, Bordetella pertussis
uggccgcagccggcugc

SEQ ID NO: 319637 - RNA, 18 nt, Bordetella pertussis
uggccgccaccagcgcgu

SEQ ID NO: 319638 - RNA, 15 nt, Bordetella pertussis
uggccgccagccggc

SEQ ID NO: 319639 - RNA, 17 nt, Bordetella pertussis
uggccgccagcggcugg

SEQ ID NO: 319640 - RNA, 19 nt, Bordetella pertussis
uggccgccagcggcuggcg

SEQ ID NO: 319641 - RNA, 17 nt, Bordetella pertussis
uggccgcccgcggccug

SEQ ID NO: 319642 - RNA, 19 nt, Bordetella pertussis
uggccgccgaacggcagca

SEQ ID NO: 319643 - RNA, 17 nt, Bordetella pertussis
uggccgccgcggccucg

SEQ ID NO: 319644 - RNA, 16 nt, Bordetella pertussis
uggccgccgcgggcgc

SEQ ID NO: 319645 - RNA, 19 nt, Bordetella pertussis
uggccgccgcgggcgccgc

SEQ ID NO: 319646 - RNA, 22 nt, Bordetella pertussis
uggccgccggcgcgguggccau

SEQ ID NO: 319647 - RNA, 20 nt, Bordetella pertussis
uggccgccggcggcgcacca

SEQ ID NO: 319648 - RNA, 14 nt, Bordetella pertussis
uggccgcgcccagc

SEQ ID NO: 319649 - RNA, 15 nt, Bordetella pertussis
uggccgcgcccgccg

SEQ ID NO: 319650 - RNA, 16 nt, Bordetella pertussis
uggccgcgccgcuggc

SEQ ID NO: 319651 - RNA, 15 nt, Bordetella pertussis
uggccgcgcgcagcg

SEQ ID NO: 319652 - RNA, 17 nt, Bordetella pertussis
uggccgcgcggcgccug

SEQ ID NO: 319653 - RNA, 13 nt, Bordetella pertussis
uggccgcuccaga

SEQ ID NO: 319654 - RNA, 17 nt, Bordetella pertussis
uggccgcuccagagcgc

SEQ ID NO: 319655 - RNA, 19 nt, Bordetella pertussis
uggccgcuccagagcgcgc

SEQ ID NO: 319656 - RNA, 13 nt, Bordetella pertussis
uggccggcgugcc

SEQ ID NO: 319657 - RNA, 13 nt, Bordetella pertussis
uggccggcguugc

SEQ ID NO: 319658 - RNA, 19 nt, Bordetella pertussis
uggccggcuugcauggugc

SEQ ID NO: 319659 - RNA, 19 nt, Bordetella pertussis
uggccgggagcggccagca

SEQ ID NO: 319660 - RNA, 22 nt, Bordetella pertussis
uggccggggaagccgccggcgu

SEQ ID NO: 319661 - RNA, 21 nt, Bordetella pertussis
uggccggggcgucgucgcggu

SEQ ID NO: 319662 - RNA, 18 nt, Bordetella pertussis
uggccgggucgcgcagca

SEQ ID NO: 319663 - RNA, 13 nt, Bordetella pertussis
uggccggugccag

SEQ ID NO: 319664 - RNA, 22 nt, Bordetella pertussis
uggccguagagggucuggcggc

SEQ ID NO: 319665 - RNA, 22 nt, Bordetella pertussis
uggccguagcguuggcggccgg

SEQ ID NO: 319666 - RNA, 16 nt, Bordetella pertussis
uggcgaacgugcgcgc

SEQ ID NO: 319667 - RNA, 19 nt, Bordetella pertussis
uggcgaacgugcgcgccag

SEQ ID NO: 319668 - RNA, 18 nt, Bordetella pertussis
uggcgaagaacaccgccg

SEQ ID NO: 319669 - RNA, 20 nt, Bordetella pertussis
uggcgaagaccgugaucggc

SEQ ID NO: 319670 - RNA, 16 nt, Bordetella pertussis
uggcgaaggccgccgc

SEQ ID NO: 319671 - RNA, 21 nt, Bordetella pertussis
uggcgaaggcgucggccaugg

SEQ ID NO: 319672 - RNA, 20 nt, Bordetella pertussis
uggcgaggacaggccagugc

SEQ ID NO: 319673 - RNA, 21 nt, Bordetella pertussis
uggcgaucaggaaaagcaggc

SEQ ID NO: 319674 - RNA, 16 nt, Bordetella pertussis
uggcgaucaggccgcc

SEQ ID NO: 319675 - RNA, 17 nt, Bordetella pertussis
uggcgauccagggccgc

SEQ ID NO: 319676 - RNA, 20 nt, Bordetella pertussis
uggcgauccagggccgccag

SEQ ID NO: 319677 - RNA, 21 nt, Bordetella pertussis
uggcgaucgucaccaucgccg

SEQ ID NO: 319678 - RNA, 16 nt, Bordetella pertussis
uggcgaugaccucggc

SEQ ID NO: 319679 - RNA, 16 nt, Bordetella pertussis
uggcgaugcccaccag

SEQ ID NO: 319680 - RNA, 20 nt, Bordetella pertussis
uggcgaugcccaccagccgc

SEQ ID NO: 319681 - RNA, 18 nt, Bordetella pertussis
uggcgaugcgggccacgc

SEQ ID NO: 319682 - RNA, 22 nt, Bordetella pertussis
uggcgaugcgggccacgccggc

SEQ ID NO: 319683 - RNA, 14 nt, Bordetella pertussis
uggcgauggccgcc

SEQ ID NO: 319684 - RNA, 15 nt, Bordetella pertussis
uggcgauggccgcca

SEQ ID NO: 319685 - RNA, 12 nt, Bordetella pertussis
uggcgauggcgc

SEQ ID NO: 319686 - RNA, 18 nt, Bordetella pertussis
uggcgauguccagcgagc

SEQ ID NO: 319687 - RNA, 12 nt, Bordetella pertussis
uggcgcaccagg

SEQ ID NO: 319688 - RNA, 18 nt, Bordetella pertussis
uggcgcacgccgggcgcg

SEQ ID NO: 319689 - RNA, 19 nt, Bordetella pertussis
uggcgcacgccgggcgcgg

SEQ ID NO: 319690 - RNA, 22 nt, Bordetella pertussis
uggcgccggcuucgucaugguc

SEQ ID NO: 319691 - RNA, 14 nt, Bordetella pertussis
uggcgccggucugg

SEQ ID NO: 319692 - RNA, 21 nt, Bordetella pertussis
uggcgccgugaaugcgccugg

SEQ ID NO: 319693 - RNA, 22 nt, Bordetella pertussis
uggcgccguguuguccuggaca

SEQ ID NO: 319694 - RNA, 17 nt, Bordetella pertussis
uggcgccguuccugcag

SEQ ID NO: 319695 - RNA, 20 nt, Bordetella pertussis
uggcgccguucgucgcgcag

SEQ ID NO: 319696 - RNA, 20 nt, Bordetella pertussis
uggcgccuuccggcagcggc

SEQ ID NO: 319697 - RNA, 18 nt, Bordetella pertussis
uggcgcgaggcggcgacg

SEQ ID NO: 319698 - RNA, 16 nt, Bordetella pertussis
uggcgcgauccagucg

SEQ ID NO: 319699 - RNA, 20 nt, Bordetella pertussis
uggcgcgauccuucgcggcc

SEQ ID NO: 319700 - RNA, 16 nt, Bordetella pertussis
uggcgcggccggaggc

SEQ ID NO: 319701 - RNA, 14 nt, Bordetella pertussis
uggcgcggcgccug

SEQ ID NO: 319702 - RNA, 20 nt, Bordetella pertussis
uggcgcggcgccugcgcgcg

SEQ ID NO: 319703 - RNA, 14 nt, Bordetella pertussis
uggcgcggcggcca

SEQ ID NO: 319704 - RNA, 15 nt, Bordetella pertussis
uggcgcggcggccag

SEQ ID NO: 319705 - RNA, 16 nt, Bordetella pertussis
uggcgcggcggccagg

SEQ ID NO: 319706 - RNA, 22 nt, Bordetella pertussis
uggcgcggcgucgaaggccgcc

SEQ ID NO: 319707 - RNA, 13 nt, Bordetella pertussis
uggcgcggcuggc

SEQ ID NO: 319708 - RNA, 15 nt, Bordetella pertussis
uggcgcggcuggcga

SEQ ID NO: 319709 - RNA, 14 nt, Bordetella pertussis
uggcgcgggcggcc

SEQ ID NO: 319710 - RNA, 20 nt, Bordetella pertussis
uggcgcgguccacgcccugg

SEQ ID NO: 319711 - RNA, 21 nt, Bordetella pertussis
uggcgcgguccacgcgggcau

SEQ ID NO: 319712 - RNA, 16 nt, Bordetella pertussis
uggcgcguugcgcauc

SEQ ID NO: 319713 - RNA, 19 nt, Bordetella pertussis
uggcgcgugcgcgcgccau

SEQ ID NO: 319714 - RNA, 16 nt, Bordetella pertussis
uggcgcuccaugcggc

SEQ ID NO: 319715 - RNA, 17 nt, Bordetella pertussis
uggcgcuccaugcggcg

SEQ ID NO: 319716 - RNA, 12 nt, Bordetella pertussis
uggcgcuccagc

SEQ ID NO: 319717 - RNA, 15 nt, Bordetella pertussis
uggcgcucgggcgcg

SEQ ID NO: 319718 - RNA, 14 nt, Bordetella pertussis
uggcgcugcagcgu

SEQ ID NO: 319719 - RNA, 20 nt, Bordetella pertussis
uggcgcugcugcuggcugcc

SEQ ID NO: 319720 - RNA, 14 nt, Bordetella pertussis
uggcgcuggcccag

SEQ ID NO: 319721 - RNA, 19 nt, Bordetella pertussis
uggcgcuggcccaguucgc

SEQ ID NO: 319722 - RNA, 14 nt, Bordetella pertussis
uggcgcuggccgcc

SEQ ID NO: 319723 - RNA, 18 nt, Bordetella pertussis
uggcgcuguuggccggcg

SEQ ID NO: 319724 - RNA, 21 nt, Bordetella pertussis
uggcgcuguuggccggcgcgc

SEQ ID NO: 319725 - RNA, 21 nt, Bordetella pertussis
uggcgcuguuuccgggccugg

SEQ ID NO: 319726 - RNA, 21 nt, Bordetella pertussis
uggcgcuuacuggaucuuggc

SEQ ID NO: 319727 - RNA, 15 nt, Bordetella pertussis
uggcggccuggccgc

SEQ ID NO: 319728 - RNA, 22 nt, Bordetella pertussis
uggcggccuggccgcgcgccug

SEQ ID NO: 319729 - RNA, 21 nt, Bordetella pertussis
uggcggccuucaugaucuggc

SEQ ID NO: 319730 - RNA, 18 nt, Bordetella pertussis
uggcggccuugcgggccg

SEQ ID NO: 319731 - RNA, 14 nt, Bordetella pertussis
uggcggcgaugccg

SEQ ID NO: 319732 - RNA, 15 nt, Bordetella pertussis
uggcggcgaugccgc

SEQ ID NO: 319733 - RNA, 20 nt, Bordetella pertussis
uggcggcgauguggcgcgcc

SEQ ID NO: 319734 - RNA, 17 nt, Bordetella pertussis
uggcggcgcagcaccag

SEQ ID NO: 319735 - RNA, 14 nt, Bordetella pertussis
uggcggcgcagccg

SEQ ID NO: 319736 - RNA, 18 nt, Bordetella pertussis
uggcggcgcagcgcccag

SEQ ID NO: 319737 - RNA, 22 nt, Bordetella pertussis
uggcggcgcaggccgcgccggc

SEQ ID NO: 319738 - RNA, 21 nt, Bordetella pertussis
uggcggcgcaguucggagcgg

SEQ ID NO: 319739 - RNA, 12 nt, Bordetella pertussis
uggcggcgcgcg

SEQ ID NO: 319740 - RNA, 12 nt, Bordetella pertussis
uggcggcggcgu

SEQ ID NO: 319741 - RNA, 15 nt, Bordetella pertussis
uggcggcgguagcgc

SEQ ID NO: 319742 - RNA, 15 nt, Bordetella pertussis
uggcggcgcuggcgu

SEQ ID NO: 319743 - RNA, 19 nt, Bordetella pertussis
uggcggcugcgggcgcaag

SEQ ID NO: 319744 - RNA, 16 nt, Bordetella pertussis
uggcggcuggcgcggc

SEQ ID NO: 319745 - RNA, 23 nt, Bordetella pertussis
uggcggcugucgggcggcgccug

SEQ ID NO: 319746 - RNA, 16 nt, Bordetella pertussis
uggcgggccugggcgu

SEQ ID NO: 319747 - RNA, 21 nt, Bordetella pertussis
uggcgggcgacauugcgccag

SEQ ID NO: 319748 - RNA, 14 nt, Bordetella pertussis
uggcggggauggcu

SEQ ID NO: 319749 - RNA, 16 nt, Bordetella pertussis
uggcgggguuggccgc

SEQ ID NO: 319750 - RNA, 19 nt, Bordetella pertussis
uggcgggucccaaccaggg

SEQ ID NO: 319751 - RNA, 19 nt, Bordetella pertussis
uggcgggugcugcagcgca

SEQ ID NO: 319752 - RNA, 14 nt, Bordetella pertussis
uggcggugcgccgc

SEQ ID NO: 319753 - RNA, 22 nt, Bordetella pertussis
uggcggugcgccgcaugcggcg

SEQ ID NO: 319754 - RNA, 16 nt, Bordetella pertussis
uggcguccaggcgcgc

SEQ ID NO: 319755 - RNA, 16 nt, Bordetella pertussis
uggcguccggccccag

SEQ ID NO: 319756 - RNA, 13 nt, Bordetella pertussis
uggcgucggccgc

SEQ ID NO: 319757 - RNA, 17 nt, Bordetella pertussis
ugggccaggcgcuccag

SEQ ID NO: 319758 - RNA, 18 nt, Bordetella pertussis
ugggccaguccgcagcgc

SEQ ID NO: 319759 - RNA, 15 nt, Bordetella pertussis
ugggccaguucgcgg

SEQ ID NO: 319760 - RNA, 18 nt, Bordetella pertussis
ugggccaguucgcggcgc

SEQ ID NO: 319761 - RNA, 23 nt, Bordetella pertussis
ugggccaguucgcggcgcagcgc

SEQ ID NO: 319762 - RNA, 23 nt, Bordetella pertussis
ugggccaucagguuguccagcgc

SEQ ID NO: 319763 - RNA, 15 nt, Bordetella pertussis
ugggcccgaucgccg

SEQ ID NO: 319764 - RNA, 15 nt, Bordetella pertussis
ugggcccgggcgcgc

SEQ ID NO: 319765 - RNA, 16 nt, Bordetella pertussis
ugggccgagcccgcgu

SEQ ID NO: 319766 - RNA, 14 nt, Bordetella pertussis
ugggccgagcgcgc

SEQ ID NO: 319767 - RNA, 23 nt, Bordetella pertussis
ugggccgagcgcgccagcacggu

SEQ ID NO: 319768 - RNA, 15 nt, Bordetella pertussis
ugggccgaggcgccg

SEQ ID NO: 319769 - RNA, 17 nt, Bordetella pertussis
ugggcgaggcgaugccc

SEQ ID NO: 319770 - RNA, 19 nt, Bordetella pertussis
ugggcgagguagggcgcgg

SEQ ID NO: 319771 - RNA, 23 nt, Bordetella pertussis
ugggcgagguagggcgcggccag

SEQ ID NO: 319772 - RNA, 16 nt, Bordetella pertussis
ugggcgaggcgcuggc

SEQ ID NO: 319773 - RNA, 19 nt, Bordetella pertussis
ugggcgaugcauucggcgg

SEQ ID NO: 319774 - RNA, 16 nt, Bordetella pertussis
ugggcgcauuggcccu

SEQ ID NO: 319775 - RNA, 19 nt, Bordetella pertussis
ugggcgccagcagcacguc

SEQ ID NO: 319776 - RNA, 15 nt, Bordetella pertussis
ugggcgccaugcgcc

SEQ ID NO: 319777 - RNA, 18 nt, Bordetella pertussis
ugggcgccgagggccgcg

SEQ ID NO: 319778 - RNA, 15 nt, Bordetella pertussis
ugggcgccggcggcg

SEQ ID NO: 319779 - RNA, 18 nt, Bordetella pertussis
ugggcgccuacggcggcg

SEQ ID NO: 319780 - RNA, 14 nt, Bordetella pertussis
ugggcgcgcgccag

SEQ ID NO: 319781 - RNA, 18 nt, Bordetella pertussis
ugggcgcgcgccagguug

SEQ ID NO: 319782 - RNA, 15 nt, Bordetella pertussis
ugggcgcgcgcccag

SEQ ID NO: 319783 - RNA, 14 nt, Bordetella pertussis
ugggcgcggcgcgc

SEQ ID NO: 319784 - RNA, 15 nt, Bordetella pertussis
ugggcgcgguagcgc

SEQ ID NO: 319785 - RNA, 21 nt, Bordetella pertussis
ugggcggcagcaggcgcguga

SEQ ID NO: 319786 - RNA, 14 nt, Bordetella pertussis
ugggcggcgagccg

SEQ ID NO: 319787 - RNA, 21 nt, Bordetella pertussis
ugggcgugaaaggccagcggc

SEQ ID NO: 319788 - RNA, 15 nt, Bordetella pertussis
ugggcgugccgcgcu

SEQ ID NO: 319789 - RNA, 16 nt, Bordetella pertussis
ugggcguggcgcgcgu

SEQ ID NO: 319790 - RNA, 23 nt, Bordetella pertussis
ugggcguggugcugacggacugg

SEQ ID NO: 319791 - RNA, 20 nt, Bordetella pertussis
ugggcuccguuccgaugcug

SEQ ID NO: 319792 - RNA, 21 nt, Bordetella pertussis
ugggcucgucgacgcggccgu

SEQ ID NO: 319793 - RNA, 23 nt, Bordetella pertussis
ugggcucgucgacgcggccgugg

SEQ ID NO: 319794 - RNA, 14 nt, Bordetella pertussis
ugggcugcggcgug

SEQ ID NO: 319795 - RNA, 21 nt, Bordetella pertussis
ugggcuuugccugcgaugccg

SEQ ID NO: 319796 - RNA, 16 nt, Bordetella pertussis
uggggacaggcacccg

SEQ ID NO: 319797 - RNA, 14 nt, Bordetella pertussis
uggggacuggcgcc

SEQ ID NO: 319798 - RNA, 20 nt, Bordetella pertussis
uggggaucgaacuugcgcgc

SEQ ID NO: 319799 - RNA, 22 nt, Bordetella pertussis
uggggcagccauccucgcccag

SEQ ID NO: 319800 - RNA, 20 nt, Bordetella pertussis
uggggccauggcacaggcca

SEQ ID NO: 319801 - RNA, 17 nt, Bordetella pertussis
uggggccgagcgugccg

SEQ ID NO: 319802 - RNA, 13 nt, Bordetella pertussis
uggggccgcgccg

SEQ ID NO: 319803 - RNA, 18 nt, Bordetella pertussis
uggggccgcggcgcgcgc

SEQ ID NO: 319804 - RNA, 16 nt, Bordetella pertussis
uggggccgggcgccag

SEQ ID NO: 319805 - RNA, 17 nt, Bordetella pertussis
uggggcggcccagcggc

SEQ ID NO: 319806 - RNA, 19 nt, Bordetella pertussis
uggggcgggcgcugcgcga

SEQ ID NO: 319807 - RNA, 17 nt, Bordetella pertussis
ugggggacuggcacccg

SEQ ID NO: 319808 - RNA, 13 nt, Bordetella pertussis
ugggggcccacau

SEQ ID NO: 319809 - RNA, 17 nt, Bordetella pertussis
ugggggcccacaugccg

SEQ ID NO: 319810 - RNA, 21 nt, Bordetella pertussis
ugggggcgguaccguccuggc

SEQ ID NO: 319811 - RNA, 15 nt, Bordetella pertussis
ugggggucagcgccg

SEQ ID NO: 319812 - RNA, 20 nt, Bordetella pertussis
uggggguggaaaugccggcg

SEQ ID NO: 319813 - RNA, 13 nt, Bordetella pertussis
ugggguaggcgcg

SEQ ID NO: 319814 - RNA, 16 nt, Bordetella pertussis
uggggugcuccugcca

SEQ ID NO: 319815 - RNA, 20 nt, Bordetella pertussis
ugggugaagccaagcagggc

SEQ ID NO: 319816 - RNA, 18 nt, Bordetella pertussis
ugggugacgcuggagcgc

SEQ ID NO: 319817 - RNA, 17 nt, Bordetella pertussis
ugggugcgguaggcgcc

SEQ ID NO: 319818 - RNA, 18 nt, Bordetella pertussis
ugguaguaaucgcgcgcc

SEQ ID NO: 319819 - RNA, 12 nt, Bordetella pertussis
ugguaucgcgcc

SEQ ID NO: 319820 - RNA, 17 nt, Bordetella pertussis
uggucaagggcggccau

SEQ ID NO: 319821 - RNA, 21 nt, Bordetella pertussis
uggucaagggcggccaugccg

SEQ ID NO: 319822 - RNA, 15 nt, Bordetella pertussis
uggucaccacccgca

SEQ ID NO: 319823 - RNA, 14 nt, Bordetella pertussis
uggucaucgauggc

SEQ ID NO: 319824 - RNA, 17 nt, Bordetella pertussis
uggucaucgauggccac

SEQ ID NO: 319825 - RNA, 21 nt, Bordetella pertussis
uggucucccccucggccugcg

SEQ ID NO: 319826 - RNA, 20 nt, Bordetella pertussis
uggucugccaguccauccag

SEQ ID NO: 319827 - RNA, 14 nt, Bordetella pertussis
uggugaaacagcau

SEQ ID NO: 319828 - RNA, 18 nt, Bordetella pertussis
uggugaaagccgccggcg

SEQ ID NO: 319829 - RNA, 13 nt, Bordetella pertussis
uggucuugccgcc

SEQ ID NO: 319830 - RNA, 18 nt, Bordetella pertussis
uggugaagaaccgccgca

SEQ ID NO: 319831 - RNA, 14 nt, Bordetella pertussis
uggugcacgccgau

SEQ ID NO: 319832 - RNA, 13 nt, Bordetella pertussis
uggugcagcggca

SEQ ID NO: 319833 - RNA, 17 nt, Bordetella pertussis
uggugccgccgcccgac

SEQ ID NO: 319834 - RNA, 17 nt, Bordetella pertussis
uggugccgacggcgcgg

SEQ ID NO: 319835 - RNA, 12 nt, Bordetella pertussis
uggugcgccucg

SEQ ID NO: 319836 - RNA, 20 nt, Bordetella pertussis
uggugcgcguccugggccga

SEQ ID NO: 319837 - RNA, 13 nt, Bordetella pertussis
uggugcugggcgg

SEQ ID NO: 319838 - RNA, 14 nt, Bordetella pertussis
uggugcugggcggc

SEQ ID NO: 319839 - RNA, 15 nt, Bordetella pertussis
uggugcugggcggcg

SEQ ID NO: 319840 - RNA, 16 nt, Bordetella pertussis
uggugcugggcggcgg

SEQ ID NO: 319841 - RNA, 17 nt, Bordetella pertussis
uggugcugcugggcgcc

SEQ ID NO: 319842 - RNA, 17 nt, Bordetella pertussis
ugguggauccgccggug

SEQ ID NO: 319843 - RNA, 24 nt, Bordetella pertussis
ugguggcgauccauguggccagcu

SEQ ID NO: 319844 - RNA, 13 nt, Bordetella pertussis
uggugggcaugac

SEQ ID NO: 319845 - RNA, 22 nt, Bordetella pertussis
uggugggccacucgaugggcgc

SEQ ID NO: 319846 - RNA, 14 nt, Bordetella pertussis
uggugggccgacgg

SEQ ID NO: 319847 - RNA, 14 nt, Bordetella pertussis
uggugggcggcaau

SEQ ID NO: 319848 - RNA, 16 nt, Bordetella pertussis
ugguggggcuggccgc

SEQ ID NO: 319849 - RNA, 13 nt, Bordetella pertussis
uguacaggcgcgg

SEQ ID NO: 319850 - RNA, 15 nt, Bordetella pertussis
uguacaggcgcggca

SEQ ID NO: 319851 - RNA, 21 nt, Bordetella pertussis
uguaccagaugagacacggca

SEQ ID NO: 319852 - RNA, 19 nt, Bordetella pertussis
uguacgacgucuugcugcc

SEQ ID NO: 319853 - RNA, 22 nt, Bordetella pertussis
uguagcccuggcgcugcagcgu

SEQ ID NO: 319854 - RNA, 23 nt, Bordetella pertussis
uguagcccuggcgcugcagcguc

SEQ ID NO: 319855 - RNA, 12 nt, Bordetella pertussis
uguagcgcagcc

SEQ ID NO: 319856 - RNA, 22 nt, Bordetella pertussis
aaucaccgccgcgaccgggccg

SEQ ID NO: 319857 - RNA, 17 nt, Bordetella pertussis
uguaggcgccgcgcccg

SEQ ID NO: 319858 - RNA, 20 nt, Bordetella pertussis
ugucaagcagcgccggcugg

SEQ ID NO: 319859 - RNA, 22 nt, Bordetella pertussis
ugucaccgacgccagcgauacc

SEQ ID NO: 319860 - RNA, 22 nt, Bordetella pertussis
ugucacgacguccacgaugucg

SEQ ID NO: 319861 - RNA, 19 nt, Bordetella pertussis
ugucggggccgggccggcg

SEQ ID NO: 319862 - RNA, 22 nt, Bordetella pertussis
ugucggggugccguucggccag

SEQ ID NO: 319863 - RNA, 23 nt, Bordetella pertussis
ugucguccagcuccaggugccag

SEQ ID NO: 319864 - RNA, 17 nt, Bordetella pertussis
ugucguugaugguccgc

SEQ ID NO: 319865 - RNA, 18 nt, Bordetella pertussis
ugucguugcacagcacgu

SEQ ID NO: 319866 - RNA, 19 nt, Bordetella pertussis
ugugacggauucccagcuc

SEQ ID NO: 319867 - RNA, 22 nt, Bordetella pertussis
ugugauagcacugcaccugcuc

SEQ ID NO: 319868 - RNA, 15 nt, Bordetella pertussis
ugugaucgccgacga

SEQ ID NO: 319869 - RNA, 21 nt, Bordetella pertussis
ugugcagccacgccuggccgc

SEQ ID NO: 319870 - RNA, 15 nt, Bordetella pertussis
ugugcaugcgcgcca

SEQ ID NO: 319871 - RNA, 16 nt, Bordetella pertussis
ugugcaugcgcgccag

SEQ ID NO: 319872 - RNA, 17 nt, Bordetella pertussis
ugugccagcuggcccag

SEQ ID NO: 319873 - RNA, 16 nt, Bordetella pertussis
ugugccccuugcccaa

SEQ ID NO: 319874 - RNA, 16 nt, Bordetella pertussis
ugugccgccagcggga

SEQ ID NO: 319875 - RNA, 19 nt, Bordetella pertussis
ugugccugucccagcgggg

SEQ ID NO: 319876 - RNA, 17 nt, Bordetella pertussis
ugugcgccccgcuggcc

SEQ ID NO: 319877 - RNA, 15 nt, Bordetella pertussis
ugugcgccggggcgc

SEQ ID NO: 319878 - RNA, 14 nt, Bordetella pertussis
ugugcgcgggcgcg

SEQ ID NO: 319879 - RNA, 15 nt, Bordetella pertussis
ugugcugccaugccg

SEQ ID NO: 319880 - RNA, 16 nt, Bordetella pertussis
ugugcugccaugccgc

SEQ ID NO: 319881 - RNA, 13 nt, Bordetella pertussis
uguggacgccgcc

SEQ ID NO: 319882 - RNA, 12 nt, Bordetella pertussis
uguggcgcgcca

SEQ ID NO: 319883 - RNA, 15 nt, Bordetella pertussis
uguggcgucgggggc

SEQ ID NO: 319884 - RNA, 16 nt, Bordetella pertussis
ugugguagccgccguc

SEQ ID NO: 319885 - RNA, 15 nt, Bordetella pertussis
uguucggaugcgcgu

SEQ ID NO: 319886 - RNA, 19 nt, Bordetella pertussis
uguucggcgccgggcgacg

SEQ ID NO: 319887 - RNA, 16 nt, Bordetella pertussis
uguucgggccggcugc

SEQ ID NO: 319888 - RNA, 22 nt, Bordetella pertussis
uguucgggcgcggugcgcacca

SEQ ID NO: 319889 - RNA, 22 nt, Bordetella pertussis
uguugauccgccaauggcggau

SEQ ID NO: 319890 - RNA, 14 nt, Bordetella pertussis
uguugccgcgucga

SEQ ID NO: 319891 - RNA, 13 nt, Bordetella pertussis
uguugccggccag

SEQ ID NO: 319892 - RNA, 20 nt, Bordetella pertussis
uuacaggcccaguacggccu

SEQ ID NO: 319893 - RNA, 15 nt, Bordetella pertussis
uuacgcggcgcgcgc

SEQ ID NO: 319894 - RNA, 17 nt, Bordetella pertussis
uucaccuaccucagcau

SEQ ID NO: 319895 - RNA, 20 nt, Bordetella pertussis
uucacgacacgcccagcagg

SEQ ID NO: 319896 - RNA, 13 nt, Bordetella pertussis
uucacgcccagga

SEQ ID NO: 319897 - RNA, 23 nt, Bordetella pertussis
uucacgccccgcacgaucagcau

SEQ ID NO: 319898 - RNA, 20 nt, Bordetella pertussis
uucacgcgcaagccgcugga

SEQ ID NO: 319899 - RNA, 19 nt, Bordetella pertussis
uucagcagcucguugaccu

SEQ ID NO: 319900 - RNA, 14 nt, Bordetella pertussis
uucaggaugccgcc

SEQ ID NO: 319901 - RNA, 15 nt, Bordetella pertussis
uucaggcgcgcggca

SEQ ID NO: 319902 - RNA, 18 nt, Bordetella pertussis
uucaucaaacgcggcgcc

SEQ ID NO: 319903 - RNA, 15 nt, Bordetella pertussis
uucaucacgggcgcc

SEQ ID NO: 319904 - RNA, 21 nt, Bordetella pertussis
uucaucgagcauugccgcggc

SEQ ID NO: 319905 - RNA, 17 nt, Bordetella pertussis
uucaugaccgccgcgcc

SEQ ID NO: 319906 - RNA, 19 nt, Bordetella pertussis
uucaugggcggcgagccga

SEQ ID NO: 319907 - RNA, 21 nt, Bordetella pertussis
uucauggcguaauugggcugg

SEQ ID NO: 319908 - RNA, 11 nt, Bordetella pertussis
uuccacagcca

SEQ ID NO: 319909 - RNA, 20 nt, Bordetella pertussis
uuccacagcgccgaccgcac

SEQ ID NO: 319910 - RNA, 17 nt, Bordetella pertussis
uuccaccgucuggcgua

SEQ ID NO: 319911 - RNA, 16 nt, Bordetella pertussis
uuccagcgccuggcgg

SEQ ID NO: 319912 - RNA, 17 nt, Bordetella pertussis
uuccaugacggugccga

SEQ ID NO: 319913 - RNA, 14 nt, Bordetella pertussis
uucccuggcgcgcc

SEQ ID NO: 319914 - RNA, 16 nt, Bordetella pertussis
uuccgccaccgcgccg

SEQ ID NO: 319915 - RNA, 17 nt, Bordetella pertussis
uuccgccaccgcgccgc

SEQ ID NO: 319916 - RNA, 23 nt, Bordetella pertussis
uuccgccuacuggcgcgcgcaag

SEQ ID NO: 319917 - RNA, 17 nt, Bordetella pertussis
uuccgcgaaacggcggg

SEQ ID NO: 319918 - RNA, 24 nt, Bordetella pertussis
uuccgcuaccaggcgcgcgcgcgg

SEQ ID NO: 319919 - RNA, 16 nt, Bordetella pertussis
uuccgcuuccggccgg

SEQ ID NO: 319920 - RNA, 16 nt, Bordetella pertussis
uuccuuggucagcgau

SEQ ID NO: 319921 - RNA, 15 nt, Bordetella pertussis
uucgaacaaggcggu

SEQ ID NO: 319922 - RNA, 14 nt, Bordetella pertussis
uucgaagccgcccc

SEQ ID NO: 319923 - RNA, 15 nt, Bordetella pertussis
uucgaagcgcucgac

SEQ ID NO: 319924 - RNA, 16 nt, Bordetella pertussis
uucgacacccuugcgc

SEQ ID NO: 319925 - RNA, 15 nt, Bordetella pertussis
uucgacagcgcgcag

SEQ ID NO: 319926 - RNA, 13 nt, Bordetella pertussis
uucgaccagcgac

SEQ ID NO: 319927 - RNA, 20 nt, Bordetella pertussis
uucgcccaccaccagcggcg

SEQ ID NO: 319928 - RNA, 21 nt, Bordetella pertussis
uucgcccagcgcuugcacgcc

SEQ ID NO: 319929 - RNA, 21 nt, Bordetella pertussis
uucgcccgccaccacgcgcac

SEQ ID NO: 319930 - RNA, 20 nt, Bordetella pertussis
uucgcgcagaucccaggcgc

SEQ ID NO: 319931 - RNA, 11 nt, Bordetella pertussis
uucgcgcagca

SEQ ID NO: 319932 - RNA, 23 nt, Bordetella pertussis
uucgcgcagcaacccgcccgggu

SEQ ID NO: 319933 - RNA, 23 nt, Bordetella pertussis
uucgcgcagcagcuugccgaccg

SEQ ID NO: 319934 - RNA, 13 nt, Bordetella pertussis
uucgcgcagcggc

SEQ ID NO: 319935 - RNA, 18 nt, Bordetella pertussis
uucgcgguacgcccagcu

SEQ ID NO: 319936 - RNA, 16 nt, Bordetella pertussis
uucgcugggcgcgcac

SEQ ID NO: 319937 - RNA, 18 nt, Bordetella pertussis
uucggaugcgcguugccg

SEQ ID NO: 319938 - RNA, 17 nt, Bordetella pertussis
uucggcaaccgcgccuc

SEQ ID NO: 319939 - RNA, 13 nt, Bordetella pertussis
uucggcgcgcgcc

SEQ ID NO: 319940 - RNA, 16 nt, Bordetella pertussis
uucggcgcgcgugccg

SEQ ID NO: 319941 - RNA, 21 nt, Bordetella pertussis
uucggcgcgcgugccgcgcag

SEQ ID NO: 319942 - RNA, 23 nt, Bordetella pertussis
uucggcgcggcgggcgcuggcgc

SEQ ID NO: 319943 - RNA, 22 nt, Bordetella pertussis
uucggcggccagccggcgcgcc

SEQ ID NO: 319944 - RNA, 16 nt, Bordetella pertussis
uucggcggccaugccg

SEQ ID NO: 319945 - RNA, 23 nt, Bordetella pertussis
uucggcuugcguuggcauggcgc

SEQ ID NO: 319946 - RNA, 17 nt, Bordetella pertussis
uucgggcgcggugcgca

SEQ ID NO: 319947 - RNA, 21 nt, Bordetella pertussis
uucgggcgcggugcgcaccag

SEQ ID NO: 319948 - RNA, 13 nt, Bordetella pertussis
uucguccagguug

SEQ ID NO: 319949 - RNA, 19 nt, Bordetella pertussis
uucguccucgaccaggaug

SEQ ID NO: 319950 - RNA, 17 nt, Bordetella pertussis
uucgucgcugccgcgcg

SEQ ID NO: 319951 - RNA, 15 nt, Bordetella pertussis
uucgucgggcagcgc

SEQ ID NO: 319952 - RNA, 21 nt, Bordetella pertussis
uucgugcaccagcccgaugcg

SEQ ID NO: 319953 - RNA, 14 nt, Bordetella pertussis
uucguggcgcagcu

SEQ ID NO: 319954 - RNA, 13 nt, Bordetella pertussis
uucgugguggcga

SEQ ID NO: 319955 - RNA, 13 nt, Bordetella pertussis
uucucgccgcgcg

SEQ ID NO: 319956 - RNA, 16 nt, Bordetella pertussis
uucugcgccugcuggu

SEQ ID NO: 319957 - RNA, 22 nt, Bordetella pertussis
uucugcgccugcuggucggccu

SEQ ID NO: 319958 - RNA, 16 nt, Bordetella pertussis
uucuggacgcugaccg

SEQ ID NO: 319959 - RNA, 13 nt, Bordetella pertussis
uucuggcgcagca

SEQ ID NO: 319960 - RNA, 21 nt, Bordetella pertussis
uucuggcugcgcgccuggcac

SEQ ID NO: 319961 - RNA, 10 nt, Bordetella pertussis
uugaugccgc

SEQ ID NO: 319962 - RNA, 14 nt, Bordetella pertussis
uugauggccucggc

SEQ ID NO: 319963 - RNA, 18 nt, Bordetella pertussis
uugauggggccgcgccgu

SEQ ID NO: 319964 - RNA, 19 nt, Bordetella pertussis
uugauguccggguugccca

SEQ ID NO: 319965 - RNA, 17 nt, Bordetella pertussis
uugcagggugucggcca

SEQ ID NO: 319966 - RNA, 20 nt, Bordetella pertussis
uugccaagauggcccagggc

SEQ ID NO: 319967 - RNA, 14 nt, Bordetella pertussis
uugccacggcgggc

SEQ ID NO: 319968 - RNA, 23 nt, Bordetella pertussis
uugccacggcgggccggcucggc

SEQ ID NO: 319969 - RNA, 15 nt, Bordetella pertussis
uugccauucgguggu

SEQ ID NO: 319970 - RNA, 18 nt, Bordetella pertussis
uugccauaggccagcgcc

SEQ ID NO: 319971 - RNA, 18 nt, Bordetella pertussis
uugcccgaaggcagcggc

SEQ ID NO: 319972 - RNA, 20 nt, Bordetella pertussis
uugcccgucagcggcgcgcc

SEQ ID NO: 319973 - RNA, 21 nt, Bordetella pertussis
uugccgaagcgucggccugca

SEQ ID NO: 319974 - RNA, 16 nt, Bordetella pertussis
uugccgauccagcgcc

SEQ ID NO: 319975 - RNA, 12 nt, Bordetella pertussis
uugccgcagccc

SEQ ID NO: 319976 - RNA, 13 nt, Bordetella pertussis
uugccgcagcggc

SEQ ID NO: 319977 - RNA, 21 nt, Bordetella pertussis
uugccgcacgaucgcgccggc

SEQ ID NO: 319978 - RNA, 20 nt, Bordetella pertussis
uugccgccgcgcagccgaca

SEQ ID NO: 319979 - RNA, 21 nt, Bordetella pertussis
uugccgcgcagcgucugcgca

SEQ ID NO: 319980 - RNA, 19 nt, Bordetella pertussis
uugccgcucaauucggccu

SEQ ID NO: 319981 - RNA, 20 nt, Bordetella pertussis
uugccggagcagcagcgggc

SEQ ID NO: 319982 - RNA, 18 nt, Bordetella pertussis
uugccggaggucggcgca

SEQ ID NO: 319983 - RNA, 20 nt, Bordetella pertussis
uugccggccgcccaggcgca

SEQ ID NO: 319984 - RNA, 13 nt, Bordetella pertussis
uugccggcgcgca

SEQ ID NO: 319985 - RNA, 18 nt, Bordetella pertussis
uugccggcgcgcaaaccg

SEQ ID NO: 319986 - RNA, 14 nt, Bordetella pertussis
uugccggugcgcgu

SEQ ID NO: 319987 - RNA, 15 nt, Bordetella pertussis
uugccguccuggcga

SEQ ID NO: 319988 - RNA, 13 nt, Bordetella pertussis
uugccgucggccg

SEQ ID NO: 319989 - RNA, 17 nt, Bordetella pertussis
uugccgucggccgcgcc

SEQ ID NO: 319990 - RNA, 16 nt, Bordetella pertussis
uugccguuguccgccu

SEQ ID NO: 319991 - RNA, 17 nt, Bordetella pertussis
uugccguucaugccgac

SEQ ID NO: 319992 - RNA, 16 nt, Bordetella pertussis
uugcgcaucgcgcacc

SEQ ID NO: 319993 - RNA, 13 nt, Bordetella pertussis
uugcgccagcggc

SEQ ID NO: 319994 - RNA, 14 nt, Bordetella pertussis
uugcgccagcuugc

SEQ ID NO: 319995 - RNA, 13 nt, Bordetella pertussis
uugcgccccgcca

SEQ ID NO: 319996 - RNA, 21 nt, Bordetella pertussis
aauccacagcuggugccgguu

SEQ ID NO: 319997 - RNA, 13 nt, Bordetella pertussis
aauccagcgcgcc

SEQ ID NO: 319998 - RNA, 21 nt, Bordetella pertussis
aauccagcgcgcccagaucga

SEQ ID NO: 319999 - RNA, 20 nt, Bordetella pertussis
uugcgccguugcgggcugcg

SEQ ID NO: 320000 - RNA, 20 nt, Bordetella pertussis
uuggcaaccucgccgcgcca

SEQ ID NO: 320001 - RNA, 23 nt, Bordetella pertussis
uuggcauggcgcgugcgcgcgcc

SEQ ID NO: 320002 - RNA, 14 nt, Bordetella pertussis
uuggccagcagcgc

SEQ ID NO: 320003 - RNA, 14 nt, Bordetella pertussis
aauccgccgccagc

SEQ ID NO: 320004 - RNA, 17 nt, Bordetella pertussis
uuggcgaaggcgucggc

SEQ ID NO: 320005 - RNA, 19 nt, Bordetella pertussis
uuggcgaaggcgucggcca

SEQ ID NO: 320006 - RNA, 21 nt, Bordetella pertussis
uuggcgaaggcgucggccaug

SEQ ID NO: 320007 - RNA, 21 nt, Bordetella pertussis
uuggcgaaucaguucgcgcag

SEQ ID NO: 320008 - RNA, 17 nt, Bordetella pertussis
uuggcgauggccgccag

SEQ ID NO: 320009 - RNA, 22 nt, Bordetella pertussis
uuggcgcaggaacucagcgcac

SEQ ID NO: 320010 - RNA, 16 nt, Bordetella pertussis
uuggcgcccagcgcca

SEQ ID NO: 320011 - RNA, 23 nt, Bordetella pertussis
uuggucgcgaccucggcggcguc

SEQ ID NO: 320012 - RNA, 16 nt, Bordetella pertussis
uuggugcgcgccaggu

SEQ ID NO: 320013 - RNA, 15 nt, Bordetella pertussis
uugguguugccggcc

SEQ ID NO: 320014 - RNA, 18 nt, Bordetella pertussis
uugucaagcagcgccggc

SEQ ID NO: 320015 - RNA, 13 nt, Bordetella pertussis
uuguccuggcgcg

SEQ ID NO: 320016 - RNA, 13 nt, Bordetella pertussis
uugucgcugcgca

SEQ ID NO: 320017 - RNA, 17 nt, Bordetella pertussis
uugugcugccaugccgc

SEQ ID NO: 320018 - RNA, 16 nt, Bordetella pertussis
uuuccgccaugcggcg

SEQ ID NO: 320019 - RNA, 16 nt, Bordetella pertussis
uuucggccaugugcgc

SEQ ID NO: 320020 - RNA, 24 nt, Bordetella pertussis
uuuguccuguauuccugaccgucc

SEQ ID NO: 320021 - RNA, 13 nt, Bordetella pertussis
aaucgcgcgccac

SEQ ID NO: 320022 - RNA, 19 nt, Bordetella pertussis
aaucggcgugcagcaagcc

SEQ ID NO: 320023 - RNA, 16 nt, Bordetella pertussis
aaugcgacagcgacag

SEQ ID NO: 320024 - RNA, 13 nt, Bordetella pertussis
aaugcgccgcgcc

SEQ ID NO: 320025 - RNA, 16 nt, Bordetella pertussis
aaugcggcgacagggc

SEQ ID NO: 320026 - RNA, 20 nt, Bordetella pertussis
aaugcggcgacagggcgucg

SEQ ID NO: 320027 - RNA, 19 nt, Bordetella pertussis
aaugcggcggcgcuggccu

SEQ ID NO: 320028 - RNA, 14 nt, Bordetella pertussis
aauggaugcgcgcc

SEQ ID NO: 320029 - RNA, 11 nt, Bordetella pertussis
aauggcgcggu

SEQ ID NO: 320030 - RNA, 21 nt, Bordetella pertussis
aauggcggccucgggcaacug

SEQ ID NO: 320031 - RNA, 14 nt, Bordetella pertussis
aauggucaagcggc

SEQ ID NO: 320032 - RNA, 23 nt, Bordetella pertussis
aauggugcggccaugauacccau

SEQ ID NO: 320033 - RNA, 22 nt, Bordetella pertussis
aauggugcgguugcgaggcggc

SEQ ID NO: 320034 - RNA, 17 nt, Bordetella pertussis
aaugucaccgacgccag

SEQ ID NO: 320035 - RNA, 18 nt, Bordetella pertussis
aauguccggggcgcuugc

SEQ ID NO: 320036 - RNA, 15 nt, Bordetella pertussis
acaacaagccgggcg

SEQ ID NO: 320037 - RNA, 22 nt, Bordetella pertussis
acaacaucaaugacauggccac

SEQ ID NO: 320038 - RNA, 22 nt, Bordetella pertussis
acaacauuggguacgacggccg

SEQ ID NO: 320039 - RNA, 14 nt, Bordetella pertussis
acaaccuggcgcgc

SEQ ID NO: 320040 - RNA, 15 nt, Bordetella pertussis
acaacgcgcgccacu

SEQ ID NO: 320041 - RNA, 14 nt, Bordetella pertussis
acaacgggaucggc

SEQ ID NO: 320042 - RNA, 19 nt, Bordetella pertussis
acaagcgcgaaauggugua

SEQ ID NO: 320043 - RNA, 17 nt, Bordetella pertussis
acaaggccggagccagg

SEQ ID NO: 320044 - RNA, 20 nt, Bordetella pertussis
acaaggcgcguaugacgcgc

SEQ ID NO: 320045 - RNA, 19 nt, Bordetella pertussis
acaagguccaggcccggca

SEQ ID NO: 320046 - RNA, 14 nt, Bordetella pertussis
acacaaggcggccg

SEQ ID NO: 320047 - RNA, 17 nt, Bordetella pertussis
acacaauugaugcgggu

SEQ ID NO: 320048 - RNA, 21 nt, Bordetella pertussis
acaccgcccgaaagguccugg

SEQ ID NO: 320049 - RNA, 18 nt, Bordetella pertussis
acaccgucacgcgcaagg

SEQ ID NO: 320050 - RNA, 14 nt, Bordetella pertussis
acaccgucgcgcgc

SEQ ID NO: 320051 - RNA, 19 nt, Bordetella pertussis
acaccgugaaggugccgga

SEQ ID NO: 320052 - RNA, 14 nt, Bordetella pertussis
acaccgugcuggcc

SEQ ID NO: 320053 - RNA, 17 nt, Bordetella pertussis
acaccgugcuggccgac

SEQ ID NO: 320054 - RNA, 18 nt, Bordetella pertussis
acaccgugugaucgccga

SEQ ID NO: 320055 - RNA, 18 nt, Bordetella pertussis
acaccguuuuggcaggcu

SEQ ID NO: 320056 - RNA, 16 nt, Bordetella pertussis
acacgaggaccgcgau

SEQ ID NO: 320057 - RNA, 18 nt, Bordetella pertussis
acacgauccacggccggc

SEQ ID NO: 320058 - RNA, 14 nt, Bordetella pertussis
acacgaugccucga

SEQ ID NO: 320059 - RNA, 17 nt, Bordetella pertussis
acacgcccaugauggug

SEQ ID NO: 320060 - RNA, 22 nt, Bordetella pertussis
acacgccgauugaggccagcac

SEQ ID NO: 320061 - RNA, 23 nt, Bordetella pertussis
acacgcgcgcaaugcgcggcgcu

SEQ ID NO: 320062 - RNA, 22 nt, Bordetella pertussis
acacgcgcugggcguggcgcgc

SEQ ID NO: 320063 - RNA, 21 nt, Bordetella pertussis
acacgcgguagguagcgcgca

SEQ ID NO: 320064 - RNA, 16 nt, Bordetella pertussis
acacgcugaagcgccg

SEQ ID NO: 320065 - RNA, 15 nt, Bordetella pertussis
acacgcuggacgacg

SEQ ID NO: 320066 - RNA, 17 nt, Bordetella pertussis
acacgcuggacgacgug

SEQ ID NO: 320067 - RNA, 21 nt, Bordetella pertussis
acacggcgcgggcggucggcg

SEQ ID NO: 320068 - RNA, 14 nt, Bordetella pertussis
acagcacgcccgcc

SEQ ID NO: 320069 - RNA, 12 nt, Bordetella pertussis
acagcagauggc

SEQ ID NO: 320070 - RNA, 15 nt, Bordetella pertussis
acagccacgcgcgau

SEQ ID NO: 320071 - RNA, 22 nt, Bordetella pertussis
acagccacgcgcgauccgcgcc

SEQ ID NO: 320072 - RNA, 15 nt, Bordetella pertussis
acagccaggccagca

SEQ ID NO: 320073 - RNA, 19 nt, Bordetella pertussis
acagccaggccagcgccag

SEQ ID NO: 320074 - RNA, 23 nt, Bordetella pertussis
acagcccgaacagaaggcgugcg

SEQ ID NO: 320075 - RNA, 21 nt, Bordetella pertussis
acagccugcccugguggcaga

SEQ ID NO: 320076 - RNA, 19 nt, Bordetella pertussis
acagcgccaggcuccauau

SEQ ID NO: 320077 - RNA, 16 nt, Bordetella pertussis
acagcgccaucgcgcg

SEQ ID NO: 320078 - RNA, 23 nt, Bordetella pertussis
acagcgccccgaucagcaagggc

SEQ ID NO: 320079 - RNA, 16 nt, Bordetella pertussis
acagcgccgcggcguc

SEQ ID NO: 320080 - RNA, 13 nt, Bordetella pertussis
acagcgccugcgc

SEQ ID NO: 320081 - RNA, 22 nt, Bordetella pertussis
acagcgccuggcggcuggucaa

SEQ ID NO: 320082 - RNA, 18 nt, Bordetella pertussis
acagcgcgcccgaugccu

SEQ ID NO: 320083 - RNA, 22 nt, Bordetella pertussis
acagcgcggcgaaggcgcggcu

SEQ ID NO: 320084 - RNA, 14 nt, Bordetella pertussis
acagcggagccgcg

SEQ ID NO: 320085 - RNA, 17 nt, Bordetella pertussis
acagcggcgagcgcggc

SEQ ID NO: 320086 - RNA, 12 nt, Bordetella pertussis
acagcggcgcga

SEQ ID NO: 320087 - RNA, 14 nt, Bordetella pertussis
acagcggcgcgagc

SEQ ID NO: 320088 - RNA, 19 nt, Bordetella pertussis
acaguacuuguugcgugcc

SEQ ID NO: 320089 - RNA, 14 nt, Bordetella pertussis
acauacaaggcgcg

SEQ ID NO: 320090 - RNA, 20 nt, Bordetella pertussis
acauacagcggagccgcgca

SEQ ID NO: 320091 - RNA, 23 nt, Bordetella pertussis
acauccucgggcgacuccagccc

SEQ ID NO: 320092 - RNA, 13 nt, Bordetella pertussis
acauccugaccgg

SEQ ID NO: 320093 - RNA, 18 nt, Bordetella pertussis
acaugaccgcguccgcga

SEQ ID NO: 320094 - RNA, 21 nt, Bordetella pertussis
acaugacguucuccagcgccg

SEQ ID NO: 320095 - RNA, 16 nt, Bordetella pertussis
acaugaugcccagcgc

SEQ ID NO: 320096 - RNA, 22 nt, Bordetella pertussis
acaugaugcccagcgccagggc

SEQ ID NO: 320097 - RNA, 19 nt, Bordetella pertussis
acaugcacgauauuggcgu

SEQ ID NO: 320098 - RNA, 14 nt, Bordetella pertussis
acaugcccggccac

SEQ ID NO: 320099 - RNA, 19 nt, Bordetella pertussis
accaacggggccgccaacg

SEQ ID NO: 320100 - RNA, 21 nt, Bordetella pertussis
accaacggggccgccaacgcc

SEQ ID NO: 320101 - RNA, 18 nt, Bordetella pertussis
accaacucgaggcggcgc

SEQ ID NO: 320102 - RNA, 23 nt, Bordetella pertussis
accaacugccugcagcgcgcgcg

SEQ ID NO: 320103 - RNA, 12 nt, Bordetella pertussis
accaagggcgcc

SEQ ID NO: 320104 - RNA, 22 nt, Bordetella pertussis
accaaucuugccaggcccggcg

SEQ ID NO: 320105 - RNA, 12 nt, Bordetella pertussis
accaccggcuug

SEQ ID NO: 320106 - RNA, 18 nt, Bordetella pertussis
accaccgucuugcccgcc

SEQ ID NO: 320107 - RNA, 22 nt, Bordetella pertussis
accaccgucuugcccgccagcg

SEQ ID NO: 320108 - RNA, 14 nt, Bordetella pertussis
accaccuccaccgc

SEQ ID NO: 320109 - RNA, 15 nt, Bordetella pertussis
accaccuccaccgcc

SEQ ID NO: 320110 - RNA, 17 nt, Bordetella pertussis
accaccuccaccgccag

SEQ ID NO: 320111 - RNA, 15 nt, Bordetella pertussis
accaccugcaccgcc

SEQ ID NO: 320112 - RNA, 19 nt, Bordetella pertussis
accaccuucagggcgccgg

SEQ ID NO: 320113 - RNA, 20 nt, Bordetella pertussis
accaccuucagggcgccggc

SEQ ID NO: 320114 - RNA, 19 nt, Bordetella pertussis
accacggcaucggcgccgc

SEQ ID NO: 320115 - RNA, 21 nt, Bordetella pertussis
accacggcgcgcccgcaggcg

SEQ ID NO: 320116 - RNA, 15 nt, Bordetella pertussis
accacggcggccagg

SEQ ID NO: 320117 - RNA, 17 nt, Bordetella pertussis
accacgggcacgauggc

SEQ ID NO: 320118 - RNA, 18 nt, Bordetella pertussis
accacgggcacgauggcc

SEQ ID NO: 320119 - RNA, 15 nt, Bordetella pertussis
accagcagcgccagg

SEQ ID NO: 320120 - RNA, 13 nt, Bordetella pertussis
accagcagcgccg

SEQ ID NO: 320121 - RNA, 15 nt, Bordetella pertussis
accagcaggcggccg

SEQ ID NO: 320122 - RNA, 14 nt, Bordetella pertussis
accagcaggccggu

SEQ ID NO: 320123 - RNA, 14 nt, Bordetella pertussis
accagcccggccgc

SEQ ID NO: 320124 - RNA, 16 nt, Bordetella pertussis
accagcccggccgcca

SEQ ID NO: 320125 - RNA, 12 nt, Bordetella pertussis
accagcccggcg

SEQ ID NO: 320126 - RNA, 13 nt, Bordetella pertussis
accagccgccgcc

SEQ ID NO: 320127 - RNA, 16 nt, Bordetella pertussis
accagccggccgccga

SEQ ID NO: 320128 - RNA, 15 nt, Bordetella pertussis
accagcggcgugcgg

SEQ ID NO: 320129 - RNA, 18 nt, Bordetella pertussis
accagcggcguggcggcc

SEQ ID NO: 320130 - RNA, 14 nt, Bordetella pertussis
accagcgucagcac

SEQ ID NO: 320131 - RNA, 20 nt, Bordetella pertussis
accagcgucagcacaucgcc

SEQ ID NO: 320132 - RNA, 13 nt, Bordetella pertussis
accagcucgacgc

SEQ ID NO: 320133 - RNA, 16 nt, Bordetella pertussis
accagcugcaccaggc

SEQ ID NO: 320134 - RNA, 15 nt, Bordetella pertussis
accagcuugcgcgcc

SEQ ID NO: 320135 - RNA, 18 nt, Bordetella pertussis
accagcuuggccugcgga

SEQ ID NO: 320136 - RNA, 15 nt, Bordetella pertussis
accaggaagcgcgcc

SEQ ID NO: 320137 - RNA, 21 nt, Bordetella pertussis
accaggaagagcuggcgcugc

SEQ ID NO: 320138 - RNA, 17 nt, Bordetella pertussis
accaggauccccagcac

SEQ ID NO: 320139 - RNA, 15 nt, Bordetella pertussis
accaggcagccggcc

SEQ ID NO: 320140 - RNA, 16 nt, Bordetella pertussis
accaggcagccggccc

SEQ ID NO: 320141 - RNA, 17 nt, Bordetella pertussis
accaggcagccggcccc

SEQ ID NO: 320142 - RNA, 20 nt, Bordetella pertussis
accaggccacccgccguacc

SEQ ID NO: 320143 - RNA, 17 nt, Bordetella pertussis
accaggccacgaugaug

SEQ ID NO: 320144 - RNA, 18 nt, Bordetella pertussis
acccagaacccggccggc

SEQ ID NO: 320145 - RNA, 17 nt, Bordetella pertussis
acccagcagcggcagca

SEQ ID NO: 320146 - RNA, 24 nt, Bordetella pertussis
acccagccggacccgcgccgcagg

SEQ ID NO: 320147 - RNA, 12 nt, Bordetella pertussis
acccaggcccau

SEQ ID NO: 320148 - RNA, 14 nt, Bordetella pertussis
acccaggcggcagg

SEQ ID NO: 320149 - RNA, 20 nt, Bordetella pertussis
acccaggucgccgccgcgcu

SEQ ID NO: 320150 - RNA, 17 nt, Bordetella pertussis
acccagucgcaguucgg

SEQ ID NO: 320151 - RNA, 15 nt, Bordetella pertussis
acccauaccagcccg

SEQ ID NO: 320152 - RNA, 12 nt, Bordetella pertussis
acccaugcgggg

SEQ ID NO: 320153 - RNA, 18 nt, Bordetella pertussis
acccaugcggggcggcgg

SEQ ID NO: 320154 - RNA, 17 nt, Bordetella pertussis
accccaguuccagcacg

SEQ ID NO: 320155 - RNA, 11 nt, Bordetella pertussis
acccccagcag

SEQ ID NO: 320156 - RNA, 16 nt, Bordetella pertussis
acccccagcggcgcac

SEQ ID NO: 320157 - RNA, 19 nt, Bordetella pertussis
accccgagauaggcggcca

SEQ ID NO: 320158 - RNA, 14 nt, Bordetella pertussis
accccgccaccgcc

SEQ ID NO: 320159 - RNA, 21 nt, Bordetella pertussis
accccgccagguucgccuggc

SEQ ID NO: 320160 - RNA, 17 nt, Bordetella pertussis
accccgcccggcggcgc

SEQ ID NO: 320161 - RNA, 20 nt, Bordetella pertussis
accccgcccggcggcgcgcc

SEQ ID NO: 320162 - RNA, 23 nt, Bordetella pertussis
accccgcccggcggcgcgccgcc

SEQ ID NO: 320163 - RNA, 16 nt, Bordetella pertussis
accccgccgugccggg

SEQ ID NO: 320164 - RNA, 13 nt, Bordetella pertussis
accccggcgccgc

SEQ ID NO: 320165 - RNA, 13 nt, Bordetella pertussis
accccggcugcgc

SEQ ID NO: 320166 - RNA, 22 nt, Bordetella pertussis
accccgguguaggcgggcagcg

SEQ ID NO: 320167 - RNA, 19 nt, Bordetella pertussis
accccggugucgccguggc

SEQ ID NO: 320168 - RNA, 16 nt, Bordetella pertussis
accccguagcgcaucg

SEQ ID NO: 320169 - RNA, 20 nt, Bordetella pertussis
accccgucguccguccuggc

SEQ ID NO: 320170 - RNA, 19 nt, Bordetella pertussis
accccguggucgccagcac

SEQ ID NO: 320171 - RNA, 23 nt, Bordetella pertussis
acccgaaucucccggcgcccucu

SEQ ID NO: 320172 - RNA, 16 nt, Bordetella pertussis
acccgcaugguggcgc

SEQ ID NO: 320173 - RNA, 20 nt, Bordetella pertussis
acccgcaugguggcgcaggc

SEQ ID NO: 320174 - RNA, 17 nt, Bordetella pertussis
acccgccauccuggccg

SEQ ID NO: 320175 - RNA, 13 nt, Bordetella pertussis
acccgcccacgcg

SEQ ID NO: 320176 - RNA, 19 nt, Bordetella pertussis
acccgcccacgcggcgcug

SEQ ID NO: 320177 - RNA, 16 nt, Bordetella pertussis
acccgccggccaucac

SEQ ID NO: 320178 - RNA, 18 nt, Bordetella pertussis
acccgccggccaucacgc

SEQ ID NO: 320179 - RNA, 18 nt, Bordetella pertussis
acccgccgggcggcgccg

SEQ ID NO: 320180 - RNA, 15 nt, Bordetella pertussis
acccgcggcccuugc

SEQ ID NO: 320181 - RNA, 23 nt, Bordetella pertussis
acccgcuaccccggcagcgucaa

SEQ ID NO: 320182 - RNA, 14 nt, Bordetella pertussis
acccgcuucgacgg

SEQ ID NO: 320183 - RNA, 15 nt, Bordetella pertussis
acccgcuucgacggc

SEQ ID NO: 320184 - RNA, 21 nt, Bordetella pertussis
acccgcuucgacggcuugcgc

SEQ ID NO: 320185 - RNA, 21 nt, Bordetella pertussis
acccggagcugccgaaucggc

SEQ ID NO: 320186 - RNA, 23 nt, Bordetella pertussis
acccggaugccgaacugucgcgc

SEQ ID NO: 320187 - RNA, 17 nt, Bordetella pertussis
acccggccggcgccggc

SEQ ID NO: 320188 - RNA, 19 nt, Bordetella pertussis
acccggccucgcugcgggc

SEQ ID NO: 320189 - RNA, 16 nt, Bordetella pertussis
acccggccugcgcgcc

SEQ ID NO: 320190 - RNA, 18 nt, Bordetella pertussis
acccggccugcgcgccgg

SEQ ID NO: 320191 - RNA, 22 nt, Bordetella pertussis
acccgucccugguccagcagcg

SEQ ID NO: 320192 - RNA, 23 nt, Bordetella pertussis
acccgucccugguccagcagcgu

SEQ ID NO: 320193 - RNA, 19 nt, Bordetella pertussis
acccguccuuggcguccgg

SEQ ID NO: 320194 - RNA, 14 nt, Bordetella pertussis
acccguuccagcau

SEQ ID NO: 320195 - RNA, 18 nt, Bordetella pertussis
acccugcaggccgggcag

SEQ ID NO: 320196 - RNA, 22 nt, Bordetella pertussis
acccugcaggccgggcaguccu

SEQ ID NO: 320197 - RNA, 16 nt, Bordetella pertussis
acccugcccggcaggg

SEQ ID NO: 320198 - RNA, 23 nt, Bordetella pertussis
acccugccgugggacaggcacuc

SEQ ID NO: 320199 - RNA, 16 nt, Bordetella pertussis
acccugcgcacccgcc

SEQ ID NO: 320200 - RNA, 18 nt, Bordetella pertussis
acccuggccgaacgccgc

SEQ ID NO: 320201 - RNA, 20 nt, Bordetella pertussis
acccuugcucagucgggcag

SEQ ID NO: 320202 - RNA, 13 nt, Bordetella pertussis
accgacacgcugg

SEQ ID NO: 320203 - RNA, 12 nt, Bordetella pertussis
accgacagcgcc

SEQ ID NO: 320204 - RNA, 16 nt, Bordetella pertussis
accgacaugaccgcgu

SEQ ID NO: 320205 - RNA, 17 nt, Bordetella pertussis
accgaccagcgcgcgcc

SEQ ID NO: 320206 - RNA, 19 nt, Bordetella pertussis
accgaccugaucgcgcagc

SEQ ID NO: 320207 - RNA, 21 nt, Bordetella pertussis
accgaccugaucgcgcagcgc

SEQ ID NO: 320208 - RNA, 23 nt, Bordetella pertussis
accgacgcagcgcaccgacggca

SEQ ID NO: 320209 - RNA, 22 nt, Bordetella pertussis
accgcaggcaagcugcuggcgc

SEQ ID NO: 320210 - RNA, 23 nt, Bordetella pertussis
accgcaggcaagcugcuggcgcg

SEQ ID NO: 320211 - RNA, 15 nt, Bordetella pertussis
accgcaugggccagg

SEQ ID NO: 320212 - RNA, 16 nt, Bordetella pertussis
accgccagcaggcgcu

SEQ ID NO: 320213 - RNA, 14 nt, Bordetella pertussis
accgccagcgcguc

SEQ ID NO: 320214 - RNA, 20 nt, Bordetella pertussis
accgccgauaccacgcgcgg

SEQ ID NO: 320215 - RNA, 16 nt, Bordetella pertussis
accgccgccacgcgca

SEQ ID NO: 320216 - RNA, 13 nt, Bordetella pertussis
accgccgccaguu

SEQ ID NO: 320217 - RNA, 20 nt, Bordetella pertussis
accgccgcguccucggccug

SEQ ID NO: 320218 - RNA, 21 nt, Bordetella pertussis
accgccgcguccucggccugg

SEQ ID NO: 320219 - RNA, 22 nt, Bordetella pertussis
accgccgcguccucggccuggc

SEQ ID NO: 320220 - RNA, 24 nt, Bordetella pertussis
accgccggcaccagcgccacgccc

SEQ ID NO: 320221 - RNA, 16 nt, Bordetella pertussis
accgccuccagcgcgg

SEQ ID NO: 320222 - RNA, 17 nt, Bordetella pertussis
accgccuccagcgcggc

SEQ ID NO: 320223 - RNA, 14 nt, Bordetella pertussis
accgccugcugcgc

SEQ ID NO: 320224 - RNA, 18 nt, Bordetella pertussis
accgccugcugcgccugg

SEQ ID NO: 320225 - RNA, 17 nt, Bordetella pertussis
accgccugugccagcug

SEQ ID NO: 320226 - RNA, 17 nt, Bordetella pertussis
accgcgaaccaggccug

SEQ ID NO: 320227 - RNA, 20 nt, Bordetella pertussis
accgcgaaccaggccugcgg

SEQ ID NO: 320228 - RNA, 23 nt, Bordetella pertussis
accgcgaacuuggccaugccaac

SEQ ID NO: 320229 - RNA, 15 nt, Bordetella pertussis
accgcgaagccgccc

SEQ ID NO: 320230 - RNA, 17 nt, Bordetella pertussis
accgcgaagcgcgccag

SEQ ID NO: 320231 - RNA, 23 nt, Bordetella pertussis
accgcgaccaugcggccgucgcc

SEQ ID NO: 320232 - RNA, 15 nt, Bordetella pertussis
accgcgaugcugcgc

SEQ ID NO: 320233 - RNA, 16 nt, Bordetella pertussis
accgcgaugcugcgca

SEQ ID NO: 320234 - RNA, 15 nt, Bordetella pertussis
accgcgccagcgccg

SEQ ID NO: 320235 - RNA, 21 nt, Bordetella pertussis
accgcgcccagggugguggcc

SEQ ID NO: 320236 - RNA, 12 nt, Bordetella pertussis
accgcgccaucu

SEQ ID NO: 320237 - RNA, 19 nt, Bordetella pertussis
accgcgcgcacgaccacca

SEQ ID NO: 320238 - RNA, 18 nt, Bordetella pertussis
accgcgccugggggcugg

SEQ ID NO: 320239 - RNA, 14 nt, Bordetella pertussis
accgcgcggcgcug

SEQ ID NO: 320240 - RNA, 17 nt, Bordetella pertussis
accgcgcguaucggcgc

SEQ ID NO: 320241 - RNA, 21 nt, Bordetella pertussis
accgcgcguaucggcgcgagc

SEQ ID NO: 320242 - RNA, 22 nt, Bordetella pertussis
accgcguugaccggcuggcgca

SEQ ID NO: 320243 - RNA, 19 nt, Bordetella pertussis
accgcguugagcgccgacg

SEQ ID NO: 320244 - RNA, 19 nt, Bordetella pertussis
accgcucagcccuugacgc

SEQ ID NO: 320245 - RNA, 14 nt, Bordetella pertussis
accgcucagcuugu

SEQ ID NO: 320246 - RNA, 15 nt, Bordetella pertussis
accgcucgucaugau

SEQ ID NO: 320247 - RNA, 23 nt, Bordetella pertussis
accgcuuccgccaccgcgccgcc

SEQ ID NO: 320248 - RNA, 17 nt, Bordetella pertussis
accgcuucggucagcug

SEQ ID NO: 320249 - RNA, 17 nt, Bordetella pertussis
accggaacaccagcaag

SEQ ID NO: 320250 - RNA, 19 nt, Bordetella pertussis
accggaacaccagcaagcc

SEQ ID NO: 320251 - RNA, 18 nt, Bordetella pertussis
accggauccugcggcgcg

SEQ ID NO: 320252 - RNA, 17 nt, Bordetella pertussis
accggcaccugggccuu

SEQ ID NO: 320253 - RNA, 23 nt, Bordetella pertussis
accggcaccuucuuccaggcgcc

SEQ ID NO: 320254 - RNA, 18 nt, Bordetella pertussis
accggcacgccggcggcg

SEQ ID NO: 320255 - RNA, 23 nt, Bordetella pertussis
accggcacgccggcggcgcuggc

SEQ ID NO: 320256 - RNA, 16 nt, Bordetella pertussis
accggcacgcgccagg

SEQ ID NO: 320257 - RNA, 22 nt, Bordetella pertussis
accggccuggucaugacgggcg

SEQ ID NO: 320258 - RNA, 14 nt, Bordetella pertussis
accggcgaccaccg

SEQ ID NO: 320259 - RNA, 18 nt, Bordetella pertussis
accggcgcgccuggcgcg

SEQ ID NO: 320260 - RNA, 19 nt, Bordetella pertussis
accggcgcgccuggcgcgc

SEQ ID NO: 320261 - RNA, 13 nt, Bordetella pertussis
accggcgcgcgcg

SEQ ID NO: 320262 - RNA, 11 nt, Bordetella pertussis
accggcgcggc

SEQ ID NO: 320263 - RNA, 23 nt, Bordetella pertussis
accggcggcaccauugccggcgc

SEQ ID NO: 320264 - RNA, 15 nt, Bordetella pertussis
accggcuacgaccug

SEQ ID NO: 320265 - RNA, 16 nt, Bordetella pertussis
accggcuauaccgggc

SEQ ID NO: 320266 - RNA, 15 nt, Bordetella pertussis
accggcucgaucgcc

SEQ ID NO: 320267 - RNA, 22 nt, Bordetella pertussis
accggcucgaucgccgccggca

SEQ ID NO: 320268 - RNA, 23 nt, Bordetella pertussis
accggcucgaucgccgccggcac

SEQ ID NO: 320269 - RNA, 14 nt, Bordetella pertussis
accggcucgggcuc

SEQ ID NO: 320270 - RNA, 16 nt, Bordetella pertussis
accggcugcaugcgcg

SEQ ID NO: 320271 - RNA, 21 nt, Bordetella pertussis
accgggcugaacauccugacc

SEQ ID NO: 320272 - RNA, 20 nt, Bordetella pertussis
accggggcguccaccgccga

SEQ ID NO: 320273 - RNA, 21 nt, Bordetella pertussis
accggggcguccaccgccgau

SEQ ID NO: 320274 - RNA, 14 nt, Bordetella pertussis
accgggucgggcgu

SEQ ID NO: 320275 - RNA, 14 nt, Bordetella pertussis
accggguugcccgg

SEQ ID NO: 320276 - RNA, 14 nt, Bordetella pertussis
accgguagcccgcg

SEQ ID NO: 320277 - RNA, 21 nt, Bordetella pertussis
accuaccaggccgacgaggcg

SEQ ID NO: 320278 - RNA, 16 nt, Bordetella pertussis
accuaccucagcaugg

SEQ ID NO: 320279 - RNA, 17 nt, Bordetella pertussis
accucagcauggcggga

SEQ ID NO: 320280 - RNA, 17 nt, Bordetella pertussis
accuccaccucgaacgc

SEQ ID NO: 320281 - RNA, 18 nt, Bordetella pertussis
accuccaguaucguuuuc

SEQ ID NO: 320282 - RNA, 14 nt, Bordetella pertussis
accucgacgcgcau

SEQ ID NO: 320283 - RNA, 17 nt, Bordetella pertussis
accucgaucaccaccgg

SEQ ID NO: 320284 - RNA, 19 nt, Bordetella pertussis
accucgaucaccaccggca

SEQ ID NO: 320285 - RNA, 18 nt, Bordetella pertussis
accucgcccaggccgggc

SEQ ID NO: 320286 - RNA, 22 nt, Bordetella pertussis
accucgcccaggccgggcgagc

SEQ ID NO: 320287 - RNA, 15 nt, Bordetella pertussis
accucgccgcgccag

SEQ ID NO: 320288 - RNA, 16 nt, Bordetella pertussis
accucgccgcgccagc

SEQ ID NO: 320289 - RNA, 21 nt, Bordetella pertussis
accucgcgccggucacgcugg

SEQ ID NO: 320290 - RNA, 14 nt, Bordetella pertussis
accucgcuugcccg

SEQ ID NO: 320291 - RNA, 20 nt, Bordetella pertussis
accucggcaccgaggccgag

SEQ ID NO: 320292 - RNA, 18 nt, Bordetella pertussis
accucggcgccgcggcgc

SEQ ID NO: 320293 - RNA, 13 nt, Bordetella pertussis
accucggcgucgc

SEQ ID NO: 320294 - RNA, 18 nt, Bordetella pertussis
accucggcguggcgggga

SEQ ID NO: 320295 - RNA, 20 nt, Bordetella pertussis
accugaauccguaagcgcug

SEQ ID NO: 320296 - RNA, 15 nt, Bordetella pertussis
accugacccugcgca

SEQ ID NO: 320297 - RNA, 16 nt, Bordetella pertussis
accugagccaggcgcc

SEQ ID NO: 320298 - RNA, 16 nt, Bordetella pertussis
accugaucgcgcagcg

SEQ ID NO: 320299 - RNA, 20 nt, Bordetella pertussis
accugaugccugucccgcac

SEQ ID NO: 320300 - RNA, 19 nt, Bordetella pertussis
accugcacgauggcgccgg

SEQ ID NO: 320301 - RNA, 20 nt, Bordetella pertussis
accugcacgauggcgccggc

SEQ ID NO: 320302 - RNA, 15 nt, Bordetella pertussis
accugcagcaggcgc

SEQ ID NO: 320303 - RNA, 16 nt, Bordetella pertussis
accugcagcaggcgca

SEQ ID NO: 320304 - RNA, 17 nt, Bordetella pertussis
accugcagcaggcgcac

SEQ ID NO: 320305 - RNA, 22 nt, Bordetella pertussis
accugcaggcccaccggcaugc

SEQ ID NO: 320306 - RNA, 19 nt, Bordetella pertussis
accugcaggccgccggcca

SEQ ID NO: 320307 - RNA, 20 nt, Bordetella pertussis
accugcagggucagcccgcc

SEQ ID NO: 320308 - RNA, 22 nt, Bordetella pertussis
accugcagggucagcccgccau

SEQ ID NO: 320309 - RNA, 23 nt, Bordetella pertussis
accugcagggucagcccgccauc

SEQ ID NO: 320310 - RNA, 22 nt, Bordetella pertussis
accugccgacuucuggggugcc

SEQ ID NO: 320311 - RNA, 19 nt, Bordetella pertussis
accugcgcaccggccggcc

SEQ ID NO: 320312 - RNA, 15 nt, Bordetella pertussis
accugcgcaugcgcc

SEQ ID NO: 320313 - RNA, 17 nt, Bordetella pertussis
accugcgcgaccgccgc

SEQ ID NO: 320314 - RNA, 13 nt, Bordetella pertussis
accugcgggccgc

SEQ ID NO: 320315 - RNA, 15 nt, Bordetella pertussis
accugcgucugcacg

SEQ ID NO: 320316 - RNA, 18 nt, Bordetella pertussis
accugcgucugcacgcug

SEQ ID NO: 320317 - RNA, 22 nt, Bordetella pertussis
accugcgucugcgugccggagc

SEQ ID NO: 320318 - RNA, 15 nt, Bordetella pertussis
accugcugcggcacg

SEQ ID NO: 320319 - RNA, 16 nt, Bordetella pertussis
accugcuggcgcgcac

SEQ ID NO: 320320 - RNA, 19 nt, Bordetella pertussis
accugcuggcgcgcaccau

SEQ ID NO: 320321 - RNA, 22 nt, Bordetella pertussis
accugcuggcguuugcgcgcgc

SEQ ID NO: 320322 - RNA, 18 nt, Bordetella pertussis
accugcuugagcaccacg

SEQ ID NO: 320323 - RNA, 13 nt, Bordetella pertussis
accuggacccgcu

SEQ ID NO: 320324 - RNA, 17 nt, Bordetella pertussis
accuggacgagggccgc

SEQ ID NO: 320325 - RNA, 22 nt, Bordetella pertussis
accuggacgagggccgcggcga

SEQ ID NO: 320326 - RNA, 12 nt, Bordetella pertussis
accuggcccggc

SEQ ID NO: 320327 - RNA, 22 nt, Bordetella pertussis
accuggcgaucgucaccaucgc

SEQ ID NO: 320328 - RNA, 18 nt, Bordetella pertussis
accuggcgcaaggcgucg

SEQ ID NO: 320329 - RNA, 19 nt, Bordetella pertussis
accuggcgcccggcggcgc

SEQ ID NO: 320330 - RNA, 16 nt, Bordetella pertussis
accuggcggugcgccg

SEQ ID NO: 320331 - RNA, 18 nt, Bordetella pertussis
accugggaggggccggcu

SEQ ID NO: 320332 - RNA, 20 nt, Bordetella pertussis
accugggcaucaacacgcug

SEQ ID NO: 320333 - RNA, 22 nt, Bordetella pertussis
accuggggguucgugggcgagc

SEQ ID NO: 320334 - RNA, 15 nt, Bordetella pertussis
accugguacggcauc

SEQ ID NO: 320335 - RNA, 16 nt, Bordetella pertussis
accugguauccggcgc

SEQ ID NO: 320336 - RNA, 17 nt, Bordetella pertussis
accuggucaagggcggc

SEQ ID NO: 320337 - RNA, 19 nt, Bordetella pertussis
accuggucgaucagccccu

SEQ ID NO: 320338 - RNA, 14 nt, Bordetella pertussis
accuguggcgcacc

SEQ ID NO: 320339 - RNA, 23 nt, Bordetella pertussis
accuugccgauccagcgccuggg

SEQ ID NO: 320340 - RNA, 15 nt, Bordetella pertussis
accuugcggccgcgc

SEQ ID NO: 320341 - RNA, 18 nt, Bordetella pertussis
accuugcuggaccgcgcc

SEQ ID NO: 320342 - RNA, 20 nt, Bordetella pertussis
accuuguugcgguggugcgc

SEQ ID NO: 320343 - RNA, 20 nt, Bordetella pertussis
acgaagguuucguagccgcc

SEQ ID NO: 320344 - RNA, 17 nt, Bordetella pertussis
acgaauccccgcucagg

SEQ ID NO: 320345 - RNA, 17 nt, Bordetella pertussis
acgaauuccucgccgcc

SEQ ID NO: 320346 - RNA, 18 nt, Bordetella pertussis
acgaccagcacgagaugu

SEQ ID NO: 320347 - RNA, 17 nt, Bordetella pertussis
acgaccagcaggcccac

SEQ ID NO: 320348 - RNA, 17 nt, Bordetella pertussis
acgaccccgccgugccg

SEQ ID NO: 320349 - RNA, 13 nt, Bordetella pertussis
acgacccgcugaa

SEQ ID NO: 320350 - RNA, 19 nt, Bordetella pertussis
acgacccgcugaaggaccu

SEQ ID NO: 320351 - RNA, 20 nt, Bordetella pertussis
acgaccgaaccgauccagcc

SEQ ID NO: 320352 - RNA, 14 nt, Bordetella pertussis
acgaccugcgcaug

SEQ ID NO: 320353 - RNA, 19 nt, Bordetella pertussis
acgaccugcgcaugcgccu

SEQ ID NO: 320354 - RNA, 15 nt, Bordetella pertussis
acgaccuugcggccg

SEQ ID NO: 320355 - RNA, 18 nt, Bordetella pertussis
acgaccuugcggccgcgc

SEQ ID NO: 320356 - RNA, 12 nt, Bordetella pertussis
acgaccuugcug

SEQ ID NO: 320357 - RNA, 15 nt, Bordetella pertussis
acgaccuuggcggcc

SEQ ID NO: 320358 - RNA, 16 nt, Bordetella pertussis
acgaccuuggcggccg

SEQ ID NO: 320359 - RNA, 15 nt, Bordetella pertussis
acgacgacggccggc

SEQ ID NO: 320360 - RNA, 20 nt, Bordetella pertussis
acgacgcagcgugcgacgca

SEQ ID NO: 320361 - RNA, 14 nt, Bordetella pertussis
acgacgcaggcgcc

SEQ ID NO: 320362 - RNA, 16 nt, Bordetella pertussis
acgacgcaggcgccgc

SEQ ID NO: 320363 - RNA, 17 nt, Bordetella pertussis
acgacgcaggcgccgca

SEQ ID NO: 320364 - RNA, 22 nt, Bordetella pertussis
acgacgccggcuuucagcgccg

SEQ ID NO: 320365 - RNA, 14 nt, Bordetella pertussis
acgacgcggcaugc

SEQ ID NO: 320366 - RNA, 21 nt, Bordetella pertussis
acgacucgucgaccaccagca

SEQ ID NO: 320367 - RNA, 22 nt, Bordetella pertussis
acgagcggcggcuucgcgcagc

SEQ ID NO: 320368 - RNA, 22 nt, Bordetella pertussis
acgagcgggugaugcugcagcg

SEQ ID NO: 320369 - RNA, 14 nt, Bordetella pertussis
acgaucuaggccgu

SEQ ID NO: 320370 - RNA, 20 nt, Bordetella pertussis
acgaucuccacccccgggcg

SEQ ID NO: 320371 - RNA, 21 nt, Bordetella pertussis
acgaucuggcgcgcgaccagg

SEQ ID NO: 320372 - RNA, 22 nt, Bordetella pertussis
acgaucuggcgcgcgaccaggc

SEQ ID NO: 320373 - RNA, 13 nt, Bordetella pertussis
acgauggcgccgg

SEQ ID NO: 320374 - RNA, 15 nt, Bordetella pertussis
acgauggcgccggcu

SEQ ID NO: 320375 - RNA, 12 nt, Bordetella pertussis
acgauggcgcgc

SEQ ID NO: 320376 - RNA, 15 nt, Bordetella pertussis
acgauggggccgucg

SEQ ID NO: 320377 - RNA, 13 nt, Bordetella pertussis
acgaugucggcgc

SEQ ID NO: 320378 - RNA, 15 nt, Bordetella pertussis
acgaugucggcgcaa

SEQ ID NO: 320379 - RNA, 18 nt, Bordetella pertussis
acgauguugccgccggcc

SEQ ID NO: 320380 - RNA, 14 nt, Bordetella pertussis
acgaugucgccgcc

SEQ ID NO: 320381 - RNA, 22 nt, Bordetella pertussis
acgauuccgccuacuggcgcgc

SEQ ID NO: 320382 - RNA, 12 nt, Bordetella pertussis
acgcaaggccga

SEQ ID NO: 320383 - RNA, 23 nt, Bordetella pertussis
acgcaagggccccccggcgcggc

SEQ ID NO: 320384 - RNA, 19 nt, Bordetella pertussis
acgcaauugcgugguggcc

SEQ ID NO: 320385 - RNA, 17 nt, Bordetella pertussis
acgcacaagggccccgc

SEQ ID NO: 320386 - RNA, 23 nt, Bordetella pertussis
acgcacaugaugcccagcgccag

SEQ ID NO: 320387 - RNA, 15 nt, Bordetella pertussis
acgcaccaggcgcac

SEQ ID NO: 320388 - RNA, 15 nt, Bordetella pertussis
acgcagaccacgccg

SEQ ID NO: 320389 - RNA, 21 nt, Bordetella pertussis
acgcagcaacggugagccggc

SEQ ID NO: 320390 - RNA, 18 nt, Bordetella pertussis
acgcagcacggcuugcgc

SEQ ID NO: 320391 - RNA, 20 nt, Bordetella pertussis
acgcagcacggcuugcgcgc

SEQ ID NO: 320392 - RNA, 19 nt, Bordetella pertussis
acgcagccuucguccugcc

SEQ ID NO: 320393 - RNA, 15 nt, Bordetella pertussis
acgcagcgcaggauu

SEQ ID NO: 320394 - RNA, 23 nt, Bordetella pertussis
acgcauagguaucggcccgcgcc

SEQ ID NO: 320395 - RNA, 18 nt, Bordetella pertussis
acgcauauccaggcggcg

SEQ ID NO: 320396 - RNA, 16 nt, Bordetella pertussis
acgccaagcugcuggc

SEQ ID NO: 320397 - RNA, 17 nt, Bordetella pertussis
acgccaagcugcuggcc

SEQ ID NO: 320398 - RNA, 16 nt, Bordetella pertussis
acgccaccagugcgcc

SEQ ID NO: 320399 - RNA, 19 nt, Bordetella pertussis
acgccaccagugcgccggc

SEQ ID NO: 320400 - RNA, 20 nt, Bordetella pertussis
acgccaccagugcgccggcg

SEQ ID NO: 320401 - RNA, 12 nt, Bordetella pertussis
acgccagcgcgc

SEQ ID NO: 320402 - RNA, 19 nt, Bordetella pertussis
acgccauggcggcggccac

SEQ ID NO: 320403 - RNA, 16 nt, Bordetella pertussis
acgcccacgcgccgcc

SEQ ID NO: 320404 - RNA, 18 nt, Bordetella pertussis
acgcccacgcgccgccag

SEQ ID NO: 320405 - RNA, 12 nt, Bordetella pertussis
acgcccacgcuc

SEQ ID NO: 320406 - RNA, 15 nt, Bordetella pertussis
acgcccagccugccg

SEQ ID NO: 320407 - RNA, 22 nt, Bordetella pertussis
acgcccagccugccggcggccu

SEQ ID NO: 320408 - RNA, 15 nt, Bordetella pertussis
acgcccgagauggcg

SEQ ID NO: 320409 - RNA, 23 nt, Bordetella pertussis
acgcccgagauggcgcaggcgcg

SEQ ID NO: 320410 - RNA, 14 nt, Bordetella pertussis
acgcccgccagcag

SEQ ID NO: 320411 - RNA, 16 nt, Bordetella pertussis
acgcccgccagcagcu

SEQ ID NO: 320412 - RNA, 11 nt, Bordetella pertussis
acgcccgccuu

SEQ ID NO: 320413 - RNA, 13 nt, Bordetella pertussis
acgcccgcgccca

SEQ ID NO: 320414 - RNA, 15 nt, Bordetella pertussis
acgcccgcggcgccc

SEQ ID NO: 320415 - RNA, 17 nt, Bordetella pertussis
acgcccgcggcgcccag

SEQ ID NO: 320416 - RNA, 20 nt, Bordetella pertussis
acgcccgcggcgcccagcug

SEQ ID NO: 320417 - RNA, 19 nt, Bordetella pertussis
acgccgaacugcuugcgcg

SEQ ID NO: 320418 - RNA, 20 nt, Bordetella pertussis
acgccgaauugcuggagcgc

SEQ ID NO: 320419 - RNA, 21 nt, Bordetella pertussis
acgccgaauugcuggagcgcc

SEQ ID NO: 320420 - RNA, 17 nt, Bordetella pertussis
acgccgacgaugccggu

SEQ ID NO: 320421 - RNA, 20 nt, Bordetella pertussis
acgccgacugggugcgccug

SEQ ID NO: 320422 - RNA, 21 nt, Bordetella pertussis
acgccgacugggugcgccuga

SEQ ID NO: 320423 - RNA, 13 nt, Bordetella pertussis
acgccgauggcgc

SEQ ID NO: 320424 - RNA, 21 nt, Bordetella pertussis
acgccgauugaggccagcacg

SEQ ID NO: 320425 - RNA, 14 nt, Bordetella pertussis
acgccgccacgcug

SEQ ID NO: 320426 - RNA, 17 nt, Bordetella pertussis
acgccgccacgcuggcc

SEQ ID NO: 320427 - RNA, 18 nt, Bordetella pertussis
acgccgccacgcuggccg

SEQ ID NO: 320428 - RNA, 22 nt, Bordetella pertussis
acgccgcccguccgggcggcgu

SEQ ID NO: 320429 - RNA, 23 nt, Bordetella pertussis
acgccgcccguccgggcggcguu

SEQ ID NO: 320430 - RNA, 12 nt, Bordetella pertussis
acgccgccaugg

SEQ ID NO: 320431 - RNA, 18 nt, Bordetella pertussis
acgccgccgauggcgcca

SEQ ID NO: 320432 - RNA, 17 nt, Bordetella pertussis
acgccgccgcagccgcc

SEQ ID NO: 320433 - RNA, 19 nt, Bordetella pertussis
acgccgccgcagccgccag

SEQ ID NO: 320434 - RNA, 22 nt, Bordetella pertussis
acgccgccgcagccgccagcgc

SEQ ID NO: 320435 - RNA, 13 nt, Bordetella pertussis
acgccgccgaacg

SEQ ID NO: 320436 - RNA, 23 nt, Bordetella pertussis
acgccgccgaccucgucgggcug

SEQ ID NO: 320437 - RNA, 15 nt, Bordetella pertussis
acgccgccgccguau

SEQ ID NO: 320438 - RNA, 14 nt, Bordetella pertussis
acgccgcguccgcc

SEQ ID NO: 320439 - RNA, 18 nt, Bordetella pertussis
acgccgcgucgcuggccg

SEQ ID NO: 320440 - RNA, 17 nt, Bordetella pertussis
acgccgcugauggcggu

SEQ ID NO: 320441 - RNA, 18 nt, Bordetella pertussis
acgccgcugauggcgguc

SEQ ID NO: 320442 - RNA, 17 nt, Bordetella pertussis
acgccgcugucgaccuc

SEQ ID NO: 320443 - RNA, 18 nt, Bordetella pertussis
acgccggccacgaacggc

SEQ ID NO: 320444 - RNA, 17 nt, Bordetella pertussis
acgccggccauggcggc

SEQ ID NO: 320445 - RNA, 12 nt, Bordetella pertussis
acgccggccgcc

SEQ ID NO: 320446 - RNA, 15 nt, Bordetella pertussis
acgccggccgccaug

SEQ ID NO: 320447 - RNA, 21 nt, Bordetella pertussis
acgccggccgccauggccggc

SEQ ID NO: 320448 - RNA, 17 nt, Bordetella pertussis
acgccggccugacgcgc

SEQ ID NO: 320449 - RNA, 14 nt, Bordetella pertussis
acgccggccugcgc

SEQ ID NO: 320450 - RNA, 17 nt, Bordetella pertussis
acgccggccugcgccag

SEQ ID NO: 320451 - RNA, 20 nt, Bordetella pertussis
acgccggccugcgccagcuc

SEQ ID NO: 320452 - RNA, 18 nt, Bordetella pertussis
acgccggccuugcugaac

SEQ ID NO: 320453 - RNA, 16 nt, Bordetella pertussis
acgccggcgaaugccg

SEQ ID NO: 320454 - RNA, 12 nt, Bordetella pertussis
acgccggccggg

SEQ ID NO: 320455 - RNA, 14 nt, Bordetella pertussis
acgccuggccgcgc

SEQ ID NO: 320456 - RNA, 15 nt, Bordetella pertussis
acgccuggccgcgcu

SEQ ID NO: 320457 - RNA, 14 nt, Bordetella pertussis
acgccuggcgcggc

SEQ ID NO: 320458 - RNA, 13 nt, Bordetella pertussis
acgccuuccggcc

SEQ ID NO: 320459 - RNA, 17 nt, Bordetella pertussis
acgccuuccggccccau

SEQ ID NO: 320460 - RNA, 20 nt, Bordetella pertussis
acgccuucggcgacuucggc

SEQ ID NO: 320461 - RNA, 14 nt, Bordetella pertussis
acgccuucggcgcg

SEQ ID NO: 320462 - RNA, 18 nt, Bordetella pertussis
acgccuucggcgcgcgcc

SEQ ID NO: 320463 - RNA, 21 nt, Bordetella pertussis
acgccuucggcgcgcgccggc

SEQ ID NO: 320464 - RNA, 22 nt, Bordetella pertussis
acgccuugcccgggcuggccgc

SEQ ID NO: 320465 - RNA, 23 nt, Bordetella pertussis
acgcgaugcccgcgcaccaggcg

SEQ ID NO: 320466 - RNA, 18 nt, Bordetella pertussis
acgcgauguccagcucca

SEQ ID NO: 320467 - RNA, 14 nt, Bordetella pertussis
acgcgcaacauggu

SEQ ID NO: 320468 - RNA, 14 nt, Bordetella pertussis
acgcgcaacgccgc

SEQ ID NO: 320469 - RNA, 14 nt, Bordetella pertussis
acgcgcaaggcggg

SEQ ID NO: 320470 - RNA, 13 nt, Bordetella pertussis
acgcgcaccaggc

SEQ ID NO: 320471 - RNA, 19 nt, Bordetella pertussis
acgcgcagcuugcccgcgc

SEQ ID NO: 320472 - RNA, 23 nt, Bordetella pertussis
acgcgcagcuugcccgcgcgcac

SEQ ID NO: 320473 - RNA, 17 nt, Bordetella pertussis
acgcgcauuucgaccug

SEQ ID NO: 320474 - RNA, 20 nt, Bordetella pertussis
acgcgcauuucgaccugcgc

SEQ ID NO: 320475 - RNA, 12 nt, Bordetella pertussis
acgcgccaggcg

SEQ ID NO: 320476 - RNA, 12 nt, Bordetella pertussis
acgcgccgaaca

SEQ ID NO: 320477 - RNA, 16 nt, Bordetella pertussis
acgcgccgaacaccag

SEQ ID NO: 320478 - RNA, 13 nt, Bordetella pertussis
acgcgccgccagg

SEQ ID NO: 320479 - RNA, 17 nt, Bordetella pertussis
acgcgccgccaggcgcg

SEQ ID NO: 320480 - RNA, 13 nt, Bordetella pertussis
acgcgccgccugg

SEQ ID NO: 320481 - RNA, 14 nt, Bordetella pertussis
acgcgccgccuggc

SEQ ID NO: 320482 - RNA, 13 nt, Bordetella pertussis
acgcgccggaugc

SEQ ID NO: 320483 - RNA, 12 nt, Bordetella pertussis
acgcgcgcuccu

SEQ ID NO: 320484 - RNA, 14 nt, Bordetella pertussis
acgcgcgcuggcgc

SEQ ID NO: 320485 - RNA, 23 nt, Bordetella pertussis
acgcgcgcuggcgcccggccugc

SEQ ID NO: 320486 - RNA, 17 nt, Bordetella pertussis
acgcgcggaucggccac

SEQ ID NO: 320487 - RNA, 21 nt, Bordetella pertussis
acgcgcggaucggccacgaug

SEQ ID NO: 320488 - RNA, 14 nt, Bordetella pertussis
acgcgcggcggcgg

SEQ ID NO: 320489 - RNA, 23 nt, Bordetella pertussis
acgcgcucaggcggugacgcccu

SEQ ID NO: 320490 - RNA, 14 nt, Bordetella pertussis
acgcgcucgccguc

SEQ ID NO: 320491 - RNA, 15 nt, Bordetella pertussis
acgcgcucgccgucg

SEQ ID NO: 320492 - RNA, 18 nt, Bordetella pertussis
acgcgcucgcgcgcgugc

SEQ ID NO: 320493 - RNA, 22 nt, Bordetella pertussis
acgcggaggagguggcuggugc

SEQ ID NO: 320494 - RNA, 11 nt, Bordetella pertussis
acgcggccagc

SEQ ID NO: 320495 - RNA, 17 nt, Bordetella pertussis
acgcggccagcggcgcu

SEQ ID NO: 320496 - RNA, 18 nt, Bordetella pertussis
acgcggccgcgggccgcu

SEQ ID NO: 320497 - RNA, 19 nt, Bordetella pertussis
acgcggccgcgggccgcug

SEQ ID NO: 320498 - RNA, 16 nt, Bordetella pertussis
acgcggccguggcggc

SEQ ID NO: 320499 - RNA, 20 nt, Bordetella pertussis
acgcggccguggcggccugc

SEQ ID NO: 320500 - RNA, 22 nt, Bordetella pertussis
acgcugcugauccucgccagcg

SEQ ID NO: 320501 - RNA, 13 nt, Bordetella pertussis
acgcuggagcgcg

SEQ ID NO: 320502 - RNA, 16 nt, Bordetella pertussis
acgcuggcaucgucgc

SEQ ID NO: 320503 - RNA, 13 nt, Bordetella pertussis
acgcuggccgcgc

SEQ ID NO: 320504 - RNA, 18 nt, Bordetella pertussis
acgcuggccgcgcccgcc

SEQ ID NO: 320505 - RNA, 11 nt, Bordetella pertussis
acgcuggcgcg

SEQ ID NO: 320506 - RNA, 17 nt, Bordetella pertussis
acgcuggcuaucgccuc

SEQ ID NO: 320507 - RNA, 18 nt, Bordetella pertussis
acgcuggcuaucgccucg

SEQ ID NO: 320508 - RNA, 20 nt, Bordetella pertussis
acgcuggcuucgucgccggc

SEQ ID NO: 320509 - RNA, 18 nt, Bordetella pertussis
acgcuguuuucggccgac

SEQ ID NO: 320510 - RNA, 14 nt, Bordetella pertussis
acgcuuaucgcggc

SEQ ID NO: 320511 - RNA, 21 nt, Bordetella pertussis
acgcuuccugggccugcggcg

SEQ ID NO: 320512 - RNA, 20 nt, Bordetella pertussis
acggaugccgucuuggcggg

SEQ ID NO: 320513 - RNA, 17 nt, Bordetella pertussis
acggauugccgccgcgc

SEQ ID NO: 320514 - RNA, 21 nt, Bordetella pertussis
acggauugccgccgcgcagcc

SEQ ID NO: 320515 - RNA, 13 nt, Bordetella pertussis
acggauugcugau

SEQ ID NO: 320516 - RNA, 14 nt, Bordetella pertussis
acggcacgccucgc

SEQ ID NO: 320517 - RNA, 21 nt, Bordetella pertussis
acggcagaugaucuacgcgcg

SEQ ID NO: 320518 - RNA, 13 nt, Bordetella pertussis
acggcagcgcgcg

SEQ ID NO: 320519 - RNA, 23 nt, Bordetella pertussis
acggcaguaugacugaccacucg

SEQ ID NO: 320520 - RNA, 14 nt, Bordetella pertussis
acggcaucccgaca

SEQ ID NO: 320521 - RNA, 15 nt, Bordetella pertussis
acggcaucggccagc

SEQ ID NO: 320522 - RNA, 18 nt, Bordetella pertussis
acggcaucggcgccgcgc

SEQ ID NO: 320523 - RNA, 19 nt, Bordetella pertussis
acggcauggcggccagcuu

SEQ ID NO: 320524 - RNA, 16 nt, Bordetella pertussis
acggcauggccagcuu

SEQ ID NO: 320525 - RNA, 20 nt, Bordetella pertussis
acggccaacccucgcacggc

SEQ ID NO: 320526 - RNA, 16 nt, Bordetella pertussis
acggccaagcagcgcc

SEQ ID NO: 320527 - RNA, 19 nt, Bordetella pertussis
acggccaagcagcgccugc

SEQ ID NO: 320528 - RNA, 22 nt, Bordetella pertussis
acggccaagcagcgccugccgc

SEQ ID NO: 320529 - RNA, 19 nt, Bordetella pertussis
acggccacgcagcgcgugu

SEQ ID NO: 320530 - RNA, 15 nt, Bordetella pertussis
acggccacggccggc

SEQ ID NO: 320531 - RNA, 13 nt, Bordetella pertussis
acggccacgucgg

SEQ ID NO: 320532 - RNA, 14 nt, Bordetella pertussis
acggccagcaccau

SEQ ID NO: 320533 - RNA, 15 nt, Bordetella pertussis
acggccagcagcacg

SEQ ID NO: 320534 - RNA, 23 nt, Bordetella pertussis
acggccagcagcacgaucgcggc

SEQ ID NO: 320535 - RNA, 22 nt, Bordetella pertussis
acggccagcaggagcccgcugc

SEQ ID NO: 320536 - RNA, 14 nt, Bordetella pertussis
acggccagcagcac

SEQ ID NO: 320537 - RNA, 14 nt, Bordetella pertussis
acggccagcgcgac

SEQ ID NO: 320538 - RNA, 14 nt, Bordetella pertussis
acggccagcgcgcg

SEQ ID NO: 320539 - RNA, 13 nt, Bordetella pertussis
acggccagcggcg

SEQ ID NO: 320540 - RNA, 14 nt, Bordetella pertussis
acggccauccggcc

SEQ ID NO: 320541 - RNA, 13 nt, Bordetella pertussis
acggcccacgcug

SEQ ID NO: 320542 - RNA, 13 nt, Bordetella pertussis
acggcccauccau

SEQ ID NO: 320543 - RNA, 13 nt, Bordetella pertussis
acggccccagcgc

SEQ ID NO: 320544 - RNA, 23 nt, Bordetella pertussis
acggcccgccaggaagcgggccu

SEQ ID NO: 320545 - RNA, 17 nt, Bordetella pertussis
acggccgcccggcaugg

SEQ ID NO: 320546 - RNA, 15 nt, Bordetella pertussis
acggccgcggccggc

SEQ ID NO: 320547 - RNA, 13 nt, Bordetella pertussis
acggccgccaccu

SEQ ID NO: 320548 - RNA, 15 nt, Bordetella pertussis
acggccgccacgccc

SEQ ID NO: 320549 - RNA, 13 nt, Bordetella pertussis
acggccggccagg

SEQ ID NO: 320550 - RNA, 17 nt, Bordetella pertussis
acggccggccaggcgcc

SEQ ID NO: 320551 - RNA, 13 nt, Bordetella pertussis
acggccggcgcac

SEQ ID NO: 320552 - RNA, 22 nt, Bordetella pertussis
acggccgggucccuggcccugg

SEQ ID NO: 320553 - RNA, 14 nt, Bordetella pertussis
acggccggucagcc

SEQ ID NO: 320554 - RNA, 15 nt, Bordetella pertussis
acggccggucagccc

SEQ ID NO: 320555 - RNA, 19 nt, Bordetella pertussis
acggccggucagcccaggc

SEQ ID NO: 320556 - RNA, 18 nt, Bordetella pertussis
acggccuccgcgccgacc

SEQ ID NO: 320557 - RNA, 13 nt, Bordetella pertussis
acggccuguccgg

SEQ ID NO: 320558 - RNA, 15 nt, Bordetella pertussis
acggccuucggcggc

SEQ ID NO: 320559 - RNA, 18 nt, Bordetella pertussis
acggccuugucgcgcccg

SEQ ID NO: 320560 - RNA, 17 nt, Bordetella pertussis
acggcgacuuccagcag

SEQ ID NO: 320561 - RNA, 19 nt, Bordetella pertussis
acggcgacuuccagcagau

SEQ ID NO: 320562 - RNA, 20 nt, Bordetella pertussis
acggcgacuuccagcagauu

SEQ ID NO: 320563 - RNA, 18 nt, Bordetella pertussis
acggcgaggaugccgcgc

SEQ ID NO: 320564 - RNA, 14 nt, Bordetella pertussis
acggcgaugccggc

SEQ ID NO: 320565 - RNA, 15 nt, Bordetella pertussis
acggcgaugccggcg

SEQ ID NO: 320566 - RNA, 16 nt, Bordetella pertussis
acggcgaugccggcgc

SEQ ID NO: 320567 - RNA, 21 nt, Bordetella pertussis
acggcgaugaacagcggcacg

SEQ ID NO: 320568 - RNA, 18 nt, Bordetella pertussis
acggcgaugcugccgucg

SEQ ID NO: 320569 - RNA, 17 nt, Bordetella pertussis
acggcgcacccgcggcg

SEQ ID NO: 320570 - RNA, 19 nt, Bordetella pertussis
acggcgcacaccaucagcu

SEQ ID NO: 320571 - RNA, 15 nt, Bordetella pertussis
acggcgccaaagcac

SEQ ID NO: 320572 - RNA, 12 nt, Bordetella pertussis
acggcgccaugc

SEQ ID NO: 320573 - RNA, 21 nt, Bordetella pertussis
acggcgcccugcagggcaugg

SEQ ID NO: 320574 - RNA, 15 nt, Bordetella pertussis
acggcgccgauccgg

SEQ ID NO: 320575 - RNA, 15 nt, Bordetella pertussis
acggcgccuugacgc

SEQ ID NO: 320576 - RNA, 16 nt, Bordetella pertussis
acggcgcgaaggugcg

SEQ ID NO: 320577 - RNA, 18 nt, Bordetella pertussis
acggcgcgcccgcaggcg

SEQ ID NO: 320578 - RNA, 22 nt, Bordetella pertussis
acggcgcgcccgcaggcggcgg

SEQ ID NO: 320579 - RNA, 21 nt, Bordetella pertussis
acggcgcgcccgccgcgucgg

SEQ ID NO: 320580 - RNA, 17 nt, Bordetella pertussis
acggcgcgcgccugcuc

SEQ ID NO: 320581 - RNA, 16 nt, Bordetella pertussis
acggcgcggaucgugc

SEQ ID NO: 320582 - RNA, 23 nt, Bordetella pertussis
acggcgcggaugccguccacgcc

SEQ ID NO: 320583 - RNA, 24 nt, Bordetella pertussis
acggcgcgggcacucggccauggu

SEQ ID NO: 320584 - RNA, 18 nt, Bordetella pertussis
acggcgcgggcggucggc

SEQ ID NO: 320585 - RNA, 13 nt, Bordetella pertussis
acggcgcggugcc

SEQ ID NO: 320586 - RNA, 18 nt, Bordetella pertussis
acggcgcggugccugugc

SEQ ID NO: 320587 - RNA, 17 nt, Bordetella pertussis
acggcgcucuugguggu

SEQ ID NO: 320588 - RNA, 23 nt, Bordetella pertussis
acggcgcucuugguggugccugc

SEQ ID NO: 320589 - RNA, 21 nt, Bordetella pertussis
acggcgcuggggaagcgcucg

SEQ ID NO: 320590 - RNA, 19 nt, Bordetella pertussis
acggcggaaugcggcgaca

SEQ ID NO: 320591 - RNA, 18 nt, Bordetella pertussis
acggcggacuggccgcgc

SEQ ID NO: 320592 - RNA, 17 nt, Bordetella pertussis
acggcggaucuucccgc

SEQ ID NO: 320593 - RNA, 20 nt, Bordetella pertussis
acggcggcaggccgcgccac

SEQ ID NO: 320594 - RNA, 21 nt, Bordetella pertussis
acggcggcgaucacgccgucg

SEQ ID NO: 320595 - RNA, 15 nt, Bordetella pertussis
acggcggcgcgcgga

SEQ ID NO: 320596 - RNA, 16 nt, Bordetella pertussis
acggcggcuucggccg

SEQ ID NO: 320597 - RNA, 18 nt, Bordetella pertussis
acggcgggaucgggcagc

SEQ ID NO: 320598 - RNA, 17 nt, Bordetella pertussis
acggcgggccggcucgg

SEQ ID NO: 320599 - RNA, 23 nt, Bordetella pertussis
acggcgggcgccccgaucggcgc

SEQ ID NO: 320600 - RNA, 13 nt, Bordetella pertussis
acggcgggcgcgc

SEQ ID NO: 320601 - RNA, 18 nt, Bordetella pertussis
acggcgggcgcgcaggcc

SEQ ID NO: 320602 - RNA, 15 nt, Bordetella pertussis
acggcuucgcccagc

SEQ ID NO: 320603 - RNA, 19 nt, Bordetella pertussis
acggcuugaccacggccag

SEQ ID NO: 320604 - RNA, 20 nt, Bordetella pertussis
acggcuugaccacggccagc

SEQ ID NO: 320605 - RNA, 20 nt, Bordetella pertussis
acggcuugcgcauacgcggg

SEQ ID NO: 320606 - RNA, 17 nt, Bordetella pertussis
acggcuugcgcgccugc

SEQ ID NO: 320607 - RNA, 20 nt, Bordetella pertussis
acggcuugcgcguaggcgcg

SEQ ID NO: 320608 - RNA, 16 nt, Bordetella pertussis
acggcuuggcgugcgc

SEQ ID NO: 320609 - RNA, 19 nt, Bordetella pertussis
acggcuuggggggcgcggu

SEQ ID NO: 320610 - RNA, 15 nt, Bordetella pertussis
acgggaaugaagcgc

SEQ ID NO: 320611 - RNA, 19 nt, Bordetella pertussis
acgggccgaugaagacgcc

SEQ ID NO: 320612 - RNA, 24 nt, Bordetella pertussis
acgggccgaugaagacgccgucga

SEQ ID NO: 320613 - RNA, 23 nt, Bordetella pertussis
acgggccgcaagcaagccccagg

SEQ ID NO: 320614 - RNA, 16 nt, Bordetella pertussis
acgggccucgauggug

SEQ ID NO: 320615 - RNA, 19 nt, Bordetella pertussis
acgggcgccagcagcgggc

SEQ ID NO: 320616 - RNA, 16 nt, Bordetella pertussis
acgggcgcugcccagg

SEQ ID NO: 320617 - RNA, 21 nt, Bordetella pertussis
acgggcggcggcgcgcgcgcc

SEQ ID NO: 320618 - RNA, 17 nt, Bordetella pertussis
acgggcgucaccggcga

SEQ ID NO: 320619 - RNA, 13 nt, Bordetella pertussis
acgguaggcgcgu

SEQ ID NO: 320620 - RNA, 17 nt, Bordetella pertussis
acgguaucugucccggc

SEQ ID NO: 320621 - RNA, 14 nt, Bordetella pertussis
acgguauugcacgg

SEQ ID NO: 320622 - RNA, 22 nt, Bordetella pertussis
acgguauugcacggugccgcgc

SEQ ID NO: 320623 - RNA, 21 nt, Bordetella pertussis
acggucgcgagcugcgcgacc

SEQ ID NO: 320624 - RNA, 14 nt, Bordetella pertussis
acggucaccgcgcc

SEQ ID NO: 320625 - RNA, 14 nt, Bordetella pertussis
acggucggcgcgua

SEQ ID NO: 320626 - RNA, 20 nt, Bordetella pertussis
acggucuggcccacgcgcac

SEQ ID NO: 320627 - RNA, 13 nt, Bordetella pertussis
acguagccggcca

SEQ ID NO: 320628 - RNA, 14 nt, Bordetella pertussis
acguagcggaucgc

SEQ ID NO: 320629 - RNA, 17 nt, Bordetella pertussis
acguaggcaaagcgcgg

SEQ ID NO: 320630 - RNA, 17 nt, Bordetella pertussis
acguaguacagcagcag

SEQ ID NO: 320631 - RNA, 19 nt, Bordetella pertussis
acgucaguccguggcgcgg

SEQ ID NO: 320632 - RNA, 14 nt, Bordetella pertussis
acguccagcgccac

SEQ ID NO: 320633 - RNA, 17 nt, Bordetella pertussis
acguccagcggcgcgac

SEQ ID NO: 320634 - RNA, 17 nt, Bordetella pertussis
acgucgaccucgagcac

SEQ ID NO: 320635 - RNA, 18 nt, Bordetella pertussis
acgucggccucgcgcagg

SEQ ID NO: 320636 - RNA, 15 nt, Bordetella pertussis
acgucggcggccgcc

SEQ ID NO: 320637 - RNA, 23 nt, Bordetella pertussis
acgucggcggccgccuugacggu

SEQ ID NO: 320638 - RNA, 20 nt, Bordetella pertussis
acgucgguggugaccacggc

SEQ ID NO: 320639 - RNA, 16 nt, Bordetella pertussis
acgucguagcgcugca

SEQ ID NO: 320640 - RNA, 17 nt, Bordetella pertussis
acgucguagugcgcgcc

SEQ ID NO: 320641 - RNA, 20 nt, Bordetella pertussis
acgucguagugcgcgccgcu

SEQ ID NO: 320642 - RNA, 13 nt, Bordetella pertussis
acgucgucgauga

SEQ ID NO: 320643 - RNA, 23 nt, Bordetella pertussis
acgucgucgaugaugacgaccuu

SEQ ID NO: 320644 - RNA, 17 nt, Bordetella pertussis
acgucgucgaugccgac

SEQ ID NO: 320645 - RNA, 16 nt, Bordetella pertussis
acgugccggauggcgc

SEQ ID NO: 320646 - RNA, 17 nt, Bordetella pertussis
acgugccggauggcgcg

SEQ ID NO: 320647 - RNA, 22 nt, Bordetella pertussis
acgugccggccgccuccaggcg

SEQ ID NO: 320648 - RNA, 21 nt, Bordetella pertussis
acgugcgccaggcaaaggccc

SEQ ID NO: 320649 - RNA, 17 nt, Bordetella pertussis
acguucggggcgucgcu

SEQ ID NO: 320650 - RNA, 17 nt, Bordetella pertussis
acguucuccagcgccgu

SEQ ID NO: 320651 - RNA, 20 nt, Bordetella pertussis
acguuggccgauacgcgugc

SEQ ID NO: 320652 - RNA, 19 nt, Bordetella pertussis
acuccaggaaagcgccgcc

SEQ ID NO: 320653 - RNA, 16 nt, Bordetella pertussis
acuccauagcgccgcu

SEQ ID NO: 320654 - RNA, 19 nt, Bordetella pertussis
acuccaucuguucggcgcc

SEQ ID NO: 320655 - RNA, 16 nt, Bordetella pertussis
acucccaugacccugc

SEQ ID NO: 320656 - RNA, 18 nt, Bordetella pertussis
acuccccagacgcagacc

SEQ ID NO: 320657 - RNA, 15 nt, Bordetella pertussis
acuccggccgggcca

SEQ ID NO: 320658 - RNA, 13 nt, Bordetella pertussis
acuccggcggcgc

SEQ ID NO: 320659 - RNA, 21 nt, Bordetella pertussis
acuccggcugcuugcccagcg

SEQ ID NO: 320660 - RNA, 19 nt, Bordetella pertussis
acuccguaaagaugcgcgc

SEQ ID NO: 320661 - RNA, 16 nt, Bordetella pertussis
acuccgucauggcgcc

SEQ ID NO: 320662 - RNA, 20 nt, Bordetella pertussis
acucgacgaacacgcgcgcc

SEQ ID NO: 320663 - RNA, 17 nt, Bordetella pertussis
acucgaugggcgcgcgc

SEQ ID NO: 320664 - RNA, 19 nt, Bordetella pertussis
acucgccgaacugccggcg

SEQ ID NO: 320665 - RNA, 17 nt, Bordetella pertussis
acucgcgcucggccagc

SEQ ID NO: 320666 - RNA, 21 nt, Bordetella pertussis
acucgcggucuggucuggcaa

SEQ ID NO: 320667 - RNA, 20 nt, Bordetella pertussis
acucggaagacauggcgcgc

SEQ ID NO: 320668 - RNA, 22 nt, Bordetella pertussis
acucggaagacauggcgcgcgc

SEQ ID NO: 320669 - RNA, 12 nt, Bordetella pertussis
acucggcaaacg

SEQ ID NO: 320670 - RNA, 13 nt, Bordetella pertussis
acugaucgccgcc

SEQ ID NO: 320671 - RNA, 21 nt, Bordetella pertussis
acugaucgccgccuucaucgu

SEQ ID NO: 320672 - RNA, 15 nt, Bordetella pertussis
acugccaggcgagcg

SEQ ID NO: 320673 - RNA, 18 nt, Bordetella pertussis
acugccaggcgagcgccg

SEQ ID NO: 320674 - RNA, 13 nt, Bordetella pertussis
acugccaggcgcc

SEQ ID NO: 320675 - RNA, 16 nt, Bordetella pertussis
acugccaguaggcgcc

SEQ ID NO: 320676 - RNA, 22 nt, Bordetella pertussis
acugccaguaggcgccccaggc

SEQ ID NO: 320677 - RNA, 15 nt, Bordetella pertussis
acugcccgcgccgua

SEQ ID NO: 320678 - RNA, 19 nt, Bordetella pertussis
acugcccgucuuggcgugg

SEQ ID NO: 320679 - RNA, 19 nt, Bordetella pertussis
acugcuugcgcgugcgcag

SEQ ID NO: 320680 - RNA, 14 nt, Bordetella pertussis
agaaauacgcgcgc

SEQ ID NO: 320681 - RNA, 13 nt, Bordetella pertussis
agaacaccgccgc

SEQ ID NO: 320682 - RNA, 15 nt, Bordetella pertussis
agaacaccgccgcgc

SEQ ID NO: 320683 - RNA, 17 nt, Bordetella pertussis
agaacaccgccgcgccg

SEQ ID NO: 320684 - RNA, 17 nt, Bordetella pertussis
agaacagggugccgccc

SEQ ID NO: 320685 - RNA, 20 nt, Bordetella pertussis
agaacgagccggccgcgccc

SEQ ID NO: 320686 - RNA, 13 nt, Bordetella pertussis
agaacgccagggu

SEQ ID NO: 320687 - RNA, 15 nt, Bordetella pertussis
agaacuucacgccga

SEQ ID NO: 320688 - RNA, 15 nt, Bordetella pertussis
agaagcagccgcgcu

SEQ ID NO: 320689 - RNA, 20 nt, Bordetella pertussis
agaagcccccgcgcugcgcc

SEQ ID NO: 320690 - RNA, 14 nt, Bordetella pertussis
agaagcugcgugcg

SEQ ID NO: 320691 - RNA, 13 nt, Bordetella pertussis
agaagucaucgau

SEQ ID NO: 320692 - RNA, 12 nt, Bordetella pertussis
agaauggcgcgg

SEQ ID NO: 320693 - RNA, 18 nt, Bordetella pertussis
agaauguauuggcccagu

SEQ ID NO: 320694 - RNA, 13 nt, Bordetella pertussis
agacaggcgcgcc

SEQ ID NO: 320695 - RNA, 17 nt, Bordetella pertussis
agacaggcgcgccaucc

SEQ ID NO: 320696 - RNA, 16 nt, Bordetella pertussis
agacauggcgcgcgcc

SEQ ID NO: 320697 - RNA, 20 nt, Bordetella pertussis
agaccacgauggccggcgcg

SEQ ID NO: 320698 - RNA, 17 nt, Bordetella pertussis
agaccagcaccggcacg

SEQ ID NO: 320699 - RNA, 22 nt, Bordetella pertussis
agaccagcagcggguugcgcgc

SEQ ID NO: 320700 - RNA, 21 nt, Bordetella pertussis
agacccacagguuggccgcga

SEQ ID NO: 320701 - RNA, 14 nt, Bordetella pertussis
agaccgcggccgcg

SEQ ID NO: 320702 - RNA, 16 nt, Bordetella pertussis
agaccgcggccgcgcu

SEQ ID NO: 320703 - RNA, 20 nt, Bordetella pertussis
agaccggcgccugcggcaug

SEQ ID NO: 320704 - RNA, 19 nt, Bordetella pertussis
agaccguagcgcaggcgcu

SEQ ID NO: 320705 - RNA, 14 nt, Bordetella pertussis
agaccgugaucggc

SEQ ID NO: 320706 - RNA, 19 nt, Bordetella pertussis
agaccgugaucggcgcaac

SEQ ID NO: 320707 - RNA, 16 nt, Bordetella pertussis
agaccugcgggccgca

SEQ ID NO: 320708 - RNA, 20 nt, Bordetella pertussis
agaccugcgggccgcacagc

SEQ ID NO: 320709 - RNA, 16 nt, Bordetella pertussis
agacgaaggcgccggc

SEQ ID NO: 320710 - RNA, 17 nt, Bordetella pertussis
agacgaaggcgccggcc

SEQ ID NO: 320711 - RNA, 18 nt, Bordetella pertussis
agacgaaggcgccggcca

SEQ ID NO: 320712 - RNA, 16 nt, Bordetella pertussis
agacgauggugccggc

SEQ ID NO: 320713 - RNA, 17 nt, Bordetella pertussis
agacgauggugccggcc

SEQ ID NO: 320714 - RNA, 15 nt, Bordetella pertussis
agacgccgucgaccc

SEQ ID NO: 320715 - RNA, 23 nt, Bordetella pertussis
agacgcgagaccaugacgucgac

SEQ ID NO: 320716 - RNA, 18 nt, Bordetella pertussis
agacgcgcucgccgucga

SEQ ID NO: 320717 - RNA, 15 nt, Bordetella pertussis
agacgcgcucgcgcg

SEQ ID NO: 320718 - RNA, 20 nt, Bordetella pertussis
agacgcggggacaggcacac

SEQ ID NO: 320719 - RNA, 15 nt, Bordetella pertussis
agacgcugucgcgcc

SEQ ID NO: 320720 - RNA, 16 nt, Bordetella pertussis
agacgcugucgcgccc

SEQ ID NO: 320721 - RNA, 19 nt, Bordetella pertussis
agacggaugcuugcggggc

SEQ ID NO: 320722 - RNA, 13 nt, Bordetella pertussis
agacggccagcgc

SEQ ID NO: 320723 - RNA, 17 nt, Bordetella pertussis
agacggccagcgcgcgu

SEQ ID NO: 320724 - RNA, 21 nt, Bordetella pertussis
agacggcuugaccacggccag

SEQ ID NO: 320725 - RNA, 16 nt, Bordetella pertussis
agacguagccgcugcc

SEQ ID NO: 320726 - RNA, 21 nt, Bordetella pertussis
agagcaggccgcccagcgcau

SEQ ID NO: 320727 - RNA, 12 nt, Bordetella pertussis
agagcaugcggc

SEQ ID NO: 320728 - RNA, 22 nt, Bordetella pertussis
agagccuggaagugaugccgcc

SEQ ID NO: 320729 - RNA, 23 nt, Bordetella pertussis
agagccuggaagugaugccgccg

SEQ ID NO: 320730 - RNA, 21 nt, Bordetella pertussis
agagccugggcgcgcgcccag

SEQ ID NO: 320731 - RNA, 13 nt, Bordetella pertussis
agagcgaauccau

SEQ ID NO: 320732 - RNA, 13 nt, Bordetella pertussis
agagcgccacgcc

SEQ ID NO: 320733 - RNA, 16 nt, Bordetella pertussis
agagcgccacgccagc

SEQ ID NO: 320734 - RNA, 18 nt, Bordetella pertussis
agagcggcguggcgccga

SEQ ID NO: 320735 - RNA, 21 nt, Bordetella pertussis
agagcgggauggucgcggccg

SEQ ID NO: 320736 - RNA, 21 nt, Bordetella pertussis
agaguucgcugcgaaacagca

SEQ ID NO: 320737 - RNA, 19 nt, Bordetella pertussis
agauacuguucgccgcacc

SEQ ID NO: 320738 - RNA, 14 nt, Bordetella pertussis
agauagcccagcac

SEQ ID NO: 320739 - RNA, 21 nt, Bordetella pertussis
agauagucgcggaugcgcgcc

SEQ ID NO: 320740 - RNA, 17 nt, Bordetella pertussis
agauccacgcccgcgcc

SEQ ID NO: 320741 - RNA, 15 nt, Bordetella pertussis
agaucccgccggacu

SEQ ID NO: 320742 - RNA, 22 nt, Bordetella pertussis
agauccgguaugccugccagcc

SEQ ID NO: 320743 - RNA, 16 nt, Bordetella pertussis
agauuguccagcggca

SEQ ID NO: 320744 - RNA, 16 nt, Bordetella pertussis
agcaagcccaccgggc

SEQ ID NO: 320745 - RNA, 21 nt, Bordetella pertussis
agcaagccgaucaaccugauc

SEQ ID NO: 320746 - RNA, 17 nt, Bordetella pertussis
agcaaggcgcgccaccg

SEQ ID NO: 320747 - RNA, 21 nt, Bordetella pertussis
agcaaggcggcaaacccggcg

SEQ ID NO: 320748 - RNA, 21 nt, Bordetella pertussis
agcaaggcgucggccaggccg

SEQ ID NO: 320749 - RNA, 20 nt, Bordetella pertussis
agcaagggcgucuucgccga

SEQ ID NO: 320750 - RNA, 22 nt, Bordetella pertussis
agcacacggucagcaaccccag

SEQ ID NO: 320751 - RNA, 17 nt, Bordetella pertussis
agcacauagcgcaagcc

SEQ ID NO: 320752 - RNA, 20 nt, Bordetella pertussis
agcacauagcgcaagcccgu

SEQ ID NO: 320753 - RNA, 21 nt, Bordetella pertussis
agcacagugucuaucauggcc

SEQ ID NO: 320754 - RNA, 14 nt, Bordetella pertussis
agcacaugcccggc

SEQ ID NO: 320755 - RNA, 18 nt, Bordetella pertussis
agcacaugcccggccacc

SEQ ID NO: 320756 - RNA, 19 nt, Bordetella pertussis
agcacauggcgcgccggcc

SEQ ID NO: 320757 - RNA, 13 nt, Bordetella pertussis
agcacaugggcgc

SEQ ID NO: 320758 - RNA, 15 nt, Bordetella pertussis
agcaccacggcaucg

SEQ ID NO: 320759 - RNA, 15 nt, Bordetella pertussis
agcaccacggcgcgc

SEQ ID NO: 320760 - RNA, 15 nt, Bordetella pertussis
agcaccacggcggcc

SEQ ID NO: 320761 - RNA, 13 nt, Bordetella pertussis
agcaccacguccu

SEQ ID NO: 320762 - RNA, 19 nt, Bordetella pertussis
agcaccgccugcugcgccu

SEQ ID NO: 320763 - RNA, 21 nt, Bordetella pertussis
agcaccgcgaccaugcggccg

SEQ ID NO: 320764 - RNA, 21 nt, Bordetella pertussis
agcaccggauccugcggcgcg

SEQ ID NO: 320765 - RNA, 19 nt, Bordetella pertussis
agcaccggcacgacggccu

SEQ ID NO: 320766 - RNA, 16 nt, Bordetella pertussis
agcaccgugccggcgu

SEQ ID NO: 320767 - RNA, 17 nt, Bordetella pertussis
agcaccucgacgcagcc

SEQ ID NO: 320768 - RNA, 22 nt, Bordetella pertussis
agcaccucggacgagacaggcg

SEQ ID NO: 320769 - RNA, 19 nt, Bordetella pertussis
agcaccucggcgcccagcu

SEQ ID NO: 320770 - RNA, 20 nt, Bordetella pertussis
agcaccucggggcgcggccg

SEQ ID NO: 320771 - RNA, 14 nt, Bordetella pertussis
agcaccugcaggcc

SEQ ID NO: 320772 - RNA, 17 nt, Bordetella pertussis
agcaccugcaggccgcc

SEQ ID NO: 320773 - RNA, 20 nt, Bordetella pertussis
agcaccugcaggccgccggc

SEQ ID NO: 320774 - RNA, 22 nt, Bordetella pertussis
agcaccugcaggccgccggcca

SEQ ID NO: 320775 - RNA, 22 nt, Bordetella pertussis
agcaccuugaccuggucggccu

SEQ ID NO: 320776 - RNA, 22 nt, Bordetella pertussis
agcacgaaccacaggguggcgc

SEQ ID NO: 320777 - RNA, 14 nt, Bordetella pertussis
agcacgacgacggc

SEQ ID NO: 320778 - RNA, 18 nt, Bordetella pertussis
agcacgacgacggccggc

SEQ ID NO: 320779 - RNA, 14 nt, Bordetella pertussis
agcacgagaugucc

SEQ ID NO: 320780 - RNA, 14 nt, Bordetella pertussis
agcacgaucacgaa

SEQ ID NO: 320781 - RNA, 18 nt, Bordetella pertussis
agcacgaucgcggcgcug

SEQ ID NO: 320782 - RNA, 13 nt, Bordetella pertussis
agcacgaugagca

SEQ ID NO: 320783 - RNA, 18 nt, Bordetella pertussis
agcacgaugagcaugauu

SEQ ID NO: 320784 - RNA, 18 nt, Bordetella pertussis
agcacgauggggccaugg

SEQ ID NO: 320785 - RNA, 19 nt, Bordetella pertussis
agcacgauggggccauggc

SEQ ID NO: 320786 - RNA, 20 nt, Bordetella pertussis
agcacgauggucagcggcau

SEQ ID NO: 320787 - RNA, 16 nt, Bordetella pertussis
agcacgcccagauggc

SEQ ID NO: 320788 - RNA, 14 nt, Bordetella pertussis
agcacgccggccag

SEQ ID NO: 320789 - RNA, 12 nt, Bordetella pertussis
agcacgccggcg

SEQ ID NO: 320790 - RNA, 16 nt, Bordetella pertussis
agcacgcgcaccaggc

SEQ ID NO: 320791 - RNA, 22 nt, Bordetella pertussis
agcacgcgcaccaggccugccu

SEQ ID NO: 320792 - RNA, 13 nt, Bordetella pertussis
agcacgcggcgcg

SEQ ID NO: 320793 - RNA, 14 nt, Bordetella pertussis
agcacgcugcgcgg

SEQ ID NO: 320794 - RNA, 15 nt, Bordetella pertussis
agcacuugccggccg

SEQ ID NO: 320795 - RNA, 13 nt, Bordetella pertussis
agcagauaccggc

SEQ ID NO: 320796 - RNA, 17 nt, Bordetella pertussis
agcagauggccaucgac

SEQ ID NO: 320797 - RNA, 20 nt, Bordetella pertussis
agcagauucaugggcggcga

SEQ ID NO: 320798 - RNA, 17 nt, Bordetella pertussis
agcagauugccgcgcgg

SEQ ID NO: 320799 - RNA, 23 nt, Bordetella pertussis
agcagcaauacggguaugcgcag

SEQ ID NO: 320800 - RNA, 16 nt, Bordetella pertussis
agcagccgcgcggccg

SEQ ID NO: 320801 - RNA, 15 nt, Bordetella pertussis
agcagcgagagcgcc

SEQ ID NO: 320802 - RNA, 16 nt, Bordetella pertussis
agcagcgcaucgagcu

SEQ ID NO: 320803 - RNA, 18 nt, Bordetella pertussis
agcagcgcaucgaucucg

SEQ ID NO: 320804 - RNA, 11 nt, Bordetella pertussis
agcagcgccac

SEQ ID NO: 320805 - RNA, 22 nt, Bordetella pertussis
agcagcgccaccguggccacgg

SEQ ID NO: 320806 - RNA, 21 nt, Bordetella pertussis
agcagcgcggcgccggccguc

SEQ ID NO: 320807 - RNA, 20 nt, Bordetella pertussis
agcagcggcagcucggcgaa

SEQ ID NO: 320808 - RNA, 23 nt, Bordetella pertussis
agcagcgugaugccgucgagcgc

SEQ ID NO: 320809 - RNA, 17 nt, Bordetella pertussis
agcagcgugcggucguc

SEQ ID NO: 320810 - RNA, 16 nt, Bordetella pertussis
agcagcguggccgcca

SEQ ID NO: 320811 - RNA, 14 nt, Bordetella pertussis
agcagcucggccac

SEQ ID NO: 320812 - RNA, 15 nt, Bordetella pertussis
agcagcucggccacc

SEQ ID NO: 320813 - RNA, 23 nt, Bordetella pertussis
agcagcucggcgaucugcgcggc

SEQ ID NO: 320814 - RNA, 15 nt, Bordetella pertussis
agcagcuggcgcagc

SEQ ID NO: 320815 - RNA, 17 nt, Bordetella pertussis
agcaggccgcccagcgc

SEQ ID NO: 320816 - RNA, 18 nt, Bordetella pertussis
agcaggccgcgcgugcgg

SEQ ID NO: 320817 - RNA, 15 nt, Bordetella pertussis
agcaggccggcggcg

SEQ ID NO: 320818 - RNA, 18 nt, Bordetella pertussis
agcaggccgggucguucg

SEQ ID NO: 320819 - RNA, 20 nt, Bordetella pertussis
agcaggccguaaccggccag

SEQ ID NO: 320820 - RNA, 21 nt, Bordetella pertussis
agcaggcgcaggccgcgcgca

SEQ ID NO: 320821 - RNA, 13 nt, Bordetella pertussis
agcagggcggcgg

SEQ ID NO: 320822 - RNA, 14 nt, Bordetella pertussis
agcagggcggcguc

SEQ ID NO: 320823 - RNA, 16 nt, Bordetella pertussis
agcagggcggcgucga

SEQ ID NO: 320824 - RNA, 15 nt, Bordetella pertussis
agcaggggcugccau

SEQ ID NO: 320825 - RNA, 20 nt, Bordetella pertussis
agcagggggucgaucauggc

SEQ ID NO: 320826 - RNA, 22 nt, Bordetella pertussis
agcagggucgagaccagcagcg

SEQ ID NO: 320827 - RNA, 15 nt, Bordetella pertussis
agcagguccugcacg

SEQ ID NO: 320828 - RNA, 15 nt, Bordetella pertussis
agcaggucgcgcacg

SEQ ID NO: 320829 - RNA, 19 nt, Bordetella pertussis
agcaggucgcgcacgcugg

SEQ ID NO: 320830 - RNA, 16 nt, Bordetella pertussis
agcaguguuucggccu

SEQ ID NO: 320831 - RNA, 19 nt, Bordetella pertussis
agcaguucggccggcggcc

SEQ ID NO: 320832 - RNA, 15 nt, Bordetella pertussis
agcaguugcgccagu

SEQ ID NO: 320833 - RNA, 20 nt, Bordetella pertussis
agcauacccugcgcgccgcc

SEQ ID NO: 320834 - RNA, 14 nt, Bordetella pertussis
agcaucgccgccag

SEQ ID NO: 320835 - RNA, 15 nt, Bordetella pertussis
agcaucugccccagc

SEQ ID NO: 320836 - RNA, 21 nt, Bordetella pertussis
agcaucugccccagcuugucg

SEQ ID NO: 320837 - RNA, 12 nt, Bordetella pertussis
agcauggcggcc

SEQ ID NO: 320838 - RNA, 13 nt, Bordetella pertussis
agcauggcggcgc

SEQ ID NO: 320839 - RNA, 19 nt, Bordetella pertussis
agcauggcgguggccagcg

SEQ ID NO: 320840 - RNA, 13 nt, Bordetella pertussis
agcauggcgucga

SEQ ID NO: 320841 - RNA, 15 nt, Bordetella pertussis
agcauggucgccucg

SEQ ID NO: 320842 - RNA, 23 nt, Bordetella pertussis
agcauguauucaucacgggcgcc

SEQ ID NO: 320843 - RNA, 15 nt, Bordetella pertussis
agcauguccgccaug

SEQ ID NO: 320844 - RNA, 16 nt, Bordetella pertussis
agcauguccgccaugc

SEQ ID NO: 320845 - RNA, 20 nt, Bordetella pertussis
agcaugucguggcgauagcg

SEQ ID NO: 320846 - RNA, 14 nt, Bordetella pertussis
agcauuucggcgcc

SEQ ID NO: 320847 - RNA, 14 nt, Bordetella pertussis
agccacacgaucag

SEQ ID NO: 320848 - RNA, 18 nt, Bordetella pertussis
agccacacgaucagcgcc

SEQ ID NO: 320849 - RNA, 21 nt, Bordetella pertussis
agccacacgcugaagcgccgc

SEQ ID NO: 320850 - RNA, 12 nt, Bordetella pertussis
agccacaggccc

SEQ ID NO: 320851 - RNA, 16 nt, Bordetella pertussis
agccaccccgucaucg

SEQ ID NO: 320852 - RNA, 19 nt, Bordetella pertussis
agccaccccgucaucgccg

SEQ ID NO: 320853 - RNA, 21 nt, Bordetella pertussis
agccaccacugcaaggcccgc

SEQ ID NO: 320854 - RNA, 21 nt, Bordetella pertussis
agccaccgguugcagcgcgcc

SEQ ID NO: 320855 - RNA, 11 nt, Bordetella pertussis
agcccggcgcg

SEQ ID NO: 320856 - RNA, 15 nt, Bordetella pertussis
agcccggcgcgccac

SEQ ID NO: 320857 - RNA, 17 nt, Bordetella pertussis
agcccggcgcgccaccc

SEQ ID NO: 320858 - RNA, 20 nt, Bordetella pertussis
agcccgggaaacucgcgcag

SEQ ID NO: 320859 - RNA, 22 nt, Bordetella pertussis
agcccgggaaacucgcgcagcg

SEQ ID NO: 320860 - RNA, 19 nt, Bordetella pertussis
agcccggcugcucguucug

SEQ ID NO: 320861 - RNA, 15 nt, Bordetella pertussis
agcccgucaggcgga

SEQ ID NO: 320862 - RNA, 16 nt, Bordetella pertussis
agcccgucaggcggau

SEQ ID NO: 320863 - RNA, 16 nt, Bordetella pertussis
agcccgugggcggcgu

SEQ ID NO: 320864 - RNA, 17 nt, Bordetella pertussis
agcccuugaucagcggc

SEQ ID NO: 320865 - RNA, 16 nt, Bordetella pertussis
agcccuuguggccgcc

SEQ ID NO: 320866 - RNA, 16 nt, Bordetella pertussis
agccgaaguacacggc

SEQ ID NO: 320867 - RNA, 18 nt, Bordetella pertussis
agccgaaguacacggcca

SEQ ID NO: 320868 - RNA, 19 nt, Bordetella pertussis
agccgaaguacacggccag

SEQ ID NO: 320869 - RNA, 15 nt, Bordetella pertussis
agccgaauccggcca

SEQ ID NO: 320870 - RNA, 22 nt, Bordetella pertussis
agccgaauccggccagcacgcc

SEQ ID NO: 320871 - RNA, 22 nt, Bordetella pertussis
agccgaugaccggccaggcgcg

SEQ ID NO: 320872 - RNA, 15 nt, Bordetella pertussis
agccgaugcgccgcg

SEQ ID NO: 320873 - RNA, 20 nt, Bordetella pertussis
agccgcaagcuggcggcgcg

SEQ ID NO: 320874 - RNA, 23 nt, Bordetella pertussis
agccgcaauaccuucagcccggc

SEQ ID NO: 320875 - RNA, 13 nt, Bordetella pertussis
agccgcaccagcg

SEQ ID NO: 320876 - RNA, 14 nt, Bordetella pertussis
agccgcaccagcgc

SEQ ID NO: 320877 - RNA, 15 nt, Bordetella pertussis
agccgcacgcccgcc

SEQ ID NO: 320878 - RNA, 13 nt, Bordetella pertussis
agccgcaggucca

SEQ ID NO: 320879 - RNA, 16 nt, Bordetella pertussis
agccgcaugccggcga

SEQ ID NO: 320880 - RNA, 13 nt, Bordetella pertussis
agccgccggcgcg

SEQ ID NO: 320881 - RNA, 15 nt, Bordetella pertussis
agccgccgucgaugu

SEQ ID NO: 320882 - RNA, 17 nt, Bordetella pertussis
agccgcgcggccgggcu

SEQ ID NO: 320883 - RNA, 17 nt, Bordetella pertussis
agccgcgcgcggccggc

SEQ ID NO: 320884 - RNA, 13 nt, Bordetella pertussis
agccgcggccgcc

SEQ ID NO: 320885 - RNA, 20 nt, Bordetella pertussis
agccgcggcgguuucggccg

SEQ ID NO: 320886 - RNA, 14 nt, Bordetella pertussis
agccgcucggccac

SEQ ID NO: 320887 - RNA, 19 nt, Bordetella pertussis
agccgcucggccacgcgcu

SEQ ID NO: 320888 - RNA, 15 nt, Bordetella pertussis
agccgcucgcgcgac

SEQ ID NO: 320889 - RNA, 13 nt, Bordetella pertussis
agccgcugcagcg

SEQ ID NO: 320890 - RNA, 15 nt, Bordetella pertussis
agccgcugcgcgcgg

SEQ ID NO: 320891 - RNA, 18 nt, Bordetella pertussis
agccgcugcgcgcggccu

SEQ ID NO: 320892 - RNA, 21 nt, Bordetella pertussis
agccgcugcgcgcggccuggc

SEQ ID NO: 320893 - RNA, 17 nt, Bordetella pertussis
agccgcugcgcuggccg

SEQ ID NO: 320894 - RNA, 19 nt, Bordetella pertussis
agccgcugcgcuggccgcg

SEQ ID NO: 320895 - RNA, 20 nt, Bordetella pertussis
agccgcugcgcuggccgcga

SEQ ID NO: 320896 - RNA, 19 nt, Bordetella pertussis
agccgcugccguugucggu

SEQ ID NO: 320897 - RNA, 18 nt, Bordetella pertussis
agccgcuggauuucgccg

SEQ ID NO: 320898 - RNA, 20 nt, Bordetella pertussis
agccgcuggauuucgccgcg

SEQ ID NO: 320899 - RNA, 17 nt, Bordetella pertussis
agccgcuggcgcgccgc

SEQ ID NO: 320900 - RNA, 18 nt, Bordetella pertussis
agccgcuggcgcgccgcc

SEQ ID NO: 320901 - RNA, 19 nt, Bordetella pertussis
agccgcuggcgcgccgccu

SEQ ID NO: 320902 - RNA, 17 nt, Bordetella pertussis
agccgcugucgcaggcg

SEQ ID NO: 320903 - RNA, 20 nt, Bordetella pertussis
agccgcuuggccugcgccac

SEQ ID NO: 320904 - RNA, 22 nt, Bordetella pertussis
agccggacccgcgccgcaggcc

SEQ ID NO: 320905 - RNA, 15 nt, Bordetella pertussis
agccggacucgucca

SEQ ID NO: 320906 - RNA, 18 nt, Bordetella pertussis
agccggagcagucgcgca

SEQ ID NO: 320907 - RNA, 14 nt, Bordetella pertussis
agccggcacgccug

SEQ ID NO: 320908 - RNA, 19 nt, Bordetella pertussis
agccggcacgccugccgcg

SEQ ID NO: 320909 - RNA, 13 nt, Bordetella pertussis
agccggccagcgc

SEQ ID NO: 320910 - RNA, 17 nt, Bordetella pertussis
agccggccagcgccugg

SEQ ID NO: 320911 - RNA, 21 nt, Bordetella pertussis
agccggccagcgccugggcgc

SEQ ID NO: 320912 - RNA, 12 nt, Bordetella pertussis
agccggccaggu

SEQ ID NO: 320913 - RNA, 20 nt, Bordetella pertussis
agccggccgaugacaucgcc

SEQ ID NO: 320914 - RNA, 20 nt, Bordetella pertussis
agccggccgcgccgcgccgg

SEQ ID NO: 320915 - RNA, 12 nt, Bordetella pertussis
agccggcgccau

SEQ ID NO: 320916 - RNA, 15 nt, Bordetella pertussis
agccggcgcgccaug

SEQ ID NO: 320917 - RNA, 21 nt, Bordetella pertussis
agccggcggcaugcgccagcc

SEQ ID NO: 320918 - RNA, 13 nt, Bordetella pertussis
agccggcggccag

SEQ ID NO: 320919 - RNA, 16 nt, Bordetella pertussis
agccggcggccagcuu

SEQ ID NO: 320920 - RNA, 22 nt, Bordetella pertussis
agccggcugcaagacgcccagg

SEQ ID NO: 320921 - RNA, 13 nt, Bordetella pertussis
agccgggcaccga

SEQ ID NO: 320922 - RNA, 16 nt, Bordetella pertussis
agccgggccacgcgca

SEQ ID NO: 320923 - RNA, 18 nt, Bordetella pertussis
agccgggccacgcgcaca

SEQ ID NO: 320924 - RNA, 15 nt, Bordetella pertussis
agccgggcgaucgcg

SEQ ID NO: 320925 - RNA, 17 nt, Bordetella pertussis
agccgggcgaucgcguc

SEQ ID NO: 320926 - RNA, 13 nt, Bordetella pertussis
agccgggcgccga

SEQ ID NO: 320927 - RNA, 14 nt, Bordetella pertussis
agccgggcgccggc

SEQ ID NO: 320928 - RNA, 13 nt, Bordetella pertussis
agccgggcggcga

SEQ ID NO: 320929 - RNA, 17 nt, Bordetella pertussis
agccggggcgagcgcag

SEQ ID NO: 320930 - RNA, 15 nt, Bordetella pertussis
agccgggucuggccg

SEQ ID NO: 320931 - RNA, 17 nt, Bordetella pertussis
agccggguggucgcgcc

SEQ ID NO: 320932 - RNA, 18 nt, Bordetella pertussis
agccgguacagccaggcc

SEQ ID NO: 320933 - RNA, 19 nt, Bordetella pertussis
agccgguaucgcggcgcag

SEQ ID NO: 320934 - RNA, 20 nt, Bordetella pertussis
agccgguaucgcggcgcagg

SEQ ID NO: 320935 - RNA, 18 nt, Bordetella pertussis
agccggucuggucggcga

SEQ ID NO: 320936 - RNA, 15 nt, Bordetella pertussis
agccggugccagucc

SEQ ID NO: 320937 - RNA, 18 nt, Bordetella pertussis
agccgguuggcgccuucc

SEQ ID NO: 320938 - RNA, 22 nt, Bordetella pertussis
agccucacuccauagcgccgcu

SEQ ID NO: 320939 - RNA, 23 nt, Bordetella pertussis
agccucuuuugcuugggggcgug

SEQ ID NO: 320940 - RNA, 19 nt, Bordetella pertussis
agccugauucccaggcccg

SEQ ID NO: 320941 - RNA, 15 nt, Bordetella pertussis
agccugccacaucga

SEQ ID NO: 320942 - RNA, 14 nt, Bordetella pertussis
agccugcccgggca

SEQ ID NO: 320943 - RNA, 19 nt, Bordetella pertussis
agccugcccucgggcgaca

SEQ ID NO: 320944 - RNA, 16 nt, Bordetella pertussis
agccugccgcggccgc

SEQ ID NO: 320945 - RNA, 17 nt, Bordetella pertussis
agccugccggcgcgccc

SEQ ID NO: 320946 - RNA, 16 nt, Bordetella pertussis
agccugccggcggccu

SEQ ID NO: 320947 - RNA, 23 nt, Bordetella pertussis
agccuggaagugaugccgccggc

SEQ ID NO: 320948 - RNA, 21 nt, Bordetella pertussis
agccuguccccgccggggcag

SEQ ID NO: 320949 - RNA, 14 nt, Bordetella pertussis
agccugucguucgg

SEQ ID NO: 320950 - RNA, 15 nt, Bordetella pertussis
agccugggccuguac

SEQ ID NO: 320951 - RNA, 13 nt, Bordetella pertussis
agccugggcgcgc

SEQ ID NO: 320952 - RNA, 15 nt, Bordetella pertussis
agcgaaauacgcgac

SEQ ID NO: 320953 - RNA, 15 nt, Bordetella pertussis
agcgaaauggcggcc

SEQ ID NO: 320954 - RNA, 16 nt, Bordetella pertussis
agcgaaauggcggccu

SEQ ID NO: 320955 - RNA, 18 nt, Bordetella pertussis
agcgaacggcccacgcug

SEQ ID NO: 320956 - RNA, 18 nt, Bordetella pertussis
agcgacccguggcccggg

SEQ ID NO: 320957 - RNA, 16 nt, Bordetella pertussis
agcgacgcgcgccggc

SEQ ID NO: 320958 - RNA, 21 nt, Bordetella pertussis
agcgacggcagauggacaaga

SEQ ID NO: 320959 - RNA, 21 nt, Bordetella pertussis
agcgacggccccagcgccgcg

SEQ ID NO: 320960 - RNA, 23 nt, Bordetella pertussis
agcgacuucuaccuggacggggu

SEQ ID NO: 320961 - RNA, 12 nt, Bordetella pertussis
agcgaugcccug

SEQ ID NO: 320962 - RNA, 19 nt, Bordetella pertussis
agcgauuucuucugcgcgu

SEQ ID NO: 320963 - RNA, 20 nt, Bordetella pertussis
agcgcaaacgggggcaggcc

SEQ ID NO: 320964 - RNA, 15 nt, Bordetella pertussis
agcgcaagcaccgcc

SEQ ID NO: 320965 - RNA, 13 nt, Bordetella pertussis
agcgcaagcccgu

SEQ ID NO: 320966 - RNA, 19 nt, Bordetella pertussis
agcgcaaggguuguggccg

SEQ ID NO: 320967 - RNA, 21 nt, Bordetella pertussis
agcgccaggaacagcgccggc

SEQ ID NO: 320968 - RNA, 17 nt, Bordetella pertussis
agcgccaggccgcgcag

SEQ ID NO: 320969 - RNA, 14 nt, Bordetella pertussis
agcgccagggccag

SEQ ID NO: 320970 - RNA, 18 nt, Bordetella pertussis
agcgccagggccaggccg

SEQ ID NO: 320971 - RNA, 20 nt, Bordetella pertussis
agcgccagggccaggccgcc

SEQ ID NO: 320972 - RNA, 20 nt, Bordetella pertussis
agcgccaucaagagcaccgu

SEQ ID NO: 320973 - RNA, 15 nt, Bordetella pertussis
agcgccaucgcgcgc

SEQ ID NO: 320974 - RNA, 20 nt, Bordetella pertussis
agcgccaugaugucgcgcgc

SEQ ID NO: 320975 - RNA, 21 nt, Bordetella pertussis
agcgccaugaugucgcgcgcc

SEQ ID NO: 320976 - RNA, 14 nt, Bordetella pertussis
agcgcccuggcgug

SEQ ID NO: 320977 - RNA, 20 nt, Bordetella pertussis
agcgccgaccgcacgauggc

SEQ ID NO: 320978 - RNA, 23 nt, Bordetella pertussis
agcgccgaccgcacgauggcgcg

SEQ ID NO: 320979 - RNA, 16 nt, Bordetella pertussis
agcgccgacggcaugg

SEQ ID NO: 320980 - RNA, 15 nt, Bordetella pertussis
agcgccgagcgccag

SEQ ID NO: 320981 - RNA, 17 nt, Bordetella pertussis
agcgccgcagcgucgcg

SEQ ID NO: 320982 - RNA, 14 nt, Bordetella pertussis
agcgccgccacagg

SEQ ID NO: 320983 - RNA, 21 nt, Bordetella pertussis
agcgccgccagcauggcggcc

SEQ ID NO: 320984 - RNA, 14 nt, Bordetella pertussis
agcgccgccaggcc

SEQ ID NO: 320985 - RNA, 22 nt, Bordetella pertussis
agcgccgccaucauggcgucgg

SEQ ID NO: 320986 - RNA, 19 nt, Bordetella pertussis
agcgccgccauggcggcgc

SEQ ID NO: 320987 - RNA, 15 nt, Bordetella pertussis
agcgccgccgacggc

SEQ ID NO: 320988 - RNA, 14 nt, Bordetella pertussis
agcgccgccgccau

SEQ ID NO: 320989 - RNA, 15 nt, Bordetella pertussis
agcgccgccgccaug

SEQ ID NO: 320990 - RNA, 14 nt, Bordetella pertussis
agcgccgccgccgg

SEQ ID NO: 320991 - RNA, 20 nt, Bordetella pertussis
agcgccgccuucaccggccc

SEQ ID NO: 320992 - RNA, 21 nt, Bordetella pertussis
agcgccgccuucaccggcccc

SEQ ID NO: 320993 - RNA, 18 nt, Bordetella pertussis
agcgccgcgaacuggcgg

SEQ ID NO: 320994 - RNA, 13 nt, Bordetella pertussis
agcgccgcgccag

SEQ ID NO: 320995 - RNA, 14 nt, Bordetella pertussis
agcgccgcgccagg

SEQ ID NO: 320996 - RNA, 20 nt, Bordetella pertussis
agcgccgcgccgaaggcgug

SEQ ID NO: 320997 - RNA, 13 nt, Bordetella pertussis
agcgccgcgccuc

SEQ ID NO: 320998 - RNA, 11 nt, Bordetella pertussis
agcgccgcgcg

SEQ ID NO: 320999 - RNA, 17 nt, Bordetella pertussis
agcgccggcccgccucg

SEQ ID NO: 321000 - RNA, 12 nt, Bordetella pertussis
agcgccggcgca

SEQ ID NO: 321001 - RNA, 13 nt, Bordetella pertussis
agcgccggcgcau

SEQ ID NO: 321002 - RNA, 13 nt, Bordetella pertussis
agcgccggcgcgc

SEQ ID NO: 321003 - RNA, 15 nt, Bordetella pertussis
agcgccgggaucggc

SEQ ID NO: 321004 - RNA, 13 nt, Bordetella pertussis
agcgccgggcgcc

SEQ ID NO: 321005 - RNA, 15 nt, Bordetella pertussis
agcgccgggcgccgc

SEQ ID NO: 321006 - RNA, 17 nt, Bordetella pertussis
agcgccggggcguggcc

SEQ ID NO: 321007 - RNA, 15 nt, Bordetella pertussis
agcgccggggggcgc

SEQ ID NO: 321008 - RNA, 22 nt, Bordetella pertussis
agcgccggggggcgcacgccgc

SEQ ID NO: 321009 - RNA, 18 nt, Bordetella pertussis
agcgccgguucgacgcug

SEQ ID NO: 321010 - RNA, 19 nt, Bordetella pertussis
agcgccgucagcagcgcgg

SEQ ID NO: 321011 - RNA, 20 nt, Bordetella pertussis
agcgccgucagcagcgcggc

SEQ ID NO: 321012 - RNA, 22 nt, Bordetella pertussis
agcgccgucagcagcgcggcgc

SEQ ID NO: 321013 - RNA, 23 nt, Bordetella pertussis
agcgccuccaucagcagcaccuu

SEQ ID NO: 321014 - RNA, 16 nt, Bordetella pertussis
agcgccuggcgggccu

SEQ ID NO: 321015 - RNA, 12 nt, Bordetella pertussis
agcgccugggcg

SEQ ID NO: 321016 - RNA, 15 nt, Bordetella pertussis
agcgccugggcggcc

SEQ ID NO: 321017 - RNA, 20 nt, Bordetella pertussis
agcgccugggcggccacgua

SEQ ID NO: 321018 - RNA, 19 nt, Bordetella pertussis
agcgcgaaauccagcgcgc

SEQ ID NO: 321019 - RNA, 20 nt, Bordetella pertussis
agcgcgaaauccagcgcgcc

SEQ ID NO: 321020 - RNA, 21 nt, Bordetella pertussis
agcgcgaaaugcccagcgagc

SEQ ID NO: 321021 - RNA, 13 nt, Bordetella pertussis
agcgcgacagcac

SEQ ID NO: 321022 - RNA, 14 nt, Bordetella pertussis
agcgcgccagcagc

SEQ ID NO: 321023 - RNA, 15 nt, Bordetella pertussis
agcgcgccagcagcg

SEQ ID NO: 321024 - RNA, 15 nt, Bordetella pertussis
agcgcgccagccgcg

SEQ ID NO: 321025 - RNA, 16 nt, Bordetella pertussis
agcgcgccaggcgcau

SEQ ID NO: 321026 - RNA, 19 nt, Bordetella pertussis
agcgcgcccgaggcgcgca

SEQ ID NO: 321027 - RNA, 20 nt, Bordetella pertussis
agcgcgcccgaggcgcgcag

SEQ ID NO: 321028 - RNA, 18 nt, Bordetella pertussis
agcgcgcccgcuugcgcg

SEQ ID NO: 321029 - RNA, 21 nt, Bordetella pertussis
agcgcgcccgcuugggccgcg

SEQ ID NO: 321030 - RNA, 23 nt, Bordetella pertussis
agcgcgcccucguugacgccgac

SEQ ID NO: 321031 - RNA, 20 nt, Bordetella pertussis
agcgcgccgaagcgcaggcc

SEQ ID NO: 321032 - RNA, 11 nt, Bordetella pertussis
agcgcgccgcc

SEQ ID NO: 321033 - RNA, 13 nt, Bordetella pertussis
agcgcgccgccgu

SEQ ID NO: 321034 - RNA, 13 nt, Bordetella pertussis
agcgcgccgcgcc

SEQ ID NO: 321035 - RNA, 21 nt, Bordetella pertussis
agcgcgccgcgccgggcgcgc

SEQ ID NO: 321036 - RNA, 14 nt, Bordetella pertussis
agcgcgccgcgcgc

SEQ ID NO: 321037 - RNA, 15 nt, Bordetella pertussis
agcgcgccgcgcgca

SEQ ID NO: 321038 - RNA, 13 nt, Bordetella pertussis
agcgcgccgccag

SEQ ID NO: 321039 - RNA, 21 nt, Bordetella pertussis
agcgcgccgccagcgcgcgcg

SEQ ID NO: 321040 - RNA, 14 nt, Bordetella pertussis
agcgcgccgcccac

SEQ ID NO: 321041 - RNA, 23 nt, Bordetella pertussis
agcgcgccgcccaccaccagcgc

SEQ ID NO: 321042 - RNA, 18 nt, Bordetella pertussis
agcgcggcaugccgcugc

SEQ ID NO: 321043 - RNA, 16 nt, Bordetella pertussis
agcgcggcaugcgcau

SEQ ID NO: 321044 - RNA, 19 nt, Bordetella pertussis
agcgcggccacggccugcc

SEQ ID NO: 321045 - RNA, 20 nt, Bordetella pertussis
agcgcggccacggccugccc

SEQ ID NO: 321046 - RNA, 17 nt, Bordetella pertussis
agcgcggccagcaccgg

SEQ ID NO: 321047 - RNA, 16 nt, Bordetella pertussis
agcgcggccagcgcgu

SEQ ID NO: 321048 - RNA, 19 nt, Bordetella pertussis
agcgcggccagcgcgucga

SEQ ID NO: 321049 - RNA, 14 nt, Bordetella pertussis
agcgcggccaggcg

SEQ ID NO: 321050 - RNA, 20 nt, Bordetella pertussis
agcgcggccaggucggcguc

SEQ ID NO: 321051 - RNA, 15 nt, Bordetella pertussis
agcgcggcugcgggc

SEQ ID NO: 321052 - RNA, 22 nt, Bordetella pertussis
agcgcggcugcgggccggcgcc

SEQ ID NO: 321053 - RNA, 13 nt, Bordetella pertussis
agcgcggcuuggu

SEQ ID NO: 321054 - RNA, 23 nt, Bordetella pertussis
agcgcggcuugguugucgcgcac

SEQ ID NO: 321055 - RNA, 19 nt, Bordetella pertussis
agcgcgggaagcgcucgcg

SEQ ID NO: 321056 - RNA, 19 nt, Bordetella pertussis
agcgcgggccacugcgccu

SEQ ID NO: 321057 - RNA, 20 nt, Bordetella pertussis
agcgcgucgcguagcgcggc

SEQ ID NO: 321058 - RNA, 12 nt, Bordetella pertussis
agcgcgucggcc

SEQ ID NO: 321059 - RNA, 14 nt, Bordetella pertussis
agcgcgucggccag

SEQ ID NO: 321060 - RNA, 21 nt, Bordetella pertussis
agcgcgucggccagcgccgcg

SEQ ID NO: 321061 - RNA, 13 nt, Bordetella pertussis
agcgcgucggcgc

SEQ ID NO: 321062 - RNA, 15 nt, Bordetella pertussis
agcgcgucggcgccg

SEQ ID NO: 321063 - RNA, 14 nt, Bordetella pertussis
agcgcgucggcgcg

SEQ ID NO: 321064 - RNA, 21 nt, Bordetella pertussis
agcgcgucggccaggcgccag

SEQ ID NO: 321065 - RNA, 16 nt, Bordetella pertussis
agcgcguggccagcac

SEQ ID NO: 321066 - RNA, 19 nt, Bordetella pertussis
agcgcguggccagcacggc

SEQ ID NO: 321067 - RNA, 17 nt, Bordetella pertussis
agcgcguggccaucaac

SEQ ID NO: 321068 - RNA, 16 nt, Bordetella pertussis
agcgcguggccggcga

SEQ ID NO: 321069 - RNA, 22 nt, Bordetella pertussis
agcgcguggccggcgacggcau

SEQ ID NO: 321070 - RNA, 18 nt, Bordetella pertussis
agcgcgugggccagcaac

SEQ ID NO: 321071 - RNA, 20 nt, Bordetella pertussis
agcgcgugggccagcaacug

SEQ ID NO: 321072 - RNA, 17 nt, Bordetella pertussis
agcgcgugggccagucc

SEQ ID NO: 321073 - RNA, 19 nt, Bordetella pertussis
agcgcgugucccagccggc

SEQ ID NO: 321074 - RNA, 21 nt, Bordetella pertussis
agcgcugcgccaacggugcca

SEQ ID NO: 321075 - RNA, 17 nt, Bordetella pertussis
agcgcuggacgcccugg

SEQ ID NO: 321076 - RNA, 21 nt, Bordetella pertussis
agcgcuggacgcccuggcgca

SEQ ID NO: 321077 - RNA, 16 nt, Bordetella pertussis
agcgcuguccaggccg

SEQ ID NO: 321078 - RNA, 17 nt, Bordetella pertussis
agcgcuguccaggccgg

SEQ ID NO: 321079 - RNA, 18 nt, Bordetella pertussis
agcgcugggcgccagcag

SEQ ID NO: 321080 - RNA, 19 nt, Bordetella pertussis
agcgcugggcgccagcagc

SEQ ID NO: 321081 - RNA, 22 nt, Bordetella pertussis
agcgcuggguguagucgcggcc

SEQ ID NO: 321082 - RNA, 17 nt, Bordetella pertussis
agcggaauggggcccgc

SEQ ID NO: 321083 - RNA, 18 nt, Bordetella pertussis
agcggaauggggcccgca

SEQ ID NO: 321084 - RNA, 17 nt, Bordetella pertussis
agcggaauguugccgaa

SEQ ID NO: 321085 - RNA, 16 nt, Bordetella pertussis
agcggacgggccaggc

SEQ ID NO: 321086 - RNA, 12 nt, Bordetella pertussis
agcggagccgcg

SEQ ID NO: 321087 - RNA, 14 nt, Bordetella pertussis
agcggagccgcgca

SEQ ID NO: 321088 - RNA, 16 nt, Bordetella pertussis
agcggagccgcgcaca

SEQ ID NO: 321089 - RNA, 15 nt, Bordetella pertussis
agcggcacgccggcg

SEQ ID NO: 321090 - RNA, 18 nt, Bordetella pertussis
agcggcacgccggcggcc

SEQ ID NO: 321091 - RNA, 18 nt, Bordetella pertussis
agcggcagcacgauggcg

SEQ ID NO: 321092 - RNA, 14 nt, Bordetella pertussis
agcggcagcgcacc

SEQ ID NO: 321093 - RNA, 21 nt, Bordetella pertussis
agcggcagcgcaccgucgcca

SEQ ID NO: 321094 - RNA, 20 nt, Bordetella pertussis
agcggcagcauggcgcgcgg

SEQ ID NO: 321095 - RNA, 14 nt, Bordetella pertussis
agcggcagcgcgca

SEQ ID NO: 321096 - RNA, 15 nt, Bordetella pertussis
agcggcagcucggcg

SEQ ID NO: 321097 - RNA, 16 nt, Bordetella pertussis
agcggcaggcccagcu

SEQ ID NO: 321098 - RNA, 18 nt, Bordetella pertussis
agcggcaggcuggccggc

SEQ ID NO: 321099 - RNA, 20 nt, Bordetella pertussis
agcggcaggggcucgcgccc

SEQ ID NO: 321100 - RNA, 17 nt, Bordetella pertussis
agcggcaucacgccggu

SEQ ID NO: 321101 - RNA, 19 nt, Bordetella pertussis
agcggcauugcccagguug

SEQ ID NO: 321102 - RNA, 10 nt, Bordetella pertussis
agcggccagc

SEQ ID NO: 321103 - RNA, 17 nt, Bordetella pertussis
agcggccagcaagcgcg

SEQ ID NO: 321104 - RNA, 19 nt, Bordetella pertussis
agcggccagcaagcgcgcc

SEQ ID NO: 321105 - RNA, 12 nt, Bordetella pertussis
agcggccagccu

SEQ ID NO: 321106 - RNA, 17 nt, Bordetella pertussis
agcggccagccugccgc

SEQ ID NO: 321107 - RNA, 22 nt, Bordetella pertussis
agcggccagccugccgcggccg

SEQ ID NO: 321108 - RNA, 14 nt, Bordetella pertussis
agcggccagcgcgg

SEQ ID NO: 321109 - RNA, 15 nt, Bordetella pertussis
agcggccagcgcggc

SEQ ID NO: 321110 - RNA, 16 nt, Bordetella pertussis
agcggccagcgcggcg

SEQ ID NO: 321111 - RNA, 14 nt, Bordetella pertussis
agcggccaucgggc

SEQ ID NO: 321112 - RNA, 16 nt, Bordetella pertussis
agcggccaucgggcug

SEQ ID NO: 321113 - RNA, 18 nt, Bordetella pertussis
agcggcccacccggcacg

SEQ ID NO: 321114 - RNA, 14 nt, Bordetella pertussis
agcggccccaggua

SEQ ID NO: 321115 - RNA, 20 nt, Bordetella pertussis
agcggccccagucgcugcuc

SEQ ID NO: 321116 - RNA, 16 nt, Bordetella pertussis
agcggccgcugccgcg

SEQ ID NO: 321117 - RNA, 12 nt, Bordetella pertussis
agcggccggccc

SEQ ID NO: 321118 - RNA, 14 nt, Bordetella pertussis
agcggccggccugc

SEQ ID NO: 321119 - RNA, 11 nt, Bordetella pertussis
agcggccggcg

SEQ ID NO: 321120 - RNA, 17 nt, Bordetella pertussis
agcggccggcgcgcgcg

SEQ ID NO: 321121 - RNA, 14 nt, Bordetella pertussis
agcggcgacggcgc

SEQ ID NO: 321122 - RNA, 14 nt, Bordetella pertussis
agcggcgcggcgcg

SEQ ID NO: 321123 - RNA, 18 nt, Bordetella pertussis
agcggcgcuuaccgcgcc

SEQ ID NO: 321124 - RNA, 16 nt, Bordetella pertussis
agcggcggcacggugg

SEQ ID NO: 321125 - RNA, 13 nt, Bordetella pertussis
agcggcggccgcg

SEQ ID NO: 321126 - RNA, 12 nt, Bordetella pertussis
agcggcggcgcg

SEQ ID NO: 321127 - RNA, 14 nt, Bordetella pertussis
agcggcggcgcggu

SEQ ID NO: 321128 - RNA, 16 nt, Bordetella pertussis
agcgggccugcagcau

SEQ ID NO: 321129 - RNA, 23 nt, Bordetella pertussis
agcgggccugcagcaugaccgac

SEQ ID NO: 321130 - RNA, 13 nt, Bordetella pertussis
agcgggcgccaga

SEQ ID NO: 321131 - RNA, 13 nt, Bordetella pertussis
agcgggcggcggc

SEQ ID NO: 321132 - RNA, 15 nt, Bordetella pertussis
agcgguagccggcgu

SEQ ID NO: 321133 - RNA, 18 nt, Bordetella pertussis
agcgguagggcgauggcg

SEQ ID NO: 321134 - RNA, 23 nt, Bordetella pertussis
agcgguaguccaucgcguccagg

SEQ ID NO: 321135 - RNA, 17 nt, Bordetella pertussis
agcgguauucguugccg

SEQ ID NO: 321136 - RNA, 20 nt, Bordetella pertussis
agcgguccagcugcgcgcga

SEQ ID NO: 321137 - RNA, 21 nt, Bordetella pertussis
agcgguccagcugcgcgcgag

SEQ ID NO: 321138 - RNA, 22 nt, Bordetella pertussis
agcgguccagcugcgcgcgagc

SEQ ID NO: 321139 - RNA, 17 nt, Bordetella pertussis
agcgguccggggcgggc

SEQ ID NO: 321140 - RNA, 17 nt, Bordetella pertussis
agcgguugcgccagcuu

SEQ ID NO: 321141 - RNA, 14 nt, Bordetella pertussis
agcguacgcacgcc

SEQ ID NO: 321142 - RNA, 21 nt, Bordetella pertussis
agcgucaccagcaggcggccg

SEQ ID NO: 321143 - RNA, 18 nt, Bordetella pertussis
agcgucagcacaucgccc

SEQ ID NO: 321144 - RNA, 16 nt, Bordetella pertussis
agcguccaggcggcca

SEQ ID NO: 321145 - RNA, 15 nt, Bordetella pertussis
agcguccgcgcgccg

SEQ ID NO: 321146 - RNA, 19 nt, Bordetella pertussis
agcgucggcuuccaucagg

SEQ ID NO: 321147 - RNA, 14 nt, Bordetella pertussis
agcgucucgcccac

SEQ ID NO: 321148 - RNA, 16 nt, Bordetella pertussis
agcugcgugcgaucgg

SEQ ID NO: 321149 - RNA, 14 nt, Bordetella pertussis
agcugcguggcgac

SEQ ID NO: 321150 - RNA, 22 nt, Bordetella pertussis
agcugcugcuggaccuggccac

SEQ ID NO: 321151 - RNA, 16 nt, Bordetella pertussis
agcugcuggccggccc

SEQ ID NO: 321152 - RNA, 15 nt, Bordetella pertussis
agcugcuggcgcgcc

SEQ ID NO: 321153 - RNA, 15 nt, Bordetella pertussis
agcugcugugcgccg

SEQ ID NO: 321154 - RNA, 19 nt, Bordetella pertussis
agcugcuugcccaggccgg

SEQ ID NO: 321155 - RNA, 22 nt, Bordetella pertussis
agcugcuugcccaggccggcgc

SEQ ID NO: 321156 - RNA, 14 nt, Bordetella pertussis
agcuggaacgcgcc

SEQ ID NO: 321157 - RNA, 22 nt, Bordetella pertussis
agcuggcccaguucggcgacga

SEQ ID NO: 321158 - RNA, 18 nt, Bordetella pertussis
agcuggccgaugucgccg

SEQ ID NO: 321159 - RNA, 13 nt, Bordetella pertussis
agcuggccggcga

SEQ ID NO: 321160 - RNA, 20 nt, Bordetella pertussis
agcuggcgcuuggccagcug

SEQ ID NO: 321161 - RNA, 13 nt, Bordetella pertussis
agcuggcggcgcg

SEQ ID NO: 321162 - RNA, 16 nt, Bordetella pertussis
agcuggcggcgcgcgg

SEQ ID NO: 321163 - RNA, 19 nt, Bordetella pertussis
agcuggcguucgucgccuc

SEQ ID NO: 321164 - RNA, 13 nt, Bordetella pertussis
agcugggcggcgu

SEQ ID NO: 321165 - RNA, 14 nt, Bordetella pertussis
agcugggcggcgug

SEQ ID NO: 321166 - RNA, 23 nt, Bordetella pertussis
agcuggggcgucccggugaucgu

SEQ ID NO: 321167 - RNA, 18 nt, Bordetella pertussis
agcuggugauggugucga

SEQ ID NO: 321168 - RNA, 21 nt, Bordetella pertussis
agcuggugccgguugcgcgcc

SEQ ID NO: 321169 - RNA, 22 nt, Bordetella pertussis
agcuguagcgguagccggcgug

SEQ ID NO: 321170 - RNA, 17 nt, Bordetella pertussis
agcugugguaggccgau

SEQ ID NO: 321171 - RNA, 19 nt, Bordetella pertussis
agcuucuaucugccgcgca

SEQ ID NO: 321172 - RNA, 20 nt, Bordetella pertussis
agcuucuggaucaccgccgg

SEQ ID NO: 321173 - RNA, 23 nt, Bordetella pertussis
agcuucuucuuugcccuggccac

SEQ ID NO: 321174 - RNA, 17 nt, Bordetella pertussis
agcuucuugaacucggc

SEQ ID NO: 321175 - RNA, 21 nt, Bordetella pertussis
agcuugaccgccuccaggaug

SEQ ID NO: 321176 - RNA, 20 nt, Bordetella pertussis
agcuugaccuugagcacgcu

SEQ ID NO: 321177 - RNA, 19 nt, Bordetella pertussis
agcuugagcgaaugcgcgu

SEQ ID NO: 321178 - RNA, 14 nt, Bordetella pertussis
agcuugcaggcgcc

SEQ ID NO: 321179 - RNA, 23 nt, Bordetella pertussis
agcuugccgcucaauucggccug

SEQ ID NO: 321180 - RNA, 12 nt, Bordetella pertussis
agcuugcgcgcc

SEQ ID NO: 321181 - RNA, 20 nt, Bordetella pertussis
agcuuggccaccacgcccau

SEQ ID NO: 321182 - RNA, 14 nt, Bordetella pertussis
agcuuggcgcgcgg

SEQ ID NO: 321183 - RNA, 23 nt, Bordetella pertussis
agcuugucgaucgccaccagcgu

SEQ ID NO: 321184 - RNA, 15 nt, Bordetella pertussis
agcuugucggccgcg

SEQ ID NO: 321185 - RNA, 15 nt, Bordetella pertussis
aggaaaaagccucgc

SEQ ID NO: 321186 - RNA, 19 nt, Bordetella pertussis
aggaaaaccggcgccuggc

SEQ ID NO: 321187 - RNA, 15 nt, Bordetella pertussis
aggaaagcggccugu

SEQ ID NO: 321188 - RNA, 15 nt, Bordetella pertussis
aggaacagcaacgcc

SEQ ID NO: 321189 - RNA, 17 nt, Bordetella pertussis
aggaacagcgccggcag

SEQ ID NO: 321190 - RNA, 15 nt, Bordetella pertussis
aggaacaggcugcgc

SEQ ID NO: 321191 - RNA, 19 nt, Bordetella pertussis
aggaacauguccaccagcc

SEQ ID NO: 321192 - RNA, 17 nt, Bordetella pertussis
aggaacauguucacgcc

SEQ ID NO: 321193 - RNA, 18 nt, Bordetella pertussis
aggaaccagccgucggca

SEQ ID NO: 321194 - RNA, 21 nt, Bordetella pertussis
aggaacgcaagcccggcacgg

SEQ ID NO: 321195 - RNA, 13 nt, Bordetella pertussis
aggaacgccagca

SEQ ID NO: 321196 - RNA, 13 nt, Bordetella pertussis
aggaacgccgcgc

SEQ ID NO: 321197 - RNA, 17 nt, Bordetella pertussis
aggaacuccggcggcgc

SEQ ID NO: 321198 - RNA, 19 nt, Bordetella pertussis
aggaacuccggcggcgcau

SEQ ID NO: 321199 - RNA, 17 nt, Bordetella pertussis
aggaacugggcgccggc

SEQ ID NO: 321200 - RNA, 20 nt, Bordetella pertussis
aggaagcagcccagcacgac

SEQ ID NO: 321201 - RNA, 15 nt, Bordetella pertussis
aggaagcgcgccgcg

SEQ ID NO: 321202 - RNA, 18 nt, Bordetella pertussis
aggaagcgcuggcccguc

SEQ ID NO: 321203 - RNA, 15 nt, Bordetella pertussis
aggaagcggcgcacc

SEQ ID NO: 321204 - RNA, 19 nt, Bordetella pertussis
aggaaggccgccgcgugcg

SEQ ID NO: 321205 - RNA, 20 nt, Bordetella pertussis
aggaaggccgccgcgugcgc

SEQ ID NO: 321206 - RNA, 20 nt, Bordetella pertussis
aggaagggugcggcgccacu

SEQ ID NO: 321207 - RNA, 14 nt, Bordetella pertussis
aggaagucggucag

SEQ ID NO: 321208 - RNA, 23 nt, Bordetella pertussis
aggaaguugcccaccgacaugac

SEQ ID NO: 321209 - RNA, 14 nt, Bordetella pertussis
aggacaaggcgcgc

SEQ ID NO: 321210 - RNA, 12 nt, Bordetella pertussis
aggacagcccca

SEQ ID NO: 321211 - RNA, 18 nt, Bordetella pertussis
aggaccgaggugccagcc

SEQ ID NO: 321212 - RNA, 20 nt, Bordetella pertussis
aggaccgaggugccagccug

SEQ ID NO: 321213 - RNA, 14 nt, Bordetella pertussis
aggaccucgcgccg

SEQ ID NO: 321214 - RNA, 18 nt, Bordetella pertussis
aggaccucgcgccgguca

SEQ ID NO: 321215 - RNA, 15 nt, Bordetella pertussis
aggacgaacaggccg

SEQ ID NO: 321216 - RNA, 20 nt, Bordetella pertussis
aggacgaacaggccgccgua

SEQ ID NO: 321217 - RNA, 22 nt, Bordetella pertussis
aggacgaccaacucgaggcggc

SEQ ID NO: 321218 - RNA, 11 nt, Bordetella pertussis
aggacgacgau

SEQ ID NO: 321219 - RNA, 11 nt, Bordetella pertussis
aggacgccggc

SEQ ID NO: 321220 - RNA, 12 nt, Bordetella pertussis
aggacgccggcg

SEQ ID NO: 321221 - RNA, 13 nt, Bordetella pertussis
aggacgccggcgc

SEQ ID NO: 321222 - RNA, 14 nt, Bordetella pertussis
aggacggcgccguc

SEQ ID NO: 321223 - RNA, 20 nt, Bordetella pertussis
aggacggggaacaggcgcgc

SEQ ID NO: 321224 - RNA, 15 nt, Bordetella pertussis
aggagccggcgggcg

SEQ ID NO: 321225 - RNA, 15 nt, Bordetella pertussis
aggaggugcgccgcu

SEQ ID NO: 321226 - RNA, 23 nt, Bordetella pertussis
aggagguggcuggugccaguccc

SEQ ID NO: 321227 - RNA, 21 nt, Bordetella pertussis
aggauaccggagcggcucgcc

SEQ ID NO: 321228 - RNA, 14 nt, Bordetella pertussis
aggaucaccgccgc

SEQ ID NO: 321229 - RNA, 20 nt, Bordetella pertussis
aggaucaccgccgcgccgcu

SEQ ID NO: 321230 - RNA, 15 nt, Bordetella pertussis
aggaucaaggcccgg

SEQ ID NO: 321231 - RNA, 14 nt, Bordetella pertussis
aggaucccggcgcc

SEQ ID NO: 321232 - RNA, 17 nt, Bordetella pertussis
aggaucgaaggcagcgc

SEQ ID NO: 321233 - RNA, 15 nt, Bordetella pertussis
aggaucgcggccagc

SEQ ID NO: 321234 - RNA, 12 nt, Bordetella pertussis
aggaucgcggcc

SEQ ID NO: 321235 - RNA, 22 nt, Bordetella pertussis
aggaugcccuggguggcggggc

SEQ ID NO: 321236 - RNA, 11 nt, Bordetella pertussis
aggaugcccuu

SEQ ID NO: 321237 - RNA, 15 nt, Bordetella pertussis
aggcaaaggcccagg

SEQ ID NO: 321238 - RNA, 16 nt, Bordetella pertussis
aggcaaaggcccaggc

SEQ ID NO: 321239 - RNA, 18 nt, Bordetella pertussis
aggcaagcugcuggcgcg

SEQ ID NO: 321240 - RNA, 22 nt, Bordetella pertussis
aggcaagcugcuggcgcgccag

SEQ ID NO: 321241 - RNA, 17 nt, Bordetella pertussis
aggcaaucagccccagg

SEQ ID NO: 321242 - RNA, 15 nt, Bordetella pertussis
aggcacaccacgcga

SEQ ID NO: 321243 - RNA, 22 nt, Bordetella pertussis
aggcacacccuccuacgccaug

SEQ ID NO: 321244 - RNA, 22 nt, Bordetella pertussis
aggcacaccggucuacgccaug

SEQ ID NO: 321245 - RNA, 20 nt, Bordetella pertussis
aggcacaccgugccgcagau

SEQ ID NO: 321246 - RNA, 21 nt, Bordetella pertussis
aggcaccccgucaugcgccau

SEQ ID NO: 321247 - RNA, 15 nt, Bordetella pertussis
aggcacccgcgcgca

SEQ ID NO: 321248 - RNA, 22 nt, Bordetella pertussis
aggcacccugucauacgccaug

SEQ ID NO: 321249 - RNA, 23 nt, Bordetella pertussis
aggcacccugucauacgccauga

SEQ ID NO: 321250 - RNA, 21 nt, Bordetella pertussis
aggcacuccggauaccgccgc

SEQ ID NO: 321251 - RNA, 22 nt, Bordetella pertussis
aggcacuccggauaccgccgcc

SEQ ID NO: 321252 - RNA, 16 nt, Bordetella pertussis
aggcacuggcgcggcg

SEQ ID NO: 321253 - RNA, 15 nt, Bordetella pertussis
aggcagcaccgccac

SEQ ID NO: 321254 - RNA, 18 nt, Bordetella pertussis
aggcagcaggcugccgcc

SEQ ID NO: 321255 - RNA, 22 nt, Bordetella pertussis
aggcagcaggcugccgccggcg

SEQ ID NO: 321256 - RNA, 13 nt, Bordetella pertussis
aggcagccggccc

SEQ ID NO: 321257 - RNA, 17 nt, Bordetella pertussis
aggcagcgcggccggca

SEQ ID NO: 321258 - RNA, 11 nt, Bordetella pertussis
aggcagcggcc

SEQ ID NO: 321259 - RNA, 15 nt, Bordetella pertussis
aggcagcggccgcgc

SEQ ID NO: 321260 - RNA, 20 nt, Bordetella pertussis
aggcagcggccgcgcgggcg

SEQ ID NO: 321261 - RNA, 14 nt, Bordetella pertussis
aggcagcugcgcgu

SEQ ID NO: 321262 - RNA, 14 nt, Bordetella pertussis
aggcaggcgggccc

SEQ ID NO: 321263 - RNA, 23 nt, Bordetella pertussis
aggcaguuggcggcgcagccgcc

SEQ ID NO: 321264 - RNA, 21 nt, Bordetella pertussis
aggcauacaggcuguggccgc

SEQ ID NO: 321265 - RNA, 15 nt, Bordetella pertussis
aggcaucgaccagcg

SEQ ID NO: 321266 - RNA, 19 nt, Bordetella pertussis
aggcaucgaccagcgcacg

SEQ ID NO: 321267 - RNA, 22 nt, Bordetella pertussis
aggccaccccguugcagcccag

SEQ ID NO: 321268 - RNA, 17 nt, Bordetella pertussis
aggccaccgacggcgcg

SEQ ID NO: 321269 - RNA, 20 nt, Bordetella pertussis
aggccaccgcggugccgcgc

SEQ ID NO: 321270 - RNA, 21 nt, Bordetella pertussis
aggccaccgcggugccgcgcg

SEQ ID NO: 321271 - RNA, 13 nt, Bordetella pertussis
aggccacgcgcgg

SEQ ID NO: 321272 - RNA, 17 nt, Bordetella pertussis
aggccagcacgccggcc

SEQ ID NO: 321273 - RNA, 12 nt, Bordetella pertussis
aggccagcagcu

SEQ ID NO: 321274 - RNA, 13 nt, Bordetella pertussis
aggccagcagcuc

SEQ ID NO: 321275 - RNA, 15 nt, Bordetella pertussis
aggccagcccgcgcg

SEQ ID NO: 321276 - RNA, 17 nt, Bordetella pertussis
aggccagcccgcgcgcg

SEQ ID NO: 321277 - RNA, 22 nt, Bordetella pertussis
aggccagcgccgcggccggcgg

SEQ ID NO: 321278 - RNA, 15 nt, Bordetella pertussis
aggccccgcgaccca

SEQ ID NO: 321279 - RNA, 21 nt, Bordetella pertussis
aggccccggcccggcgggccg

SEQ ID NO: 321280 - RNA, 15 nt, Bordetella pertussis
aggcccgacaggauc

SEQ ID NO: 321281 - RNA, 21 nt, Bordetella pertussis
aggcccgccacggcgcccgag

SEQ ID NO: 321282 - RNA, 18 nt, Bordetella pertussis
aggcccgcgcggccagcg

SEQ ID NO: 321283 - RNA, 15 nt, Bordetella pertussis
aggcccgcggccgcg

SEQ ID NO: 321284 - RNA, 21 nt, Bordetella pertussis
aggcccgcggcgccagcgcuu

SEQ ID NO: 321285 - RNA, 13 nt, Bordetella pertussis
aggcccggccugc

SEQ ID NO: 321286 - RNA, 18 nt, Bordetella pertussis
aggcccgggcgccugcgc

SEQ ID NO: 321287 - RNA, 15 nt, Bordetella pertussis
aggcccuccggcgcc

SEQ ID NO: 321288 - RNA, 17 nt, Bordetella pertussis
aggcccguguagacggc

SEQ ID NO: 321289 - RNA, 15 nt, Bordetella pertussis
aggccgaggccaggu

SEQ ID NO: 321290 - RNA, 16 nt, Bordetella pertussis
aggccgaggcugcgcg

SEQ ID NO: 321291 - RNA, 15 nt, Bordetella pertussis
aggccgaguggccgc

SEQ ID NO: 321292 - RNA, 22 nt, Bordetella pertussis
aggccgaguggccgcuguucgg

SEQ ID NO: 321293 - RNA, 18 nt, Bordetella pertussis
aggccgaguagcggcgca

SEQ ID NO: 321294 - RNA, 18 nt, Bordetella pertussis
aggccgaugaauugcgcc

SEQ ID NO: 321295 - RNA, 20 nt, Bordetella pertussis
aggccgaugaauugcgccac

SEQ ID NO: 321296 - RNA, 17 nt, Bordetella pertussis
aggccgaucagcgacag

SEQ ID NO: 321297 - RNA, 23 nt, Bordetella pertussis
aggccgauggcguccagcagcag

SEQ ID NO: 321298 - RNA, 17 nt, Bordetella pertussis
aggccgauucgccgugg

SEQ ID NO: 321299 - RNA, 22 nt, Bordetella pertussis
aggccgauuucggccgccggcg

SEQ ID NO: 321300 - RNA, 13 nt, Bordetella pertussis
aggccucggccac

SEQ ID NO: 321301 - RNA, 16 nt, Bordetella pertussis
aggccucggccaccug

SEQ ID NO: 321302 - RNA, 20 nt, Bordetella pertussis
aggccucggcuccgccauug

SEQ ID NO: 321303 - RNA, 19 nt, Bordetella pertussis
aggccugccugauggcgcg

SEQ ID NO: 321304 - RNA, 14 nt, Bordetella pertussis
aggccugcggcgcc

SEQ ID NO: 321305 - RNA, 17 nt, Bordetella pertussis
aggccugcggcgccagc

SEQ ID NO: 321306 - RNA, 18 nt, Bordetella pertussis
aggccugcggcgccagcg

SEQ ID NO: 321307 - RNA, 19 nt, Bordetella pertussis
aggccugcggcgccagcgc

SEQ ID NO: 321308 - RNA, 13 nt, Bordetella pertussis
aggccugcgggug

SEQ ID NO: 321309 - RNA, 20 nt, Bordetella pertussis
aggccuggcuuggcggccag

SEQ ID NO: 321310 - RNA, 21 nt, Bordetella pertussis
aggccuggucgagcgggcgcc

SEQ ID NO: 321311 - RNA, 14 nt, Bordetella pertussis
aggccuuccaccag

SEQ ID NO: 321312 - RNA, 14 nt, Bordetella pertussis
aggccuugccgccg

SEQ ID NO: 321313 - RNA, 20 nt, Bordetella pertussis
aggccuuggccugggccgac

SEQ ID NO: 321314 - RNA, 23 nt, Bordetella pertussis
aggccuucgcgguaggacggcag

SEQ ID NO: 321315 - RNA, 20 nt, Bordetella pertussis
aggccuuucucaaggccgaa

SEQ ID NO: 321316 - RNA, 12 nt, Bordetella pertussis
aggcgaaacgcc

SEQ ID NO: 321317 - RNA, 15 nt, Bordetella pertussis
aggcgaaccuggcgg

SEQ ID NO: 321318 - RNA, 15 nt, Bordetella pertussis
aggcgaauccgcaac

SEQ ID NO: 321319 - RNA, 14 nt, Bordetella pertussis
aggcgagcgccgcg

SEQ ID NO: 321320 - RNA, 16 nt, Bordetella pertussis
aggcgagcggcgucgc

SEQ ID NO: 321321 - RNA, 19 nt, Bordetella pertussis
aggcgcaccagcgcgccga

SEQ ID NO: 321322 - RNA, 21 nt, Bordetella pertussis
aggcgcaccagcgcgccgauc

SEQ ID NO: 321323 - RNA, 21 nt, Bordetella pertussis
aggcgcaccucguaaguggcg

SEQ ID NO: 321324 - RNA, 15 nt, Bordetella pertussis
aggcgcacggcggca

SEQ ID NO: 321325 - RNA, 15 nt, Bordetella pertussis
aggcgcagcaggcca

SEQ ID NO: 321326 - RNA, 14 nt, Bordetella pertussis
aggcgcagcgcggc

SEQ ID NO: 321327 - RNA, 16 nt, Bordetella pertussis
aggcgcagcgcggcac

SEQ ID NO: 321328 - RNA, 13 nt, Bordetella pertussis
aggcgcagcggcg

SEQ ID NO: 321329 - RNA, 18 nt, Bordetella pertussis
aggcgcagcggcggcgcg

SEQ ID NO: 321330 - RNA, 19 nt, Bordetella pertussis
aggcgcagcggcggcgcgg

SEQ ID NO: 321331 - RNA, 13 nt, Bordetella pertussis
aggcgcaggccga

SEQ ID NO: 321332 - RNA, 14 nt, Bordetella pertussis
aggcgcaggccgac

SEQ ID NO: 321333 - RNA, 17 nt, Bordetella pertussis
aggcgcaggccgacgcg

SEQ ID NO: 321334 - RNA, 16 nt, Bordetella pertussis
aggcgcaggccgcgcg

SEQ ID NO: 321335 - RNA, 18 nt, Bordetella pertussis
aggcgcaggccgcgcgca

SEQ ID NO: 321336 - RNA, 14 nt, Bordetella pertussis
aggcgcagccgcgc

SEQ ID NO: 321337 - RNA, 12 nt, Bordetella pertussis
aggcgcagcgca

SEQ ID NO: 321338 - RNA, 15 nt, Bordetella pertussis
aggcgcaguccagcg

SEQ ID NO: 321339 - RNA, 23 nt, Bordetella pertussis
aggcgcaucagcuuggccaccac

SEQ ID NO: 321340 - RNA, 20 nt, Bordetella pertussis
aggcgcaucgacagcgcgcc

SEQ ID NO: 321341 - RNA, 21 nt, Bordetella pertussis
aggcgcaucgacagcgcgccc

SEQ ID NO: 321342 - RNA, 22 nt, Bordetella pertussis
aggcgccgcucagcgcggcgcg

SEQ ID NO: 321343 - RNA, 12 nt, Bordetella pertussis
aggcgccggccu

SEQ ID NO: 321344 - RNA, 22 nt, Bordetella pertussis
aggcgccggcgccgggcagccc

SEQ ID NO: 321345 - RNA, 22 nt, Bordetella pertussis
aggcgccggcuggcaugcggcg

SEQ ID NO: 321346 - RNA, 16 nt, Bordetella pertussis
aggcgccgggccgcua

SEQ ID NO: 321347 - RNA, 12 nt, Bordetella pertussis
aggcgccgucga

SEQ ID NO: 321348 - RNA, 21 nt, Bordetella pertussis
aggcgccuacaguuccaccug

SEQ ID NO: 321349 - RNA, 17 nt, Bordetella pertussis
aggcgccugccccgccg

SEQ ID NO: 321350 - RNA, 16 nt, Bordetella pertussis
aggcgccuucggcgcg

SEQ ID NO: 321351 - RNA, 19 nt, Bordetella pertussis
aggcgccuucggcgcggcg

SEQ ID NO: 321352 - RNA, 14 nt, Bordetella pertussis
aggcgcgagcgccg

SEQ ID NO: 321353 - RNA, 16 nt, Bordetella pertussis
aggcgcgcaccagccc

SEQ ID NO: 321354 - RNA, 17 nt, Bordetella pertussis
aggcgcgcagcacgccg

SEQ ID NO: 321355 - RNA, 18 nt, Bordetella pertussis
aggcgcgcaggcgggccu

SEQ ID NO: 321356 - RNA, 19 nt, Bordetella pertussis
aggcgcgcaucgcgcggca

SEQ ID NO: 321357 - RNA, 22 nt, Bordetella pertussis
aggcgcgcaucgcgcggcaugg

SEQ ID NO: 321358 - RNA, 13 nt, Bordetella pertussis
aggcgcgccagcc

SEQ ID NO: 321359 - RNA, 18 nt, Bordetella pertussis
aggcgcgccagcccgccg

SEQ ID NO: 321360 - RNA, 16 nt, Bordetella pertussis
aggcgcgccagccgcg

SEQ ID NO: 321361 - RNA, 11 nt, Bordetella pertussis
aggcgcgccau

SEQ ID NO: 321362 - RNA, 14 nt, Bordetella pertussis
aggcgcgcccgcgu

SEQ ID NO: 321363 - RNA, 16 nt, Bordetella pertussis
aggcgcgccgcgaugg

SEQ ID NO: 321364 - RNA, 20 nt, Bordetella pertussis
aggcgcgccgcgauggcgcc

SEQ ID NO: 321365 - RNA, 22 nt, Bordetella pertussis
aggcgcgccgcgauggcgccgg

SEQ ID NO: 321366 - RNA, 18 nt, Bordetella pertussis
aggcgcgcgcaucggccg

SEQ ID NO: 321367 - RNA, 11 nt, Bordetella pertussis
aggcgcgcgcc

SEQ ID NO: 321368 - RNA, 15 nt, Bordetella pertussis
aggcgcgcgccaucg

SEQ ID NO: 321369 - RNA, 15 nt, Bordetella pertussis
aggcggcaagcggcg

SEQ ID NO: 321370 - RNA, 17 nt, Bordetella pertussis
aggcggcaagcggcgug

SEQ ID NO: 321371 - RNA, 14 nt, Bordetella pertussis
aggcggcaggcgcc

SEQ ID NO: 321372 - RNA, 17 nt, Bordetella pertussis
aggcggcaggcgccgcc

SEQ ID NO: 321373 - RNA, 19 nt, Bordetella pertussis
aggcggcaggcgccgccgc

SEQ ID NO: 321374 - RNA, 13 nt, Bordetella pertussis
aggcggccaccac

SEQ ID NO: 321375 - RNA, 16 nt, Bordetella pertussis
aggcggccagcaugcu

SEQ ID NO: 321376 - RNA, 12 nt, Bordetella pertussis
aggcggccaggc

SEQ ID NO: 321377 - RNA, 14 nt, Bordetella pertussis
aggcggccaggccg

SEQ ID NO: 321378 - RNA, 15 nt, Bordetella pertussis
aggcggccaggccga

SEQ ID NO: 321379 - RNA, 20 nt, Bordetella pertussis
aggcggccaggcucugggcg

SEQ ID NO: 321380 - RNA, 13 nt, Bordetella pertussis
aggcggccagggc

SEQ ID NO: 321381 - RNA, 23 nt, Bordetella pertussis
aggcggccagggccugcgggccg

SEQ ID NO: 321382 - RNA, 22 nt, Bordetella pertussis
aggcggccaucgccgccacgug

SEQ ID NO: 321383 - RNA, 12 nt, Bordetella pertussis
aggcggcccagg

SEQ ID NO: 321384 - RNA, 14 nt, Bordetella pertussis
aggcggcccaggcg

SEQ ID NO: 321385 - RNA, 23 nt, Bordetella pertussis
aggcggcccggccgccgccggca

SEQ ID NO: 321386 - RNA, 13 nt, Bordetella pertussis
aggcggccgcgcc

SEQ ID NO: 321387 - RNA, 17 nt, Bordetella pertussis
aggcggccgcgcccgca

SEQ ID NO: 321388 - RNA, 20 nt, Bordetella pertussis
aggcggccgcgggcggcgcg

SEQ ID NO: 321389 - RNA, 22 nt, Bordetella pertussis
aggcggccgcgggcggcgcgcc

SEQ ID NO: 321390 - RNA, 18 nt, Bordetella pertussis
aggcggccggcaggccgg

SEQ ID NO: 321391 - RNA, 12 nt, Bordetella pertussis
aggcggcgacga

SEQ ID NO: 321392 - RNA, 18 nt, Bordetella pertussis
aggcggcgcaggccagcg

SEQ ID NO: 321393 - RNA, 19 nt, Bordetella pertussis
aggcggcgcaucagcgcgc

SEQ ID NO: 321394 - RNA, 13 nt, Bordetella pertussis
aggcggcgcgccc

SEQ ID NO: 321395 - RNA, 20 nt, Bordetella pertussis
aggcggcgcucgaaggcgcc

SEQ ID NO: 321396 - RNA, 19 nt, Bordetella pertussis
aggcggcggugccagcgca

SEQ ID NO: 321397 - RNA, 23 nt, Bordetella pertussis
aggcggcuggugccgacggcgcg

SEQ ID NO: 321398 - RNA, 19 nt, Bordetella pertussis
aggcguacgaggaccugug

SEQ ID NO: 321399 - RNA, 13 nt, Bordetella pertussis
aggcguccagccc

SEQ ID NO: 321400 - RNA, 15 nt, Bordetella pertussis
aggcguccagccccu

SEQ ID NO: 321401 - RNA, 13 nt, Bordetella pertussis
aggcgucggccag

SEQ ID NO: 321402 - RNA, 17 nt, Bordetella pertussis
aggcgucggccagcgcg

SEQ ID NO: 321403 - RNA, 18 nt, Bordetella pertussis
aggcgucggccaggccga

SEQ ID NO: 321404 - RNA, 18 nt, Bordetella pertussis
aggcgucgggcacguccg

SEQ ID NO: 321405 - RNA, 17 nt, Bordetella pertussis
aggcucaggcggccagg

SEQ ID NO: 321406 - RNA, 16 nt, Bordetella pertussis
aggcucccgcuggcgg

SEQ ID NO: 321407 - RNA, 19 nt, Bordetella pertussis
aggcucccgcuggcggcac

SEQ ID NO: 321408 - RNA, 15 nt, Bordetella pertussis
aggcugaccagcgcg

SEQ ID NO: 321409 - RNA, 17 nt, Bordetella pertussis
aggcugaccagcgcguc

SEQ ID NO: 321410 - RNA, 16 nt, Bordetella pertussis
aggcugaaugccgccg

SEQ ID NO: 321411 - RNA, 20 nt, Bordetella pertussis
aggcugggcgaaacggccag

SEQ ID NO: 321412 - RNA, 20 nt, Bordetella pertussis
aggcuggggccgagcgugcc

SEQ ID NO: 321413 - RNA, 18 nt, Bordetella pertussis
aggcuucgauggcggcgg

SEQ ID NO: 321414 - RNA, 14 nt, Bordetella pertussis
aggcuucgcccgcc

SEQ ID NO: 321415 - RNA, 19 nt, Bordetella pertussis
agggccagguaaugaucgc

SEQ ID NO: 321416 - RNA, 20 nt, Bordetella pertussis
agggccauggcagggcgccg

SEQ ID NO: 321417 - RNA, 12 nt, Bordetella pertussis
agggcccagcug

SEQ ID NO: 321418 - RNA, 20 nt, Bordetella pertussis
agggccccccggcgcggccg

SEQ ID NO: 321419 - RNA, 21 nt, Bordetella pertussis
agggccccccggcgcggccgg

SEQ ID NO: 321420 - RNA, 18 nt, Bordetella pertussis
agggcccggacgcggccg

SEQ ID NO: 321421 - RNA, 12 nt, Bordetella pertussis
agggccgccagg

SEQ ID NO: 321422 - RNA, 23 nt, Bordetella pertussis
agggccgccagggcggcugccga

SEQ ID NO: 321423 - RNA, 21 nt, Bordetella pertussis
agggccgcccagucguccagc

SEQ ID NO: 321424 - RNA, 14 nt, Bordetella pertussis
agggccgccgcgcc

SEQ ID NO: 321425 - RNA, 19 nt, Bordetella pertussis
agggccgccgcgcccagcc

SEQ ID NO: 321426 - RNA, 14 nt, Bordetella pertussis
agggccgcgcgauc

SEQ ID NO: 321427 - RNA, 15 nt, Bordetella pertussis
agggccggaacagcg

SEQ ID NO: 321428 - RNA, 13 nt, Bordetella pertussis
agggccugcgggc

SEQ ID NO: 321429 - RNA, 18 nt, Bordetella pertussis
agggccuggaagcuggcc

SEQ ID NO: 321430 - RNA, 22 nt, Bordetella pertussis
agggccuggaagcuggccagcg

SEQ ID NO: 321431 - RNA, 18 nt, Bordetella pertussis
agggccuggcacaucggc

SEQ ID NO: 321432 - RNA, 21 nt, Bordetella pertussis
agggcgaacgggguggccggc

SEQ ID NO: 321433 - RNA, 14 nt, Bordetella pertussis
agggcgaaggccag

SEQ ID NO: 321434 - RNA, 16 nt, Bordetella pertussis
agggcgacggcggcgu

SEQ ID NO: 321435 - RNA, 22 nt, Bordetella pertussis
agggcgaugcgguaccacgcga

SEQ ID NO: 321436 - RNA, 15 nt, Bordetella pertussis
agggcgauggcgcgu

SEQ ID NO: 321437 - RNA, 17 nt, Bordetella pertussis
agggcgauuccgccaac

SEQ ID NO: 321438 - RNA, 12 nt, Bordetella pertussis
agggcgcgccag

SEQ ID NO: 321439 - RNA, 16 nt, Bordetella pertussis
agggcgcggccagggu

SEQ ID NO: 321440 - RNA, 15 nt, Bordetella pertussis
agggcggccggcacg

SEQ ID NO: 321441 - RNA, 18 nt, Bordetella pertussis
agggcggcgucgaucggc

SEQ ID NO: 321442 - RNA, 16 nt, Bordetella pertussis
agggcggugggcagcg

SEQ ID NO: 321443 - RNA, 22 nt, Bordetella pertussis
agggcggugggcagcgcgucga

SEQ ID NO: 321444 - RNA, 14 nt, Bordetella pertussis
agggcggugcgcuc

SEQ ID NO: 321445 - RNA, 14 nt, Bordetella pertussis
agggcgucaucggc

SEQ ID NO: 321446 - RNA, 20 nt, Bordetella pertussis
agggcgucgcgaugcgccag

SEQ ID NO: 321447 - RNA, 14 nt, Bordetella pertussis
agggcgucgcggcg

SEQ ID NO: 321448 - RNA, 12 nt, Bordetella pertussis
agggcgucggcg

SEQ ID NO: 321449 - RNA, 18 nt, Bordetella pertussis
agggcgucggcgacguga

SEQ ID NO: 321450 - RNA, 19 nt, Bordetella pertussis
agggcgucggcgacgugau

SEQ ID NO: 321451 - RNA, 17 nt, Bordetella pertussis
agggcgucuucgccgac

SEQ ID NO: 321452 - RNA, 13 nt, Bordetella pertussis
agggcguggcgcg

SEQ ID NO: 321453 - RNA, 14 nt, Bordetella pertussis
agggcuccaggcug

SEQ ID NO: 321454 - RNA, 21 nt, Bordetella pertussis
agggcuccaggcugagcguga

SEQ ID NO: 321455 - RNA, 23 nt, Bordetella pertussis
agggcugcacgauguugccgccg

SEQ ID NO: 321456 - RNA, 23 nt, Bordetella pertussis
agggcugcccucgcccgugcgcg

SEQ ID NO: 321457 - RNA, 20 nt, Bordetella pertussis
agggcuuccaguucgcgcag

SEQ ID NO: 321458 - RNA, 14 nt, Bordetella pertussis
agggcuugcggcgc

SEQ ID NO: 321459 - RNA, 16 nt, Bordetella pertussis
agggcuugcggcgcug

SEQ ID NO: 321460 - RNA, 16 nt, Bordetella pertussis
aggggauugccgcgcg

SEQ ID NO: 321461 - RNA, 21 nt, Bordetella pertussis
aggggcaggugccccacgccg

SEQ ID NO: 321462 - RNA, 15 nt, Bordetella pertussis
aggggcaugccggca

SEQ ID NO: 321463 - RNA, 12 nt, Bordetella pertussis
aggggccagccu

SEQ ID NO: 321464 - RNA, 23 nt, Bordetella pertussis
aggggccagccuggcgccaaccc

SEQ ID NO: 321465 - RNA, 14 nt, Bordetella pertussis
aggggccgcacgcg

SEQ ID NO: 321466 - RNA, 20 nt, Bordetella pertussis
aggggccggcgcgccgcgcc

SEQ ID NO: 321467 - RNA, 16 nt, Bordetella pertussis
aggggcgggugcggau

SEQ ID NO: 321468 - RNA, 18 nt, Bordetella pertussis
agggucagcggccggccc

SEQ ID NO: 321469 - RNA, 21 nt, Bordetella pertussis
agggucugcuggucgcgggcc

SEQ ID NO: 321470 - RNA, 15 nt, Bordetella pertussis
agggucuggcggccg

SEQ ID NO: 321471 - RNA, 14 nt, Bordetella pertussis
agggugaccuggcg

SEQ ID NO: 321472 - RNA, 13 nt, Bordetella pertussis
agggugagugccc

SEQ ID NO: 321473 - RNA, 15 nt, Bordetella pertussis
agggugucggccagg

SEQ ID NO: 321474 - RNA, 22 nt, Bordetella pertussis
agggugucggccagggcggcga

SEQ ID NO: 321475 - RNA, 14 nt, Bordetella pertussis
aggguguugccgag

SEQ ID NO: 321476 - RNA, 17 nt, Bordetella pertussis
aggguuauuuccggccg

SEQ ID NO: 321477 - RNA, 18 nt, Bordetella pertussis
aggguuauuuccggccgc

SEQ ID NO: 321478 - RNA, 19 nt, Bordetella pertussis
aggguuauuuccggccgca

SEQ ID NO: 321479 - RNA, 20 nt, Bordetella pertussis
aggguugcaguucgccggcg

SEQ ID NO: 321480 - RNA, 23 nt, Bordetella pertussis
agguaucgacccaggccggcgcc

SEQ ID NO: 321481 - RNA, 20 nt, Bordetella pertussis
agguaugcacgaccaggccg

SEQ ID NO: 321482 - RNA, 19 nt, Bordetella pertussis
agguauugcggggcggcgu

SEQ ID NO: 321483 - RNA, 13 nt, Bordetella pertussis
agguccaggcgcg

SEQ ID NO: 321484 - RNA, 19 nt, Bordetella pertussis
agguccaugaacgccgcgc

SEQ ID NO: 321485 - RNA, 16 nt, Bordetella pertussis
agguccggucgcgcgu

SEQ ID NO: 321486 - RNA, 18 nt, Bordetella pertussis
agguccggucgcgcgugc

SEQ ID NO: 321487 - RNA, 18 nt, Bordetella pertussis
agguccugcacgcgggcc

SEQ ID NO: 321488 - RNA, 17 nt, Bordetella pertussis
agguccugcgccagcuu

SEQ ID NO: 321489 - RNA, 12 nt, Bordetella pertussis
agguccuggaga

SEQ ID NO: 321490 - RNA, 15 nt, Bordetella pertussis
agguccuggcggccg

SEQ ID NO: 321491 - RNA, 23 nt, Bordetella pertussis
aggucgcgcgacgugucggccac

SEQ ID NO: 321492 - RNA, 12 nt, Bordetella pertussis
aggucgcgcgua

SEQ ID NO: 321493 - RNA, 17 nt, Bordetella pertussis
aggucgcggugcgccac

SEQ ID NO: 321494 - RNA, 19 nt, Bordetella pertussis
aggucgcuucgguggcgcg

SEQ ID NO: 321495 - RNA, 12 nt, Bordetella pertussis
aggucggccagc

SEQ ID NO: 321496 - RNA, 19 nt, Bordetella pertussis
aggucggccaccgccgugg

SEQ ID NO: 321497 - RNA, 15 nt, Bordetella pertussis
aguagagcuguugca

SEQ ID NO: 321498 - RNA, 19 nt, Bordetella pertussis
aguagccgaauccggccag

SEQ ID NO: 321499 - RNA, 14 nt, Bordetella pertussis
aguaggccggcacg

SEQ ID NO: 321500 - RNA, 21 nt, Bordetella pertussis
aguccagcaccggcugccagg

SEQ ID NO: 321501 - RNA, 15 nt, Bordetella pertussis
aguccagcagcagcg

SEQ ID NO: 321502 - RNA, 13 nt, Bordetella pertussis
aguccagcgcgcc

SEQ ID NO: 321503 - RNA, 16 nt, Bordetella pertussis
aguccagcgcgccgcg

SEQ ID NO: 321504 - RNA, 14 nt, Bordetella pertussis
aguccaugccgccc

SEQ ID NO: 321505 - RNA, 20 nt, Bordetella pertussis
agucccaggaucaccgccgc

SEQ ID NO: 321506 - RNA, 16 nt, Bordetella pertussis
aguccccaugcggccc

SEQ ID NO: 321507 - RNA, 13 nt, Bordetella pertussis
aguccggcgccgc

SEQ ID NO: 321508 - RNA, 19 nt, Bordetella pertussis
aguccgguauccuggcgcg

SEQ ID NO: 321509 - RNA, 20 nt, Bordetella pertussis
aguccgguauccuggcgcgg

SEQ ID NO: 321510 - RNA, 15 nt, Bordetella pertussis
aguccucuacuggcu

SEQ ID NO: 321511 - RNA, 18 nt, Bordetella pertussis
agucgccgcugccgggcu

SEQ ID NO: 321512 - RNA, 19 nt, Bordetella pertussis
agucgccggcuuccagcag

SEQ ID NO: 321513 - RNA, 15 nt, Bordetella pertussis
agucgcgcagccaca

SEQ ID NO: 321514 - RNA, 18 nt, Bordetella pertussis
agucggaguagggcagcg

SEQ ID NO: 321515 - RNA, 15 nt, Bordetella pertussis
agucggccuggcgcu

SEQ ID NO: 321516 - RNA, 14 nt, Bordetella pertussis
agucggcgcgcgcu

SEQ ID NO: 321517 - RNA, 14 nt, Bordetella pertussis
agucggggcgccgg

SEQ ID NO: 321518 - RNA, 15 nt, Bordetella pertussis
agucggggcgccggu

SEQ ID NO: 321519 - RNA, 19 nt, Bordetella pertussis
agucggucgccgcaguucc

SEQ ID NO: 321520 - RNA, 20 nt, Bordetella pertussis
agucguauucggaccagggc

SEQ ID NO: 321521 - RNA, 22 nt, Bordetella pertussis
agucguccagcacgcggcgcag

SEQ ID NO: 321522 - RNA, 21 nt, Bordetella pertussis
agucgugcaggauggcgucga

SEQ ID NO: 321523 - RNA, 19 nt, Bordetella pertussis
agucugcgccuuccgggcg

SEQ ID NO: 321524 - RNA, 18 nt, Bordetella pertussis
agugaaacgcgacgcgcc

SEQ ID NO: 321525 - RNA, 22 nt, Bordetella pertussis
agugaucaccgccauggcggcc

SEQ ID NO: 321526 - RNA, 16 nt, Bordetella pertussis
agugaugccgccggcg

SEQ ID NO: 321527 - RNA, 12 nt, Bordetella pertussis
agugcaggcccg

SEQ ID NO: 321528 - RNA, 15 nt, Bordetella pertussis
agugcaggccgcgca

SEQ ID NO: 321529 - RNA, 14 nt, Bordetella pertussis
agugcccaggcccg

SEQ ID NO: 321530 - RNA, 22 nt, Bordetella pertussis
agugcccugacccgcuggcugg

SEQ ID NO: 321531 - RNA, 19 nt, Bordetella pertussis
agugccugcgaacgcccgg

SEQ ID NO: 321532 - RNA, 23 nt, Bordetella pertussis
agugccuggacgcgcuggccgac

SEQ ID NO: 321533 - RNA, 17 nt, Bordetella pertussis
agugcgaggacgaccuu

SEQ ID NO: 321534 - RNA, 15 nt, Bordetella pertussis
agugcgccccgccac

SEQ ID NO: 321535 - RNA, 17 nt, Bordetella pertussis
agugcgccccgccacgu

SEQ ID NO: 321536 - RNA, 17 nt, Bordetella pertussis
aguggaaccgcgguacg

SEQ ID NO: 321537 - RNA, 17 nt, Bordetella pertussis
aguggcaggaggcggcg

SEQ ID NO: 321538 - RNA, 16 nt, Bordetella pertussis
agugggcugcggcgug

SEQ ID NO: 321539 - RNA, 13 nt, Bordetella pertussis
aguguggcgcacc

SEQ ID NO: 321540 - RNA, 20 nt, Bordetella pertussis
aguguucgauggcggccagg

SEQ ID NO: 321541 - RNA, 21 nt, Bordetella pertussis
aguucagggcgaacugcucgu

SEQ ID NO: 321542 - RNA, 16 nt, Bordetella pertussis
aguucgccggcgccgu

SEQ ID NO: 321543 - RNA, 17 nt, Bordetella pertussis
aguucgcugccgggauc

SEQ ID NO: 321544 - RNA, 17 nt, Bordetella pertussis
aguucggccagcggcag

SEQ ID NO: 321545 - RNA, 18 nt, Bordetella pertussis
aguucggccagcggcagg

SEQ ID NO: 321546 - RNA, 23 nt, Bordetella pertussis
aguucggccgccaggucggccac

SEQ ID NO: 321547 - RNA, 15 nt, Bordetella pertussis
aguugcgcgccgucg

SEQ ID NO: 321548 - RNA, 15 nt, Bordetella pertussis
aguugcgcggugcgg

SEQ ID NO: 321549 - RNA, 15 nt, Bordetella pertussis
aguugcgggcgcacc

SEQ ID NO: 321550 - RNA, 13 nt, Bordetella pertussis
aguugcggggcgc

SEQ ID NO: 321551 - RNA, 23 nt, Bordetella pertussis
aguugcggggcgcccagcgcguc

SEQ ID NO: 321552 - RNA, 13 nt, Bordetella pertussis
aguugcgccacgg

SEQ ID NO: 321553 - RNA, 19 nt, Bordetella pertussis
aguugcucauggcggcacg

SEQ ID NO: 321554 - RNA, 19 nt, Bordetella pertussis
aguugcuggcggccgugcc

SEQ ID NO: 321555 - RNA, 19 nt, Bordetella pertussis
aguuggcagaguggcagga

SEQ ID NO: 321556 - RNA, 19 nt, Bordetella pertussis
aguuggcggcgcagccgcc

SEQ ID NO: 321557 - RNA, 21 nt, Bordetella pertussis
aguuggcggcgcagccgccau

SEQ ID NO: 321558 - RNA, 18 nt, Bordetella pertussis
aguuucugcaccggcgcc

SEQ ID NO: 321559 - RNA, 17 nt, Bordetella pertussis
auaccagcccggcgcga

SEQ ID NO: 321560 - RNA, 14 nt, Bordetella pertussis
auaccggagcggcu

SEQ ID NO: 321561 - RNA, 15 nt, Bordetella pertussis
auaccuuggcgccca

SEQ ID NO: 321562 - RNA, 23 nt, Bordetella pertussis
auacgccgccauggugccgcgca

SEQ ID NO: 321563 - RNA, 14 nt, Bordetella pertussis
auacgccgcugaug

SEQ ID NO: 321564 - RNA, 12 nt, Bordetella pertussis
auacgcgccgcc

SEQ ID NO: 321565 - RNA, 15 nt, Bordetella pertussis
auacgcgugcgcggc

SEQ ID NO: 321566 - RNA, 14 nt, Bordetella pertussis
auacgcuggcgcgu

SEQ ID NO: 321567 - RNA, 16 nt, Bordetella pertussis
auacggccagcgccag

SEQ ID NO: 321568 - RNA, 14 nt, Bordetella pertussis
auagcgcgccacaa

SEQ ID NO: 321569 - RNA, 17 nt, Bordetella pertussis
auagcgguggcgggcca

SEQ ID NO: 321570 - RNA, 19 nt, Bordetella pertussis
auaggaucccggcgccagc

SEQ ID NO: 321571 - RNA, 20 nt, Bordetella pertussis
auaggccucggccaccuggc

SEQ ID NO: 321572 - RNA, 15 nt, Bordetella pertussis
auaggcgaagcgcgg

SEQ ID NO: 321573 - RNA, 19 nt, Bordetella pertussis
auagggggcauggcgccgc

SEQ ID NO: 321574 - RNA, 20 nt, Bordetella pertussis
auaguggucgccggcgcaac

SEQ ID NO: 321575 - RNA, 16 nt, Bordetella pertussis
auauagaccagcagcu

SEQ ID NO: 321576 - RNA, 22 nt, Bordetella pertussis
auauagggggcauggcgccgcg

SEQ ID NO: 321577 - RNA, 17 nt, Bordetella pertussis
auaucgcgaaagcggcg

SEQ ID NO: 321578 - RNA, 22 nt, Bordetella pertussis
auauugggggucagcgccgacu

SEQ ID NO: 321579 - RNA, 17 nt, Bordetella pertussis
aucagcucgaccacggc

SEQ ID NO: 321580 - RNA, 17 nt, Bordetella pertussis
aucagcuugaugccggc

SEQ ID NO: 321581 - RNA, 21 nt, Bordetella pertussis
aucagcuugggcuugauggcc

SEQ ID NO: 321582 - RNA, 22 nt, Bordetella pertussis
aucaggaugaacaucggcagcg

SEQ ID NO: 321583 - RNA, 14 nt, Bordetella pertussis
aucaggaugggcgc

SEQ ID NO: 321584 - RNA, 17 nt, Bordetella pertussis
aucaggcccacgaugcg

SEQ ID NO: 321585 - RNA, 20 nt, Bordetella pertussis
aucaggcccacgaugcgggc

SEQ ID NO: 321586 - RNA, 13 nt, Bordetella pertussis
aucaggccggcga

SEQ ID NO: 321587 - RNA, 21 nt, Bordetella pertussis
aucaggcgcaucgacagcgcg

SEQ ID NO: 321588 - RNA, 17 nt, Bordetella pertussis
aucaggcgcuccauggc

SEQ ID NO: 321589 - RNA, 22 nt, Bordetella pertussis
aucaggcgcuccauggcgccgg

SEQ ID NO: 321590 - RNA, 21 nt, Bordetella pertussis
aucaggcggugccccggccuc

SEQ ID NO: 321591 - RNA, 15 nt, Bordetella pertussis
aucagggugggcacg

SEQ ID NO: 321592 - RNA, 21 nt, Bordetella pertussis
aucagggugggcacgcgcgcg

SEQ ID NO: 321593 - RNA, 13 nt, Bordetella pertussis
aucagguccauga

SEQ ID NO: 321594 - RNA, 17 nt, Bordetella pertussis
aucaggucgaugccggc

SEQ ID NO: 321595 - RNA, 23 nt, Bordetella pertussis
aucaguccgggcgcuugccguag

SEQ ID NO: 321596 - RNA, 15 nt, Bordetella pertussis
aucaguucgcgcagg

SEQ ID NO: 321597 - RNA, 22 nt, Bordetella pertussis
aucaguucgcgcaggcgugcgc

SEQ ID NO: 321598 - RNA, 14 nt, Bordetella pertussis
aucaucagcauggc

SEQ ID NO: 321599 - RNA, 15 nt, Bordetella pertussis
aucaucaucgucggc

SEQ ID NO: 321600 - RNA, 14 nt, Bordetella pertussis
aucauccgcgcaug

SEQ ID NO: 321601 - RNA, 13 nt, Bordetella pertussis
aucauccgggccc

SEQ ID NO: 321602 - RNA, 19 nt, Bordetella pertussis
aucaucgaccaccagcggc

SEQ ID NO: 321603 - RNA, 16 nt, Bordetella pertussis
aucaucgccgacgcgc

SEQ ID NO: 321604 - RNA, 14 nt, Bordetella pertussis
aucaucggcgccau

SEQ ID NO: 321605 - RNA, 16 nt, Bordetella pertussis
aucaucgucggcgcca

SEQ ID NO: 321606 - RNA, 22 nt, Bordetella pertussis
aucaugcccgccacggucgcga

SEQ ID NO: 321607 - RNA, 17 nt, Bordetella pertussis
aucaugcgcugcuggcc

SEQ ID NO: 321608 - RNA, 21 nt, Bordetella pertussis
aucauggcgccgauggcgccg

SEQ ID NO: 321609 - RNA, 14 nt, Bordetella pertussis
aucauggcgucggc

SEQ ID NO: 321610 - RNA, 23 nt, Bordetella pertussis
aucaugucguccucggccacguc

SEQ ID NO: 321611 - RNA, 21 nt, Bordetella pertussis
aucauuggccagcgcgacggc

SEQ ID NO: 321612 - RNA, 13 nt, Bordetella pertussis
auccaccggcgcg

SEQ ID NO: 321613 - RNA, 14 nt, Bordetella pertussis
auccaccggcgcgc

SEQ ID NO: 321614 - RNA, 12 nt, Bordetella pertussis
auccacgccgcc

SEQ ID NO: 321615 - RNA, 19 nt, Bordetella pertussis
auccacgccuucggcgcgc

SEQ ID NO: 321616 - RNA, 17 nt, Bordetella pertussis
auccacggccggcgcac

SEQ ID NO: 321617 - RNA, 15 nt, Bordetella pertussis
auccagcaucaccag

SEQ ID NO: 321618 - RNA, 21 nt, Bordetella pertussis
auccagccauggaagcggcag

SEQ ID NO: 321619 - RNA, 24 nt, Bordetella pertussis
auccagccauggaagcggcagacg

SEQ ID NO: 321620 - RNA, 16 nt, Bordetella pertussis
auccagccgaucagcc

SEQ ID NO: 321621 - RNA, 20 nt, Bordetella pertussis
auccagcgccagcaccggca

SEQ ID NO: 321622 - RNA, 17 nt, Bordetella pertussis
auccagccguuggcgcc

SEQ ID NO: 321623 - RNA, 14 nt, Bordetella pertussis
auccagcgaggcau

SEQ ID NO: 321624 - RNA, 20 nt, Bordetella pertussis
auccagcgcgcgaucgccag

SEQ ID NO: 321625 - RNA, 11 nt, Bordetella pertussis
auccagcggca

SEQ ID NO: 321626 - RNA, 23 nt, Bordetella pertussis
auccagcgcucgggcucgcgcgc

SEQ ID NO: 321627 - RNA, 17 nt, Bordetella pertussis
auccagcucggcgaugc

SEQ ID NO: 321628 - RNA, 15 nt, Bordetella pertussis
auccaggccaccgcg

SEQ ID NO: 321629 - RNA, 21 nt, Bordetella pertussis
auccaggccgugagcgccgcc

SEQ ID NO: 321630 - RNA, 12 nt, Bordetella pertussis
auccaggcgcuc

SEQ ID NO: 321631 - RNA, 19 nt, Bordetella pertussis
auccagguaggcggcgcgc

SEQ ID NO: 321632 - RNA, 13 nt, Bordetella pertussis
auccaggucgaua

SEQ ID NO: 321633 - RNA, 22 nt, Bordetella pertussis
auccaggucgauaucgccaucc

SEQ ID NO: 321634 - RNA, 16 nt, Bordetella pertussis
auccagguugucgcgc

SEQ ID NO: 321635 - RNA, 12 nt, Bordetella pertussis
auccaucggcgc

SEQ ID NO: 321636 - RNA, 15 nt, Bordetella pertussis
auccccagcgccgcc

SEQ ID NO: 321637 - RNA, 13 nt, Bordetella pertussis
auccccgcucagg

SEQ ID NO: 321638 - RNA, 17 nt, Bordetella pertussis
aucccgacgauccgcgg

SEQ ID NO: 321639 - RNA, 17 nt, Bordetella pertussis
aucccgauuucggagcg

SEQ ID NO: 321640 - RNA, 12 nt, Bordetella pertussis
aucccggcgaca

SEQ ID NO: 321641 - RNA, 18 nt, Bordetella pertussis
aucccggcgacaccgcgg

SEQ ID NO: 321642 - RNA, 22 nt, Bordetella pertussis
aucccggcgcucagcgcgccga

SEQ ID NO: 321643 - RNA, 16 nt, Bordetella pertussis
aucccggcgcuggccg

SEQ ID NO: 321644 - RNA, 23 nt, Bordetella pertussis
aucccgggcuccggucguggcca

SEQ ID NO: 321645 - RNA, 15 nt, Bordetella pertussis
aucccugaucccggc

SEQ ID NO: 321646 - RNA, 20 nt, Bordetella pertussis
aucccugaucccggcgcugg

SEQ ID NO: 321647 - RNA, 23 nt, Bordetella pertussis
auccgccguugcucgcgcgcagu

SEQ ID NO: 321648 - RNA, 22 nt, Bordetella pertussis
auccgcgaagugccuguccccg

SEQ ID NO: 321649 - RNA, 14 nt, Bordetella pertussis
auccgcgacgcccu

SEQ ID NO: 321650 - RNA, 13 nt, Bordetella pertussis
auccggccgcacg

SEQ ID NO: 321651 - RNA, 20 nt, Bordetella pertussis
auccggccgcacgcggccgc

SEQ ID NO: 321652 - RNA, 21 nt, Bordetella pertussis
auccggccgcacgcggccgcg

SEQ ID NO: 321653 - RNA, 21 nt, Bordetella pertussis
auccggcccagcgccaucggc

SEQ ID NO: 321654 - RNA, 12 nt, Bordetella pertussis
auccggcgcacg

SEQ ID NO: 321655 - RNA, 23 nt, Bordetella pertussis
auccggcgcaugauggccggccu

SEQ ID NO: 321656 - RNA, 21 nt, Bordetella pertussis
auccggcgaccgacggcaucg

SEQ ID NO: 321657 - RNA, 20 nt, Bordetella pertussis
auccggugauuucggcgcau

SEQ ID NO: 321658 - RNA, 23 nt, Bordetella pertussis
auccgguugacgaucucgcccug

SEQ ID NO: 321659 - RNA, 17 nt, Bordetella pertussis
aucgagguggcgggcga

SEQ ID NO: 321660 - RNA, 18 nt, Bordetella pertussis
aucgagguuuccgccaug

SEQ ID NO: 321661 - RNA, 19 nt, Bordetella pertussis
aucgagguuuccgccaugc

SEQ ID NO: 321662 - RNA, 14 nt, Bordetella pertussis
aucgaguaggccgg

SEQ ID NO: 321663 - RNA, 20 nt, Bordetella pertussis
aucgaguaggccggcacguc

SEQ ID NO: 321664 - RNA, 17 nt, Bordetella pertussis
aucgauacgccgggcgc

SEQ ID NO: 321665 - RNA, 16 nt, Bordetella pertussis
aucgauaugggcggcc

SEQ ID NO: 321666 - RNA, 16 nt, Bordetella pertussis
aucgaucagccagccg

SEQ ID NO: 321667 - RNA, 15 nt, Bordetella pertussis
aucgaucagcgcgcc

SEQ ID NO: 321668 - RNA, 23 nt, Bordetella pertussis
aucgaugaagaucaggcggcugc

SEQ ID NO: 321669 - RNA, 17 nt, Bordetella pertussis
aucgcaucgcggcagcc

SEQ ID NO: 321670 - RNA, 19 nt, Bordetella pertussis
aucgcaucgcggcagcccg

SEQ ID NO: 321671 - RNA, 16 nt, Bordetella pertussis
aucgccaggcgcgugc

SEQ ID NO: 321672 - RNA, 22 nt, Bordetella pertussis
aucgccaggucggccagccggc

SEQ ID NO: 321673 - RNA, 15 nt, Bordetella pertussis
aucgccauccaggua

SEQ ID NO: 321674 - RNA, 15 nt, Bordetella pertussis
aucgccaucgaccgc

SEQ ID NO: 321675 - RNA, 11 nt, Bordetella pertussis
aucgccgaaca

SEQ ID NO: 321676 - RNA, 17 nt, Bordetella pertussis
aucgccgaagucggcgc

SEQ ID NO: 321677 - RNA, 18 nt, Bordetella pertussis
aucgccgaagucggcgcg

SEQ ID NO: 321678 - RNA, 19 nt, Bordetella pertussis
aucgccgacgaugucgccg

SEQ ID NO: 321679 - RNA, 20 nt, Bordetella pertussis
aucgccgacgcgccgggcca

SEQ ID NO: 321680 - RNA, 21 nt, Bordetella pertussis
aucgccgagccgcugucgcag

SEQ ID NO: 321681 - RNA, 14 nt, Bordetella pertussis
aucgcggcgcggcg

SEQ ID NO: 321682 - RNA, 15 nt, Bordetella pertussis
aucgcggcgcggcuu

SEQ ID NO: 321683 - RNA, 21 nt, Bordetella pertussis
aucgcggcgcggcuuucgccg

SEQ ID NO: 321684 - RNA, 13 nt, Bordetella pertussis
aucgcggcgcugg

SEQ ID NO: 321685 - RNA, 13 nt, Bordetella pertussis
aucgcggcgcugu

SEQ ID NO: 321686 - RNA, 17 nt, Bordetella pertussis
aucgcggcggguggccu

SEQ ID NO: 321687 - RNA, 15 nt, Bordetella pertussis
aucgcggucaucggc

SEQ ID NO: 321688 - RNA, 18 nt, Bordetella pertussis
aucgcgguccugaccggc

SEQ ID NO: 321689 - RNA, 20 nt, Bordetella pertussis
aucgcguccaggcccagcgc

SEQ ID NO: 321690 - RNA, 22 nt, Bordetella pertussis
aucgcguccaggcccagcgcgu

SEQ ID NO: 321691 - RNA, 22 nt, Bordetella pertussis
aucgcgucgacggugcgcgcca

SEQ ID NO: 321692 - RNA, 21 nt, Bordetella pertussis
aucgcgucggccaaggccggc

SEQ ID NO: 321693 - RNA, 16 nt, Bordetella pertussis
aucgcguucacguaga

SEQ ID NO: 321694 - RNA, 15 nt, Bordetella pertussis
aucggaauuggcggc

SEQ ID NO: 321695 - RNA, 14 nt, Bordetella pertussis
aucggcaggccggc

SEQ ID NO: 321696 - RNA, 13 nt, Bordetella pertussis
aucgggcagcacg

SEQ ID NO: 321697 - RNA, 12 nt, Bordetella pertussis
aucgggcugcgg

SEQ ID NO: 321698 - RNA, 13 nt, Bordetella pertussis
aucggugcggccg

SEQ ID NO: 321699 - RNA, 21 nt, Bordetella pertussis
aucgguggaaugggagguugc

SEQ ID NO: 321700 - RNA, 15 nt, Bordetella pertussis
aucgucagcagcacg

SEQ ID NO: 321701 - RNA, 17 nt, Bordetella pertussis
aucgucagcagcacgcc

SEQ ID NO: 321702 - RNA, 23 nt, Bordetella pertussis
aucgucgacaccaaccugcuggc

SEQ ID NO: 321703 - RNA, 15 nt, Bordetella pertussis
aucgucgcugcggcc

SEQ ID NO: 321704 - RNA, 18 nt, Bordetella pertussis
aucgucggacaacgccag

SEQ ID NO: 321705 - RNA, 18 nt, Bordetella pertussis
aucgugcucgugcugggc

SEQ ID NO: 321706 - RNA, 20 nt, Bordetella pertussis
aucgugcuguucggcgaccg

SEQ ID NO: 321707 - RNA, 14 nt, Bordetella pertussis
aucguggcuggcga

SEQ ID NO: 321708 - RNA, 20 nt, Bordetella pertussis
aucucacagacgaucacggu

SEQ ID NO: 321709 - RNA, 22 nt, Bordetella pertussis
aucucagcgcgccgcgccgggc

SEQ ID NO: 321710 - RNA, 19 nt, Bordetella pertussis
aucuccacccccgggcgca

SEQ ID NO: 321711 - RNA, 21 nt, Bordetella pertussis
aucuccacgaaggcgaucugc

SEQ ID NO: 321712 - RNA, 22 nt, Bordetella pertussis
aucugcacccccuuggcuucgg

SEQ ID NO: 321713 - RNA, 20 nt, Bordetella pertussis
aucugcauguacucggccag

SEQ ID NO: 321714 - RNA, 14 nt, Bordetella pertussis
aucugccgcgcauu

SEQ ID NO: 321715 - RNA, 21 nt, Bordetella pertussis
aucugcgagccuucggccggc

SEQ ID NO: 321716 - RNA, 14 nt, Bordetella pertussis
augacgggcggcgg

SEQ ID NO: 321717 - RNA, 17 nt, Bordetella pertussis
augacgggcggcggcgc

SEQ ID NO: 321718 - RNA, 13 nt, Bordetella pertussis
augacggugccga

SEQ ID NO: 321719 - RNA, 20 nt, Bordetella pertussis
augacgguggugucggcggc

SEQ ID NO: 321720 - RNA, 13 nt, Bordetella pertussis
augacguccagcg

SEQ ID NO: 321721 - RNA, 15 nt, Bordetella pertussis
augacucgggcaugc

SEQ ID NO: 321722 - RNA, 16 nt, Bordetella pertussis
augacuugaccgcaug

SEQ ID NO: 321723 - RNA, 17 nt, Bordetella pertussis
augacuugaccgcaugc

SEQ ID NO: 321724 - RNA, 14 nt, Bordetella pertussis
augagacacggcag

SEQ ID NO: 321725 - RNA, 21 nt, Bordetella pertussis
augagccaugccgucuggcgg

SEQ ID NO: 321726 - RNA, 15 nt, Bordetella pertussis
augagcugcgcgugc

SEQ ID NO: 321727 - RNA, 12 nt, Bordetella pertussis
augaggcggcgg

SEQ ID NO: 321728 - RNA, 14 nt, Bordetella pertussis
augaucucgggcga

SEQ ID NO: 321729 - RNA, 17 nt, Bordetella pertussis
augaugagcgcgccgcc

SEQ ID NO: 321730 - RNA, 18 nt, Bordetella pertussis
augaugcccagcgccagg

SEQ ID NO: 321731 - RNA, 13 nt, Bordetella pertussis
augaugcggcgcc

SEQ ID NO: 321732 - RNA, 15 nt, Bordetella pertussis
augcaacacgaccag

SEQ ID NO: 321733 - RNA, 22 nt, Bordetella pertussis
augcaauagcgcccgccuucgc

SEQ ID NO: 321734 - RNA, 21 nt, Bordetella pertussis
augcaccgcguggcgcugcgu

SEQ ID NO: 321735 - RNA, 14 nt, Bordetella pertussis
augcaccggccagu

SEQ ID NO: 321736 - RNA, 13 nt, Bordetella pertussis
augcacgaccagg

SEQ ID NO: 321737 - RNA, 18 nt, Bordetella pertussis
augcacgaugccgucgcc

SEQ ID NO: 321738 - RNA, 20 nt, Bordetella pertussis
augcacgaugguaucggccg

SEQ ID NO: 321739 - RNA, 22 nt, Bordetella pertussis
augccaccacaaggauggacug

SEQ ID NO: 321740 - RNA, 21 nt, Bordetella pertussis
augccauggacgagggccggc

SEQ ID NO: 321741 - RNA, 19 nt, Bordetella pertussis
augccauuggugcgcacau

SEQ ID NO: 321742 - RNA, 13 nt, Bordetella pertussis
augcccaccagcc

SEQ ID NO: 321743 - RNA, 16 nt, Bordetella pertussis
augcccaccagccgcc

SEQ ID NO: 321744 - RNA, 20 nt, Bordetella pertussis
augcccaccagccgcccggc

SEQ ID NO: 321745 - RNA, 14 nt, Bordetella pertussis
augcccagcgccag

SEQ ID NO: 321746 - RNA, 15 nt, Bordetella pertussis
augcccagcgccagg

SEQ ID NO: 321747 - RNA, 17 nt, Bordetella pertussis
augcccagcgccgccga

SEQ ID NO: 321748 - RNA, 22 nt, Bordetella pertussis
augcccagcgccgccgacggca

SEQ ID NO: 321749 - RNA, 18 nt, Bordetella pertussis
augcccaggcccgccagg

SEQ ID NO: 321750 - RNA, 16 nt, Bordetella pertussis
augcccaggcccuggc

SEQ ID NO: 321751 - RNA, 13 nt, Bordetella pertussis
augccccagucca

SEQ ID NO: 321752 - RNA, 16 nt, Bordetella pertussis
augccccaguccaggc

SEQ ID NO: 321753 - RNA, 21 nt, Bordetella pertussis
augccccaguccaggccggcc

SEQ ID NO: 321754 - RNA, 22 nt, Bordetella pertussis
augccccaguccaggccggccu

SEQ ID NO: 321755 - RNA, 16 nt, Bordetella pertussis
augccccauccagcgg

SEQ ID NO: 321756 - RNA, 15 nt, Bordetella pertussis
augccccgcccgcgu

SEQ ID NO: 321757 - RNA, 22 nt, Bordetella pertussis
augcccauuuccaccacgcggu

SEQ ID NO: 321758 - RNA, 23 nt, Bordetella pertussis
augcccgaccgcaugggcgccga

SEQ ID NO: 321759 - RNA, 17 nt, Bordetella pertussis
augcccgaggcggcgcg

SEQ ID NO: 321760 - RNA, 23 nt, Bordetella pertussis
augcccucccagaaacuggcgcu

SEQ ID NO: 321761 - RNA, 23 nt, Bordetella pertussis
augcccucuucggcggccagccg

SEQ ID NO: 321762 - RNA, 16 nt, Bordetella pertussis
augcccuggauggccu

SEQ ID NO: 321763 - RNA, 17 nt, Bordetella pertussis
augcccuggauggccug

SEQ ID NO: 321764 - RNA, 14 nt, Bordetella pertussis
augcccucgcgcac

SEQ ID NO: 321765 - RNA, 15 nt, Bordetella pertussis
augcccuucggcaug

SEQ ID NO: 321766 - RNA, 16 nt, Bordetella pertussis
augcccuucggcaugc

SEQ ID NO: 321767 - RNA, 16 nt, Bordetella pertussis
augcccuuggcggcga

SEQ ID NO: 321768 - RNA, 15 nt, Bordetella pertussis
augccgaacagccag

SEQ ID NO: 321769 - RNA, 18 nt, Bordetella pertussis
augccgaacugucgcgcc

SEQ ID NO: 321770 - RNA, 19 nt, Bordetella pertussis
augccgaacugucgcgcca

SEQ ID NO: 321771 - RNA, 13 nt, Bordetella pertussis
augccgaccaggc

SEQ ID NO: 321772 - RNA, 15 nt, Bordetella pertussis
augccgaccaggccc

SEQ ID NO: 321773 - RNA, 17 nt, Bordetella pertussis
augccgaccaggcccgc

SEQ ID NO: 321774 - RNA, 20 nt, Bordetella pertussis
augccgaccaggcccgccac

SEQ ID NO: 321775 - RNA, 23 nt, Bordetella pertussis
augccgauacgucgcagcacgcc

SEQ ID NO: 321776 - RNA, 13 nt, Bordetella pertussis
augccgaucgccg

SEQ ID NO: 321777 - RNA, 20 nt, Bordetella pertussis
augccgaugauggccauggc

SEQ ID NO: 321778 - RNA, 23 nt, Bordetella pertussis
augccgaugauggccauggccag

SEQ ID NO: 321779 - RNA, 22 nt, Bordetella pertussis
augccgauugugcaugacggcc

SEQ ID NO: 321780 - RNA, 21 nt, Bordetella pertussis
augccgcagauggccagcagc

SEQ ID NO: 321781 - RNA, 24 nt, Bordetella pertussis
augccgcagauggccagcagcgcc

SEQ ID NO: 321782 - RNA, 23 nt, Bordetella pertussis
augccgcagauuuccagcgcguc

SEQ ID NO: 321783 - RNA, 14 nt, Bordetella pertussis
augccgcagcacca

SEQ ID NO: 321784 - RNA, 21 nt, Bordetella pertussis
augccgcagcaccacaucgcc

SEQ ID NO: 321785 - RNA, 17 nt, Bordetella pertussis
augccgcccacgaucac

SEQ ID NO: 321786 - RNA, 15 nt, Bordetella pertussis
augccgcccgccaug

SEQ ID NO: 321787 - RNA, 13 nt, Bordetella pertussis
augccgcccgugc

SEQ ID NO: 321788 - RNA, 21 nt, Bordetella pertussis
augccgccgaaccagcgcacc

SEQ ID NO: 321789 - RNA, 10 nt, Bordetella pertussis
augccgcgca

SEQ ID NO: 321790 - RNA, 22 nt, Bordetella pertussis
augccgcgcaccugggcgucga

SEQ ID NO: 321791 - RNA, 16 nt, Bordetella pertussis
augccgcgcccgccuu

SEQ ID NO: 321792 - RNA, 17 nt, Bordetella pertussis
augccgcgguggcgggc

SEQ ID NO: 321793 - RNA, 16 nt, Bordetella pertussis
augccgcgguugcggu

SEQ ID NO: 321794 - RNA, 19 nt, Bordetella pertussis
augccgcgggcggcgccgg

SEQ ID NO: 321795 - RNA, 17 nt, Bordetella pertussis
augccgcuggcgauggc

SEQ ID NO: 321796 - RNA, 19 nt, Bordetella pertussis
augccgcuggcgauggccu

SEQ ID NO: 321797 - RNA, 20 nt, Bordetella pertussis
augccgcuggcgauggccug

SEQ ID NO: 321798 - RNA, 19 nt, Bordetella pertussis
augccggaacaggcgccua

SEQ ID NO: 321799 - RNA, 18 nt, Bordetella pertussis
augccggcaagcacgaac

SEQ ID NO: 321800 - RNA, 12 nt, Bordetella pertussis
augccggccagc

SEQ ID NO: 321801 - RNA, 23 nt, Bordetella pertussis
augccggccagcagcgacggccc

SEQ ID NO: 321802 - RNA, 22 nt, Bordetella pertussis
augccggccaugcucagcagca

SEQ ID NO: 321803 - RNA, 21 nt, Bordetella pertussis
augccggccgauagccgcggc

SEQ ID NO: 321804 - RNA, 16 nt, Bordetella pertussis
augccggccucggcca

SEQ ID NO: 321805 - RNA, 16 nt, Bordetella pertussis
augccggcguggcgcg

SEQ ID NO: 321806 - RNA, 12 nt, Bordetella pertussis
augccgggcaag

SEQ ID NO: 321807 - RNA, 17 nt, Bordetella pertussis
augccggguugcaggau

SEQ ID NO: 321808 - RNA, 19 nt, Bordetella pertussis
augccggucuccagcgcgu

SEQ ID NO: 321809 - RNA, 20 nt, Bordetella pertussis
augccguaccaggugcgcau

SEQ ID NO: 321810 - RNA, 21 nt, Bordetella pertussis
augccguaccaguacaccggc

SEQ ID NO: 321811 - RNA, 17 nt, Bordetella pertussis
augccguacuuggcgau

SEQ ID NO: 321812 - RNA, 20 nt, Bordetella pertussis
augccguacuuggcgauggc

SEQ ID NO: 321813 - RNA, 17 nt, Bordetella pertussis
augccguaggcgccggc

SEQ ID NO: 321814 - RNA, 15 nt, Bordetella pertussis
augccgucaccggcu

SEQ ID NO: 321815 - RNA, 17 nt, Bordetella pertussis
augccguccacgcccag

SEQ ID NO: 321816 - RNA, 21 nt, Bordetella pertussis
augccguccacgcccagcgcc

SEQ ID NO: 321817 - RNA, 16 nt, Bordetella pertussis
augccguccacgccgc

SEQ ID NO: 321818 - RNA, 20 nt, Bordetella pertussis
augccguccacgccgcgcgc

SEQ ID NO: 321819 - RNA, 22 nt, Bordetella pertussis
augccguccaggaagcagccca

SEQ ID NO: 321820 - RNA, 13 nt, Bordetella pertussis
augccgucggccu

SEQ ID NO: 321821 - RNA, 14 nt, Bordetella pertussis
augccgucggccug

SEQ ID NO: 321822 - RNA, 13 nt, Bordetella pertussis
augccgucggcga

SEQ ID NO: 321823 - RNA, 22 nt, Bordetella pertussis
augccgucgagcgcggccaggc

SEQ ID NO: 321824 - RNA, 18 nt, Bordetella pertussis
augccgucuggcggcagc

SEQ ID NO: 321825 - RNA, 16 nt, Bordetella pertussis
augccgucuuggcggg

SEQ ID NO: 321826 - RNA, 17 nt, Bordetella pertussis
augccgucuuggcgggc

SEQ ID NO: 321827 - RNA, 17 nt, Bordetella pertussis
augccgucgaaggccgc

SEQ ID NO: 321828 - RNA, 15 nt, Bordetella pertussis
augccuauuggcugu

SEQ ID NO: 321829 - RNA, 21 nt, Bordetella pertussis
augccucgaagcggcucaggc

SEQ ID NO: 321830 - RNA, 20 nt, Bordetella pertussis
augccuugcgcgacagcagg

SEQ ID NO: 321831 - RNA, 23 nt, Bordetella pertussis
augccuugguggggucgaugcca

SEQ ID NO: 321832 - RNA, 16 nt, Bordetella pertussis
augcgaaagcggccag

SEQ ID NO: 321833 - RNA, 19 nt, Bordetella pertussis
augcgaagaauuggccguc

SEQ ID NO: 321834 - RNA, 19 nt, Bordetella pertussis
augcgacagcgacagccag

SEQ ID NO: 321835 - RNA, 19 nt, Bordetella pertussis
augcgacaugagcugcgcg

SEQ ID NO: 321836 - RNA, 20 nt, Bordetella pertussis
augcgagacgaaggcgccgg

SEQ ID NO: 321837 - RNA, 23 nt, Bordetella pertussis
augcgauagcgggccugcagcau

SEQ ID NO: 321838 - RNA, 13 nt, Bordetella pertussis
augcgauaggcga

SEQ ID NO: 321839 - RNA, 18 nt, Bordetella pertussis
augcgauaggcgaagcgc

SEQ ID NO: 321840 - RNA, 16 nt, Bordetella pertussis
augcgccugcgccaug

SEQ ID NO: 321841 - RNA, 13 nt, Bordetella pertussis
augcgcgaagcgc

SEQ ID NO: 321842 - RNA, 14 nt, Bordetella pertussis
augcgcgaagcgcc

SEQ ID NO: 321843 - RNA, 15 nt, Bordetella pertussis
augcgcgaagcgccc

SEQ ID NO: 321844 - RNA, 14 nt, Bordetella pertussis
augcgcgagccgcc

SEQ ID NO: 321845 - RNA, 17 nt, Bordetella pertussis
augcgcgagccgcccac

SEQ ID NO: 321846 - RNA, 12 nt, Bordetella pertussis
augcgcgagcgc

SEQ ID NO: 321847 - RNA, 16 nt, Bordetella pertussis
augcgcgagcgcgugg

SEQ ID NO: 321848 - RNA, 22 nt, Bordetella pertussis
augcgcgccaggcugucgucgu

SEQ ID NO: 321849 - RNA, 19 nt, Bordetella pertussis
augcgcgccccgucggccg

SEQ ID NO: 321850 - RNA, 20 nt, Bordetella pertussis
augcgcgccguacagccgcg

SEQ ID NO: 321851 - RNA, 23 nt, Bordetella pertussis
augcgcgcggccucgacgauggc

SEQ ID NO: 321852 - RNA, 21 nt, Bordetella pertussis
augcgcgcggcucgccgcgca

SEQ ID NO: 321853 - RNA, 22 nt, Bordetella pertussis
augcgcgcggcucgccgcgcac

SEQ ID NO: 321854 - RNA, 13 nt, Bordetella pertussis
augcgcgcgcgga

SEQ ID NO: 321855 - RNA, 14 nt, Bordetella pertussis
augcgcggcacguc

SEQ ID NO: 321856 - RNA, 16 nt, Bordetella pertussis
augcgcggcgggacgg

SEQ ID NO: 321857 - RNA, 21 nt, Bordetella pertussis
augcgcggcgggcucgagcug

SEQ ID NO: 321858 - RNA, 15 nt, Bordetella pertussis
augcgcggggccagg

SEQ ID NO: 321859 - RNA, 16 nt, Bordetella pertussis
augcgcggggccaggc

SEQ ID NO: 321860 - RNA, 14 nt, Bordetella pertussis
augcgcggggccgg

SEQ ID NO: 321861 - RNA, 21 nt, Bordetella pertussis
augcgcgucuccagcgccggc

SEQ ID NO: 321862 - RNA, 23 nt, Bordetella pertussis
augcgcguugccggugcgcgugg

SEQ ID NO: 321863 - RNA, 22 nt, Bordetella pertussis
augcgcucgguccagacgggcu

SEQ ID NO: 321864 - RNA, 16 nt, Bordetella pertussis
augcgcugcgccuugg

SEQ ID NO: 321865 - RNA, 22 nt, Bordetella pertussis
augcgcugcuggaggccggcgu

SEQ ID NO: 321866 - RNA, 21 nt, Bordetella pertussis
augcgcugggcaugggcggcc

SEQ ID NO: 321867 - RNA, 15 nt, Bordetella pertussis
augcgcugggccagg

SEQ ID NO: 321868 - RNA, 13 nt, Bordetella pertussis
augcgcuugccga

SEQ ID NO: 321869 - RNA, 22 nt, Bordetella pertussis
augcgcuugucgccgcugcgcu

SEQ ID NO: 321870 - RNA, 16 nt, Bordetella pertussis
augcggacgccagccc

SEQ ID NO: 321871 - RNA, 21 nt, Bordetella pertussis
augcggaugaacgaccagcac

SEQ ID NO: 321872 - RNA, 20 nt, Bordetella pertussis
augcggcacaaccuggcgcg

SEQ ID NO: 321873 - RNA, 17 nt, Bordetella pertussis
augcgugaagcccaugg

SEQ ID NO: 321874 - RNA, 18 nt, Bordetella pertussis
augcgugaagcccauggc

SEQ ID NO: 321875 - RNA, 17 nt, Bordetella pertussis
augcgugacacggccau

SEQ ID NO: 321876 - RNA, 20 nt, Bordetella pertussis
augcgugcgcaucagcgcau

SEQ ID NO: 321877 - RNA, 19 nt, Bordetella pertussis
augcguggccggcgggggc

SEQ ID NO: 321878 - RNA, 20 nt, Bordetella pertussis
augcgugguacggcgaagcc

SEQ ID NO: 321879 - RNA, 20 nt, Bordetella pertussis
augcguguuccagcgccugg

SEQ ID NO: 321880 - RNA, 14 nt, Bordetella pertussis
augcguucggccag

SEQ ID NO: 321881 - RNA, 19 nt, Bordetella pertussis
augcucacgcccaguccca

SEQ ID NO: 321882 - RNA, 22 nt, Bordetella pertussis
augcucgauaugcagcaccgga

SEQ ID NO: 321883 - RNA, 15 nt, Bordetella pertussis
augcucgccggcgcc

SEQ ID NO: 321884 - RNA, 18 nt, Bordetella pertussis
augcucgcgcacagcgcg

SEQ ID NO: 321885 - RNA, 20 nt, Bordetella pertussis
augcucuggcacaccagcgc

SEQ ID NO: 321886 - RNA, 21 nt, Bordetella pertussis
augcucuggcacaccagcgcc

SEQ ID NO: 321887 - RNA, 22 nt, Bordetella pertussis
augcucuggcacaccagcgcca

SEQ ID NO: 321888 - RNA, 23 nt, Bordetella pertussis
augcucuggcacaccagcgccag

SEQ ID NO: 321889 - RNA, 23 nt, Bordetella pertussis
auggcccgggugaucaguccgac

SEQ ID NO: 321890 - RNA, 23 nt, Bordetella pertussis
auggccgaaucguucacgcccga

SEQ ID NO: 321891 - RNA, 18 nt, Bordetella pertussis
auggccgaaugcccgccc

SEQ ID NO: 321892 - RNA, 20 nt, Bordetella pertussis
auggccgaaugcccgcccuu

SEQ ID NO: 321893 - RNA, 17 nt, Bordetella pertussis
auggccgccagcggcug

SEQ ID NO: 321894 - RNA, 15 nt, Bordetella pertussis
auggccgcccagcau

SEQ ID NO: 321895 - RNA, 18 nt, Bordetella pertussis
auggccgcgcgcagcgag

SEQ ID NO: 321896 - RNA, 17 nt, Bordetella pertussis
auggccgcgcccagcgc

SEQ ID NO: 321897 - RNA, 22 nt, Bordetella pertussis
auggccgcgcccagcgcggccu

SEQ ID NO: 321898 - RNA, 16 nt, Bordetella pertussis
auggccggggcgucgu

SEQ ID NO: 321899 - RNA, 17 nt, Bordetella pertussis
auggccgguucgaugac

SEQ ID NO: 321900 - RNA, 17 nt, Bordetella pertussis
auggcgauguaggccag

SEQ ID NO: 321901 - RNA, 18 nt, Bordetella pertussis
auggcgcaggcgcgcgcc

SEQ ID NO: 321902 - RNA, 15 nt, Bordetella pertussis
auggcgccaugcgac

SEQ ID NO: 321903 - RNA, 20 nt, Bordetella pertussis
auggcgccaugcgacagccc

SEQ ID NO: 321904 - RNA, 16 nt, Bordetella pertussis
auggcgcccacggccg

SEQ ID NO: 321905 - RNA, 17 nt, Bordetella pertussis
auggcgcccacggccug

SEQ ID NO: 321906 - RNA, 20 nt, Bordetella pertussis
auggcgccaccuucgccgcg

SEQ ID NO: 321907 - RNA, 14 nt, Bordetella pertussis
auggcgccgcgcgc

SEQ ID NO: 321908 - RNA, 13 nt, Bordetella pertussis
auggcgccggcca

SEQ ID NO: 321909 - RNA, 14 nt, Bordetella pertussis
auggcgccggccag

SEQ ID NO: 321910 - RNA, 15 nt, Bordetella pertussis
auggcgccggccagc

SEQ ID NO: 321911 - RNA, 20 nt, Bordetella pertussis
auggcgccggccagcgcgcc

SEQ ID NO: 321912 - RNA, 23 nt, Bordetella pertussis
auggcgccggccagcgcgccggc

SEQ ID NO: 321913 - RNA, 16 nt, Bordetella pertussis
auggcgccggcggccu

SEQ ID NO: 321914 - RNA, 17 nt, Bordetella pertussis
auggcgccggcggccuc

SEQ ID NO: 321915 - RNA, 17 nt, Bordetella pertussis
auggcgcgccggccggu

SEQ ID NO: 321916 - RNA, 12 nt, Bordetella pertussis
auggcgcgcgcc

SEQ ID NO: 321917 - RNA, 13 nt, Bordetella pertussis
auggcgcgcgcca

SEQ ID NO: 321918 - RNA, 19 nt, Bordetella pertussis
auggcgcgcgccagcggcu

SEQ ID NO: 321919 - RNA, 20 nt, Bordetella pertussis
auggcgcggguaaugccggu

SEQ ID NO: 321920 - RNA, 16 nt, Bordetella pertussis
auggcgcgucgccgcg

SEQ ID NO: 321921 - RNA, 19 nt, Bordetella pertussis
auggcgcgugcgcgcgcca

SEQ ID NO: 321922 - RNA, 15 nt, Bordetella pertussis
auggcgcuccagccc

SEQ ID NO: 321923 - RNA, 16 nt, Bordetella pertussis
auggcgcuccagcccu

SEQ ID NO: 321924 - RNA, 18 nt, Bordetella pertussis
auggcgcuggcaggcgcc

SEQ ID NO: 321925 - RNA, 19 nt, Bordetella pertussis
auggcgcuugugcgucggc

SEQ ID NO: 321926 - RNA, 18 nt, Bordetella pertussis
auggcggaugcgccacaa

SEQ ID NO: 321927 - RNA, 18 nt, Bordetella pertussis
auggcggcaggcgcgagg

SEQ ID NO: 321928 - RNA, 23 nt, Bordetella pertussis
auggcggccagcuugaccgccag

SEQ ID NO: 321929 - RNA, 12 nt, Bordetella pertussis
auggcggccagg

SEQ ID NO: 321930 - RNA, 13 nt, Bordetella pertussis
auggcggccaggg

SEQ ID NO: 321931 - RNA, 20 nt, Bordetella pertussis
auggcggccgccagcgccau

SEQ ID NO: 321932 - RNA, 21 nt, Bordetella pertussis
auggcggccgccagcgccaug

SEQ ID NO: 321933 - RNA, 22 nt, Bordetella pertussis
auggcggccgccagcgccauga

SEQ ID NO: 321934 - RNA, 23 nt, Bordetella pertussis
auggcggccgccgccagcgcgcc

SEQ ID NO: 321935 - RNA, 14 nt, Bordetella pertussis
auggcggccggcgu

SEQ ID NO: 321936 - RNA, 18 nt, Bordetella pertussis
auggcggccucgggcaac

SEQ ID NO: 321937 - RNA, 19 nt, Bordetella pertussis
auggcggcgcccgcugcgu

SEQ ID NO: 321938 - RNA, 13 nt, Bordetella pertussis
auggcggcgccga

SEQ ID NO: 321939 - RNA, 22 nt, Bordetella pertussis
auggcggugaaaucgacguggc

SEQ ID NO: 321940 - RNA, 20 nt, Bordetella pertussis
auggcggugaaggcgcccgg

SEQ ID NO: 321941 - RNA, 17 nt, Bordetella pertussis
auggcguaggcggccuu

SEQ ID NO: 321942 - RNA, 22 nt, Bordetella pertussis
auggcgucaagccagcggcgcg

SEQ ID NO: 321943 - RNA, 22 nt, Bordetella pertussis
auggcguccgcgucgccgccgu

SEQ ID NO: 321944 - RNA, 16 nt, Bordetella pertussis
auggcgucguccagcu

SEQ ID NO: 321945 - RNA, 23 nt, Bordetella pertussis
auggcgugcacgcguaugcccug

SEQ ID NO: 321946 - RNA, 15 nt, Bordetella pertussis
auggcguugccggcc

SEQ ID NO: 321947 - RNA, 16 nt, Bordetella pertussis
auggcguugccggccu

SEQ ID NO: 321948 - RNA, 23 nt, Bordetella pertussis
auggcuauaccgucguccucggc

SEQ ID NO: 321949 - RNA, 24 nt, Bordetella pertussis
auggcucgggcagcagcagggcca

SEQ ID NO: 321950 - RNA, 19 nt, Bordetella pertussis
auggcuggucccugcgcga

SEQ ID NO: 321951 - RNA, 20 nt, Bordetella pertussis
auggucaccacccgcacgcc

SEQ ID NO: 321952 - RNA, 20 nt, Bordetella pertussis
auggucagcaugucgacguu

SEQ ID NO: 321953 - RNA, 18 nt, Bordetella pertussis
auggucaguccgcccagc

SEQ ID NO: 321954 - RNA, 13 nt, Bordetella pertussis
auggucgcccagc

SEQ ID NO: 321955 - RNA, 18 nt, Bordetella pertussis
auggucgagcgccugcgc

SEQ ID NO: 321956 - RNA, 20 nt, Bordetella pertussis
auggucgcgaccaccgugau

SEQ ID NO: 321957 - RNA, 20 nt, Bordetella pertussis
auggucgcggccgaggccag

SEQ ID NO: 321958 - RNA, 12 nt, Bordetella pertussis
auggucggccuc

SEQ ID NO: 321959 - RNA, 17 nt, Bordetella pertussis
auggucggugccgccga

SEQ ID NO: 321960 - RNA, 18 nt, Bordetella pertussis
auggucggugccgccgag

SEQ ID NO: 321961 - RNA, 20 nt, Bordetella pertussis
auggucgugcggcacgcaca

SEQ ID NO: 321962 - RNA, 20 nt, Bordetella pertussis
auggucucccccucggccug

SEQ ID NO: 321963 - RNA, 21 nt, Bordetella pertussis
auggucucccccucggccugc

SEQ ID NO: 321964 - RNA, 15 nt, Bordetella pertussis
auggugaacgccacc

SEQ ID NO: 321965 - RNA, 15 nt, Bordetella pertussis
auggugccggccguc

SEQ ID NO: 321966 - RNA, 22 nt, Bordetella pertussis
auggugcugccgcugcccaccu

SEQ ID NO: 321967 - RNA, 20 nt, Bordetella pertussis
auguacgcaucggcgccggc

SEQ ID NO: 321968 - RNA, 23 nt, Bordetella pertussis
auguagagggucuggccggugau

SEQ ID NO: 321969 - RNA, 14 nt, Bordetella pertussis
auguaggcgccgcg

SEQ ID NO: 321970 - RNA, 22 nt, Bordetella pertussis
augucccgcaugaccugcagga

SEQ ID NO: 321971 - RNA, 13 nt, Bordetella pertussis
auguccggcgcga

SEQ ID NO: 321972 - RNA, 16 nt, Bordetella pertussis
auguccguaucgcggc

SEQ ID NO: 321973 - RNA, 16 nt, Bordetella pertussis
augucgaacagcugca

SEQ ID NO: 321974 - RNA, 20 nt, Bordetella pertussis
augucgacgaucucgcggcu

SEQ ID NO: 321975 - RNA, 17 nt, Bordetella pertussis
augucgcaggccgcggc

SEQ ID NO: 321976 - RNA, 19 nt, Bordetella pertussis
augucgcaggccgcggcca

SEQ ID NO: 321977 - RNA, 21 nt, Bordetella pertussis
augucgcaggccgcggccagg

SEQ ID NO: 321978 - RNA, 13 nt, Bordetella pertussis
augucgccggcca

SEQ ID NO: 321979 - RNA, 19 nt, Bordetella pertussis
augucgccgccugcggcgc

SEQ ID NO: 321980 - RNA, 14 nt, Bordetella pertussis
augucgcggcccac

SEQ ID NO: 321981 - RNA, 20 nt, Bordetella pertussis
augucgcggcccacggccag

SEQ ID NO: 321982 - RNA, 21 nt, Bordetella pertussis
augucgcggcccacggccagc

SEQ ID NO: 321983 - RNA, 16 nt, Bordetella pertussis
augucgcgggcccgcu

SEQ ID NO: 321984 - RNA, 23 nt, Bordetella pertussis
augucgcgggcccgcucggccag

SEQ ID NO: 321985 - RNA, 18 nt, Bordetella pertussis
auguuguuggccgccagc

SEQ ID NO: 321986 - RNA, 14 nt, Bordetella pertussis
auucacaggcccgc

SEQ ID NO: 321987 - RNA, 12 nt, Bordetella pertussis
auuccagccagg

SEQ ID NO: 321988 - RNA, 19 nt, Bordetella pertussis
auuucgauuucggcggcca

SEQ ID NO: 321989 - RNA, 14 nt, Bordetella pertussis
auuucgcugggcgc

SEQ ID NO: 321990 - RNA, 19 nt, Bordetella pertussis
auuucggagcggcucugga

SEQ ID NO: 321991 - RNA, 18 nt, Bordetella pertussis
auuucggcgcaucggcgc

SEQ ID NO: 321992 - RNA, 21 nt, Bordetella pertussis
auuucggcgcaucggcgccag

SEQ ID NO: 321993 - RNA, 23 nt, Bordetella pertussis
auuucggcgcaucggcgccagua

SEQ ID NO: 321994 - RNA, 15 nt, Bordetella pertussis
auuucggcggccagg

SEQ ID NO: 321995 - RNA, 14 nt, Bordetella pertussis
auuucggggcgcga

SEQ ID NO: 321996 - RNA, 13 nt, Bordetella pertussis
auuugcagcggcg

SEQ ID NO: 321997 - RNA, 19 nt, Bordetella pertussis
auuuuguugauggcgaugg

SEQ ID NO: 321998 - RNA, 16 nt, Bordetella pertussis
caaaaacgcccggcgc

SEQ ID NO: 321999 - RNA, 16 nt, Bordetella pertussis
caaaaccgggcccgga

SEQ ID NO: 322000 - RNA, 15 nt, Bordetella pertussis
caaacggcggcaggc

SEQ ID NO: 322001 - RNA, 19 nt, Bordetella pertussis
caaacggcggcaggccgcg

SEQ ID NO: 322002 - RNA, 21 nt, Bordetella pertussis
caaacggauugccgccgcgca

SEQ ID NO: 322003 - RNA, 22 nt, Bordetella pertussis
caaagacggcuugaccacggcc

SEQ ID NO: 322004 - RNA, 23 nt, Bordetella pertussis
caacacuuucaucaaacgcggcg

SEQ ID NO: 322005 - RNA, 18 nt, Bordetella pertussis
caacagacccgggccgcu

SEQ ID NO: 322006 - RNA, 13 nt, Bordetella pertussis
caacagcgccugc

SEQ ID NO: 322007 - RNA, 16 nt, Bordetella pertussis
caacagcuugcccggc

SEQ ID NO: 322008 - RNA, 14 nt, Bordetella pertussis
caacaggcagcugc

SEQ ID NO: 322009 - RNA, 11 nt, Bordetella pertussis
caacaggucgu

SEQ ID NO: 322010 - RNA, 19 nt, Bordetella pertussis
caacaggucguggcccagc

SEQ ID NO: 322011 - RNA, 19 nt, Bordetella pertussis
caacaucaaugacauggcc

SEQ ID NO: 322012 - RNA, 20 nt, Bordetella pertussis
caacaucaaugacauggcca

SEQ ID NO: 322013 - RNA, 18 nt, Bordetella pertussis
caaccaggggcggcgcgg

SEQ ID NO: 322014 - RNA, 20 nt, Bordetella pertussis
caacccggccucagcggccg

SEQ ID NO: 322015 - RNA, 13 nt, Bordetella pertussis
caacccggccucg

SEQ ID NO: 322016 - RNA, 21 nt, Bordetella pertussis
caacccggcgaggccgcccgc

SEQ ID NO: 322017 - RNA, 20 nt, Bordetella pertussis
caacccgucgacgcagcagc

SEQ ID NO: 322018 - RNA, 19 nt, Bordetella pertussis
caacccguuccccaucauc

SEQ ID NO: 322019 - RNA, 16 nt, Bordetella pertussis
caacccucgcacggcc

SEQ ID NO: 322020 - RNA, 16 nt, Bordetella pertussis
caacgacgcaggcgcc

SEQ ID NO: 322021 - RNA, 14 nt, Bordetella pertussis
caacgccacgcgcg

SEQ ID NO: 322022 - RNA, 15 nt, Bordetella pertussis
caacgccacgcgcgg

SEQ ID NO: 322023 - RNA, 16 nt, Bordetella pertussis
caacgccacgcgcgga

SEQ ID NO: 322024 - RNA, 22 nt, Bordetella pertussis
caacgccacgcgcggaucggcc

SEQ ID NO: 322025 - RNA, 23 nt, Bordetella pertussis
caacgccacgcgcggaucggcca

SEQ ID NO: 322026 - RNA, 16 nt, Bordetella pertussis
caacgccagcaggcga

SEQ ID NO: 322027 - RNA, 21 nt, Bordetella pertussis
caacgcccagguugcggccgc

SEQ ID NO: 322028 - RNA, 22 nt, Bordetella pertussis
caacgcccagguugcggccgcc

SEQ ID NO: 322029 - RNA, 22 nt, Bordetella pertussis
caacgccgccaccagggcgccc

SEQ ID NO: 322030 - RNA, 22 nt, Bordetella pertussis
caacgccgcccguccgggcggc

SEQ ID NO: 322031 - RNA, 14 nt, Bordetella pertussis
caacgccgccggca

SEQ ID NO: 322032 - RNA, 19 nt, Bordetella pertussis
caacgccgccggcagggcc

SEQ ID NO: 322033 - RNA, 16 nt, Bordetella pertussis
caacgccgcguccgcc

SEQ ID NO: 322034 - RNA, 23 nt, Bordetella pertussis
caacgccggccauggcggccggc

SEQ ID NO: 322035 - RNA, 15 nt, Bordetella pertussis
caacgccggccgcca

SEQ ID NO: 322036 - RNA, 23 nt, Bordetella pertussis
caacgccggccgccauggccggc

SEQ ID NO: 322037 - RNA, 13 nt, Bordetella pertussis
caacgcgcgcgcg

SEQ ID NO: 322038 - RNA, 16 nt, Bordetella pertussis
caacgcggccagcgga

SEQ ID NO: 322039 - RNA, 15 nt, Bordetella pertussis
caacgcggcgcgugc

SEQ ID NO: 322040 - RNA, 23 nt, Bordetella pertussis
caacggccuucggcggcgcgcug

SEQ ID NO: 322041 - RNA, 14 nt, Bordetella pertussis
caacgggccgcugg

SEQ ID NO: 322042 - RNA, 15 nt, Bordetella pertussis
caacgggccgcuggu

SEQ ID NO: 322043 - RNA, 19 nt, Bordetella pertussis
caacgggccggccgccggc

SEQ ID NO: 322044 - RNA, 21 nt, Bordetella pertussis
caacgggccggccgccggcgg

SEQ ID NO: 322045 - RNA, 15 nt, Bordetella pertussis
caacgggaucggcgu

SEQ ID NO: 322046 - RNA, 18 nt, Bordetella pertussis
caacggggacgggcgccc

SEQ ID NO: 322047 - RNA, 18 nt, Bordetella pertussis
caacugccugcagcgcgc

SEQ ID NO: 322048 - RNA, 19 nt, Bordetella pertussis
caacugccugcagcgcgcg

SEQ ID NO: 322049 - RNA, 20 nt, Bordetella pertussis
caacugccugcagcgcgcgc

SEQ ID NO: 322050 - RNA, 13 nt, Bordetella pertussis
caacugcgcgaau

SEQ ID NO: 322051 - RNA, 19 nt, Bordetella pertussis
caacuggccggccuggcgc

SEQ ID NO: 322052 - RNA, 16 nt, Bordetella pertussis
caacuggggcgcucga

SEQ ID NO: 322053 - RNA, 18 nt, Bordetella pertussis
caacugguagugcggcgc

SEQ ID NO: 322054 - RNA, 22 nt, Bordetella pertussis
caacuggugcacgaugcccagg

SEQ ID NO: 322055 - RNA, 17 nt, Bordetella pertussis
caacuuccagcgcccgc

SEQ ID NO: 322056 - RNA, 15 nt, Bordetella pertussis
caagaccgcggccgc

SEQ ID NO: 322057 - RNA, 23 nt, Bordetella pertussis
caagaccgcggccgcgcuggcgc

SEQ ID NO: 322058 - RNA, 19 nt, Bordetella pertussis
caagacgcccaggcccacc

SEQ ID NO: 322059 - RNA, 16 nt, Bordetella pertussis
caagacggcgcucggc

SEQ ID NO: 322060 - RNA, 21 nt, Bordetella pertussis
caagacgguaucugucccggc

SEQ ID NO: 322061 - RNA, 15 nt, Bordetella pertussis
caagagccuggagcu

SEQ ID NO: 322062 - RNA, 15 nt, Bordetella pertussis
caagauggcccaggg

SEQ ID NO: 322063 - RNA, 14 nt, Bordetella pertussis
caagcaccgccugc

SEQ ID NO: 322064 - RNA, 24 nt, Bordetella pertussis
caagcagaaaggaugcccgcgggc

SEQ ID NO: 322065 - RNA, 18 nt, Bordetella pertussis
caagcacgaacagguuga

SEQ ID NO: 322066 - RNA, 18 nt, Bordetella pertussis
caagcagcgccggcuggg

SEQ ID NO: 322067 - RNA, 16 nt, Bordetella pertussis
caagcagcgccugccg

SEQ ID NO: 322068 - RNA, 20 nt, Bordetella pertussis
caagcagggcauguugcgcg

SEQ ID NO: 322069 - RNA, 17 nt, Bordetella pertussis
caagcauuugcgcgacg

SEQ ID NO: 322070 - RNA, 20 nt, Bordetella pertussis
caagcauuugcgcgacggcg

SEQ ID NO: 322071 - RNA, 14 nt, Bordetella pertussis
caagccagggcagg

SEQ ID NO: 322072 - RNA, 23 nt, Bordetella pertussis
caagccagggcaggaggcgcggg

SEQ ID NO: 322073 - RNA, 13 nt, Bordetella pertussis
caagcccaccggg

SEQ ID NO: 322074 - RNA, 15 nt, Bordetella pertussis
caagcccaccgggcc

SEQ ID NO: 322075 - RNA, 16 nt, Bordetella pertussis
caagcccaccgggccg

SEQ ID NO: 322076 - RNA, 17 nt, Bordetella pertussis
caagcccaggcggccca

SEQ ID NO: 322077 - RNA, 20 nt, Bordetella pertussis
caagccccuguucggcaucg

SEQ ID NO: 322078 - RNA, 16 nt, Bordetella pertussis
caagcccggcacggag

SEQ ID NO: 322079 - RNA, 14 nt, Bordetella pertussis
caagcccguggcgg

SEQ ID NO: 322080 - RNA, 17 nt, Bordetella pertussis
caagccgauccgcgacg

SEQ ID NO: 322081 - RNA, 24 nt, Bordetella pertussis
caagccgauccgcgacgcccuggc

SEQ ID NO: 322082 - RNA, 18 nt, Bordetella pertussis
caagccgcccgcggcggc

SEQ ID NO: 322083 - RNA, 19 nt, Bordetella pertussis
caagccgcccggccggcac

SEQ ID NO: 322084 - RNA, 22 nt, Bordetella pertussis
caagccgcccggccggcacggc

SEQ ID NO: 322085 - RNA, 19 nt, Bordetella pertussis
caagccgcaccaugcgguc

SEQ ID NO: 322086 - RNA, 14 nt, Bordetella pertussis
caagccgcggcggu

SEQ ID NO: 322087 - RNA, 22 nt, Bordetella pertussis
caagccgcggcgguuucggccg

SEQ ID NO: 322088 - RNA, 13 nt, Bordetella pertussis
caagccggccgcg

SEQ ID NO: 322089 - RNA, 15 nt, Bordetella pertussis
caagccggccgcgcg

SEQ ID NO: 322090 - RNA, 17 nt, Bordetella pertussis
caagccggccgcgcggc

SEQ ID NO: 322091 - RNA, 14 nt, Bordetella pertussis
caagcgcguggccg

SEQ ID NO: 322092 - RNA, 19 nt, Bordetella pertussis
caagcgcucgccggcgcgc

SEQ ID NO: 322093 - RNA, 20 nt, Bordetella pertussis
caagcgcucgccggcgcgca

SEQ ID NO: 322094 - RNA, 17 nt, Bordetella pertussis
caagcgcucggccacgc

SEQ ID NO: 322095 - RNA, 14 nt, Bordetella pertussis
caagcggccccagg

SEQ ID NO: 322096 - RNA, 22 nt, Bordetella pertussis
caagcggccccagucgcugcuc

SEQ ID NO: 322097 - RNA, 21 nt, Bordetella pertussis
caagcggcguggggccggccg

SEQ ID NO: 322098 - RNA, 18 nt, Bordetella pertussis
caagcgucgauggcguac

SEQ ID NO: 322099 - RNA, 23 nt, Bordetella pertussis
caagcgucgauggcguacagcag

SEQ ID NO: 322100 - RNA, 18 nt, Bordetella pertussis
caagcguucauggcgcau

SEQ ID NO: 322101 - RNA, 22 nt, Bordetella pertussis
caagcguucauggcgcaugacg

SEQ ID NO: 322102 - RNA, 23 nt, Bordetella pertussis
caaggcaagcagcgagagcgcca

SEQ ID NO: 322103 - RNA, 13 nt, Bordetella pertussis
caaggcaugcgcc

SEQ ID NO: 322104 - RNA, 21 nt, Bordetella pertussis
caaggccacgaauuccucgcc

SEQ ID NO: 322105 - RNA, 22 nt, Bordetella pertussis
caaggccacgaauuccucgccg

SEQ ID NO: 322106 - RNA, 23 nt, Bordetella pertussis
caaggccacgaauuccucgccgc

SEQ ID NO: 322107 - RNA, 19 nt, Bordetella pertussis
caaggccaugaucaggccg

SEQ ID NO: 322108 - RNA, 20 nt, Bordetella pertussis
caaggccaugaucaggccga

SEQ ID NO: 322109 - RNA, 21 nt, Bordetella pertussis
caaggccaugaucaggccgaa

SEQ ID NO: 322110 - RNA, 17 nt, Bordetella pertussis
caaggcccgccgcggca

SEQ ID NO: 322111 - RNA, 11 nt, Bordetella pertussis
caaggcccgga

SEQ ID NO: 322112 - RNA, 18 nt, Bordetella pertussis
caaggccgauagcguucg

SEQ ID NO: 322113 - RNA, 21 nt, Bordetella pertussis
caagggcgccgcgccggggcg

SEQ ID NO: 322114 - RNA, 15 nt, Bordetella pertussis
caagggcgccgggcg

SEQ ID NO: 322115 - RNA, 21 nt, Bordetella pertussis
caagggggacuggcaccggca

SEQ ID NO: 322116 - RNA, 22 nt, Bordetella pertussis
caagggguccguggcggccgcg

SEQ ID NO: 322117 - RNA, 15 nt, Bordetella pertussis
caagguccaggcccg

SEQ ID NO: 322118 - RNA, 18 nt, Bordetella pertussis
caagguccaggcccggca

SEQ ID NO: 322119 - RNA, 15 nt, Bordetella pertussis
caagguccaggcgcg

SEQ ID NO: 322120 - RNA, 17 nt, Bordetella pertussis
caagguccaggcgcgca

SEQ ID NO: 322121 - RNA, 15 nt, Bordetella pertussis
caaggugaucgaggc

SEQ ID NO: 322122 - RNA, 20 nt, Bordetella pertussis
caagguggcgugcagcaggu

SEQ ID NO: 322123 - RNA, 19 nt, Bordetella pertussis
caaugaagggcugcaaggc

SEQ ID NO: 322124 - RNA, 17 nt, Bordetella pertussis
caaugcgcaggcccgac

SEQ ID NO: 322125 - RNA, 12 nt, Bordetella pertussis
caaugcgcggcg

SEQ ID NO: 322126 - RNA, 18 nt, Bordetella pertussis
caaugcggcggcgcuggc

SEQ ID NO: 322127 - RNA, 15 nt, Bordetella pertussis
caaugcguggccggc

SEQ ID NO: 322128 - RNA, 18 nt, Bordetella pertussis
caauggacacagcggcgc

SEQ ID NO: 322129 - RNA, 20 nt, Bordetella pertussis
caauucaagccgcaccaugc

SEQ ID NO: 322130 - RNA, 17 nt, Bordetella pertussis
caauucgagcaggcgca

SEQ ID NO: 322131 - RNA, 23 nt, Bordetella pertussis
caauucguugaucuggccgucga

SEQ ID NO: 322132 - RNA, 23 nt, Bordetella pertussis
cacaaagcggguugcggcagcgc

SEQ ID NO: 322133 - RNA, 24 nt, Bordetella pertussis
cacaaagcggguugcggcagcgcc

SEQ ID NO: 322134 - RNA, 11 nt, Bordetella pertussis
cacacauggcg

SEQ ID NO: 322135 - RNA, 21 nt, Bordetella pertussis
cacaccagguugucggcgcca

SEQ ID NO: 322136 - RNA, 22 nt, Bordetella pertussis
cacaccagguugucggcgccac

SEQ ID NO: 322137 - RNA, 15 nt, Bordetella pertussis
cacacgaucagcgcc

SEQ ID NO: 322138 - RNA, 16 nt, Bordetella pertussis
cacacgaucgucagca

SEQ ID NO: 322139 - RNA, 15 nt, Bordetella pertussis
cacacgccuucggcg

SEQ ID NO: 322140 - RNA, 12 nt, Bordetella pertussis
cacagccaggcc

SEQ ID NO: 322141 - RNA, 13 nt, Bordetella pertussis
cacagccaggccg

SEQ ID NO: 322142 - RNA, 14 nt, Bordetella pertussis
cacagccaggccga

SEQ ID NO: 322143 - RNA, 20 nt, Bordetella pertussis
cacagccaggccgaucagca

SEQ ID NO: 322144 - RNA, 13 nt, Bordetella pertussis
cacagccacugcg

SEQ ID NO: 322145 - RNA, 19 nt, Bordetella pertussis
cacagccauugcccacagc

SEQ ID NO: 322146 - RNA, 23 nt, Bordetella pertussis
cacagccauugcccacagcacgg

SEQ ID NO: 322147 - RNA, 21 nt, Bordetella pertussis
cacagcccgaucgacggccgc

SEQ ID NO: 322148 - RNA, 16 nt, Bordetella pertussis
cacagcccggccccca

SEQ ID NO: 322149 - RNA, 21 nt, Bordetella pertussis
cacagccggggcgagcgcagc

SEQ ID NO: 322150 - RNA, 22 nt, Bordetella pertussis
cacagccggggcgagcgcagcc

SEQ ID NO: 322151 - RNA, 20 nt, Bordetella pertussis
cacagcggcgcgagcgcaca

SEQ ID NO: 322152 - RNA, 18 nt, Bordetella pertussis
cacagcguggcgaagucg

SEQ ID NO: 322153 - RNA, 18 nt, Bordetella pertussis
cacaggaacagccugccc

SEQ ID NO: 322154 - RNA, 16 nt, Bordetella pertussis
cacaggcccaugccgc

SEQ ID NO: 322155 - RNA, 20 nt, Bordetella pertussis
cacaggcccgcgcggccagc

SEQ ID NO: 322156 - RNA, 21 nt, Bordetella pertussis
cacaggccuucguugaccgcu

SEQ ID NO: 322157 - RNA, 14 nt, Bordetella pertussis
cacaggcggcgccg

SEQ ID NO: 322158 - RNA, 16 nt, Bordetella pertussis
cacaggcggcgccggc

SEQ ID NO: 322159 - RNA, 18 nt, Bordetella pertussis
cacaggcggcgccggcac

SEQ ID NO: 322160 - RNA, 20 nt, Bordetella pertussis
cacagggggacuggcacccg

SEQ ID NO: 322161 - RNA, 16 nt, Bordetella pertussis
cacaggguggcgccca

SEQ ID NO: 322162 - RNA, 20 nt, Bordetella pertussis
cacagguagaucagccgcug

SEQ ID NO: 322163 - RNA, 14 nt, Bordetella pertussis
cacaggugcgcggc

SEQ ID NO: 322164 - RNA, 15 nt, Bordetella pertussis
cacaggugcgcggcg

SEQ ID NO: 322165 - RNA, 18 nt, Bordetella pertussis
cacaggugcgcggcgcgc

SEQ ID NO: 322166 - RNA, 17 nt, Bordetella pertussis
cacagguuggccgcgac

SEQ ID NO: 322167 - RNA, 18 nt, Bordetella pertussis
cacagguuggccgcgacg

SEQ ID NO: 322168 - RNA, 18 nt, Bordetella pertussis
cacagugucuaucauggc

SEQ ID NO: 322169 - RNA, 13 nt, Bordetella pertussis
cacaguucggcca

SEQ ID NO: 322170 - RNA, 15 nt, Bordetella pertussis
cacaguucggccagc

SEQ ID NO: 322171 - RNA, 14 nt, Bordetella pertussis
cacauacgccgccg

SEQ ID NO: 322172 - RNA, 17 nt, Bordetella pertussis
cacauagcggccggcgc

SEQ ID NO: 322173 - RNA, 19 nt, Bordetella pertussis
cacauagcggccggcgcgc

SEQ ID NO: 322174 - RNA, 18 nt, Bordetella pertussis
cacaucagcgugccgccg

SEQ ID NO: 322175 - RNA, 19 nt, Bordetella pertussis
cacaucagcgugccgccgg

SEQ ID NO: 322176 - RNA, 14 nt, Bordetella pertussis
cacaucaucgacca

SEQ ID NO: 322177 - RNA, 13 nt, Bordetella pertussis
cacauccagcgcc

SEQ ID NO: 322178 - RNA, 14 nt, Bordetella pertussis
cacauccagcgcca

SEQ ID NO: 322179 - RNA, 17 nt, Bordetella pertussis
cacauccagcgccagca

SEQ ID NO: 322180 - RNA, 23 nt, Bordetella pertussis
cacauccagcgccagcaccggca

SEQ ID NO: 322181 - RNA, 20 nt, Bordetella pertussis
cacaucgaauuugaacagcc

SEQ ID NO: 322182 - RNA, 21 nt, Bordetella pertussis
cacaucgaauuugaacagccg

SEQ ID NO: 322183 - RNA, 23 nt, Bordetella pertussis
cacaucgaauuugaacagccgcc

SEQ ID NO: 322184 - RNA, 14 nt, Bordetella pertussis
cacaucgcccggca

SEQ ID NO: 322185 - RNA, 13 nt, Bordetella pertussis
cacaucggccacc

SEQ ID NO: 322186 - RNA, 16 nt, Bordetella pertussis
cacaucgucgacgucg

SEQ ID NO: 322187 - RNA, 17 nt, Bordetella pertussis
cacaucgucgacgucga

SEQ ID NO: 322188 - RNA, 16 nt, Bordetella pertussis
cacaugcccggccacc

SEQ ID NO: 322189 - RNA, 15 nt, Bordetella pertussis
cacauggggacuggc

SEQ ID NO: 322190 - RNA, 14 nt, Bordetella pertussis
cacauggcgcgccg

SEQ ID NO: 322191 - RNA, 16 nt, Bordetella pertussis
caccaagggcgccggg

SEQ ID NO: 322192 - RNA, 17 nt, Bordetella pertussis
caccaagggcgccgggc

SEQ ID NO: 322193 - RNA, 17 nt, Bordetella pertussis
caccaaucuugccaggc

SEQ ID NO: 322194 - RNA, 13 nt, Bordetella pertussis
caccaccgagggc

SEQ ID NO: 322195 - RNA, 13 nt, Bordetella pertussis
caccaccgcccgc

SEQ ID NO: 322196 - RNA, 18 nt, Bordetella pertussis
caccacgaugucggcgca

SEQ ID NO: 322197 - RNA, 18 nt, Bordetella pertussis
caccacgcccgcgccgca

SEQ ID NO: 322198 - RNA, 20 nt, Bordetella pertussis
caccacgccgcccagcgcgu

SEQ ID NO: 322199 - RNA, 17 nt, Bordetella pertussis
caccacgcgcaccagcu

SEQ ID NO: 322200 - RNA, 20 nt, Bordetella pertussis
caccacgcgcaccagcuugg

SEQ ID NO: 322201 - RNA, 23 nt, Bordetella pertussis
caccacugcaaggcccgcccggg

SEQ ID NO: 322202 - RNA, 13 nt, Bordetella pertussis
caccaggccggcc

SEQ ID NO: 322203 - RNA, 15 nt, Bordetella pertussis
caccaggccggccag

SEQ ID NO: 322204 - RNA, 15 nt, Bordetella pertussis
caccaggccgucggc

SEQ ID NO: 322205 - RNA, 19 nt, Bordetella pertussis
caccaggccgucggccagg

SEQ ID NO: 322206 - RNA, 15 nt, Bordetella pertussis
caccaggcgcacggc

SEQ ID NO: 322207 - RNA, 19 nt, Bordetella pertussis
caccaggcgcacggcggca

SEQ ID NO: 322208 - RNA, 17 nt, Bordetella pertussis
caccaggcgcucgcgcg

SEQ ID NO: 322209 - RNA, 19 nt, Bordetella pertussis
caccaggcgcucgcgcgcc

SEQ ID NO: 322210 - RNA, 20 nt, Bordetella pertussis
caccaggcgcucgcgcgcca

SEQ ID NO: 322211 - RNA, 22 nt, Bordetella pertussis
caccaggcgcgcgccaucgacg

SEQ ID NO: 322212 - RNA, 16 nt, Bordetella pertussis
caccaggcugaucacc

SEQ ID NO: 322213 - RNA, 21 nt, Bordetella pertussis
caccaggcugaucacccacag

SEQ ID NO: 322214 - RNA, 13 nt, Bordetella pertussis
caccagggccagc

SEQ ID NO: 322215 - RNA, 16 nt, Bordetella pertussis
caccagggccagcuug

SEQ ID NO: 322216 - RNA, 15 nt, Bordetella pertussis
caccagggcgcccgc

SEQ ID NO: 322217 - RNA, 19 nt, Bordetella pertussis
caccagggcgcccgccgac

SEQ ID NO: 322218 - RNA, 14 nt, Bordetella pertussis
caccagggcgcgca

SEQ ID NO: 322219 - RNA, 15 nt, Bordetella pertussis
caccagggcgcgcag

SEQ ID NO: 322220 - RNA, 23 nt, Bordetella pertussis
caccaggucgcggugcgccacga

SEQ ID NO: 322221 - RNA, 17 nt, Bordetella pertussis
caccagguugucggcgc

SEQ ID NO: 322222 - RNA, 23 nt, Bordetella pertussis
caccagguuuuccacagccaggc

SEQ ID NO: 322223 - RNA, 17 nt, Bordetella pertussis
caccagucccgcaccga

SEQ ID NO: 322224 - RNA, 15 nt, Bordetella pertussis
caccagugcgccggc

SEQ ID NO: 322225 - RNA, 17 nt, Bordetella pertussis
caccagugcgccggcgc

SEQ ID NO: 322226 - RNA, 15 nt, Bordetella pertussis
caccaucaacgggcc

SEQ ID NO: 322227 - RNA, 17 nt, Bordetella pertussis
caccaucaacgggccgc

SEQ ID NO: 322228 - RNA, 19 nt, Bordetella pertussis
caccaucaacgggccgcug

SEQ ID NO: 322229 - RNA, 16 nt, Bordetella pertussis
caccaucgccgccugc

SEQ ID NO: 322230 - RNA, 23 nt, Bordetella pertussis
caccaucguugccugggugcugg

SEQ ID NO: 322231 - RNA, 23 nt, Bordetella pertussis
caccaugccggggaacaggucgu

SEQ ID NO: 322232 - RNA, 22 nt, Bordetella pertussis
caccaugcgcaccaggcgcucg

SEQ ID NO: 322233 - RNA, 19 nt, Bordetella pertussis
caccaugcggucgaugacc

SEQ ID NO: 322234 - RNA, 22 nt, Bordetella pertussis
caccaugggcucgugcagcagg

SEQ ID NO: 322235 - RNA, 17 nt, Bordetella pertussis
caccaugucccuggcca

SEQ ID NO: 322236 - RNA, 21 nt, Bordetella pertussis
caccaugugcuugccgcagcg

SEQ ID NO: 322237 - RNA, 23 nt, Bordetella pertussis
caccaugugcuugccgcagcggc

SEQ ID NO: 322238 - RNA, 17 nt, Bordetella pertussis
caccauugccggcgcgc

SEQ ID NO: 322239 - RNA, 23 nt, Bordetella pertussis
cacccaugaacacuugacggcca

SEQ ID NO: 322240 - RNA, 13 nt, Bordetella pertussis
caccccgccgcug

SEQ ID NO: 322241 - RNA, 13 nt, Bordetella pertussis
caccccgggcggg

SEQ ID NO: 322242 - RNA, 21 nt, Bordetella pertussis
caccccggucagcagggcgcc

SEQ ID NO: 322243 - RNA, 16 nt, Bordetella pertussis
caccccggugucgccg

SEQ ID NO: 322244 - RNA, 18 nt, Bordetella pertussis
caccccguagcgcaucgc

SEQ ID NO: 322245 - RNA, 20 nt, Bordetella pertussis
caccccgucaucgccgcggc

SEQ ID NO: 322246 - RNA, 18 nt, Bordetella pertussis
cacccgacagcucggacg

SEQ ID NO: 322247 - RNA, 20 nt, Bordetella pertussis
cacccgauacgacacgccgc

SEQ ID NO: 322248 - RNA, 23 nt, Bordetella pertussis
cacccgauacgacacgccgcgcg

SEQ ID NO: 322249 - RNA, 22 nt, Bordetella pertussis
cacccgaugacggggcggcgcc

SEQ ID NO: 322250 - RNA, 17 nt, Bordetella pertussis
cacccgcacgccggccu

SEQ ID NO: 322251 - RNA, 21 nt, Bordetella pertussis
cacccgcacgggcagacgcca

SEQ ID NO: 322252 - RNA, 14 nt, Bordetella pertussis
cacccgcaggccgu

SEQ ID NO: 322253 - RNA, 19 nt, Bordetella pertussis
cacccggaucgacaggaac

SEQ ID NO: 322254 - RNA, 19 nt, Bordetella pertussis
cacccggcccaugaccggc

SEQ ID NO: 322255 - RNA, 12 nt, Bordetella pertussis
cacccggccgcu

SEQ ID NO: 322256 - RNA, 13 nt, Bordetella pertussis
cacccggccgcug

SEQ ID NO: 322257 - RNA, 14 nt, Bordetella pertussis
cacccugcaggccg

SEQ ID NO: 322258 - RNA, 16 nt, Bordetella pertussis
cacccugcaggccggg

SEQ ID NO: 322259 - RNA, 23 nt, Bordetella pertussis
cacccuggaugccaugccgggca

SEQ ID NO: 322260 - RNA, 15 nt, Bordetella pertussis
cacccuggcacgcug

SEQ ID NO: 322261 - RNA, 21 nt, Bordetella pertussis
cacccugguacccaugcgggg

SEQ ID NO: 322262 - RNA, 15 nt, Bordetella pertussis
cacccugucauacgc

SEQ ID NO: 322263 - RNA, 14 nt, Bordetella pertussis
cacccuugccgcgg

SEQ ID NO: 322264 - RNA, 17 nt, Bordetella pertussis
caccgagauguuccugc

SEQ ID NO: 322265 - RNA, 23 nt, Bordetella pertussis
caccgagauguuccugcgcgaca

SEQ ID NO: 322266 - RNA, 19 nt, Bordetella pertussis
caccgagggccggaacagc

SEQ ID NO: 322267 - RNA, 17 nt, Bordetella pertussis
caccgagcugagcacca

SEQ ID NO: 322268 - RNA, 20 nt, Bordetella pertussis
caccgcaaggaaguggccga

SEQ ID NO: 322269 - RNA, 24 nt, Bordetella pertussis
caccgcaaggaaguggccgagcgc

SEQ ID NO: 322270 - RNA, 15 nt, Bordetella pertussis
caccgcaggugccug

SEQ ID NO: 322271 - RNA, 18 nt, Bordetella pertussis
caccgcaggugccugucc

SEQ ID NO: 322272 - RNA, 13 nt, Bordetella pertussis
caccgcaucgcgc

SEQ ID NO: 322273 - RNA, 17 nt, Bordetella pertussis
caccgcaucgcgcagcg

SEQ ID NO: 322274 - RNA, 15 nt, Bordetella pertussis
caccgcaugggccag

SEQ ID NO: 322275 - RNA, 16 nt, Bordetella pertussis
caccgcaugggccagg

SEQ ID NO: 322276 - RNA, 23 nt, Bordetella pertussis
caccgcauggggcgaggucagca

SEQ ID NO: 322277 - RNA, 13 nt, Bordetella pertussis
caccgccacgcgg

SEQ ID NO: 322278 - RNA, 18 nt, Bordetella pertussis
caccgccacgcgguccag

SEQ ID NO: 322279 - RNA, 14 nt, Bordetella pertussis
caccgccacgucau

SEQ ID NO: 322280 - RNA, 15 nt, Bordetella pertussis
caccgccaccguggc

SEQ ID NO: 322281 - RNA, 16 nt, Bordetella pertussis
caccgccagcccgguc

SEQ ID NO: 322282 - RNA, 23 nt, Bordetella pertussis
caccgccagcccggucgucccca

SEQ ID NO: 322283 - RNA, 21 nt, Bordetella pertussis
caccgccagcgcgucguccag

SEQ ID NO: 322284 - RNA, 21 nt, Bordetella pertussis
caccgcccagaaugcggcgga

SEQ ID NO: 322285 - RNA, 15 nt, Bordetella pertussis
caccgcccaggcgca

SEQ ID NO: 322286 - RNA, 16 nt, Bordetella pertussis
caccgccgaugccgcc

SEQ ID NO: 322287 - RNA, 18 nt, Bordetella pertussis
caccgccgauaccacgcg

SEQ ID NO: 322288 - RNA, 21 nt, Bordetella pertussis
caccgccgauaccacgcgcgg

SEQ ID NO: 322289 - RNA, 12 nt, Bordetella pertussis
caccgccgcccg

SEQ ID NO: 322290 - RNA, 13 nt, Bordetella pertussis
caccgccgcccgc

SEQ ID NO: 322291 - RNA, 16 nt, Bordetella pertussis
caccgccgccgccacc

SEQ ID NO: 322292 - RNA, 13 nt, Bordetella pertussis
caccgccgcggcg

SEQ ID NO: 322293 - RNA, 22 nt, Bordetella pertussis
caccgccgcggcgaugccggcc

SEQ ID NO: 322294 - RNA, 14 nt, Bordetella pertussis
caccgccgcguccu

SEQ ID NO: 322295 - RNA, 20 nt, Bordetella pertussis
caccgccugcugcauguccu

SEQ ID NO: 322296 - RNA, 15 nt, Bordetella pertussis
caccgccugcugcgc

SEQ ID NO: 322297 - RNA, 21 nt, Bordetella pertussis
caccgccugugccagcuggcc

SEQ ID NO: 322298 - RNA, 20 nt, Bordetella pertussis
caccgcgcagcccggcgugc

SEQ ID NO: 322299 - RNA, 22 nt, Bordetella pertussis
caccucggacgagacaggcgcg

SEQ ID NO: 322300 - RNA, 23 nt, Bordetella pertussis
caccucggacgagacaggcgcgc

SEQ ID NO: 322301 - RNA, 13 nt, Bordetella pertussis
caccucggccucg

SEQ ID NO: 322302 - RNA, 16 nt, Bordetella pertussis
caccucggccucgcug

SEQ ID NO: 322303 - RNA, 20 nt, Bordetella pertussis
caccucggccucgcuggcga

SEQ ID NO: 322304 - RNA, 17 nt, Bordetella pertussis
caccucggcgcccagcu

SEQ ID NO: 322305 - RNA, 13 nt, Bordetella pertussis
caccucggcgugg

SEQ ID NO: 322306 - RNA, 19 nt, Bordetella pertussis
caccucguaaguggcggcg

SEQ ID NO: 322307 - RNA, 23 nt, Bordetella pertussis
caccucguccguuucgucggcgc

SEQ ID NO: 322308 - RNA, 17 nt, Bordetella pertussis
caccucgucguccagcg

SEQ ID NO: 322309 - RNA, 19 nt, Bordetella pertussis
caccucgucguccagcguc

SEQ ID NO: 322310 - RNA, 21 nt, Bordetella pertussis
caccucgucguccagcgucau

SEQ ID NO: 322311 - RNA, 17 nt, Bordetella pertussis
caccucuucagcccggc

SEQ ID NO: 322312 - RNA, 21 nt, Bordetella pertussis
caccucuucagcccggcgcgc

SEQ ID NO: 322313 - RNA, 17 nt, Bordetella pertussis
caccugaacaccggcgc

SEQ ID NO: 322314 - RNA, 21 nt, Bordetella pertussis
caccugaacaccggcgcgccu

SEQ ID NO: 322315 - RNA, 15 nt, Bordetella pertussis
caccugcaccgccgc

SEQ ID NO: 322316 - RNA, 20 nt, Bordetella pertussis
caccugcaccgucaggugca

SEQ ID NO: 322317 - RNA, 14 nt, Bordetella pertussis
caccugcaggccgc

SEQ ID NO: 322318 - RNA, 19 nt, Bordetella pertussis
caccugcaggccgccggcc

SEQ ID NO: 322319 - RNA, 20 nt, Bordetella pertussis
caccugcagggucagcccgc

SEQ ID NO: 322320 - RNA, 22 nt, Bordetella pertussis
caccugcagggucagcccgcca

SEQ ID NO: 322321 - RNA, 19 nt, Bordetella pertussis
caccugcgucugcacgcug

SEQ ID NO: 322322 - RNA, 14 nt, Bordetella pertussis
caccugcguggccu

SEQ ID NO: 322323 - RNA, 14 nt, Bordetella pertussis
caccugcugcggca

SEQ ID NO: 322324 - RNA, 19 nt, Bordetella pertussis
caccugcucggugagcggc

SEQ ID NO: 322325 - RNA, 17 nt, Bordetella pertussis
caccugcuugagcacca

SEQ ID NO: 322326 - RNA, 21 nt, Bordetella pertussis
caccuggccacaagcggcccc

SEQ ID NO: 322327 - RNA, 15 nt, Bordetella pertussis
caccuggcgcccggc

SEQ ID NO: 322328 - RNA, 20 nt, Bordetella pertussis
caccuggcgcccggcggcgc

SEQ ID NO: 322329 - RNA, 12 nt, Bordetella pertussis
caccugggccgc

SEQ ID NO: 322330 - RNA, 16 nt, Bordetella pertussis
caccugggccgccugc

SEQ ID NO: 322331 - RNA, 14 nt, Bordetella pertussis
caccugggcgucga

SEQ ID NO: 322332 - RNA, 17 nt, Bordetella pertussis
caccuggucgucggcca

SEQ ID NO: 322333 - RNA, 18 nt, Bordetella pertussis
caccuggucgucggccac

SEQ ID NO: 322334 - RNA, 16 nt, Bordetella pertussis
caccugguggcgcugg

SEQ ID NO: 322335 - RNA, 17 nt, Bordetella pertussis
caccugguccugcguga

SEQ ID NO: 322336 - RNA, 16 nt, Bordetella pertussis
caccuguucggcggcg

SEQ ID NO: 322337 - RNA, 15 nt, Bordetella pertussis
caccuucagggcgcc

SEQ ID NO: 322338 - RNA, 16 nt, Bordetella pertussis
caccuucagggcgccg

SEQ ID NO: 322339 - RNA, 20 nt, Bordetella pertussis
caccuucagggcgccggcgu

SEQ ID NO: 322340 - RNA, 15 nt, Bordetella pertussis
caccuucgcgcagcg

SEQ ID NO: 322341 - RNA, 23 nt, Bordetella pertussis
caccuucgcgcagcggcgcgcgc

SEQ ID NO: 322342 - RNA, 21 nt, Bordetella pertussis
caccuucuuccaggcgcccgc

SEQ ID NO: 322343 - RNA, 21 nt, Bordetella pertussis
caccuucgaggaaagcggccu

SEQ ID NO: 322344 - RNA, 13 nt, Bordetella pertussis
caccuugcccacg

SEQ ID NO: 322345 - RNA, 15 nt, Bordetella pertussis
caccuugcgcgcgaa

SEQ ID NO: 322346 - RNA, 16 nt, Bordetella pertussis
caccuugcgcgcgaac

SEQ ID NO: 322347 - RNA, 15 nt, Bordetella pertussis
caccuuggcccggcg

SEQ ID NO: 322348 - RNA, 16 nt, Bordetella pertussis
caccuugggcgccugc

SEQ ID NO: 322349 - RNA, 17 nt, Bordetella pertussis
caccuuguacuggucgc

SEQ ID NO: 322350 - RNA, 20 nt, Bordetella pertussis
caccuuguacuggucgcgca

SEQ ID NO: 322351 - RNA, 23 nt, Bordetella pertussis
caccuuguacuggucgcgcagcu

SEQ ID NO: 322352 - RNA, 19 nt, Bordetella pertussis
caccuugucgcgcagcgcc

SEQ ID NO: 322353 - RNA, 16 nt, Bordetella pertussis
caccuuguuggcgccg

SEQ ID NO: 322354 - RNA, 19 nt, Bordetella pertussis
caccuuguuggcgccggcc

SEQ ID NO: 322355 - RNA, 18 nt, Bordetella pertussis
cacgaaacccacggcgau

SEQ ID NO: 322356 - RNA, 19 nt, Bordetella pertussis
cacgaaagcgcccaggccg

SEQ ID NO: 322357 - RNA, 20 nt, Bordetella pertussis
cacgaaagcgcccaggccga

SEQ ID NO: 322358 - RNA, 14 nt, Bordetella pertussis
cacgaagcagguga

SEQ ID NO: 322359 - RNA, 14 nt, Bordetella pertussis
cacgaagccgaugc

SEQ ID NO: 322360 - RNA, 21 nt, Bordetella pertussis
cacgaaggcgaucugcggcgu

SEQ ID NO: 322361 - RNA, 14 nt, Bordetella pertussis
cacgaaggcgccga

SEQ ID NO: 322362 - RNA, 16 nt, Bordetella pertussis
cacgaaggcgccgaaa

SEQ ID NO: 322363 - RNA, 20 nt, Bordetella pertussis
cacgaaguacucgccggcgc

SEQ ID NO: 322364 - RNA, 21 nt, Bordetella pertussis
cacgaaguacucgccggcgcu

SEQ ID NO: 322365 - RNA, 20 nt, Bordetella pertussis
cacgaagucgaaccagccgu

SEQ ID NO: 322366 - RNA, 14 nt, Bordetella pertussis
cacgacacgcccag

SEQ ID NO: 322367 - RNA, 15 nt, Bordetella pertussis
cacgacacgcccagc

SEQ ID NO: 322368 - RNA, 14 nt, Bordetella pertussis
cacgaccaccagcg

SEQ ID NO: 322369 - RNA, 16 nt, Bordetella pertussis
cacgaccaccagcgca

SEQ ID NO: 322370 - RNA, 18 nt, Bordetella pertussis
cacgaccagcaggcccac

SEQ ID NO: 322371 - RNA, 20 nt, Bordetella pertussis
cacgaccaggccguggccca

SEQ ID NO: 322372 - RNA, 16 nt, Bordetella pertussis
cacgaccggcucgggc

SEQ ID NO: 322373 - RNA, 13 nt, Bordetella pertussis
cacgaccugcgca

SEQ ID NO: 322374 - RNA, 18 nt, Bordetella pertussis
cacgaccuuggcggccga

SEQ ID NO: 322375 - RNA, 22 nt, Bordetella pertussis
cacgaccuuggcggccgacagc

SEQ ID NO: 322376 - RNA, 16 nt, Bordetella pertussis
cacgacgacggccggc

SEQ ID NO: 322377 - RNA, 18 nt, Bordetella pertussis
cacgacgacggccggcgc

SEQ ID NO: 322378 - RNA, 14 nt, Bordetella pertussis
cacgacggccuccg

SEQ ID NO: 322379 - RNA, 16 nt, Bordetella pertussis
cacgacgccgucgcgg

SEQ ID NO: 322380 - RNA, 23 nt, Bordetella pertussis
cacgacgggauugccgucacgcg

SEQ ID NO: 322381 - RNA, 21 nt, Bordetella pertussis
cacgacgguuaacgaaucgcu

SEQ ID NO: 322382 - RNA, 22 nt, Bordetella pertussis
cacgacguagucggcgcccagc

SEQ ID NO: 322383 - RNA, 22 nt, Bordetella pertussis
cacgacgucguagugcgcgccg

SEQ ID NO: 322384 - RNA, 12 nt, Bordetella pertussis
cacgacguggcc

SEQ ID NO: 322385 - RNA, 17 nt, Bordetella pertussis
cacgagcaguacacgcg

SEQ ID NO: 322386 - RNA, 19 nt, Bordetella pertussis
cacgagcaguacacgcgca

SEQ ID NO: 322387 - RNA, 22 nt, Bordetella pertussis
cacgaggcgcucggccuugccg

SEQ ID NO: 322388 - RNA, 16 nt, Bordetella pertussis
cacgaggucuugccga

SEQ ID NO: 322389 - RNA, 23 nt, Bordetella pertussis
cacgauauuggcgucggccgccg

SEQ ID NO: 322390 - RNA, 15 nt, Bordetella pertussis
cacgaucaccacgcc

SEQ ID NO: 322391 - RNA, 13 nt, Bordetella pertussis
cacgaucagcgcc

SEQ ID NO: 322392 - RNA, 18 nt, Bordetella pertussis
cacgaucagcgcccaggu

SEQ ID NO: 322393 - RNA, 23 nt, Bordetella pertussis
cacgaucaucaggaugaacaucg

SEQ ID NO: 322394 - RNA, 14 nt, Bordetella pertussis
cacgauccacggcc

SEQ ID NO: 322395 - RNA, 17 nt, Bordetella pertussis
cacgauccacggccggc

SEQ ID NO: 322396 - RNA, 18 nt, Bordetella pertussis
cacgauccacggccggcg

SEQ ID NO: 322397 - RNA, 20 nt, Bordetella pertussis
cacgauccacggccggcgca

SEQ ID NO: 322398 - RNA, 13 nt, Bordetella pertussis
cacgaucgcgccg

SEQ ID NO: 322399 - RNA, 15 nt, Bordetella pertussis
cacgaucgcgccggc

SEQ ID NO: 322400 - RNA, 16 nt, Bordetella pertussis
cacgaucgcggcgcug

SEQ ID NO: 322401 - RNA, 15 nt, Bordetella pertussis
cacgaucgucagcag

SEQ ID NO: 322402 - RNA, 19 nt, Bordetella pertussis
cacgaucggcgccuggccg

SEQ ID NO: 322403 - RNA, 20 nt, Bordetella pertussis
cacgaugaucgcgccgacga

SEQ ID NO: 322404 - RNA, 19 nt, Bordetella pertussis
cacgaugaacgcgcgcaac

SEQ ID NO: 322405 - RNA, 20 nt, Bordetella pertussis
cacgaugcccagggccgcgc

SEQ ID NO: 322406 - RNA, 14 nt, Bordetella pertussis
cacgaugccgucgc

SEQ ID NO: 322407 - RNA, 15 nt, Bordetella pertussis
cacgaugccgucgcc

SEQ ID NO: 322408 - RNA, 17 nt, Bordetella pertussis
cacgauggaaucgucga

SEQ ID NO: 322409 - RNA, 15 nt, Bordetella pertussis
cacgauggccgcgcc

SEQ ID NO: 322410 - RNA, 13 nt, Bordetella pertussis
cacgauggcgccc

SEQ ID NO: 322411 - RNA, 14 nt, Bordetella pertussis
cacgauggcgcgcg

SEQ ID NO: 322412 - RNA, 16 nt, Bordetella pertussis
cacgauggggccgucg

SEQ ID NO: 322413 - RNA, 17 nt, Bordetella pertussis
cacgauggggccgucgc

SEQ ID NO: 322414 - RNA, 19 nt, Bordetella pertussis
cacgaugguaucggccggg

SEQ ID NO: 322415 - RNA, 19 nt, Bordetella pertussis
cacgauggccggcgcgaac

SEQ ID NO: 322416 - RNA, 17 nt, Bordetella pertussis
cacgaugucguccagcu

SEQ ID NO: 322417 - RNA, 20 nt, Bordetella pertussis
cacgauguugcgcaggcugu

SEQ ID NO: 322418 - RNA, 14 nt, Bordetella pertussis
cacgcacaccgccc

SEQ ID NO: 322419 - RNA, 15 nt, Bordetella pertussis
cacgcacagcaccug

SEQ ID NO: 322420 - RNA, 22 nt, Bordetella pertussis
cacgcaccaggcgcacggcggc

SEQ ID NO: 322421 - RNA, 14 nt, Bordetella pertussis
cacgcagcugaacg

SEQ ID NO: 322422 - RNA, 19 nt, Bordetella pertussis
cacgcaggauaccggagcg

SEQ ID NO: 322423 - RNA, 21 nt, Bordetella pertussis
cacgcaggauaccggagcggc

SEQ ID NO: 322424 - RNA, 17 nt, Bordetella pertussis
cacgcauuugcagcggc

SEQ ID NO: 322425 - RNA, 19 nt, Bordetella pertussis
cacgccagaacgcugaugc

SEQ ID NO: 322426 - RNA, 14 nt, Bordetella pertussis
cacgccagcggcga

SEQ ID NO: 322427 - RNA, 22 nt, Bordetella pertussis
cacgcccgccagcagcucggcg

SEQ ID NO: 322428 - RNA, 17 nt, Bordetella pertussis
cacgcccgcggcgccca

SEQ ID NO: 322429 - RNA, 14 nt, Bordetella pertussis
cacgcccgcgcgcg

SEQ ID NO: 322430 - RNA, 15 nt, Bordetella pertussis
cacgcccgucucgcg

SEQ ID NO: 322431 - RNA, 19 nt, Bordetella pertussis
cacgcccgucucgcgcgcc

SEQ ID NO: 322432 - RNA, 20 nt, Bordetella pertussis
cacgcccgucucgcgcgcca

SEQ ID NO: 322433 - RNA, 13 nt, Bordetella pertussis
cacgcccuggccg

SEQ ID NO: 322434 - RNA, 15 nt, Bordetella pertussis
cacgcccuggcgguc

SEQ ID NO: 322435 - RNA, 12 nt, Bordetella pertussis
cacgccgccggc

SEQ ID NO: 322436 - RNA, 13 nt, Bordetella pertussis
cacgccgccgaag

SEQ ID NO: 322437 - RNA, 18 nt, Bordetella pertussis
cacgccgcgcgcgucgcc

SEQ ID NO: 322438 - RNA, 19 nt, Bordetella pertussis
cacgccgcgcgcgucgccg

SEQ ID NO: 322439 - RNA, 20 nt, Bordetella pertussis
cacgccgcgcucguugcgcg

SEQ ID NO: 322440 - RNA, 16 nt, Bordetella pertussis
cacgccgccuggcccg

SEQ ID NO: 322441 - RNA, 17 nt, Bordetella pertussis
cacgccgcugauguggc

SEQ ID NO: 322442 - RNA, 15 nt, Bordetella pertussis
cacgccgcgccaggc

SEQ ID NO: 322443 - RNA, 13 nt, Bordetella pertussis
cacgccuggccgc

SEQ ID NO: 322444 - RNA, 16 nt, Bordetella pertussis
cacgccuggccgcgcu

SEQ ID NO: 322445 - RNA, 17 nt, Bordetella pertussis
cacgccuucgagcacca

SEQ ID NO: 322446 - RNA, 16 nt, Bordetella pertussis
cacgccuugcucgacc

SEQ ID NO: 322447 - RNA, 19 nt, Bordetella pertussis
cacgccuugcucgaccagg

SEQ ID NO: 322448 - RNA, 22 nt, Bordetella pertussis
cacgccuugcucgaccaggucg

SEQ ID NO: 322449 - RNA, 20 nt, Bordetella pertussis
cacgccuuguucgcgcgcgg

SEQ ID NO: 322450 - RNA, 13 nt, Bordetella pertussis
cacgcgcaacgcc

SEQ ID NO: 322451 - RNA, 17 nt, Bordetella pertussis
cacgcgcaacgccgcca

SEQ ID NO: 322452 - RNA, 19 nt, Bordetella pertussis
cacgcgcaaggcgggcugg

SEQ ID NO: 322453 - RNA, 16 nt, Bordetella pertussis
cacgcgcaccaggccu

SEQ ID NO: 322454 - RNA, 13 nt, Bordetella pertussis
cacgcgcacggcc

SEQ ID NO: 322455 - RNA, 15 nt, Bordetella pertussis
cacgcgcagcacgcu

SEQ ID NO: 322456 - RNA, 15 nt, Bordetella pertussis
cacgcgccgccaggc

SEQ ID NO: 322457 - RNA, 18 nt, Bordetella pertussis
cacgcgccgccaggcgcg

SEQ ID NO: 322458 - RNA, 20 nt, Bordetella pertussis
cacgcgcgacgccguggugg

SEQ ID NO: 322459 - RNA, 14 nt, Bordetella pertussis
cacgcgcgcgccgc

SEQ ID NO: 322460 - RNA, 17 nt, Bordetella pertussis
cacgcgcgcggcgcggc

SEQ ID NO: 322461 - RNA, 19 nt, Bordetella pertussis
cacgcgcgcgggcgcgccg

SEQ ID NO: 322462 - RNA, 16 nt, Bordetella pertussis
cacgcgcgcgugcagg

SEQ ID NO: 322463 - RNA, 13 nt, Bordetella pertussis
cacgcgcgcuggc

SEQ ID NO: 322464 - RNA, 20 nt, Bordetella pertussis
cacgcgcgcuggcgcccggc

SEQ ID NO: 322465 - RNA, 16 nt, Bordetella pertussis
cacgcgcggcagcgcc

SEQ ID NO: 322466 - RNA, 19 nt, Bordetella pertussis
cacgcgcggcagcgccggg

SEQ ID NO: 322467 - RNA, 13 nt, Bordetella pertussis
cacgcgcggcggc

SEQ ID NO: 322468 - RNA, 22 nt, Bordetella pertussis
cacgcgcgguucgccgugcagg

SEQ ID NO: 322469 - RNA, 14 nt, Bordetella pertussis
cacggagggugcgc

SEQ ID NO: 322470 - RNA, 23 nt, Bordetella pertussis
cacggcaagacggcgcucggccu

SEQ ID NO: 322471 - RNA, 13 nt, Bordetella pertussis
cacggcaaugucg

SEQ ID NO: 322472 - RNA, 22 nt, Bordetella pertussis
cacggcaaugucgcaggccgcg

SEQ ID NO: 322473 - RNA, 15 nt, Bordetella pertussis
cacggccgcggccgg

SEQ ID NO: 322474 - RNA, 18 nt, Bordetella pertussis
cacggccgcggccggcac

SEQ ID NO: 322475 - RNA, 18 nt, Bordetella pertussis
cacggccggccaggcgcc

SEQ ID NO: 322476 - RNA, 19 nt, Bordetella pertussis
cacggccggccaggcgccg

SEQ ID NO: 322477 - RNA, 20 nt, Bordetella pertussis
cacggccggccaggcgccgc

SEQ ID NO: 322478 - RNA, 17 nt, Bordetella pertussis
cacggcgaugaacagcg

SEQ ID NO: 322479 - RNA, 20 nt, Bordetella pertussis
cacggcgaugcugccgucgc

SEQ ID NO: 322480 - RNA, 22 nt, Bordetella pertussis
cacggcgaugcugccgucgcca

SEQ ID NO: 322481 - RNA, 17 nt, Bordetella pertussis
cacggcgcacaccauca

SEQ ID NO: 322482 - RNA, 21 nt, Bordetella pertussis
cacggcgcgcccgcaggcggc

SEQ ID NO: 322483 - RNA, 13 nt, Bordetella pertussis
cacggcgcggcug

SEQ ID NO: 322484 - RNA, 15 nt, Bordetella pertussis
cacggcgcgggcggu

SEQ ID NO: 322485 - RNA, 20 nt, Bordetella pertussis
cacggcgcgggcggucggcg

SEQ ID NO: 322486 - RNA, 20 nt, Bordetella pertussis
cacggcggccaggccggcga

SEQ ID NO: 322487 - RNA, 15 nt, Bordetella pertussis
cacggcggcggcggu

SEQ ID NO: 322488 - RNA, 16 nt, Bordetella pertussis
cacggcgggccggcuc

SEQ ID NO: 322489 - RNA, 20 nt, Bordetella pertussis
cacggcgggccggcucggcg

SEQ ID NO: 322490 - RNA, 22 nt, Bordetella pertussis
cacggcgggccggcucggcggc

SEQ ID NO: 322491 - RNA, 17 nt, Bordetella pertussis
cacggcggugaccacca

SEQ ID NO: 322492 - RNA, 18 nt, Bordetella pertussis
cacggcggugaccaccag

SEQ ID NO: 322493 - RNA, 19 nt, Bordetella pertussis
cacggcggugaccaccagg

SEQ ID NO: 322494 - RNA, 20 nt, Bordetella pertussis
cacggcggugaccaccaggc

SEQ ID NO: 322495 - RNA, 23 nt, Bordetella pertussis
cacggcggugaccaccaggccgc

SEQ ID NO: 322496 - RNA, 23 nt, Bordetella pertussis
cacggcggugaucugcucgccgc

SEQ ID NO: 322497 - RNA, 17 nt, Bordetella pertussis
cacggcggugccgcgca

SEQ ID NO: 322498 - RNA, 14 nt, Bordetella pertussis
cacggcgucgaugc

SEQ ID NO: 322499 - RNA, 19 nt, Bordetella pertussis
cacggcgucgaugcgcgcg

SEQ ID NO: 322500 - RNA, 13 nt, Bordetella pertussis
cacggcgucgccg

SEQ ID NO: 322501 - RNA, 17 nt, Bordetella pertussis
cacggcgucgccggcca

SEQ ID NO: 322502 - RNA, 16 nt, Bordetella pertussis
cacggcguggcgcgca

SEQ ID NO: 322503 - RNA, 13 nt, Bordetella pertussis
cacggcguggcgc

SEQ ID NO: 322504 - RNA, 15 nt, Bordetella pertussis
cacggggacaggcac

SEQ ID NO: 322505 - RNA, 17 nt, Bordetella pertussis
cacggggcugucgcgcg

SEQ ID NO: 322506 - RNA, 16 nt, Bordetella pertussis
cacggggcaaccggcc

SEQ ID NO: 322507 - RNA, 13 nt, Bordetella pertussis
cacggguaccagg

SEQ ID NO: 322508 - RNA, 21 nt, Bordetella pertussis
cacgguaggcgcgucgcugcg

SEQ ID NO: 322509 - RNA, 17 nt, Bordetella pertussis
cacggucaaccacgcca

SEQ ID NO: 322510 - RNA, 18 nt, Bordetella pertussis
cacggucaaccacgccaa

SEQ ID NO: 322511 - RNA, 18 nt, Bordetella pertussis
cacggucuggcccacgcg

SEQ ID NO: 322512 - RNA, 22 nt, Bordetella pertussis
cacggucuggcccacgcgcacg

SEQ ID NO: 322513 - RNA, 19 nt, Bordetella pertussis
cacggucuggcgcgacaga

SEQ ID NO: 322514 - RNA, 16 nt, Bordetella pertussis
cacggugccgccgauc

SEQ ID NO: 322515 - RNA, 20 nt, Bordetella pertussis
cacggugccgccgaucugcu

SEQ ID NO: 322516 - RNA, 20 nt, Bordetella pertussis
cacgguggcgaaggccgccg

SEQ ID NO: 322517 - RNA, 21 nt, Bordetella pertussis
cacgguggcgaaggccgccgc

SEQ ID NO: 322518 - RNA, 19 nt, Bordetella pertussis
cacgguggcgcccggcggc

SEQ ID NO: 322519 - RNA, 13 nt, Bordetella pertussis
cacgguggcgccg

SEQ ID NO: 322520 - RNA, 18 nt, Bordetella pertussis
cacgguggcggugcucga

SEQ ID NO: 322521 - RNA, 16 nt, Bordetella pertussis
cacggugggcagcagc

SEQ ID NO: 322522 - RNA, 14 nt, Bordetella pertussis
cacggugucgaugg

SEQ ID NO: 322523 - RNA, 17 nt, Bordetella pertussis
cacguccagcacggccg

SEQ ID NO: 322524 - RNA, 19 nt, Bordetella pertussis
cacguccagcacggccgcg

SEQ ID NO: 322525 - RNA, 13 nt, Bordetella pertussis
cacguccagcgcc

SEQ ID NO: 322526 - RNA, 15 nt, Bordetella pertussis
cacguccagcggcgc

SEQ ID NO: 322527 - RNA, 18 nt, Bordetella pertussis
cacguccagcggcgcgac

SEQ ID NO: 322528 - RNA, 23 nt, Bordetella pertussis
cacguccagcggcgcgacgcgcu

SEQ ID NO: 322529 - RNA, 19 nt, Bordetella pertussis
cacguccggcacggcggca

SEQ ID NO: 322530 - RNA, 19 nt, Bordetella pertussis
cacguccggguuggcgaug

SEQ ID NO: 322531 - RNA, 23 nt, Bordetella pertussis
cacguccucgacguaagugccca

SEQ ID NO: 322532 - RNA, 14 nt, Bordetella pertussis
cacgucgccggcgu

SEQ ID NO: 322533 - RNA, 21 nt, Bordetella pertussis
cacgucggcggccgccuugac

SEQ ID NO: 322534 - RNA, 13 nt, Bordetella pertussis
cacgucggcgucg

SEQ ID NO: 322535 - RNA, 21 nt, Bordetella pertussis
cacgucgggcaggauggccau

SEQ ID NO: 322536 - RNA, 14 nt, Bordetella pertussis
cacgucgucgaugc

SEQ ID NO: 322537 - RNA, 16 nt, Bordetella pertussis
cacgugacgccggcga

SEQ ID NO: 322538 - RNA, 22 nt, Bordetella pertussis
cacgugcacgaucuugauccag

SEQ ID NO: 322539 - RNA, 15 nt, Bordetella pertussis
cacucgaugggcgcg

SEQ ID NO: 322540 - RNA, 14 nt, Bordetella pertussis
cacucuugccgcug

SEQ ID NO: 322541 - RNA, 18 nt, Bordetella pertussis
cacugagaaaggccgcca

SEQ ID NO: 322542 - RNA, 21 nt, Bordetella pertussis
cacugcagcaguucggcgucg

SEQ ID NO: 322543 - RNA, 13 nt, Bordetella pertussis
cacugcaggccau

SEQ ID NO: 322544 - RNA, 13 nt, Bordetella pertussis
cacugcaucgugc

SEQ ID NO: 322545 - RNA, 19 nt, Bordetella pertussis
cacugcaucgugcgcgagg

SEQ ID NO: 322546 - RNA, 17 nt, Bordetella pertussis
cacugccaggcgagcgc

SEQ ID NO: 322547 - RNA, 18 nt, Bordetella pertussis
cacugccaggcgagcgcc

SEQ ID NO: 322548 - RNA, 20 nt, Bordetella pertussis
cacugccaggcgagcgccgc

SEQ ID NO: 322549 - RNA, 18 nt, Bordetella pertussis
cacugccaguaggcgccc

SEQ ID NO: 322550 - RNA, 12 nt, Bordetella pertussis
cacugcggcccg

SEQ ID NO: 322551 - RNA, 21 nt, Bordetella pertussis
cacugcgucacgaaagcgccc

SEQ ID NO: 322552 - RNA, 14 nt, Bordetella pertussis
cacuggccgcgcuc

SEQ ID NO: 322553 - RNA, 22 nt, Bordetella pertussis
cacuggccuugugcgccgucgc

SEQ ID NO: 322554 - RNA, 13 nt, Bordetella pertussis
cacuggccagcaa

SEQ ID NO: 322555 - RNA, 11 nt, Bordetella pertussis
cacuggcgcgg

SEQ ID NO: 322556 - RNA, 12 nt, Bordetella pertussis
cacuggcgcggc

SEQ ID NO: 322557 - RNA, 14 nt, Bordetella pertussis
cacuggcgcggcgc

SEQ ID NO: 322558 - RNA, 20 nt, Bordetella pertussis
cacugggggacuggcacccg

SEQ ID NO: 322559 - RNA, 13 nt, Bordetella pertussis
cacuggguggcca

SEQ ID NO: 322560 - RNA, 17 nt, Bordetella pertussis
cacuggguggccagcgc

SEQ ID NO: 322561 - RNA, 13 nt, Bordetella pertussis
cacugucgccacg

SEQ ID NO: 322562 - RNA, 21 nt, Bordetella pertussis
cacuugcgaacggccgcccgg

SEQ ID NO: 322563 - RNA, 14 nt, Bordetella pertussis
cacuuggccggcga

SEQ ID NO: 322564 - RNA, 20 nt, Bordetella pertussis
cacuuucaucaaacgcggcg

SEQ ID NO: 322565 - RNA, 19 nt, Bordetella pertussis
cagaaauggaugcgcgccc

SEQ ID NO: 322566 - RNA, 23 nt, Bordetella pertussis
cagaaauggaugcgcgccccguc

SEQ ID NO: 322567 - RNA, 14 nt, Bordetella pertussis
cagaacagccgcga

SEQ ID NO: 322568 - RNA, 18 nt, Bordetella pertussis
cagaacagcggaucgccg

SEQ ID NO: 322569 - RNA, 15 nt, Bordetella pertussis
cagaacccggccggc

SEQ ID NO: 322570 - RNA, 16 nt, Bordetella pertussis
cagaacgacagcgaca

SEQ ID NO: 322571 - RNA, 21 nt, Bordetella pertussis
cagaagcugaccaccgucuug

SEQ ID NO: 322572 - RNA, 21 nt, Bordetella pertussis
cagaaggucugggccagcagg

SEQ ID NO: 322573 - RNA, 23 nt, Bordetella pertussis
cagaaggucugggccagcaggcu

SEQ ID NO: 322574 - RNA, 18 nt, Bordetella pertussis
cagaaguggucgcgcagg

SEQ ID NO: 322575 - RNA, 17 nt, Bordetella pertussis
cagauaccgccuuggcc

SEQ ID NO: 322576 - RNA, 17 nt, Bordetella pertussis
cagauaccggcauggca

SEQ ID NO: 322577 - RNA, 19 nt, Bordetella pertussis
cagauaccguccuugagcg

SEQ ID NO: 322578 - RNA, 14 nt, Bordetella pertussis
cagauaccgucuug

SEQ ID NO: 322579 - RNA, 21 nt, Bordetella pertussis
cagaucaucgagcaccgccuc

SEQ ID NO: 322580 - RNA, 21 nt, Bordetella pertussis
cagaugccguccuggccguca

SEQ ID NO: 322581 - RNA, 15 nt, Bordetella pertussis
cagaugcgcagcagg

SEQ ID NO: 322582 - RNA, 20 nt, Bordetella pertussis
cagaugcgcagcaggcgcgu

SEQ ID NO: 322583 - RNA, 15 nt, Bordetella pertussis
cagauggacuugacc

SEQ ID NO: 322584 - RNA, 17 nt, Bordetella pertussis
cagauggccagcagcgc

SEQ ID NO: 322585 - RNA, 18 nt, Bordetella pertussis
cagauggccagcagcgcc

SEQ ID NO: 322586 - RNA, 15 nt, Bordetella pertussis
cagauggcccuugcc

SEQ ID NO: 322587 - RNA, 20 nt, Bordetella pertussis
cagauggcccuugcccagcg

SEQ ID NO: 322588 - RNA, 15 nt, Bordetella pertussis
cagauggcgcagcgg

SEQ ID NO: 322589 - RNA, 23 nt, Bordetella pertussis
cagauggcgcuugugcgucggcu

SEQ ID NO: 322590 - RNA, 15 nt, Bordetella pertussis
cagaugggcggcgac

SEQ ID NO: 322591 - RNA, 16 nt, Bordetella pertussis
cagauguccgugcugg

SEQ ID NO: 322592 - RNA, 19 nt, Bordetella pertussis
cagcaacgccacgcgcgga

SEQ ID NO: 322593 - RNA, 13 nt, Bordetella pertussis
cagcaacgccggc

SEQ ID NO: 322594 - RNA, 15 nt, Bordetella pertussis
cagcaacgccggcgg

SEQ ID NO: 322595 - RNA, 17 nt, Bordetella pertussis
cagcaacgccggcggca

SEQ ID NO: 322596 - RNA, 22 nt, Bordetella pertussis
cagcaacggugagccggccacc

SEQ ID NO: 322597 - RNA, 17 nt, Bordetella pertussis
cagcaaugacgacgccg

SEQ ID NO: 322598 - RNA, 19 nt, Bordetella pertussis
cagcaaugacgacgccggc

SEQ ID NO: 322599 - RNA, 19 nt, Bordetella pertussis
cagcaauucgaccggcagg

SEQ ID NO: 322600 - RNA, 16 nt, Bordetella pertussis
cagcaauugccccagc

SEQ ID NO: 322601 - RNA, 18 nt, Bordetella pertussis
cagcacauacgccgccga

SEQ ID NO: 322602 - RNA, 15 nt, Bordetella pertussis
cagcacauggcgcgc

SEQ ID NO: 322603 - RNA, 17 nt, Bordetella pertussis
cagcacauggcgcgccg

SEQ ID NO: 322604 - RNA, 19 nt, Bordetella pertussis
cagcacauggcgcgccggc

SEQ ID NO: 322605 - RNA, 16 nt, Bordetella pertussis
cagcacaucgcccggc

SEQ ID NO: 322606 - RNA, 16 nt, Bordetella pertussis
cagcaccacggcggcc

SEQ ID NO: 322607 - RNA, 17 nt, Bordetella pertussis
cagcaccacgggcucgc

SEQ ID NO: 322608 - RNA, 20 nt, Bordetella pertussis
cagcaccacgggcucgcuga

SEQ ID NO: 322609 - RNA, 13 nt, Bordetella pertussis
cagcaccagcgcc

SEQ ID NO: 322610 - RNA, 15 nt, Bordetella pertussis
cagcaccagcgccug

SEQ ID NO: 322611 - RNA, 24 nt, Bordetella pertussis
cagcaccagggcgcgcagcaggcc

SEQ ID NO: 322612 - RNA, 14 nt, Bordetella pertussis
cagcaccaggccga

SEQ ID NO: 322613 - RNA, 18 nt, Bordetella pertussis
cagcaccaggccgccggc

SEQ ID NO: 322614 - RNA, 22 nt, Bordetella pertussis
cagcaccaggcuuugcgcgcca

SEQ ID NO: 322615 - RNA, 13 nt, Bordetella pertussis
cagcaccagggcg

SEQ ID NO: 322616 - RNA, 20 nt, Bordetella pertussis
cagcaccaugggcucgugca

SEQ ID NO: 322617 - RNA, 14 nt, Bordetella pertussis
cagcaccaugccga

SEQ ID NO: 322618 - RNA, 15 nt, Bordetella pertussis
cagcaccccgucggc

SEQ ID NO: 322619 - RNA, 17 nt, Bordetella pertussis
cagcaccgacaggccga

SEQ ID NO: 322620 - RNA, 18 nt, Bordetella pertussis
cagcaccgaugcgccggc

SEQ ID NO: 322621 - RNA, 21 nt, Bordetella pertussis
cagcaccgaugcgccggccug

SEQ ID NO: 322622 - RNA, 15 nt, Bordetella pertussis
cagcaccgccaccgu

SEQ ID NO: 322623 - RNA, 19 nt, Bordetella pertussis
cagcaccgccaccguggcg

SEQ ID NO: 322624 - RNA, 20 nt, Bordetella pertussis
cagcaccgccaccguggcgu

SEQ ID NO: 322625 - RNA, 12 nt, Bordetella pertussis
cagcaccgccgc

SEQ ID NO: 322626 - RNA, 19 nt, Bordetella pertussis
cagcaccgccgccaguucg

SEQ ID NO: 322627 - RNA, 14 nt, Bordetella pertussis
cagcaccgcgacca

SEQ ID NO: 322628 - RNA, 16 nt, Bordetella pertussis
cagcaccgcgcgcacg

SEQ ID NO: 322629 - RNA, 14 nt, Bordetella pertussis
cagcaccgcggcgg

SEQ ID NO: 322630 - RNA, 17 nt, Bordetella pertussis
cagcaccggcacgacgg

SEQ ID NO: 322631 - RNA, 20 nt, Bordetella pertussis
cagcaccggcacgacggccu

SEQ ID NO: 322632 - RNA, 18 nt, Bordetella pertussis
cagcaccggcacgcgcca

SEQ ID NO: 322633 - RNA, 21 nt, Bordetella pertussis
cagcaccggcacgcgccaggc

SEQ ID NO: 322634 - RNA, 18 nt, Bordetella pertussis
cagcaccggcagauggug

SEQ ID NO: 322635 - RNA, 13 nt, Bordetella pertussis
cagcaccggcagc

SEQ ID NO: 322636 - RNA, 13 nt, Bordetella pertussis
cagcaccggcgug

SEQ ID NO: 322637 - RNA, 14 nt, Bordetella pertussis
cagcaccggcguga

SEQ ID NO: 322638 - RNA, 12 nt, Bordetella pertussis
cagcaccggcug

SEQ ID NO: 322639 - RNA, 13 nt, Bordetella pertussis
cagcaccucggcg

SEQ ID NO: 322640 - RNA, 20 nt, Bordetella pertussis
cagcaccucggggcgcggcc

SEQ ID NO: 322641 - RNA, 21 nt, Bordetella pertussis
cagcaccucggggcgcggccg

SEQ ID NO: 322642 - RNA, 13 nt, Bordetella pertussis
cagcaccucggac

SEQ ID NO: 322643 - RNA, 20 nt, Bordetella pertussis
cagcaccugcaggccgccgg

SEQ ID NO: 322644 - RNA, 21 nt, Bordetella pertussis
cagcaccugguggcgcuggcc

SEQ ID NO: 322645 - RNA, 21 nt, Bordetella pertussis
cagcaccuucugccgccaggc

SEQ ID NO: 322646 - RNA, 19 nt, Bordetella pertussis
cagcacgaagggcagcagc

SEQ ID NO: 322647 - RNA, 17 nt, Bordetella pertussis
cagcacgacgacggccg

SEQ ID NO: 322648 - RNA, 19 nt, Bordetella pertussis
cagcacgacgacggccggc

SEQ ID NO: 322649 - RNA, 22 nt, Bordetella pertussis
cagcacgacgacggccggcgcg

SEQ ID NO: 322650 - RNA, 17 nt, Bordetella pertussis
cagcacgaucgcggcgc

SEQ ID NO: 322651 - RNA, 18 nt, Bordetella pertussis
cagcacgaucuggcgcgc

SEQ ID NO: 322652 - RNA, 22 nt, Bordetella pertussis
cagcacgaucuggcgcgcgacc

SEQ ID NO: 322653 - RNA, 20 nt, Bordetella pertussis
cagcacgauggggccauggc

SEQ ID NO: 322654 - RNA, 13 nt, Bordetella pertussis
cagcacgauggug

SEQ ID NO: 322655 - RNA, 17 nt, Bordetella pertussis
cagcacgcaccaggcgc

SEQ ID NO: 322656 - RNA, 19 nt, Bordetella pertussis
cagcacgcaccaggcgcac

SEQ ID NO: 322657 - RNA, 17 nt, Bordetella pertussis
cagcacgcccaguaugg

SEQ ID NO: 322658 - RNA, 12 nt, Bordetella pertussis
cagcacgcccgc

SEQ ID NO: 322659 - RNA, 17 nt, Bordetella pertussis
cagcacgcccgcgcgcg

SEQ ID NO: 322660 - RNA, 13 nt, Bordetella pertussis
cagcacgcccugg

SEQ ID NO: 322661 - RNA, 14 nt, Bordetella pertussis
cagcacgcccuggc

SEQ ID NO: 322662 - RNA, 18 nt, Bordetella pertussis
cagcacgccgcgccaggc

SEQ ID NO: 322663 - RNA, 14 nt, Bordetella pertussis
cagcacgccggcgg

SEQ ID NO: 322664 - RNA, 14 nt, Bordetella pertussis
cagcacgcggcgca

SEQ ID NO: 322665 - RNA, 15 nt, Bordetella pertussis
cagcacgcggcgcag

SEQ ID NO: 322666 - RNA, 17 nt, Bordetella pertussis
cagcacgcggcgcagca

SEQ ID NO: 322667 - RNA, 16 nt, Bordetella pertussis
cagcacgcugcgcggc

SEQ ID NO: 322668 - RNA, 14 nt, Bordetella pertussis
cagcacgcgcagcu

SEQ ID NO: 322669 - RNA, 17 nt, Bordetella pertussis
cagcacggccgcggccg

SEQ ID NO: 322670 - RNA, 19 nt, Bordetella pertussis
cagcacggccgcggccggc

SEQ ID NO: 322671 - RNA, 14 nt, Bordetella pertussis
cagcacggcgcaca

SEQ ID NO: 322672 - RNA, 19 nt, Bordetella pertussis
cagcagacccuggcgcgcg

SEQ ID NO: 322673 - RNA, 18 nt, Bordetella pertussis
cagcagauaccggcaugg

SEQ ID NO: 322674 - RNA, 19 nt, Bordetella pertussis
cagcagaucggcggccugg

SEQ ID NO: 322675 - RNA, 13 nt, Bordetella pertussis
cagcagcacgccu

SEQ ID NO: 322676 - RNA, 17 nt, Bordetella pertussis
cagcagcacgccuucga

SEQ ID NO: 322677 - RNA, 22 nt, Bordetella pertussis
cagcagcacgccuucgagcugc

SEQ ID NO: 322678 - RNA, 12 nt, Bordetella pertussis
cagcagcagcga

SEQ ID NO: 322679 - RNA, 16 nt, Bordetella pertussis
cagcagcagcgcaucg

SEQ ID NO: 322680 - RNA, 17 nt, Bordetella pertussis
cagcagcagcgcaucga

SEQ ID NO: 322681 - RNA, 17 nt, Bordetella pertussis
cagcagcagcgccgcgc

SEQ ID NO: 322682 - RNA, 13 nt, Bordetella pertussis
cagcagcaggccc

SEQ ID NO: 322683 - RNA, 23 nt, Bordetella pertussis
cagcagcaggcccuccggcgcca

SEQ ID NO: 322684 - RNA, 12 nt, Bordetella pertussis
cagcagcagggc

SEQ ID NO: 322685 - RNA, 16 nt, Bordetella pertussis
cagcagcagggccagg

SEQ ID NO: 322686 - RNA, 20 nt, Bordetella pertussis
cagcagcaguugcagcauga

SEQ ID NO: 322687 - RNA, 17 nt, Bordetella pertussis
cagcagcaugccuucga

SEQ ID NO: 322688 - RNA, 13 nt, Bordetella pertussis
cagcagcaugcgg

SEQ ID NO: 322689 - RNA, 21 nt, Bordetella pertussis
cagcagcaugcggcccgcgcu

SEQ ID NO: 322690 - RNA, 23 nt, Bordetella pertussis
cagcagcauuucgaugcgcacca

SEQ ID NO: 322691 - RNA, 17 nt, Bordetella pertussis
cagcagcgacaggacgu

SEQ ID NO: 322692 - RNA, 23 nt, Bordetella pertussis
cagcagcgacggccccagcgccg

SEQ ID NO: 322693 - RNA, 16 nt, Bordetella pertussis
cagcagcgcaucgcgc

SEQ ID NO: 322694 - RNA, 12 nt, Bordetella pertussis
cagcagcgccac

SEQ ID NO: 322695 - RNA, 23 nt, Bordetella pertussis
cagcagcgccacgacgccgucgc

SEQ ID NO: 322696 - RNA, 14 nt, Bordetella pertussis
cagcagcgccgcca

SEQ ID NO: 322697 - RNA, 17 nt, Bordetella pertussis
cagcagcgccgccagca

SEQ ID NO: 322698 - RNA, 20 nt, Bordetella pertussis
cagcagcgccgccagcaugg

SEQ ID NO: 322699 - RNA, 16 nt, Bordetella pertussis
cagcagcgccgcgccg

SEQ ID NO: 322700 - RNA, 16 nt, Bordetella pertussis
cagcagcgccggcagg

SEQ ID NO: 322701 - RNA, 19 nt, Bordetella pertussis
cagcagcgccggcaggcgc

SEQ ID NO: 322702 - RNA, 21 nt, Bordetella pertussis
cagcagcgccggcaggcgcgc

SEQ ID NO: 322703 - RNA, 13 nt, Bordetella pertussis
cagcagcgccggg

SEQ ID NO: 322704 - RNA, 21 nt, Bordetella pertussis
cagcagcgccgggaucggcgu

SEQ ID NO: 322705 - RNA, 20 nt, Bordetella pertussis
cagcagcgugaugccgucga

SEQ ID NO: 322706 - RNA, 15 nt, Bordetella pertussis
cagcagcguggccgc

SEQ ID NO: 322707 - RNA, 23 nt, Bordetella pertussis
cagcagcuccucggccugccggc

SEQ ID NO: 322708 - RNA, 14 nt, Bordetella pertussis
cagcagcucggcca

SEQ ID NO: 322709 - RNA, 17 nt, Bordetella pertussis
cagcagcucggcgacca

SEQ ID NO: 322710 - RNA, 16 nt, Bordetella pertussis
cagcagcuggcgcagc

SEQ ID NO: 322711 - RNA, 17 nt, Bordetella pertussis
cagcagcuggcgcagca

SEQ ID NO: 322712 - RNA, 22 nt, Bordetella pertussis
cagcagcuuggccacuucgccg

SEQ ID NO: 322713 - RNA, 22 nt, Bordetella pertussis
cagcaggaacaggcugcgcagg

SEQ ID NO: 322714 - RNA, 13 nt, Bordetella pertussis
cagcaggccagga

SEQ ID NO: 322715 - RNA, 19 nt, Bordetella pertussis
cagcaggcccaugccgcgc

SEQ ID NO: 322716 - RNA, 18 nt, Bordetella pertussis
cagcauacccugcgcgcc

SEQ ID NO: 322717 - RNA, 22 nt, Bordetella pertussis
cagcauacccugcgcgccgccg

SEQ ID NO: 322718 - RNA, 18 nt, Bordetella pertussis
cagcauaucgucgcugcg

SEQ ID NO: 322719 - RNA, 20 nt, Bordetella pertussis
cagcauaucgucgcugcggc

SEQ ID NO: 322720 - RNA, 22 nt, Bordetella pertussis
cagcauaucgucgcugcggccg

SEQ ID NO: 322721 - RNA, 23 nt, Bordetella pertussis
cagcauaucgucgcugcggccgg

SEQ ID NO: 322722 - RNA, 20 nt, Bordetella pertussis
cagcaucagcggcagcacga

SEQ ID NO: 322723 - RNA, 18 nt, Bordetella pertussis
cagcaucuugcgccgcug

SEQ ID NO: 322724 - RNA, 22 nt, Bordetella pertussis
cagcaugaaaugcuggucgcgc

SEQ ID NO: 322725 - RNA, 18 nt, Bordetella pertussis
cagcaugaacggcagcgc

SEQ ID NO: 322726 - RNA, 21 nt, Bordetella pertussis
cagcaugaacggcagcgcgcg

SEQ ID NO: 322727 - RNA, 22 nt, Bordetella pertussis
cagcaugacggggucggggcag

SEQ ID NO: 322728 - RNA, 21 nt, Bordetella pertussis
cagcaugagcugaugcucgcc

SEQ ID NO: 322729 - RNA, 22 nt, Bordetella pertussis
cagcaugaagcgguggcggccg

SEQ ID NO: 322730 - RNA, 18 nt, Bordetella pertussis
cagcaugaucaugccgcu

SEQ ID NO: 322731 - RNA, 17 nt, Bordetella pertussis
cagcaugaucuugccga

SEQ ID NO: 322732 - RNA, 21 nt, Bordetella pertussis
cagcaugcacgacuacggcgg

SEQ ID NO: 322733 - RNA, 22 nt, Bordetella pertussis
cagcaugccuucgacggcggga

SEQ ID NO: 322734 - RNA, 19 nt, Bordetella pertussis
cagcaugcgcgcggccucg

SEQ ID NO: 322735 - RNA, 22 nt, Bordetella pertussis
cagcaugcgcgucuccagcgcc

SEQ ID NO: 322736 - RNA, 23 nt, Bordetella pertussis
cagcaugcgcuggucgcgcagca

SEQ ID NO: 322737 - RNA, 16 nt, Bordetella pertussis
cagcaugcggcccgcg

SEQ ID NO: 322738 - RNA, 23 nt, Bordetella pertussis
cagcauggagcuggggccgcgcg

SEQ ID NO: 322739 - RNA, 17 nt, Bordetella pertussis
cagcauggccaccaggu

SEQ ID NO: 322740 - RNA, 16 nt, Bordetella pertussis
cagcauggccguggcg

SEQ ID NO: 322741 - RNA, 14 nt, Bordetella pertussis
cagcauggcgcgcg

SEQ ID NO: 322742 - RNA, 23 nt, Bordetella pertussis
cagcauggcggccaggcgcgccg

SEQ ID NO: 322743 - RNA, 17 nt, Bordetella pertussis
cagcauggcggcgcccg

SEQ ID NO: 322744 - RNA, 18 nt, Bordetella pertussis
cagcauggcggcgcccgc

SEQ ID NO: 322745 - RNA, 20 nt, Bordetella pertussis
cagcauucuggugcagcggc

SEQ ID NO: 322746 - RNA, 15 nt, Bordetella pertussis
cagcauuucggcgcc

SEQ ID NO: 322747 - RNA, 20 nt, Bordetella pertussis
cagcauuucggcgccgccgg

SEQ ID NO: 322748 - RNA, 17 nt, Bordetella pertussis
cagccagauaccguccu

SEQ ID NO: 322749 - RNA, 15 nt, Bordetella pertussis
cagccagaucucgcg

SEQ ID NO: 322750 - RNA, 22 nt, Bordetella pertussis
cagccagaucucgcguccggug

SEQ ID NO: 322751 - RNA, 20 nt, Bordetella pertussis
cagccagauucccccgcaca

SEQ ID NO: 322752 - RNA, 16 nt, Bordetella pertussis
cagccagcccuggccc

SEQ ID NO: 322753 - RNA, 17 nt, Bordetella pertussis
cagccagccgccgcgcg

SEQ ID NO: 322754 - RNA, 19 nt, Bordetella pertussis
cagccagccgccgcgcggc

SEQ ID NO: 322755 - RNA, 20 nt, Bordetella pertussis
cagccagccgccgcgcggcg

SEQ ID NO: 322756 - RNA, 16 nt, Bordetella pertussis
cagccagccggcggcc

SEQ ID NO: 322757 - RNA, 17 nt, Bordetella pertussis
cagccagccggcggcca

SEQ ID NO: 322758 - RNA, 22 nt, Bordetella pertussis
cagccagccgcuugcggccagg

SEQ ID NO: 322759 - RNA, 23 nt, Bordetella pertussis
cagccagccgcuugcggccaggc

SEQ ID NO: 322760 - RNA, 17 nt, Bordetella pertussis
cagccagcgccgcagcg

SEQ ID NO: 322761 - RNA, 14 nt, Bordetella pertussis
cagccagcggccga

SEQ ID NO: 322762 - RNA, 21 nt, Bordetella pertussis
cagccagcggugcgcggcgca

SEQ ID NO: 322763 - RNA, 13 nt, Bordetella pertussis
cagccaggccagc

SEQ ID NO: 322764 - RNA, 14 nt, Bordetella pertussis
cagccaggccagca

SEQ ID NO: 322765 - RNA, 14 nt, Bordetella pertussis
cagccaggccagcg

SEQ ID NO: 322766 - RNA, 16 nt, Bordetella pertussis
cagccaggccagcgcc

SEQ ID NO: 322767 - RNA, 17 nt, Bordetella pertussis
cagccauggaagcggca

SEQ ID NO: 322768 - RNA, 21 nt, Bordetella pertussis
cagccaggccgaucagcacca

SEQ ID NO: 322769 - RNA, 14 nt, Bordetella pertussis
cagccauucggcca

SEQ ID NO: 322770 - RNA, 15 nt, Bordetella pertussis
cagccauucggccac

SEQ ID NO: 322771 - RNA, 17 nt, Bordetella pertussis
cagcccacaagccguac

SEQ ID NO: 322772 - RNA, 15 nt, Bordetella pertussis
cagcccaccagcgcc

SEQ ID NO: 322773 - RNA, 13 nt, Bordetella pertussis
cagcccagcacca

SEQ ID NO: 322774 - RNA, 14 nt, Bordetella pertussis
cagccccacgccga

SEQ ID NO: 322775 - RNA, 22 nt, Bordetella pertussis
cagccccagcagcacgcccagu

SEQ ID NO: 322776 - RNA, 14 nt, Bordetella pertussis
cagccccagcgcca

SEQ ID NO: 322777 - RNA, 18 nt, Bordetella pertussis
cagccccagcgcccaggc

SEQ ID NO: 322778 - RNA, 13 nt, Bordetella pertussis
cagcccgaugcgc

SEQ ID NO: 322779 - RNA, 17 nt, Bordetella pertussis
cagcccgaugcgccagg

SEQ ID NO: 322780 - RNA, 14 nt, Bordetella pertussis
cagcccgcccgcga

SEQ ID NO: 322781 - RNA, 20 nt, Bordetella pertussis
cagcccgcccgcgagcggcc

SEQ ID NO: 322782 - RNA, 17 nt, Bordetella pertussis
cagcccgcccgcgccca

SEQ ID NO: 322783 - RNA, 15 nt, Bordetella pertussis
cagcccgccggcgcg

SEQ ID NO: 322784 - RNA, 16 nt, Bordetella pertussis
cagcccgccggcgcgc

SEQ ID NO: 322785 - RNA, 19 nt, Bordetella pertussis
cagcccgcgcacgcccgcg

SEQ ID NO: 322786 - RNA, 17 nt, Bordetella pertussis
cagcccgccuggcgccg

SEQ ID NO: 322787 - RNA, 11 nt, Bordetella pertussis
cagcccggcga

SEQ ID NO: 322788 - RNA, 12 nt, Bordetella pertussis
cagcccggcgcg

SEQ ID NO: 322789 - RNA, 16 nt, Bordetella pertussis
cagcccggcgcgccac

SEQ ID NO: 322790 - RNA, 16 nt, Bordetella pertussis
cagcccggcgugccca

SEQ ID NO: 322791 - RNA, 12 nt, Bordetella pertussis
cagcccggucgu

SEQ ID NO: 322792 - RNA, 15 nt, Bordetella pertussis
cagcccggugaucga

SEQ ID NO: 322793 - RNA, 22 nt, Bordetella pertussis
cagcccguccuggugcacgccg

SEQ ID NO: 322794 - RNA, 15 nt, Bordetella pertussis
cagcccgugggcggc

SEQ ID NO: 322795 - RNA, 17 nt, Bordetella pertussis
cagcccgugggcggcgu

SEQ ID NO: 322796 - RNA, 12 nt, Bordetella pertussis
cagcccuggccc

SEQ ID NO: 322797 - RNA, 18 nt, Bordetella pertussis
cagcccuggcccagcgca

SEQ ID NO: 322798 - RNA, 21 nt, Bordetella pertussis
cagcccuggcccagcgcauag

SEQ ID NO: 322799 - RNA, 18 nt, Bordetella pertussis
cagccgcaagcuggcggc

SEQ ID NO: 322800 - RNA, 14 nt, Bordetella pertussis
cagccgcaccagcg

SEQ ID NO: 322801 - RNA, 17 nt, Bordetella pertussis
cagccgcaccagcgcau

SEQ ID NO: 322802 - RNA, 19 nt, Bordetella pertussis
cagccgcagccgucgcgcu

SEQ ID NO: 322803 - RNA, 12 nt, Bordetella pertussis
cagccgcagcag

SEQ ID NO: 322804 - RNA, 17 nt, Bordetella pertussis
cagccgcagcaggcgcu

SEQ ID NO: 322805 - RNA, 23 nt, Bordetella pertussis
cagccgcagcaggcgcucggcca

SEQ ID NO: 322806 - RNA, 13 nt, Bordetella pertussis
cagccgcaugccg

SEQ ID NO: 322807 - RNA, 15 nt, Bordetella pertussis
cagccgcaugccggc

SEQ ID NO: 322808 - RNA, 21 nt, Bordetella pertussis
cagccgcaguauuccugcugg

SEQ ID NO: 322809 - RNA, 19 nt, Bordetella pertussis
cagccgccccagcagcagc

SEQ ID NO: 322810 - RNA, 22 nt, Bordetella pertussis
cagccgcccgccgggccgucgu

SEQ ID NO: 322811 - RNA, 12 nt, Bordetella pertussis
cagccgcccggc

SEQ ID NO: 322812 - RNA, 13 nt, Bordetella pertussis
cagccgcccggca

SEQ ID NO: 322813 - RNA, 13 nt, Bordetella pertussis
cagccgcccggcg

SEQ ID NO: 322814 - RNA, 12 nt, Bordetella pertussis
cagccgccgcga

SEQ ID NO: 322815 - RNA, 17 nt, Bordetella pertussis
cagccgccuggcgcggc

SEQ ID NO: 322816 - RNA, 16 nt, Bordetella pertussis
cagccgcgccagcgcc

SEQ ID NO: 322817 - RNA, 20 nt, Bordetella pertussis
cagccgcgccagcgccucca

SEQ ID NO: 322818 - RNA, 19 nt, Bordetella pertussis
cagccgcgccugcagcagc

SEQ ID NO: 322819 - RNA, 15 nt, Bordetella pertussis
cagccgcgcgaccuu

SEQ ID NO: 322820 - RNA, 16 nt, Bordetella pertussis
cagccgcgcggccggg

SEQ ID NO: 322821 - RNA, 20 nt, Bordetella pertussis
cagccgcgcgcggccggcgc

SEQ ID NO: 322822 - RNA, 21 nt, Bordetella pertussis
cagccgcgcgcggccggcgcg

SEQ ID NO: 322823 - RNA, 16 nt, Bordetella pertussis
cagccgcggcagaucu

SEQ ID NO: 322824 - RNA, 17 nt, Bordetella pertussis
cagccgcucgcgcgacc

SEQ ID NO: 322825 - RNA, 21 nt, Bordetella pertussis
cagccgcucgcgcgaccacug

SEQ ID NO: 322826 - RNA, 15 nt, Bordetella pertussis
cagccgcucggccac

SEQ ID NO: 322827 - RNA, 16 nt, Bordetella pertussis
cagccgcucggccacg

SEQ ID NO: 322828 - RNA, 17 nt, Bordetella pertussis
cagccgcucggccacgc

SEQ ID NO: 322829 - RNA, 13 nt, Bordetella pertussis
cagccgcugcaga

SEQ ID NO: 322830 - RNA, 17 nt, Bordetella pertussis
cagccgcugcagcacgc

SEQ ID NO: 322831 - RNA, 17 nt, Bordetella pertussis
cagccgcugcagcgacu

SEQ ID NO: 322832 - RNA, 16 nt, Bordetella pertussis
cagccgcuggcgauca

SEQ ID NO: 322833 - RNA, 15 nt, Bordetella pertussis
cagccgcuggcgcgc

SEQ ID NO: 322834 - RNA, 14 nt, Bordetella pertussis
cagccgcuugaagu

SEQ ID NO: 322835 - RNA, 16 nt, Bordetella pertussis
cagccggacccgcgcc

SEQ ID NO: 322836 - RNA, 22 nt, Bordetella pertussis
cagccggacccgcgccgcaggc

SEQ ID NO: 322837 - RNA, 23 nt, Bordetella pertussis
cagccggccaaggcaagcagcga

SEQ ID NO: 322838 - RNA, 21 nt, Bordetella pertussis
cagccggccauggcccuugcc

SEQ ID NO: 322839 - RNA, 23 nt, Bordetella pertussis
cagccggccauggcccuugccgc

SEQ ID NO: 322840 - RNA, 14 nt, Bordetella pertussis
cagccggcccagca

SEQ ID NO: 322841 - RNA, 17 nt, Bordetella pertussis
cagccggcccagcacgc

SEQ ID NO: 322842 - RNA, 18 nt, Bordetella pertussis
cagccggcccagcacgcc

SEQ ID NO: 322843 - RNA, 19 nt, Bordetella pertussis
cagccggcccagcacgccg

SEQ ID NO: 322844 - RNA, 13 nt, Bordetella pertussis
cagccggcccgac

SEQ ID NO: 322845 - RNA, 17 nt, Bordetella pertussis
cagccggccgauggcau

SEQ ID NO: 322846 - RNA, 13 nt, Bordetella pertussis
cagccggccgccg

SEQ ID NO: 322847 - RNA, 14 nt, Bordetella pertussis
cagccggccgccga

SEQ ID NO: 322848 - RNA, 20 nt, Bordetella pertussis
cagccggccgguaaggcgcu

SEQ ID NO: 322849 - RNA, 14 nt, Bordetella pertussis
cagccggcgcgcca

SEQ ID NO: 322850 - RNA, 13 nt, Bordetella pertussis
cagccgucgcgcu

SEQ ID NO: 322851 - RNA, 16 nt, Bordetella pertussis
cagccgucgcgcugca

SEQ ID NO: 322852 - RNA, 15 nt, Bordetella pertussis
cagccgugccgcgcg

SEQ ID NO: 322853 - RNA, 18 nt, Bordetella pertussis
cagccgugccgcgcgcac

SEQ ID NO: 322854 - RNA, 22 nt, Bordetella pertussis
cagccgugccgcgcgcaccggc

SEQ ID NO: 322855 - RNA, 19 nt, Bordetella pertussis
cagccucgagguggcgcau

SEQ ID NO: 322856 - RNA, 20 nt, Bordetella pertussis
cagccugauucccaggcccg

SEQ ID NO: 322857 - RNA, 22 nt, Bordetella pertussis
cagccugauucccaggcccggc

SEQ ID NO: 322858 - RNA, 15 nt, Bordetella pertussis
cagccugcccgggca

SEQ ID NO: 322859 - RNA, 15 nt, Bordetella pertussis
cagccugcccgucga

SEQ ID NO: 322860 - RNA, 20 nt, Bordetella pertussis
cagccugcccucgggcgaca

SEQ ID NO: 322861 - RNA, 18 nt, Bordetella pertussis
cagccugccgcggccgcc

SEQ ID NO: 322862 - RNA, 19 nt, Bordetella pertussis
cagccugccgcggccgccc

SEQ ID NO: 322863 - RNA, 21 nt, Bordetella pertussis
cagccugccggcgcgcccagg

SEQ ID NO: 322864 - RNA, 11 nt, Bordetella pertussis
cagccuggccu

SEQ ID NO: 322865 - RNA, 13 nt, Bordetella pertussis
cagccuggcgcca

SEQ ID NO: 322866 - RNA, 17 nt, Bordetella pertussis
cagcgaaugcgacagcg

SEQ ID NO: 322867 - RNA, 20 nt, Bordetella pertussis
cagcgaaugcgacagcgaca

SEQ ID NO: 322868 - RNA, 19 nt, Bordetella pertussis
cagcgacaacagcuugccc

SEQ ID NO: 322869 - RNA, 22 nt, Bordetella pertussis
cagcgacaacagcuugcccggc

SEQ ID NO: 322870 - RNA, 17 nt, Bordetella pertussis
cagcgacaacaggucgu

SEQ ID NO: 322871 - RNA, 14 nt, Bordetella pertussis
cagcgacacggcgg

SEQ ID NO: 322872 - RNA, 15 nt, Bordetella pertussis
cagcgacgcgcgccg

SEQ ID NO: 322873 - RNA, 18 nt, Bordetella pertussis
cagcgacgcgcgccggcg

SEQ ID NO: 322874 - RNA, 12 nt, Bordetella pertussis
cagcgacggccc

SEQ ID NO: 322875 - RNA, 18 nt, Bordetella pertussis
cagcgacuccggccgggc

SEQ ID NO: 322876 - RNA, 13 nt, Bordetella pertussis
cagcgacucgccg

SEQ ID NO: 322877 - RNA, 17 nt, Bordetella pertussis
cagcgacuugucgcgcc

SEQ ID NO: 322878 - RNA, 16 nt, Bordetella pertussis
cagcgagaacagccac

SEQ ID NO: 322879 - RNA, 21 nt, Bordetella pertussis
cagcgcgccgccagcgcgcgc

SEQ ID NO: 322880 - RNA, 23 nt, Bordetella pertussis
cagcgcgccgcccaccaccagcg

SEQ ID NO: 322881 - RNA, 13 nt, Bordetella pertussis
cagcgcgccgcga

SEQ ID NO: 322882 - RNA, 23 nt, Bordetella pertussis
cagcgcgccgcgaaacgucccca

SEQ ID NO: 322883 - RNA, 14 nt, Bordetella pertussis
cagcgcgccgcgcg

SEQ ID NO: 322884 - RNA, 18 nt, Bordetella pertussis
cagcgcgccgcgcgcggc

SEQ ID NO: 322885 - RNA, 14 nt, Bordetella pertussis
cagcgcgccggcca

SEQ ID NO: 322886 - RNA, 23 nt, Bordetella pertussis
cagcgcgccgggcgggucggcga

SEQ ID NO: 322887 - RNA, 14 nt, Bordetella pertussis
cagcgcgccgucgg

SEQ ID NO: 322888 - RNA, 15 nt, Bordetella pertussis
cagcgcgccugccca

SEQ ID NO: 322889 - RNA, 20 nt, Bordetella pertussis
cagcgcgccugcccaggcca

SEQ ID NO: 322890 - RNA, 17 nt, Bordetella pertussis
cagcgcgcgaucgccag

SEQ ID NO: 322891 - RNA, 21 nt, Bordetella pertussis
cagcgcgcgaucgccagcagg

SEQ ID NO: 322892 - RNA, 17 nt, Bordetella pertussis
cagcgcgcgcagccgcg

SEQ ID NO: 322893 - RNA, 14 nt, Bordetella pertussis
cagcgcgcgccggc

SEQ ID NO: 322894 - RNA, 15 nt, Bordetella pertussis
cagcgcgcgccggcc

SEQ ID NO: 322895 - RNA, 13 nt, Bordetella pertussis
cagcgcgcggccg

SEQ ID NO: 322896 - RNA, 14 nt, Bordetella pertussis
cagcgcgcggccgg

SEQ ID NO: 322897 - RNA, 15 nt, Bordetella pertussis
cagcgcgcggccggc

SEQ ID NO: 322898 - RNA, 13 nt, Bordetella pertussis
cagcgcgcggccu

SEQ ID NO: 322899 - RNA, 14 nt, Bordetella pertussis
cagcgcgcggccuc

SEQ ID NO: 322900 - RNA, 12 nt, Bordetella pertussis
cagcgcgcggcg

SEQ ID NO: 322901 - RNA, 13 nt, Bordetella pertussis
cagcgcgcggcgc

SEQ ID NO: 322902 - RNA, 14 nt, Bordetella pertussis
cagcgcgcggcgca

SEQ ID NO: 322903 - RNA, 17 nt, Bordetella pertussis
cagcgcgcggcgcagcg

SEQ ID NO: 322904 - RNA, 18 nt, Bordetella pertussis
cagcgcgcgcgaggcggc

SEQ ID NO: 322905 - RNA, 19 nt, Bordetella pertussis
cagcgcgcggggcaggccg

SEQ ID NO: 322906 - RNA, 23 nt, Bordetella pertussis
cagcgcgcggggcaggccgaugu

SEQ ID NO: 322907 - RNA, 21 nt, Bordetella pertussis
cagcgcgcggugccgccuggc

SEQ ID NO: 322908 - RNA, 17 nt, Bordetella pertussis
cagcgcggcacgcugcu

SEQ ID NO: 322909 - RNA, 20 nt, Bordetella pertussis
cagcgcggcacgcugcugau

SEQ ID NO: 322910 - RNA, 18 nt, Bordetella pertussis
cagcgcggcaucggccau

SEQ ID NO: 322911 - RNA, 16 nt, Bordetella pertussis
cagcgcggcaugccgc

SEQ ID NO: 322912 - RNA, 14 nt, Bordetella pertussis
cagcgcggccagcg

SEQ ID NO: 322913 - RNA, 15 nt, Bordetella pertussis
cagcgcggccagcgc

SEQ ID NO: 322914 - RNA, 15 nt, Bordetella pertussis
cagcgcggccacggc

SEQ ID NO: 322915 - RNA, 14 nt, Bordetella pertussis
cagcgcggccggca

SEQ ID NO: 322916 - RNA, 17 nt, Bordetella pertussis
cagcgcggccggcacca

SEQ ID NO: 322917 - RNA, 15 nt, Bordetella pertussis
cagcgcggccgcuug

SEQ ID NO: 322918 - RNA, 23 nt, Bordetella pertussis
cagcgcggcgcacagggcgucgc

SEQ ID NO: 322919 - RNA, 15 nt, Bordetella pertussis
cagcgcggcgccggc

SEQ ID NO: 322920 - RNA, 16 nt, Bordetella pertussis
cagcgcggcgccggcc

SEQ ID NO: 322921 - RNA, 20 nt, Bordetella pertussis
cagcgcggcgccggccguca

SEQ ID NO: 322922 - RNA, 18 nt, Bordetella pertussis
cagcgcggcgccggccuc

SEQ ID NO: 322923 - RNA, 14 nt, Bordetella pertussis
cagcgcggcgcaca

SEQ ID NO: 322924 - RNA, 14 nt, Bordetella pertussis
cagcgcggcgcggc

SEQ ID NO: 322925 - RNA, 15 nt, Bordetella pertussis
cagcgcggcgcggcc

SEQ ID NO: 322926 - RNA, 14 nt, Bordetella pertussis
cagcgcggcggcca

SEQ ID NO: 322927 - RNA, 17 nt, Bordetella pertussis
cagcgcggcggcgaccg

SEQ ID NO: 322928 - RNA, 12 nt, Bordetella pertussis
cagcgcggcggg

SEQ ID NO: 322929 - RNA, 16 nt, Bordetella pertussis
cagcgcggcgggccgg

SEQ ID NO: 322930 - RNA, 16 nt, Bordetella pertussis
cagcgcggcgggcggc

SEQ ID NO: 322931 - RNA, 23 nt, Bordetella pertussis
cagcgcggcuugguugucgcgca

SEQ ID NO: 322932 - RNA, 13 nt, Bordetella pertussis
cagcgcgggccac

SEQ ID NO: 322933 - RNA, 14 nt, Bordetella pertussis
cagcgcgggcgcac

SEQ ID NO: 322934 - RNA, 15 nt, Bordetella pertussis
cagcgcggucaugcc

SEQ ID NO: 322935 - RNA, 17 nt, Bordetella pertussis
cagcgcgguggccagcg

SEQ ID NO: 322936 - RNA, 18 nt, Bordetella pertussis
cagcgcgguugacugcag

SEQ ID NO: 322937 - RNA, 14 nt, Bordetella pertussis
cagcgcgguggcca

SEQ ID NO: 322938 - RNA, 20 nt, Bordetella pertussis
cagcgcguccugcacguccu

SEQ ID NO: 322939 - RNA, 23 nt, Bordetella pertussis
cagcgcguccugccaguugccgc

SEQ ID NO: 322940 - RNA, 20 nt, Bordetella pertussis
cagcgcguccaggugcggcg

SEQ ID NO: 322941 - RNA, 13 nt, Bordetella pertussis
cagcgcgucgccg

SEQ ID NO: 322942 - RNA, 16 nt, Bordetella pertussis
cagcgcgucgccgcca

SEQ ID NO: 322943 - RNA, 21 nt, Bordetella pertussis
cagcgcgucgcguagcgcggc

SEQ ID NO: 322944 - RNA, 14 nt, Bordetella pertussis
cagcgcgucggcca

SEQ ID NO: 322945 - RNA, 19 nt, Bordetella pertussis
cagcgcgucggccagcgcc

SEQ ID NO: 322946 - RNA, 17 nt, Bordetella pertussis
cagcgcgucggccaggc

SEQ ID NO: 322947 - RNA, 17 nt, Bordetella pertussis
cagcgcgucguccagcg

SEQ ID NO: 322948 - RNA, 19 nt, Bordetella pertussis
cagcgcgucguccagcgug

SEQ ID NO: 322949 - RNA, 20 nt, Bordetella pertussis
cagcgcgucguccagcgugg

SEQ ID NO: 322950 - RNA, 22 nt, Bordetella pertussis
cagcgcgugcagccagcggccg

SEQ ID NO: 322951 - RNA, 13 nt, Bordetella pertussis
cagcgcguggccg

SEQ ID NO: 322952 - RNA, 20 nt, Bordetella pertussis
cagcgcgugggccagcaacu

SEQ ID NO: 322953 - RNA, 19 nt, Bordetella pertussis
cagcgcgugggccaguccg

SEQ ID NO: 322954 - RNA, 12 nt, Bordetella pertussis
cagcgcgugugg

SEQ ID NO: 322955 - RNA, 20 nt, Bordetella pertussis
cagcgcucaguagcucgacc

SEQ ID NO: 322956 - RNA, 15 nt, Bordetella pertussis
cagcgcucgcacggc

SEQ ID NO: 322957 - RNA, 19 nt, Bordetella pertussis
cagcgcucgggcucgcgcg

SEQ ID NO: 322958 - RNA, 16 nt, Bordetella pertussis
cagcgcugguggccag

SEQ ID NO: 322959 - RNA, 17 nt, Bordetella pertussis
cagcgcugguucgaccu

SEQ ID NO: 322960 - RNA, 18 nt, Bordetella pertussis
cagcgcugguucgaccug

SEQ ID NO: 322961 - RNA, 17 nt, Bordetella pertussis
cagcgcuguccaggccg

SEQ ID NO: 322962 - RNA, 22 nt, Bordetella pertussis
cagcgcuucgggcagcucgcgc

SEQ ID NO: 322963 - RNA, 23 nt, Bordetella pertussis
cagcgcuucgggcagcucgcgcg

SEQ ID NO: 322964 - RNA, 17 nt, Bordetella pertussis
cagcgcuucgugcagcg

SEQ ID NO: 322965 - RNA, 20 nt, Bordetella pertussis
cagcgcuucgugcagcgcgu

SEQ ID NO: 322966 - RNA, 16 nt, Bordetella pertussis
cagcgcuugcacgcca

SEQ ID NO: 322967 - RNA, 17 nt, Bordetella pertussis
cagcgcuugcacgccau

SEQ ID NO: 322968 - RNA, 23 nt, Bordetella pertussis
cagcggaaugaugguggggcugg

SEQ ID NO: 322969 - RNA, 15 nt, Bordetella pertussis
cagcggaaugucguu

SEQ ID NO: 322970 - RNA, 19 nt, Bordetella pertussis
cagcggaaguauucgcgcg

SEQ ID NO: 322971 - RNA, 21 nt, Bordetella pertussis
cagcggaaguauucgcgcggc

SEQ ID NO: 322972 - RNA, 16 nt, Bordetella pertussis
cagcggacgggccagg

SEQ ID NO: 322973 - RNA, 20 nt, Bordetella pertussis
cagcggacgggccaggccga

SEQ ID NO: 322974 - RNA, 16 nt, Bordetella pertussis
cagcggacggcgcgga

SEQ ID NO: 322975 - RNA, 20 nt, Bordetella pertussis
cagcggacggcgcggaucgu

SEQ ID NO: 322976 - RNA, 14 nt, Bordetella pertussis
cagcggagccgcgc

SEQ ID NO: 322977 - RNA, 16 nt, Bordetella pertussis
cagcggagccgcgcac

SEQ ID NO: 322978 - RNA, 22 nt, Bordetella pertussis
cagcggagccgcgcacacaugg

SEQ ID NO: 322979 - RNA, 17 nt, Bordetella pertussis
cagcggaucgccgggca

SEQ ID NO: 322980 - RNA, 21 nt, Bordetella pertussis
cagcggauugaccagcgcggc

SEQ ID NO: 322981 - RNA, 17 nt, Bordetella pertussis
cagcggcacgccggcgg

SEQ ID NO: 322982 - RNA, 14 nt, Bordetella pertussis
cagcggcagcacga

SEQ ID NO: 322983 - RNA, 14 nt, Bordetella pertussis
cagcggcagcaugg

SEQ ID NO: 322984 - RNA, 13 nt, Bordetella pertussis
cagcggcagcgca

SEQ ID NO: 322985 - RNA, 20 nt, Bordetella pertussis
cagcggcagcgcaccgucgc

SEQ ID NO: 322986 - RNA, 22 nt, Bordetella pertussis
cagcggcagcgcaccgucgcca

SEQ ID NO: 322987 - RNA, 14 nt, Bordetella pertussis
cagcggcagcgggu

SEQ ID NO: 322988 - RNA, 16 nt, Bordetella pertussis
cagcggcagcgggucg

SEQ ID NO: 322989 - RNA, 16 nt, Bordetella pertussis
cagcggcagcucggcg

SEQ ID NO: 322990 - RNA, 22 nt, Bordetella pertussis
cagcggcaggacggggaacagg

SEQ ID NO: 322991 - RNA, 13 nt, Bordetella pertussis
cagcggcaggccc

SEQ ID NO: 322992 - RNA, 19 nt, Bordetella pertussis
cagcggcaggcccagcuug

SEQ ID NO: 322993 - RNA, 15 nt, Bordetella pertussis
cagcggcaggcggcu

SEQ ID NO: 322994 - RNA, 14 nt, Bordetella pertussis
cagcggcaggcugg

SEQ ID NO: 322995 - RNA, 19 nt, Bordetella pertussis
cagcggcaggggcucgcgc

SEQ ID NO: 322996 - RNA, 23 nt, Bordetella pertussis
cagcggcaggggcucgcgcccga

SEQ ID NO: 322997 - RNA, 14 nt, Bordetella pertussis
cagcggcaucacgc

SEQ ID NO: 322998 - RNA, 17 nt, Bordetella pertussis
cagcggcauugcccagg

SEQ ID NO: 322999 - RNA, 18 nt, Bordetella pertussis
cagcggcauugcccaggu

SEQ ID NO: 323000 - RNA, 15 nt, Bordetella pertussis
cagcggccaguccac

SEQ ID NO: 323001 - RNA, 23 nt, Bordetella pertussis
cagcggcccacccggcacgcgcc

SEQ ID NO: 323002 - RNA, 15 nt, Bordetella pertussis
cagcggccgcugccg

SEQ ID NO: 323003 - RNA, 16 nt, Bordetella pertussis
cagcggccgcugccgc

SEQ ID NO: 323004 - RNA, 17 nt, Bordetella pertussis
cagcggccggcccgugc

SEQ ID NO: 323005 - RNA, 22 nt, Bordetella pertussis
cagcggccggcccgugcgcaac

SEQ ID NO: 323006 - RNA, 21 nt, Bordetella pertussis
cagcggccgucgccuucggcg

SEQ ID NO: 323007 - RNA, 13 nt, Bordetella pertussis
cagcggccgucgc

SEQ ID NO: 323008 - RNA, 20 nt, Bordetella pertussis
cagcggcgaaaugucgagcg

SEQ ID NO: 323009 - RNA, 15 nt, Bordetella pertussis
cagcggcgacggcgc

SEQ ID NO: 323010 - RNA, 19 nt, Bordetella pertussis
cagcggcgacggcgccugg

SEQ ID NO: 323011 - RNA, 21 nt, Bordetella pertussis
cagcggcgacggcgccuggcg

SEQ ID NO: 323012 - RNA, 22 nt, Bordetella pertussis
cagcggcgacggcgccuggcgc

SEQ ID NO: 323013 - RNA, 16 nt, Bordetella pertussis
cagcggcgagcgcggc

SEQ ID NO: 323014 - RNA, 15 nt, Bordetella pertussis
cagcggcgcagccgg

SEQ ID NO: 323015 - RNA, 14 nt, Bordetella pertussis
cagcggcgccaugc

SEQ ID NO: 323016 - RNA, 22 nt, Bordetella pertussis
cagcggcgccggaucggccggc

SEQ ID NO: 323017 - RNA, 20 nt, Bordetella pertussis
cagcggcgcgacgcgcuuga

SEQ ID NO: 323018 - RNA, 19 nt, Bordetella pertussis
cagcggcgcggcgcgcugg

SEQ ID NO: 323019 - RNA, 15 nt, Bordetella pertussis
cagcggcgccgacca

SEQ ID NO: 323020 - RNA, 22 nt, Bordetella pertussis
cagcggcgcuuaccgcgccggc

SEQ ID NO: 323021 - RNA, 17 nt, Bordetella pertussis
cagcggcggcacggugg

SEQ ID NO: 323022 - RNA, 21 nt, Bordetella pertussis
cagcggcggcacgguggcgaa

SEQ ID NO: 323023 - RNA, 14 nt, Bordetella pertussis
cagcggcggcgcgg

SEQ ID NO: 323024 - RNA, 18 nt, Bordetella pertussis
cagcggcggcgcggucag

SEQ ID NO: 323025 - RNA, 18 nt, Bordetella pertussis
cagcggcguauaggccac

SEQ ID NO: 323026 - RNA, 15 nt, Bordetella pertussis
cagcggcguggcggc

SEQ ID NO: 323027 - RNA, 17 nt, Bordetella pertussis
cagcggcguggcggcca

SEQ ID NO: 323028 - RNA, 22 nt, Bordetella pertussis
cagcggcguggcggccaggccg

SEQ ID NO: 323029 - RNA, 22 nt, Bordetella pertussis
cagcggcucgacgccguacugg

SEQ ID NO: 323030 - RNA, 19 nt, Bordetella pertussis
cagcggcucgagcggcagc

SEQ ID NO: 323031 - RNA, 14 nt, Bordetella pertussis
cagcggcgugcggc

SEQ ID NO: 323032 - RNA, 23 nt, Bordetella pertussis
cagcggcugcuugagcagccacu

SEQ ID NO: 323033 - RNA, 23 nt, Bordetella pertussis
cagcggcuggcgccguucgucgc

SEQ ID NO: 323034 - RNA, 17 nt, Bordetella pertussis
cagcggcuucaugccgg

SEQ ID NO: 323035 - RNA, 20 nt, Bordetella pertussis
cagcggcuucaugccggcgu

SEQ ID NO: 323036 - RNA, 20 nt, Bordetella pertussis
cagcggcuucgagcgcgacg

SEQ ID NO: 323037 - RNA, 23 nt, Bordetella pertussis
cagcggggccgugacgugcuuga

SEQ ID NO: 323038 - RNA, 20 nt, Bordetella pertussis
cagcgggugaucacggccgu

SEQ ID NO: 323039 - RNA, 14 nt, Bordetella pertussis
cagcggguugcgcg

SEQ ID NO: 323040 - RNA, 18 nt, Bordetella pertussis
cagcgucaugcgcaccuu

SEQ ID NO: 323041 - RNA, 16 nt, Bordetella pertussis
cagcgucauggccugg

SEQ ID NO: 323042 - RNA, 17 nt, Bordetella pertussis
cagcguccagccgcccg

SEQ ID NO: 323043 - RNA, 17 nt, Bordetella pertussis
cagcguccaggcggcca

SEQ ID NO: 323044 - RNA, 15 nt, Bordetella pertussis
cagcguccagccgcc

SEQ ID NO: 323045 - RNA, 21 nt, Bordetella pertussis
cagcgucggcguaaggccgcc

SEQ ID NO: 323046 - RNA, 19 nt, Bordetella pertussis
cagcgucucgaucacgugg

SEQ ID NO: 323047 - RNA, 16 nt, Bordetella pertussis
cagcgucucgggcugg

SEQ ID NO: 323048 - RNA, 13 nt, Bordetella pertussis
cagcgucugcugg

SEQ ID NO: 323049 - RNA, 23 nt, Bordetella pertussis
cagcgucugcugguacagcccca

SEQ ID NO: 323050 - RNA, 22 nt, Bordetella pertussis
cagcgucuggcacgcuugccgc

SEQ ID NO: 323051 - RNA, 17 nt, Bordetella pertussis
cagcgugcggaccagcg

SEQ ID NO: 323052 - RNA, 14 nt, Bordetella pertussis
cagcgugcggucgu

SEQ ID NO: 323053 - RNA, 17 nt, Bordetella pertussis
cagcguggagcugcuca

SEQ ID NO: 323054 - RNA, 22 nt, Bordetella pertussis
cagcguggccaccaggcgcgcg

SEQ ID NO: 323055 - RNA, 12 nt, Bordetella pertussis
cagcguggccgc

SEQ ID NO: 323056 - RNA, 14 nt, Bordetella pertussis
cagcguggccgcca

SEQ ID NO: 323057 - RNA, 15 nt, Bordetella pertussis
cagcguggcggcgac

SEQ ID NO: 323058 - RNA, 14 nt, Bordetella pertussis
cagcguggcgcggg

SEQ ID NO: 323059 - RNA, 19 nt, Bordetella pertussis
cagcguguagagcaggccg

SEQ ID NO: 323060 - RNA, 18 nt, Bordetella pertussis
cagcgugucgaacaccag

SEQ ID NO: 323061 - RNA, 22 nt, Bordetella pertussis
cagcguguggugaaagccgccg

SEQ ID NO: 323062 - RNA, 15 nt, Bordetella pertussis
cagcucauggcacag

SEQ ID NO: 323063 - RNA, 21 nt, Bordetella pertussis
cagcucauggcacagcgcggc

SEQ ID NO: 323064 - RNA, 14 nt, Bordetella pertussis
cagcuccggcggca

SEQ ID NO: 323065 - RNA, 21 nt, Bordetella pertussis
cagcuccgggucgagcgccga

SEQ ID NO: 323066 - RNA, 14 nt, Bordetella pertussis
cagcuccuugacca

SEQ ID NO: 323067 - RNA, 19 nt, Bordetella pertussis
cagcugccugagcaccgcc

SEQ ID NO: 323068 - RNA, 20 nt, Bordetella pertussis
cagcugccugagcaccgccg

SEQ ID NO: 323069 - RNA, 21 nt, Bordetella pertussis
cagcugccugagcaccgccgc

SEQ ID NO: 323070 - RNA, 13 nt, Bordetella pertussis
cagcugcgcagcg

SEQ ID NO: 323071 - RNA, 17 nt, Bordetella pertussis
cagcugcgcgcgagcgg

SEQ ID NO: 323072 - RNA, 18 nt, Bordetella pertussis
cagcugcgcgcgagcggc

SEQ ID NO: 323073 - RNA, 14 nt, Bordetella pertussis
cagcugcguggcga

SEQ ID NO: 323074 - RNA, 22 nt, Bordetella pertussis
cagcugcguggcgacgcgcugc

SEQ ID NO: 323075 - RNA, 19 nt, Bordetella pertussis
cagcuggcgcagcacgccg

SEQ ID NO: 323076 - RNA, 23 nt, Bordetella pertussis
cagcuggcgccccuuccacccgc

SEQ ID NO: 323077 - RNA, 17 nt, Bordetella pertussis
cagcuggcgcgggcggc

SEQ ID NO: 323078 - RNA, 20 nt, Bordetella pertussis
cagcuggcgcguggccgcca

SEQ ID NO: 323079 - RNA, 14 nt, Bordetella pertussis
cagcuggcggcgca

SEQ ID NO: 323080 - RNA, 19 nt, Bordetella pertussis
cagcugggccacagggcga

SEQ ID NO: 323081 - RNA, 20 nt, Bordetella pertussis
cagcuggugccgguugcgcg

SEQ ID NO: 323082 - RNA, 23 nt, Bordetella pertussis
cagcuguagcccuggcgcugcag

SEQ ID NO: 323083 - RNA, 16 nt, Bordetella pertussis
cagcuguccaagcgcg

SEQ ID NO: 323084 - RNA, 15 nt, Bordetella pertussis
cagcugugguaggcc

SEQ ID NO: 323085 - RNA, 13 nt, Bordetella pertussis
cagcuuggcgcgc

SEQ ID NO: 323086 - RNA, 14 nt, Bordetella pertussis
cagcuuggcgcgcc

SEQ ID NO: 323087 - RNA, 15 nt, Bordetella pertussis
cagcuuggcgcgccg

SEQ ID NO: 323088 - RNA, 16 nt, Bordetella pertussis
cagcuuggcgcgccgg

SEQ ID NO: 323089 - RNA, 20 nt, Bordetella pertussis
cagcuuggucacggccucgg

SEQ ID NO: 323090 - RNA, 23 nt, Bordetella pertussis
cagcuugucgaccaccggcuugg

SEQ ID NO: 323091 - RNA, 16 nt, Bordetella pertussis
cagcuugucgaucgcc

SEQ ID NO: 323092 - RNA, 19 nt, Bordetella pertussis
cagcuugucgaucgccacc

SEQ ID NO: 323093 - RNA, 16 nt, Bordetella pertussis
cagcuugucggccgcg

SEQ ID NO: 323094 - RNA, 22 nt, Bordetella pertussis
caggaaaaucgauacgccgggc

SEQ ID NO: 323095 - RNA, 17 nt, Bordetella pertussis
caggaaaccggcgacca

SEQ ID NO: 323096 - RNA, 14 nt, Bordetella pertussis
caggaaagcgccgc

SEQ ID NO: 323097 - RNA, 16 nt, Bordetella pertussis
caggaaaucaggcgca

SEQ ID NO: 323098 - RNA, 15 nt, Bordetella pertussis
caggaacaggccggc

SEQ ID NO: 323099 - RNA, 21 nt, Bordetella pertussis
caggaacauguucacgcccag

SEQ ID NO: 323100 - RNA, 14 nt, Bordetella pertussis
caggaaccagcggc

SEQ ID NO: 323101 - RNA, 13 nt, Bordetella pertussis
caggaacgccagc

SEQ ID NO: 323102 - RNA, 16 nt, Bordetella pertussis
caggaacuccggcggc

SEQ ID NO: 323103 - RNA, 23 nt, Bordetella pertussis
caggaacuugaacggcgcggccu

SEQ ID NO: 323104 - RNA, 14 nt, Bordetella pertussis
caggaagcagccca

SEQ ID NO: 323105 - RNA, 18 nt, Bordetella pertussis
caggaagaucggcccggc

SEQ ID NO: 323106 - RNA, 22 nt, Bordetella pertussis
caggaagaucggcccggcgccg

SEQ ID NO: 323107 - RNA, 16 nt, Bordetella pertussis
caggacgaacaggccg

SEQ ID NO: 323108 - RNA, 24 nt, Bordetella pertussis
caggacgaacaggccgccguacga

SEQ ID NO: 323109 - RNA, 18 nt, Bordetella pertussis
caggacgacaggcaugca

SEQ ID NO: 323110 - RNA, 15 nt, Bordetella pertussis
caggacgccggcgcc

SEQ ID NO: 323111 - RNA, 16 nt, Bordetella pertussis
caggacgccggcgccg

SEQ ID NO: 323112 - RNA, 18 nt, Bordetella pertussis
caggacgccggcgccggc

SEQ ID NO: 323113 - RNA, 22 nt, Bordetella pertussis
caggacgcgaagaucccgccgg

SEQ ID NO: 323114 - RNA, 14 nt, Bordetella pertussis
caggagacuggcag

SEQ ID NO: 323115 - RNA, 15 nt, Bordetella pertussis
caggaucaggccggc

SEQ ID NO: 323116 - RNA, 17 nt, Bordetella pertussis
caggaucaggccggcga

SEQ ID NO: 323117 - RNA, 21 nt, Bordetella pertussis
caggaucgaaggcagcgcggc

SEQ ID NO: 323118 - RNA, 23 nt, Bordetella pertussis
caggaucgaaggcagcgcggccg

SEQ ID NO: 323119 - RNA, 16 nt, Bordetella pertussis
caggaucgcggccagc

SEQ ID NO: 323120 - RNA, 15 nt, Bordetella pertussis
caggaugcccggggu

SEQ ID NO: 323121 - RNA, 23 nt, Bordetella pertussis
caggaugcccuggguggcggggc

SEQ ID NO: 323122 - RNA, 17 nt, Bordetella pertussis
caggaugcccuuggcgg

SEQ ID NO: 323123 - RNA, 20 nt, Bordetella pertussis
caggaugcccuuggcggcga

SEQ ID NO: 323124 - RNA, 17 nt, Bordetella pertussis
caggaugcgcggcacgu

SEQ ID NO: 323125 - RNA, 16 nt, Bordetella pertussis
caggaugcgcuggccg

SEQ ID NO: 323126 - RNA, 21 nt, Bordetella pertussis
caggaugcgcuggccggccgc

SEQ ID NO: 323127 - RNA, 15 nt, Bordetella pertussis
caggauggaucccug

SEQ ID NO: 323128 - RNA, 22 nt, Bordetella pertussis
caggcacuccggauaccgccgc

SEQ ID NO: 323129 - RNA, 18 nt, Bordetella pertussis
caggcagacgaugcccag

SEQ ID NO: 323130 - RNA, 14 nt, Bordetella pertussis
caggcagauccgcc

SEQ ID NO: 323131 - RNA, 21 nt, Bordetella pertussis
caggcagcaaccggaacacca

SEQ ID NO: 323132 - RNA, 12 nt, Bordetella pertussis
caggcagcggcc

SEQ ID NO: 323133 - RNA, 13 nt, Bordetella pertussis
caggcagcggccg

SEQ ID NO: 323134 - RNA, 18 nt, Bordetella pertussis
caggcagcugcgcgucga

SEQ ID NO: 323135 - RNA, 12 nt, Bordetella pertussis
caggcaggcgcg

SEQ ID NO: 323136 - RNA, 15 nt, Bordetella pertussis
caggcaggcgcgccg

SEQ ID NO: 323137 - RNA, 17 nt, Bordetella pertussis
caggcaggcgcgccggg

SEQ ID NO: 323138 - RNA, 17 nt, Bordetella pertussis
caggcaggcgggcccgc

SEQ ID NO: 323139 - RNA, 18 nt, Bordetella pertussis
caggcaguacgagcggcg

SEQ ID NO: 323140 - RNA, 22 nt, Bordetella pertussis
caggcagugguggugcagcggc

SEQ ID NO: 323141 - RNA, 23 nt, Bordetella pertussis
caggcagugguggugcagcggca

SEQ ID NO: 323142 - RNA, 18 nt, Bordetella pertussis
caggcaguuggcggcgca

SEQ ID NO: 323143 - RNA, 21 nt, Bordetella pertussis
caggcauucgaacaacagcgc

SEQ ID NO: 323144 - RNA, 23 nt, Bordetella pertussis
caggcauucgaacaacagcgccu

SEQ ID NO: 323145 - RNA, 23 nt, Bordetella pertussis
caggcauugaagcuggcgccggu

SEQ ID NO: 323146 - RNA, 23 nt, Bordetella pertussis
caggcauugcgccagccguugcg

SEQ ID NO: 323147 - RNA, 23 nt, Bordetella pertussis
caggccaaaaaaaaccggcaagc

SEQ ID NO: 323148 - RNA, 20 nt, Bordetella pertussis
caggccaccgacggcgcggc

SEQ ID NO: 323149 - RNA, 15 nt, Bordetella pertussis
caggccaccgcggcg

SEQ ID NO: 323150 - RNA, 22 nt, Bordetella pertussis
caggccacguugauccagcgcu

SEQ ID NO: 323151 - RNA, 13 nt, Bordetella pertussis
caggccagcagcu

SEQ ID NO: 323152 - RNA, 22 nt, Bordetella pertussis
caggccagcagcucggccaccg

SEQ ID NO: 323153 - RNA, 13 nt, Bordetella pertussis
caggccagcaugg

SEQ ID NO: 323154 - RNA, 15 nt, Bordetella pertussis
caggccagcauggcc

SEQ ID NO: 323155 - RNA, 15 nt, Bordetella pertussis
caggccagcccgcgc

SEQ ID NO: 323156 - RNA, 20 nt, Bordetella pertussis
caggccagcccgcgcgcguu

SEQ ID NO: 323157 - RNA, 12 nt, Bordetella pertussis
caggccagcgac

SEQ ID NO: 323158 - RNA, 13 nt, Bordetella pertussis
caggccagcgccg

SEQ ID NO: 323159 - RNA, 14 nt, Bordetella pertussis
caggccagcgccgc

SEQ ID NO: 323160 - RNA, 15 nt, Bordetella pertussis
caggccagcgccgcg

SEQ ID NO: 323161 - RNA, 17 nt, Bordetella pertussis
caggccagcgccgcggc

SEQ ID NO: 323162 - RNA, 21 nt, Bordetella pertussis
caggccagcgccgcggccggc

SEQ ID NO: 323163 - RNA, 23 nt, Bordetella pertussis
caggccaggcucagcagggucga

SEQ ID NO: 323164 - RNA, 20 nt, Bordetella pertussis
caggccaucgccgccgccgg

SEQ ID NO: 323165 - RNA, 22 nt, Bordetella pertussis
caggccaucgccgccgccgggc

SEQ ID NO: 323166 - RNA, 14 nt, Bordetella pertussis
caggccaucggcgc

SEQ ID NO: 323167 - RNA, 17 nt, Bordetella pertussis
caggccaucggcgccaa

SEQ ID NO: 323168 - RNA, 16 nt, Bordetella pertussis
caggccaugcugggcc

SEQ ID NO: 323169 - RNA, 15 nt, Bordetella pertussis
caggcccaccagggc

SEQ ID NO: 323170 - RNA, 20 nt, Bordetella pertussis
caggcccaccagggccagcu

SEQ ID NO: 323171 - RNA, 23 nt, Bordetella pertussis
caggcccaccagggccagcuuga

SEQ ID NO: 323172 - RNA, 17 nt, Bordetella pertussis
caggcccaccgcaucgc

SEQ ID NO: 323173 - RNA, 19 nt, Bordetella pertussis
caggcccaccgcaucgcgc

SEQ ID NO: 323174 - RNA, 21 nt, Bordetella pertussis
caggcccaccggcaugccguc

SEQ ID NO: 323175 - RNA, 11 nt, Bordetella pertussis
caggcccacga

SEQ ID NO: 323176 - RNA, 13 nt, Bordetella pertussis
caggcccacgccg

SEQ ID NO: 323177 - RNA, 14 nt, Bordetella pertussis
caggcccacgccgc

SEQ ID NO: 323178 - RNA, 15 nt, Bordetella pertussis
caggcccacgccgcc

SEQ ID NO: 323179 - RNA, 13 nt, Bordetella pertussis
caggcccacggca

SEQ ID NO: 323180 - RNA, 14 nt, Bordetella pertussis
caggcccuggcggc

SEQ ID NO: 323181 - RNA, 16 nt, Bordetella pertussis
caggcccuggcggcgc

SEQ ID NO: 323182 - RNA, 17 nt, Bordetella pertussis
caggcccuggcggcgca

SEQ ID NO: 323183 - RNA, 15 nt, Bordetella pertussis
caggcccuggcuggc

SEQ ID NO: 323184 - RNA, 22 nt, Bordetella pertussis
caggcccuggcuggccagccgg

SEQ ID NO: 323185 - RNA, 24 nt, Bordetella pertussis
caggcccuggcuggccagccggcc

SEQ ID NO: 323186 - RNA, 17 nt, Bordetella pertussis
caggcccugggccagca

SEQ ID NO: 323187 - RNA, 20 nt, Bordetella pertussis
caggcccugggccagcagcu

SEQ ID NO: 323188 - RNA, 14 nt, Bordetella pertussis
caggcccugccgcc

SEQ ID NO: 323189 - RNA, 21 nt, Bordetella pertussis
caggcccugcgcguugagcag

SEQ ID NO: 323190 - RNA, 13 nt, Bordetella pertussis
caggcccuggggc

SEQ ID NO: 323191 - RNA, 18 nt, Bordetella pertussis
caggcccuggggccgcgg

SEQ ID NO: 323192 - RNA, 19 nt, Bordetella pertussis
caggcccuggggccgcggc

SEQ ID NO: 323193 - RNA, 16 nt, Bordetella pertussis
caggcccuugaucagg

SEQ ID NO: 323194 - RNA, 20 nt, Bordetella pertussis
caggcccuugaucaggcgca

SEQ ID NO: 323195 - RNA, 20 nt, Bordetella pertussis
caggcccuugauggccgggc

SEQ ID NO: 323196 - RNA, 23 nt, Bordetella pertussis
caggccgaacugggacaggccca

SEQ ID NO: 323197 - RNA, 20 nt, Bordetella pertussis
caggccgaaauggcggcggu

SEQ ID NO: 323198 - RNA, 18 nt, Bordetella pertussis
caggccgaaccacagcau

SEQ ID NO: 323199 - RNA, 19 nt, Bordetella pertussis
caggccgaacgcggucgca

SEQ ID NO: 323200 - RNA, 20 nt, Bordetella pertussis
caggccgaucagcaccacgg

SEQ ID NO: 323201 - RNA, 23 nt, Bordetella pertussis
caggccgaucagcaccacggcgg

SEQ ID NO: 323202 - RNA, 11 nt, Bordetella pertussis
caggccgaacu

SEQ ID NO: 323203 - RNA, 22 nt, Bordetella pertussis
caggccgaucagcggauugacc

SEQ ID NO: 323204 - RNA, 15 nt, Bordetella pertussis
caggccgaugcuggu

SEQ ID NO: 323205 - RNA, 18 nt, Bordetella pertussis
caggccgaugcuggucgc

SEQ ID NO: 323206 - RNA, 15 nt, Bordetella pertussis
caggccgauggcguc

SEQ ID NO: 323207 - RNA, 21 nt, Bordetella pertussis
caggccgauuucggccgccgg

SEQ ID NO: 323208 - RNA, 14 nt, Bordetella pertussis
caggccgcagcggg

SEQ ID NO: 323209 - RNA, 15 nt, Bordetella pertussis
caggccgcagcgggc

SEQ ID NO: 323210 - RNA, 15 nt, Bordetella pertussis
caggccgccagggcc

SEQ ID NO: 323211 - RNA, 14 nt, Bordetella pertussis
caggccgcccagcc

SEQ ID NO: 323212 - RNA, 20 nt, Bordetella pertussis
caggccgcccagccgcgcca

SEQ ID NO: 323213 - RNA, 16 nt, Bordetella pertussis
caggccgcccagcgca

SEQ ID NO: 323214 - RNA, 19 nt, Bordetella pertussis
caggccgccccaacggccu

SEQ ID NO: 323215 - RNA, 22 nt, Bordetella pertussis
caggccgccccaacggccuucg

SEQ ID NO: 323216 - RNA, 14 nt, Bordetella pertussis
caggccgccgccgg

SEQ ID NO: 323217 - RNA, 22 nt, Bordetella pertussis
caggccgccgccggucaccgcc

SEQ ID NO: 323218 - RNA, 17 nt, Bordetella pertussis
caggccgccggccagcg

SEQ ID NO: 323219 - RNA, 20 nt, Bordetella pertussis
caggccgccggccagcgcca

SEQ ID NO: 323220 - RNA, 19 nt, Bordetella pertussis
caggccgccggcggcgucg

SEQ ID NO: 323221 - RNA, 14 nt, Bordetella pertussis
caggccgcgcagca

SEQ ID NO: 323222 - RNA, 20 nt, Bordetella pertussis
caggccgcgcagcacgcccg

SEQ ID NO: 323223 - RNA, 16 nt, Bordetella pertussis
caggccgcgcagggca

SEQ ID NO: 323224 - RNA, 11 nt, Bordetella pertussis
caggccgcgcc

SEQ ID NO: 323225 - RNA, 16 nt, Bordetella pertussis
caggccgcgccacagg

SEQ ID NO: 323226 - RNA, 23 nt, Bordetella pertussis
caggccgcgcgugcggggcggca

SEQ ID NO: 323227 - RNA, 11 nt, Bordetella pertussis
caggccgcgcu

SEQ ID NO: 323228 - RNA, 18 nt, Bordetella pertussis
caggccgcgcugccagcc

SEQ ID NO: 323229 - RNA, 22 nt, Bordetella pertussis
caggccgcgcuggugcuggccg

SEQ ID NO: 323230 - RNA, 15 nt, Bordetella pertussis
caggccgcggccagg

SEQ ID NO: 323231 - RNA, 19 nt, Bordetella pertussis
caggccgcuuucgaccagc

SEQ ID NO: 323232 - RNA, 20 nt, Bordetella pertussis
caggccgcuuucgaccagcg

SEQ ID NO: 323233 - RNA, 14 nt, Bordetella pertussis
caggccucgcccga

SEQ ID NO: 323234 - RNA, 19 nt, Bordetella pertussis
caggccucgcccgaucggc

SEQ ID NO: 323235 - RNA, 22 nt, Bordetella pertussis
caggccucgcccgaucggccgg

SEQ ID NO: 323236 - RNA, 16 nt, Bordetella pertussis
caggccucggucgccu

SEQ ID NO: 323237 - RNA, 19 nt, Bordetella pertussis
caggccucggucgccucga

SEQ ID NO: 323238 - RNA, 24 nt, Bordetella pertussis
caggccugcacgucccagucgccg

SEQ ID NO: 323239 - RNA, 16 nt, Bordetella pertussis
caggccugcggcgcca

SEQ ID NO: 323240 - RNA, 17 nt, Bordetella pertussis
caggccugcggcgccag

SEQ ID NO: 323241 - RNA, 19 nt, Bordetella pertussis
caggccugcggcgccagcg

SEQ ID NO: 323242 - RNA, 21 nt, Bordetella pertussis
caggccugcggcgccagcgcc

SEQ ID NO: 323243 - RNA, 22 nt, Bordetella pertussis
caggccuucgacguccagcccg

SEQ ID NO: 323244 - RNA, 13 nt, Bordetella pertussis
caggccuggucga

SEQ ID NO: 323245 - RNA, 16 nt, Bordetella pertussis
caggccuggucgagcg

SEQ ID NO: 323246 - RNA, 20 nt, Bordetella pertussis
caggccuggucgagcgggcg

SEQ ID NO: 323247 - RNA, 20 nt, Bordetella pertussis
caggccuguucggccgggac

SEQ ID NO: 323248 - RNA, 16 nt, Bordetella pertussis
caggcgaaacgccagc

SEQ ID NO: 323249 - RNA, 19 nt, Bordetella pertussis
caggcgaaacgccagcccg

SEQ ID NO: 323250 - RNA, 21 nt, Bordetella pertussis
caggcgaaacgccagcccgac

SEQ ID NO: 323251 - RNA, 18 nt, Bordetella pertussis
caggcgcaccagcgcgcc

SEQ ID NO: 323252 - RNA, 14 nt, Bordetella pertussis
caggcgcacggcgg

SEQ ID NO: 323253 - RNA, 14 nt, Bordetella pertussis
caggcgcagccgcg

SEQ ID NO: 323254 - RNA, 15 nt, Bordetella pertussis
caggcgcagccgcgc

SEQ ID NO: 323255 - RNA, 20 nt, Bordetella pertussis
caggcgcagccgcgcgccuu

SEQ ID NO: 323256 - RNA, 14 nt, Bordetella pertussis
caggcgcagcggcg

SEQ ID NO: 323257 - RNA, 18 nt, Bordetella pertussis
caggcgcagcggcggcgc

SEQ ID NO: 323258 - RNA, 19 nt, Bordetella pertussis
caggcgcaggccgcgcgca

SEQ ID NO: 323259 - RNA, 21 nt, Bordetella pertussis
caggcgcauauggagccaggc

SEQ ID NO: 323260 - RNA, 22 nt, Bordetella pertussis
caggcgcauauggagccaggcg

SEQ ID NO: 323261 - RNA, 24 nt, Bordetella pertussis
caggcgcauauggagccaggcggc

SEQ ID NO: 323262 - RNA, 19 nt, Bordetella pertussis
caggcgcaucgacagcgcg

SEQ ID NO: 323263 - RNA, 23 nt, Bordetella pertussis
caggcgcauggugagggccacgc

SEQ ID NO: 323264 - RNA, 16 nt, Bordetella pertussis
caggcgcgagcgccgg

SEQ ID NO: 323265 - RNA, 17 nt, Bordetella pertussis
caggcgcgagcgccggg

SEQ ID NO: 323266 - RNA, 21 nt, Bordetella pertussis
caggcgcgagcgccgggcgcc

SEQ ID NO: 323267 - RNA, 13 nt, Bordetella pertussis
caggcgcgccagc

SEQ ID NO: 323268 - RNA, 23 nt, Bordetella pertussis
caggcgcgccagccgcugcagcg

SEQ ID NO: 323269 - RNA, 21 nt, Bordetella pertussis
caggcgcgccauccugaacgc

SEQ ID NO: 323270 - RNA, 13 nt, Bordetella pertussis
caggcgcgcccgc

SEQ ID NO: 323271 - RNA, 14 nt, Bordetella pertussis
caggcgcgccgcga

SEQ ID NO: 323272 - RNA, 13 nt, Bordetella pertussis
caggcgcgccggg

SEQ ID NO: 323273 - RNA, 20 nt, Bordetella pertussis
caggcgcgcgccaucgacgg

SEQ ID NO: 323274 - RNA, 14 nt, Bordetella pertussis
caggcgcgcgccuu

SEQ ID NO: 323275 - RNA, 14 nt, Bordetella pertussis
caggcgcgcgcgcg

SEQ ID NO: 323276 - RNA, 17 nt, Bordetella pertussis
caggcgcgcggcagggc

SEQ ID NO: 323277 - RNA, 18 nt, Bordetella pertussis
caggcgcgcggcagggcg

SEQ ID NO: 323278 - RNA, 13 nt, Bordetella pertussis
caggcgcgcggcc

SEQ ID NO: 323279 - RNA, 14 nt, Bordetella pertussis
caggcgcgcggccu

SEQ ID NO: 323280 - RNA, 15 nt, Bordetella pertussis
caggcgcgcggcguu

SEQ ID NO: 323281 - RNA, 22 nt, Bordetella pertussis
caggcgcgcggcguugcggcgc

SEQ ID NO: 323282 - RNA, 21 nt, Bordetella pertussis
caggcgcgcgggggugcgcga

SEQ ID NO: 323283 - RNA, 16 nt, Bordetella pertussis
caggcgcgcucaggcc

SEQ ID NO: 323284 - RNA, 17 nt, Bordetella pertussis
caggcgcgcucaggccg

SEQ ID NO: 323285 - RNA, 19 nt, Bordetella pertussis
caggcgcgcucaggccgcc

SEQ ID NO: 323286 - RNA, 20 nt, Bordetella pertussis
caggcgcgcucaggccgccg

SEQ ID NO: 323287 - RNA, 21 nt, Bordetella pertussis
caggcgcgcucaggccgccgg

SEQ ID NO: 323288 - RNA, 22 nt, Bordetella pertussis
caggcgcgcucaggccgccggc

SEQ ID NO: 323289 - RNA, 13 nt, Bordetella pertussis
caggcgcgcuggc

SEQ ID NO: 323290 - RNA, 13 nt, Bordetella pertussis
caggcgcggaucu

SEQ ID NO: 323291 - RNA, 20 nt, Bordetella pertussis
caggcgcggauugaugucgc

SEQ ID NO: 323292 - RNA, 23 nt, Bordetella pertussis
caggcgcggauugaugucgcgca

SEQ ID NO: 323293 - RNA, 13 nt, Bordetella pertussis
caggcgcggcacg

SEQ ID NO: 323294 - RNA, 13 nt, Bordetella pertussis
caggcgcggcugg

SEQ ID NO: 323295 - RNA, 20 nt, Bordetella pertussis
caggcgcgugaggucgcgcg

SEQ ID NO: 323296 - RNA, 13 nt, Bordetella pertussis
caggcgcgugcgc

SEQ ID NO: 323297 - RNA, 21 nt, Bordetella pertussis
caggcgcgugcucaucggcag

SEQ ID NO: 323298 - RNA, 18 nt, Bordetella pertussis
cagggcaugggcccgggc

SEQ ID NO: 323299 - RNA, 19 nt, Bordetella pertussis
cagggcaugggcccgggcg

SEQ ID NO: 323300 - RNA, 22 nt, Bordetella pertussis
cagggcaugggcccgggcgcgc

SEQ ID NO: 323301 - RNA, 17 nt, Bordetella pertussis
cagggccaccacgccga

SEQ ID NO: 323302 - RNA, 16 nt, Bordetella pertussis
cagggccacgcccagg

SEQ ID NO: 323303 - RNA, 19 nt, Bordetella pertussis
cagggccacgccggccgcc

SEQ ID NO: 323304 - RNA, 14 nt, Bordetella pertussis
cagggccagcgcca

SEQ ID NO: 323305 - RNA, 13 nt, Bordetella pertussis
cagggccaggccg

SEQ ID NO: 323306 - RNA, 14 nt, Bordetella pertussis
cagggccaggccga

SEQ ID NO: 323307 - RNA, 20 nt, Bordetella pertussis
cagggccagcuugacgucca

SEQ ID NO: 323308 - RNA, 20 nt, Bordetella pertussis
cagggccauucucaauagcg

SEQ ID NO: 323309 - RNA, 22 nt, Bordetella pertussis
cagggcccggacgcggccggca

SEQ ID NO: 323310 - RNA, 22 nt, Bordetella pertussis
cagggccgaucccuugugcgcg

SEQ ID NO: 323311 - RNA, 12 nt, Bordetella pertussis
cagggccgcagc

SEQ ID NO: 323312 - RNA, 15 nt, Bordetella pertussis
cagggccgcagcaau

SEQ ID NO: 323313 - RNA, 11 nt, Bordetella pertussis
cagggccgcca

SEQ ID NO: 323314 - RNA, 13 nt, Bordetella pertussis
cagggccgcccag

SEQ ID NO: 323315 - RNA, 20 nt, Bordetella pertussis
cagggccgcccagucgucca

SEQ ID NO: 323316 - RNA, 17 nt, Bordetella pertussis
cagggccgccgcgccca

SEQ ID NO: 323317 - RNA, 13 nt, Bordetella pertussis
cagggccgcgagc

SEQ ID NO: 323318 - RNA, 19 nt, Bordetella pertussis
cagggcgaucuugccggcc

SEQ ID NO: 323319 - RNA, 23 nt, Bordetella pertussis
cagggcgaucuugccggccuggc

SEQ ID NO: 323320 - RNA, 17 nt, Bordetella pertussis
cagggcgccgaccgggc

SEQ ID NO: 323321 - RNA, 23 nt, Bordetella pertussis
cagggcgccgaccgggccgacca

SEQ ID NO: 323322 - RNA, 17 nt, Bordetella pertussis
cagggcgccgcggcggc

SEQ ID NO: 323323 - RNA, 15 nt, Bordetella pertussis
cagggcgcgcagcag

SEQ ID NO: 323324 - RNA, 16 nt, Bordetella pertussis
cagggcgcgcagcagg

SEQ ID NO: 323325 - RNA, 13 nt, Bordetella pertussis
cagggcgcgccgg

SEQ ID NO: 323326 - RNA, 22 nt, Bordetella pertussis
cagggcgcgccggaacauggcg

SEQ ID NO: 323327 - RNA, 17 nt, Bordetella pertussis
cagggcgcggacuucgc

SEQ ID NO: 323328 - RNA, 19 nt, Bordetella pertussis
cagggcgcggaucaugggc

SEQ ID NO: 323329 - RNA, 22 nt, Bordetella pertussis
cagggcggaaaacagcaccagc

SEQ ID NO: 323330 - RNA, 23 nt, Bordetella pertussis
cagggcggaaaacagcaccagca

SEQ ID NO: 323331 - RNA, 17 nt, Bordetella pertussis
cagggcggccaggccgg

SEQ ID NO: 323332 - RNA, 20 nt, Bordetella pertussis
cagggcggccccggccgccc

SEQ ID NO: 323333 - RNA, 21 nt, Bordetella pertussis
cagggcggccccggccgcccc

SEQ ID NO: 323334 - RNA, 18 nt, Bordetella pertussis
cagggcggccucgacggc

SEQ ID NO: 323335 - RNA, 17 nt, Bordetella pertussis
cagggcggcgacuucgc

SEQ ID NO: 323336 - RNA, 17 nt, Bordetella pertussis
cagggcggugcgcucga

SEQ ID NO: 323337 - RNA, 17 nt, Bordetella pertussis
cagggcuugacgcgcgu

SEQ ID NO: 323338 - RNA, 16 nt, Bordetella pertussis
caggggcaggcgcacg

SEQ ID NO: 323339 - RNA, 17 nt, Bordetella pertussis
caggggcaaggcgaacg

SEQ ID NO: 323340 - RNA, 14 nt, Bordetella pertussis
caggggccgcacgc

SEQ ID NO: 323341 - RNA, 18 nt, Bordetella pertussis
caggggccgcacgcgcgg

SEQ ID NO: 323342 - RNA, 18 nt, Bordetella pertussis
caggggccucaugacggg

SEQ ID NO: 323343 - RNA, 20 nt, Bordetella pertussis
caggggcuccaggaacacca

SEQ ID NO: 323344 - RNA, 20 nt, Bordetella pertussis
caggggcucuucgacagcgc

SEQ ID NO: 323345 - RNA, 23 nt, Bordetella pertussis
caggggcucuucgacagcgcgca

SEQ ID NO: 323346 - RNA, 18 nt, Bordetella pertussis
caggggguggcggccguc

SEQ ID NO: 323347 - RNA, 14 nt, Bordetella pertussis
cagggucagcccgc

SEQ ID NO: 323348 - RNA, 15 nt, Bordetella pertussis
cagggucgguugcag

SEQ ID NO: 323349 - RNA, 14 nt, Bordetella pertussis
cagggucucggcca

SEQ ID NO: 323350 - RNA, 16 nt, Bordetella pertussis
cagggugacgggcugg

SEQ ID NO: 323351 - RNA, 15 nt, Bordetella pertussis
cagggugcaccaggu

SEQ ID NO: 323352 - RNA, 16 nt, Bordetella pertussis
cagggugccccgccgg

SEQ ID NO: 323353 - RNA, 17 nt, Bordetella pertussis
cagggugccccgccgga

SEQ ID NO: 323354 - RNA, 16 nt, Bordetella pertussis
cagggugccgcgccgg

SEQ ID NO: 323355 - RNA, 18 nt, Bordetella pertussis
cagggugccgcgccgguc

SEQ ID NO: 323356 - RNA, 12 nt, Bordetella pertussis
caggguggccac

SEQ ID NO: 323357 - RNA, 14 nt, Bordetella pertussis
caggguggccgcga

SEQ ID NO: 323358 - RNA, 16 nt, Bordetella pertussis
caggguggcgcccagg

SEQ ID NO: 323359 - RNA, 18 nt, Bordetella pertussis
caggguggcgccggccac

SEQ ID NO: 323360 - RNA, 18 nt, Bordetella pertussis
cagggugggcacgcgcuu

SEQ ID NO: 323361 - RNA, 16 nt, Bordetella pertussis
caggguuggcgcgccg

SEQ ID NO: 323362 - RNA, 17 nt, Bordetella pertussis
caggguuggcgcgccgu

SEQ ID NO: 323363 - RNA, 18 nt, Bordetella pertussis
caggguuggcgcgccgug

SEQ ID NO: 323364 - RNA, 18 nt, Bordetella pertussis
caggguuuccucgccgac

SEQ ID NO: 323365 - RNA, 21 nt, Bordetella pertussis
caggguuucguggucgugcug

SEQ ID NO: 323366 - RNA, 17 nt, Bordetella pertussis
cagguacaggccgccgg

SEQ ID NO: 323367 - RNA, 23 nt, Bordetella pertussis
cagguacaucauccccagcgccg

SEQ ID NO: 323368 - RNA, 15 nt, Bordetella pertussis
cagguagaccacgcg

SEQ ID NO: 323369 - RNA, 20 nt, Bordetella pertussis
cagguagaucagccgcugca

SEQ ID NO: 323370 - RNA, 15 nt, Bordetella pertussis
cagguagcgccucgc

SEQ ID NO: 323371 - RNA, 17 nt, Bordetella pertussis
cagguagcggguggccg

SEQ ID NO: 323372 - RNA, 20 nt, Bordetella pertussis
cagguaguagccgaauccgg

SEQ ID NO: 323373 - RNA, 15 nt, Bordetella pertussis
caggucacgacgggu

SEQ ID NO: 323374 - RNA, 16 nt, Bordetella pertussis
caggucaucaccaggg

SEQ ID NO: 323375 - RNA, 16 nt, Bordetella pertussis
caggucaucgccaggc

SEQ ID NO: 323376 - RNA, 16 nt, Bordetella pertussis
cagguccacauccgcg

SEQ ID NO: 323377 - RNA, 19 nt, Bordetella pertussis
cagguccaugaacgccgcg

SEQ ID NO: 323378 - RNA, 15 nt, Bordetella pertussis
cagguccauggccag

SEQ ID NO: 323379 - RNA, 13 nt, Bordetella pertussis
cagguccaggccu

SEQ ID NO: 323380 - RNA, 14 nt, Bordetella pertussis
cagguccaggccug

SEQ ID NO: 323381 - RNA, 15 nt, Bordetella pertussis
cagguccgaaccgac

SEQ ID NO: 323382 - RNA, 20 nt, Bordetella pertussis
cagguccgaaccgaccgcca

SEQ ID NO: 323383 - RNA, 16 nt, Bordetella pertussis
cagguccugcacgcgg

SEQ ID NO: 323384 - RNA, 14 nt, Bordetella pertussis
cagguccugcgcca

SEQ ID NO: 323385 - RNA, 17 nt, Bordetella pertussis
caggucgaagcacugca

SEQ ID NO: 323386 - RNA, 22 nt, Bordetella pertussis
caggucgggauaguccagcacc

SEQ ID NO: 323387 - RNA, 23 nt, Bordetella pertussis
caggucgggcagggugggcacgc

SEQ ID NO: 323388 - RNA, 13 nt, Bordetella pertussis
caggucggugcac

SEQ ID NO: 323389 - RNA, 21 nt, Bordetella pertussis
caggucgucguagcgggcggc

SEQ ID NO: 323390 - RNA, 14 nt, Bordetella pertussis
caggugcacggugg

SEQ ID NO: 323391 - RNA, 17 nt, Bordetella pertussis
caggugccccacgccga

SEQ ID NO: 323392 - RNA, 18 nt, Bordetella pertussis
caggugccugucccagcg

SEQ ID NO: 323393 - RNA, 22 nt, Bordetella pertussis
caggugccuguccccacgggga

SEQ ID NO: 323394 - RNA, 14 nt, Bordetella pertussis
caggugccgccggc

SEQ ID NO: 323395 - RNA, 17 nt, Bordetella pertussis
caggugccgccggcgcg

SEQ ID NO: 323396 - RNA, 19 nt, Bordetella pertussis
caggugggccgagcccgcg

SEQ ID NO: 323397 - RNA, 15 nt, Bordetella pertussis
cagguggggcagcag

SEQ ID NO: 323398 - RNA, 20 nt, Bordetella pertussis
cagguggggcagcaggccgg

SEQ ID NO: 323399 - RNA, 16 nt, Bordetella pertussis
cagguuguccagcgcg

SEQ ID NO: 323400 - RNA, 18 nt, Bordetella pertussis
cagguuguccagcgcgcc

SEQ ID NO: 323401 - RNA, 23 nt, Bordetella pertussis
cagguugucgcgcgagaccagcg

SEQ ID NO: 323402 - RNA, 13 nt, Bordetella pertussis
cagguuguccagc

SEQ ID NO: 323403 - RNA, 17 nt, Bordetella pertussis
cagguugugguucauga

SEQ ID NO: 323404 - RNA, 23 nt, Bordetella pertussis
cagguuuuccacagccaggccga

SEQ ID NO: 323405 - RNA, 19 nt, Bordetella pertussis
caguacaggcugccgucgu

SEQ ID NO: 323406 - RNA, 21 nt, Bordetella pertussis
caguacaggcugccgucgucg

SEQ ID NO: 323407 - RNA, 18 nt, Bordetella pertussis
caguacccggugcagcgu

SEQ ID NO: 323408 - RNA, 23 nt, Bordetella pertussis
caguacccggugcagcguggcgc

SEQ ID NO: 323409 - RNA, 17 nt, Bordetella pertussis
caguacguacgcccggc

SEQ ID NO: 323410 - RNA, 19 nt, Bordetella pertussis
caguacgucggacagggcc

SEQ ID NO: 323411 - RNA, 18 nt, Bordetella pertussis
caguacuuguugcgugcc

SEQ ID NO: 323412 - RNA, 20 nt, Bordetella pertussis
caguacuuguugcgugccgc

SEQ ID NO: 323413 - RNA, 15 nt, Bordetella pertussis
caguagcacacgccg

SEQ ID NO: 323414 - RNA, 20 nt, Bordetella pertussis
caguagcgccggcuugcgcc

SEQ ID NO: 323415 - RNA, 21 nt, Bordetella pertussis
caguagcgccggcuugcgcca

SEQ ID NO: 323416 - RNA, 21 nt, Bordetella pertussis
caguccaaggaaagcccggcc

SEQ ID NO: 323417 - RNA, 23 nt, Bordetella pertussis
caguccaccuugaguugcggguc

SEQ ID NO: 323418 - RNA, 18 nt, Bordetella pertussis
caguccagcgcgccgcga

SEQ ID NO: 323419 - RNA, 18 nt, Bordetella pertussis
caguccagcgucggcgua

SEQ ID NO: 323420 - RNA, 12 nt, Bordetella pertussis
cagucccaggcc

SEQ ID NO: 323421 - RNA, 13 nt, Bordetella pertussis
cagucccaguccg

SEQ ID NO: 323422 - RNA, 19 nt, Bordetella pertussis
cagucccaguccggcagca

SEQ ID NO: 323423 - RNA, 14 nt, Bordetella pertussis
caguccccgcaugg

SEQ ID NO: 323424 - RNA, 16 nt, Bordetella pertussis
caguccccgcaugggg

SEQ ID NO: 323425 - RNA, 22 nt, Bordetella pertussis
caguccccgcauggggacuggc

SEQ ID NO: 323426 - RNA, 21 nt, Bordetella pertussis
caguccccguucggggacagg

SEQ ID NO: 323427 - RNA, 16 nt, Bordetella pertussis
caguccccaugcggcc

SEQ ID NO: 323428 - RNA, 20 nt, Bordetella pertussis
caguccccugcggggacagg

SEQ ID NO: 323429 - RNA, 20 nt, Bordetella pertussis
cagucccgcaccgaccagcg

SEQ ID NO: 323430 - RNA, 14 nt, Bordetella pertussis
cagucccguggcgc

SEQ ID NO: 323431 - RNA, 14 nt, Bordetella pertussis
caguccgacgacaa

SEQ ID NO: 323432 - RNA, 14 nt, Bordetella pertussis
caguccgcagcgca

SEQ ID NO: 323433 - RNA, 20 nt, Bordetella pertussis
caguccgcagcgcagcgcca

SEQ ID NO: 323434 - RNA, 14 nt, Bordetella pertussis
caguccgcccagcc

SEQ ID NO: 323435 - RNA, 21 nt, Bordetella pertussis
caguccgcccagccaggcgcc

SEQ ID NO: 323436 - RNA, 16 nt, Bordetella pertussis
caguccggcagcaccc

SEQ ID NO: 323437 - RNA, 18 nt, Bordetella pertussis
cagucgcaguucggccuc

SEQ ID NO: 323438 - RNA, 13 nt, Bordetella pertussis
cagucgcgcagca

SEQ ID NO: 323439 - RNA, 13 nt, Bordetella pertussis
cagucgcgcagcc

SEQ ID NO: 323440 - RNA, 16 nt, Bordetella pertussis
cagucgcgcagccaca

SEQ ID NO: 323441 - RNA, 20 nt, Bordetella pertussis
cagucgcugcucgacagcag

SEQ ID NO: 323442 - RNA, 22 nt, Bordetella pertussis
cagugccugcgaacgcccggcc

SEQ ID NO: 323443 - RNA, 17 nt, Bordetella pertussis
cagugccuggacgcgcu

SEQ ID NO: 323444 - RNA, 19 nt, Bordetella pertussis
cagugccuggacgcgcugg

SEQ ID NO: 323445 - RNA, 23 nt, Bordetella pertussis
cagugccuggacgcgcuggccga

SEQ ID NO: 323446 - RNA, 15 nt, Bordetella pertussis
cagugcgacggaugg

SEQ ID NO: 323447 - RNA, 15 nt, Bordetella pertussis
cagugcgccggcgcg

SEQ ID NO: 323448 - RNA, 17 nt, Bordetella pertussis
cagugcgccggcgcggc

SEQ ID NO: 323449 - RNA, 20 nt, Bordetella pertussis
cagugcgccggcggcgguca

SEQ ID NO: 323450 - RNA, 16 nt, Bordetella pertussis
cagugcgccuggcuga

SEQ ID NO: 323451 - RNA, 21 nt, Bordetella pertussis
caguggcgagggucaggcgcg

SEQ ID NO: 323452 - RNA, 21 nt, Bordetella pertussis
cagugggccaguucgcggcgc

SEQ ID NO: 323453 - RNA, 15 nt, Bordetella pertussis
caguuccagcacgac

SEQ ID NO: 323454 - RNA, 13 nt, Bordetella pertussis
caguugcaggcca

SEQ ID NO: 323455 - RNA, 17 nt, Bordetella pertussis
caguugcgcgccgucgg

SEQ ID NO: 323456 - RNA, 20 nt, Bordetella pertussis
caguugcgcgccgucggcgu

SEQ ID NO: 323457 - RNA, 14 nt, Bordetella pertussis
caguugcgggcgca

SEQ ID NO: 323458 - RNA, 20 nt, Bordetella pertussis
caguugcggggcgcccagcg

SEQ ID NO: 323459 - RNA, 14 nt, Bordetella pertussis
caguugcuggccca

SEQ ID NO: 323460 - RNA, 21 nt, Bordetella pertussis
cauacaggcuguggccgcggc

SEQ ID NO: 323461 - RNA, 17 nt, Bordetella pertussis
cauacauccucgaugcc

SEQ ID NO: 323462 - RNA, 15 nt, Bordetella pertussis
cauaccagcccggcg

SEQ ID NO: 323463 - RNA, 23 nt, Bordetella pertussis
cauacccauggccaaugaccgac

SEQ ID NO: 323464 - RNA, 20 nt, Bordetella pertussis
cauaccgaucuacgacgccu

SEQ ID NO: 323465 - RNA, 13 nt, Bordetella pertussis
cauaccggccgcg

SEQ ID NO: 323466 - RNA, 20 nt, Bordetella pertussis
cauacucgaugcccagcacc

SEQ ID NO: 323467 - RNA, 22 nt, Bordetella pertussis
cauacucggaagacauggcgcg

SEQ ID NO: 323468 - RNA, 14 nt, Bordetella pertussis
cauacugcaugaug

SEQ ID NO: 323469 - RNA, 19 nt, Bordetella pertussis
cauagggcgacugcagcag

SEQ ID NO: 323470 - RNA, 13 nt, Bordetella pertussis
cauauccacgcca

SEQ ID NO: 323471 - RNA, 13 nt, Bordetella pertussis
cauauccaggcgg

SEQ ID NO: 323472 - RNA, 17 nt, Bordetella pertussis
cauaucgucgcugcggc

SEQ ID NO: 323473 - RNA, 13 nt, Bordetella pertussis
cauaugcgcgaag

SEQ ID NO: 323474 - RNA, 13 nt, Bordetella pertussis
caucacaucgcua

SEQ ID NO: 323475 - RNA, 20 nt, Bordetella pertussis
caucaccaagggcgccgggc

SEQ ID NO: 323476 - RNA, 19 nt, Bordetella pertussis
caucaccagcagguggcgc

SEQ ID NO: 323477 - RNA, 23 nt, Bordetella pertussis
caucaccaggguggcgggcgccu

SEQ ID NO: 323478 - RNA, 15 nt, Bordetella pertussis
caucaccagcucgcg

SEQ ID NO: 323479 - RNA, 14 nt, Bordetella pertussis
caucaccauggccg

SEQ ID NO: 323480 - RNA, 12 nt, Bordetella pertussis
caucaccgccuc

SEQ ID NO: 323481 - RNA, 22 nt, Bordetella pertussis
caucagggcgaucuugccggcc

SEQ ID NO: 323482 - RNA, 19 nt, Bordetella pertussis
caucagggcgaugccgcag

SEQ ID NO: 323483 - RNA, 15 nt, Bordetella pertussis
caucaggggcucggc

SEQ ID NO: 323484 - RNA, 19 nt, Bordetella pertussis
caucaggggcucggccagg

SEQ ID NO: 323485 - RNA, 20 nt, Bordetella pertussis
caucaggggcucggccaggu

SEQ ID NO: 323486 - RNA, 11 nt, Bordetella pertussis
caucaggucga

SEQ ID NO: 323487 - RNA, 19 nt, Bordetella pertussis
caucaggugggccgagccc

SEQ ID NO: 323488 - RNA, 13 nt, Bordetella pertussis
caucaucagcaug

SEQ ID NO: 323489 - RNA, 15 nt, Bordetella pertussis
caucaucaucgucgg

SEQ ID NO: 323490 - RNA, 15 nt, Bordetella pertussis
caucauccccagcgc

SEQ ID NO: 323491 - RNA, 19 nt, Bordetella pertussis
caucaucgccgacgcgccg

SEQ ID NO: 323492 - RNA, 21 nt, Bordetella pertussis
caucaucgcgcuggcgcgcga

SEQ ID NO: 323493 - RNA, 17 nt, Bordetella pertussis
caucaucgucggcgcca

SEQ ID NO: 323494 - RNA, 14 nt, Bordetella pertussis
caucauggccaggg

SEQ ID NO: 323495 - RNA, 17 nt, Bordetella pertussis
caucauggccagggccg

SEQ ID NO: 323496 - RNA, 17 nt, Bordetella pertussis
caucauggcgcgcgccg

SEQ ID NO: 323497 - RNA, 17 nt, Bordetella pertussis
caucauggcgucggcca

SEQ ID NO: 323498 - RNA, 22 nt, Bordetella pertussis
caucaugggcgaagccacggcc

SEQ ID NO: 323499 - RNA, 14 nt, Bordetella pertussis
cauccacggcgcca

SEQ ID NO: 323500 - RNA, 23 nt, Bordetella pertussis
caucccgacaugccgccccaggc

SEQ ID NO: 323501 - RNA, 18 nt, Bordetella pertussis
caucccgcccccgccgca

SEQ ID NO: 323502 - RNA, 19 nt, Bordetella pertussis
caucccuugagcguggcgu

SEQ ID NO: 323503 - RNA, 19 nt, Bordetella pertussis
cauccgcgccacacgggcg

SEQ ID NO: 323504 - RNA, 14 nt, Bordetella pertussis
cauccgcgccagga

SEQ ID NO: 323505 - RNA, 20 nt, Bordetella pertussis
cauccggugauuucggcgca

SEQ ID NO: 323506 - RNA, 15 nt, Bordetella pertussis
cauccguccgccagg

SEQ ID NO: 323507 - RNA, 20 nt, Bordetella pertussis
caucgggauccgugcggcgc

SEQ ID NO: 323508 - RNA, 22 nt, Bordetella pertussis
caucggggucgaucgcaucgcg

SEQ ID NO: 323509 - RNA, 20 nt, Bordetella pertussis
caucgggguuccacagcgcc

SEQ ID NO: 323510 - RNA, 15 nt, Bordetella pertussis
caucgggugcggcgc

SEQ ID NO: 323511 - RNA, 20 nt, Bordetella pertussis
caucggucaacgccugcggg

SEQ ID NO: 323512 - RNA, 16 nt, Bordetella pertussis
caucggugcggccggu

SEQ ID NO: 323513 - RNA, 19 nt, Bordetella pertussis
caucgucaggcaggcgcgc

SEQ ID NO: 323514 - RNA, 22 nt, Bordetella pertussis
caucgucaucaccaagggcgcc

SEQ ID NO: 323515 - RNA, 20 nt, Bordetella pertussis
caucgucgcgcugcgacagc

SEQ ID NO: 323516 - RNA, 14 nt, Bordetella pertussis
caucgucgcgcugg

SEQ ID NO: 323517 - RNA, 18 nt, Bordetella pertussis
caucgucguagcgccagc

SEQ ID NO: 323518 - RNA, 15 nt, Bordetella pertussis
caucuacagcgccug

SEQ ID NO: 323519 - RNA, 21 nt, Bordetella pertussis
caucuacgugcuggacccgcu

SEQ ID NO: 323520 - RNA, 15 nt, Bordetella pertussis
caucuaugucggcua

SEQ ID NO: 323521 - RNA, 19 nt, Bordetella pertussis
caucuccaggaugcgcgac

SEQ ID NO: 323522 - RNA, 15 nt, Bordetella pertussis
caucucgaugcgguc

SEQ ID NO: 323523 - RNA, 18 nt, Bordetella pertussis
caucucggcaucggccac

SEQ ID NO: 323524 - RNA, 15 nt, Bordetella pertussis
caucucggccgcggc

SEQ ID NO: 323525 - RNA, 21 nt, Bordetella pertussis
caucugcugcgagacgcgcuc

SEQ ID NO: 323526 - RNA, 16 nt, Bordetella pertussis
caucuggaccgcgcgc

SEQ ID NO: 323527 - RNA, 20 nt, Bordetella pertussis
caucuggaccgcgcgcgacg

SEQ ID NO: 323528 - RNA, 22 nt, Bordetella pertussis
caucuggaccgcgcgcgacgac

SEQ ID NO: 323529 - RNA, 14 nt, Bordetella pertussis
caucuggcgcaugg

SEQ ID NO: 323530 - RNA, 16 nt, Bordetella pertussis
caucuguacggccggc

SEQ ID NO: 323531 - RNA, 19 nt, Bordetella pertussis
caucuguucggcgccgggc

SEQ ID NO: 323532 - RNA, 16 nt, Bordetella pertussis
caucuugcaggcgcca

SEQ ID NO: 323533 - RNA, 15 nt, Bordetella pertussis
caucuuggugcgcgc

SEQ ID NO: 323534 - RNA, 20 nt, Bordetella pertussis
caucuuggugcgcgccaggu

SEQ ID NO: 323535 - RNA, 23 nt, Bordetella pertussis
caucuuggugcgcgccaggucgc

SEQ ID NO: 323536 - RNA, 17 nt, Bordetella pertussis
caucuugcgccgcugcg

SEQ ID NO: 323537 - RNA, 16 nt, Bordetella pertussis
caucuuguccuucagc

SEQ ID NO: 323538 - RNA, 22 nt, Bordetella pertussis
caugaaaugcuggucgcgcacc

SEQ ID NO: 323539 - RNA, 20 nt, Bordetella pertussis
caugaacacuugacggccaa

SEQ ID NO: 323540 - RNA, 20 nt, Bordetella pertussis
caugaacaggcacgacgcga

SEQ ID NO: 323541 - RNA, 17 nt, Bordetella pertussis
caugaaccgcagcgcca

SEQ ID NO: 323542 - RNA, 16 nt, Bordetella pertussis
caugaagcgcagcaga

SEQ ID NO: 323543 - RNA, 16 nt, Bordetella pertussis
caugaaggcggccagc

SEQ ID NO: 323544 - RNA, 21 nt, Bordetella pertussis
caugacaugcgggccucgacg

SEQ ID NO: 323545 - RNA, 14 nt, Bordetella pertussis
caugaccagcggcg

SEQ ID NO: 323546 - RNA, 15 nt, Bordetella pertussis
caugaccagcggcgu

SEQ ID NO: 323547 - RNA, 15 nt, Bordetella pertussis
caugaccaucgcgca

SEQ ID NO: 323548 - RNA, 16 nt, Bordetella pertussis
caugaccgccgccagc

SEQ ID NO: 323549 - RNA, 17 nt, Bordetella pertussis
caugaccgccgccagca

SEQ ID NO: 323550 - RNA, 16 nt, Bordetella pertussis
caugaccgccgcgccg

SEQ ID NO: 323551 - RNA, 19 nt, Bordetella pertussis
caugaccgccggcaccagc

SEQ ID NO: 323552 - RNA, 20 nt, Bordetella pertussis
caugaccgccggcaccagcg

SEQ ID NO: 323553 - RNA, 17 nt, Bordetella pertussis
caugaccgcggacgcca

SEQ ID NO: 323554 - RNA, 15 nt, Bordetella pertussis
caugaccgcguccgc

SEQ ID NO: 323555 - RNA, 16 nt, Bordetella pertussis
caugaccgcguccgcg

SEQ ID NO: 323556 - RNA, 17 nt, Bordetella pertussis
caugaccucggccugcg

SEQ ID NO: 323557 - RNA, 16 nt, Bordetella pertussis
caugaccugcgacagc

SEQ ID NO: 323558 - RNA, 17 nt, Bordetella pertussis
caugaccugcgacagca

SEQ ID NO: 323559 - RNA, 18 nt, Bordetella pertussis
caugaccugcgacagcac

SEQ ID NO: 323560 - RNA, 12 nt, Bordetella pertussis
caugacgaccgc

SEQ ID NO: 323561 - RNA, 15 nt, Bordetella pertussis
caugacgaccuugcg

SEQ ID NO: 323562 - RNA, 17 nt, Bordetella pertussis
caugacgaccuugcggc

SEQ ID NO: 323563 - RNA, 21 nt, Bordetella pertussis
caugacgaccuugcggccgcg

SEQ ID NO: 323564 - RNA, 20 nt, Bordetella pertussis
caugacgauggucuugccgc

SEQ ID NO: 323565 - RNA, 16 nt, Bordetella pertussis
caugacgggcggcggc

SEQ ID NO: 323566 - RNA, 23 nt, Bordetella pertussis
caugacgggcggcggcgcgcgcg

SEQ ID NO: 323567 - RNA, 19 nt, Bordetella pertussis
caugacggggucggggcag

SEQ ID NO: 323568 - RNA, 14 nt, Bordetella pertussis
caugacggugccga

SEQ ID NO: 323569 - RNA, 13 nt, Bordetella pertussis
caugacguccagc

SEQ ID NO: 323570 - RNA, 17 nt, Bordetella pertussis
caugacguccagcgcca

SEQ ID NO: 323571 - RNA, 18 nt, Bordetella pertussis
caugacguccagcgccac

SEQ ID NO: 323572 - RNA, 17 nt, Bordetella pertussis
caugacgaucacgggcu

SEQ ID NO: 323573 - RNA, 17 nt, Bordetella pertussis
caugacguucuccagcg

SEQ ID NO: 323574 - RNA, 15 nt, Bordetella pertussis
caugaucagggccgu

SEQ ID NO: 323575 - RNA, 15 nt, Bordetella pertussis
caugaucccgcgccu

SEQ ID NO: 323576 - RNA, 16 nt, Bordetella pertussis
caugaucccgcgccua

SEQ ID NO: 323577 - RNA, 21 nt, Bordetella pertussis
caugaugcgcugggccaggcc

SEQ ID NO: 323578 - RNA, 23 nt, Bordetella pertussis
caugaugcgcugggccaggccgg

SEQ ID NO: 323579 - RNA, 15 nt, Bordetella pertussis
caugaugcugccggg

SEQ ID NO: 323580 - RNA, 14 nt, Bordetella pertussis
caugcagccgccgc

SEQ ID NO: 323581 - RNA, 14 nt, Bordetella pertussis
caugcagaacaggg

SEQ ID NO: 323582 - RNA, 20 nt, Bordetella pertussis
caugcagcuggauggccugc

SEQ ID NO: 323583 - RNA, 18 nt, Bordetella pertussis
caugccaccacaaggaug

SEQ ID NO: 323584 - RNA, 17 nt, Bordetella pertussis
caugcccuccucggcca

SEQ ID NO: 323585 - RNA, 22 nt, Bordetella pertussis
caugcccuccucggccaggucg

SEQ ID NO: 323586 - RNA, 22 nt, Bordetella pertussis
caugccauggacgagggccggc

SEQ ID NO: 323587 - RNA, 22 nt, Bordetella pertussis
caugccgacggauucgcccagg

SEQ ID NO: 323588 - RNA, 17 nt, Bordetella pertussis
caugccgaucagcgggc

SEQ ID NO: 323589 - RNA, 17 nt, Bordetella pertussis
caugccgaugccgcagu

SEQ ID NO: 323590 - RNA, 15 nt, Bordetella pertussis
caugccgauggcggu

SEQ ID NO: 323591 - RNA, 23 nt, Bordetella pertussis
caugccguccacgcccagcgccg

SEQ ID NO: 323592 - RNA, 19 nt, Bordetella pertussis
caugccguccugcugcggc

SEQ ID NO: 323593 - RNA, 14 nt, Bordetella pertussis
caugccgucgagcg

SEQ ID NO: 323594 - RNA, 14 nt, Bordetella pertussis
caugccgucgcgca

SEQ ID NO: 323595 - RNA, 22 nt, Bordetella pertussis
caugccgucgcgcaccaccugg

SEQ ID NO: 323596 - RNA, 16 nt, Bordetella pertussis
caugccgucgcgcucg

SEQ ID NO: 323597 - RNA, 16 nt, Bordetella pertussis
caugccgucuggcggc

SEQ ID NO: 323598 - RNA, 12 nt, Bordetella pertussis
caugccgugcca

SEQ ID NO: 323599 - RNA, 14 nt, Bordetella pertussis
caugccuugcgcga

SEQ ID NO: 323600 - RNA, 19 nt, Bordetella pertussis
caugccuugcgcgacagca

SEQ ID NO: 323601 - RNA, 21 nt, Bordetella pertussis
caugcgaaaucuucugcgcca

SEQ ID NO: 323602 - RNA, 21 nt, Bordetella pertussis
caugcgaaugaucucgcgcuu

SEQ ID NO: 323603 - RNA, 23 nt, Bordetella pertussis
caugcgauacagcuuggcgcgcg

SEQ ID NO: 323604 - RNA, 13 nt, Bordetella pertussis
caugcgcaccagg

SEQ ID NO: 323605 - RNA, 20 nt, Bordetella pertussis
caugcgcaccuugucgcgca

SEQ ID NO: 323606 - RNA, 22 nt, Bordetella pertussis
caugcgcacggacagcccgcgc

SEQ ID NO: 323607 - RNA, 18 nt, Bordetella pertussis
caugcgcagcgcgucggc

SEQ ID NO: 323608 - RNA, 20 nt, Bordetella pertussis
caugcgcaucgcgaccgcca

SEQ ID NO: 323609 - RNA, 12 nt, Bordetella pertussis
caugcgcauggc

SEQ ID NO: 323610 - RNA, 17 nt, Bordetella pertussis
caugcgcauggccagca

SEQ ID NO: 323611 - RNA, 19 nt, Bordetella pertussis
caugcgcauggccagcaca

SEQ ID NO: 323612 - RNA, 14 nt, Bordetella pertussis
caugcgccagcagg

SEQ ID NO: 323613 - RNA, 18 nt, Bordetella pertussis
caugcgccagccagcgca

SEQ ID NO: 323614 - RNA, 15 nt, Bordetella pertussis
caugcgccagcgccu

SEQ ID NO: 323615 - RNA, 14 nt, Bordetella pertussis
caugcgcccggcca

SEQ ID NO: 323616 - RNA, 16 nt, Bordetella pertussis
caugcgcccggccacc

SEQ ID NO: 323617 - RNA, 19 nt, Bordetella pertussis
caugcgccgcaccagcggc

SEQ ID NO: 323618 - RNA, 16 nt, Bordetella pertussis
caugcgccggcccggc

SEQ ID NO: 323619 - RNA, 21 nt, Bordetella pertussis
caugcgccugucccaggcgcu

SEQ ID NO: 323620 - RNA, 11 nt, Bordetella pertussis
caugcgcgaac

SEQ ID NO: 323621 - RNA, 18 nt, Bordetella pertussis
caugcgcgaacgcgcgcc

SEQ ID NO: 323622 - RNA, 22 nt, Bordetella pertussis
caugcgcgaacgcgcgccggcc

SEQ ID NO: 323623 - RNA, 18 nt, Bordetella pertussis
caugcgcgaucucguggc

SEQ ID NO: 323624 - RNA, 22 nt, Bordetella pertussis
caugcgcgcggcucgccgcgca

SEQ ID NO: 323625 - RNA, 19 nt, Bordetella pertussis
caugcgcgucuccagcgcc

SEQ ID NO: 323626 - RNA, 20 nt, Bordetella pertussis
caugcgcgucuccagcgccg

SEQ ID NO: 323627 - RNA, 21 nt, Bordetella pertussis
caugcgcgucuccagcgccgg

SEQ ID NO: 323628 - RNA, 15 nt, Bordetella pertussis
caugcuggcccagcu

SEQ ID NO: 323629 - RNA, 22 nt, Bordetella pertussis
caugcuggcccagcugggcggc

SEQ ID NO: 323630 - RNA, 12 nt, Bordetella pertussis
caugcuggccgc

SEQ ID NO: 323631 - RNA, 22 nt, Bordetella pertussis
caugcuggucaucuacagcgcc

SEQ ID NO: 323632 - RNA, 21 nt, Bordetella pertussis
cauggaaccgguuggccagcu

SEQ ID NO: 323633 - RNA, 19 nt, Bordetella pertussis
cauggaccggcguccauga

SEQ ID NO: 323634 - RNA, 17 nt, Bordetella pertussis
cauggacgagggccggc

SEQ ID NO: 323635 - RNA, 22 nt, Bordetella pertussis
cauggacagcaccgacaggccg

SEQ ID NO: 323636 - RNA, 16 nt, Bordetella pertussis
cauggacugcaggcgc

SEQ ID NO: 323637 - RNA, 17 nt, Bordetella pertussis
cauggacugcaggcgcu

SEQ ID NO: 323638 - RNA, 15 nt, Bordetella pertussis
cauggagaccggcgc

SEQ ID NO: 323639 - RNA, 19 nt, Bordetella pertussis
cauggaggcgcagcgcggc

SEQ ID NO: 323640 - RNA, 16 nt, Bordetella pertussis
cauggaggggcgcagg

SEQ ID NO: 323641 - RNA, 15 nt, Bordetella pertussis
cauggcacagcgcgg

SEQ ID NO: 323642 - RNA, 23 nt, Bordetella pertussis
cauggcacagcgcggcgaaggcg

SEQ ID NO: 323643 - RNA, 20 nt, Bordetella pertussis
cauggcagcagaucggcggc

SEQ ID NO: 323644 - RNA, 23 nt, Bordetella pertussis
cauggccaccagguagggcagca

SEQ ID NO: 323645 - RNA, 12 nt, Bordetella pertussis
cauggccagccg

SEQ ID NO: 323646 - RNA, 14 nt, Bordetella pertussis
cauggccagccgcu

SEQ ID NO: 323647 - RNA, 19 nt, Bordetella pertussis
cauggccagguacaggccg

SEQ ID NO: 323648 - RNA, 20 nt, Bordetella pertussis
cauggccagguacaggccgc

SEQ ID NO: 323649 - RNA, 17 nt, Bordetella pertussis
cauggccgacagcgucg

SEQ ID NO: 323650 - RNA, 14 nt, Bordetella pertussis
cauggccgcgccca

SEQ ID NO: 323651 - RNA, 16 nt, Bordetella pertussis
cauggccgcgcccagc

SEQ ID NO: 323652 - RNA, 17 nt, Bordetella pertussis
cauggccgcgcccagcg

SEQ ID NO: 323653 - RNA, 21 nt, Bordetella pertussis
cauggccgcgcccagcgcggc

SEQ ID NO: 323654 - RNA, 16 nt, Bordetella pertussis
cauggccgcgcggcgc

SEQ ID NO: 323655 - RNA, 17 nt, Bordetella pertussis
cauggccggcaggucga

SEQ ID NO: 323656 - RNA, 14 nt, Bordetella pertussis
cauggccggccgcc

SEQ ID NO: 323657 - RNA, 16 nt, Bordetella pertussis
cauggccggccgccgg

SEQ ID NO: 323658 - RNA, 18 nt, Bordetella pertussis
cauggccggccgccgggc

SEQ ID NO: 323659 - RNA, 21 nt, Bordetella pertussis
cauggccggccgccgggccgc

SEQ ID NO: 323660 - RNA, 16 nt, Bordetella pertussis
cauggcgcccacggcc

SEQ ID NO: 323661 - RNA, 17 nt, Bordetella pertussis
cauggcgcccacggccg

SEQ ID NO: 323662 - RNA, 18 nt, Bordetella pertussis
cauggcgcccacggccgc

SEQ ID NO: 323663 - RNA, 19 nt, Bordetella pertussis
cauggcgccgcgcgccgcg

SEQ ID NO: 323664 - RNA, 14 nt, Bordetella pertussis
cauggcgcgcagca

SEQ ID NO: 323665 - RNA, 14 nt, Bordetella pertussis
cauggcgcgccggc

SEQ ID NO: 323666 - RNA, 16 nt, Bordetella pertussis
cauggcgcgccggccg

SEQ ID NO: 323667 - RNA, 16 nt, Bordetella pertussis
cauggcgcgcgccagc

SEQ ID NO: 323668 - RNA, 17 nt, Bordetella pertussis
cauggcgcgcgccagcg

SEQ ID NO: 323669 - RNA, 15 nt, Bordetella pertussis
cauggcgcgcgccgc

SEQ ID NO: 323670 - RNA, 19 nt, Bordetella pertussis
cauggcgcgugcgcgcgcc

SEQ ID NO: 323671 - RNA, 20 nt, Bordetella pertussis
cauggcgcgugcgcgcgcca

SEQ ID NO: 323672 - RNA, 21 nt, Bordetella pertussis
cauggcgcgugcgcgcgccau

SEQ ID NO: 323673 - RNA, 11 nt, Bordetella pertussis
cauggcgcugg

SEQ ID NO: 323674 - RNA, 16 nt, Bordetella pertussis
cauggcgcuggcaggc

SEQ ID NO: 323675 - RNA, 18 nt, Bordetella pertussis
cauggcgcuggcaggcgc

SEQ ID NO: 323676 - RNA, 16 nt, Bordetella pertussis
cauggcggcaggcgcg

SEQ ID NO: 323677 - RNA, 13 nt, Bordetella pertussis
cauggcggccagc

SEQ ID NO: 323678 - RNA, 19 nt, Bordetella pertussis
cauggcggccagcuugacc

SEQ ID NO: 323679 - RNA, 14 nt, Bordetella pertussis
cauggcggccaggc

SEQ ID NO: 323680 - RNA, 21 nt, Bordetella pertussis
cauggcggcccuguucgcgcg

SEQ ID NO: 323681 - RNA, 14 nt, Bordetella pertussis
cauggcggccgccg

SEQ ID NO: 323682 - RNA, 15 nt, Bordetella pertussis
cauggcggccgccgc

SEQ ID NO: 323683 - RNA, 19 nt, Bordetella pertussis
cauggcggccgccgccagc

SEQ ID NO: 323684 - RNA, 13 nt, Bordetella pertussis
cauggcggccggc

SEQ ID NO: 323685 - RNA, 13 nt, Bordetella pertussis
cauggcggcgccc

SEQ ID NO: 323686 - RNA, 22 nt, Bordetella pertussis
cauggcgggcgagaucagccac

SEQ ID NO: 323687 - RNA, 19 nt, Bordetella pertussis
cauggcggucuccgguucg

SEQ ID NO: 323688 - RNA, 21 nt, Bordetella pertussis
cauggcggugaaggcgcccgg

SEQ ID NO: 323689 - RNA, 22 nt, Bordetella pertussis
cauggcggugaaggcgcccggg

SEQ ID NO: 323690 - RNA, 18 nt, Bordetella pertussis
cauggcgguggccagcgc

SEQ ID NO: 323691 - RNA, 15 nt, Bordetella pertussis
cauggcguaggccuc

SEQ ID NO: 323692 - RNA, 22 nt, Bordetella pertussis
cauggcgucaagccagcggcgc

SEQ ID NO: 323693 - RNA, 20 nt, Bordetella pertussis
cauggcgucgaaacgcugcg

SEQ ID NO: 323694 - RNA, 16 nt, Bordetella pertussis
cauggcgucggccacg

SEQ ID NO: 323695 - RNA, 16 nt, Bordetella pertussis
cauggcgucguccagc

SEQ ID NO: 323696 - RNA, 18 nt, Bordetella pertussis
cauggcgucugcccgugc

SEQ ID NO: 323697 - RNA, 17 nt, Bordetella pertussis
caugguagcgguccagc

SEQ ID NO: 323698 - RNA, 15 nt, Bordetella pertussis
cauggucgaccagca

SEQ ID NO: 323699 - RNA, 14 nt, Bordetella pertussis
cauggucgcccagc

SEQ ID NO: 323700 - RNA, 15 nt, Bordetella pertussis
cauggucgcgaccac

SEQ ID NO: 323701 - RNA, 20 nt, Bordetella pertussis
cauggucgcgaccaccguga

SEQ ID NO: 323702 - RNA, 15 nt, Bordetella pertussis
cauggucggcauggc

SEQ ID NO: 323703 - RNA, 16 nt, Bordetella pertussis
cauggucucguccacc

SEQ ID NO: 323704 - RNA, 22 nt, Bordetella pertussis
cauggugaccggggcguccacc

SEQ ID NO: 323705 - RNA, 18 nt, Bordetella pertussis
cauggugccgcgcaggcc

SEQ ID NO: 323706 - RNA, 19 nt, Bordetella pertussis
cauggugccgcgcaggccc

SEQ ID NO: 323707 - RNA, 20 nt, Bordetella pertussis
cauggugccgcgcaggcccu

SEQ ID NO: 323708 - RNA, 21 nt, Bordetella pertussis
cauguagucgucgcuggccca

SEQ ID NO: 323709 - RNA, 17 nt, Bordetella pertussis
cauguauaacguggcgc

SEQ ID NO: 323710 - RNA, 14 nt, Bordetella pertussis
cauguccaccagcc

SEQ ID NO: 323711 - RNA, 16 nt, Bordetella pertussis
cauguccaccagccgg

SEQ ID NO: 323712 - RNA, 23 nt, Bordetella pertussis
cauguccagacccgaaucucccg

SEQ ID NO: 323713 - RNA, 16 nt, Bordetella pertussis
cauguccagcgccagg

SEQ ID NO: 323714 - RNA, 18 nt, Bordetella pertussis
cauguccagcgccaggcc

SEQ ID NO: 323715 - RNA, 21 nt, Bordetella pertussis
cauguccagcgccaggccgcg

SEQ ID NO: 323716 - RNA, 14 nt, Bordetella pertussis
cauguccgagucga

SEQ ID NO: 323717 - RNA, 16 nt, Bordetella pertussis
cauguccugcaggucc

SEQ ID NO: 323718 - RNA, 22 nt, Bordetella pertussis
caugucgaagcaggcgguacag

SEQ ID NO: 323719 - RNA, 22 nt, Bordetella pertussis
cauucgguggucugccagucca

SEQ ID NO: 323720 - RNA, 23 nt, Bordetella pertussis
cauucguccagguugucggccau

SEQ ID NO: 323721 - RNA, 20 nt, Bordetella pertussis
cauucucgcccugcuggcgc

SEQ ID NO: 323722 - RNA, 21 nt, Bordetella pertussis
cauucuucgccgaugcgcucg

SEQ ID NO: 323723 - RNA, 17 nt, Bordetella pertussis
cauugaagcuggcgccg

SEQ ID NO: 323724 - RNA, 19 nt, Bordetella pertussis
cauugcagggugucggcca

SEQ ID NO: 323725 - RNA, 20 nt, Bordetella pertussis
cauugccacggcgggccggc

SEQ ID NO: 323726 - RNA, 12 nt, Bordetella pertussis
cauugcccagca

SEQ ID NO: 323727 - RNA, 12 nt, Bordetella pertussis
cauugcccaggu

SEQ ID NO: 323728 - RNA, 18 nt, Bordetella pertussis
cauugccggagcagcagc

SEQ ID NO: 323729 - RNA, 13 nt, Bordetella pertussis
cauugccguacgc

SEQ ID NO: 323730 - RNA, 15 nt, Bordetella pertussis
cauugcgccagccgu

SEQ ID NO: 323731 - RNA, 20 nt, Bordetella pertussis
cauugcgccagccguugcgc

SEQ ID NO: 323732 - RNA, 15 nt, Bordetella pertussis
cauuggcccugcugg

SEQ ID NO: 323733 - RNA, 17 nt, Bordetella pertussis
cauuggccgccgccacc

SEQ ID NO: 323734 - RNA, 13 nt, Bordetella pertussis
cauuggcgccgcg

SEQ ID NO: 323735 - RNA, 14 nt, Bordetella pertussis
cauuggcgccgcgc

SEQ ID NO: 323736 - RNA, 13 nt, Bordetella pertussis
cauuggcgcgcuu

SEQ ID NO: 323737 - RNA, 13 nt, Bordetella pertussis
cauuggcggcggc

SEQ ID NO: 323738 - RNA, 17 nt, Bordetella pertussis
cauugggacgcggccuu

SEQ ID NO: 323739 - RNA, 19 nt, Bordetella pertussis
cauugucaagcagcgccgg

SEQ ID NO: 323740 - RNA, 19 nt, Bordetella pertussis
cauuugcgaggugcccgcg

SEQ ID NO: 323741 - RNA, 18 nt, Bordetella pertussis
cauuugcggaugcccggg

SEQ ID NO: 323742 - RNA, 22 nt, Bordetella pertussis
ccaacccggcgaggccgcccgc

SEQ ID NO: 323743 - RNA, 16 nt, Bordetella pertussis
ccaacccucgcacggc

SEQ ID NO: 323744 - RNA, 18 nt, Bordetella pertussis
ccaaccugguauccggcg

SEQ ID NO: 323745 - RNA, 22 nt, Bordetella pertussis
ccaaccugguauccggcgcacg

SEQ ID NO: 323746 - RNA, 23 nt, Bordetella pertussis
ccaaccugguauccggcgcacgc

SEQ ID NO: 323747 - RNA, 21 nt, Bordetella pertussis
ccaacgacuucaccgugaugg

SEQ ID NO: 323748 - RNA, 20 nt, Bordetella pertussis
ccaacgcacaagggccccgc

SEQ ID NO: 323749 - RNA, 17 nt, Bordetella pertussis
ccaacgccaagcugcug

SEQ ID NO: 323750 - RNA, 18 nt, Bordetella pertussis
ccaacgccaagcugcugg

SEQ ID NO: 323751 - RNA, 14 nt, Bordetella pertussis
ccaacgcggcgcgu

SEQ ID NO: 323752 - RNA, 19 nt, Bordetella pertussis
ccaacgcggcgucgacgcc

SEQ ID NO: 323753 - RNA, 14 nt, Bordetella pertussis
ccaacggcgcaccg

SEQ ID NO: 323754 - RNA, 20 nt, Bordetella pertussis
ccaacggggacgggcgcccg

SEQ ID NO: 323755 - RNA, 15 nt, Bordetella pertussis
ccaacggggccgcca

SEQ ID NO: 323756 - RNA, 23 nt, Bordetella pertussis
ccaacggggccgccaacgccaag

SEQ ID NO: 323757 - RNA, 20 nt, Bordetella pertussis
ccaacucgaggcggcgcagg

SEQ ID NO: 323758 - RNA, 17 nt, Bordetella pertussis
ccaagaccgcggccgcg

SEQ ID NO: 323759 - RNA, 19 nt, Bordetella pertussis
ccaagacgcggggacaggc

SEQ ID NO: 323760 - RNA, 19 nt, Bordetella pertussis
ccaagcagacccgcgccca

SEQ ID NO: 323761 - RNA, 14 nt, Bordetella pertussis
ccaagcgccacagc

SEQ ID NO: 323762 - RNA, 19 nt, Bordetella pertussis
ccaagcgccacagcgccau

SEQ ID NO: 323763 - RNA, 12 nt, Bordetella pertussis
ccaagcgcgccg

SEQ ID NO: 323764 - RNA, 17 nt, Bordetella pertussis
ccaagcgcacgcgcagc

SEQ ID NO: 323765 - RNA, 18 nt, Bordetella pertussis
ccaagcgcacgcgcagca

SEQ ID NO: 323766 - RNA, 15 nt, Bordetella pertussis
ccaagcgcguggcca

SEQ ID NO: 323767 - RNA, 22 nt, Bordetella pertussis
ccaagucgaguucggcgcgccc

SEQ ID NO: 323768 - RNA, 19 nt, Bordetella pertussis
ccaauacaggaagcgcugg

SEQ ID NO: 323769 - RNA, 22 nt, Bordetella pertussis
ccaauaccugaucucgcgcacc

SEQ ID NO: 323770 - RNA, 23 nt, Bordetella pertussis
ccacacgaggaccgcgaugcugc

SEQ ID NO: 323771 - RNA, 15 nt, Bordetella pertussis
ccacacgaucagcgc

SEQ ID NO: 323772 - RNA, 20 nt, Bordetella pertussis
ccacacgcgguagguagcgc

SEQ ID NO: 323773 - RNA, 14 nt, Bordetella pertussis
ccacauagcggccg

SEQ ID NO: 323774 - RNA, 16 nt, Bordetella pertussis
ccacauagcggccggc

SEQ ID NO: 323775 - RNA, 20 nt, Bordetella pertussis
ccacauagcggccggcgcgc

SEQ ID NO: 323776 - RNA, 13 nt, Bordetella pertussis
ccacaucgaaggc

SEQ ID NO: 323777 - RNA, 13 nt, Bordetella pertussis
ccacaucgucgcg

SEQ ID NO: 323778 - RNA, 12 nt, Bordetella pertussis
ccacauggcggc

SEQ ID NO: 323779 - RNA, 17 nt, Bordetella pertussis
ccacauggggacuggca

SEQ ID NO: 323780 - RNA, 18 nt, Bordetella pertussis
ccacauggggacuggcac

SEQ ID NO: 323781 - RNA, 22 nt, Bordetella pertussis
ccacauggggacuggcacccgc

SEQ ID NO: 323782 - RNA, 17 nt, Bordetella pertussis
ccacauggucgcccagc

SEQ ID NO: 323783 - RNA, 14 nt, Bordetella pertussis
ccaccaacgaaggc

SEQ ID NO: 323784 - RNA, 21 nt, Bordetella pertussis
ccaccacgucgcggcugggca

SEQ ID NO: 323785 - RNA, 19 nt, Bordetella pertussis
ccaccacugcaaggcccgc

SEQ ID NO: 323786 - RNA, 23 nt, Bordetella pertussis
ccaccagaucgauaccgucgcgc

SEQ ID NO: 323787 - RNA, 18 nt, Bordetella pertussis
ccaccagcaccgaugcgc

SEQ ID NO: 323788 - RNA, 14 nt, Bordetella pertussis
ccaccagccgcccg

SEQ ID NO: 323789 - RNA, 13 nt, Bordetella pertussis
ccaccaggcccag

SEQ ID NO: 323790 - RNA, 14 nt, Bordetella pertussis
ccaccaggcccagg

SEQ ID NO: 323791 - RNA, 14 nt, Bordetella pertussis
ccaccaggccgccu

SEQ ID NO: 323792 - RNA, 15 nt, Bordetella pertussis
ccaccagccggccgc

SEQ ID NO: 323793 - RNA, 12 nt, Bordetella pertussis
ccaccaggccgg

SEQ ID NO: 323794 - RNA, 21 nt, Bordetella pertussis
ccaccaggccggccagggcca

SEQ ID NO: 323795 - RNA, 13 nt, Bordetella pertussis
ccaccaggcgcgc

SEQ ID NO: 323796 - RNA, 14 nt, Bordetella pertussis
ccaccaggcgcgcg

SEQ ID NO: 323797 - RNA, 15 nt, Bordetella pertussis
ccaccagggcccgga

SEQ ID NO: 323798 - RNA, 16 nt, Bordetella pertussis
ccaccagggcgcccgc

SEQ ID NO: 323799 - RNA, 14 nt, Bordetella pertussis
ccaccaggccgucg

SEQ ID NO: 323800 - RNA, 12 nt, Bordetella pertussis
ccaccagggugc

SEQ ID NO: 323801 - RNA, 23 nt, Bordetella pertussis
ccaccagggugccgccuucgccg

SEQ ID NO: 323802 - RNA, 20 nt, Bordetella pertussis
ccaccaggucguacagcgcc

SEQ ID NO: 323803 - RNA, 23 nt, Bordetella pertussis
ccaccaggucguacagcgccugc

SEQ ID NO: 323804 - RNA, 20 nt, Bordetella pertussis
ccaccaggguuuccucgccg

SEQ ID NO: 323805 - RNA, 16 nt, Bordetella pertussis
ccaccagugcgccggc

SEQ ID NO: 323806 - RNA, 19 nt, Bordetella pertussis
ccaccagugcgccggcggc

SEQ ID NO: 323807 - RNA, 14 nt, Bordetella pertussis
ccaccaugucccug

SEQ ID NO: 323808 - RNA, 19 nt, Bordetella pertussis
ccaccgucucgaacgccgc

SEQ ID NO: 323809 - RNA, 16 nt, Bordetella pertussis
ccaccgucuggcguac

SEQ ID NO: 323810 - RNA, 18 nt, Bordetella pertussis
ccaccgucuugcccgcca

SEQ ID NO: 323811 - RNA, 18 nt, Bordetella pertussis
ccaccguggccacggccg

SEQ ID NO: 323812 - RNA, 23 nt, Bordetella pertussis
ccaccguggccacggccgcgauc

SEQ ID NO: 323813 - RNA, 21 nt, Bordetella pertussis
ccaccuccaccgccagcccgg

SEQ ID NO: 323814 - RNA, 18 nt, Bordetella pertussis
ccaccucuucagcccggc

SEQ ID NO: 323815 - RNA, 16 nt, Bordetella pertussis
ccaccugcaccgccgc

SEQ ID NO: 323816 - RNA, 24 nt, Bordetella pertussis
ccaccugcucggugagcggcacga

SEQ ID NO: 323817 - RNA, 15 nt, Bordetella pertussis
ccaccuggcgcccgg

SEQ ID NO: 323818 - RNA, 16 nt, Bordetella pertussis
ccaccuggcgcccggc

SEQ ID NO: 323819 - RNA, 19 nt, Bordetella pertussis
ccaccuggcggugcgccgc

SEQ ID NO: 323820 - RNA, 20 nt, Bordetella pertussis
ccaccuggcggugcgccgca

SEQ ID NO: 323821 - RNA, 16 nt, Bordetella pertussis
ccaccuggcagccgau

SEQ ID NO: 323822 - RNA, 14 nt, Bordetella pertussis
ccaccuucgccgcg

SEQ ID NO: 323823 - RNA, 15 nt, Bordetella pertussis
ccaccuucgccgcgc

SEQ ID NO: 323824 - RNA, 16 nt, Bordetella pertussis
ccaccuucgccgcgca

SEQ ID NO: 323825 - RNA, 17 nt, Bordetella pertussis
ccaccuucgccgcgcac

SEQ ID NO: 323826 - RNA, 21 nt, Bordetella pertussis
ccaccuugacgcgcaggccau

SEQ ID NO: 323827 - RNA, 15 nt, Bordetella pertussis
ccaccuugcgcgcga

SEQ ID NO: 323828 - RNA, 14 nt, Bordetella pertussis
ccacgaacgccacg

SEQ ID NO: 323829 - RNA, 20 nt, Bordetella pertussis
ccacgaacgccacgcccguc

SEQ ID NO: 323830 - RNA, 22 nt, Bordetella pertussis
ccacgaacgcgauuuccuugcg

SEQ ID NO: 323831 - RNA, 15 nt, Bordetella pertussis
ccacgaagcgcagca

SEQ ID NO: 323832 - RNA, 13 nt, Bordetella pertussis
ccacgaaggcagc

SEQ ID NO: 323833 - RNA, 21 nt, Bordetella pertussis
ccacgaaggcgaucugcggcg

SEQ ID NO: 323834 - RNA, 14 nt, Bordetella pertussis
ccacgaaggcgccg

SEQ ID NO: 323835 - RNA, 17 nt, Bordetella pertussis
ccacgaauuccucgccg

SEQ ID NO: 323836 - RNA, 12 nt, Bordetella pertussis
ccacgaccacca

SEQ ID NO: 323837 - RNA, 14 nt, Bordetella pertussis
ccacgaccggcucg

SEQ ID NO: 323838 - RNA, 18 nt, Bordetella pertussis
ccacgaccuuggcggccg

SEQ ID NO: 323839 - RNA, 16 nt, Bordetella pertussis
ccacgacggucugggc

SEQ ID NO: 323840 - RNA, 20 nt, Bordetella pertussis
ccacgacguagucggcgccc

SEQ ID NO: 323841 - RNA, 20 nt, Bordetella pertussis
ccacgagcaguacacgcgca

SEQ ID NO: 323842 - RNA, 18 nt, Bordetella pertussis
ccacgagcugcagcccgg

SEQ ID NO: 323843 - RNA, 19 nt, Bordetella pertussis
ccacgagcugcagcccggc

SEQ ID NO: 323844 - RNA, 19 nt, Bordetella pertussis
ccacgaucaccacgcccgc

SEQ ID NO: 323845 - RNA, 18 nt, Bordetella pertussis
ccacgaucaucaggauga

SEQ ID NO: 323846 - RNA, 23 nt, Bordetella pertussis
ccacgaugcgggcaucgcccugc

SEQ ID NO: 323847 - RNA, 14 nt, Bordetella pertussis
ccacgauggccggc

SEQ ID NO: 323848 - RNA, 15 nt, Bordetella pertussis
ccacgauggccggcg

SEQ ID NO: 323849 - RNA, 18 nt, Bordetella pertussis
ccacgauggccggcgcga

SEQ ID NO: 323850 - RNA, 22 nt, Bordetella pertussis
ccacgauggcgcaauaggccgc

SEQ ID NO: 323851 - RNA, 24 nt, Bordetella pertussis
ccacgaugucguacacaugcuugc

SEQ ID NO: 323852 - RNA, 17 nt, Bordetella pertussis
ccacgauguugcgcagg

SEQ ID NO: 323853 - RNA, 20 nt, Bordetella pertussis
ccacgcacaugaugcccagc

SEQ ID NO: 323854 - RNA, 22 nt, Bordetella pertussis
ccacgcagaaauggaugcgcgc

SEQ ID NO: 323855 - RNA, 20 nt, Bordetella pertussis
ccacgcagaaggcgaacugg

SEQ ID NO: 323856 - RNA, 16 nt, Bordetella pertussis
ccacgcaggcgggcgc

SEQ ID NO: 323857 - RNA, 19 nt, Bordetella pertussis
ccacgcaggcgggcgccgc

SEQ ID NO: 323858 - RNA, 20 nt, Bordetella pertussis
ccacgcaggcgggcgccgcg

SEQ ID NO: 323859 - RNA, 17 nt, Bordetella pertussis
ccacgccagcggcgagc

SEQ ID NO: 323860 - RNA, 17 nt, Bordetella pertussis
ccacgccauggacgccg

SEQ ID NO: 323861 - RNA, 16 nt, Bordetella pertussis
ccacgcccagcgccgg

SEQ ID NO: 323862 - RNA, 19 nt, Bordetella pertussis
ccacgcccagcgccggcac

SEQ ID NO: 323863 - RNA, 16 nt, Bordetella pertussis
ccacgcccaggccgcu

SEQ ID NO: 323864 - RNA, 17 nt, Bordetella pertussis
ccacgcccaggccgugg

SEQ ID NO: 323865 - RNA, 16 nt, Bordetella pertussis
ccacgcccacgcgccg

SEQ ID NO: 323866 - RNA, 17 nt, Bordetella pertussis
ccacgcccacgcgccgc

SEQ ID NO: 323867 - RNA, 14 nt, Bordetella pertussis
ccacgcccgcgccg

SEQ ID NO: 323868 - RNA, 15 nt, Bordetella pertussis
ccacgcccgcgccga

SEQ ID NO: 323869 - RNA, 23 nt, Bordetella pertussis
ccacgcccggugccugccccugc

SEQ ID NO: 323870 - RNA, 21 nt, Bordetella pertussis
ccacgcccgucucgcgcgcca

SEQ ID NO: 323871 - RNA, 23 nt, Bordetella pertussis
ccacgcccgucucgcgcgccagg

SEQ ID NO: 323872 - RNA, 20 nt, Bordetella pertussis
ccacgcccuggcuggcggcc

SEQ ID NO: 323873 - RNA, 13 nt, Bordetella pertussis
ccacgccgcccag

SEQ ID NO: 323874 - RNA, 14 nt, Bordetella pertussis
ccacgccgcccagc

SEQ ID NO: 323875 - RNA, 20 nt, Bordetella pertussis
ccacgccgcccagcgcgugg

SEQ ID NO: 323876 - RNA, 15 nt, Bordetella pertussis
ccacgccgccggcca

SEQ ID NO: 323877 - RNA, 13 nt, Bordetella pertussis
ccacgccgccgua

SEQ ID NO: 323878 - RNA, 18 nt, Bordetella pertussis
ccacgccgcgcgcgucgc

SEQ ID NO: 323879 - RNA, 14 nt, Bordetella pertussis
ccacgccgccuggc

SEQ ID NO: 323880 - RNA, 12 nt, Bordetella pertussis
ccacgccgcuga

SEQ ID NO: 323881 - RNA, 13 nt, Bordetella pertussis
ccacgccggccac

SEQ ID NO: 323882 - RNA, 14 nt, Bordetella pertussis
ccacgccggccagc

SEQ ID NO: 323883 - RNA, 12 nt, Bordetella pertussis
ccacgccggccg

SEQ ID NO: 323884 - RNA, 13 nt, Bordetella pertussis
ccacgccggccgc

SEQ ID NO: 323885 - RNA, 14 nt, Bordetella pertussis
ccacgccggccggg

SEQ ID NO: 323886 - RNA, 14 nt, Bordetella pertussis
ccacgccggcgcgc

SEQ ID NO: 323887 - RNA, 18 nt, Bordetella pertussis
ccacgccggcgcgccggc

SEQ ID NO: 323888 - RNA, 13 nt, Bordetella pertussis
ccacgccggcggu

SEQ ID NO: 323889 - RNA, 16 nt, Bordetella pertussis
ccacgccuuccggccc

SEQ ID NO: 323890 - RNA, 23 nt, Bordetella pertussis
ccacgccuucgagcaccaugccg

SEQ ID NO: 323891 - RNA, 17 nt, Bordetella pertussis
ccacgccuucggcgcgc

SEQ ID NO: 323892 - RNA, 23 nt, Bordetella pertussis
ccacgccuucggcgcgcgccggc

SEQ ID NO: 323893 - RNA, 18 nt, Bordetella pertussis
ccacgcgagcccgcguca

SEQ ID NO: 323894 - RNA, 21 nt, Bordetella pertussis
ccacgcgcgauccgcgccagg

SEQ ID NO: 323895 - RNA, 22 nt, Bordetella pertussis
ccacgcgcgauccgcgccaggc

SEQ ID NO: 323896 - RNA, 18 nt, Bordetella pertussis
ccacgcgcgcgccgccgg

SEQ ID NO: 323897 - RNA, 19 nt, Bordetella pertussis
ccacgcgcgcgccgccggc

SEQ ID NO: 323898 - RNA, 13 nt, Bordetella pertussis
ccacgcgcuccug

SEQ ID NO: 323899 - RNA, 17 nt, Bordetella pertussis
ccacgcgcugcagcagc

SEQ ID NO: 323900 - RNA, 15 nt, Bordetella pertussis
ccacgcgcugcgcgc

SEQ ID NO: 323901 - RNA, 11 nt, Bordetella pertussis
ccacgcgcugu

SEQ ID NO: 323902 - RNA, 20 nt, Bordetella pertussis
ccacgcgcuguugcuggcca

SEQ ID NO: 323903 - RNA, 18 nt, Bordetella pertussis
ccacgcgcuugcgcgcca

SEQ ID NO: 323904 - RNA, 20 nt, Bordetella pertussis
ccacgcgcuugcgcgccacg

SEQ ID NO: 323905 - RNA, 16 nt, Bordetella pertussis
ccacgcgccgccaggc

SEQ ID NO: 323906 - RNA, 18 nt, Bordetella pertussis
ccacgcgccgccaggcgc

SEQ ID NO: 323907 - RNA, 17 nt, Bordetella pertussis
ccacgcggcgcugcugg

SEQ ID NO: 323908 - RNA, 21 nt, Bordetella pertussis
ccacgcggcgcugcuggccgg

SEQ ID NO: 323909 - RNA, 17 nt, Bordetella pertussis
ccacgcgguccagcccc

SEQ ID NO: 323910 - RNA, 13 nt, Bordetella pertussis
ccacgcguccccg

SEQ ID NO: 323911 - RNA, 17 nt, Bordetella pertussis
ccacggcgccaugccgg

SEQ ID NO: 323912 - RNA, 12 nt, Bordetella pertussis
ccacggcgcccg

SEQ ID NO: 323913 - RNA, 16 nt, Bordetella pertussis
ccacggcgcccgaggc

SEQ ID NO: 323914 - RNA, 12 nt, Bordetella pertussis
ccacggcgcgcc

SEQ ID NO: 323915 - RNA, 15 nt, Bordetella pertussis
ccacggcgcgcccgc

SEQ ID NO: 323916 - RNA, 21 nt, Bordetella pertussis
ccacggcgcgcccgcaggcgg

SEQ ID NO: 323917 - RNA, 13 nt, Bordetella pertussis
ccacggcgcgcgc

SEQ ID NO: 323918 - RNA, 13 nt, Bordetella pertussis
ccacggcgcggau

SEQ ID NO: 323919 - RNA, 14 nt, Bordetella pertussis
ccacggcggccagg

SEQ ID NO: 323920 - RNA, 18 nt, Bordetella pertussis
ccacggcggcuucggccg

SEQ ID NO: 323921 - RNA, 13 nt, Bordetella pertussis
ccacggcgggccg

SEQ ID NO: 323922 - RNA, 18 nt, Bordetella pertussis
ccacggcgggccggcucg

SEQ ID NO: 323923 - RNA, 23 nt, Bordetella pertussis
ccacggcggugaccaccaggccg

SEQ ID NO: 323924 - RNA, 23 nt, Bordetella pertussis
ccacggcggugaucugcucgccg

SEQ ID NO: 323925 - RNA, 17 nt, Bordetella pertussis
ccacggcgucgaugcgc

SEQ ID NO: 323926 - RNA, 14 nt, Bordetella pertussis
ccacggcgucgccg

SEQ ID NO: 323927 - RNA, 16 nt, Bordetella pertussis
ccacggcgucgccggc

SEQ ID NO: 323928 - RNA, 17 nt, Bordetella pertussis
ccacggcguggcgcgcc

SEQ ID NO: 323929 - RNA, 19 nt, Bordetella pertussis
ccacggcguggcgcgcccg

SEQ ID NO: 323930 - RNA, 19 nt, Bordetella pertussis
ccacggucugcacgccggg

SEQ ID NO: 323931 - RNA, 18 nt, Bordetella pertussis
ccacggucuggcgcgaca

SEQ ID NO: 323932 - RNA, 13 nt, Bordetella pertussis
ccacgucgcccac

SEQ ID NO: 323933 - RNA, 14 nt, Bordetella pertussis
ccacgucgcggcug

SEQ ID NO: 323934 - RNA, 11 nt, Bordetella pertussis
ccacgucggcg

SEQ ID NO: 323935 - RNA, 13 nt, Bordetella pertussis
ccacgucggcggc

SEQ ID NO: 323936 - RNA, 15 nt, Bordetella pertussis
ccacgucggcggccg

SEQ ID NO: 323937 - RNA, 20 nt, Bordetella pertussis
ccacgucggcggccgccuug

SEQ ID NO: 323938 - RNA, 17 nt, Bordetella pertussis
ccacgucggugggaauc

SEQ ID NO: 323939 - RNA, 14 nt, Bordetella pertussis
ccacgugcggcagg

SEQ ID NO: 323940 - RNA, 13 nt, Bordetella pertussis
ccacgugcugcug

SEQ ID NO: 323941 - RNA, 18 nt, Bordetella pertussis
ccacguggacaggcaccu

SEQ ID NO: 323942 - RNA, 17 nt, Bordetella pertussis
ccacguugaagcgcagc

SEQ ID NO: 323943 - RNA, 15 nt, Bordetella pertussis
ccacucaugcgcugc

SEQ ID NO: 323944 - RNA, 17 nt, Bordetella pertussis
ccacucacgcaaggccg

SEQ ID NO: 323945 - RNA, 21 nt, Bordetella pertussis
ccacuggaagcugcggccggu

SEQ ID NO: 323946 - RNA, 14 nt, Bordetella pertussis
ccacuggccuugug

SEQ ID NO: 323947 - RNA, 21 nt, Bordetella pertussis
ccacugggggacuggcacccg

SEQ ID NO: 323948 - RNA, 20 nt, Bordetella pertussis
ccagacccgaaucucccggc

SEQ ID NO: 323949 - RNA, 13 nt, Bordetella pertussis
ccagaccgcgcgc

SEQ ID NO: 323950 - RNA, 14 nt, Bordetella pertussis
ccagaccgcgcgca

SEQ ID NO: 323951 - RNA, 17 nt, Bordetella pertussis
ccagaccgcgcgcacca

SEQ ID NO: 323952 - RNA, 18 nt, Bordetella pertussis
ccagaccugcgcgccggc

SEQ ID NO: 323953 - RNA, 17 nt, Bordetella pertussis
ccagaccuugcgcgacg

SEQ ID NO: 323954 - RNA, 20 nt, Bordetella pertussis
ccagacgcagaccacgccgg

SEQ ID NO: 323955 - RNA, 21 nt, Bordetella pertussis
ccagacgcagaccacgccggc

SEQ ID NO: 323956 - RNA, 22 nt, Bordetella pertussis
ccagauaaggcgggugucccag

SEQ ID NO: 323957 - RNA, 15 nt, Bordetella pertussis
ccagauaugccccuc

SEQ ID NO: 323958 - RNA, 21 nt, Bordetella pertussis
ccagaucaggucgaugccggc

SEQ ID NO: 323959 - RNA, 16 nt, Bordetella pertussis
ccagaucgaccaggac

SEQ ID NO: 323960 - RNA, 18 nt, Bordetella pertussis
ccagaucgauaccgucgc

SEQ ID NO: 323961 - RNA, 19 nt, Bordetella pertussis
ccagaucgauaccgucgcg

SEQ ID NO: 323962 - RNA, 17 nt, Bordetella pertussis
ccagaucggacgggccg

SEQ ID NO: 323963 - RNA, 12 nt, Bordetella pertussis
ccagaucgucga

SEQ ID NO: 323964 - RNA, 23 nt, Bordetella pertussis
ccagaucguugaucucgcccagc

SEQ ID NO: 323965 - RNA, 23 nt, Bordetella pertussis
ccagaugauggucggugccgccg

SEQ ID NO: 323966 - RNA, 13 nt, Bordetella pertussis
ccagaugcgcagc

SEQ ID NO: 323967 - RNA, 14 nt, Bordetella pertussis
ccagaugcgcagca

SEQ ID NO: 323968 - RNA, 17 nt, Bordetella pertussis
ccagaugcgcagcaggc

SEQ ID NO: 323969 - RNA, 14 nt, Bordetella pertussis
ccagaugcgccgca

SEQ ID NO: 323970 - RNA, 20 nt, Bordetella pertussis
ccagaugccggucaggaugc

SEQ ID NO: 323971 - RNA, 16 nt, Bordetella pertussis
ccagcaccucgacgca

SEQ ID NO: 323972 - RNA, 16 nt, Bordetella pertussis
ccagcaccugcaggcc

SEQ ID NO: 323973 - RNA, 17 nt, Bordetella pertussis
ccagcaccugcaggccg

SEQ ID NO: 323974 - RNA, 21 nt, Bordetella pertussis
ccagcaccugcaggccgccgg

SEQ ID NO: 323975 - RNA, 17 nt, Bordetella pertussis
ccagcacgaagggcagc

SEQ ID NO: 323976 - RNA, 20 nt, Bordetella pertussis
ccagcacgacgacggccggc

SEQ ID NO: 323977 - RNA, 23 nt, Bordetella pertussis
ccagcacgacgacggccggcgcg

SEQ ID NO: 323978 - RNA, 19 nt, Bordetella pertussis
ccagcacgagauguccaug

SEQ ID NO: 323979 - RNA, 16 nt, Bordetella pertussis
ccagcacgauccagcc

SEQ ID NO: 323980 - RNA, 17 nt, Bordetella pertussis
ccagcacgauccagccg

SEQ ID NO: 323981 - RNA, 21 nt, Bordetella pertussis
ccagcacgauggucagcggca

SEQ ID NO: 323982 - RNA, 15 nt, Bordetella pertussis
ccagcacgccgcgcu

SEQ ID NO: 323983 - RNA, 12 nt, Bordetella pertussis
ccagcacgccgg

SEQ ID NO: 323984 - RNA, 13 nt, Bordetella pertussis
ccagcacgccggc

SEQ ID NO: 323985 - RNA, 13 nt, Bordetella pertussis
ccagcacgccauu

SEQ ID NO: 323986 - RNA, 14 nt, Bordetella pertussis
ccagcagaucgcgg

SEQ ID NO: 323987 - RNA, 21 nt, Bordetella pertussis
ccagcagcaccgugccggcgu

SEQ ID NO: 323988 - RNA, 13 nt, Bordetella pertussis
ccagcagcacgau

SEQ ID NO: 323989 - RNA, 16 nt, Bordetella pertussis
ccagcagcacgcccag

SEQ ID NO: 323990 - RNA, 20 nt, Bordetella pertussis
ccagcagcgaggacacgcag

SEQ ID NO: 323991 - RNA, 18 nt, Bordetella pertussis
ccagcagcgcaucgcgcg

SEQ ID NO: 323992 - RNA, 14 nt, Bordetella pertussis
ccagcagcgccacc

SEQ ID NO: 323993 - RNA, 15 nt, Bordetella pertussis
ccagcagcgccaccg

SEQ ID NO: 323994 - RNA, 13 nt, Bordetella pertussis
ccagcagcgccgc

SEQ ID NO: 323995 - RNA, 15 nt, Bordetella pertussis
ccagcagcgccgcca

SEQ ID NO: 323996 - RNA, 17 nt, Bordetella pertussis
ccagcagcgccgccagc

SEQ ID NO: 323997 - RNA, 22 nt, Bordetella pertussis
ccagcagcgccgguucgacgcu

SEQ ID NO: 323998 - RNA, 15 nt, Bordetella pertussis
ccagcagcggcagca

SEQ ID NO: 323999 - RNA, 16 nt, Bordetella pertussis
ccagcagcggcagcag

SEQ ID NO: 324000 - RNA, 17 nt, Bordetella pertussis
ccagcagcggcagcagc

SEQ ID NO: 324001 - RNA, 12 nt, Bordetella pertussis
ccagcaggccca

SEQ ID NO: 324002 - RNA, 13 nt, Bordetella pertussis
ccagcaggccggu

SEQ ID NO: 324003 - RNA, 19 nt, Bordetella pertussis
ccagcaggcgaaacgccag

SEQ ID NO: 324004 - RNA, 23 nt, Bordetella pertussis
ccagcagggacuugggcaggccu

SEQ ID NO: 324005 - RNA, 12 nt, Bordetella pertussis
ccagcagggcgg

SEQ ID NO: 324006 - RNA, 23 nt, Bordetella pertussis
ccagcaguguuucggccugcucg

SEQ ID NO: 324007 - RNA, 22 nt, Bordetella pertussis
ccagcaguucgggguccagcaa

SEQ ID NO: 324008 - RNA, 18 nt, Bordetella pertussis
ccagcauacccugcgcgc

SEQ ID NO: 324009 - RNA, 19 nt, Bordetella pertussis
ccagcauacccugcgcgcc

SEQ ID NO: 324010 - RNA, 20 nt, Bordetella pertussis
ccagcauacccugcgcgccg

SEQ ID NO: 324011 - RNA, 13 nt, Bordetella pertussis
ccagcaugcgcgc

SEQ ID NO: 324012 - RNA, 14 nt, Bordetella pertussis
ccagcaugcgcgcg

SEQ ID NO: 324013 - RNA, 15 nt, Bordetella pertussis
ccagcaugcgcgcga

SEQ ID NO: 324014 - RNA, 14 nt, Bordetella pertussis
ccagcauggccgug

SEQ ID NO: 324015 - RNA, 17 nt, Bordetella pertussis
ccagcauggccguggcg

SEQ ID NO: 324016 - RNA, 19 nt, Bordetella pertussis
ccagcauggccguggcgug

SEQ ID NO: 324017 - RNA, 17 nt, Bordetella pertussis
ccagcauggcggccagg

SEQ ID NO: 324018 - RNA, 20 nt, Bordetella pertussis
ccagcauggcggccaggcgc

SEQ ID NO: 324019 - RNA, 22 nt, Bordetella pertussis
ccagcauggcggccaggcgcgc

SEQ ID NO: 324020 - RNA, 22 nt, Bordetella pertussis
ccagcauggucggcauggccag

SEQ ID NO: 324021 - RNA, 23 nt, Bordetella pertussis
ccagcaugucguggcgauagcgc

SEQ ID NO: 324022 - RNA, 16 nt, Bordetella pertussis
ccagccaaugccgcgg

SEQ ID NO: 324023 - RNA, 22 nt, Bordetella pertussis
ccagccaccaugucccuggcca

SEQ ID NO: 324024 - RNA, 18 nt, Bordetella pertussis
ccagccacgccggcgcgc

SEQ ID NO: 324025 - RNA, 20 nt, Bordetella pertussis
ccagccacgccggcgcgccg

SEQ ID NO: 324026 - RNA, 15 nt, Bordetella pertussis
ccagccacgcgcgcu

SEQ ID NO: 324027 - RNA, 16 nt, Bordetella pertussis
ccagccacgcgcgcug

SEQ ID NO: 324028 - RNA, 20 nt, Bordetella pertussis
ccagccacgcgcgcuggcgc

SEQ ID NO: 324029 - RNA, 22 nt, Bordetella pertussis
ccagccacgcgcgcuggcgccc

SEQ ID NO: 324030 - RNA, 19 nt, Bordetella pertussis
ccagccagcccuggcccag

SEQ ID NO: 324031 - RNA, 13 nt, Bordetella pertussis
ccagccagcgccg

SEQ ID NO: 324032 - RNA, 14 nt, Bordetella pertussis
ccagccagccgccg

SEQ ID NO: 324033 - RNA, 16 nt, Bordetella pertussis
ccagccaggccucggc

SEQ ID NO: 324034 - RNA, 14 nt, Bordetella pertussis
ccagccaggcgcgc

SEQ ID NO: 324035 - RNA, 15 nt, Bordetella pertussis
ccagccaggcgcgca

SEQ ID NO: 324036 - RNA, 18 nt, Bordetella pertussis
ccagccauguucgaccag

SEQ ID NO: 324037 - RNA, 19 nt, Bordetella pertussis
ccagccauguucgaccagg

SEQ ID NO: 324038 - RNA, 16 nt, Bordetella pertussis
ccagccauugccgcac

SEQ ID NO: 324039 - RNA, 17 nt, Bordetella pertussis
ccagccauugccgcacg

SEQ ID NO: 324040 - RNA, 22 nt, Bordetella pertussis
ccagcccaccagcgccacgccg

SEQ ID NO: 324041 - RNA, 23 nt, Bordetella pertussis
ccagcccaccgcgaaccaggccu

SEQ ID NO: 324042 - RNA, 16 nt, Bordetella pertussis
ccagccccaccuugcc

SEQ ID NO: 324043 - RNA, 17 nt, Bordetella pertussis
ccagccccacgccgacc

SEQ ID NO: 324044 - RNA, 14 nt, Bordetella pertussis
ccagccccgcggcc

SEQ ID NO: 324045 - RNA, 15 nt, Bordetella pertussis
ccagccccggcgcgc

SEQ ID NO: 324046 - RNA, 17 nt, Bordetella pertussis
ccagccccggcgcgccg

SEQ ID NO: 324047 - RNA, 18 nt, Bordetella pertussis
ccagccccggcgcgccgg

SEQ ID NO: 324048 - RNA, 19 nt, Bordetella pertussis
ccagccccggcgcgccggc

SEQ ID NO: 324049 - RNA, 21 nt, Bordetella pertussis
ccagccccggcgcgccggccg

SEQ ID NO: 324050 - RNA, 16 nt, Bordetella pertussis
ccagcccgacggccag

SEQ ID NO: 324051 - RNA, 19 nt, Bordetella pertussis
ccagcccgacggccagcgc

SEQ ID NO: 324052 - RNA, 18 nt, Bordetella pertussis
ccagcccgaugcgccagg

SEQ ID NO: 324053 - RNA, 13 nt, Bordetella pertussis
ccagcccgcccgc

SEQ ID NO: 324054 - RNA, 14 nt, Bordetella pertussis
ccagcccgcccgcg

SEQ ID NO: 324055 - RNA, 19 nt, Bordetella pertussis
ccagcccgcccgcgcccag

SEQ ID NO: 324056 - RNA, 14 nt, Bordetella pertussis
ccagcccgccgcug

SEQ ID NO: 324057 - RNA, 15 nt, Bordetella pertussis
ccagcccgccggcgc

SEQ ID NO: 324058 - RNA, 16 nt, Bordetella pertussis
ccagcccgccggcgcg

SEQ ID NO: 324059 - RNA, 14 nt, Bordetella pertussis
ccagcccgcugccg

SEQ ID NO: 324060 - RNA, 13 nt, Bordetella pertussis
ccagcccggccgc

SEQ ID NO: 324061 - RNA, 14 nt, Bordetella pertussis
ccagcccggccgcc

SEQ ID NO: 324062 - RNA, 14 nt, Bordetella pertussis
ccagcccggcgcga

SEQ ID NO: 324063 - RNA, 17 nt, Bordetella pertussis
ccagcccggcgcgacag

SEQ ID NO: 324064 - RNA, 13 nt, Bordetella pertussis
ccagcccggcggu

SEQ ID NO: 324065 - RNA, 23 nt, Bordetella pertussis
ccagcccguccuggugcacgccg

SEQ ID NO: 324066 - RNA, 16 nt, Bordetella pertussis
ccagcccugcccgcac

SEQ ID NO: 324067 - RNA, 23 nt, Bordetella pertussis
ccagcccugcccgcaccaugccg

SEQ ID NO: 324068 - RNA, 13 nt, Bordetella pertussis
ccagcccuugcuu

SEQ ID NO: 324069 - RNA, 17 nt, Bordetella pertussis
ccagcccuucgcccgca

SEQ ID NO: 324070 - RNA, 22 nt, Bordetella pertussis
ccagccgaucagccggccaugg

SEQ ID NO: 324071 - RNA, 15 nt, Bordetella pertussis
ccagccgaugccgcu

SEQ ID NO: 324072 - RNA, 13 nt, Bordetella pertussis
ccagccgcagcag

SEQ ID NO: 324073 - RNA, 15 nt, Bordetella pertussis
ccagccgcagcaggc

SEQ ID NO: 324074 - RNA, 12 nt, Bordetella pertussis
ccagccgcccgg

SEQ ID NO: 324075 - RNA, 14 nt, Bordetella pertussis
ccagccgcccgugg

SEQ ID NO: 324076 - RNA, 13 nt, Bordetella pertussis
ccagccgccgcca

SEQ ID NO: 324077 - RNA, 21 nt, Bordetella pertussis
ccagccgcgccagggcgcgga

SEQ ID NO: 324078 - RNA, 14 nt, Bordetella pertussis
ccagccgcgcgaac

SEQ ID NO: 324079 - RNA, 16 nt, Bordetella pertussis
ccagccgcucgcgcga

SEQ ID NO: 324080 - RNA, 17 nt, Bordetella pertussis
ccagccgcucgcgcgac

SEQ ID NO: 324081 - RNA, 17 nt, Bordetella pertussis
ccagcgagaucagcacc

SEQ ID NO: 324082 - RNA, 17 nt, Bordetella pertussis
ccagcgagcggggcugg

SEQ ID NO: 324083 - RNA, 15 nt, Bordetella pertussis
ccagcgagccggcca

SEQ ID NO: 324084 - RNA, 14 nt, Bordetella pertussis
ccagcgaggccgcu

SEQ ID NO: 324085 - RNA, 19 nt, Bordetella pertussis
ccagcgcaccaccagcacc

SEQ ID NO: 324086 - RNA, 19 nt, Bordetella pertussis
ccagcgcauaggacgccac

SEQ ID NO: 324087 - RNA, 22 nt, Bordetella pertussis
ccagcgcauaggacgccaccag

SEQ ID NO: 324088 - RNA, 17 nt, Bordetella pertussis
ccagcgcauugccgccg

SEQ ID NO: 324089 - RNA, 21 nt, Bordetella pertussis
ccagcgcauuggugagcacgc

SEQ ID NO: 324090 - RNA, 13 nt, Bordetella pertussis
ccagcgcccgcgg

SEQ ID NO: 324091 - RNA, 11 nt, Bordetella pertussis
ccagcgccgcc

SEQ ID NO: 324092 - RNA, 15 nt, Bordetella pertussis
ccagcgccgccagcc

SEQ ID NO: 324093 - RNA, 21 nt, Bordetella pertussis
ccagcgccgccaucauggcgu

SEQ ID NO: 324094 - RNA, 17 nt, Bordetella pertussis
ccagcgccgcggccggc

SEQ ID NO: 324095 - RNA, 18 nt, Bordetella pertussis
ccagcgccgcggccggcg

SEQ ID NO: 324096 - RNA, 23 nt, Bordetella pertussis
ccagcgccgcgucgagcgcgacg

SEQ ID NO: 324097 - RNA, 13 nt, Bordetella pertussis
ccagcgccggcgc

SEQ ID NO: 324098 - RNA, 14 nt, Bordetella pertussis
ccagcgccggcgca

SEQ ID NO: 324099 - RNA, 19 nt, Bordetella pertussis
ccagcgccggcgcgcgcug

SEQ ID NO: 324100 - RNA, 15 nt, Bordetella pertussis
ccagcgccggcgcgu

SEQ ID NO: 324101 - RNA, 16 nt, Bordetella pertussis
ccagcgccggcgcguc

SEQ ID NO: 324102 - RNA, 17 nt, Bordetella pertussis
ccagcgccggcacgcug

SEQ ID NO: 324103 - RNA, 18 nt, Bordetella pertussis
ccagcgccggcagcccca

SEQ ID NO: 324104 - RNA, 13 nt, Bordetella pertussis
ccagcgccgucau

SEQ ID NO: 324105 - RNA, 20 nt, Bordetella pertussis
ccagcgcgcccagcgcgccg

SEQ ID NO: 324106 - RNA, 13 nt, Bordetella pertussis
ccagcgcgcccga

SEQ ID NO: 324107 - RNA, 15 nt, Bordetella pertussis
ccagcgcgcccgagg

SEQ ID NO: 324108 - RNA, 16 nt, Bordetella pertussis
ccagcgcgccgccagc

SEQ ID NO: 324109 - RNA, 17 nt, Bordetella pertussis
ccagcgcgccggccagg

SEQ ID NO: 324110 - RNA, 19 nt, Bordetella pertussis
ccagcgcgccggccagggc

SEQ ID NO: 324111 - RNA, 23 nt, Bordetella pertussis
ccagcgcgccggccagggccacc

SEQ ID NO: 324112 - RNA, 13 nt, Bordetella pertussis
ccagcgcgccggg

SEQ ID NO: 324113 - RNA, 16 nt, Bordetella pertussis
ccagcgcgccgggggc

SEQ ID NO: 324114 - RNA, 13 nt, Bordetella pertussis
ccagcgcgccugc

SEQ ID NO: 324115 - RNA, 14 nt, Bordetella pertussis
ccagcgcgccugcc

SEQ ID NO: 324116 - RNA, 16 nt, Bordetella pertussis
ccagcgcgccugccca

SEQ ID NO: 324117 - RNA, 13 nt, Bordetella pertussis
ccagcgcgccgcg

SEQ ID NO: 324118 - RNA, 13 nt, Bordetella pertussis
ccagcgcgcgcca

SEQ ID NO: 324119 - RNA, 20 nt, Bordetella pertussis
ccagcgcgcgccggccgaca

SEQ ID NO: 324120 - RNA, 22 nt, Bordetella pertussis
ccagcgcgcgccggccgacagg

SEQ ID NO: 324121 - RNA, 16 nt, Bordetella pertussis
ccagcgcgcggccggc

SEQ ID NO: 324122 - RNA, 17 nt, Bordetella pertussis
ccagcgcgcggcgcagc

SEQ ID NO: 324123 - RNA, 20 nt, Bordetella pertussis
ccagcgcgcggggcaggccg

SEQ ID NO: 324124 - RNA, 22 nt, Bordetella pertussis
ccagcgcgcggugccgccuggc

SEQ ID NO: 324125 - RNA, 12 nt, Bordetella pertussis
ccagcgcgcgug

SEQ ID NO: 324126 - RNA, 13 nt, Bordetella pertussis
ccagcggcagcgc

SEQ ID NO: 324127 - RNA, 17 nt, Bordetella pertussis
ccagcggcagcgcgcag

SEQ ID NO: 324128 - RNA, 15 nt, Bordetella pertussis
ccagcggcaggcugg

SEQ ID NO: 324129 - RNA, 20 nt, Bordetella pertussis
ccagcggcaggcuggccggc

SEQ ID NO: 324130 - RNA, 13 nt, Bordetella pertussis
ccagcggcgugau

SEQ ID NO: 324131 - RNA, 19 nt, Bordetella pertussis
ccagcggcgugaugcccag

SEQ ID NO: 324132 - RNA, 23 nt, Bordetella pertussis
ccagcggcgugaugcccaggccc

SEQ ID NO: 324133 - RNA, 19 nt, Bordetella pertussis
ccagcggcgugcggcccag

SEQ ID NO: 324134 - RNA, 22 nt, Bordetella pertussis
ccagcggcgugcggcccagccg

SEQ ID NO: 324135 - RNA, 18 nt, Bordetella pertussis
ccagcggcguggcggcca

SEQ ID NO: 324136 - RNA, 19 nt, Bordetella pertussis
ccagcggcguggcggccag

SEQ ID NO: 324137 - RNA, 23 nt, Bordetella pertussis
ccagcggcguggcggccaggccg

SEQ ID NO: 324138 - RNA, 14 nt, Bordetella pertussis
ccagcggcuggcca

SEQ ID NO: 324139 - RNA, 14 nt, Bordetella pertussis
ccagcggcuggcgc

SEQ ID NO: 324140 - RNA, 16 nt, Bordetella pertussis
ccagcggcuggcgccg

SEQ ID NO: 324141 - RNA, 17 nt, Bordetella pertussis
ccagcgggagccugucc

SEQ ID NO: 324142 - RNA, 22 nt, Bordetella pertussis
ccagcgggagccuguccccgcg

SEQ ID NO: 324143 - RNA, 15 nt, Bordetella pertussis
ccagcggggacaggc

SEQ ID NO: 324144 - RNA, 17 nt, Bordetella pertussis
ccagcggggacaggcac

SEQ ID NO: 324145 - RNA, 19 nt, Bordetella pertussis
ccagcggggccgugacgug

SEQ ID NO: 324146 - RNA, 23 nt, Bordetella pertussis
ccagcggggccgugacgugcuug

SEQ ID NO: 324147 - RNA, 16 nt, Bordetella pertussis
ccagcgguacgccgaa

SEQ ID NO: 324148 - RNA, 18 nt, Bordetella pertussis
ccagcguaucgccgccgc

SEQ ID NO: 324149 - RNA, 22 nt, Bordetella pertussis
ccagcguaucgccgccgccggc

SEQ ID NO: 324150 - RNA, 22 nt, Bordetella pertussis
ccagcgucagcacaucgcccgg

SEQ ID NO: 324151 - RNA, 20 nt, Bordetella pertussis
ccagcgucauggccuggccc

SEQ ID NO: 324152 - RNA, 21 nt, Bordetella pertussis
ccagcgucauggccuggccca

SEQ ID NO: 324153 - RNA, 22 nt, Bordetella pertussis
ccagcgucauggccuggcccag

SEQ ID NO: 324154 - RNA, 14 nt, Bordetella pertussis
ccagcguccaggcg

SEQ ID NO: 324155 - RNA, 18 nt, Bordetella pertussis
ccagcguccaggcggcca

SEQ ID NO: 324156 - RNA, 23 nt, Bordetella pertussis
ccagcgucggcguaaggccgccg

SEQ ID NO: 324157 - RNA, 14 nt, Bordetella pertussis
ccagcgugcccagc

SEQ ID NO: 324158 - RNA, 20 nt, Bordetella pertussis
ccagcguggccgaggugccc

SEQ ID NO: 324159 - RNA, 18 nt, Bordetella pertussis
ccaggaugagcgccugca

SEQ ID NO: 324160 - RNA, 21 nt, Bordetella pertussis
ccaggaugcccuuggcggcga

SEQ ID NO: 324161 - RNA, 13 nt, Bordetella pertussis
ccaggaugcgcac

SEQ ID NO: 324162 - RNA, 15 nt, Bordetella pertussis
ccaggaugcgcgaca

SEQ ID NO: 324163 - RNA, 13 nt, Bordetella pertussis
ccaggauggcgcc

SEQ ID NO: 324164 - RNA, 14 nt, Bordetella pertussis
ccaggauggcgcca

SEQ ID NO: 324165 - RNA, 19 nt, Bordetella pertussis
ccaggcaaucgaugaucac

SEQ ID NO: 324166 - RNA, 20 nt, Bordetella pertussis
ccaggcaaugcgcaggcccg

SEQ ID NO: 324167 - RNA, 12 nt, Bordetella pertussis
ccaggcagccgg

SEQ ID NO: 324168 - RNA, 17 nt, Bordetella pertussis
ccaggcagccggccccg

SEQ ID NO: 324169 - RNA, 23 nt, Bordetella pertussis
ccaggcauucucggacaggucgg

SEQ ID NO: 324170 - RNA, 22 nt, Bordetella pertussis
ccaggcauugaagcuggcgccg

SEQ ID NO: 324171 - RNA, 21 nt, Bordetella pertussis
ccaggcauucccgcccagcga

SEQ ID NO: 324172 - RNA, 22 nt, Bordetella pertussis
ccaggcauucccgcccagcgac

SEQ ID NO: 324173 - RNA, 16 nt, Bordetella pertussis
ccaggccaccgcggcg

SEQ ID NO: 324174 - RNA, 15 nt, Bordetella pertussis
ccaggccaccgcggu

SEQ ID NO: 324175 - RNA, 16 nt, Bordetella pertussis
ccaggccagcagcucg

SEQ ID NO: 324176 - RNA, 16 nt, Bordetella pertussis
ccaggccagcgccaga

SEQ ID NO: 324177 - RNA, 16 nt, Bordetella pertussis
ccaggccagcgccgcg

SEQ ID NO: 324178 - RNA, 22 nt, Bordetella pertussis
ccaggcccacgacgaacaacac

SEQ ID NO: 324179 - RNA, 12 nt, Bordetella pertussis
ccaggcccagca

SEQ ID NO: 324180 - RNA, 13 nt, Bordetella pertussis
ccaggcccagcgc

SEQ ID NO: 324181 - RNA, 17 nt, Bordetella pertussis
ccaggcccagcgcgcca

SEQ ID NO: 324182 - RNA, 15 nt, Bordetella pertussis
ccaggcccagggcga

SEQ ID NO: 324183 - RNA, 21 nt, Bordetella pertussis
ccaggcccauaugccgccggc

SEQ ID NO: 324184 - RNA, 14 nt, Bordetella pertussis
ccaggcccaugccg

SEQ ID NO: 324185 - RNA, 21 nt, Bordetella pertussis
ccaggcccaugccgcccgcca

SEQ ID NO: 324186 - RNA, 15 nt, Bordetella pertussis
ccaggccccgccggg

SEQ ID NO: 324187 - RNA, 21 nt, Bordetella pertussis
ccaggcccgaaacgcgcagca

SEQ ID NO: 324188 - RNA, 22 nt, Bordetella pertussis
ccaggcccgaaacgcgcagcac

SEQ ID NO: 324189 - RNA, 12 nt, Bordetella pertussis
ccaggcccgcca

SEQ ID NO: 324190 - RNA, 24 nt, Bordetella pertussis
ccaggcccgccacggcgcccgagg

SEQ ID NO: 324191 - RNA, 16 nt, Bordetella pertussis
ccaggcccgccagggc

SEQ ID NO: 324192 - RNA, 14 nt, Bordetella pertussis
ccaggcccggccgc

SEQ ID NO: 324193 - RNA, 16 nt, Bordetella pertussis
ccaggcccggccgcag

SEQ ID NO: 324194 - RNA, 17 nt, Bordetella pertussis
ccaggcccggccgcagg

SEQ ID NO: 324195 - RNA, 13 nt, Bordetella pertussis
ccaggcccggcgc

SEQ ID NO: 324196 - RNA, 17 nt, Bordetella pertussis
ccaggcccucgcggccg

SEQ ID NO: 324197 - RNA, 20 nt, Bordetella pertussis
ccaggcccucgcggccgucg

SEQ ID NO: 324198 - RNA, 20 nt, Bordetella pertussis
ccaggcccuggcggcgcagu

SEQ ID NO: 324199 - RNA, 18 nt, Bordetella pertussis
ccaggcccuggcuggcca

SEQ ID NO: 324200 - RNA, 20 nt, Bordetella pertussis
ccaggccgaacuucagcccg

SEQ ID NO: 324201 - RNA, 18 nt, Bordetella pertussis
ccaggccgauuucggccg

SEQ ID NO: 324202 - RNA, 19 nt, Bordetella pertussis
ccaggccgcauacgacacg

SEQ ID NO: 324203 - RNA, 15 nt, Bordetella pertussis
ccaggccgccagggc

SEQ ID NO: 324204 - RNA, 18 nt, Bordetella pertussis
ccaggccgcccagccgcg

SEQ ID NO: 324205 - RNA, 14 nt, Bordetella pertussis
ccaggccgccggcg

SEQ ID NO: 324206 - RNA, 19 nt, Bordetella pertussis
ccaggccgcggcgcccggu

SEQ ID NO: 324207 - RNA, 21 nt, Bordetella pertussis
ccaggccgcggcgcccggugc

SEQ ID NO: 324208 - RNA, 14 nt, Bordetella pertussis
ccaggccggcgaaa

SEQ ID NO: 324209 - RNA, 16 nt, Bordetella pertussis
ccaggccggcaugcgc

SEQ ID NO: 324210 - RNA, 12 nt, Bordetella pertussis
ccaggccggcca

SEQ ID NO: 324211 - RNA, 14 nt, Bordetella pertussis
ccaggccggccagg

SEQ ID NO: 324212 - RNA, 12 nt, Bordetella pertussis
ccaggccggccc

SEQ ID NO: 324213 - RNA, 14 nt, Bordetella pertussis
ccaggccggcgcca

SEQ ID NO: 324214 - RNA, 14 nt, Bordetella pertussis
ccaggccggcgcgc

SEQ ID NO: 324215 - RNA, 18 nt, Bordetella pertussis
ccaggccggcgcgccggc

SEQ ID NO: 324216 - RNA, 19 nt, Bordetella pertussis
ccaggccggcgcgcucggc

SEQ ID NO: 324217 - RNA, 13 nt, Bordetella pertussis
ccaggccggcggc

SEQ ID NO: 324218 - RNA, 18 nt, Bordetella pertussis
ccaggccggcucgccgca

SEQ ID NO: 324219 - RNA, 12 nt, Bordetella pertussis
ccaggccggggc

SEQ ID NO: 324220 - RNA, 14 nt, Bordetella pertussis
ccaggccggggccg

SEQ ID NO: 324221 - RNA, 17 nt, Bordetella pertussis
ccaggccggggccgccc

SEQ ID NO: 324222 - RNA, 19 nt, Bordetella pertussis
ccaggccggggccgcccag

SEQ ID NO: 324223 - RNA, 14 nt, Bordetella pertussis
ccaggccggugcgc

SEQ ID NO: 324224 - RNA, 20 nt, Bordetella pertussis
ccaggccgguggaccagggc

SEQ ID NO: 324225 - RNA, 22 nt, Bordetella pertussis
ccaggccgguggaccagggcac

SEQ ID NO: 324226 - RNA, 14 nt, Bordetella pertussis
ccaggccgucggcc

SEQ ID NO: 324227 - RNA, 17 nt, Bordetella pertussis
ccaggccgucggccagg

SEQ ID NO: 324228 - RNA, 17 nt, Bordetella pertussis
ccaggccguggcgcacc

SEQ ID NO: 324229 - RNA, 14 nt, Bordetella pertussis
ccaggccucggucg

SEQ ID NO: 324230 - RNA, 11 nt, Bordetella pertussis
ccaggccugcc

SEQ ID NO: 324231 - RNA, 23 nt, Bordetella pertussis
ccaggccugcgggugcgccugca

SEQ ID NO: 324232 - RNA, 16 nt, Bordetella pertussis
ccaggccuucgacguc

SEQ ID NO: 324233 - RNA, 15 nt, Bordetella pertussis
ccaggcgacccagca

SEQ ID NO: 324234 - RNA, 22 nt, Bordetella pertussis
ccaggcgaggcuggcgcccacg

SEQ ID NO: 324235 - RNA, 18 nt, Bordetella pertussis
ccaggcgaugcccagcgc

SEQ ID NO: 324236 - RNA, 22 nt, Bordetella pertussis
ccaggcgauggccgggagcggc

SEQ ID NO: 324237 - RNA, 13 nt, Bordetella pertussis
ccaggcgcaggcg

SEQ ID NO: 324238 - RNA, 22 nt, Bordetella pertussis
ccaggcgcaguaucuggugcgc

SEQ ID NO: 324239 - RNA, 23 nt, Bordetella pertussis
ccaggcgcauguccgccacgccg

SEQ ID NO: 324240 - RNA, 14 nt, Bordetella pertussis
ccaggcgccccacc

SEQ ID NO: 324241 - RNA, 18 nt, Bordetella pertussis
ccaggcgccccacccggg

SEQ ID NO: 324242 - RNA, 14 nt, Bordetella pertussis
ccaggcgcccgcca

SEQ ID NO: 324243 - RNA, 13 nt, Bordetella pertussis
ccaggcgcccggc

SEQ ID NO: 324244 - RNA, 15 nt, Bordetella pertussis
ccaggcgcccggcgu

SEQ ID NO: 324245 - RNA, 15 nt, Bordetella pertussis
ccaggcgccgcacgc

SEQ ID NO: 324246 - RNA, 12 nt, Bordetella pertussis
ccaggcgccgcu

SEQ ID NO: 324247 - RNA, 18 nt, Bordetella pertussis
ccaggcgccgcucagcgc

SEQ ID NO: 324248 - RNA, 12 nt, Bordetella pertussis
ccaggcgccggg

SEQ ID NO: 324249 - RNA, 14 nt, Bordetella pertussis
ccaggcgccgggcc

SEQ ID NO: 324250 - RNA, 16 nt, Bordetella pertussis
ccaggcgcgaucgaac

SEQ ID NO: 324251 - RNA, 12 nt, Bordetella pertussis
ccaggcgcgcca

SEQ ID NO: 324252 - RNA, 13 nt, Bordetella pertussis
ccaggcgcgccag

SEQ ID NO: 324253 - RNA, 15 nt, Bordetella pertussis
ccaggcgcgccagcc

SEQ ID NO: 324254 - RNA, 16 nt, Bordetella pertussis
ccaggcgcgccagccg

SEQ ID NO: 324255 - RNA, 20 nt, Bordetella pertussis
ccaggcgcgccagccgcugc

SEQ ID NO: 324256 - RNA, 23 nt, Bordetella pertussis
ccaggcgcgccagccgcugcagc

SEQ ID NO: 324257 - RNA, 14 nt, Bordetella pertussis
ccaggcgcgccgcg

SEQ ID NO: 324258 - RNA, 14 nt, Bordetella pertussis
ccaggcgcgcgcca

SEQ ID NO: 324259 - RNA, 14 nt, Bordetella pertussis
ccaggcgcgcuggc

SEQ ID NO: 324260 - RNA, 16 nt, Bordetella pertussis
ccaggcgcggaucucg

SEQ ID NO: 324261 - RNA, 18 nt, Bordetella pertussis
ccaggcgcgugcgcaggc

SEQ ID NO: 324262 - RNA, 21 nt, Bordetella pertussis
ccaggcgcgugggcaggugcu

SEQ ID NO: 324263 - RNA, 15 nt, Bordetella pertussis
ccaggcgcuccagca

SEQ ID NO: 324264 - RNA, 16 nt, Bordetella pertussis
ccaggcgcuccagcac

SEQ ID NO: 324265 - RNA, 20 nt, Bordetella pertussis
ccaggcgcucggcguugcug

SEQ ID NO: 324266 - RNA, 21 nt, Bordetella pertussis
ccaggcgcucggcguugcugg

SEQ ID NO: 324267 - RNA, 13 nt, Bordetella pertussis
ccaggcgcugcgc

SEQ ID NO: 324268 - RNA, 21 nt, Bordetella pertussis
ccaggcggcaggcgccgccgc

SEQ ID NO: 324269 - RNA, 14 nt, Bordetella pertussis
ccaggcggccacca

SEQ ID NO: 324270 - RNA, 15 nt, Bordetella pertussis
ccaggcggcgcucga

SEQ ID NO: 324271 - RNA, 19 nt, Bordetella pertussis
ccaggcgggcaucgcccac

SEQ ID NO: 324272 - RNA, 20 nt, Bordetella pertussis
ccaggcgggcaucgcccacc

SEQ ID NO: 324273 - RNA, 15 nt, Bordetella pertussis
ccaggcgggccaggu

SEQ ID NO: 324274 - RNA, 18 nt, Bordetella pertussis
ccaggcggguguagaaga

SEQ ID NO: 324275 - RNA, 14 nt, Bordetella pertussis
ccaggcgugcccgg

SEQ ID NO: 324276 - RNA, 14 nt, Bordetella pertussis
ccaggcucaggcgg

SEQ ID NO: 324277 - RNA, 17 nt, Bordetella pertussis
ccaggcucaggcggcca

SEQ ID NO: 324278 - RNA, 19 nt, Bordetella pertussis
ccaggcucaggcggccagg

SEQ ID NO: 324279 - RNA, 18 nt, Bordetella pertussis
ccaggcuccggcuugccg

SEQ ID NO: 324280 - RNA, 20 nt, Bordetella pertussis
ccaggcugaccagcgcgucg

SEQ ID NO: 324281 - RNA, 18 nt, Bordetella pertussis
ccaggcugaaugccgccg

SEQ ID NO: 324282 - RNA, 15 nt, Bordetella pertussis
ccaggcugcgcgccg

SEQ ID NO: 324283 - RNA, 16 nt, Bordetella pertussis
ccaggcugcgcgccgg

SEQ ID NO: 324284 - RNA, 14 nt, Bordetella pertussis
ccaggcugcccugg

SEQ ID NO: 324285 - RNA, 17 nt, Bordetella pertussis
ccaggcuggggccgagc

SEQ ID NO: 324286 - RNA, 21 nt, Bordetella pertussis
ccaggcuuucgaagccgcccc

SEQ ID NO: 324287 - RNA, 21 nt, Bordetella pertussis
ccagggaccaauacgccgcca

SEQ ID NO: 324288 - RNA, 21 nt, Bordetella pertussis
ccagggagugcgaggacgacc

SEQ ID NO: 324289 - RNA, 17 nt, Bordetella pertussis
ccagggugguggccucg

SEQ ID NO: 324290 - RNA, 23 nt, Bordetella pertussis
ccaggguguagaccugcgggccg

SEQ ID NO: 324291 - RNA, 17 nt, Bordetella pertussis
ccaggguguccuggucg

SEQ ID NO: 324292 - RNA, 21 nt, Bordetella pertussis
ccaggguuuccucgccgacga

SEQ ID NO: 324293 - RNA, 23 nt, Bordetella pertussis
ccagguaagcuggcgcuuggcca

SEQ ID NO: 324294 - RNA, 19 nt, Bordetella pertussis
ccagguacaggccgccggu

SEQ ID NO: 324295 - RNA, 22 nt, Bordetella pertussis
ccagguacaucauccccagcgc

SEQ ID NO: 324296 - RNA, 18 nt, Bordetella pertussis
ccagguccugcgccagcu

SEQ ID NO: 324297 - RNA, 17 nt, Bordetella pertussis
ccagguccuggcggccg

SEQ ID NO: 324298 - RNA, 15 nt, Bordetella pertussis
ccaggucgauaucgc

SEQ ID NO: 324299 - RNA, 20 nt, Bordetella pertussis
ccaggucgauaucgccaucc

SEQ ID NO: 324300 - RNA, 20 nt, Bordetella pertussis
ccaggucgcggugcgccacg

SEQ ID NO: 324301 - RNA, 18 nt, Bordetella pertussis
ccaggucggacgcgccgg

SEQ ID NO: 324302 - RNA, 23 nt, Bordetella pertussis
ccaggucggacgcgccgggcgaa

SEQ ID NO: 324303 - RNA, 19 nt, Bordetella pertussis
ccaggucggccaccgccgu

SEQ ID NO: 324304 - RNA, 23 nt, Bordetella pertussis
ccaggucggccaccgccguggca

SEQ ID NO: 324305 - RNA, 17 nt, Bordetella pertussis
ccaggucggccagccgg

SEQ ID NO: 324306 - RNA, 20 nt, Bordetella pertussis
ccaggucggccagccggccg

SEQ ID NO: 324307 - RNA, 23 nt, Bordetella pertussis
ccagguggacagcgccagcccgc

SEQ ID NO: 324308 - RNA, 16 nt, Bordetella pertussis
ccagguggcccgcacc

SEQ ID NO: 324309 - RNA, 13 nt, Bordetella pertussis
ccagguggcgaug

SEQ ID NO: 324310 - RNA, 16 nt, Bordetella pertussis
ccagguggcggcggca

SEQ ID NO: 324311 - RNA, 22 nt, Bordetella pertussis
ccaguaccugacccugcgcacc

SEQ ID NO: 324312 - RNA, 17 nt, Bordetella pertussis
ccaguacgagaacgcgu

SEQ ID NO: 324313 - RNA, 16 nt, Bordetella pertussis
ccaguacgaugccguc

SEQ ID NO: 324314 - RNA, 17 nt, Bordetella pertussis
ccaguacgucggacagg

SEQ ID NO: 324315 - RNA, 18 nt, Bordetella pertussis
ccaguagcacacgccgau

SEQ ID NO: 324316 - RNA, 14 nt, Bordetella pertussis
ccaguagcgccggc

SEQ ID NO: 324317 - RNA, 16 nt, Bordetella pertussis
ccaguccagcgcgccg

SEQ ID NO: 324318 - RNA, 17 nt, Bordetella pertussis
ccaguccagcgcgccgc

SEQ ID NO: 324319 - RNA, 15 nt, Bordetella pertussis
ccaguccauccagcg

SEQ ID NO: 324320 - RNA, 23 nt, Bordetella pertussis
ccagucccaggaucaccgccgcg

SEQ ID NO: 324321 - RNA, 20 nt, Bordetella pertussis
ccaguccccaugcggggacu

SEQ ID NO: 324322 - RNA, 21 nt, Bordetella pertussis
ccaguccccaugcggggacug

SEQ ID NO: 324323 - RNA, 24 nt, Bordetella pertussis
ccaguccccaugcggggacuggca

SEQ ID NO: 324324 - RNA, 20 nt, Bordetella pertussis
ccagucccccugcggggaca

SEQ ID NO: 324325 - RNA, 19 nt, Bordetella pertussis
ccaguccccgcggggacag

SEQ ID NO: 324326 - RNA, 22 nt, Bordetella pertussis
ccagugcaggggguggcggccg

SEQ ID NO: 324327 - RNA, 19 nt, Bordetella pertussis
ccagugccuggacgcgcug

SEQ ID NO: 324328 - RNA, 13 nt, Bordetella pertussis
ccagugcgccggc

SEQ ID NO: 324329 - RNA, 14 nt, Bordetella pertussis
ccagugcgccggcg

SEQ ID NO: 324330 - RNA, 19 nt, Bordetella pertussis
ccagugcgccggcgcggcg

SEQ ID NO: 324331 - RNA, 16 nt, Bordetella pertussis
ccagugcgccggcggc

SEQ ID NO: 324332 - RNA, 14 nt, Bordetella pertussis
ccaguuccagcacg

SEQ ID NO: 324333 - RNA, 16 nt, Bordetella pertussis
ccaguuccagcacgac

SEQ ID NO: 324334 - RNA, 19 nt, Bordetella pertussis
ccaguuccgugcgcgcccg

SEQ ID NO: 324335 - RNA, 17 nt, Bordetella pertussis
ccaguucgacgcccaug

SEQ ID NO: 324336 - RNA, 14 nt, Bordetella pertussis
ccaguucgcggccg

SEQ ID NO: 324337 - RNA, 16 nt, Bordetella pertussis
ccaguucgcggcgcag

SEQ ID NO: 324338 - RNA, 12 nt, Bordetella pertussis
ccaguucggccg

SEQ ID NO: 324339 - RNA, 20 nt, Bordetella pertussis
ccaguucggcgcgcgugccg

SEQ ID NO: 324340 - RNA, 22 nt, Bordetella pertussis
ccaguucguccgcuucgucggg

SEQ ID NO: 324341 - RNA, 14 nt, Bordetella pertussis
ccaguucgucgucg

SEQ ID NO: 324342 - RNA, 15 nt, Bordetella pertussis
ccauagcugcgccaa

SEQ ID NO: 324343 - RNA, 15 nt, Bordetella pertussis
ccauaggccagcgcc

SEQ ID NO: 324344 - RNA, 12 nt, Bordetella pertussis
ccauaggcgcgc

SEQ ID NO: 324345 - RNA, 13 nt, Bordetella pertussis
ccauaggcgcgca

SEQ ID NO: 324346 - RNA, 21 nt, Bordetella pertussis
ccauaggcgcgcaccagcccg

SEQ ID NO: 324347 - RNA, 20 nt, Bordetella pertussis
ccauagggcgacugcagcag

SEQ ID NO: 324348 - RNA, 15 nt, Bordetella pertussis
ccauaugccgccggc

SEQ ID NO: 324349 - RNA, 12 nt, Bordetella pertussis
ccauaugcgcga

SEQ ID NO: 324350 - RNA, 22 nt, Bordetella pertussis
ccauauugaugcagcacgucgg

SEQ ID NO: 324351 - RNA, 18 nt, Bordetella pertussis
ccaucaacgggccgcugg

SEQ ID NO: 324352 - RNA, 12 nt, Bordetella pertussis
ccaucaaggcca

SEQ ID NO: 324353 - RNA, 13 nt, Bordetella pertussis
ccaucaccauggc

SEQ ID NO: 324354 - RNA, 15 nt, Bordetella pertussis
ccaucagcucgacca

SEQ ID NO: 324355 - RNA, 15 nt, Bordetella pertussis
ccaucaggaacggca

SEQ ID NO: 324356 - RNA, 12 nt, Bordetella pertussis
ccaucaggccga

SEQ ID NO: 324357 - RNA, 15 nt, Bordetella pertussis
ccaucggcgcgcgcu

SEQ ID NO: 324358 - RNA, 23 nt, Bordetella pertussis
ccaucgggauaccgcuggccagg

SEQ ID NO: 324359 - RNA, 19 nt, Bordetella pertussis
ccaucgucguagcgccagc

SEQ ID NO: 324360 - RNA, 16 nt, Bordetella pertussis
ccaucgugcgcgaucu

SEQ ID NO: 324361 - RNA, 20 nt, Bordetella pertussis
ccaucgugcgcgaucuugcc

SEQ ID NO: 324362 - RNA, 14 nt, Bordetella pertussis
ccaucguugccugg

SEQ ID NO: 324363 - RNA, 14 nt, Bordetella pertussis
ccaucucgcgcgcu

SEQ ID NO: 324364 - RNA, 19 nt, Bordetella pertussis
ccaucucgucggucaugcc

SEQ ID NO: 324365 - RNA, 12 nt, Bordetella pertussis
ccaucugcgagc

SEQ ID NO: 324366 - RNA, 18 nt, Bordetella pertussis
ccaucuggaccgcgcgcg

SEQ ID NO: 324367 - RNA, 21 nt, Bordetella pertussis
ccaugccggguugcaggaugc

SEQ ID NO: 324368 - RNA, 16 nt, Bordetella pertussis
ccaugccguccugcug

SEQ ID NO: 324369 - RNA, 13 nt, Bordetella pertussis
ccaugccgucugg

SEQ ID NO: 324370 - RNA, 17 nt, Bordetella pertussis
ccaugccuugcgcgaca

SEQ ID NO: 324371 - RNA, 22 nt, Bordetella pertussis
ccaugccuugcgcgacagcagg

SEQ ID NO: 324372 - RNA, 20 nt, Bordetella pertussis
ccaugcgaaugaucucgcgc

SEQ ID NO: 324373 - RNA, 18 nt, Bordetella pertussis
ccaugcgauacagcuugg

SEQ ID NO: 324374 - RNA, 21 nt, Bordetella pertussis
ccaugcgauaggcgaagcgcg

SEQ ID NO: 324375 - RNA, 16 nt, Bordetella pertussis
ccaugcgauccagggc

SEQ ID NO: 324376 - RNA, 18 nt, Bordetella pertussis
ccaugcgcaccaggcgcu

SEQ ID NO: 324377 - RNA, 20 nt, Bordetella pertussis
ccaugcgcaccaggcgcucg

SEQ ID NO: 324378 - RNA, 19 nt, Bordetella pertussis
ccaugcgcauggccagcac

SEQ ID NO: 324379 - RNA, 22 nt, Bordetella pertussis
ccaugcgcauggccagcgcgca

SEQ ID NO: 324380 - RNA, 23 nt, Bordetella pertussis
ccaugcgcauggccagcgcgcag

SEQ ID NO: 324381 - RNA, 16 nt, Bordetella pertussis
ccaugcgccagcagga

SEQ ID NO: 324382 - RNA, 12 nt, Bordetella pertussis
ccaugcgcccgg

SEQ ID NO: 324383 - RNA, 17 nt, Bordetella pertussis
ccaugcgcccggccacc

SEQ ID NO: 324384 - RNA, 22 nt, Bordetella pertussis
ccaugcgcgagggcaucagcgc

SEQ ID NO: 324385 - RNA, 21 nt, Bordetella pertussis
ccaugcgcgguugggcgcaca

SEQ ID NO: 324386 - RNA, 16 nt, Bordetella pertussis
ccaugcgcugcgccuu

SEQ ID NO: 324387 - RNA, 16 nt, Bordetella pertussis
ccaugcgcuggcgcaa

SEQ ID NO: 324388 - RNA, 17 nt, Bordetella pertussis
ccaugcgcugggcaugg

SEQ ID NO: 324389 - RNA, 16 nt, Bordetella pertussis
ccaugcggcuggccga

SEQ ID NO: 324390 - RNA, 13 nt, Bordetella pertussis
ccaugcggggaca

SEQ ID NO: 324391 - RNA, 15 nt, Bordetella pertussis
ccaugcggggacagg

SEQ ID NO: 324392 - RNA, 18 nt, Bordetella pertussis
ccaugcggggacuggcac

SEQ ID NO: 324393 - RNA, 21 nt, Bordetella pertussis
ccaugcggggacuggcaccag

SEQ ID NO: 324394 - RNA, 22 nt, Bordetella pertussis
ccaugcggccgucgccgcccau

SEQ ID NO: 324395 - RNA, 21 nt, Bordetella pertussis
ccaugcggcggcgggcggccg

SEQ ID NO: 324396 - RNA, 21 nt, Bordetella pertussis
ccauggcgccggcggccuccg

SEQ ID NO: 324397 - RNA, 12 nt, Bordetella pertussis
ccauggcgcgca

SEQ ID NO: 324398 - RNA, 16 nt, Bordetella pertussis
ccauggcgcgcagcac

SEQ ID NO: 324399 - RNA, 23 nt, Bordetella pertussis
ccaugggaaucugcuugccguuc

SEQ ID NO: 324400 - RNA, 13 nt, Bordetella pertussis
ccauggcgugcca

SEQ ID NO: 324401 - RNA, 21 nt, Bordetella pertussis
ccauggugccccaugcgcggu

SEQ ID NO: 324402 - RNA, 17 nt, Bordetella pertussis
ccauguagauggccgcc

SEQ ID NO: 324403 - RNA, 18 nt, Bordetella pertussis
ccauguagauggccgccu

SEQ ID NO: 324404 - RNA, 22 nt, Bordetella pertussis
ccauguauaacguggcgcgcac

SEQ ID NO: 324405 - RNA, 22 nt, Bordetella pertussis
ccauguccagguagcgccucgc

SEQ ID NO: 324406 - RNA, 15 nt, Bordetella pertussis
ccauguccgcgccca

SEQ ID NO: 324407 - RNA, 18 nt, Bordetella pertussis
ccauguccuggcaggccg

SEQ ID NO: 324408 - RNA, 13 nt, Bordetella pertussis
ccaugugcgccgc

SEQ ID NO: 324409 - RNA, 14 nt, Bordetella pertussis
ccauguggcgcagc

SEQ ID NO: 324410 - RNA, 20 nt, Bordetella pertussis
ccauguggggacaggcaccc

SEQ ID NO: 324411 - RNA, 21 nt, Bordetella pertussis
ccauguucagcuucagccugg

SEQ ID NO: 324412 - RNA, 21 nt, Bordetella pertussis
ccauguugaacugcaggccgc

SEQ ID NO: 324413 - RNA, 16 nt, Bordetella pertussis
ccauugcgcggccagg

SEQ ID NO: 324414 - RNA, 18 nt, Bordetella pertussis
ccauugcgcggccagggc

SEQ ID NO: 324415 - RNA, 18 nt, Bordetella pertussis
ccauugcggcaccugcug

SEQ ID NO: 324416 - RNA, 19 nt, Bordetella pertussis
ccauugggacgccagcccg

SEQ ID NO: 324417 - RNA, 20 nt, Bordetella pertussis
ccauugggacgccagcccgc

SEQ ID NO: 324418 - RNA, 22 nt, Bordetella pertussis
ccauuggugcgcacaucgcccg

SEQ ID NO: 324419 - RNA, 14 nt, Bordetella pertussis
ccauuucgugcgug

SEQ ID NO: 324420 - RNA, 14 nt, Bordetella pertussis
cccaacccaggucg

SEQ ID NO: 324421 - RNA, 13 nt, Bordetella pertussis
cccaacgcggcca

SEQ ID NO: 324422 - RNA, 16 nt, Bordetella pertussis
cccaacgcggccagcg

SEQ ID NO: 324423 - RNA, 16 nt, Bordetella pertussis
cccaacgcggcgucga

SEQ ID NO: 324424 - RNA, 14 nt, Bordetella pertussis
cccaacggccuucg

SEQ ID NO: 324425 - RNA, 22 nt, Bordetella pertussis
cccaagucgaguucggcgcgcc

SEQ ID NO: 324426 - RNA, 22 nt, Bordetella pertussis
cccaaucgggcagcacgcgcac

SEQ ID NO: 324427 - RNA, 23 nt, Bordetella pertussis
cccaauuggccgcccuggcgcga

SEQ ID NO: 324428 - RNA, 17 nt, Bordetella pertussis
cccacagcagcgcgccg

SEQ ID NO: 324429 - RNA, 12 nt, Bordetella pertussis
cccacagcgccc

SEQ ID NO: 324430 - RNA, 13 nt, Bordetella pertussis
cccacagcgcccc

SEQ ID NO: 324431 - RNA, 15 nt, Bordetella pertussis
cccacagcgccccca

SEQ ID NO: 324432 - RNA, 22 nt, Bordetella pertussis
cccacagcgcccccagcacggu

SEQ ID NO: 324433 - RNA, 21 nt, Bordetella pertussis
cccacaggaacaggccggccu

SEQ ID NO: 324434 - RNA, 23 nt, Bordetella pertussis
cccacaggaacaggccggccugg

SEQ ID NO: 324435 - RNA, 16 nt, Bordetella pertussis
cccacaggcgcgcggc

SEQ ID NO: 324436 - RNA, 18 nt, Bordetella pertussis
cccacagggggacuggca

SEQ ID NO: 324437 - RNA, 17 nt, Bordetella pertussis
cccacagguuggccgcg

SEQ ID NO: 324438 - RNA, 21 nt, Bordetella pertussis
cccacagguuggccgcgacga

SEQ ID NO: 324439 - RNA, 15 nt, Bordetella pertussis
cccacauagaccggc

SEQ ID NO: 324440 - RNA, 20 nt, Bordetella pertussis
cccacauagcggccggcgcg

SEQ ID NO: 324441 - RNA, 17 nt, Bordetella pertussis
cccacauggggacuggc

SEQ ID NO: 324442 - RNA, 19 nt, Bordetella pertussis
cccacguggacaggcaccu

SEQ ID NO: 324443 - RNA, 22 nt, Bordetella pertussis
cccacugccaguaggcgcccca

SEQ ID NO: 324444 - RNA, 21 nt, Bordetella pertussis
cccacuggaucgccgaucggc

SEQ ID NO: 324445 - RNA, 17 nt, Bordetella pertussis
cccacugggggacuggc

SEQ ID NO: 324446 - RNA, 18 nt, Bordetella pertussis
cccacugggggacuggca

SEQ ID NO: 324447 - RNA, 19 nt, Bordetella pertussis
cccacugggggacuggcac

SEQ ID NO: 324448 - RNA, 22 nt, Bordetella pertussis
cccacuuccucggcgcgcgcgg

SEQ ID NO: 324449 - RNA, 15 nt, Bordetella pertussis
cccacuugagcagcg

SEQ ID NO: 324450 - RNA, 16 nt, Bordetella pertussis
cccacuugagcagcgc

SEQ ID NO: 324451 - RNA, 18 nt, Bordetella pertussis
cccacuugagcagcgccu

SEQ ID NO: 324452 - RNA, 13 nt, Bordetella pertussis
cccacuuggcgau

SEQ ID NO: 324453 - RNA, 16 nt, Bordetella pertussis
cccagaacccggccgg

SEQ ID NO: 324454 - RNA, 21 nt, Bordetella pertussis
cccagaacccggccggcgccg

SEQ ID NO: 324455 - RNA, 14 nt, Bordetella pertussis
cccagacagccacg

SEQ ID NO: 324456 - RNA, 20 nt, Bordetella pertussis
cccagacagccacgcgcgau

SEQ ID NO: 324457 - RNA, 15 nt, Bordetella pertussis
cccagaccugcgcgc

SEQ ID NO: 324458 - RNA, 16 nt, Bordetella pertussis
cccagaccaagcgcca

SEQ ID NO: 324459 - RNA, 15 nt, Bordetella pertussis
cccagcaugccgaug

SEQ ID NO: 324460 - RNA, 21 nt, Bordetella pertussis
cccagcauggucggcauggcc

SEQ ID NO: 324461 - RNA, 17 nt, Bordetella pertussis
cccagcaugugcgcggc

SEQ ID NO: 324462 - RNA, 16 nt, Bordetella pertussis
cccagccagcccuggc

SEQ ID NO: 324463 - RNA, 18 nt, Bordetella pertussis
cccagccccgcggccgcg

SEQ ID NO: 324464 - RNA, 17 nt, Bordetella pertussis
cccagcccugcccgcac

SEQ ID NO: 324465 - RNA, 16 nt, Bordetella pertussis
cccagccgcagcaggc

SEQ ID NO: 324466 - RNA, 14 nt, Bordetella pertussis
cccagccgcaugcc

SEQ ID NO: 324467 - RNA, 13 nt, Bordetella pertussis
cccagccgcgcca

SEQ ID NO: 324468 - RNA, 15 nt, Bordetella pertussis
cccagccgcgccagg

SEQ ID NO: 324469 - RNA, 12 nt, Bordetella pertussis
cccagccgcucg

SEQ ID NO: 324470 - RNA, 18 nt, Bordetella pertussis
cccagccgcucggccacg

SEQ ID NO: 324471 - RNA, 13 nt, Bordetella pertussis
cccagccggccga

SEQ ID NO: 324472 - RNA, 17 nt, Bordetella pertussis
cccagccggcggcaugc

SEQ ID NO: 324473 - RNA, 18 nt, Bordetella pertussis
cccagccgucgcgcugca

SEQ ID NO: 324474 - RNA, 14 nt, Bordetella pertussis
cccagccugccggc

SEQ ID NO: 324475 - RNA, 15 nt, Bordetella pertussis
cccagcgacgagggc

SEQ ID NO: 324476 - RNA, 13 nt, Bordetella pertussis
cccagcgagcggg

SEQ ID NO: 324477 - RNA, 17 nt, Bordetella pertussis
cccagcgagccggccag

SEQ ID NO: 324478 - RNA, 22 nt, Bordetella pertussis
cccagcgagccggccagcgcca

SEQ ID NO: 324479 - RNA, 13 nt, Bordetella pertussis
cccagcgagucga

SEQ ID NO: 324480 - RNA, 20 nt, Bordetella pertussis
cccagcgcacgcagcgcuca

SEQ ID NO: 324481 - RNA, 22 nt, Bordetella pertussis
cccagcgcauaggacgccacca

SEQ ID NO: 324482 - RNA, 12 nt, Bordetella pertussis
cccagcgccagc

SEQ ID NO: 324483 - RNA, 12 nt, Bordetella pertussis
cccagcgccgcc

SEQ ID NO: 324484 - RNA, 13 nt, Bordetella pertussis
cccagcgccgccg

SEQ ID NO: 324485 - RNA, 13 nt, Bordetella pertussis
cccagcuggcgcc

SEQ ID NO: 324486 - RNA, 15 nt, Bordetella pertussis
cccagcugggccaca

SEQ ID NO: 324487 - RNA, 16 nt, Bordetella pertussis
cccagcugggccacag

SEQ ID NO: 324488 - RNA, 18 nt, Bordetella pertussis
cccagcugggcggcguga

SEQ ID NO: 324489 - RNA, 18 nt, Bordetella pertussis
cccagcuugucggccgcg

SEQ ID NO: 324490 - RNA, 22 nt, Bordetella pertussis
cccagcuugucggccgcgcgca

SEQ ID NO: 324491 - RNA, 17 nt, Bordetella pertussis
cccaggaucaccgccgc

SEQ ID NO: 324492 - RNA, 13 nt, Bordetella pertussis
cccaggccggcgc

SEQ ID NO: 324493 - RNA, 15 nt, Bordetella pertussis
cccaggccggcgcca

SEQ ID NO: 324494 - RNA, 16 nt, Bordetella pertussis
cccaggcgaggcuggc

SEQ ID NO: 324495 - RNA, 17 nt, Bordetella pertussis
cccaggccguggcgcac

SEQ ID NO: 324496 - RNA, 14 nt, Bordetella pertussis
cccaggccucggcu

SEQ ID NO: 324497 - RNA, 17 nt, Bordetella pertussis
cccaggcgaugcccagc

SEQ ID NO: 324498 - RNA, 18 nt, Bordetella pertussis
cccaggcgaugcccagcg

SEQ ID NO: 324499 - RNA, 15 nt, Bordetella pertussis
cccaggcgcagccca

SEQ ID NO: 324500 - RNA, 14 nt, Bordetella pertussis
cccaggcgcagccg

SEQ ID NO: 324501 - RNA, 21 nt, Bordetella pertussis
cccaggcgcagccgcgcgccu

SEQ ID NO: 324502 - RNA, 12 nt, Bordetella pertussis
cccaggcgcgcu

SEQ ID NO: 324503 - RNA, 17 nt, Bordetella pertussis
cccaggcgcgcuggcgc

SEQ ID NO: 324504 - RNA, 21 nt, Bordetella pertussis
cccaggcgcucagccgugccg

SEQ ID NO: 324505 - RNA, 22 nt, Bordetella pertussis
cccaggcgucggcggcccacag

SEQ ID NO: 324506 - RNA, 23 nt, Bordetella pertussis
cccaggcgugaacgccccggccg

SEQ ID NO: 324507 - RNA, 13 nt, Bordetella pertussis
cccagggcgcgcc

SEQ ID NO: 324508 - RNA, 14 nt, Bordetella pertussis
cccagggcgcgccg

SEQ ID NO: 324509 - RNA, 19 nt, Bordetella pertussis
cccagggcuugacgcgcgu

SEQ ID NO: 324510 - RNA, 15 nt, Bordetella pertussis
cccaggggacggcgc

SEQ ID NO: 324511 - RNA, 15 nt, Bordetella pertussis
cccaggggccggcgc

SEQ ID NO: 324512 - RNA, 18 nt, Bordetella pertussis
cccaggguguagaccugc

SEQ ID NO: 324513 - RNA, 22 nt, Bordetella pertussis
cccagggggucagggccgccca

SEQ ID NO: 324514 - RNA, 22 nt, Bordetella pertussis
cccagguacaucauccccagcg

SEQ ID NO: 324515 - RNA, 16 nt, Bordetella pertussis
cccagguaucggccag

SEQ ID NO: 324516 - RNA, 17 nt, Bordetella pertussis
cccagguaucggccagc

SEQ ID NO: 324517 - RNA, 18 nt, Bordetella pertussis
cccagguaucggccagca

SEQ ID NO: 324518 - RNA, 16 nt, Bordetella pertussis
cccaggucaucgccag

SEQ ID NO: 324519 - RNA, 16 nt, Bordetella pertussis
cccagguccagcgcca

SEQ ID NO: 324520 - RNA, 13 nt, Bordetella pertussis
cccagguccgccg

SEQ ID NO: 324521 - RNA, 18 nt, Bordetella pertussis
cccaggucggacgcgccg

SEQ ID NO: 324522 - RNA, 12 nt, Bordetella pertussis
cccaggugccgg

SEQ ID NO: 324523 - RNA, 18 nt, Bordetella pertussis
cccaguuccacgcggccg

SEQ ID NO: 324524 - RNA, 23 nt, Bordetella pertussis
cccaguuccacgcggccguggcg

SEQ ID NO: 324525 - RNA, 15 nt, Bordetella pertussis
cccaguucgcgcagc

SEQ ID NO: 324526 - RNA, 17 nt, Bordetella pertussis
cccaguucgcggccggc

SEQ ID NO: 324527 - RNA, 14 nt, Bordetella pertussis
cccaguucggccgc

SEQ ID NO: 324528 - RNA, 16 nt, Bordetella pertussis
cccaguucggccgcca

SEQ ID NO: 324529 - RNA, 21 nt, Bordetella pertussis
cccaguucggcgcgcgugccg

SEQ ID NO: 324530 - RNA, 20 nt, Bordetella pertussis
cccaguugacgaugcccagg

SEQ ID NO: 324531 - RNA, 23 nt, Bordetella pertussis
cccaguugacgaugcccaggucg

SEQ ID NO: 324532 - RNA, 22 nt, Bordetella pertussis
cccauaguccucuacuggcuga

SEQ ID NO: 324533 - RNA, 14 nt, Bordetella pertussis
cccaucgcgcugac

SEQ ID NO: 324534 - RNA, 15 nt, Bordetella pertussis
cccaucgugcgcgau

SEQ ID NO: 324535 - RNA, 13 nt, Bordetella pertussis
cccaucugccagg

SEQ ID NO: 324536 - RNA, 17 nt, Bordetella pertussis
cccaucuguacggccgg

SEQ ID NO: 324537 - RNA, 21 nt, Bordetella pertussis
cccaucuguacggccggcucc

SEQ ID NO: 324538 - RNA, 14 nt, Bordetella pertussis
cccaucucggccgc

SEQ ID NO: 324539 - RNA, 18 nt, Bordetella pertussis
cccaucucggccgcggcg

SEQ ID NO: 324540 - RNA, 14 nt, Bordetella pertussis
cccaugaaggcggc

SEQ ID NO: 324541 - RNA, 17 nt, Bordetella pertussis
cccaugaaggcggccag

SEQ ID NO: 324542 - RNA, 18 nt, Bordetella pertussis
cccaugaaggcggccagc

SEQ ID NO: 324543 - RNA, 22 nt, Bordetella pertussis
cccaugacgaccuugcggccgc

SEQ ID NO: 324544 - RNA, 18 nt, Bordetella pertussis
cccaugcaguagcgcucg

SEQ ID NO: 324545 - RNA, 13 nt, Bordetella pertussis
cccaugccgcccg

SEQ ID NO: 324546 - RNA, 15 nt, Bordetella pertussis
cccaugcgcauggcc

SEQ ID NO: 324547 - RNA, 18 nt, Bordetella pertussis
cccaugcggggacaggca

SEQ ID NO: 324548 - RNA, 22 nt, Bordetella pertussis
cccaugcggggacaggcacucc

SEQ ID NO: 324549 - RNA, 15 nt, Bordetella pertussis
cccaugcgcggcacg

SEQ ID NO: 324550 - RNA, 15 nt, Bordetella pertussis
cccauggcaugcacc

SEQ ID NO: 324551 - RNA, 12 nt, Bordetella pertussis
cccauggcgcgc

SEQ ID NO: 324552 - RNA, 17 nt, Bordetella pertussis
cccauggggacuggcac

SEQ ID NO: 324553 - RNA, 19 nt, Bordetella pertussis
cccauggggacuggcaccu

SEQ ID NO: 324554 - RNA, 23 nt, Bordetella pertussis
cccauggggacuggcaccugcaa

SEQ ID NO: 324555 - RNA, 22 nt, Bordetella pertussis
cccauggggugcuccugccagg

SEQ ID NO: 324556 - RNA, 18 nt, Bordetella pertussis
cccauguccagguagcgc

SEQ ID NO: 324557 - RNA, 20 nt, Bordetella pertussis
cccauguugaacugcaggcc

SEQ ID NO: 324558 - RNA, 16 nt, Bordetella pertussis
cccauucccgcccuga

SEQ ID NO: 324559 - RNA, 17 nt, Bordetella pertussis
ccccgguagucgccggc

SEQ ID NO: 324560 - RNA, 16 nt, Bordetella pertussis
ccccguagcgcaucgc

SEQ ID NO: 324561 - RNA, 16 nt, Bordetella pertussis
ccccgucaucgccgcg

SEQ ID NO: 324562 - RNA, 13 nt, Bordetella pertussis
ccccgucggcggc

SEQ ID NO: 324563 - RNA, 19 nt, Bordetella pertussis
ccccgucguccguccuggc

SEQ ID NO: 324564 - RNA, 23 nt, Bordetella pertussis
ccccgugccgcggcgcggcccgc

SEQ ID NO: 324565 - RNA, 18 nt, Bordetella pertussis
ccccgugcggggaccggc

SEQ ID NO: 324566 - RNA, 18 nt, Bordetella pertussis
ccccguggggacaggcac

SEQ ID NO: 324567 - RNA, 19 nt, Bordetella pertussis
ccccguggggacgagcucc

SEQ ID NO: 324568 - RNA, 17 nt, Bordetella pertussis
ccccguggucgccagca

SEQ ID NO: 324569 - RNA, 16 nt, Bordetella pertussis
ccccguugucgccgcg

SEQ ID NO: 324570 - RNA, 22 nt, Bordetella pertussis
ccccguugucgccgcggccggc

SEQ ID NO: 324571 - RNA, 14 nt, Bordetella pertussis
ccccugcccgccug

SEQ ID NO: 324572 - RNA, 13 nt, Bordetella pertussis
ccccugcggggac

SEQ ID NO: 324573 - RNA, 16 nt, Bordetella pertussis
ccccugcggggacagg

SEQ ID NO: 324574 - RNA, 19 nt, Bordetella pertussis
ccccugcggggacaggcac

SEQ ID NO: 324575 - RNA, 14 nt, Bordetella pertussis
ccccuugcggccgc

SEQ ID NO: 324576 - RNA, 16 nt, Bordetella pertussis
cccgaaacgcgcagca

SEQ ID NO: 324577 - RNA, 20 nt, Bordetella pertussis
cccgaaacgcgcagcaccgg

SEQ ID NO: 324578 - RNA, 20 nt, Bordetella pertussis
cccgaaacucaccgccgccc

SEQ ID NO: 324579 - RNA, 13 nt, Bordetella pertussis
cccgaaggccgcg

SEQ ID NO: 324580 - RNA, 20 nt, Bordetella pertussis
cccgaaggcgcggccgggcu

SEQ ID NO: 324581 - RNA, 15 nt, Bordetella pertussis
cccgaaggggacugg

SEQ ID NO: 324582 - RNA, 16 nt, Bordetella pertussis
cccgaagguggcccga

SEQ ID NO: 324583 - RNA, 20 nt, Bordetella pertussis
cccgacccuguacaagcgca

SEQ ID NO: 324584 - RNA, 21 nt, Bordetella pertussis
cccgacgaggagccggcgggc

SEQ ID NO: 324585 - RNA, 15 nt, Bordetella pertussis
cccgacgaggccgag

SEQ ID NO: 324586 - RNA, 14 nt, Bordetella pertussis
cccgacggcgccga

SEQ ID NO: 324587 - RNA, 23 nt, Bordetella pertussis
cccgacggcgccgauccggcgca

SEQ ID NO: 324588 - RNA, 15 nt, Bordetella pertussis
cccgacggcgcgccc

SEQ ID NO: 324589 - RNA, 16 nt, Bordetella pertussis
cccgacggcgcgcccg

SEQ ID NO: 324590 - RNA, 16 nt, Bordetella pertussis
cccgacgccgcgcgcg

SEQ ID NO: 324591 - RNA, 23 nt, Bordetella pertussis
cccgacgguaucucagcgcgccg

SEQ ID NO: 324592 - RNA, 18 nt, Bordetella pertussis
cccgagauggcgcaggcg

SEQ ID NO: 324593 - RNA, 22 nt, Bordetella pertussis
cccgagcccuggcuuggccgaa

SEQ ID NO: 324594 - RNA, 13 nt, Bordetella pertussis
cccgagcgccaca

SEQ ID NO: 324595 - RNA, 12 nt, Bordetella pertussis
cccgagcgcgac

SEQ ID NO: 324596 - RNA, 17 nt, Bordetella pertussis
cccgagcgcucccgcca

SEQ ID NO: 324597 - RNA, 15 nt, Bordetella pertussis
cccgagcgggcaugg

SEQ ID NO: 324598 - RNA, 21 nt, Bordetella pertussis
cccgagcgggcaugggcccca

SEQ ID NO: 324599 - RNA, 22 nt, Bordetella pertussis
cccgaggcgcgcagcacgccga

SEQ ID NO: 324600 - RNA, 16 nt, Bordetella pertussis
cccgaggcggcgcggg

SEQ ID NO: 324601 - RNA, 18 nt, Bordetella pertussis
cccgagggcgcggcgccg

SEQ ID NO: 324602 - RNA, 15 nt, Bordetella pertussis
cccgagggcgcgucg

SEQ ID NO: 324603 - RNA, 20 nt, Bordetella pertussis
cccgaguccuugacgccgcc

SEQ ID NO: 324604 - RNA, 23 nt, Bordetella pertussis
cccgaguccuugacgccgccgaa

SEQ ID NO: 324605 - RNA, 17 nt, Bordetella pertussis
cccgaguugaggaugcg

SEQ ID NO: 324606 - RNA, 19 nt, Bordetella pertussis
cccgauacaaggugccugu

SEQ ID NO: 324607 - RNA, 21 nt, Bordetella pertussis
cccgauacgacacgccgcgcg

SEQ ID NO: 324608 - RNA, 18 nt, Bordetella pertussis
cccgauagccgcgcgccu

SEQ ID NO: 324609 - RNA, 19 nt, Bordetella pertussis
cccgaugccgauacgucgc

SEQ ID NO: 324610 - RNA, 17 nt, Bordetella pertussis
cccgaugcgccucggcg

SEQ ID NO: 324611 - RNA, 14 nt, Bordetella pertussis
cccgaugcucgccg

SEQ ID NO: 324612 - RNA, 16 nt, Bordetella pertussis
cccgaugcucgccggc

SEQ ID NO: 324613 - RNA, 18 nt, Bordetella pertussis
cccgaugcucgccggcgc

SEQ ID NO: 324614 - RNA, 19 nt, Bordetella pertussis
cccgaugcucgccggcgcc

SEQ ID NO: 324615 - RNA, 20 nt, Bordetella pertussis
cccgaugcucgccggcgccg

SEQ ID NO: 324616 - RNA, 20 nt, Bordetella pertussis
cccgauggucacacugucgc

SEQ ID NO: 324617 - RNA, 22 nt, Bordetella pertussis
cccgauggucacacugucgcca

SEQ ID NO: 324618 - RNA, 22 nt, Bordetella pertussis
cccgauuccaggacgacaggca

SEQ ID NO: 324619 - RNA, 23 nt, Bordetella pertussis
cccgauuccaggacgacaggcau

SEQ ID NO: 324620 - RNA, 17 nt, Bordetella pertussis
cccgcaaaaccgggccc

SEQ ID NO: 324621 - RNA, 19 nt, Bordetella pertussis
cccgcaaggggccggcgcc

SEQ ID NO: 324622 - RNA, 17 nt, Bordetella pertussis
cccgcaagggggacugg

SEQ ID NO: 324623 - RNA, 23 nt, Bordetella pertussis
cccgcagguggggcagcaggccg

SEQ ID NO: 324624 - RNA, 18 nt, Bordetella pertussis
cccgcaguacccggugca

SEQ ID NO: 324625 - RNA, 16 nt, Bordetella pertussis
cccgcauagacgccga

SEQ ID NO: 324626 - RNA, 20 nt, Bordetella pertussis
cccgcauagacgccgaccgc

SEQ ID NO: 324627 - RNA, 16 nt, Bordetella pertussis
cccgcaucgcgcgccg

SEQ ID NO: 324628 - RNA, 13 nt, Bordetella pertussis
cccgcaugcgcag

SEQ ID NO: 324629 - RNA, 17 nt, Bordetella pertussis
cccgcaugguggcgcag

SEQ ID NO: 324630 - RNA, 20 nt, Bordetella pertussis
cccgcaugguggcgcaggca

SEQ ID NO: 324631 - RNA, 18 nt, Bordetella pertussis
cccgcauugaucgaucag

SEQ ID NO: 324632 - RNA, 19 nt, Bordetella pertussis
cccgccaccacgcgcacca

SEQ ID NO: 324633 - RNA, 16 nt, Bordetella pertussis
cccgccacgcgggccg

SEQ ID NO: 324634 - RNA, 22 nt, Bordetella pertussis
cccgccacggcggugcugaacg

SEQ ID NO: 324635 - RNA, 13 nt, Bordetella pertussis
cccgccacggucg

SEQ ID NO: 324636 - RNA, 20 nt, Bordetella pertussis
cccgccaggcgaaccuggcg

SEQ ID NO: 324637 - RNA, 21 nt, Bordetella pertussis
cccgccauccuggccgccgcg

SEQ ID NO: 324638 - RNA, 21 nt, Bordetella pertussis
cccgccauugcacgcgcagga

SEQ ID NO: 324639 - RNA, 13 nt, Bordetella pertussis
cccgcccacgcgg

SEQ ID NO: 324640 - RNA, 15 nt, Bordetella pertussis
cccgcccacgcggcg

SEQ ID NO: 324641 - RNA, 17 nt, Bordetella pertussis
cccgcccacgcggcgcu

SEQ ID NO: 324642 - RNA, 21 nt, Bordetella pertussis
cccgcccagcgagucgaccag

SEQ ID NO: 324643 - RNA, 18 nt, Bordetella pertussis
cccgcccagcauccgcgc

SEQ ID NO: 324644 - RNA, 23 nt, Bordetella pertussis
cccgccccauugggacgccagcc

SEQ ID NO: 324645 - RNA, 14 nt, Bordetella pertussis
cccgccccggcgca

SEQ ID NO: 324646 - RNA, 19 nt, Bordetella pertussis
cccgcccgcugaccggccu

SEQ ID NO: 324647 - RNA, 21 nt, Bordetella pertussis
cccgccggcgcgcgcgcgccg

SEQ ID NO: 324648 - RNA, 20 nt, Bordetella pertussis
cccgccgggccaaggugccu

SEQ ID NO: 324649 - RNA, 22 nt, Bordetella pertussis
cccgcgacccagaacccggccg

SEQ ID NO: 324650 - RNA, 23 nt, Bordetella pertussis
cccgcgacccagaacccggccgg

SEQ ID NO: 324651 - RNA, 13 nt, Bordetella pertussis
cccgcgcgcacgu

SEQ ID NO: 324652 - RNA, 13 nt, Bordetella pertussis
cccgcgcgcagcg

SEQ ID NO: 324653 - RNA, 14 nt, Bordetella pertussis
cccgcgcgcgagca

SEQ ID NO: 324654 - RNA, 15 nt, Bordetella pertussis
cccgcgcggccagcg

SEQ ID NO: 324655 - RNA, 18 nt, Bordetella pertussis
cccgcgcggccagcgccg

SEQ ID NO: 324656 - RNA, 16 nt, Bordetella pertussis
cccgcgucggacgcgc

SEQ ID NO: 324657 - RNA, 21 nt, Bordetella pertussis
cccgcgucggcgaagcugucc

SEQ ID NO: 324658 - RNA, 14 nt, Bordetella pertussis
cccgcgucggcgcg

SEQ ID NO: 324659 - RNA, 16 nt, Bordetella pertussis
cccgcgucggcgcggu

SEQ ID NO: 324660 - RNA, 13 nt, Bordetella pertussis
cccgcgucugggc

SEQ ID NO: 324661 - RNA, 20 nt, Bordetella pertussis
cccgcgucuuggcgggcacc

SEQ ID NO: 324662 - RNA, 14 nt, Bordetella pertussis
cccgcgugacggcc

SEQ ID NO: 324663 - RNA, 13 nt, Bordetella pertussis
cccgcgugccugu

SEQ ID NO: 324664 - RNA, 22 nt, Bordetella pertussis
cccgcgugccuguccccgcaag

SEQ ID NO: 324665 - RNA, 12 nt, Bordetella pertussis
cccgcucggcca

SEQ ID NO: 324666 - RNA, 15 nt, Bordetella pertussis
cccgcuggcggcaca

SEQ ID NO: 324667 - RNA, 22 nt, Bordetella pertussis
cccgcuggcuggcagcgaccgc

SEQ ID NO: 324668 - RNA, 18 nt, Bordetella pertussis
cccgcugggacaggcaca

SEQ ID NO: 324669 - RNA, 19 nt, Bordetella pertussis
cccgcugggacaggcacuc

SEQ ID NO: 324670 - RNA, 15 nt, Bordetella pertussis
cccgcugggccagca

SEQ ID NO: 324671 - RNA, 13 nt, Bordetella pertussis
cccgcuuccugcu

SEQ ID NO: 324672 - RNA, 15 nt, Bordetella pertussis
cccgcuuccugcugc

SEQ ID NO: 324673 - RNA, 16 nt, Bordetella pertussis
cccgcuuccugcugcg

SEQ ID NO: 324674 - RNA, 12 nt, Bordetella pertussis
cccgcuucgggc

SEQ ID NO: 324675 - RNA, 19 nt, Bordetella pertussis
cccgcuucucacugcccgc

SEQ ID NO: 324676 - RNA, 21 nt, Bordetella pertussis
cccgcuucucacugcccgcgc

SEQ ID NO: 324677 - RNA, 22 nt, Bordetella pertussis
cccgcuucucacugcccgcgcc

SEQ ID NO: 324678 - RNA, 16 nt, Bordetella pertussis
cccgcuugcggccggc

SEQ ID NO: 324679 - RNA, 16 nt, Bordetella pertussis
cccgcuugggccgcgc

SEQ ID NO: 324680 - RNA, 16 nt, Bordetella pertussis
cccggauauggccggc

SEQ ID NO: 324681 - RNA, 17 nt, Bordetella pertussis
cccggauauggccggcg

SEQ ID NO: 324682 - RNA, 19 nt, Bordetella pertussis
cccggauauggccggcgcg

SEQ ID NO: 324683 - RNA, 14 nt, Bordetella pertussis
cccggcgcaugcug

SEQ ID NO: 324684 - RNA, 12 nt, Bordetella pertussis
cccggcgccagc

SEQ ID NO: 324685 - RNA, 13 nt, Bordetella pertussis
cccggcgccagcc

SEQ ID NO: 324686 - RNA, 12 nt, Bordetella pertussis
cccggcgccgcg

SEQ ID NO: 324687 - RNA, 11 nt, Bordetella pertussis
cccggcgcgca

SEQ ID NO: 324688 - RNA, 14 nt, Bordetella pertussis
cccggcgcgcagcg

SEQ ID NO: 324689 - RNA, 14 nt, Bordetella pertussis
cccggcgcgccacc

SEQ ID NO: 324690 - RNA, 21 nt, Bordetella pertussis
cccggcgcgccuuacgcggcg

SEQ ID NO: 324691 - RNA, 12 nt, Bordetella pertussis
cccggcgcggcg

SEQ ID NO: 324692 - RNA, 12 nt, Bordetella pertussis
cccggcgcuggc

SEQ ID NO: 324693 - RNA, 14 nt, Bordetella pertussis
cccggcgcuggccg

SEQ ID NO: 324694 - RNA, 15 nt, Bordetella pertussis
cccggcgcuggccgc

SEQ ID NO: 324695 - RNA, 17 nt, Bordetella pertussis
cccggcgcuggccgcca

SEQ ID NO: 324696 - RNA, 19 nt, Bordetella pertussis
cccggcggccaggccggcg

SEQ ID NO: 324697 - RNA, 20 nt, Bordetella pertussis
cccggcggccaggccggcgc

SEQ ID NO: 324698 - RNA, 16 nt, Bordetella pertussis
cccggcugcgcggccg

SEQ ID NO: 324699 - RNA, 22 nt, Bordetella pertussis
cccggcugcucguucugcgcgc

SEQ ID NO: 324700 - RNA, 19 nt, Bordetella pertussis
cccggcuucugggucagcu

SEQ ID NO: 324701 - RNA, 21 nt, Bordetella pertussis
cccggcuucgaucaugcccgc

SEQ ID NO: 324702 - RNA, 20 nt, Bordetella pertussis
cccgggaaacucgcgcagcg

SEQ ID NO: 324703 - RNA, 22 nt, Bordetella pertussis
cccgggcaugcgaaagccggcc

SEQ ID NO: 324704 - RNA, 23 nt, Bordetella pertussis
cccgggcaugcgaaagccggccu

SEQ ID NO: 324705 - RNA, 16 nt, Bordetella pertussis
cccgggcuggccgccu

SEQ ID NO: 324706 - RNA, 20 nt, Bordetella pertussis
cccgggcuggccgccugcug

SEQ ID NO: 324707 - RNA, 22 nt, Bordetella pertussis
cccgggcuggccgccugcugcg

SEQ ID NO: 324708 - RNA, 21 nt, Bordetella pertussis
cccggggcaggaagccggccc

SEQ ID NO: 324709 - RNA, 23 nt, Bordetella pertussis
cccgggguugggaucgcgccagg

SEQ ID NO: 324710 - RNA, 19 nt, Bordetella pertussis
cccgggguucuggcaggug

SEQ ID NO: 324711 - RNA, 12 nt, Bordetella pertussis
cccggucggccc

SEQ ID NO: 324712 - RNA, 19 nt, Bordetella pertussis
cccggugaucaugccgcug

SEQ ID NO: 324713 - RNA, 22 nt, Bordetella pertussis
cccggugaucgaguaggccggc

SEQ ID NO: 324714 - RNA, 13 nt, Bordetella pertussis
cccggugccgaag

SEQ ID NO: 324715 - RNA, 17 nt, Bordetella pertussis
cccggugcagccgccgc

SEQ ID NO: 324716 - RNA, 18 nt, Bordetella pertussis
cccgguuggggucgcgcu

SEQ ID NO: 324717 - RNA, 23 nt, Bordetella pertussis
cccguacgucaaggccugcccgg

SEQ ID NO: 324718 - RNA, 13 nt, Bordetella pertussis
cccgucagcggcg

SEQ ID NO: 324719 - RNA, 19 nt, Bordetella pertussis
cccgucaggguacgcucga

SEQ ID NO: 324720 - RNA, 21 nt, Bordetella pertussis
cccgucagcacggucggcgcg

SEQ ID NO: 324721 - RNA, 18 nt, Bordetella pertussis
cccgucauggcggcaggc

SEQ ID NO: 324722 - RNA, 16 nt, Bordetella pertussis
cccguccacggccugc

SEQ ID NO: 324723 - RNA, 22 nt, Bordetella pertussis
cccguccacggccugcgcgccg

SEQ ID NO: 324724 - RNA, 17 nt, Bordetella pertussis
cccguccuuggcguccg

SEQ ID NO: 324725 - RNA, 21 nt, Bordetella pertussis
cccguccuuggcguccggccc

SEQ ID NO: 324726 - RNA, 12 nt, Bordetella pertussis
cccgucgcgcca

SEQ ID NO: 324727 - RNA, 17 nt, Bordetella pertussis
cccgucgcgccaggccg

SEQ ID NO: 324728 - RNA, 15 nt, Bordetella pertussis
cccgucgcuggcgcg

SEQ ID NO: 324729 - RNA, 23 nt, Bordetella pertussis
cccgucgggcaggucggcgcggg

SEQ ID NO: 324730 - RNA, 22 nt, Bordetella pertussis
cccgucucgcgcgccaggugca

SEQ ID NO: 324731 - RNA, 23 nt, Bordetella pertussis
cccgugccgcagaagaacaccgu

SEQ ID NO: 324732 - RNA, 20 nt, Bordetella pertussis
cccgugccgcggcgcggccc

SEQ ID NO: 324733 - RNA, 18 nt, Bordetella pertussis
cccgugcgugcgccuguc

SEQ ID NO: 324734 - RNA, 19 nt, Bordetella pertussis
cccgugcgugcgccugucc

SEQ ID NO: 324735 - RNA, 19 nt, Bordetella pertussis
cccgugcgugugccugucc

SEQ ID NO: 324736 - RNA, 19 nt, Bordetella pertussis
cccgugcgggugccugucc

SEQ ID NO: 324737 - RNA, 13 nt, Bordetella pertussis
cccuccggcgccg

SEQ ID NO: 324738 - RNA, 18 nt, Bordetella pertussis
cccuccucggccaggucg

SEQ ID NO: 324739 - RNA, 17 nt, Bordetella pertussis
cccucggucagcgccag

SEQ ID NO: 324740 - RNA, 18 nt, Bordetella pertussis
cccucggucagcgccagg

SEQ ID NO: 324741 - RNA, 20 nt, Bordetella pertussis
cccucggugcggaagacgau

SEQ ID NO: 324742 - RNA, 16 nt, Bordetella pertussis
cccucggugcugcugu

SEQ ID NO: 324743 - RNA, 15 nt, Bordetella pertussis
cccucgucgcggccg

SEQ ID NO: 324744 - RNA, 17 nt, Bordetella pertussis
cccucguugacgccgac

SEQ ID NO: 324745 - RNA, 15 nt, Bordetella pertussis
cccugacgccugcgc

SEQ ID NO: 324746 - RNA, 21 nt, Bordetella pertussis
cccugccaugccccauccagc

SEQ ID NO: 324747 - RNA, 12 nt, Bordetella pertussis
cccugcccggca

SEQ ID NO: 324748 - RNA, 15 nt, Bordetella pertussis
cccugcccugcggcu

SEQ ID NO: 324749 - RNA, 21 nt, Bordetella pertussis
cccugccgaucaagagccugg

SEQ ID NO: 324750 - RNA, 13 nt, Bordetella pertussis
cccugccgccuca

SEQ ID NO: 324751 - RNA, 18 nt, Bordetella pertussis
cccugccgggacaggcac

SEQ ID NO: 324752 - RNA, 15 nt, Bordetella pertussis
cccugccgugggaca

SEQ ID NO: 324753 - RNA, 17 nt, Bordetella pertussis
cccugccgugggacagg

SEQ ID NO: 324754 - RNA, 17 nt, Bordetella pertussis
cccugccuccaggcgca

SEQ ID NO: 324755 - RNA, 19 nt, Bordetella pertussis
cccugcgccagcgccucgc

SEQ ID NO: 324756 - RNA, 18 nt, Bordetella pertussis
cccugcgcgaggugccgg

SEQ ID NO: 324757 - RNA, 15 nt, Bordetella pertussis
cccugcgcgccgccg

SEQ ID NO: 324758 - RNA, 18 nt, Bordetella pertussis
cccugcgcguacguggcg

SEQ ID NO: 324759 - RNA, 20 nt, Bordetella pertussis
cccuggaugccaugccgggc

SEQ ID NO: 324760 - RNA, 16 nt, Bordetella pertussis
cccuggauggcggccg

SEQ ID NO: 324761 - RNA, 23 nt, Bordetella pertussis
cccuggauggcggccgccagcgc

SEQ ID NO: 324762 - RNA, 13 nt, Bordetella pertussis
cccuggcagcugg

SEQ ID NO: 324763 - RNA, 16 nt, Bordetella pertussis
cccuggcagcuggcgc

SEQ ID NO: 324764 - RNA, 22 nt, Bordetella pertussis
cccuggaucaggaugggcgcgg

SEQ ID NO: 324765 - RNA, 23 nt, Bordetella pertussis
cccuggaucaggaugggcgcggc

SEQ ID NO: 324766 - RNA, 14 nt, Bordetella pertussis
cccuggccacgcug

SEQ ID NO: 324767 - RNA, 13 nt, Bordetella pertussis
cccuggcccuggc

SEQ ID NO: 324768 - RNA, 15 nt, Bordetella pertussis
cccuggccgaacgcc

SEQ ID NO: 324769 - RNA, 17 nt, Bordetella pertussis
cccuggccgaacgccgc

SEQ ID NO: 324770 - RNA, 19 nt, Bordetella pertussis
cccuggccgaacgccgccg

SEQ ID NO: 324771 - RNA, 20 nt, Bordetella pertussis
cccuggccgaacgccgccgc

SEQ ID NO: 324772 - RNA, 12 nt, Bordetella pertussis
cccuggccgcgc

SEQ ID NO: 324773 - RNA, 14 nt, Bordetella pertussis
cccuggccgcgccg

SEQ ID NO: 324774 - RNA, 22 nt, Bordetella pertussis
cccuggcgcgaggcggcgacgc

SEQ ID NO: 324775 - RNA, 15 nt, Bordetella pertussis
cccuggcgcgccagc

SEQ ID NO: 324776 - RNA, 19 nt, Bordetella pertussis
cccuggcgcaggccggcgg

SEQ ID NO: 324777 - RNA, 20 nt, Bordetella pertussis
cccuggcguggcgcgcgccg

SEQ ID NO: 324778 - RNA, 20 nt, Bordetella pertussis
cccuggcuggccagccggcc

SEQ ID NO: 324779 - RNA, 15 nt, Bordetella pertussis
cccuggcuuggccga

SEQ ID NO: 324780 - RNA, 21 nt, Bordetella pertussis
cccugggccagcagcuggcgc

SEQ ID NO: 324781 - RNA, 18 nt, Bordetella pertussis
cccugggccagccagcgc

SEQ ID NO: 324782 - RNA, 16 nt, Bordetella pertussis
cccuggggccgcggcg

SEQ ID NO: 324783 - RNA, 17 nt, Bordetella pertussis
cccuggggccgcggcgc

SEQ ID NO: 324784 - RNA, 12 nt, Bordetella pertussis
cccugggugagc

SEQ ID NO: 324785 - RNA, 18 nt, Bordetella pertussis
cccuggguggcggggcgc

SEQ ID NO: 324786 - RNA, 15 nt, Bordetella pertussis
cccugguacgaucag

SEQ ID NO: 324787 - RNA, 21 nt, Bordetella pertussis
cccuguacaagcgcacgcugg

SEQ ID NO: 324788 - RNA, 17 nt, Bordetella pertussis
ccgaaacucaccgccgc

SEQ ID NO: 324789 - RNA, 21 nt, Bordetella pertussis
ccgaaagacugcggcgcgaag

SEQ ID NO: 324790 - RNA, 14 nt, Bordetella pertussis
ccgaaccacccggc

SEQ ID NO: 324791 - RNA, 13 nt, Bordetella pertussis
ccgaacgaggcgc

SEQ ID NO: 324792 - RNA, 15 nt, Bordetella pertussis
ccgaagccgccgccg

SEQ ID NO: 324793 - RNA, 22 nt, Bordetella pertussis
ccgaagcgcagcaccaggucga

SEQ ID NO: 324794 - RNA, 14 nt, Bordetella pertussis
ccgaagcgcaggcc

SEQ ID NO: 324795 - RNA, 12 nt, Bordetella pertussis
ccgaagcgcggg

SEQ ID NO: 324796 - RNA, 13 nt, Bordetella pertussis
ccgaagcggcguu

SEQ ID NO: 324797 - RNA, 20 nt, Bordetella pertussis
ccgaagcggcguucugcagc

SEQ ID NO: 324798 - RNA, 15 nt, Bordetella pertussis
ccgaagcgggcgagg

SEQ ID NO: 324799 - RNA, 18 nt, Bordetella pertussis
ccgaaucguucacgcccg

SEQ ID NO: 324800 - RNA, 23 nt, Bordetella pertussis
ccgaauuccggcucggaccuggc

SEQ ID NO: 324801 - RNA, 15 nt, Bordetella pertussis
ccgaauugccgccgc

SEQ ID NO: 324802 - RNA, 13 nt, Bordetella pertussis
ccgacaacggcgu

SEQ ID NO: 324803 - RNA, 15 nt, Bordetella pertussis
ccgacgaugucgccg

SEQ ID NO: 324804 - RNA, 19 nt, Bordetella pertussis
ccgacgaugucgccgccgc

SEQ ID NO: 324805 - RNA, 12 nt, Bordetella pertussis
ccgacgccagcg

SEQ ID NO: 324806 - RNA, 15 nt, Bordetella pertussis
ccgacgccgcgcgcg

SEQ ID NO: 324807 - RNA, 12 nt, Bordetella pertussis
ccgacgcgccgg

SEQ ID NO: 324808 - RNA, 14 nt, Bordetella pertussis
ccgacgcgccgggc

SEQ ID NO: 324809 - RNA, 16 nt, Bordetella pertussis
ccgacgcggccagcgg

SEQ ID NO: 324810 - RNA, 15 nt, Bordetella pertussis
ccgacgcggucgccc

SEQ ID NO: 324811 - RNA, 17 nt, Bordetella pertussis
ccgacggcauggccggc

SEQ ID NO: 324812 - RNA, 14 nt, Bordetella pertussis
ccgacggcgcggcg

SEQ ID NO: 324813 - RNA, 20 nt, Bordetella pertussis
ccgacggcgcggcgaucggc

SEQ ID NO: 324814 - RNA, 22 nt, Bordetella pertussis
ccgacggcggcgcggcgccagc

SEQ ID NO: 324815 - RNA, 21 nt, Bordetella pertussis
ccgacggcucgcgcucgcccg

SEQ ID NO: 324816 - RNA, 15 nt, Bordetella pertussis
ccgacggcgcgcccg

SEQ ID NO: 324817 - RNA, 14 nt, Bordetella pertussis
ccgacgggugggug

SEQ ID NO: 324818 - RNA, 22 nt, Bordetella pertussis
ccgacgguaucucagcgcgccg

SEQ ID NO: 324819 - RNA, 19 nt, Bordetella pertussis
ccgacguagucgcgccagc

SEQ ID NO: 324820 - RNA, 14 nt, Bordetella pertussis
ccgacgugcgccgc

SEQ ID NO: 324821 - RNA, 12 nt, Bordetella pertussis
ccgacgugcugc

SEQ ID NO: 324822 - RNA, 22 nt, Bordetella pertussis
ccgacucgaaacgggcggcguc

SEQ ID NO: 324823 - RNA, 14 nt, Bordetella pertussis
ccgacugcgcaugg

SEQ ID NO: 324824 - RNA, 20 nt, Bordetella pertussis
ccgacugcuguacgacagca

SEQ ID NO: 324825 - RNA, 18 nt, Bordetella pertussis
ccgacugggugcgccuga

SEQ ID NO: 324826 - RNA, 20 nt, Bordetella pertussis
ccgacuucagacagacgcug

SEQ ID NO: 324827 - RNA, 22 nt, Bordetella pertussis
ccgacuucuggggugccugucc

SEQ ID NO: 324828 - RNA, 14 nt, Bordetella pertussis
ccgagaccgcccgc

SEQ ID NO: 324829 - RNA, 16 nt, Bordetella pertussis
ccgagaccuucggcca

SEQ ID NO: 324830 - RNA, 20 nt, Bordetella pertussis
ccgagacgcugucgcgcccg

SEQ ID NO: 324831 - RNA, 16 nt, Bordetella pertussis
ccgagacggccgccga

SEQ ID NO: 324832 - RNA, 16 nt, Bordetella pertussis
ccgagauaggcggcca

SEQ ID NO: 324833 - RNA, 18 nt, Bordetella pertussis
ccgagauaggcggccagg

SEQ ID NO: 324834 - RNA, 21 nt, Bordetella pertussis
ccgagauggcgcaggcgcgcg

SEQ ID NO: 324835 - RNA, 15 nt, Bordetella pertussis
ccgagaugugcggcg

SEQ ID NO: 324836 - RNA, 17 nt, Bordetella pertussis
ccgagaugugcggcgug

SEQ ID NO: 324837 - RNA, 20 nt, Bordetella pertussis
ccgagaugugcggcguggcg

SEQ ID NO: 324838 - RNA, 21 nt, Bordetella pertussis
ccgagccgaaguacacggcca

SEQ ID NO: 324839 - RNA, 16 nt, Bordetella pertussis
ccgagccgcaggucca

SEQ ID NO: 324840 - RNA, 21 nt, Bordetella pertussis
ccgagccgccccggcgcggcg

SEQ ID NO: 324841 - RNA, 22 nt, Bordetella pertussis
ccgagccgccccggcgcggcgc

SEQ ID NO: 324842 - RNA, 17 nt, Bordetella pertussis
ccgagccggccagcgcc

SEQ ID NO: 324843 - RNA, 18 nt, Bordetella pertussis
ccgagccggccagcgccu

SEQ ID NO: 324844 - RNA, 14 nt, Bordetella pertussis
ccgagcgcaccccg

SEQ ID NO: 324845 - RNA, 23 nt, Bordetella pertussis
ccgagcgccacauaaucgucggc

SEQ ID NO: 324846 - RNA, 15 nt, Bordetella pertussis
ccgagcgcgagcagg

SEQ ID NO: 324847 - RNA, 12 nt, Bordetella pertussis
ccgagcgcgcca

SEQ ID NO: 324848 - RNA, 17 nt, Bordetella pertussis
ccgagcgcgccagcacg

SEQ ID NO: 324849 - RNA, 13 nt, Bordetella pertussis
ccgagcgcgcccg

SEQ ID NO: 324850 - RNA, 11 nt, Bordetella pertussis
ccgagcgcggc

SEQ ID NO: 324851 - RNA, 17 nt, Bordetella pertussis
ccgagcgcggcaugcgc

SEQ ID NO: 324852 - RNA, 15 nt, Bordetella pertussis
ccgagcggcaucugc

SEQ ID NO: 324853 - RNA, 13 nt, Bordetella pertussis
ccgagcggcgcca

SEQ ID NO: 324854 - RNA, 16 nt, Bordetella pertussis
ccgagcgggccagcgc

SEQ ID NO: 324855 - RNA, 17 nt, Bordetella pertussis
ccgagcgggccagcgcg

SEQ ID NO: 324856 - RNA, 19 nt, Bordetella pertussis
ccgagcgggccagcgcggc

SEQ ID NO: 324857 - RNA, 20 nt, Bordetella pertussis
ccgagcgggcccgacagcgc

SEQ ID NO: 324858 - RNA, 22 nt, Bordetella pertussis
ccgagcgggcccgacagcgccc

SEQ ID NO: 324859 - RNA, 15 nt, Bordetella pertussis
ccgagcggggccgcg

SEQ ID NO: 324860 - RNA, 16 nt, Bordetella pertussis
ccgaggcacaaggccg

SEQ ID NO: 324861 - RNA, 17 nt, Bordetella pertussis
ccgaggccaccuuggcc

SEQ ID NO: 324862 - RNA, 20 nt, Bordetella pertussis
ccgaggccagcgugcccagc

SEQ ID NO: 324863 - RNA, 13 nt, Bordetella pertussis
ccgaggccugcug

SEQ ID NO: 324864 - RNA, 18 nt, Bordetella pertussis
ccgaggcgggcagcaugg

SEQ ID NO: 324865 - RNA, 23 nt, Bordetella pertussis
ccgaggcgggcagcauggcgcca

SEQ ID NO: 324866 - RNA, 16 nt, Bordetella pertussis
ccgaggcggucgauga

SEQ ID NO: 324867 - RNA, 17 nt, Bordetella pertussis
ccgagggcgcggcgccg

SEQ ID NO: 324868 - RNA, 14 nt, Bordetella pertussis
ccgagggcgcggcg

SEQ ID NO: 324869 - RNA, 19 nt, Bordetella pertussis
ccgaguccuugacgccgcc

SEQ ID NO: 324870 - RNA, 20 nt, Bordetella pertussis
ccgaguccuugacgccgccg

SEQ ID NO: 324871 - RNA, 23 nt, Bordetella pertussis
ccgagucgaacuuuucgucgucg

SEQ ID NO: 324872 - RNA, 14 nt, Bordetella pertussis
ccgaguggccgcug

SEQ ID NO: 324873 - RNA, 19 nt, Bordetella pertussis
ccgaguucgacucucgggg

SEQ ID NO: 324874 - RNA, 23 nt, Bordetella pertussis
ccgauacaaggugccuguccccg

SEQ ID NO: 324875 - RNA, 16 nt, Bordetella pertussis
ccgauaccacgcgcgg

SEQ ID NO: 324876 - RNA, 17 nt, Bordetella pertussis
ccgauaccacgcgcggc

SEQ ID NO: 324877 - RNA, 18 nt, Bordetella pertussis
ccgauaccacgcgcggcg

SEQ ID NO: 324878 - RNA, 17 nt, Bordetella pertussis
ccgauacgacacgccgc

SEQ ID NO: 324879 - RNA, 21 nt, Bordetella pertussis
ccgauacgacacgccgcgcga

SEQ ID NO: 324880 - RNA, 17 nt, Bordetella pertussis
ccgauacgggcgcggcg

SEQ ID NO: 324881 - RNA, 22 nt, Bordetella pertussis
ccgauacgucgcagcacgccca

SEQ ID NO: 324882 - RNA, 15 nt, Bordetella pertussis
ccgauagccgcgcgc

SEQ ID NO: 324883 - RNA, 16 nt, Bordetella pertussis
ccgauagccgcggcgc

SEQ ID NO: 324884 - RNA, 18 nt, Bordetella pertussis
ccgauagccgcggcgccg

SEQ ID NO: 324885 - RNA, 16 nt, Bordetella pertussis
ccgauagcggcgccgc

SEQ ID NO: 324886 - RNA, 19 nt, Bordetella pertussis
ccgauaucgauaccaacug

SEQ ID NO: 324887 - RNA, 16 nt, Bordetella pertussis
ccgauaugccaaggau

SEQ ID NO: 324888 - RNA, 20 nt, Bordetella pertussis
ccgaucagcaccacggcggc

SEQ ID NO: 324889 - RNA, 15 nt, Bordetella pertussis
ccgaucagccggcca

SEQ ID NO: 324890 - RNA, 15 nt, Bordetella pertussis
ccgauccagcccgcg

SEQ ID NO: 324891 - RNA, 14 nt, Bordetella pertussis
ccgauccgcgacgc

SEQ ID NO: 324892 - RNA, 11 nt, Bordetella pertussis
ccgaucgagca

SEQ ID NO: 324893 - RNA, 18 nt, Bordetella pertussis
ccgaucgagcaggccgcc

SEQ ID NO: 324894 - RNA, 15 nt, Bordetella pertussis
ccgaucgacggccgc

SEQ ID NO: 324895 - RNA, 19 nt, Bordetella pertussis
ccgaucgcgcacagcaugg

SEQ ID NO: 324896 - RNA, 17 nt, Bordetella pertussis
ccgaucgcggcuccagc

SEQ ID NO: 324897 - RNA, 13 nt, Bordetella pertussis
ccgaucggcgccg

SEQ ID NO: 324898 - RNA, 18 nt, Bordetella pertussis
ccgaucgugcacgcccgc

SEQ ID NO: 324899 - RNA, 22 nt, Bordetella pertussis
ccgaucgugcacgcccgcggcg

SEQ ID NO: 324900 - RNA, 19 nt, Bordetella pertussis
ccgaucuccgggagccugu

SEQ ID NO: 324901 - RNA, 20 nt, Bordetella pertussis
ccgaucuccgggagccuguc

SEQ ID NO: 324902 - RNA, 22 nt, Bordetella pertussis
ccgaucuccgggagccuguccc

SEQ ID NO: 324903 - RNA, 14 nt, Bordetella pertussis
ccgaugaagacgcc

SEQ ID NO: 324904 - RNA, 14 nt, Bordetella pertussis
ccgaugacaucgcc

SEQ ID NO: 324905 - RNA, 16 nt, Bordetella pertussis
ccgaugaugcccagga

SEQ ID NO: 324906 - RNA, 20 nt, Bordetella pertussis
ccgaugauggauucgcgccg

SEQ ID NO: 324907 - RNA, 17 nt, Bordetella pertussis
ccgaugucgccgccugc

SEQ ID NO: 324908 - RNA, 22 nt, Bordetella pertussis
ccgauguggcgguucccggggu

SEQ ID NO: 324909 - RNA, 19 nt, Bordetella pertussis
ccgauguuguuggccgcca

SEQ ID NO: 324910 - RNA, 21 nt, Bordetella pertussis
ccgauguuguuggccgccagc

SEQ ID NO: 324911 - RNA, 17 nt, Bordetella pertussis
ccgauucgccguggcug

SEQ ID NO: 324912 - RNA, 14 nt, Bordetella pertussis
ccgauucgcgcacc

SEQ ID NO: 324913 - RNA, 18 nt, Bordetella pertussis
ccgcaaccgucgaccggc

SEQ ID NO: 324914 - RNA, 14 nt, Bordetella pertussis
ccgcaacgccagca

SEQ ID NO: 324915 - RNA, 14 nt, Bordetella pertussis
ccgcaacgccgccg

SEQ ID NO: 324916 - RNA, 21 nt, Bordetella pertussis
ccgcaacgccgccggcagggc

SEQ ID NO: 324917 - RNA, 13 nt, Bordetella pertussis
ccgcaacgccgcc

SEQ ID NO: 324918 - RNA, 15 nt, Bordetella pertussis
ccgcaacgccgggcc

SEQ ID NO: 324919 - RNA, 19 nt, Bordetella pertussis
ccgcaauagaucauccagg

SEQ ID NO: 324920 - RNA, 16 nt, Bordetella pertussis
ccgcacaucgucgacg

SEQ ID NO: 324921 - RNA, 19 nt, Bordetella pertussis
ccgcacaucgucgacgucg

SEQ ID NO: 324922 - RNA, 18 nt, Bordetella pertussis
ccgcaccagcgccgacgg

SEQ ID NO: 324923 - RNA, 16 nt, Bordetella pertussis
ccgcaccaggccgcgg

SEQ ID NO: 324924 - RNA, 18 nt, Bordetella pertussis
ccgcacgauggcgcgcga

SEQ ID NO: 324925 - RNA, 13 nt, Bordetella pertussis
ccgcacgcagccc

SEQ ID NO: 324926 - RNA, 12 nt, Bordetella pertussis
ccgcacgcccgc

SEQ ID NO: 324927 - RNA, 13 nt, Bordetella pertussis
ccgcacgccgacc

SEQ ID NO: 324928 - RNA, 18 nt, Bordetella pertussis
ccgcacgccggccugcgc

SEQ ID NO: 324929 - RNA, 17 nt, Bordetella pertussis
ccgcacgccggucgcca

SEQ ID NO: 324930 - RNA, 12 nt, Bordetella pertussis
ccgcacgcgcgg

SEQ ID NO: 324931 - RNA, 23 nt, Bordetella pertussis
ccgcacgcucuacacggccgcca

SEQ ID NO: 324932 - RNA, 12 nt, Bordetella pertussis
ccgcacgggcgc

SEQ ID NO: 324933 - RNA, 18 nt, Bordetella pertussis
ccgcacgggcgccugucc

SEQ ID NO: 324934 - RNA, 16 nt, Bordetella pertussis
ccgcacggggacuggc

SEQ ID NO: 324935 - RNA, 17 nt, Bordetella pertussis
ccgcacgggccgacggc

SEQ ID NO: 324936 - RNA, 21 nt, Bordetella pertussis
ccgcacgguggcgccgucgcg

SEQ ID NO: 324937 - RNA, 15 nt, Bordetella pertussis
ccgcaggagcaugcc

SEQ ID NO: 324938 - RNA, 16 nt, Bordetella pertussis
ccgcaggagcaugccc

SEQ ID NO: 324939 - RNA, 19 nt, Bordetella pertussis
ccgcaggcggcggccucca

SEQ ID NO: 324940 - RNA, 14 nt, Bordetella pertussis
ccgcagggacaggc

SEQ ID NO: 324941 - RNA, 15 nt, Bordetella pertussis
ccgcagggacaggca

SEQ ID NO: 324942 - RNA, 20 nt, Bordetella pertussis
ccgcagggacaggcaccccg

SEQ ID NO: 324943 - RNA, 19 nt, Bordetella pertussis
ccgcagggcccgcaucggc

SEQ ID NO: 324944 - RNA, 22 nt, Bordetella pertussis
ccgcagggcgugcgggacggcc

SEQ ID NO: 324945 - RNA, 22 nt, Bordetella pertussis
ccgcaggggauugccgcgcggu

SEQ ID NO: 324946 - RNA, 14 nt, Bordetella pertussis
ccgcagguccaggc

SEQ ID NO: 324947 - RNA, 15 nt, Bordetella pertussis
ccgcaggugccuguc

SEQ ID NO: 324948 - RNA, 20 nt, Bordetella pertussis
ccgcagguggggcagcaggc

SEQ ID NO: 324949 - RNA, 18 nt, Bordetella pertussis
ccgcaguauuccugcugg

SEQ ID NO: 324950 - RNA, 14 nt, Bordetella pertussis
ccgcagugcgcgcg

SEQ ID NO: 324951 - RNA, 14 nt, Bordetella pertussis
ccgcaguugaacac

SEQ ID NO: 324952 - RNA, 15 nt, Bordetella pertussis
ccgcauagacgccga

SEQ ID NO: 324953 - RNA, 20 nt, Bordetella pertussis
ccgcauagcuggagaccggg

SEQ ID NO: 324954 - RNA, 12 nt, Bordetella pertussis
ccgcaucgcgcg

SEQ ID NO: 324955 - RNA, 15 nt, Bordetella pertussis
ccgcaucgcgcgccg

SEQ ID NO: 324956 - RNA, 16 nt, Bordetella pertussis
ccgcaucgcgcgccgc

SEQ ID NO: 324957 - RNA, 15 nt, Bordetella pertussis
ccgcaugggccaggc

SEQ ID NO: 324958 - RNA, 17 nt, Bordetella pertussis
ccgcaugggccaggcgc

SEQ ID NO: 324959 - RNA, 14 nt, Bordetella pertussis
ccgcaugggcgccg

SEQ ID NO: 324960 - RNA, 19 nt, Bordetella pertussis
ccgcaugggcgccgagggc

SEQ ID NO: 324961 - RNA, 16 nt, Bordetella pertussis
ccgcaugggcgcgccc

SEQ ID NO: 324962 - RNA, 19 nt, Bordetella pertussis
ccgcaugggcgcgcccggc

SEQ ID NO: 324963 - RNA, 22 nt, Bordetella pertussis
ccgcauggggacuggcgccugc

SEQ ID NO: 324964 - RNA, 15 nt, Bordetella pertussis
ccgcauggggcgagg

SEQ ID NO: 324965 - RNA, 18 nt, Bordetella pertussis
ccgcauggagaccggcgc

SEQ ID NO: 324966 - RNA, 19 nt, Bordetella pertussis
ccgcauuucguaaagccgc

SEQ ID NO: 324967 - RNA, 23 nt, Bordetella pertussis
ccgccacccaggcggcaggcgcc

SEQ ID NO: 324968 - RNA, 14 nt, Bordetella pertussis
ccgccacccagggc

SEQ ID NO: 324969 - RNA, 16 nt, Bordetella pertussis
ccgccaccgcccccgc

SEQ ID NO: 324970 - RNA, 12 nt, Bordetella pertussis
ccgccaccgcgc

SEQ ID NO: 324971 - RNA, 21 nt, Bordetella pertussis
ccgccaccguggcguccaugc

SEQ ID NO: 324972 - RNA, 20 nt, Bordetella pertussis
ccgccaccucggcgucgccc

SEQ ID NO: 324973 - RNA, 21 nt, Bordetella pertussis
ccgccacgaaacccacggcga

SEQ ID NO: 324974 - RNA, 24 nt, Bordetella pertussis
ccgccacgaaacccacggcgaugg

SEQ ID NO: 324975 - RNA, 19 nt, Bordetella pertussis
ccgccacgaagugcgcccc

SEQ ID NO: 324976 - RNA, 14 nt, Bordetella pertussis
ccgccacgugcugc

SEQ ID NO: 324977 - RNA, 16 nt, Bordetella pertussis
ccgccagcaaggcggc

SEQ ID NO: 324978 - RNA, 17 nt, Bordetella pertussis
ccgccagcaaggcggca

SEQ ID NO: 324979 - RNA, 23 nt, Bordetella pertussis
ccgccagcaaggcgucggccagg

SEQ ID NO: 324980 - RNA, 13 nt, Bordetella pertussis
ccgccagccgcug

SEQ ID NO: 324981 - RNA, 20 nt, Bordetella pertussis
ccgccagccgcuggcgcgcc

SEQ ID NO: 324982 - RNA, 12 nt, Bordetella pertussis
ccgccagccggc

SEQ ID NO: 324983 - RNA, 22 nt, Bordetella pertussis
ccgccagccggcccagcacgcc

SEQ ID NO: 324984 - RNA, 16 nt, Bordetella pertussis
ccgccagcgccuggac

SEQ ID NO: 324985 - RNA, 17 nt, Bordetella pertussis
ccgccagcgccuggacc

SEQ ID NO: 324986 - RNA, 12 nt, Bordetella pertussis
ccgccagcgcgc

SEQ ID NO: 324987 - RNA, 14 nt, Bordetella pertussis
ccgccagcgcgccg

SEQ ID NO: 324988 - RNA, 15 nt, Bordetella pertussis
ccgccagcgcgcgcg

SEQ ID NO: 324989 - RNA, 14 nt, Bordetella pertussis
ccgccagcgcgucg

SEQ ID NO: 324990 - RNA, 13 nt, Bordetella pertussis
ccgccagcucggc

SEQ ID NO: 324991 - RNA, 18 nt, Bordetella pertussis
ccgccaggaaaagccgcc

SEQ ID NO: 324992 - RNA, 17 nt, Bordetella pertussis
ccgccaggaagaucggc

SEQ ID NO: 324993 - RNA, 14 nt, Bordetella pertussis
ccgccaggacggga

SEQ ID NO: 324994 - RNA, 22 nt, Bordetella pertussis
ccgccagggccauguggcgcag

SEQ ID NO: 324995 - RNA, 14 nt, Bordetella pertussis
ccgccagggccgag

SEQ ID NO: 324996 - RNA, 16 nt, Bordetella pertussis
ccgccauagcugcgcc

SEQ ID NO: 324997 - RNA, 18 nt, Bordetella pertussis
ccgccauaggcgcgcacc

SEQ ID NO: 324998 - RNA, 13 nt, Bordetella pertussis
ccgccauaugcgc

SEQ ID NO: 324999 - RNA, 18 nt, Bordetella pertussis
ccgccaucauccuggucg

SEQ ID NO: 325000 - RNA, 23 nt, Bordetella pertussis
ccgccaucauccuggucgacgcg

SEQ ID NO: 325001 - RNA, 13 nt, Bordetella pertussis
ccgccaucauggc

SEQ ID NO: 325002 - RNA, 19 nt, Bordetella pertussis
ccgccaucauggcgucggc

SEQ ID NO: 325003 - RNA, 20 nt, Bordetella pertussis
ccgccaucauggcgucggcc

SEQ ID NO: 325004 - RNA, 23 nt, Bordetella pertussis
ccgccaucauggcgucggccacg

SEQ ID NO: 325005 - RNA, 18 nt, Bordetella pertussis
ccgccauccuggccgccg

SEQ ID NO: 325006 - RNA, 14 nt, Bordetella pertussis
ccgccaucgccagg

SEQ ID NO: 325007 - RNA, 15 nt, Bordetella pertussis
ccgcccguugcggcg

SEQ ID NO: 325008 - RNA, 22 nt, Bordetella pertussis
ccgcccugacgccugcgccggg

SEQ ID NO: 325009 - RNA, 14 nt, Bordetella pertussis
ccgcccugcccggc

SEQ ID NO: 325010 - RNA, 14 nt, Bordetella pertussis
ccgccgacggcaug

SEQ ID NO: 325011 - RNA, 22 nt, Bordetella pertussis
ccgccgagaaauccagcgcgcc

SEQ ID NO: 325012 - RNA, 17 nt, Bordetella pertussis
ccgccgagucggcgaug

SEQ ID NO: 325013 - RNA, 19 nt, Bordetella pertussis
ccgccgauaccacgcgcgg

SEQ ID NO: 325014 - RNA, 13 nt, Bordetella pertussis
ccgccgcaagacg

SEQ ID NO: 325015 - RNA, 23 nt, Bordetella pertussis
ccgccgcagccgccagcgccugg

SEQ ID NO: 325016 - RNA, 12 nt, Bordetella pertussis
ccgccgcccggc

SEQ ID NO: 325017 - RNA, 14 nt, Bordetella pertussis
ccgccgcccggccg

SEQ ID NO: 325018 - RNA, 16 nt, Bordetella pertussis
ccgccgcccggccggc

SEQ ID NO: 325019 - RNA, 20 nt, Bordetella pertussis
ccgccgcccuggccgcgccg

SEQ ID NO: 325020 - RNA, 15 nt, Bordetella pertussis
ccgccgccgacgaug

SEQ ID NO: 325021 - RNA, 13 nt, Bordetella pertussis
ccgccgccgcgcc

SEQ ID NO: 325022 - RNA, 15 nt, Bordetella pertussis
ccgccgccgcgcgcg

SEQ ID NO: 325023 - RNA, 13 nt, Bordetella pertussis
ccgccgccgcucg

SEQ ID NO: 325024 - RNA, 17 nt, Bordetella pertussis
ccgccgccggcccgcca

SEQ ID NO: 325025 - RNA, 15 nt, Bordetella pertussis
ccgccgccgggcugg

SEQ ID NO: 325026 - RNA, 21 nt, Bordetella pertussis
ccgccgcgaucagcgcggccg

SEQ ID NO: 325027 - RNA, 12 nt, Bordetella pertussis
ccgccgcgccca

SEQ ID NO: 325028 - RNA, 18 nt, Bordetella pertussis
ccgccgcgugcgccgggc

SEQ ID NO: 325029 - RNA, 22 nt, Bordetella pertussis
ccgccgcguggcggcgcagcgc

SEQ ID NO: 325030 - RNA, 14 nt, Bordetella pertussis
ccgccggcaccagc

SEQ ID NO: 325031 - RNA, 15 nt, Bordetella pertussis
ccgccggcacccggc

SEQ ID NO: 325032 - RNA, 15 nt, Bordetella pertussis
ccgccggcacgcgcg

SEQ ID NO: 325033 - RNA, 16 nt, Bordetella pertussis
ccgccggcacgcgcgg

SEQ ID NO: 325034 - RNA, 20 nt, Bordetella pertussis
ccgccggcacguaccaggcg

SEQ ID NO: 325035 - RNA, 17 nt, Bordetella pertussis
ccgccggcagggccagc

SEQ ID NO: 325036 - RNA, 16 nt, Bordetella pertussis
ccgccggccaccagcg

SEQ ID NO: 325037 - RNA, 21 nt, Bordetella pertussis
ccgccggccaccagcggcgcc

SEQ ID NO: 325038 - RNA, 15 nt, Bordetella pertussis
ccgccggccagcgcc

SEQ ID NO: 325039 - RNA, 17 nt, Bordetella pertussis
ccgccggccagcgcggc

SEQ ID NO: 325040 - RNA, 13 nt, Bordetella pertussis
ccgccggccauca

SEQ ID NO: 325041 - RNA, 13 nt, Bordetella pertussis
ccgccggcccagg

SEQ ID NO: 325042 - RNA, 13 nt, Bordetella pertussis
ccgccggcgcgcg

SEQ ID NO: 325043 - RNA, 15 nt, Bordetella pertussis
ccgccggcgcgcgga

SEQ ID NO: 325044 - RNA, 12 nt, Bordetella pertussis
ccgccggcgcgg

SEQ ID NO: 325045 - RNA, 23 nt, Bordetella pertussis
ccgccggcgcgguggccaugcug

SEQ ID NO: 325046 - RNA, 21 nt, Bordetella pertussis
ccgccggcggauuugcucgcg

SEQ ID NO: 325047 - RNA, 18 nt, Bordetella pertussis
ccgccggcggccuggacc

SEQ ID NO: 325048 - RNA, 16 nt, Bordetella pertussis
ccgccggcggcgcacc

SEQ ID NO: 325049 - RNA, 15 nt, Bordetella pertussis
ccgccggcggcgccg

SEQ ID NO: 325050 - RNA, 23 nt, Bordetella pertussis
ccgccggcggcgucggcgcccgg

SEQ ID NO: 325051 - RNA, 14 nt, Bordetella pertussis
ccgccggcggcgug

SEQ ID NO: 325052 - RNA, 13 nt, Bordetella pertussis
ccgccgggccugc

SEQ ID NO: 325053 - RNA, 14 nt, Bordetella pertussis
ccgccgggcggcgc

SEQ ID NO: 325054 - RNA, 16 nt, Bordetella pertussis
ccgccgggcggcgccg

SEQ ID NO: 325055 - RNA, 19 nt, Bordetella pertussis
ccgccgggcuccucgcccg

SEQ ID NO: 325056 - RNA, 21 nt, Bordetella pertussis
ccgccgggcuccucgcccgac

SEQ ID NO: 325057 - RNA, 20 nt, Bordetella pertussis
ccgccgggcuggauccggcg

SEQ ID NO: 325058 - RNA, 21 nt, Bordetella pertussis
ccgccggggaggccucgacgc

SEQ ID NO: 325059 - RNA, 16 nt, Bordetella pertussis
ccgccggggcaggcuc

SEQ ID NO: 325060 - RNA, 14 nt, Bordetella pertussis
ccgccgggucgccg

SEQ ID NO: 325061 - RNA, 15 nt, Bordetella pertussis
ccgccggucaccgcc

SEQ ID NO: 325062 - RNA, 17 nt, Bordetella pertussis
ccgccggugcaccaggc

SEQ ID NO: 325063 - RNA, 15 nt, Bordetella pertussis
ccgccgguucggucg

SEQ ID NO: 325064 - RNA, 19 nt, Bordetella pertussis
ccgccgguucggucgacga

SEQ ID NO: 325065 - RNA, 15 nt, Bordetella pertussis
ccgccguagccgcug

SEQ ID NO: 325066 - RNA, 19 nt, Bordetella pertussis
ccgccgucaacgcccaggu

SEQ ID NO: 325067 - RNA, 17 nt, Bordetella pertussis
ccgccguugcucgcgcg

SEQ ID NO: 325068 - RNA, 18 nt, Bordetella pertussis
ccgccguugcucgcgcgc

SEQ ID NO: 325069 - RNA, 20 nt, Bordetella pertussis
ccgccuauguaggcgccgcg

SEQ ID NO: 325070 - RNA, 22 nt, Bordetella pertussis
ccgccuauguaggcgccgcgcc

SEQ ID NO: 325071 - RNA, 14 nt, Bordetella pertussis
ccgccucagcccgc

SEQ ID NO: 325072 - RNA, 16 nt, Bordetella pertussis
ccgccuccagcgcggc

SEQ ID NO: 325073 - RNA, 23 nt, Bordetella pertussis
ccgccugagcacaugcccggcca

SEQ ID NO: 325074 - RNA, 17 nt, Bordetella pertussis
ccgccugccggccuggc

SEQ ID NO: 325075 - RNA, 15 nt, Bordetella pertussis
ccgccugcgccaggu

SEQ ID NO: 325076 - RNA, 15 nt, Bordetella pertussis
ccgccugcgccgagg

SEQ ID NO: 325077 - RNA, 22 nt, Bordetella pertussis
ccgccugcgcgaaacccccugg

SEQ ID NO: 325078 - RNA, 14 nt, Bordetella pertussis
ccgccugcggacgg

SEQ ID NO: 325079 - RNA, 21 nt, Bordetella pertussis
ccgccugcggacggcgggcgc

SEQ ID NO: 325080 - RNA, 23 nt, Bordetella pertussis
ccgccugcggacggcgggcgccc

SEQ ID NO: 325081 - RNA, 18 nt, Bordetella pertussis
ccgccugcggcgcggccg

SEQ ID NO: 325082 - RNA, 22 nt, Bordetella pertussis
ccgccuuugccgcuggacgcgc

SEQ ID NO: 325083 - RNA, 16 nt, Bordetella pertussis
ccgcgaaacggcgggc

SEQ ID NO: 325084 - RNA, 18 nt, Bordetella pertussis
ccgcgaaacggcgggcgc

SEQ ID NO: 325085 - RNA, 20 nt, Bordetella pertussis
ccgcgaaacggcgggcgcgc

SEQ ID NO: 325086 - RNA, 23 nt, Bordetella pertussis
ccgcgaaacggcgggcgcgcagg

SEQ ID NO: 325087 - RNA, 21 nt, Bordetella pertussis
ccgcgaacagauccacgcccg

SEQ ID NO: 325088 - RNA, 15 nt, Bordetella pertussis
ccgcgaaccaggccu

SEQ ID NO: 325089 - RNA, 16 nt, Bordetella pertussis
ccgcgaaccggugcug

SEQ ID NO: 325090 - RNA, 17 nt, Bordetella pertussis
ccgcgaaccggugcugg

SEQ ID NO: 325091 - RNA, 14 nt, Bordetella pertussis
ccgcgaacgcgccg

SEQ ID NO: 325092 - RNA, 16 nt, Bordetella pertussis
ccgcgaacgcgccggc

SEQ ID NO: 325093 - RNA, 16 nt, Bordetella pertussis
ccgcgaagcagccggc

SEQ ID NO: 325094 - RNA, 13 nt, Bordetella pertussis
ccgcgaagccgcc

SEQ ID NO: 325095 - RNA, 15 nt, Bordetella pertussis
ccgcgaagcgcgcca

SEQ ID NO: 325096 - RNA, 18 nt, Bordetella pertussis
ccgcgaagcgcgccagca

SEQ ID NO: 325097 - RNA, 13 nt, Bordetella pertussis
ccgcgaagugccu

SEQ ID NO: 325098 - RNA, 23 nt, Bordetella pertussis
ccgcgacaaauagccgaccgcgc

SEQ ID NO: 325099 - RNA, 22 nt, Bordetella pertussis
ccgcgaccacggucuggcgcga

SEQ ID NO: 325100 - RNA, 17 nt, Bordetella pertussis
ccgcgaccaccagcacc

SEQ ID NO: 325101 - RNA, 17 nt, Bordetella pertussis
ccgcgaccaugcggccg

SEQ ID NO: 325102 - RNA, 21 nt, Bordetella pertussis
ccgcgacccagaacccggccg

SEQ ID NO: 325103 - RNA, 14 nt, Bordetella pertussis
ccgcgacgcuguug

SEQ ID NO: 325104 - RNA, 22 nt, Bordetella pertussis
ccgcgacgguccugcgcgccga

SEQ ID NO: 325105 - RNA, 22 nt, Bordetella pertussis
ccgcgauauccuugcgcucgcc

SEQ ID NO: 325106 - RNA, 22 nt, Bordetella pertussis
ccgcgauaugcgagacgaaggc

SEQ ID NO: 325107 - RNA, 18 nt, Bordetella pertussis
ccgcgaucagcgcggccg

SEQ ID NO: 325108 - RNA, 19 nt, Bordetella pertussis
ccgcgaucagcgcggccgc

SEQ ID NO: 325109 - RNA, 22 nt, Bordetella pertussis
ccgcgaugcacggaacgugccg

SEQ ID NO: 325110 - RNA, 16 nt, Bordetella pertussis
ccgcgauggcgccggc

SEQ ID NO: 325111 - RNA, 12 nt, Bordetella pertussis
ccgcgaugucgc

SEQ ID NO: 325112 - RNA, 16 nt, Bordetella pertussis
ccgcgaugucgcgcgc

SEQ ID NO: 325113 - RNA, 20 nt, Bordetella pertussis
ccgcgauugcagguggccag

SEQ ID NO: 325114 - RNA, 14 nt, Bordetella pertussis
ccgcgcaaggcggc

SEQ ID NO: 325115 - RNA, 14 nt, Bordetella pertussis
ccgcgcagcacgcc

SEQ ID NO: 325116 - RNA, 16 nt, Bordetella pertussis
ccgcgcagcacgcccg

SEQ ID NO: 325117 - RNA, 13 nt, Bordetella pertussis
ccgcgcagcccgg

SEQ ID NO: 325118 - RNA, 20 nt, Bordetella pertussis
ccgcgcagccgacaggcgcg

SEQ ID NO: 325119 - RNA, 21 nt, Bordetella pertussis
ccgcgcagccgacaggcgcgc

SEQ ID NO: 325120 - RNA, 13 nt, Bordetella pertussis
ccgcgcagccgcu

SEQ ID NO: 325121 - RNA, 20 nt, Bordetella pertussis
ccgcgcaugcaagacaggcc

SEQ ID NO: 325122 - RNA, 21 nt, Bordetella pertussis
ccgcgcaugcaagacaggccg

SEQ ID NO: 325123 - RNA, 18 nt, Bordetella pertussis
ccgcgcaugccagcuugc

SEQ ID NO: 325124 - RNA, 20 nt, Bordetella pertussis
ccgcgcauggacugcaggcg

SEQ ID NO: 325125 - RNA, 21 nt, Bordetella pertussis
ccgcgcauggacugcaggcgc

SEQ ID NO: 325126 - RNA, 23 nt, Bordetella pertussis
ccgcgcaucgaucaggcugucgc

SEQ ID NO: 325127 - RNA, 16 nt, Bordetella pertussis
ccgcgccaagggcgug

SEQ ID NO: 325128 - RNA, 17 nt, Bordetella pertussis
ccgcgccacacgggcgc

SEQ ID NO: 325129 - RNA, 22 nt, Bordetella pertussis
ccgcgccgacggcggcgcggcg

SEQ ID NO: 325130 - RNA, 19 nt, Bordetella pertussis
ccgcgccgcccccgcccag

SEQ ID NO: 325131 - RNA, 17 nt, Bordetella pertussis
ccgcgccgcccacgccg

SEQ ID NO: 325132 - RNA, 20 nt, Bordetella pertussis
ccgcgccgcccacgccgcug

SEQ ID NO: 325133 - RNA, 18 nt, Bordetella pertussis
ccgcgccgccgcccuggc

SEQ ID NO: 325134 - RNA, 17 nt, Bordetella pertussis
ccgcgccgccgccuggc

SEQ ID NO: 325135 - RNA, 14 nt, Bordetella pertussis
ccgcgccgccuagg

SEQ ID NO: 325136 - RNA, 13 nt, Bordetella pertussis
ccgcgccgcgccg

SEQ ID NO: 325137 - RNA, 19 nt, Bordetella pertussis
ccgcgccgcggcaagccgc

SEQ ID NO: 325138 - RNA, 10 nt, Bordetella pertussis
ccgcgccgcg

SEQ ID NO: 325139 - RNA, 16 nt, Bordetella pertussis
ccgcgccgcgucaugg

SEQ ID NO: 325140 - RNA, 17 nt, Bordetella pertussis
ccgcgccgcgucauggc

SEQ ID NO: 325141 - RNA, 12 nt, Bordetella pertussis
ccgcgccgcugg

SEQ ID NO: 325142 - RNA, 18 nt, Bordetella pertussis
ccgcgccgcuggcggccg

SEQ ID NO: 325143 - RNA, 20 nt, Bordetella pertussis
ccgcgccgcuggcggccgcg

SEQ ID NO: 325144 - RNA, 20 nt, Bordetella pertussis
ccgcgccgcuggcguccagg

SEQ ID NO: 325145 - RNA, 22 nt, Bordetella pertussis
ccgcgccgcuguugcccaccag

SEQ ID NO: 325146 - RNA, 15 nt, Bordetella pertussis
ccgcgccggcgcgcg

SEQ ID NO: 325147 - RNA, 16 nt, Bordetella pertussis
ccgcgccggcgcgcga

SEQ ID NO: 325148 - RNA, 13 nt, Bordetella pertussis
ccgcgccggcggc

SEQ ID NO: 325149 - RNA, 13 nt, Bordetella pertussis
ccgcgccggcucc

SEQ ID NO: 325150 - RNA, 23 nt, Bordetella pertussis
ccgcgccggcucccgcgcugccg

SEQ ID NO: 325151 - RNA, 13 nt, Bordetella pertussis
ccgcgccgggcgc

SEQ ID NO: 325152 - RNA, 22 nt, Bordetella pertussis
ccgcgccgggcgcgccggcggg

SEQ ID NO: 325153 - RNA, 16 nt, Bordetella pertussis
ccgcgccggucaggcg

SEQ ID NO: 325154 - RNA, 20 nt, Bordetella pertussis
ccgcgccggggcggcucggc

SEQ ID NO: 325155 - RNA, 17 nt, Bordetella pertussis
ccgcgccggucgccgcg

SEQ ID NO: 325156 - RNA, 18 nt, Bordetella pertussis
ccgcgccguacagggccg

SEQ ID NO: 325157 - RNA, 19 nt, Bordetella pertussis
ccgcgccguucucaggccg

SEQ ID NO: 325158 - RNA, 18 nt, Bordetella pertussis
ccgcgccuauaucgacgg

SEQ ID NO: 325159 - RNA, 21 nt, Bordetella pertussis
ccgcgccuauaucgacggcgc

SEQ ID NO: 325160 - RNA, 20 nt, Bordetella pertussis
ccgcgccuaucaggccucga

SEQ ID NO: 325161 - RNA, 14 nt, Bordetella pertussis
ccgcgccucggcau

SEQ ID NO: 325162 - RNA, 17 nt, Bordetella pertussis
ccgcgccugggggcugg

SEQ ID NO: 325163 - RNA, 23 nt, Bordetella pertussis
ccgcgccugggggcuggaggcgc

SEQ ID NO: 325164 - RNA, 16 nt, Bordetella pertussis
ccgcgccuucgaggcc

SEQ ID NO: 325165 - RNA, 15 nt, Bordetella pertussis
ccgcgccuugcccgu

SEQ ID NO: 325166 - RNA, 16 nt, Bordetella pertussis
ccgcgccuugcccguc

SEQ ID NO: 325167 - RNA, 16 nt, Bordetella pertussis
ccgcgcgaacauccgg

SEQ ID NO: 325168 - RNA, 19 nt, Bordetella pertussis
ccgcgcgacagccgcgcca

SEQ ID NO: 325169 - RNA, 12 nt, Bordetella pertussis
ccgcgcgagcgc

SEQ ID NO: 325170 - RNA, 16 nt, Bordetella pertussis
ccgcgcgagcggcgug

SEQ ID NO: 325171 - RNA, 19 nt, Bordetella pertussis
ccgcgcgaucgccgcaugg

SEQ ID NO: 325172 - RNA, 21 nt, Bordetella pertussis
ccgcgcgaucgccgcaugggc

SEQ ID NO: 325173 - RNA, 13 nt, Bordetella pertussis
ccgcgcgaugcgc

SEQ ID NO: 325174 - RNA, 17 nt, Bordetella pertussis
ccgcgcgcacguggacc

SEQ ID NO: 325175 - RNA, 21 nt, Bordetella pertussis
ccgcgcgcacguggaccaggg

SEQ ID NO: 325176 - RNA, 15 nt, Bordetella pertussis
ccgcgcgcagcgagg

SEQ ID NO: 325177 - RNA, 13 nt, Bordetella pertussis
ccgcgcgccgcug

SEQ ID NO: 325178 - RNA, 11 nt, Bordetella pertussis
ccgcgcgccgg

SEQ ID NO: 325179 - RNA, 12 nt, Bordetella pertussis
ccgcgcgccggc

SEQ ID NO: 325180 - RNA, 15 nt, Bordetella pertussis
ccgcgcgcauccagg

SEQ ID NO: 325181 - RNA, 18 nt, Bordetella pertussis
ccgcgcgccggcgccggc

SEQ ID NO: 325182 - RNA, 13 nt, Bordetella pertussis
ccgcgcgccucga

SEQ ID NO: 325183 - RNA, 19 nt, Bordetella pertussis
ccgcgcgccugcaugucca

SEQ ID NO: 325184 - RNA, 11 nt, Bordetella pertussis
ccgcgcgcgac

SEQ ID NO: 325185 - RNA, 14 nt, Bordetella pertussis
ccgcgcgcgacgcg

SEQ ID NO: 325186 - RNA, 23 nt, Bordetella pertussis
ccgcgcgcgcagacgcgcucagg

SEQ ID NO: 325187 - RNA, 14 nt, Bordetella pertussis
ccgcgcgcgccagg

SEQ ID NO: 325188 - RNA, 20 nt, Bordetella pertussis
ccgcgcgcgcccgggccguc

SEQ ID NO: 325189 - RNA, 20 nt, Bordetella pertussis
ccgcgcgcggccccggcucc

SEQ ID NO: 325190 - RNA, 18 nt, Bordetella pertussis
ccgcgcgcggccggcacc

SEQ ID NO: 325191 - RNA, 20 nt, Bordetella pertussis
ccgcgcgcggccggcgcgcc

SEQ ID NO: 325192 - RNA, 21 nt, Bordetella pertussis
ccgcgcgcggccggcgcgccg

SEQ ID NO: 325193 - RNA, 11 nt, Bordetella pertussis
ccgcgcgcgug

SEQ ID NO: 325194 - RNA, 18 nt, Bordetella pertussis
ccgcgcgcgugccgcagg

SEQ ID NO: 325195 - RNA, 21 nt, Bordetella pertussis
ccgcgcgcguucaggucgccg

SEQ ID NO: 325196 - RNA, 17 nt, Bordetella pertussis
ccgcgcgcgggcgcccg

SEQ ID NO: 325197 - RNA, 18 nt, Bordetella pertussis
ccgcgcgcgggcgcccgc

SEQ ID NO: 325198 - RNA, 18 nt, Bordetella pertussis
ccgcgcgcuucaggcgcc

SEQ ID NO: 325199 - RNA, 19 nt, Bordetella pertussis
ccgcgcgcuucaggcgccg

SEQ ID NO: 325200 - RNA, 17 nt, Bordetella pertussis
ccgcgcggccagcgccg

SEQ ID NO: 325201 - RNA, 18 nt, Bordetella pertussis
ccgcgcggccagcgccgg

SEQ ID NO: 325202 - RNA, 13 nt, Bordetella pertussis
ccgcgcggccggg

SEQ ID NO: 325203 - RNA, 16 nt, Bordetella pertussis
ccgcgcggcgccugcc

SEQ ID NO: 325204 - RNA, 19 nt, Bordetella pertussis
ccgcgcggcgcugcacgcg

SEQ ID NO: 325205 - RNA, 14 nt, Bordetella pertussis
ccgcgcucagcacc

SEQ ID NO: 325206 - RNA, 15 nt, Bordetella pertussis
ccgcgcucagcacca

SEQ ID NO: 325207 - RNA, 20 nt, Bordetella pertussis
ccgcgcucagcaccaggccg

SEQ ID NO: 325208 - RNA, 22 nt, Bordetella pertussis
ccgcgcucagcaccaggccgcc

SEQ ID NO: 325209 - RNA, 13 nt, Bordetella pertussis
ccgcgcucaggcc

SEQ ID NO: 325210 - RNA, 17 nt, Bordetella pertussis
ccgcgcucaggccgcug

SEQ ID NO: 325211 - RNA, 15 nt, Bordetella pertussis
ccgcgcuccagggcg

SEQ ID NO: 325212 - RNA, 20 nt, Bordetella pertussis
ccgcgcuccagggcgucggc

SEQ ID NO: 325213 - RNA, 14 nt, Bordetella pertussis
ccgcgcucgcccag

SEQ ID NO: 325214 - RNA, 15 nt, Bordetella pertussis
ccgcgcucgcccagc

SEQ ID NO: 325215 - RNA, 19 nt, Bordetella pertussis
ccgcgcucgcccagccgcc

SEQ ID NO: 325216 - RNA, 22 nt, Bordetella pertussis
ccgcgcucgcccagccgccuga

SEQ ID NO: 325217 - RNA, 13 nt, Bordetella pertussis
ccgcgcucgcgcc

SEQ ID NO: 325218 - RNA, 19 nt, Bordetella pertussis
ccgcgcucgcgccaggccc

SEQ ID NO: 325219 - RNA, 21 nt, Bordetella pertussis
ccgcgcucgcgccaggccccg

SEQ ID NO: 325220 - RNA, 17 nt, Bordetella pertussis
ccgcggaggugucgccg

SEQ ID NO: 325221 - RNA, 19 nt, Bordetella pertussis
ccgcggauugccguccugg

SEQ ID NO: 325222 - RNA, 21 nt, Bordetella pertussis
ccgcggcaaauggggcggccg

SEQ ID NO: 325223 - RNA, 16 nt, Bordetella pertussis
ccgcggccagggugcc

SEQ ID NO: 325224 - RNA, 20 nt, Bordetella pertussis
ccgcggccagggugccccgc

SEQ ID NO: 325225 - RNA, 23 nt, Bordetella pertussis
ccgcggcccuugcgcgaaggccg

SEQ ID NO: 325226 - RNA, 23 nt, Bordetella pertussis
ccgcggccgcccccagcgcgccu

SEQ ID NO: 325227 - RNA, 12 nt, Bordetella pertussis
ccgcggccgccg

SEQ ID NO: 325228 - RNA, 14 nt, Bordetella pertussis
ccgcggccgcgcug

SEQ ID NO: 325229 - RNA, 15 nt, Bordetella pertussis
ccgcggcgggcuugg

SEQ ID NO: 325230 - RNA, 20 nt, Bordetella pertussis
ccgcggcgguuucggccggg

SEQ ID NO: 325231 - RNA, 15 nt, Bordetella pertussis
ccgcggcguccgcgc

SEQ ID NO: 325232 - RNA, 16 nt, Bordetella pertussis
ccgcggcguccgcgcc

SEQ ID NO: 325233 - RNA, 17 nt, Bordetella pertussis
ccgcggcguccgcgccg

SEQ ID NO: 325234 - RNA, 18 nt, Bordetella pertussis
ccgcggcguccgcgccga

SEQ ID NO: 325235 - RNA, 13 nt, Bordetella pertussis
ccgcggcgugcug

SEQ ID NO: 325236 - RNA, 14 nt, Bordetella pertussis
ccgcggcgugcugc

SEQ ID NO: 325237 - RNA, 23 nt, Bordetella pertussis
ccgcgguggggcaguugaccaug

SEQ ID NO: 325238 - RNA, 17 nt, Bordetella pertussis
ccgcgguggcgggcgug

SEQ ID NO: 325239 - RNA, 20 nt, Bordetella pertussis
ccgcgguggcgggcgugcgg

SEQ ID NO: 325240 - RNA, 18 nt, Bordetella pertussis
ccgcguaggcggucagcu

SEQ ID NO: 325241 - RNA, 14 nt, Bordetella pertussis
ccgcgucagacgcg

SEQ ID NO: 325242 - RNA, 18 nt, Bordetella pertussis
ccgcgucggacgcgcgcc

SEQ ID NO: 325243 - RNA, 15 nt, Bordetella pertussis
ccgcgucggccgcgu

SEQ ID NO: 325244 - RNA, 22 nt, Bordetella pertussis
ccgcgucggccucaucgagcgc

SEQ ID NO: 325245 - RNA, 14 nt, Bordetella pertussis
ccgcgucggccugc

SEQ ID NO: 325246 - RNA, 16 nt, Bordetella pertussis
ccgcgucggccugcca

SEQ ID NO: 325247 - RNA, 17 nt, Bordetella pertussis
ccgcgucggccugccag

SEQ ID NO: 325248 - RNA, 11 nt, Bordetella pertussis
ccgcgucggcg

SEQ ID NO: 325249 - RNA, 13 nt, Bordetella pertussis
ccgcgucggcgcc

SEQ ID NO: 325250 - RNA, 15 nt, Bordetella pertussis
ccgcgucggcgcggu

SEQ ID NO: 325251 - RNA, 21 nt, Bordetella pertussis
ccgcgucgguggccagccagg

SEQ ID NO: 325252 - RNA, 16 nt, Bordetella pertussis
ccgcgucguucaucgc

SEQ ID NO: 325253 - RNA, 18 nt, Bordetella pertussis
ccgcgucuuggcgggcac

SEQ ID NO: 325254 - RNA, 19 nt, Bordetella pertussis
ccgcgucuuggcgggcacc

SEQ ID NO: 325255 - RNA, 18 nt, Bordetella pertussis
ccgcgucuucggcgcggc

SEQ ID NO: 325256 - RNA, 19 nt, Bordetella pertussis
ccgcgucuucggcgcggcg

SEQ ID NO: 325257 - RNA, 16 nt, Bordetella pertussis
ccgcgucuaccuggac

SEQ ID NO: 325258 - RNA, 16 nt, Bordetella pertussis
ccgcgugacggccgcc

SEQ ID NO: 325259 - RNA, 14 nt, Bordetella pertussis
ccgcgugacggccg

SEQ ID NO: 325260 - RNA, 14 nt, Bordetella pertussis
ccgcgugcgugccg

SEQ ID NO: 325261 - RNA, 20 nt, Bordetella pertussis
ccgcgugcgugccgacgaug

SEQ ID NO: 325262 - RNA, 16 nt, Bordetella pertussis
ccgcguggaaggucca

SEQ ID NO: 325263 - RNA, 16 nt, Bordetella pertussis
ccgcguggccgcgcug

SEQ ID NO: 325264 - RNA, 17 nt, Bordetella pertussis
ccgcguggccgcgcugc

SEQ ID NO: 325265 - RNA, 18 nt, Bordetella pertussis
ccgcgugggcaugguggc

SEQ ID NO: 325266 - RNA, 20 nt, Bordetella pertussis
ccgcguucacgccggcgcgc

SEQ ID NO: 325267 - RNA, 13 nt, Bordetella pertussis
ccgcguucaggcg

SEQ ID NO: 325268 - RNA, 19 nt, Bordetella pertussis
ccgcguucaggcgcggcug

SEQ ID NO: 325269 - RNA, 18 nt, Bordetella pertussis
ccgcguugaccggcuggc

SEQ ID NO: 325270 - RNA, 21 nt, Bordetella pertussis
ccgcguugaccggcuggcgca

SEQ ID NO: 325271 - RNA, 20 nt, Bordetella pertussis
ccgcguuucccucggugcug

SEQ ID NO: 325272 - RNA, 14 nt, Bordetella pertussis
ccgcuaccaggcgc

SEQ ID NO: 325273 - RNA, 16 nt, Bordetella pertussis
ccgcuaccaggcgcgc

SEQ ID NO: 325274 - RNA, 20 nt, Bordetella pertussis
ccgcuacgcgggcuugcugc

SEQ ID NO: 325275 - RNA, 22 nt, Bordetella pertussis
ccgcuacgggcgcugcacgcag

SEQ ID NO: 325276 - RNA, 23 nt, Bordetella pertussis
ccgcuacguguccugccggggca

SEQ ID NO: 325277 - RNA, 19 nt, Bordetella pertussis
ccgcuaggccuugccgccg

SEQ ID NO: 325278 - RNA, 20 nt, Bordetella pertussis
ccgcuaggccuugccgccgc

SEQ ID NO: 325279 - RNA, 22 nt, Bordetella pertussis
ccgcuaggccuugccgccgccg

SEQ ID NO: 325280 - RNA, 16 nt, Bordetella pertussis
ccgcucgaggccaggc

SEQ ID NO: 325281 - RNA, 16 nt, Bordetella pertussis
ccgcucgacgucgccc

SEQ ID NO: 325282 - RNA, 15 nt, Bordetella pertussis
ccgcucguacuccau

SEQ ID NO: 325283 - RNA, 18 nt, Bordetella pertussis
ccgcucguaucgcccuga

SEQ ID NO: 325284 - RNA, 20 nt, Bordetella pertussis
ccgcucgucaugaucccgcg

SEQ ID NO: 325285 - RNA, 14 nt, Bordetella pertussis
ccgcucuuggcgug

SEQ ID NO: 325286 - RNA, 21 nt, Bordetella pertussis
ccgcugaaggaccucgcgccg

SEQ ID NO: 325287 - RNA, 22 nt, Bordetella pertussis
ccgcugaaggaccucgcgccgg

SEQ ID NO: 325288 - RNA, 23 nt, Bordetella pertussis
ccgcugaaggaccucgcgccggu

SEQ ID NO: 325289 - RNA, 16 nt, Bordetella pertussis
ccgcugaccggccugg

SEQ ID NO: 325290 - RNA, 19 nt, Bordetella pertussis
ccgcugaccggcggcacgg

SEQ ID NO: 325291 - RNA, 22 nt, Bordetella pertussis
ccgcugaccuggugugccuguc

SEQ ID NO: 325292 - RNA, 19 nt, Bordetella pertussis
ccgcugcguccaccaccag

SEQ ID NO: 325293 - RNA, 23 nt, Bordetella pertussis
ccgcugcguccaccaccaggccg

SEQ ID NO: 325294 - RNA, 13 nt, Bordetella pertussis
ccgcuggccaggc

SEQ ID NO: 325295 - RNA, 19 nt, Bordetella pertussis
ccgcuggccaugccgucgc

SEQ ID NO: 325296 - RNA, 16 nt, Bordetella pertussis
ccgcuggccgucgccg

SEQ ID NO: 325297 - RNA, 20 nt, Bordetella pertussis
ccgcuggcgaucaggccgcc

SEQ ID NO: 325298 - RNA, 21 nt, Bordetella pertussis
ccgcuggcgaucaggccgccc

SEQ ID NO: 325299 - RNA, 15 nt, Bordetella pertussis
ccgcuggcgcgccgc

SEQ ID NO: 325300 - RNA, 21 nt, Bordetella pertussis
ccgcugggacaggcacacccu

SEQ ID NO: 325301 - RNA, 17 nt, Bordetella pertussis
ccgcugggacaggcacu

SEQ ID NO: 325302 - RNA, 18 nt, Bordetella pertussis
ccgcugggacaggcacuc

SEQ ID NO: 325303 - RNA, 19 nt, Bordetella pertussis
ccgcugggacaggcacucu

SEQ ID NO: 325304 - RNA, 14 nt, Bordetella pertussis
ccgcugggccagca

SEQ ID NO: 325305 - RNA, 19 nt, Bordetella pertussis
ccgcugggccagcaucggc

SEQ ID NO: 325306 - RNA, 17 nt, Bordetella pertussis
ccggaauaccgccagcu

SEQ ID NO: 325307 - RNA, 20 nt, Bordetella pertussis
ccggaauagauaugggccug

SEQ ID NO: 325308 - RNA, 20 nt, Bordetella pertussis
ccggaauccuggcgacggcc

SEQ ID NO: 325309 - RNA, 16 nt, Bordetella pertussis
ccggcauaggcggcgc

SEQ ID NO: 325310 - RNA, 17 nt, Bordetella pertussis
ccggcauaggcggcgca

SEQ ID NO: 325311 - RNA, 19 nt, Bordetella pertussis
ccggcaucaguucaggcug

SEQ ID NO: 325312 - RNA, 14 nt, Bordetella pertussis
ccggcaucccugcu

SEQ ID NO: 325313 - RNA, 18 nt, Bordetella pertussis
ccggcauugcccaccacg

SEQ ID NO: 325314 - RNA, 21 nt, Bordetella pertussis
ccggccaagcuggagaagcgc

SEQ ID NO: 325315 - RNA, 17 nt, Bordetella pertussis
ccggccaaggcaagcag

SEQ ID NO: 325316 - RNA, 13 nt, Bordetella pertussis
ccggccaggauga

SEQ ID NO: 325317 - RNA, 16 nt, Bordetella pertussis
ccggccaggcgccggc

SEQ ID NO: 325318 - RNA, 19 nt, Bordetella pertussis
ccggccaggcgccggcggu

SEQ ID NO: 325319 - RNA, 13 nt, Bordetella pertussis
ccggccaggcgcg

SEQ ID NO: 325320 - RNA, 16 nt, Bordetella pertussis
ccggccagggccacgc

SEQ ID NO: 325321 - RNA, 18 nt, Bordetella pertussis
ccggccagggccacgccg

SEQ ID NO: 325322 - RNA, 12 nt, Bordetella pertussis
ccggccaggggc

SEQ ID NO: 325323 - RNA, 16 nt, Bordetella pertussis
ccggccaggucggcgg

SEQ ID NO: 325324 - RNA, 19 nt, Bordetella pertussis
ccggccaggucggcggcca

SEQ ID NO: 325325 - RNA, 23 nt, Bordetella pertussis
ccggccaggucggcggccagcgc

SEQ ID NO: 325326 - RNA, 21 nt, Bordetella pertussis
ccggccagucgcggugcaugg

SEQ ID NO: 325327 - RNA, 22 nt, Bordetella pertussis
ccggccaucaggugcaggguug

SEQ ID NO: 325328 - RNA, 13 nt, Bordetella pertussis
ccggccaucacgc

SEQ ID NO: 325329 - RNA, 16 nt, Bordetella pertussis
ccggccauggccgcca

SEQ ID NO: 325330 - RNA, 20 nt, Bordetella pertussis
ccggccauggcggccggcgu

SEQ ID NO: 325331 - RNA, 16 nt, Bordetella pertussis
ccggcccaaggccccg

SEQ ID NO: 325332 - RNA, 18 nt, Bordetella pertussis
ccggcccagcacgccgcg

SEQ ID NO: 325333 - RNA, 19 nt, Bordetella pertussis
ccggcccagcacgccgcgc

SEQ ID NO: 325334 - RNA, 15 nt, Bordetella pertussis
ccggcccagcgccau

SEQ ID NO: 325335 - RNA, 16 nt, Bordetella pertussis
ccggcccaggccgggc

SEQ ID NO: 325336 - RNA, 22 nt, Bordetella pertussis
ccggcccaucuguacggccggc

SEQ ID NO: 325337 - RNA, 18 nt, Bordetella pertussis
ccggcccaugaccggcgu

SEQ ID NO: 325338 - RNA, 14 nt, Bordetella pertussis
ccggccccaggccg

SEQ ID NO: 325339 - RNA, 15 nt, Bordetella pertussis
ccggccccaggccgg

SEQ ID NO: 325340 - RNA, 22 nt, Bordetella pertussis
ccggccccauccucaucgugcu

SEQ ID NO: 325341 - RNA, 17 nt, Bordetella pertussis
ccggcccgccucgagcg

SEQ ID NO: 325342 - RNA, 15 nt, Bordetella pertussis
ccggcccgcgcgccu

SEQ ID NO: 325343 - RNA, 22 nt, Bordetella pertussis
ccggcccggaauaccgccagcu

SEQ ID NO: 325344 - RNA, 19 nt, Bordetella pertussis
ccggcccguuggcaggcca

SEQ ID NO: 325345 - RNA, 16 nt, Bordetella pertussis
ccggccgaaaccgccg

SEQ ID NO: 325346 - RNA, 20 nt, Bordetella pertussis
ccggccgaaaccgccgcggc

SEQ ID NO: 325347 - RNA, 22 nt, Bordetella pertussis
ccggcccugccgcccuggcgca

SEQ ID NO: 325348 - RNA, 16 nt, Bordetella pertussis
ccggccgaccggcgcg

SEQ ID NO: 325349 - RNA, 23 nt, Bordetella pertussis
ccggccgacggcgcuggcgagca

SEQ ID NO: 325350 - RNA, 14 nt, Bordetella pertussis
ccggccgaucgcgc

SEQ ID NO: 325351 - RNA, 16 nt, Bordetella pertussis
ccggccgaucgcgccg

SEQ ID NO: 325352 - RNA, 22 nt, Bordetella pertussis
ccggccgaugacaucgccgcug

SEQ ID NO: 325353 - RNA, 17 nt, Bordetella pertussis
ccggccgauggcaucgc

SEQ ID NO: 325354 - RNA, 22 nt, Bordetella pertussis
ccggccgauggcaucgccccgg

SEQ ID NO: 325355 - RNA, 22 nt, Bordetella pertussis
ccggccgcacugggugacgcug

SEQ ID NO: 325356 - RNA, 16 nt, Bordetella pertussis
ccggccgcccaggcgc

SEQ ID NO: 325357 - RNA, 19 nt, Bordetella pertussis
ccggccgcccaggcgcagc

SEQ ID NO: 325358 - RNA, 14 nt, Bordetella pertussis
ccggccgccgaacg

SEQ ID NO: 325359 - RNA, 14 nt, Bordetella pertussis
ccggccgccgccgg

SEQ ID NO: 325360 - RNA, 16 nt, Bordetella pertussis
ccggccgccgccggca

SEQ ID NO: 325361 - RNA, 20 nt, Bordetella pertussis
ccggccgccucaccgcgccg

SEQ ID NO: 325362 - RNA, 19 nt, Bordetella pertussis
ccggccgccuccaggcggc

SEQ ID NO: 325363 - RNA, 16 nt, Bordetella pertussis
ccggccgcgcaaggcg

SEQ ID NO: 325364 - RNA, 22 nt, Bordetella pertussis
ccggccgcgcgcgccaggccuu

SEQ ID NO: 325365 - RNA, 19 nt, Bordetella pertussis
ccggccgcggggcuggcca

SEQ ID NO: 325366 - RNA, 17 nt, Bordetella pertussis
ccggccgcguggccgcg

SEQ ID NO: 325367 - RNA, 19 nt, Bordetella pertussis
ccggccgcguggccgcgcu

SEQ ID NO: 325368 - RNA, 16 nt, Bordetella pertussis
ccggccggcacggccg

SEQ ID NO: 325369 - RNA, 17 nt, Bordetella pertussis
ccggccggcacggccgg

SEQ ID NO: 325370 - RNA, 15 nt, Bordetella pertussis
ccggccggcgccggc

SEQ ID NO: 325371 - RNA, 16 nt, Bordetella pertussis
ccggccggccgggcag

SEQ ID NO: 325372 - RNA, 14 nt, Bordetella pertussis
ccggccgggcgcgg

SEQ ID NO: 325373 - RNA, 15 nt, Bordetella pertussis
ccggccgggcgcggc

SEQ ID NO: 325374 - RNA, 21 nt, Bordetella pertussis
ccggccgggcgcggcgcccgc

SEQ ID NO: 325375 - RNA, 11 nt, Bordetella pertussis
ccggccgggcc

SEQ ID NO: 325376 - RNA, 21 nt, Bordetella pertussis
ccggccggggucuugccgcgc

SEQ ID NO: 325377 - RNA, 17 nt, Bordetella pertussis
ccggccggugggugugg

SEQ ID NO: 325378 - RNA, 21 nt, Bordetella pertussis
ccggccguggccgggcccggc

SEQ ID NO: 325379 - RNA, 22 nt, Bordetella pertussis
ccggccguuucaggccugcggc

SEQ ID NO: 325380 - RNA, 19 nt, Bordetella pertussis
ccggccucaaccgcgcgua

SEQ ID NO: 325381 - RNA, 20 nt, Bordetella pertussis
ccggccucagcggccgcugc

SEQ ID NO: 325382 - RNA, 14 nt, Bordetella pertussis
ccggccuccagcau

SEQ ID NO: 325383 - RNA, 19 nt, Bordetella pertussis
ccggccucccggaccagca

SEQ ID NO: 325384 - RNA, 13 nt, Bordetella pertussis
ccggccugacgcg

SEQ ID NO: 325385 - RNA, 23 nt, Bordetella pertussis
ccggccugcaggcucuugaccag

SEQ ID NO: 325386 - RNA, 22 nt, Bordetella pertussis
ccggccugcgccagcuccagcc

SEQ ID NO: 325387 - RNA, 16 nt, Bordetella pertussis
ccggccugcgcgccgg

SEQ ID NO: 325388 - RNA, 17 nt, Bordetella pertussis
ccggccugcgcgccggg

SEQ ID NO: 325389 - RNA, 19 nt, Bordetella pertussis
ccggccugcgugucaggcg

SEQ ID NO: 325390 - RNA, 17 nt, Bordetella pertussis
ccggccugcuuggccgc

SEQ ID NO: 325391 - RNA, 19 nt, Bordetella pertussis
ccggccugcuuggccgcgu

SEQ ID NO: 325392 - RNA, 20 nt, Bordetella pertussis
ccggccugcuuggccgcgua

SEQ ID NO: 325393 - RNA, 22 nt, Bordetella pertussis
ccggccuggcucagucggccug

SEQ ID NO: 325394 - RNA, 20 nt, Bordetella pertussis
ccggccuggggacgggcgca

SEQ ID NO: 325395 - RNA, 20 nt, Bordetella pertussis
ccggccuggcgcgcaucggc

SEQ ID NO: 325396 - RNA, 14 nt, Bordetella pertussis
ccggccuuggccau

SEQ ID NO: 325397 - RNA, 16 nt, Bordetella pertussis
ccggccuugcugaacc

SEQ ID NO: 325398 - RNA, 22 nt, Bordetella pertussis
ccggccuugcugaaccugcugg

SEQ ID NO: 325399 - RNA, 16 nt, Bordetella pertussis
ccggcgaagccggcac

SEQ ID NO: 325400 - RNA, 15 nt, Bordetella pertussis
ccggcgacaccgcgg

SEQ ID NO: 325401 - RNA, 16 nt, Bordetella pertussis
ccggcgacaccgcggc

SEQ ID NO: 325402 - RNA, 23 nt, Bordetella pertussis
ccggcgacaccgcggccuugccg

SEQ ID NO: 325403 - RNA, 19 nt, Bordetella pertussis
ccggcgaccgacggcaucg

SEQ ID NO: 325404 - RNA, 19 nt, Bordetella pertussis
ccggcgacggcaucgauuu

SEQ ID NO: 325405 - RNA, 16 nt, Bordetella pertussis
ccggcgacguggcgcu

SEQ ID NO: 325406 - RNA, 18 nt, Bordetella pertussis
ccggcgagaacgcggccg

SEQ ID NO: 325407 - RNA, 21 nt, Bordetella pertussis
ccggcgagacgucggcgaugg

SEQ ID NO: 325408 - RNA, 24 nt, Bordetella pertussis
ccggcgagacgucggcgauggccc

SEQ ID NO: 325409 - RNA, 15 nt, Bordetella pertussis
ccggcgaggccgccc

SEQ ID NO: 325410 - RNA, 14 nt, Bordetella pertussis
ccggcgaucacgcc

SEQ ID NO: 325411 - RNA, 19 nt, Bordetella pertussis
ccggcgaucaugccgccga

SEQ ID NO: 325412 - RNA, 22 nt, Bordetella pertussis
ccggcgaugaagucgcggcccg

SEQ ID NO: 325413 - RNA, 22 nt, Bordetella pertussis
ccggcgauggcguugcgcacca

SEQ ID NO: 325414 - RNA, 23 nt, Bordetella pertussis
ccggcgcacaaucugcgucgccu

SEQ ID NO: 325415 - RNA, 23 nt, Bordetella pertussis
ccggcgcacccggugaucaugcc

SEQ ID NO: 325416 - RNA, 14 nt, Bordetella pertussis
ccggcgcacgcccc

SEQ ID NO: 325417 - RNA, 14 nt, Bordetella pertussis
ccggcgcaugcugg

SEQ ID NO: 325418 - RNA, 14 nt, Bordetella pertussis
ccggcgccgacgcg

SEQ ID NO: 325419 - RNA, 15 nt, Bordetella pertussis
ccggcgccgacgcgc

SEQ ID NO: 325420 - RNA, 17 nt, Bordetella pertussis
ccggcgccgacgcgcug

SEQ ID NO: 325421 - RNA, 18 nt, Bordetella pertussis
ccggcgccgacgcgcugg

SEQ ID NO: 325422 - RNA, 22 nt, Bordetella pertussis
ccggcgcccucuuucgccgcgc

SEQ ID NO: 325423 - RNA, 13 nt, Bordetella pertussis
ccggcgccgcccc

SEQ ID NO: 325424 - RNA, 13 nt, Bordetella pertussis
ccggcgccgccgg

SEQ ID NO: 325425 - RNA, 15 nt, Bordetella pertussis
ccggcggccaggccg

SEQ ID NO: 325426 - RNA, 16 nt, Bordetella pertussis
ccggcggccaggccgg

SEQ ID NO: 325427 - RNA, 12 nt, Bordetella pertussis
ccggcggccauc

SEQ ID NO: 325428 - RNA, 19 nt, Bordetella pertussis
ccggcggccagcgcgccgc

SEQ ID NO: 325429 - RNA, 13 nt, Bordetella pertussis
ccggcggccagcu

SEQ ID NO: 325430 - RNA, 22 nt, Bordetella pertussis
ccggcggccuaugugcaggcca

SEQ ID NO: 325431 - RNA, 18 nt, Bordetella pertussis
ccggcggcgcucaucauc

SEQ ID NO: 325432 - RNA, 15 nt, Bordetella pertussis
ccggcggcgggcgug

SEQ ID NO: 325433 - RNA, 14 nt, Bordetella pertussis
ccggcggcgucggc

SEQ ID NO: 325434 - RNA, 19 nt, Bordetella pertussis
ccggcggcgucggcgcccg

SEQ ID NO: 325435 - RNA, 11 nt, Bordetella pertussis
ccggcggcgug

SEQ ID NO: 325436 - RNA, 14 nt, Bordetella pertussis
ccggcggcguggcc

SEQ ID NO: 325437 - RNA, 17 nt, Bordetella pertussis
ccggcgggaacaggcac

SEQ ID NO: 325438 - RNA, 20 nt, Bordetella pertussis
ccggcgguaagcguccgcgc

SEQ ID NO: 325439 - RNA, 14 nt, Bordetella pertussis
ccggcggucacgcc

SEQ ID NO: 325440 - RNA, 15 nt, Bordetella pertussis
ccggcggucacgccg

SEQ ID NO: 325441 - RNA, 16 nt, Bordetella pertussis
ccggcggucacgccga

SEQ ID NO: 325442 - RNA, 17 nt, Bordetella pertussis
ccggcggucacgccgau

SEQ ID NO: 325443 - RNA, 21 nt, Bordetella pertussis
ccggcggugaugacgucgucg

SEQ ID NO: 325444 - RNA, 15 nt, Bordetella pertussis
ccggcggucgcgcug

SEQ ID NO: 325445 - RNA, 19 nt, Bordetella pertussis
ccggcguccugcggcggca

SEQ ID NO: 325446 - RNA, 15 nt, Bordetella pertussis
ccggcgucgcucagg

SEQ ID NO: 325447 - RNA, 17 nt, Bordetella pertussis
ccggcgugagcgccacc

SEQ ID NO: 325448 - RNA, 14 nt, Bordetella pertussis
ccggcgugcgcugg

SEQ ID NO: 325449 - RNA, 17 nt, Bordetella pertussis
ccggcgugcgcuggcug

SEQ ID NO: 325450 - RNA, 12 nt, Bordetella pertussis
ccggcgugcugu

SEQ ID NO: 325451 - RNA, 14 nt, Bordetella pertussis
ccggcguggccugc

SEQ ID NO: 325452 - RNA, 14 nt, Bordetella pertussis
ccggcguggcgcgc

SEQ ID NO: 325453 - RNA, 15 nt, Bordetella pertussis
ccggcguggcgcgca

SEQ ID NO: 325454 - RNA, 15 nt, Bordetella pertussis
ccggcgugguaucgc

SEQ ID NO: 325455 - RNA, 18 nt, Bordetella pertussis
ccggcgugguaucgcgcc

SEQ ID NO: 325456 - RNA, 21 nt, Bordetella pertussis
ccggcguguccagcggcgcca

SEQ ID NO: 325457 - RNA, 16 nt, Bordetella pertussis
ccggcguguucagcgc

SEQ ID NO: 325458 - RNA, 21 nt, Bordetella pertussis
ccggcguucaccaggaagcgc

SEQ ID NO: 325459 - RNA, 19 nt, Bordetella pertussis
ccggcguucuggcgcagca

SEQ ID NO: 325460 - RNA, 18 nt, Bordetella pertussis
ccggcguucuucagcgcg

SEQ ID NO: 325461 - RNA, 22 nt, Bordetella pertussis
ccggcguugccgaagcgucggc

SEQ ID NO: 325462 - RNA, 23 nt, Bordetella pertussis
ccggcguugccgaagcgucggcc

SEQ ID NO: 325463 - RNA, 17 nt, Bordetella pertussis
ccggcguuggugacgau

SEQ ID NO: 325464 - RNA, 17 nt, Bordetella pertussis
ccggcuacagcucgccg

SEQ ID NO: 325465 - RNA, 24 nt, Bordetella pertussis
ccggcuacagcucgccggcgaugg

SEQ ID NO: 325466 - RNA, 15 nt, Bordetella pertussis
ccggcuaccgcgcca

SEQ ID NO: 325467 - RNA, 16 nt, Bordetella pertussis
ccggcuauaccgggcu

SEQ ID NO: 325468 - RNA, 18 nt, Bordetella pertussis
ccggcuauaccgggcugg

SEQ ID NO: 325469 - RNA, 14 nt, Bordetella pertussis
ccggcuccggccgc

SEQ ID NO: 325470 - RNA, 20 nt, Bordetella pertussis
ccggcucgaucgccgccggc

SEQ ID NO: 325471 - RNA, 21 nt, Bordetella pertussis
ccggcucgaucgccgccggca

SEQ ID NO: 325472 - RNA, 15 nt, Bordetella pertussis
ccggcucgccgagcc

SEQ ID NO: 325473 - RNA, 18 nt, Bordetella pertussis
ccggcucgccgagccggg

SEQ ID NO: 325474 - RNA, 18 nt, Bordetella pertussis
ccggcugcaugcgcgaac

SEQ ID NO: 325475 - RNA, 17 nt, Bordetella pertussis
ccggcugcgcgcgcagc

SEQ ID NO: 325476 - RNA, 21 nt, Bordetella pertussis
ccggcugcgcgcgcagccagg

SEQ ID NO: 325477 - RNA, 23 nt, Bordetella pertussis
ccggcugcucguucugcgcgccc

SEQ ID NO: 325478 - RNA, 17 nt, Bordetella pertussis
ccggcugcuugcccagc

SEQ ID NO: 325479 - RNA, 20 nt, Bordetella pertussis
ccggcugcuugcccagcgga

SEQ ID NO: 325480 - RNA, 16 nt, Bordetella pertussis
ccggcuggcaugcggc

SEQ ID NO: 325481 - RNA, 17 nt, Bordetella pertussis
ccggcuucagccgcaag

SEQ ID NO: 325482 - RNA, 17 nt, Bordetella pertussis
ccggcuuccagcagcau

SEQ ID NO: 325483 - RNA, 22 nt, Bordetella pertussis
ccggcuuccagcagcaugccgc

SEQ ID NO: 325484 - RNA, 15 nt, Bordetella pertussis
ccggcuucgucaugg

SEQ ID NO: 325485 - RNA, 16 nt, Bordetella pertussis
ccggcuugcauggugc

SEQ ID NO: 325486 - RNA, 20 nt, Bordetella pertussis
ccggcuucugggucagcuuc

SEQ ID NO: 325487 - RNA, 19 nt, Bordetella pertussis
ccggcuugcgcaagccggc

SEQ ID NO: 325488 - RNA, 21 nt, Bordetella pertussis
ccggcuugcgccagccacgcg

SEQ ID NO: 325489 - RNA, 20 nt, Bordetella pertussis
ccggcuuggccucggccggc

SEQ ID NO: 325490 - RNA, 14 nt, Bordetella pertussis
ccggcuugggcaca

SEQ ID NO: 325491 - RNA, 17 nt, Bordetella pertussis
ccggcuugggcgugccc

SEQ ID NO: 325492 - RNA, 16 nt, Bordetella pertussis
ccggcuuggggcgcgc

SEQ ID NO: 325493 - RNA, 18 nt, Bordetella pertussis
ccggcuuucagcgccgag

SEQ ID NO: 325494 - RNA, 18 nt, Bordetella pertussis
ccgggaaacucgcgcagc

SEQ ID NO: 325495 - RNA, 19 nt, Bordetella pertussis
ccgggaccuuggcggcugg

SEQ ID NO: 325496 - RNA, 17 nt, Bordetella pertussis
ccgggagcggccagcaa

SEQ ID NO: 325497 - RNA, 21 nt, Bordetella pertussis
ccgggagcggccagcaagcgc

SEQ ID NO: 325498 - RNA, 22 nt, Bordetella pertussis
ccgggagcggccagcaagcgcg

SEQ ID NO: 325499 - RNA, 14 nt, Bordetella pertussis
ccgggagccugucc

SEQ ID NO: 325500 - RNA, 21 nt, Bordetella pertussis
ccgggagccuguccccgccgg

SEQ ID NO: 325501 - RNA, 15 nt, Bordetella pertussis
ccgggcaaucggcgu

SEQ ID NO: 325502 - RNA, 21 nt, Bordetella pertussis
ccgggcaagcagauggccauc

SEQ ID NO: 325503 - RNA, 19 nt, Bordetella pertussis
ccgggcccggccacggccg

SEQ ID NO: 325504 - RNA, 21 nt, Bordetella pertussis
ccgggcccggccacggccggg

SEQ ID NO: 325505 - RNA, 14 nt, Bordetella pertussis
ccgggccgaccagg

SEQ ID NO: 325506 - RNA, 20 nt, Bordetella pertussis
ccgggccgacgcgcccgggc

SEQ ID NO: 325507 - RNA, 14 nt, Bordetella pertussis
ccgggcgaccccgg

SEQ ID NO: 325508 - RNA, 18 nt, Bordetella pertussis
ccgggcgacggcgugcug

SEQ ID NO: 325509 - RNA, 18 nt, Bordetella pertussis
ccgggcgcaagcgcgccg

SEQ ID NO: 325510 - RNA, 19 nt, Bordetella pertussis
ccgggcgcaagcgcgccga

SEQ ID NO: 325511 - RNA, 13 nt, Bordetella pertussis
ccgggcgcccagc

SEQ ID NO: 325512 - RNA, 20 nt, Bordetella pertussis
ccgggcgcccagcgucucga

SEQ ID NO: 325513 - RNA, 12 nt, Bordetella pertussis
ccgggcgccagg

SEQ ID NO: 325514 - RNA, 15 nt, Bordetella pertussis
ccgggcgccaggcug

SEQ ID NO: 325515 - RNA, 16 nt, Bordetella pertussis
ccgggcgccaggcuga

SEQ ID NO: 325516 - RNA, 14 nt, Bordetella pertussis
ccgggcggcgcggg

SEQ ID NO: 325517 - RNA, 20 nt, Bordetella pertussis
ccgggcggcgcgggcggcua

SEQ ID NO: 325518 - RNA, 12 nt, Bordetella pertussis
ccgggcggcguu

SEQ ID NO: 325519 - RNA, 21 nt, Bordetella pertussis
ccgggcgggaauucgcugaag

SEQ ID NO: 325520 - RNA, 23 nt, Bordetella pertussis
ccgggcgggcacaacccgcccgg

SEQ ID NO: 325521 - RNA, 18 nt, Bordetella pertussis
ccgggcgguacaggucga

SEQ ID NO: 325522 - RNA, 23 nt, Bordetella pertussis
ccgggcugaacauccugaccggc

SEQ ID NO: 325523 - RNA, 20 nt, Bordetella pertussis
ccgggcugccguagcccagg

SEQ ID NO: 325524 - RNA, 17 nt, Bordetella pertussis
ccgggcugcugcacgcg

SEQ ID NO: 325525 - RNA, 17 nt, Bordetella pertussis
ccgggcuggccgccugc

SEQ ID NO: 325526 - RNA, 19 nt, Bordetella pertussis
ccgggcuggccgccugcug

SEQ ID NO: 325527 - RNA, 20 nt, Bordetella pertussis
ccgggcuggccgccugcugc

SEQ ID NO: 325528 - RNA, 21 nt, Bordetella pertussis
ccgggcuuucggucucgcgcg

SEQ ID NO: 325529 - RNA, 23 nt, Bordetella pertussis
ccgggcuuucggucucgcgcggc

SEQ ID NO: 325530 - RNA, 24 nt, Bordetella pertussis
ccgggcuuucggucucgcgcggcc

SEQ ID NO: 325531 - RNA, 15 nt, Bordetella pertussis
ccggggaagccgccg

SEQ ID NO: 325532 - RNA, 19 nt, Bordetella pertussis
ccggggaagccgccggcgu

SEQ ID NO: 325533 - RNA, 19 nt, Bordetella pertussis
ccggggaggccucgacgcu

SEQ ID NO: 325534 - RNA, 20 nt, Bordetella pertussis
ccggggaggccucgacgcug

SEQ ID NO: 325535 - RNA, 22 nt, Bordetella pertussis
ccggggcacccaggcgggcugg

SEQ ID NO: 325536 - RNA, 19 nt, Bordetella pertussis
ccggggcaggaagccggcc

SEQ ID NO: 325537 - RNA, 12 nt, Bordetella pertussis
ccggggccgccc

SEQ ID NO: 325538 - RNA, 15 nt, Bordetella pertussis
ccggggccgcccugg

SEQ ID NO: 325539 - RNA, 16 nt, Bordetella pertussis
ccggggcgcaccggca

SEQ ID NO: 325540 - RNA, 15 nt, Bordetella pertussis
ccggggcgggcgcgg

SEQ ID NO: 325541 - RNA, 17 nt, Bordetella pertussis
ccggggcgggcgcggua

SEQ ID NO: 325542 - RNA, 23 nt, Bordetella pertussis
ccggggcggcggcgcccgcaugg

SEQ ID NO: 325543 - RNA, 14 nt, Bordetella pertussis
ccggggcguggccg

SEQ ID NO: 325544 - RNA, 18 nt, Bordetella pertussis
ccggggggcgcacgccgc

SEQ ID NO: 325545 - RNA, 14 nt, Bordetella pertussis
ccggggucagcgcc

SEQ ID NO: 325546 - RNA, 16 nt, Bordetella pertussis
ccggggucagcgccgg

SEQ ID NO: 325547 - RNA, 19 nt, Bordetella pertussis
ccgggguugggaucgcgcc

SEQ ID NO: 325548 - RNA, 22 nt, Bordetella pertussis
ccgggguugggaucgcgccagg

SEQ ID NO: 325549 - RNA, 21 nt, Bordetella pertussis
ccggguaauggcgcuccagcc

SEQ ID NO: 325550 - RNA, 17 nt, Bordetella pertussis
ccggguccggccgcgca

SEQ ID NO: 325551 - RNA, 12 nt, Bordetella pertussis
ccgggucgagcg

SEQ ID NO: 325552 - RNA, 17 nt, Bordetella pertussis
ccgggucgagcgccgaa

SEQ ID NO: 325553 - RNA, 21 nt, Bordetella pertussis
ccgggugaaguugucgucggg

SEQ ID NO: 325554 - RNA, 18 nt, Bordetella pertussis
ccggugaucagcaggccc

SEQ ID NO: 325555 - RNA, 19 nt, Bordetella pertussis
ccggugaucagcaggccca

SEQ ID NO: 325556 - RNA, 19 nt, Bordetella pertussis
ccggugaucaucgugccgg

SEQ ID NO: 325557 - RNA, 21 nt, Bordetella pertussis
ccggugaugcggcgcgccgcg

SEQ ID NO: 325558 - RNA, 22 nt, Bordetella pertussis
ccggugaugcccgaggcggcgc

SEQ ID NO: 325559 - RNA, 20 nt, Bordetella pertussis
ccggugauguacgcaucggc

SEQ ID NO: 325560 - RNA, 23 nt, Bordetella pertussis
ccggugauguacgcaucggcgcc

SEQ ID NO: 325561 - RNA, 22 nt, Bordetella pertussis
ccggugauuucggcgcaucggc

SEQ ID NO: 325562 - RNA, 19 nt, Bordetella pertussis
ccggugcagccgccgcagg

SEQ ID NO: 325563 - RNA, 20 nt, Bordetella pertussis
ccggugcagcguggcgcggg

SEQ ID NO: 325564 - RNA, 22 nt, Bordetella pertussis
ccggugcaggucaucgcgcugg

SEQ ID NO: 325565 - RNA, 14 nt, Bordetella pertussis
ccggugccaguccc

SEQ ID NO: 325566 - RNA, 17 nt, Bordetella pertussis
ccggugucggggccggg

SEQ ID NO: 325567 - RNA, 18 nt, Bordetella pertussis
ccggugucggggccgggc

SEQ ID NO: 325568 - RNA, 13 nt, Bordetella pertussis
ccgguugacgauc

SEQ ID NO: 325569 - RNA, 19 nt, Bordetella pertussis
ccgguugcagcgcgccagg

SEQ ID NO: 325570 - RNA, 23 nt, Bordetella pertussis
ccgguuggcgccuuccggcagcg

SEQ ID NO: 325571 - RNA, 19 nt, Bordetella pertussis
ccgguuuuuuugcgccgcu

SEQ ID NO: 325572 - RNA, 17 nt, Bordetella pertussis
ccguaaagaugcgcgcc

SEQ ID NO: 325573 - RNA, 18 nt, Bordetella pertussis
ccguaaagaugcgcgccg

SEQ ID NO: 325574 - RNA, 19 nt, Bordetella pertussis
ccguaaagaugcgcgccgu

SEQ ID NO: 325575 - RNA, 13 nt, Bordetella pertussis
ccguaagcgcugg

SEQ ID NO: 325576 - RNA, 22 nt, Bordetella pertussis
ccguaagcgcuggacgcccugg

SEQ ID NO: 325577 - RNA, 13 nt, Bordetella pertussis
ccguacagccgcg

SEQ ID NO: 325578 - RNA, 17 nt, Bordetella pertussis
ccguacagccgcggcag

SEQ ID NO: 325579 - RNA, 14 nt, Bordetella pertussis
ccguaccccagcau

SEQ ID NO: 325580 - RNA, 14 nt, Bordetella pertussis
ccguacccgcgccg

SEQ ID NO: 325581 - RNA, 17 nt, Bordetella pertussis
ccguacgagugcaggcc

SEQ ID NO: 325582 - RNA, 19 nt, Bordetella pertussis
ccguacgcggcgcccgcgc

SEQ ID NO: 325583 - RNA, 22 nt, Bordetella pertussis
ccguacgccacuuccuugccau

SEQ ID NO: 325584 - RNA, 14 nt, Bordetella pertussis
ccguacgucaaggc

SEQ ID NO: 325585 - RNA, 15 nt, Bordetella pertussis
ccgucaacagcaugg

SEQ ID NO: 325586 - RNA, 22 nt, Bordetella pertussis
ccgucaagcguucauggcgcau

SEQ ID NO: 325587 - RNA, 12 nt, Bordetella pertussis
ccgucagcacgg

SEQ ID NO: 325588 - RNA, 20 nt, Bordetella pertussis
ccgucagcacggucggcgcg

SEQ ID NO: 325589 - RNA, 16 nt, Bordetella pertussis
ccgucagcagcgcggc

SEQ ID NO: 325590 - RNA, 19 nt, Bordetella pertussis
ccgucagcgacaucgugcu

SEQ ID NO: 325591 - RNA, 15 nt, Bordetella pertussis
ccgucagcggcgcgc

SEQ ID NO: 325592 - RNA, 19 nt, Bordetella pertussis
ccgucagcucgaucaggcg

SEQ ID NO: 325593 - RNA, 16 nt, Bordetella pertussis
ccgucaggaucaggcc

SEQ ID NO: 325594 - RNA, 16 nt, Bordetella pertussis
ccgucaggcggaugcg

SEQ ID NO: 325595 - RNA, 15 nt, Bordetella pertussis
ccgucaggugcagcg

SEQ ID NO: 325596 - RNA, 13 nt, Bordetella pertussis
ccgucaucgccgc

SEQ ID NO: 325597 - RNA, 14 nt, Bordetella pertussis
ccgucaucgccgcg

SEQ ID NO: 325598 - RNA, 17 nt, Bordetella pertussis
ccgucaucgccgcggcg

SEQ ID NO: 325599 - RNA, 13 nt, Bordetella pertussis
ccgucaucgggug

SEQ ID NO: 325600 - RNA, 18 nt, Bordetella pertussis
ccgucaucgggugcggcg

SEQ ID NO: 325601 - RNA, 21 nt, Bordetella pertussis
ccgucaucgggugcggcgccu

SEQ ID NO: 325602 - RNA, 14 nt, Bordetella pertussis
ccgucaugcgccgc

SEQ ID NO: 325603 - RNA, 22 nt, Bordetella pertussis
ccguccaaaacagacaggccgg

SEQ ID NO: 325604 - RNA, 18 nt, Bordetella pertussis
ccguccgagcccgacgcg

SEQ ID NO: 325605 - RNA, 21 nt, Bordetella pertussis
ccguccgagcccgacgcgagg

SEQ ID NO: 325606 - RNA, 21 nt, Bordetella pertussis
ccguccgccaggacgggaaag

SEQ ID NO: 325607 - RNA, 21 nt, Bordetella pertussis
ccguccgcgacgguccugcgc

SEQ ID NO: 325608 - RNA, 18 nt, Bordetella pertussis
ccguccuuggcguccggc

SEQ ID NO: 325609 - RNA, 18 nt, Bordetella pertussis
ccgucgaccgcgaagcgc

SEQ ID NO: 325610 - RNA, 21 nt, Bordetella pertussis
ccgucgaccgcgaagcgcgcc

SEQ ID NO: 325611 - RNA, 22 nt, Bordetella pertussis
ccgucgaccgcgaagcgcgcca

SEQ ID NO: 325612 - RNA, 18 nt, Bordetella pertussis
ccgucgagaaugacggug

SEQ ID NO: 325613 - RNA, 16 nt, Bordetella pertussis
ccgucgagccgggcgc

SEQ ID NO: 325614 - RNA, 17 nt, Bordetella pertussis
ccgucgagccgggcgcc

SEQ ID NO: 325615 - RNA, 18 nt, Bordetella pertussis
ccgucgagccgggcgccg

SEQ ID NO: 325616 - RNA, 14 nt, Bordetella pertussis
ccgucgagcgcggc

SEQ ID NO: 325617 - RNA, 16 nt, Bordetella pertussis
ccgucgagcgcggcca

SEQ ID NO: 325618 - RNA, 16 nt, Bordetella pertussis
ccgucggccacguccg

SEQ ID NO: 325619 - RNA, 13 nt, Bordetella pertussis
ccgucggccagcu

SEQ ID NO: 325620 - RNA, 13 nt, Bordetella pertussis
ccgucggccgucu

SEQ ID NO: 325621 - RNA, 23 nt, Bordetella pertussis
ccgucggccuggaacauggcccg

SEQ ID NO: 325622 - RNA, 19 nt, Bordetella pertussis
ccgucgucguccacgcccg

SEQ ID NO: 325623 - RNA, 14 nt, Bordetella pertussis
ccgucucgcccagg

SEQ ID NO: 325624 - RNA, 16 nt, Bordetella pertussis
ccgucucgcccaggcc

SEQ ID NO: 325625 - RNA, 13 nt, Bordetella pertussis
ccgucucgcgcgc

SEQ ID NO: 325626 - RNA, 17 nt, Bordetella pertussis
ccgucuggcggcagcuc

SEQ ID NO: 325627 - RNA, 16 nt, Bordetella pertussis
ccgucugugcgccccg

SEQ ID NO: 325628 - RNA, 17 nt, Bordetella pertussis
ccgucugugcgccccgc

SEQ ID NO: 325629 - RNA, 18 nt, Bordetella pertussis
ccgucuugcccgccagcg

SEQ ID NO: 325630 - RNA, 15 nt, Bordetella pertussis
ccgucuuggcgggcu

SEQ ID NO: 325631 - RNA, 13 nt, Bordetella pertussis
ccgucuuggcgug

SEQ ID NO: 325632 - RNA, 14 nt, Bordetella pertussis
ccgugaaggugccg

SEQ ID NO: 325633 - RNA, 22 nt, Bordetella pertussis
ccgugccaguucacgguguugc

SEQ ID NO: 325634 - RNA, 23 nt, Bordetella pertussis
ccgugccgcagaagaacaccgug

SEQ ID NO: 325635 - RNA, 14 nt, Bordetella pertussis
ccgugccgccgagg

SEQ ID NO: 325636 - RNA, 21 nt, Bordetella pertussis
ccgugccgcggcgcggcccgc

SEQ ID NO: 325637 - RNA, 23 nt, Bordetella pertussis
ccgugccgggccuggugcccgac

SEQ ID NO: 325638 - RNA, 18 nt, Bordetella pertussis
ccgugcgggugccugucc

SEQ ID NO: 325639 - RNA, 22 nt, Bordetella pertussis
ccgugcuccagaacgcgccgua

SEQ ID NO: 325640 - RNA, 21 nt, Bordetella pertussis
ccgugcugaucgacaugcugg

SEQ ID NO: 325641 - RNA, 14 nt, Bordetella pertussis
ccgugcuggccgcg

SEQ ID NO: 325642 - RNA, 15 nt, Bordetella pertussis
ccgugcuggccgcgg

SEQ ID NO: 325643 - RNA, 21 nt, Bordetella pertussis
ccgugcugguuguccaccacc

SEQ ID NO: 325644 - RNA, 14 nt, Bordetella pertussis
ccguggaggcggcg

SEQ ID NO: 325645 - RNA, 20 nt, Bordetella pertussis
ccguggcccagccgcaugcc

SEQ ID NO: 325646 - RNA, 17 nt, Bordetella pertussis
ccguggccacggccgcg

SEQ ID NO: 325647 - RNA, 18 nt, Bordetella pertussis
ccguggccacggccgcga

SEQ ID NO: 325648 - RNA, 19 nt, Bordetella pertussis
ccguggccggcaucgcgcu

SEQ ID NO: 325649 - RNA, 17 nt, Bordetella pertussis
ccguggccggcgcggca

SEQ ID NO: 325650 - RNA, 19 nt, Bordetella pertussis
ccguggccgggcccggcgc

SEQ ID NO: 325651 - RNA, 20 nt, Bordetella pertussis
ccguggcgauccagggccgc

SEQ ID NO: 325652 - RNA, 22 nt, Bordetella pertussis
ccguggcgcggccaauggccgg

SEQ ID NO: 325653 - RNA, 11 nt, Bordetella pertussis
ccguggcggcc

SEQ ID NO: 325654 - RNA, 14 nt, Bordetella pertussis
ccguggcggccaca

SEQ ID NO: 325655 - RNA, 14 nt, Bordetella pertussis
ccguggcggccgcg

SEQ ID NO: 325656 - RNA, 15 nt, Bordetella pertussis
ccguggcggccgcgg

SEQ ID NO: 325657 - RNA, 16 nt, Bordetella pertussis
ccguggcggccugcgc

SEQ ID NO: 325658 - RNA, 17 nt, Bordetella pertussis
ccguguucgacgcggcc

SEQ ID NO: 325659 - RNA, 14 nt, Bordetella pertussis
ccguucagggacgg

SEQ ID NO: 325660 - RNA, 19 nt, Bordetella pertussis
ccguucggccagcgcgcgg

SEQ ID NO: 325661 - RNA, 21 nt, Bordetella pertussis
ccguucggccagcgcgcggcg

SEQ ID NO: 325662 - RNA, 21 nt, Bordetella pertussis
ccuaccaggugggcgcgcuca

SEQ ID NO: 325663 - RNA, 22 nt, Bordetella pertussis
ccuaccggcgccgacgcgcugg

SEQ ID NO: 325664 - RNA, 14 nt, Bordetella pertussis
ccuacuggcgcgcg

SEQ ID NO: 325665 - RNA, 15 nt, Bordetella pertussis
ccuacuggcgcgcgc

SEQ ID NO: 325666 - RNA, 16 nt, Bordetella pertussis
ccuacuggcgcgcgca

SEQ ID NO: 325667 - RNA, 14 nt, Bordetella pertussis
ccuacugcccucgc

SEQ ID NO: 325668 - RNA, 15 nt, Bordetella pertussis
ccuagcccggcgcca

SEQ ID NO: 325669 - RNA, 21 nt, Bordetella pertussis
ccuagcgccgcgccagguagg

SEQ ID NO: 325670 - RNA, 16 nt, Bordetella pertussis
ccuauaucgacggcgc

SEQ ID NO: 325671 - RNA, 21 nt, Bordetella pertussis
ccucagcccgcaccgcccgca

SEQ ID NO: 325672 - RNA, 14 nt, Bordetella pertussis
ccucagccugcugg

SEQ ID NO: 325673 - RNA, 20 nt, Bordetella pertussis
ccucagcguuuccagggcgc

SEQ ID NO: 325674 - RNA, 16 nt, Bordetella pertussis
ccucaggaugcccggg

SEQ ID NO: 325675 - RNA, 19 nt, Bordetella pertussis
ccucaggcccgcggcgcca

SEQ ID NO: 325676 - RNA, 16 nt, Bordetella pertussis
ccucaugcgggacagg

SEQ ID NO: 325677 - RNA, 15 nt, Bordetella pertussis
ccucauuggcgcgcu

SEQ ID NO: 325678 - RNA, 17 nt, Bordetella pertussis
ccucauuggcgcgcuug

SEQ ID NO: 325679 - RNA, 12 nt, Bordetella pertussis
ccuccgcgccga

SEQ ID NO: 325680 - RNA, 17 nt, Bordetella pertussis
ccuccgcguugcgcugc

SEQ ID NO: 325681 - RNA, 15 nt, Bordetella pertussis
ccuccggcgccagca

SEQ ID NO: 325682 - RNA, 14 nt, Bordetella pertussis
ccuccggcgccgcc

SEQ ID NO: 325683 - RNA, 16 nt, Bordetella pertussis
ccuccgggucgcggca

SEQ ID NO: 325684 - RNA, 19 nt, Bordetella pertussis
ccuccgggucgcggcacga

SEQ ID NO: 325685 - RNA, 18 nt, Bordetella pertussis
ccuccucgcuuuaccagc

SEQ ID NO: 325686 - RNA, 22 nt, Bordetella pertussis
ccuccucggccaggucgcgcau

SEQ ID NO: 325687 - RNA, 14 nt, Bordetella pertussis
ccucgacgucgccc

SEQ ID NO: 325688 - RNA, 16 nt, Bordetella pertussis
ccucgagcaccuugac

SEQ ID NO: 325689 - RNA, 19 nt, Bordetella pertussis
ccucgagguauucgcgcga

SEQ ID NO: 325690 - RNA, 20 nt, Bordetella pertussis
ccucgagguauucgcgcgau

SEQ ID NO: 325691 - RNA, 19 nt, Bordetella pertussis
ccucgaucaccaccggcaa

SEQ ID NO: 325692 - RNA, 24 nt, Bordetella pertussis
ccucgaucagcgaaugcgacagcg

SEQ ID NO: 325693 - RNA, 14 nt, Bordetella pertussis
ccucgaucgccagg

SEQ ID NO: 325694 - RNA, 14 nt, Bordetella pertussis
ccucgaugcccucg

SEQ ID NO: 325695 - RNA, 18 nt, Bordetella pertussis
ccucgauugaccagcacc

SEQ ID NO: 325696 - RNA, 20 nt, Bordetella pertussis
ccucgcaagcggccaugcgc

SEQ ID NO: 325697 - RNA, 16 nt, Bordetella pertussis
ccucgcaucggccugc

SEQ ID NO: 325698 - RNA, 21 nt, Bordetella pertussis
ccucgcccagcgagccggcca

SEQ ID NO: 325699 - RNA, 23 nt, Bordetella pertussis
ccucgcccagcgagccggccagc

SEQ ID NO: 325700 - RNA, 15 nt, Bordetella pertussis
ccucgcccagcggcg

SEQ ID NO: 325701 - RNA, 14 nt, Bordetella pertussis
ccucgcccaggccg

SEQ ID NO: 325702 - RNA, 17 nt, Bordetella pertussis
ccucgcccaggccgggc

SEQ ID NO: 325703 - RNA, 14 nt, Bordetella pertussis
ccucgccagcggca

SEQ ID NO: 325704 - RNA, 18 nt, Bordetella pertussis
ccucgccagcggcagcgc

SEQ ID NO: 325705 - RNA, 20 nt, Bordetella pertussis
ccucgcccccgaaggccgcg

SEQ ID NO: 325706 - RNA, 21 nt, Bordetella pertussis
ccucgcccgaucggccggccg

SEQ ID NO: 325707 - RNA, 13 nt, Bordetella pertussis
ccucgccgcccag

SEQ ID NO: 325708 - RNA, 12 nt, Bordetella pertussis
ccucgccggccc

SEQ ID NO: 325709 - RNA, 20 nt, Bordetella pertussis
ccucgccggccuggcgcgcg

SEQ ID NO: 325710 - RNA, 13 nt, Bordetella pertussis
ccucgcgccacca

SEQ ID NO: 325711 - RNA, 15 nt, Bordetella pertussis
ccucgcggcgcagca

SEQ ID NO: 325712 - RNA, 18 nt, Bordetella pertussis
ccucgcggcgcagcauga

SEQ ID NO: 325713 - RNA, 12 nt, Bordetella pertussis
ccucggcgagcg

SEQ ID NO: 325714 - RNA, 13 nt, Bordetella pertussis
ccucggcgccgcg

SEQ ID NO: 325715 - RNA, 12 nt, Bordetella pertussis
ccucggcgcgcg

SEQ ID NO: 325716 - RNA, 13 nt, Bordetella pertussis
ccucggcgcgcgc

SEQ ID NO: 325717 - RNA, 15 nt, Bordetella pertussis
ccucggcggccuccg

SEQ ID NO: 325718 - RNA, 16 nt, Bordetella pertussis
ccucggcggccuccgg

SEQ ID NO: 325719 - RNA, 13 nt, Bordetella pertussis
ccucggcggcguc

SEQ ID NO: 325720 - RNA, 15 nt, Bordetella pertussis
ccucggucgccucga

SEQ ID NO: 325721 - RNA, 24 nt, Bordetella pertussis
ccucggucgucagcacgcccuggc

SEQ ID NO: 325722 - RNA, 14 nt, Bordetella pertussis
ccucggucucgugc

SEQ ID NO: 325723 - RNA, 15 nt, Bordetella pertussis
ccucuucagcccggc

SEQ ID NO: 325724 - RNA, 18 nt, Bordetella pertussis
ccucuuucgccgcgcgcu

SEQ ID NO: 325725 - RNA, 19 nt, Bordetella pertussis
ccugaacaccggcgcgccu

SEQ ID NO: 325726 - RNA, 17 nt, Bordetella pertussis
ccugaaccaggccgcca

SEQ ID NO: 325727 - RNA, 14 nt, Bordetella pertussis
ccugaacgccgggc

SEQ ID NO: 325728 - RNA, 16 nt, Bordetella pertussis
ccugaacuauggcgcg

SEQ ID NO: 325729 - RNA, 13 nt, Bordetella pertussis
ccugaaucgcccg

SEQ ID NO: 325730 - RNA, 15 nt, Bordetella pertussis
ccugacccccgaacu

SEQ ID NO: 325731 - RNA, 20 nt, Bordetella pertussis
ccugaucaaucugaucaucu

SEQ ID NO: 325732 - RNA, 20 nt, Bordetella pertussis
ccugaucccggcgcuggccg

SEQ ID NO: 325733 - RNA, 21 nt, Bordetella pertussis
ccugaucgaauaccugcgccg

SEQ ID NO: 325734 - RNA, 14 nt, Bordetella pertussis
ccugaucgcgcagc

SEQ ID NO: 325735 - RNA, 15 nt, Bordetella pertussis
ccugaucgcgcagcg

SEQ ID NO: 325736 - RNA, 23 nt, Bordetella pertussis
ccugaucgcgcagcgccuggccg

SEQ ID NO: 325737 - RNA, 15 nt, Bordetella pertussis
ccugaugccuguccc

SEQ ID NO: 325738 - RNA, 12 nt, Bordetella pertussis
ccugauggcgcg

SEQ ID NO: 325739 - RNA, 14 nt, Bordetella pertussis
ccugaugucggccu

SEQ ID NO: 325740 - RNA, 22 nt, Bordetella pertussis
ccugauucccaggcccggccgc

SEQ ID NO: 325741 - RNA, 22 nt, Bordetella pertussis
ccugcaaaaaacaagcucgcgc

SEQ ID NO: 325742 - RNA, 20 nt, Bordetella pertussis
ccugcagcacgcuggccuug

SEQ ID NO: 325743 - RNA, 21 nt, Bordetella pertussis
ccugcagcagcguggccgcca

SEQ ID NO: 325744 - RNA, 15 nt, Bordetella pertussis
ccugcagcaggucgg

SEQ ID NO: 325745 - RNA, 13 nt, Bordetella pertussis
ccugcagcaugac

SEQ ID NO: 325746 - RNA, 23 nt, Bordetella pertussis
ccugcagccagaucucgcguccg

SEQ ID NO: 325747 - RNA, 13 nt, Bordetella pertussis
ccugcagcgccgc

SEQ ID NO: 325748 - RNA, 14 nt, Bordetella pertussis
ccugcagcgccgcc

SEQ ID NO: 325749 - RNA, 12 nt, Bordetella pertussis
ccugcagcgcgc

SEQ ID NO: 325750 - RNA, 12 nt, Bordetella pertussis
ccugcagcggcc

SEQ ID NO: 325751 - RNA, 16 nt, Bordetella pertussis
ccugcaugaccgccgc

SEQ ID NO: 325752 - RNA, 18 nt, Bordetella pertussis
ccugcaugaccgccgcca

SEQ ID NO: 325753 - RNA, 20 nt, Bordetella pertussis
ccugcauguccagcggcgua

SEQ ID NO: 325754 - RNA, 15 nt, Bordetella pertussis
ccugccaagcgccgc

SEQ ID NO: 325755 - RNA, 18 nt, Bordetella pertussis
ccugccaagcgccgcggc

SEQ ID NO: 325756 - RNA, 21 nt, Bordetella pertussis
ccugccaagcgccgcggccac

SEQ ID NO: 325757 - RNA, 14 nt, Bordetella pertussis
ccugccaccagcgc

SEQ ID NO: 325758 - RNA, 16 nt, Bordetella pertussis
ccugccaccagcgcgc

SEQ ID NO: 325759 - RNA, 20 nt, Bordetella pertussis
ccugccaccagcgcgccagc

SEQ ID NO: 325760 - RNA, 14 nt, Bordetella pertussis
ccugccagcccacc

SEQ ID NO: 325761 - RNA, 16 nt, Bordetella pertussis
ccugccagcccaccag

SEQ ID NO: 325762 - RNA, 15 nt, Bordetella pertussis
ccugccagccugcca

SEQ ID NO: 325763 - RNA, 20 nt, Bordetella pertussis
ccugccaguucgaugcgcuu

SEQ ID NO: 325764 - RNA, 18 nt, Bordetella pertussis
ccugccaguugccgccgc

SEQ ID NO: 325765 - RNA, 15 nt, Bordetella pertussis
ccugccauccggccg

SEQ ID NO: 325766 - RNA, 16 nt, Bordetella pertussis
ccugccauccggccgc

SEQ ID NO: 325767 - RNA, 22 nt, Bordetella pertussis
ccugccauucgucguagccgcc

SEQ ID NO: 325768 - RNA, 15 nt, Bordetella pertussis
ccugcccaccgccgc

SEQ ID NO: 325769 - RNA, 20 nt, Bordetella pertussis
ccugcccaggccagcgccgc

SEQ ID NO: 325770 - RNA, 19 nt, Bordetella pertussis
ccugccccugcggggacag

SEQ ID NO: 325771 - RNA, 14 nt, Bordetella pertussis
ccugcccgccuggu

SEQ ID NO: 325772 - RNA, 13 nt, Bordetella pertussis
ccugcccggcagg

SEQ ID NO: 325773 - RNA, 18 nt, Bordetella pertussis
ccugcccggcgagcaugg

SEQ ID NO: 325774 - RNA, 22 nt, Bordetella pertussis
ccugcccgucuauggccugcag

SEQ ID NO: 325775 - RNA, 17 nt, Bordetella pertussis
ccugcccguucacgcgc

SEQ ID NO: 325776 - RNA, 20 nt, Bordetella pertussis
ccugcccguucacgcgcagc

SEQ ID NO: 325777 - RNA, 21 nt, Bordetella pertussis
ccugcccguucacgcgcagcg

SEQ ID NO: 325778 - RNA, 17 nt, Bordetella pertussis
ccugcccucgggcgaca

SEQ ID NO: 325779 - RNA, 16 nt, Bordetella pertussis
ccugccgagcgcugcg

SEQ ID NO: 325780 - RNA, 13 nt, Bordetella pertussis
ccugccgcauccc

SEQ ID NO: 325781 - RNA, 17 nt, Bordetella pertussis
ccugccgccaagggcgc

SEQ ID NO: 325782 - RNA, 20 nt, Bordetella pertussis
ccugccgccaagggcgcgcc

SEQ ID NO: 325783 - RNA, 21 nt, Bordetella pertussis
ccugccgccaagggcgcgcca

SEQ ID NO: 325784 - RNA, 23 nt, Bordetella pertussis
ccugccgccaagggcgcgccagc

SEQ ID NO: 325785 - RNA, 17 nt, Bordetella pertussis
ccugccgcccgagcugg

SEQ ID NO: 325786 - RNA, 14 nt, Bordetella pertussis
ccugccgcgcccgg

SEQ ID NO: 325787 - RNA, 15 nt, Bordetella pertussis
ccugccgcgcccggc

SEQ ID NO: 325788 - RNA, 20 nt, Bordetella pertussis
ccugccgcgcccggcggcca

SEQ ID NO: 325789 - RNA, 13 nt, Bordetella pertussis
ccugccgcgccga

SEQ ID NO: 325790 - RNA, 22 nt, Bordetella pertussis
ccugccgcgccgaccggcccca

SEQ ID NO: 325791 - RNA, 13 nt, Bordetella pertussis
ccugccgcgcgua

SEQ ID NO: 325792 - RNA, 20 nt, Bordetella pertussis
ccugccgcgcguacgcggcg

SEQ ID NO: 325793 - RNA, 21 nt, Bordetella pertussis
ccugccgcgcguacgcggcgc

SEQ ID NO: 325794 - RNA, 13 nt, Bordetella pertussis
ccugccgcggccg

SEQ ID NO: 325795 - RNA, 16 nt, Bordetella pertussis
ccugccgcggccgccc

SEQ ID NO: 325796 - RNA, 15 nt, Bordetella pertussis
ccugccgccugccag

SEQ ID NO: 325797 - RNA, 13 nt, Bordetella pertussis
ccugccggccggc

SEQ ID NO: 325798 - RNA, 15 nt, Bordetella pertussis
ccugccggccggcca

SEQ ID NO: 325799 - RNA, 17 nt, Bordetella pertussis
ccugccggccuggcuca

SEQ ID NO: 325800 - RNA, 13 nt, Bordetella pertussis
ccugccggcgcgc

SEQ ID NO: 325801 - RNA, 19 nt, Bordetella pertussis
ccugccggcgcgccucggc

SEQ ID NO: 325802 - RNA, 15 nt, Bordetella pertussis
ccugccggcggacga

SEQ ID NO: 325803 - RNA, 18 nt, Bordetella pertussis
ccugccggggcacccagg

SEQ ID NO: 325804 - RNA, 17 nt, Bordetella pertussis
ccugccguucgcgcugc

SEQ ID NO: 325805 - RNA, 13 nt, Bordetella pertussis
ccugccugccgcc

SEQ ID NO: 325806 - RNA, 16 nt, Bordetella pertussis
ccugcgaacccgccgc

SEQ ID NO: 325807 - RNA, 17 nt, Bordetella pertussis
ccugcgaacccgccgcg

SEQ ID NO: 325808 - RNA, 16 nt, Bordetella pertussis
ccuggccccaggcgcc

SEQ ID NO: 325809 - RNA, 19 nt, Bordetella pertussis
ccuggccccaggcgcccga

SEQ ID NO: 325810 - RNA, 13 nt, Bordetella pertussis
ccuggccgaacgc

SEQ ID NO: 325811 - RNA, 19 nt, Bordetella pertussis
ccuggccgaacgccgccgc

SEQ ID NO: 325812 - RNA, 18 nt, Bordetella pertussis
ccuggccgauuucgcgcg

SEQ ID NO: 325813 - RNA, 21 nt, Bordetella pertussis
ccuggccgauuucgcgcgcca

SEQ ID NO: 325814 - RNA, 14 nt, Bordetella pertussis
ccuggccgcccagc

SEQ ID NO: 325815 - RNA, 14 nt, Bordetella pertussis
ccuggccgccgcgg

SEQ ID NO: 325816 - RNA, 21 nt, Bordetella pertussis
ccuggccgccgcgggcgccgc

SEQ ID NO: 325817 - RNA, 13 nt, Bordetella pertussis
ccuggccgcgcgc

SEQ ID NO: 325818 - RNA, 14 nt, Bordetella pertussis
ccuggccgcgcgcc

SEQ ID NO: 325819 - RNA, 15 nt, Bordetella pertussis
ccuggccgcgcgccu

SEQ ID NO: 325820 - RNA, 14 nt, Bordetella pertussis
ccuggccgggacaa

SEQ ID NO: 325821 - RNA, 15 nt, Bordetella pertussis
ccuggcgaccggcgg

SEQ ID NO: 325822 - RNA, 18 nt, Bordetella pertussis
ccuggcgacggccugcca

SEQ ID NO: 325823 - RNA, 14 nt, Bordetella pertussis
ccuggcgcccgacg

SEQ ID NO: 325824 - RNA, 14 nt, Bordetella pertussis
ccuggcgcccggcg

SEQ ID NO: 325825 - RNA, 16 nt, Bordetella pertussis
ccuggcgcccggcggc

SEQ ID NO: 325826 - RNA, 13 nt, Bordetella pertussis
ccuggcgccgcgg

SEQ ID NO: 325827 - RNA, 13 nt, Bordetella pertussis
ccuggcgcgcguu

SEQ ID NO: 325828 - RNA, 18 nt, Bordetella pertussis
ccuggcgcgacgccugcg

SEQ ID NO: 325829 - RNA, 15 nt, Bordetella pertussis
ccuggcgcgagacca

SEQ ID NO: 325830 - RNA, 15 nt, Bordetella pertussis
ccuggcgcgccagcu

SEQ ID NO: 325831 - RNA, 16 nt, Bordetella pertussis
ccuggcgcgccagcuc

SEQ ID NO: 325832 - RNA, 23 nt, Bordetella pertussis
ccuggcgcuguuuccgggccugg

SEQ ID NO: 325833 - RNA, 20 nt, Bordetella pertussis
ccuggcggacgauggccugu

SEQ ID NO: 325834 - RNA, 13 nt, Bordetella pertussis
ccuggcggccgcc

SEQ ID NO: 325835 - RNA, 19 nt, Bordetella pertussis
ccuggcggccgcccagcag

SEQ ID NO: 325836 - RNA, 22 nt, Bordetella pertussis
ccuggcggcugucgggcggcgc

SEQ ID NO: 325837 - RNA, 17 nt, Bordetella pertussis
ccuggcgggccugggcg

SEQ ID NO: 325838 - RNA, 22 nt, Bordetella pertussis
ccuggcguagggcugcacgaug

SEQ ID NO: 325839 - RNA, 16 nt, Bordetella pertussis
ccuggcguggcgcgcg

SEQ ID NO: 325840 - RNA, 17 nt, Bordetella pertussis
ccuggcguggcgcgcgc

SEQ ID NO: 325841 - RNA, 18 nt, Bordetella pertussis
ccuggcguggcgcgcgcc

SEQ ID NO: 325842 - RNA, 15 nt, Bordetella pertussis
ccuggcguucgcgcg

SEQ ID NO: 325843 - RNA, 21 nt, Bordetella pertussis
ccuggcguucggcaccggcag

SEQ ID NO: 325844 - RNA, 13 nt, Bordetella pertussis
ccuggcucaggcc

SEQ ID NO: 325845 - RNA, 15 nt, Bordetella pertussis
ccuggcucaggccug

SEQ ID NO: 325846 - RNA, 19 nt, Bordetella pertussis
ccuggcucaggccugcacg

SEQ ID NO: 325847 - RNA, 22 nt, Bordetella pertussis
ccuggcucagucggccuggcgc

SEQ ID NO: 325848 - RNA, 13 nt, Bordetella pertussis
ccuggcggugcgc

SEQ ID NO: 325849 - RNA, 15 nt, Bordetella pertussis
ccuggcggugcgccg

SEQ ID NO: 325850 - RNA, 18 nt, Bordetella pertussis
ccuggcuccccgggcacc

SEQ ID NO: 325851 - RNA, 20 nt, Bordetella pertussis
ccuggcucugaucgcgcugg

SEQ ID NO: 325852 - RNA, 15 nt, Bordetella pertussis
ccuggcucuugccgu

SEQ ID NO: 325853 - RNA, 20 nt, Bordetella pertussis
ccuggcugagcgacaugucg

SEQ ID NO: 325854 - RNA, 16 nt, Bordetella pertussis
ccuggcuuggcggcca

SEQ ID NO: 325855 - RNA, 22 nt, Bordetella pertussis
ccugggcaaccgccacgugcug

SEQ ID NO: 325856 - RNA, 18 nt, Bordetella pertussis
ccugggccagccagcgcc

SEQ ID NO: 325857 - RNA, 12 nt, Bordetella pertussis
ccugggccaucg

SEQ ID NO: 325858 - RNA, 16 nt, Bordetella pertussis
ccugggccgccugcug

SEQ ID NO: 325859 - RNA, 17 nt, Bordetella pertussis
ccugggccgccugcugg

SEQ ID NO: 325860 - RNA, 18 nt, Bordetella pertussis
ccugggccgagcgcgcca

SEQ ID NO: 325861 - RNA, 22 nt, Bordetella pertussis
ccugggccgagcgcgccagcac

SEQ ID NO: 325862 - RNA, 18 nt, Bordetella pertussis
ccugggccgucaugcgcc

SEQ ID NO: 325863 - RNA, 12 nt, Bordetella pertussis
ccugggccugcg

SEQ ID NO: 325864 - RNA, 15 nt, Bordetella pertussis
ccugggccugcggcg

SEQ ID NO: 325865 - RNA, 17 nt, Bordetella pertussis
ccugggccugcggcguc

SEQ ID NO: 325866 - RNA, 15 nt, Bordetella pertussis
ccugggcgccggcgg

SEQ ID NO: 325867 - RNA, 15 nt, Bordetella pertussis
ccugggcgcgcgcca

SEQ ID NO: 325868 - RNA, 15 nt, Bordetella pertussis
ccugggcgcgcgccc

SEQ ID NO: 325869 - RNA, 17 nt, Bordetella pertussis
ccugggcgcgcgcccag

SEQ ID NO: 325870 - RNA, 21 nt, Bordetella pertussis
ccugggcgcgcgcccaggcca

SEQ ID NO: 325871 - RNA, 21 nt, Bordetella pertussis
ccugggcggcgcgcucuccga

SEQ ID NO: 325872 - RNA, 13 nt, Bordetella pertussis
ccuggggcgcggu

SEQ ID NO: 325873 - RNA, 18 nt, Bordetella pertussis
ccuggggcgggcgcugcg

SEQ ID NO: 325874 - RNA, 20 nt, Bordetella pertussis
ccuggggggucaaccaggua

SEQ ID NO: 325875 - RNA, 22 nt, Bordetella pertussis
ccugggugccuguccccgaacg

SEQ ID NO: 325876 - RNA, 13 nt, Bordetella pertussis
ccugggugcgcca

SEQ ID NO: 325877 - RNA, 19 nt, Bordetella pertussis
ccugggugcugccgccgau

SEQ ID NO: 325878 - RNA, 19 nt, Bordetella pertussis
ccugguacgacagcucggg

SEQ ID NO: 325879 - RNA, 14 nt, Bordetella pertussis
ccugguacgaucag

SEQ ID NO: 325880 - RNA, 16 nt, Bordetella pertussis
ccugguacgaucaggc

SEQ ID NO: 325881 - RNA, 17 nt, Bordetella pertussis
ccugguacggcaucccg

SEQ ID NO: 325882 - RNA, 15 nt, Bordetella pertussis
ccugguagccggcga

SEQ ID NO: 325883 - RNA, 16 nt, Bordetella pertussis
ccugguagccggcgac

SEQ ID NO: 325884 - RNA, 23 nt, Bordetella pertussis
ccugguaucccucgcccagcgag

SEQ ID NO: 325885 - RNA, 18 nt, Bordetella pertussis
ccuggucaagggcggcca

SEQ ID NO: 325886 - RNA, 23 nt, Bordetella pertussis
ccuggucaagggcggccaugccg

SEQ ID NO: 325887 - RNA, 16 nt, Bordetella pertussis
ccuggucacccggcgc

SEQ ID NO: 325888 - RNA, 19 nt, Bordetella pertussis
ccuggucacccggcgcaug

SEQ ID NO: 325889 - RNA, 13 nt, Bordetella pertussis
ccugguccgccgc

SEQ ID NO: 325890 - RNA, 16 nt, Bordetella pertussis
ccugguccgccgcgac

SEQ ID NO: 325891 - RNA, 20 nt, Bordetella pertussis
ccugguccgccgcgaccacc

SEQ ID NO: 325892 - RNA, 20 nt, Bordetella pertussis
ccuggucgaacguggcggcg

SEQ ID NO: 325893 - RNA, 13 nt, Bordetella pertussis
ccuggucgacgcc

SEQ ID NO: 325894 - RNA, 17 nt, Bordetella pertussis
ccuggucgacgcgacgc

SEQ ID NO: 325895 - RNA, 14 nt, Bordetella pertussis
ccuggucgaucgag

SEQ ID NO: 325896 - RNA, 17 nt, Bordetella pertussis
ccuggucgcuggcgccg

SEQ ID NO: 325897 - RNA, 15 nt, Bordetella pertussis
ccuggucgcgcgccu

SEQ ID NO: 325898 - RNA, 23 nt, Bordetella pertussis
ccuggucgcgcgccugcaugcca

SEQ ID NO: 325899 - RNA, 12 nt, Bordetella pertussis
ccuggucggcgc

SEQ ID NO: 325900 - RNA, 16 nt, Bordetella pertussis
ccuggucggcgcggca

SEQ ID NO: 325901 - RNA, 17 nt, Bordetella pertussis
ccuggucggcgcggcag

SEQ ID NO: 325902 - RNA, 16 nt, Bordetella pertussis
ccuggucgucgcggcc

SEQ ID NO: 325903 - RNA, 20 nt, Bordetella pertussis
ccuggucgucggccacgccc

SEQ ID NO: 325904 - RNA, 18 nt, Bordetella pertussis
ccuggugcaccacgcgcu

SEQ ID NO: 325905 - RNA, 21 nt, Bordetella pertussis
ccuggugcaccacgcgcucca

SEQ ID NO: 325906 - RNA, 13 nt, Bordetella pertussis
ccuggugcccgac

SEQ ID NO: 325907 - RNA, 20 nt, Bordetella pertussis
ccuggugcccgacgccgcgc

SEQ ID NO: 325908 - RNA, 16 nt, Bordetella pertussis
ccugguggcgcuggcc

SEQ ID NO: 325909 - RNA, 16 nt, Bordetella pertussis
ccugguggaccugccg

SEQ ID NO: 325910 - RNA, 16 nt, Bordetella pertussis
ccugguguucggcacc

SEQ ID NO: 325911 - RNA, 22 nt, Bordetella pertussis
ccugguucaggcgagcggcguc

SEQ ID NO: 325912 - RNA, 18 nt, Bordetella pertussis
ccugguugaccgagcccg

SEQ ID NO: 325913 - RNA, 16 nt, Bordetella pertussis
ccugguuggccgccug

SEQ ID NO: 325914 - RNA, 20 nt, Bordetella pertussis
ccuguccccacagggggacu

SEQ ID NO: 325915 - RNA, 20 nt, Bordetella pertussis
ccuguccccacagggggucu

SEQ ID NO: 325916 - RNA, 21 nt, Bordetella pertussis
ccuguccccacagggggucug

SEQ ID NO: 325917 - RNA, 18 nt, Bordetella pertussis
ccuguccccaccgggaca

SEQ ID NO: 325918 - RNA, 19 nt, Bordetella pertussis
ccuguccccacggggacag

SEQ ID NO: 325919 - RNA, 20 nt, Bordetella pertussis
ccuguccccacugggggacu

SEQ ID NO: 325920 - RNA, 21 nt, Bordetella pertussis
ccuguccccacugggggacug

SEQ ID NO: 325921 - RNA, 24 nt, Bordetella pertussis
ccuguccccacugggggacuggca

SEQ ID NO: 325922 - RNA, 21 nt, Bordetella pertussis
ccuguccccccauggggacug

SEQ ID NO: 325923 - RNA, 24 nt, Bordetella pertussis
ccuguccccccauggggacuggca

SEQ ID NO: 325924 - RNA, 20 nt, Bordetella pertussis
ccuguccccgaacggggacu

SEQ ID NO: 325925 - RNA, 21 nt, Bordetella pertussis
ccuguccccgcaagggggacu

SEQ ID NO: 325926 - RNA, 22 nt, Bordetella pertussis
ccuguccccgcaagggggacug

SEQ ID NO: 325927 - RNA, 20 nt, Bordetella pertussis
ccuguccccgcacggggaca

SEQ ID NO: 325928 - RNA, 21 nt, Bordetella pertussis
ccuguccccgcacggggacag

SEQ ID NO: 325929 - RNA, 20 nt, Bordetella pertussis
ccuguccccgcacggggacu

SEQ ID NO: 325930 - RNA, 19 nt, Bordetella pertussis
ccuguccccgcagggacag

SEQ ID NO: 325931 - RNA, 18 nt, Bordetella pertussis
ccuguccccgccgggaca

SEQ ID NO: 325932 - RNA, 19 nt, Bordetella pertussis
ccuguccccgccgggacag

SEQ ID NO: 325933 - RNA, 19 nt, Bordetella pertussis
ccuguccccgccggggcag

SEQ ID NO: 325934 - RNA, 18 nt, Bordetella pertussis
ccuguccccgcggggacu

SEQ ID NO: 325935 - RNA, 18 nt, Bordetella pertussis
ccuguccccgcugggaca

SEQ ID NO: 325936 - RNA, 18 nt, Bordetella pertussis
ccuguccccguggggaca

SEQ ID NO: 325937 - RNA, 19 nt, Bordetella pertussis
ccuguccccguggggacag

SEQ ID NO: 325938 - RNA, 18 nt, Bordetella pertussis
ccugucccgacggggaca

SEQ ID NO: 325939 - RNA, 19 nt, Bordetella pertussis
ccugucccaaccgggacag

SEQ ID NO: 325940 - RNA, 15 nt, Bordetella pertussis
ccugucccaauccgc

SEQ ID NO: 325941 - RNA, 18 nt, Bordetella pertussis
ccugucccagcggggaca

SEQ ID NO: 325942 - RNA, 19 nt, Bordetella pertussis
ccugucccagcggggacag

SEQ ID NO: 325943 - RNA, 19 nt, Bordetella pertussis
ccugucccggcugggacag

SEQ ID NO: 325944 - RNA, 18 nt, Bordetella pertussis
ccugucccugccgggaca

SEQ ID NO: 325945 - RNA, 19 nt, Bordetella pertussis
ccugucccugccgggacag

SEQ ID NO: 325946 - RNA, 18 nt, Bordetella pertussis
ccugucccugcggggacu

SEQ ID NO: 325947 - RNA, 15 nt, Bordetella pertussis
ccuucaccggcccca

SEQ ID NO: 325948 - RNA, 14 nt, Bordetella pertussis
ccuucagcgggccg

SEQ ID NO: 325949 - RNA, 17 nt, Bordetella pertussis
ccuucagcgggccggca

SEQ ID NO: 325950 - RNA, 13 nt, Bordetella pertussis
ccuucagggcgcc

SEQ ID NO: 325951 - RNA, 13 nt, Bordetella pertussis
ccuucaugaucug

SEQ ID NO: 325952 - RNA, 19 nt, Bordetella pertussis
ccuucgcgguaggacggca

SEQ ID NO: 325953 - RNA, 22 nt, Bordetella pertussis
ccuucggcaggcgccggcuggc

SEQ ID NO: 325954 - RNA, 18 nt, Bordetella pertussis
ccuucggcauggucggca

SEQ ID NO: 325955 - RNA, 13 nt, Bordetella pertussis
ccuucggccggcu

SEQ ID NO: 325956 - RNA, 15 nt, Bordetella pertussis
ccuucggccggcugc

SEQ ID NO: 325957 - RNA, 22 nt, Bordetella pertussis
ccuucggcgacuucggcggcca

SEQ ID NO: 325958 - RNA, 20 nt, Bordetella pertussis
ccuucggcgcgcacgcucug

SEQ ID NO: 325959 - RNA, 14 nt, Bordetella pertussis
ccuucggcgcggcg

SEQ ID NO: 325960 - RNA, 23 nt, Bordetella pertussis
ccuucggcgcggcgggcgcuggc

SEQ ID NO: 325961 - RNA, 15 nt, Bordetella pertussis
ccuucggcggcgcgc

SEQ ID NO: 325962 - RNA, 14 nt, Bordetella pertussis
ccuucggggcagcg

SEQ ID NO: 325963 - RNA, 14 nt, Bordetella pertussis
ccuucguggcgccg

SEQ ID NO: 325964 - RNA, 16 nt, Bordetella pertussis
ccuucguggcgccggg

SEQ ID NO: 325965 - RNA, 14 nt, Bordetella pertussis
ccuugaccaccuug

SEQ ID NO: 325966 - RNA, 21 nt, Bordetella pertussis
ccuugaccaguucgcgcagcg

SEQ ID NO: 325967 - RNA, 18 nt, Bordetella pertussis
ccuugaccgacgugcugc

SEQ ID NO: 325968 - RNA, 21 nt, Bordetella pertussis
ccuugaccgacgugcugcugc

SEQ ID NO: 325969 - RNA, 13 nt, Bordetella pertussis
ccuugacgccgcc

SEQ ID NO: 325970 - RNA, 15 nt, Bordetella pertussis
ccuugagaugccagc

SEQ ID NO: 325971 - RNA, 16 nt, Bordetella pertussis
ccuugagaugccagcg

SEQ ID NO: 325972 - RNA, 15 nt, Bordetella pertussis
ccuugagcgccagcu

SEQ ID NO: 325973 - RNA, 21 nt, Bordetella pertussis
ccuugagcgccagcucggcca

SEQ ID NO: 325974 - RNA, 22 nt, Bordetella pertussis
ccuugauggccgggccguggcg

SEQ ID NO: 325975 - RNA, 19 nt, Bordetella pertussis
ccuugauggccucggcggc

SEQ ID NO: 325976 - RNA, 16 nt, Bordetella pertussis
ccuugccauccagcca

SEQ ID NO: 325977 - RNA, 23 nt, Bordetella pertussis
ccuugccauccagccaggccgca

SEQ ID NO: 325978 - RNA, 17 nt, Bordetella pertussis
ccuugcccaacgcggcg

SEQ ID NO: 325979 - RNA, 19 nt, Bordetella pertussis
ccuugcccaacgcggcguc

SEQ ID NO: 325980 - RNA, 19 nt, Bordetella pertussis
ccuugcccacgccaucgaa

SEQ ID NO: 325981 - RNA, 16 nt, Bordetella pertussis
ccuugcaugcgccgca

SEQ ID NO: 325982 - RNA, 20 nt, Bordetella pertussis
ccuugcaugcgccgcaccag

SEQ ID NO: 325983 - RNA, 15 nt, Bordetella pertussis
ccuugcggcuugccg

SEQ ID NO: 325984 - RNA, 14 nt, Bordetella pertussis
ccuugcucagucgg

SEQ ID NO: 325985 - RNA, 17 nt, Bordetella pertussis
ccuugcucagucgggca

SEQ ID NO: 325986 - RNA, 22 nt, Bordetella pertussis
ccuugcuccggcgugacguggc

SEQ ID NO: 325987 - RNA, 19 nt, Bordetella pertussis
ccuugcugaaccugcuggc

SEQ ID NO: 325988 - RNA, 18 nt, Bordetella pertussis
ccuuggccaauggccgcg

SEQ ID NO: 325989 - RNA, 15 nt, Bordetella pertussis
ccuuucccgcgccga

SEQ ID NO: 325990 - RNA, 16 nt, Bordetella pertussis
ccuuucugcugcucgc

SEQ ID NO: 325991 - RNA, 15 nt, Bordetella pertussis
cgaaaacccgcggca

SEQ ID NO: 325992 - RNA, 14 nt, Bordetella pertussis
cgaaaagcccgccg

SEQ ID NO: 325993 - RNA, 19 nt, Bordetella pertussis
cgaaaagcccgccgagucg

SEQ ID NO: 325994 - RNA, 17 nt, Bordetella pertussis
cgaaacaggcgccgucg

SEQ ID NO: 325995 - RNA, 20 nt, Bordetella pertussis
cgaaacauaagucugcgccu

SEQ ID NO: 325996 - RNA, 17 nt, Bordetella pertussis
cgaaacccgcugggcca

SEQ ID NO: 325997 - RNA, 20 nt, Bordetella pertussis
cgaaacccgcugggccagca

SEQ ID NO: 325998 - RNA, 17 nt, Bordetella pertussis
cgaaacccgggccgucg

SEQ ID NO: 325999 - RNA, 19 nt, Bordetella pertussis
cgaaacccucgugaucgac

SEQ ID NO: 326000 - RNA, 15 nt, Bordetella pertussis
cgaaaccggcgcgcg

SEQ ID NO: 326001 - RNA, 20 nt, Bordetella pertussis
cgaaaccggcgcgcgcggcc

SEQ ID NO: 326002 - RNA, 20 nt, Bordetella pertussis
cgaaaccggugaucagcagg

SEQ ID NO: 326003 - RNA, 22 nt, Bordetella pertussis
cgaaacgggcggcgucgccgcg

SEQ ID NO: 326004 - RNA, 20 nt, Bordetella pertussis
cgaaagcgcgucgagcaggc

SEQ ID NO: 326005 - RNA, 14 nt, Bordetella pertussis
cgaaagcggccagc

SEQ ID NO: 326006 - RNA, 21 nt, Bordetella pertussis
cgaaaggcaccgagcacagca

SEQ ID NO: 326007 - RNA, 17 nt, Bordetella pertussis
cgaaagguccuggagac

SEQ ID NO: 326008 - RNA, 20 nt, Bordetella pertussis
cgaaaugcccagcgagcugg

SEQ ID NO: 326009 - RNA, 15 nt, Bordetella pertussis
cgaaaugccgcagca

SEQ ID NO: 326010 - RNA, 19 nt, Bordetella pertussis
cgaaaugccgcagcaccac

SEQ ID NO: 326011 - RNA, 16 nt, Bordetella pertussis
cgaaauggcggccucg

SEQ ID NO: 326012 - RNA, 24 nt, Bordetella pertussis
cgaaauggcggcgguagcgcucgu

SEQ ID NO: 326013 - RNA, 19 nt, Bordetella pertussis
cgaaauggugcggccauga

SEQ ID NO: 326014 - RNA, 19 nt, Bordetella pertussis
cgaacaacacgaugaucgc

SEQ ID NO: 326015 - RNA, 16 nt, Bordetella pertussis
cgaacaacagcgccug

SEQ ID NO: 326016 - RNA, 23 nt, Bordetella pertussis
cgaacaacagcgccugcauccgg

SEQ ID NO: 326017 - RNA, 14 nt, Bordetella pertussis
cgaacaaggccgga

SEQ ID NO: 326018 - RNA, 21 nt, Bordetella pertussis
cgaacaagguccaggcccggc

SEQ ID NO: 326019 - RNA, 22 nt, Bordetella pertussis
cgaacaagguccaggcccggca

SEQ ID NO: 326020 - RNA, 15 nt, Bordetella pertussis
cgaacaccagcucgg

SEQ ID NO: 326021 - RNA, 19 nt, Bordetella pertussis
cgaacaccagcucggcggc

SEQ ID NO: 326022 - RNA, 21 nt, Bordetella pertussis
cgaacgcuuccugggccugcg

SEQ ID NO: 326023 - RNA, 24 nt, Bordetella pertussis
cgaacggaaacccuucgcgcagca

SEQ ID NO: 326024 - RNA, 17 nt, Bordetella pertussis
cgaacggauugcugaug

SEQ ID NO: 326025 - RNA, 14 nt, Bordetella pertussis
cgaacggcacgucg

SEQ ID NO: 326026 - RNA, 17 nt, Bordetella pertussis
cgaacggcacgucgcgc

SEQ ID NO: 326027 - RNA, 15 nt, Bordetella pertussis
cgaacgugcgcgcca

SEQ ID NO: 326028 - RNA, 17 nt, Bordetella pertussis
cgaacgugcgcgccagc

SEQ ID NO: 326029 - RNA, 19 nt, Bordetella pertussis
cgaacgugcgcgccagcuc

SEQ ID NO: 326030 - RNA, 15 nt, Bordetella pertussis
cgaacguggccugcu

SEQ ID NO: 326031 - RNA, 14 nt, Bordetella pertussis
cgaacuccauuucg

SEQ ID NO: 326032 - RNA, 18 nt, Bordetella pertussis
cgaacucgauccgggccu

SEQ ID NO: 326033 - RNA, 17 nt, Bordetella pertussis
cgaacucgauggccucg

SEQ ID NO: 326034 - RNA, 20 nt, Bordetella pertussis
cgaacucgauggccucggca

SEQ ID NO: 326035 - RNA, 18 nt, Bordetella pertussis
cgaagaagcagccgcgcu

SEQ ID NO: 326036 - RNA, 18 nt, Bordetella pertussis
cgaagacaugcugcgaca

SEQ ID NO: 326037 - RNA, 21 nt, Bordetella pertussis
cgaagacaugcugcgacagca

SEQ ID NO: 326038 - RNA, 14 nt, Bordetella pertussis
cgaagcccggcagg

SEQ ID NO: 326039 - RNA, 23 nt, Bordetella pertussis
cgaagccgaguggcgggccaugu

SEQ ID NO: 326040 - RNA, 14 nt, Bordetella pertussis
cgaagccgaugcgc

SEQ ID NO: 326041 - RNA, 20 nt, Bordetella pertussis
cgaagccgaugcgccgcgcu

SEQ ID NO: 326042 - RNA, 15 nt, Bordetella pertussis
cgaagccggcgccau

SEQ ID NO: 326043 - RNA, 20 nt, Bordetella pertussis
cgaagccggcacgccugccg

SEQ ID NO: 326044 - RNA, 13 nt, Bordetella pertussis
cgaagccggugau

SEQ ID NO: 326045 - RNA, 16 nt, Bordetella pertussis
cgaagccuugcgcggc

SEQ ID NO: 326046 - RNA, 20 nt, Bordetella pertussis
cgaagcgagugcgccccgcc

SEQ ID NO: 326047 - RNA, 16 nt, Bordetella pertussis
cgaagcgcagcaccag

SEQ ID NO: 326048 - RNA, 18 nt, Bordetella pertussis
cgaagcgcaagcccaggc

SEQ ID NO: 326049 - RNA, 22 nt, Bordetella pertussis
cgaagcgcaugucgaagcaggc

SEQ ID NO: 326050 - RNA, 23 nt, Bordetella pertussis
cgaagcgcccuggcguggcgcgc

SEQ ID NO: 326051 - RNA, 14 nt, Bordetella pertussis
cgaagcgcgccagc

SEQ ID NO: 326052 - RNA, 21 nt, Bordetella pertussis
cgaagcgcgugucccagccgg

SEQ ID NO: 326053 - RNA, 15 nt, Bordetella pertussis
cgaagcgcgccucgu

SEQ ID NO: 326054 - RNA, 19 nt, Bordetella pertussis
cgaagcggaaacgcgcgcg

SEQ ID NO: 326055 - RNA, 21 nt, Bordetella pertussis
cgaagcggaccuggucgucca

SEQ ID NO: 326056 - RNA, 17 nt, Bordetella pertussis
cgaagcggaugcgccgc

SEQ ID NO: 326057 - RNA, 14 nt, Bordetella pertussis
cgaagcggcccggg

SEQ ID NO: 326058 - RNA, 22 nt, Bordetella pertussis
cgaagcggcccgggugggcggc

SEQ ID NO: 326059 - RNA, 14 nt, Bordetella pertussis
cgaagcggcucagg

SEQ ID NO: 326060 - RNA, 13 nt, Bordetella pertussis
cgaaggaccaagu

SEQ ID NO: 326061 - RNA, 18 nt, Bordetella pertussis
cgaaggcaaucagcccgg

SEQ ID NO: 326062 - RNA, 14 nt, Bordetella pertussis
cgaaggcagcaccu

SEQ ID NO: 326063 - RNA, 16 nt, Bordetella pertussis
cgaaggcagcaccucg

SEQ ID NO: 326064 - RNA, 14 nt, Bordetella pertussis
cgaaggcagcgcgg

SEQ ID NO: 326065 - RNA, 21 nt, Bordetella pertussis
cgaaggcagcgcggccggcac

SEQ ID NO: 326066 - RNA, 13 nt, Bordetella pertussis
cgaaggcagcggc

SEQ ID NO: 326067 - RNA, 14 nt, Bordetella pertussis
cgaaggcagcggca

SEQ ID NO: 326068 - RNA, 16 nt, Bordetella pertussis
cgaaggccagcgccuc

SEQ ID NO: 326069 - RNA, 21 nt, Bordetella pertussis
cgaaggccgccgcgcccagca

SEQ ID NO: 326070 - RNA, 14 nt, Bordetella pertussis
cgaaggcgaucugc

SEQ ID NO: 326071 - RNA, 20 nt, Bordetella pertussis
cgaaggcgccgacggcgccc

SEQ ID NO: 326072 - RNA, 17 nt, Bordetella pertussis
cgaaggcgcgcuccagc

SEQ ID NO: 326073 - RNA, 21 nt, Bordetella pertussis
cgaaggcgcgcuccagcaugu

SEQ ID NO: 326074 - RNA, 14 nt, Bordetella pertussis
cgaaggcgcggccg

SEQ ID NO: 326075 - RNA, 14 nt, Bordetella pertussis
cgaaggcgcggcug

SEQ ID NO: 326076 - RNA, 16 nt, Bordetella pertussis
cgaaggcggccggcag

SEQ ID NO: 326077 - RNA, 15 nt, Bordetella pertussis
cgaaggcggcgccgg

SEQ ID NO: 326078 - RNA, 20 nt, Bordetella pertussis
cgaaggcuucgucgaccagc

SEQ ID NO: 326079 - RNA, 18 nt, Bordetella pertussis
cgaaguugcggccgugcg

SEQ ID NO: 326080 - RNA, 16 nt, Bordetella pertussis
cgaaguugucgccaua

SEQ ID NO: 326081 - RNA, 14 nt, Bordetella pertussis
cgaauacgccacgu

SEQ ID NO: 326082 - RNA, 19 nt, Bordetella pertussis
cgaaucaguucgcgcaggc

SEQ ID NO: 326083 - RNA, 20 nt, Bordetella pertussis
cgaaucaguucgcgcaggcg

SEQ ID NO: 326084 - RNA, 22 nt, Bordetella pertussis
cgaauccaccggcgcgcgcaug

SEQ ID NO: 326085 - RNA, 20 nt, Bordetella pertussis
cgaauuccugaacgccgggc

SEQ ID NO: 326086 - RNA, 19 nt, Bordetella pertussis
cgaauucguuggugcccag

SEQ ID NO: 326087 - RNA, 18 nt, Bordetella pertussis
cgaauugccgccgcugcc

SEQ ID NO: 326088 - RNA, 21 nt, Bordetella pertussis
cgaauuucccggguggcgcca

SEQ ID NO: 326089 - RNA, 17 nt, Bordetella pertussis
cgacaacaagccgggcg

SEQ ID NO: 326090 - RNA, 18 nt, Bordetella pertussis
cgacaacaagccgggcgc

SEQ ID NO: 326091 - RNA, 20 nt, Bordetella pertussis
cgacaacaagccgggcgccg

SEQ ID NO: 326092 - RNA, 14 nt, Bordetella pertussis
cgacaaccgcggcg

SEQ ID NO: 326093 - RNA, 14 nt, Bordetella pertussis
cgacaagccggucg

SEQ ID NO: 326094 - RNA, 19 nt, Bordetella pertussis
cgacaaggagacaucaugc

SEQ ID NO: 326095 - RNA, 22 nt, Bordetella pertussis
cgacacgucaucguggccgcgc

SEQ ID NO: 326096 - RNA, 20 nt, Bordetella pertussis
cgacagaccguagcgcaggc

SEQ ID NO: 326097 - RNA, 21 nt, Bordetella pertussis
cgacagaccguagcgcaggcg

SEQ ID NO: 326098 - RNA, 23 nt, Bordetella pertussis
cgacagaccguagcgcaggcgcu

SEQ ID NO: 326099 - RNA, 13 nt, Bordetella pertussis
cgacagauggcgc

SEQ ID NO: 326100 - RNA, 18 nt, Bordetella pertussis
cgacagcaaugacgacgc

SEQ ID NO: 326101 - RNA, 20 nt, Bordetella pertussis
cgacagcacauggcgcgccg

SEQ ID NO: 326102 - RNA, 12 nt, Bordetella pertussis
cgacagcaccaa

SEQ ID NO: 326103 - RNA, 23 nt, Bordetella pertussis
cgacagcaccaacugguagugcg

SEQ ID NO: 326104 - RNA, 12 nt, Bordetella pertussis
cgacagcacgcc

SEQ ID NO: 326105 - RNA, 15 nt, Bordetella pertussis
cgacagcacgcccgc

SEQ ID NO: 326106 - RNA, 20 nt, Bordetella pertussis
cgacagcacgcccgccagca

SEQ ID NO: 326107 - RNA, 19 nt, Bordetella pertussis
cgacagcagcaugcggccc

SEQ ID NO: 326108 - RNA, 20 nt, Bordetella pertussis
cgacagcagcaugcggcccg

SEQ ID NO: 326109 - RNA, 14 nt, Bordetella pertussis
cgacagcaggccgg

SEQ ID NO: 326110 - RNA, 15 nt, Bordetella pertussis
cgacagcaggccggu

SEQ ID NO: 326111 - RNA, 20 nt, Bordetella pertussis
cgacagcaggccggucagga

SEQ ID NO: 326112 - RNA, 16 nt, Bordetella pertussis
cgacagcagggccagg

SEQ ID NO: 326113 - RNA, 21 nt, Bordetella pertussis
cgacagcagggucggccccau

SEQ ID NO: 326114 - RNA, 20 nt, Bordetella pertussis
cgacagcaucuuggccgcca

SEQ ID NO: 326115 - RNA, 22 nt, Bordetella pertussis
cgacagcaucuuggccgccacg

SEQ ID NO: 326116 - RNA, 14 nt, Bordetella pertussis
cgacagccaggcca

SEQ ID NO: 326117 - RNA, 16 nt, Bordetella pertussis
cgacagccaggccagc

SEQ ID NO: 326118 - RNA, 19 nt, Bordetella pertussis
cgacagccaggccagcgcc

SEQ ID NO: 326119 - RNA, 20 nt, Bordetella pertussis
cgacagccaggccagcgcca

SEQ ID NO: 326120 - RNA, 21 nt, Bordetella pertussis
cgacagccaggccagcgccag

SEQ ID NO: 326121 - RNA, 14 nt, Bordetella pertussis
cgacaggcgccgca

SEQ ID NO: 326122 - RNA, 14 nt, Bordetella pertussis
cgacaggcgcgccc

SEQ ID NO: 326123 - RNA, 15 nt, Bordetella pertussis
cgacaggcgcgcccg

SEQ ID NO: 326124 - RNA, 22 nt, Bordetella pertussis
cgacaggcggugcgcgcggccg

SEQ ID NO: 326125 - RNA, 14 nt, Bordetella pertussis
cgacaggcgcagcu

SEQ ID NO: 326126 - RNA, 16 nt, Bordetella pertussis
cgacaggcgcagcucg

SEQ ID NO: 326127 - RNA, 19 nt, Bordetella pertussis
cgacagguagcggucgccg

SEQ ID NO: 326128 - RNA, 21 nt, Bordetella pertussis
cgacagguagcggucgccgcg

SEQ ID NO: 326129 - RNA, 18 nt, Bordetella pertussis
cgacccgaaggcgcggcc

SEQ ID NO: 326130 - RNA, 16 nt, Bordetella pertussis
cgacccgagcccuggc

SEQ ID NO: 326131 - RNA, 17 nt, Bordetella pertussis
cgacccgauagccgcgc

SEQ ID NO: 326132 - RNA, 19 nt, Bordetella pertussis
cgacccgauagccgcgcgc

SEQ ID NO: 326133 - RNA, 23 nt, Bordetella pertussis
cgacccgauagccgcgcgccugc

SEQ ID NO: 326134 - RNA, 18 nt, Bordetella pertussis
cgacccgcggcccuugcg

SEQ ID NO: 326135 - RNA, 17 nt, Bordetella pertussis
cgacccggacaacgcgc

SEQ ID NO: 326136 - RNA, 21 nt, Bordetella pertussis
cgacccggacaacgcgcgcca

SEQ ID NO: 326137 - RNA, 16 nt, Bordetella pertussis
cgacccgggcgggcgu

SEQ ID NO: 326138 - RNA, 13 nt, Bordetella pertussis
cgacccguggccc

SEQ ID NO: 326139 - RNA, 15 nt, Bordetella pertussis
cgacccucagcccgc

SEQ ID NO: 326140 - RNA, 16 nt, Bordetella pertussis
cgacccucagcccgca

SEQ ID NO: 326141 - RNA, 15 nt, Bordetella pertussis
cgacccugcccggca

SEQ ID NO: 326142 - RNA, 21 nt, Bordetella pertussis
cgacccuuucauuucggcgcc

SEQ ID NO: 326143 - RNA, 18 nt, Bordetella pertussis
cgaccgaaaagcccacgu

SEQ ID NO: 326144 - RNA, 18 nt, Bordetella pertussis
cgaccgaaccgauccagc

SEQ ID NO: 326145 - RNA, 21 nt, Bordetella pertussis
cgacccuguacaagcgcacgc

SEQ ID NO: 326146 - RNA, 23 nt, Bordetella pertussis
cgacccuguacaagcgcacgcug

SEQ ID NO: 326147 - RNA, 20 nt, Bordetella pertussis
cgaccgacagcacauggcgc

SEQ ID NO: 326148 - RNA, 23 nt, Bordetella pertussis
cgaccgacagcacauggcgcgcc

SEQ ID NO: 326149 - RNA, 15 nt, Bordetella pertussis
cgaccgacggcaucg

SEQ ID NO: 326150 - RNA, 14 nt, Bordetella pertussis
cgaccgagccggcc

SEQ ID NO: 326151 - RNA, 16 nt, Bordetella pertussis
cgaccgagccggccag

SEQ ID NO: 326152 - RNA, 17 nt, Bordetella pertussis
cgaccgagccggccagc

SEQ ID NO: 326153 - RNA, 20 nt, Bordetella pertussis
cgaccgagccggccagcgcc

SEQ ID NO: 326154 - RNA, 18 nt, Bordetella pertussis
cgaccgauucgcgcaccg

SEQ ID NO: 326155 - RNA, 18 nt, Bordetella pertussis
cgaccgcacgauggcgcg

SEQ ID NO: 326156 - RNA, 21 nt, Bordetella pertussis
cgaccgcacgauggcgcgcga

SEQ ID NO: 326157 - RNA, 22 nt, Bordetella pertussis
cgaccgcaggggauugccgcgc

SEQ ID NO: 326158 - RNA, 21 nt, Bordetella pertussis
cgaccgcauagcgcaugaugc

SEQ ID NO: 326159 - RNA, 13 nt, Bordetella pertussis
cgaccgcaugcgg

SEQ ID NO: 326160 - RNA, 16 nt, Bordetella pertussis
cgaccgcaugcggcac

SEQ ID NO: 326161 - RNA, 20 nt, Bordetella pertussis
cgaccgccgccuuggacgcg

SEQ ID NO: 326162 - RNA, 19 nt, Bordetella pertussis
cgaccgccuccagcgcggc

SEQ ID NO: 326163 - RNA, 22 nt, Bordetella pertussis
cgaccgccucgacgcccgggcg

SEQ ID NO: 326164 - RNA, 18 nt, Bordetella pertussis
cgaccgcgaagcgcgcca

SEQ ID NO: 326165 - RNA, 15 nt, Bordetella pertussis
cgaccgcgcggcgcu

SEQ ID NO: 326166 - RNA, 18 nt, Bordetella pertussis
cgaccgcgcggcgcugca

SEQ ID NO: 326167 - RNA, 14 nt, Bordetella pertussis
cgaccgcggcgguc

SEQ ID NO: 326168 - RNA, 20 nt, Bordetella pertussis
cgaccgcggcgguccugcug

SEQ ID NO: 326169 - RNA, 18 nt, Bordetella pertussis
cgaccgcgggcgcgcgcc

SEQ ID NO: 326170 - RNA, 20 nt, Bordetella pertussis
cgaccgcguaguugucggcg

SEQ ID NO: 326171 - RNA, 23 nt, Bordetella pertussis
cgaccgcuuccgccaccgcgccg

SEQ ID NO: 326172 - RNA, 19 nt, Bordetella pertussis
cgaccgcuucggucagcug

SEQ ID NO: 326173 - RNA, 22 nt, Bordetella pertussis
cgaccggaaucaccgccgcgac

SEQ ID NO: 326174 - RNA, 20 nt, Bordetella pertussis
cgaccggaccguuccagacg

SEQ ID NO: 326175 - RNA, 13 nt, Bordetella pertussis
cgaccggcaccug

SEQ ID NO: 326176 - RNA, 17 nt, Bordetella pertussis
cgaccggcaccugggcc

SEQ ID NO: 326177 - RNA, 13 nt, Bordetella pertussis
cgaccggcccgca

SEQ ID NO: 326178 - RNA, 18 nt, Bordetella pertussis
cgaccggcucgaucgccg

SEQ ID NO: 326179 - RNA, 21 nt, Bordetella pertussis
cgaccggcucgaucgccgccg

SEQ ID NO: 326180 - RNA, 13 nt, Bordetella pertussis
cgaccggcgcgcg

SEQ ID NO: 326181 - RNA, 16 nt, Bordetella pertussis
cgaccggcuugccguc

SEQ ID NO: 326182 - RNA, 15 nt, Bordetella pertussis
cgaccgucagcaugc

SEQ ID NO: 326183 - RNA, 16 nt, Bordetella pertussis
cgaccgucagcaugcc

SEQ ID NO: 326184 - RNA, 14 nt, Bordetella pertussis
cgaccuggcgcccg

SEQ ID NO: 326185 - RNA, 15 nt, Bordetella pertussis
cgaccuggcgcccga

SEQ ID NO: 326186 - RNA, 13 nt, Bordetella pertussis
cgaccuugcggcc

SEQ ID NO: 326187 - RNA, 14 nt, Bordetella pertussis
cgaccuugcggccg

SEQ ID NO: 326188 - RNA, 16 nt, Bordetella pertussis
cgaccuugcugacgcg

SEQ ID NO: 326189 - RNA, 19 nt, Bordetella pertussis
cgaccuugcuggaccgcgc

SEQ ID NO: 326190 - RNA, 22 nt, Bordetella pertussis
cgaccuugcuggaccgcgccug

SEQ ID NO: 326191 - RNA, 19 nt, Bordetella pertussis
cgaccuuggcggccgacag

SEQ ID NO: 326192 - RNA, 19 nt, Bordetella pertussis
cgacgaaacccgggccguc

SEQ ID NO: 326193 - RNA, 21 nt, Bordetella pertussis
cgacgaaacccgggccgucgc

SEQ ID NO: 326194 - RNA, 18 nt, Bordetella pertussis
cgacgaaagcggcaaagc

SEQ ID NO: 326195 - RNA, 16 nt, Bordetella pertussis
cgacgaaaugccggcg

SEQ ID NO: 326196 - RNA, 14 nt, Bordetella pertussis
cgacgaacaaggcc

SEQ ID NO: 326197 - RNA, 15 nt, Bordetella pertussis
cgacgaacaaggccg

SEQ ID NO: 326198 - RNA, 22 nt, Bordetella pertussis
cgacgaagguguugaccacgcc

SEQ ID NO: 326199 - RNA, 17 nt, Bordetella pertussis
cgacgaaucggucacga

SEQ ID NO: 326200 - RNA, 19 nt, Bordetella pertussis
cgacgacaacccgaacucc

SEQ ID NO: 326201 - RNA, 23 nt, Bordetella pertussis
cgacgagaguuucggcgacgacu

SEQ ID NO: 326202 - RNA, 17 nt, Bordetella pertussis
cgacgagaucgcgccua

SEQ ID NO: 326203 - RNA, 17 nt, Bordetella pertussis
cgacgaucaggcccugg

SEQ ID NO: 326204 - RNA, 14 nt, Bordetella pertussis
cgacgauccggcga

SEQ ID NO: 326205 - RNA, 21 nt, Bordetella pertussis
cgacgaucugguccugggccg

SEQ ID NO: 326206 - RNA, 17 nt, Bordetella pertussis
cgacgaugcccugcgcc

SEQ ID NO: 326207 - RNA, 23 nt, Bordetella pertussis
cgacgaugcccugcgccagcgcc

SEQ ID NO: 326208 - RNA, 15 nt, Bordetella pertussis
cgacgaugccgccca

SEQ ID NO: 326209 - RNA, 22 nt, Bordetella pertussis
cgacgaugccgcccacgccaug

SEQ ID NO: 326210 - RNA, 14 nt, Bordetella pertussis
cgacgaugccgccg

SEQ ID NO: 326211 - RNA, 19 nt, Bordetella pertussis
cgacgaugccgccgccgac

SEQ ID NO: 326212 - RNA, 15 nt, Bordetella pertussis
cgacgaugccggucu

SEQ ID NO: 326213 - RNA, 23 nt, Bordetella pertussis
cgacgauggccggggcgucgucg

SEQ ID NO: 326214 - RNA, 13 nt, Bordetella pertussis
cgacgauggcggg

SEQ ID NO: 326215 - RNA, 24 nt, Bordetella pertussis
cgacgauggcgggguuggccgcca

SEQ ID NO: 326216 - RNA, 16 nt, Bordetella pertussis
cgacgccagcgcgcca

SEQ ID NO: 326217 - RNA, 16 nt, Bordetella pertussis
cgacgccgccacgcug

SEQ ID NO: 326218 - RNA, 20 nt, Bordetella pertussis
cgacgccgccacgcuggccg

SEQ ID NO: 326219 - RNA, 15 nt, Bordetella pertussis
cgacgccgcgcgcga

SEQ ID NO: 326220 - RNA, 18 nt, Bordetella pertussis
cgacgccgcgcgcgacgc

SEQ ID NO: 326221 - RNA, 18 nt, Bordetella pertussis
cgacgccugcgccauggc

SEQ ID NO: 326222 - RNA, 17 nt, Bordetella pertussis
cgacgcgaaccaggcca

SEQ ID NO: 326223 - RNA, 22 nt, Bordetella pertussis
cgacgcgaaccaggccaccgcg

SEQ ID NO: 326224 - RNA, 16 nt, Bordetella pertussis
cgacgccuggaccggc

SEQ ID NO: 326225 - RNA, 17 nt, Bordetella pertussis
cgacgccuuccuugaac

SEQ ID NO: 326226 - RNA, 17 nt, Bordetella pertussis
cgacgcgacacgcagca

SEQ ID NO: 326227 - RNA, 22 nt, Bordetella pertussis
cgacgcgacacgcagcaacggu

SEQ ID NO: 326228 - RNA, 11 nt, Bordetella pertussis
cgacgcgacgc

SEQ ID NO: 326229 - RNA, 17 nt, Bordetella pertussis
cgacgcgaugcccgcgc

SEQ ID NO: 326230 - RNA, 18 nt, Bordetella pertussis
cgacgcgaugcccgcgca

SEQ ID NO: 326231 - RNA, 21 nt, Bordetella pertussis
cgacgcgaugcccgcgcacca

SEQ ID NO: 326232 - RNA, 17 nt, Bordetella pertussis
cgacgcgauguccagcu

SEQ ID NO: 326233 - RNA, 18 nt, Bordetella pertussis
cgacgcgauguccagcuc

SEQ ID NO: 326234 - RNA, 20 nt, Bordetella pertussis
cgacgcgcauuucgaccugc

SEQ ID NO: 326235 - RNA, 20 nt, Bordetella pertussis
cgacgcggcguacuggcgcg

SEQ ID NO: 326236 - RNA, 15 nt, Bordetella pertussis
cgacgcgggcggccg

SEQ ID NO: 326237 - RNA, 17 nt, Bordetella pertussis
cgacgcgggcggccgac

SEQ ID NO: 326238 - RNA, 19 nt, Bordetella pertussis
cgacgcgggcggccgacgg

SEQ ID NO: 326239 - RNA, 17 nt, Bordetella pertussis
cgacgcggucgcccaac

SEQ ID NO: 326240 - RNA, 17 nt, Bordetella pertussis
cgacgcguuguucgggc

SEQ ID NO: 326241 - RNA, 20 nt, Bordetella pertussis
cgacgcguuguucgggccgg

SEQ ID NO: 326242 - RNA, 20 nt, Bordetella pertussis
cgacgcucgagguaggcggg

SEQ ID NO: 326243 - RNA, 22 nt, Bordetella pertussis
cgacgcucgagguaggcgggac

SEQ ID NO: 326244 - RNA, 14 nt, Bordetella pertussis
cgacgcugaugccc

SEQ ID NO: 326245 - RNA, 20 nt, Bordetella pertussis
cgacgcugaugcccagcccg

SEQ ID NO: 326246 - RNA, 16 nt, Bordetella pertussis
cgacggcucgcgcucg

SEQ ID NO: 326247 - RNA, 22 nt, Bordetella pertussis
cgacggcucgcgcucgcccggc

SEQ ID NO: 326248 - RNA, 23 nt, Bordetella pertussis
cgacggcucgcgcucgcccggcc

SEQ ID NO: 326249 - RNA, 16 nt, Bordetella pertussis
cgacgcugaucggccg

SEQ ID NO: 326250 - RNA, 17 nt, Bordetella pertussis
cgacgcugaucucggcc

SEQ ID NO: 326251 - RNA, 22 nt, Bordetella pertussis
cgacgcugaucucggccugccc

SEQ ID NO: 326252 - RNA, 15 nt, Bordetella pertussis
cgacggcuugcgcau

SEQ ID NO: 326253 - RNA, 23 nt, Bordetella pertussis
cgacgggauccucgcucuuggga

SEQ ID NO: 326254 - RNA, 21 nt, Bordetella pertussis
cgacgggauugccgucacgcg

SEQ ID NO: 326255 - RNA, 14 nt, Bordetella pertussis
cgacgggcaggccc

SEQ ID NO: 326256 - RNA, 15 nt, Bordetella pertussis
cgacgggcaggccca

SEQ ID NO: 326257 - RNA, 14 nt, Bordetella pertussis
cgacgggcggcugc

SEQ ID NO: 326258 - RNA, 19 nt, Bordetella pertussis
cgacgggcggcugccagug

SEQ ID NO: 326259 - RNA, 14 nt, Bordetella pertussis
cgacggucaggggc

SEQ ID NO: 326260 - RNA, 19 nt, Bordetella pertussis
cgacguaagugcccaggcc

SEQ ID NO: 326261 - RNA, 21 nt, Bordetella pertussis
cgacguaagugcccaggcccg

SEQ ID NO: 326262 - RNA, 17 nt, Bordetella pertussis
cgacguagucgcgccag

SEQ ID NO: 326263 - RNA, 15 nt, Bordetella pertussis
cgacguccuggugga

SEQ ID NO: 326264 - RNA, 15 nt, Bordetella pertussis
cgacgucgcccaacg

SEQ ID NO: 326265 - RNA, 16 nt, Bordetella pertussis
cgacgucuugcugccg

SEQ ID NO: 326266 - RNA, 18 nt, Bordetella pertussis
cgacgucuugcugccguc

SEQ ID NO: 326267 - RNA, 14 nt, Bordetella pertussis
cgacgucgcgcgga

SEQ ID NO: 326268 - RNA, 15 nt, Bordetella pertussis
cgacgugaugcucga

SEQ ID NO: 326269 - RNA, 23 nt, Bordetella pertussis
cgacguugcauaccucgauggcg

SEQ ID NO: 326270 - RNA, 15 nt, Bordetella pertussis
cgacguugcgcgaca

SEQ ID NO: 326271 - RNA, 17 nt, Bordetella pertussis
cgacguugcgcgacagg

SEQ ID NO: 326272 - RNA, 19 nt, Bordetella pertussis
cgacguugggcaugccgau

SEQ ID NO: 326273 - RNA, 18 nt, Bordetella pertussis
cgacuacggcggacuggc

SEQ ID NO: 326274 - RNA, 20 nt, Bordetella pertussis
cgacuacggcggacuggccg

SEQ ID NO: 326275 - RNA, 13 nt, Bordetella pertussis
cgacuccagcccg

SEQ ID NO: 326276 - RNA, 13 nt, Bordetella pertussis
cgacuggcccagg

SEQ ID NO: 326277 - RNA, 14 nt, Bordetella pertussis
cgacuggcccaggc

SEQ ID NO: 326278 - RNA, 17 nt, Bordetella pertussis
cgacuggcccaggcggg

SEQ ID NO: 326279 - RNA, 14 nt, Bordetella pertussis
cgacuggcggcugc

SEQ ID NO: 326280 - RNA, 19 nt, Bordetella pertussis
cgacuucagacagacgcug

SEQ ID NO: 326281 - RNA, 15 nt, Bordetella pertussis
cgacuucgccgauga

SEQ ID NO: 326282 - RNA, 17 nt, Bordetella pertussis
cgacuucgccgaugacc

SEQ ID NO: 326283 - RNA, 20 nt, Bordetella pertussis
cgacuucgcgaaagcgcugc

SEQ ID NO: 326284 - RNA, 12 nt, Bordetella pertussis
cgacuucggccg

SEQ ID NO: 326285 - RNA, 13 nt, Bordetella pertussis
cgacuucggcggc

SEQ ID NO: 326286 - RNA, 16 nt, Bordetella pertussis
cgacuucggcggccug

SEQ ID NO: 326287 - RNA, 22 nt, Bordetella pertussis
cgacuucggcggccugcuuggc

SEQ ID NO: 326288 - RNA, 17 nt, Bordetella pertussis
cgacuucguccggcgcg

SEQ ID NO: 326289 - RNA, 21 nt, Bordetella pertussis
cgacuucguccggcgcgucgc

SEQ ID NO: 326290 - RNA, 14 nt, Bordetella pertussis
cgacuucgacccgg

SEQ ID NO: 326291 - RNA, 17 nt, Bordetella pertussis
cgacuucuaccuggacg

SEQ ID NO: 326292 - RNA, 20 nt, Bordetella pertussis
cgacuucuggggugccuguc

SEQ ID NO: 326293 - RNA, 19 nt, Bordetella pertussis
cgacuugaucagggccacg

SEQ ID NO: 326294 - RNA, 22 nt, Bordetella pertussis
cgagaaaaucggcgaucgccug

SEQ ID NO: 326295 - RNA, 13 nt, Bordetella pertussis
cgagaagcaaccg

SEQ ID NO: 326296 - RNA, 23 nt, Bordetella pertussis
cgagaagggcuugaccagggcgg

SEQ ID NO: 326297 - RNA, 16 nt, Bordetella pertussis
cgagacaggcgcgcca

SEQ ID NO: 326298 - RNA, 19 nt, Bordetella pertussis
cgagaccacgauggccggc

SEQ ID NO: 326299 - RNA, 21 nt, Bordetella pertussis
cgagaccacgauggccggcgc

SEQ ID NO: 326300 - RNA, 19 nt, Bordetella pertussis
cgagaccaugacgucgacg

SEQ ID NO: 326301 - RNA, 13 nt, Bordetella pertussis
cgagaccgcccgc

SEQ ID NO: 326302 - RNA, 13 nt, Bordetella pertussis
cgagaccgggcgg

SEQ ID NO: 326303 - RNA, 17 nt, Bordetella pertussis
cgagaccuugugcggca

SEQ ID NO: 326304 - RNA, 16 nt, Bordetella pertussis
cgagacgaaggcgccg

SEQ ID NO: 326305 - RNA, 21 nt, Bordetella pertussis
cgagacgauggccgaaugccc

SEQ ID NO: 326306 - RNA, 19 nt, Bordetella pertussis
cgagacgcgcucgcgcgcg

SEQ ID NO: 326307 - RNA, 18 nt, Bordetella pertussis
cgagacggccgccgacgc

SEQ ID NO: 326308 - RNA, 15 nt, Bordetella pertussis
cgagauaggcggcca

SEQ ID NO: 326309 - RNA, 15 nt, Bordetella pertussis
cgagaucagccaccg

SEQ ID NO: 326310 - RNA, 18 nt, Bordetella pertussis
cgagaucagcaccgcgac

SEQ ID NO: 326311 - RNA, 16 nt, Bordetella pertussis
cgagcacccgcaggcg

SEQ ID NO: 326312 - RNA, 17 nt, Bordetella pertussis
cgagcacccgcaggcgg

SEQ ID NO: 326313 - RNA, 18 nt, Bordetella pertussis
cgagcacccgcaggcggc

SEQ ID NO: 326314 - RNA, 17 nt, Bordetella pertussis
cgagcaccgugaccugc

SEQ ID NO: 326315 - RNA, 17 nt, Bordetella pertussis
cgagcagaugcgacugg

SEQ ID NO: 326316 - RNA, 21 nt, Bordetella pertussis
cgagcagaugcgacuggcggc

SEQ ID NO: 326317 - RNA, 20 nt, Bordetella pertussis
cgagcagggggucgaucaug

SEQ ID NO: 326318 - RNA, 23 nt, Bordetella pertussis
cgagcagggggucgaucauggcc

SEQ ID NO: 326319 - RNA, 20 nt, Bordetella pertussis
cgagcagguccauggccagu

SEQ ID NO: 326320 - RNA, 18 nt, Bordetella pertussis
cgagccacgucgcucggc

SEQ ID NO: 326321 - RNA, 20 nt, Bordetella pertussis
cgagccagguggacagcgcc

SEQ ID NO: 326322 - RNA, 21 nt, Bordetella pertussis
cgagccagguggacagcgcca

SEQ ID NO: 326323 - RNA, 18 nt, Bordetella pertussis
cgagccgcugucgcaggc

SEQ ID NO: 326324 - RNA, 21 nt, Bordetella pertussis
cgagccgcugucgcaggcgcu

SEQ ID NO: 326325 - RNA, 17 nt, Bordetella pertussis
cgagccggccagcgcca

SEQ ID NO: 326326 - RNA, 15 nt, Bordetella pertussis
cgagccggccgcgcc

SEQ ID NO: 326327 - RNA, 17 nt, Bordetella pertussis
cgagccggccgcgcccg

SEQ ID NO: 326328 - RNA, 16 nt, Bordetella pertussis
cgagccgggcaccgag

SEQ ID NO: 326329 - RNA, 13 nt, Bordetella pertussis
cgagccgggcgcc

SEQ ID NO: 326330 - RNA, 20 nt, Bordetella pertussis
cgagccgggcgccgauccag

SEQ ID NO: 326331 - RNA, 20 nt, Bordetella pertussis
cgagcgccgaagucggcucg

SEQ ID NO: 326332 - RNA, 14 nt, Bordetella pertussis
cgagcgccgccagg

SEQ ID NO: 326333 - RNA, 17 nt, Bordetella pertussis
cgagcgccgccaggccg

SEQ ID NO: 326334 - RNA, 20 nt, Bordetella pertussis
cgagcgccgccaggccgucg

SEQ ID NO: 326335 - RNA, 15 nt, Bordetella pertussis
cgagcgccgcgcucc

SEQ ID NO: 326336 - RNA, 18 nt, Bordetella pertussis
cgagcgccgggcgccgcg

SEQ ID NO: 326337 - RNA, 21 nt, Bordetella pertussis
cgagcgccgggcgccgcgccc

SEQ ID NO: 326338 - RNA, 13 nt, Bordetella pertussis
cgagcgccugggc

SEQ ID NO: 326339 - RNA, 16 nt, Bordetella pertussis
cgagcgccugggcggc

SEQ ID NO: 326340 - RNA, 18 nt, Bordetella pertussis
cgagcgccugggcggcca

SEQ ID NO: 326341 - RNA, 21 nt, Bordetella pertussis
cgagcgccugggcggccacgu

SEQ ID NO: 326342 - RNA, 21 nt, Bordetella pertussis
cgagcgcgaaauccagcgcgc

SEQ ID NO: 326343 - RNA, 15 nt, Bordetella pertussis
cgagcgcgacgcgcu

SEQ ID NO: 326344 - RNA, 17 nt, Bordetella pertussis
cgagcgcgacgcgcucg

SEQ ID NO: 326345 - RNA, 11 nt, Bordetella pertussis
cgagcgcgagc

SEQ ID NO: 326346 - RNA, 13 nt, Bordetella pertussis
cgagcgcgccagc

SEQ ID NO: 326347 - RNA, 14 nt, Bordetella pertussis
cgagcgcgccagca

SEQ ID NO: 326348 - RNA, 22 nt, Bordetella pertussis
cgagcgcgcccgcuugggccgc

SEQ ID NO: 326349 - RNA, 14 nt, Bordetella pertussis
cgagcggcagcagc

SEQ ID NO: 326350 - RNA, 13 nt, Bordetella pertussis
cgagcggccagcc

SEQ ID NO: 326351 - RNA, 17 nt, Bordetella pertussis
cgagcggccagccugcc

SEQ ID NO: 326352 - RNA, 21 nt, Bordetella pertussis
cgagcggcgccagucgcgcag

SEQ ID NO: 326353 - RNA, 22 nt, Bordetella pertussis
cgagcggcggcuucgcgcagca

SEQ ID NO: 326354 - RNA, 19 nt, Bordetella pertussis
cgagcggcgugcgcgugca

SEQ ID NO: 326355 - RNA, 13 nt, Bordetella pertussis
cgagcgggcccga

SEQ ID NO: 326356 - RNA, 19 nt, Bordetella pertussis
cgagcgggcccgacagcgc

SEQ ID NO: 326357 - RNA, 21 nt, Bordetella pertussis
cgagcgggcccgacagcgccc

SEQ ID NO: 326358 - RNA, 22 nt, Bordetella pertussis
cgagcgggcccgacagcgcccc

SEQ ID NO: 326359 - RNA, 13 nt, Bordetella pertussis
cgagcgggcgcca

SEQ ID NO: 326360 - RNA, 20 nt, Bordetella pertussis
cgagcgggugaugcugcagc

SEQ ID NO: 326361 - RNA, 19 nt, Bordetella pertussis
cgaggcugcgcgcgccagc

SEQ ID NO: 326362 - RNA, 20 nt, Bordetella pertussis
cgaggcuuuuuuucgccggg

SEQ ID NO: 326363 - RNA, 12 nt, Bordetella pertussis
cgagggccgcgg

SEQ ID NO: 326364 - RNA, 23 nt, Bordetella pertussis
cgagggccgcggcgagcucggca

SEQ ID NO: 326365 - RNA, 21 nt, Bordetella pertussis
cgagggccggaacagcgucca

SEQ ID NO: 326366 - RNA, 23 nt, Bordetella pertussis
cgagggccggaacagcguccagc

SEQ ID NO: 326367 - RNA, 12 nt, Bordetella pertussis
cgagggccggcg

SEQ ID NO: 326368 - RNA, 15 nt, Bordetella pertussis
cgagggccggcgcca

SEQ ID NO: 326369 - RNA, 16 nt, Bordetella pertussis
cgagggcgcggcgccg

SEQ ID NO: 326370 - RNA, 18 nt, Bordetella pertussis
cgagggcgcguccaagca

SEQ ID NO: 326371 - RNA, 15 nt, Bordetella pertussis
cgagggcucgaccgc

SEQ ID NO: 326372 - RNA, 18 nt, Bordetella pertussis
cgagggcucgaccgccgc

SEQ ID NO: 326373 - RNA, 16 nt, Bordetella pertussis
cgagggucaggcgcgc

SEQ ID NO: 326374 - RNA, 23 nt, Bordetella pertussis
cgagguaagugggcugcggcgug

SEQ ID NO: 326375 - RNA, 15 nt, Bordetella pertussis
cgagguagggcgcgg

SEQ ID NO: 326376 - RNA, 18 nt, Bordetella pertussis
cgagguagggcgcggcca

SEQ ID NO: 326377 - RNA, 13 nt, Bordetella pertussis
cgaggucagcccg

SEQ ID NO: 326378 - RNA, 14 nt, Bordetella pertussis
cgaggucagcccgg

SEQ ID NO: 326379 - RNA, 20 nt, Bordetella pertussis
cgaggucagcccggcggcca

SEQ ID NO: 326380 - RNA, 14 nt, Bordetella pertussis
cgagguccaggcgg

SEQ ID NO: 326381 - RNA, 23 nt, Bordetella pertussis
cgaggugcacgugggcacgccgg

SEQ ID NO: 326382 - RNA, 17 nt, Bordetella pertussis
cgagguggaugcguucg

SEQ ID NO: 326383 - RNA, 23 nt, Bordetella pertussis
cgagguggaugcguucgcggccc

SEQ ID NO: 326384 - RNA, 14 nt, Bordetella pertussis
cgaggugggcggca

SEQ ID NO: 326385 - RNA, 16 nt, Bordetella pertussis
cgaggugggcggcagc

SEQ ID NO: 326386 - RNA, 17 nt, Bordetella pertussis
cgaggugggcggcagca

SEQ ID NO: 326387 - RNA, 17 nt, Bordetella pertussis
cgagguuuccgccaugc

SEQ ID NO: 326388 - RNA, 21 nt, Bordetella pertussis
cgagguuuccgccaugcggcg

SEQ ID NO: 326389 - RNA, 13 nt, Bordetella pertussis
cgaguaccgccgc

SEQ ID NO: 326390 - RNA, 22 nt, Bordetella pertussis
cgaguagaaguaggcggccagg

SEQ ID NO: 326391 - RNA, 13 nt, Bordetella pertussis
cgaguaggccggc

SEQ ID NO: 326392 - RNA, 16 nt, Bordetella pertussis
cgaguauucacgccgc

SEQ ID NO: 326393 - RNA, 13 nt, Bordetella pertussis
cgagucgaccagu

SEQ ID NO: 326394 - RNA, 18 nt, Bordetella pertussis
cgagugcgccccgccacg

SEQ ID NO: 326395 - RNA, 14 nt, Bordetella pertussis
cgaguggccgcugu

SEQ ID NO: 326396 - RNA, 14 nt, Bordetella pertussis
cgaguucgucgucg

SEQ ID NO: 326397 - RNA, 16 nt, Bordetella pertussis
cgaguucgucgucgcc

SEQ ID NO: 326398 - RNA, 17 nt, Bordetella pertussis
cgaguucgucgucgcca

SEQ ID NO: 326399 - RNA, 23 nt, Bordetella pertussis
cgaguugaggaugcgcgcggcca

SEQ ID NO: 326400 - RNA, 14 nt, Bordetella pertussis
cgaguugcgcgcca

SEQ ID NO: 326401 - RNA, 20 nt, Bordetella pertussis
cgauacaggcgcucgcgcug

SEQ ID NO: 326402 - RNA, 22 nt, Bordetella pertussis
cgauacaggcgcucgcgcugca

SEQ ID NO: 326403 - RNA, 14 nt, Bordetella pertussis
cgauaccacgcgcg

SEQ ID NO: 326404 - RNA, 17 nt, Bordetella pertussis
cgauaccacgcgcggcg

SEQ ID NO: 326405 - RNA, 20 nt, Bordetella pertussis
cgauaccacgcgcggcggcg

SEQ ID NO: 326406 - RNA, 19 nt, Bordetella pertussis
cgauacgacacgccgcgcg

SEQ ID NO: 326407 - RNA, 18 nt, Bordetella pertussis
cgauacgcgccgccuggc

SEQ ID NO: 326408 - RNA, 22 nt, Bordetella pertussis
cgauacgcgccgccuggcccac

SEQ ID NO: 326409 - RNA, 21 nt, Bordetella pertussis
cgauacgcgugcgcggccgcg

SEQ ID NO: 326410 - RNA, 21 nt, Bordetella pertussis
cgauacgucgaauuccaguug

SEQ ID NO: 326411 - RNA, 20 nt, Bordetella pertussis
cgauaugcagccgcaccagc

SEQ ID NO: 326412 - RNA, 22 nt, Bordetella pertussis
cgauaugcagccgcaccagcgc

SEQ ID NO: 326413 - RNA, 23 nt, Bordetella pertussis
cgauaugcgagacgaaggcgccg

SEQ ID NO: 326414 - RNA, 13 nt, Bordetella pertussis
cgauaugggcggc

SEQ ID NO: 326415 - RNA, 17 nt, Bordetella pertussis
cgauauugaaggccgag

SEQ ID NO: 326416 - RNA, 14 nt, Bordetella pertussis
cgauauuggcgucg

SEQ ID NO: 326417 - RNA, 20 nt, Bordetella pertussis
cgauauugguguugccggcc

SEQ ID NO: 326418 - RNA, 22 nt, Bordetella pertussis
cgauauugguguugccggccag

SEQ ID NO: 326419 - RNA, 14 nt, Bordetella pertussis
cgaucaccgacagc

SEQ ID NO: 326420 - RNA, 20 nt, Bordetella pertussis
cgaucaccgacagcgccagc

SEQ ID NO: 326421 - RNA, 16 nt, Bordetella pertussis
cgaucaccgccgcggc

SEQ ID NO: 326422 - RNA, 16 nt, Bordetella pertussis
cgaucacgguggcgua

SEQ ID NO: 326423 - RNA, 16 nt, Bordetella pertussis
cgaucagcaagggccc

SEQ ID NO: 326424 - RNA, 19 nt, Bordetella pertussis
cgaucagcaccacggcggc

SEQ ID NO: 326425 - RNA, 15 nt, Bordetella pertussis
cgaucagcaccgcgg

SEQ ID NO: 326426 - RNA, 12 nt, Bordetella pertussis
cgaucagcgccc

SEQ ID NO: 326427 - RNA, 14 nt, Bordetella pertussis
cgaucagcgcccag

SEQ ID NO: 326428 - RNA, 13 nt, Bordetella pertussis
cgaucagcgcgcc

SEQ ID NO: 326429 - RNA, 14 nt, Bordetella pertussis
cgaucagcgcgccg

SEQ ID NO: 326430 - RNA, 15 nt, Bordetella pertussis
cgaucagcgcgccgu

SEQ ID NO: 326431 - RNA, 15 nt, Bordetella pertussis
cgaucagcgcgggcc

SEQ ID NO: 326432 - RNA, 20 nt, Bordetella pertussis
cgaucagcggauugaccagc

SEQ ID NO: 326433 - RNA, 21 nt, Bordetella pertussis
cgaucagcggauugaccagcg

SEQ ID NO: 326434 - RNA, 23 nt, Bordetella pertussis
cgaucagcggauugaccagcgcg

SEQ ID NO: 326435 - RNA, 21 nt, Bordetella pertussis
cgaucagcugcggccccggca

SEQ ID NO: 326436 - RNA, 19 nt, Bordetella pertussis
cgaucagcgggcuggccag

SEQ ID NO: 326437 - RNA, 14 nt, Bordetella pertussis
cgaucaggcgcucc

SEQ ID NO: 326438 - RNA, 21 nt, Bordetella pertussis
cgaucaggcgcuccauggcgc

SEQ ID NO: 326439 - RNA, 23 nt, Bordetella pertussis
cgaucaugaugcgcugggccagg

SEQ ID NO: 326440 - RNA, 14 nt, Bordetella pertussis
cgaucaugccgccg

SEQ ID NO: 326441 - RNA, 14 nt, Bordetella pertussis
cgaucaugcgcugc

SEQ ID NO: 326442 - RNA, 20 nt, Bordetella pertussis
cgaucaugcgcugcgagccg

SEQ ID NO: 326443 - RNA, 15 nt, Bordetella pertussis
cgaucauggccagcc

SEQ ID NO: 326444 - RNA, 16 nt, Bordetella pertussis
cgaucauggccagccg

SEQ ID NO: 326445 - RNA, 14 nt, Bordetella pertussis
cgaucauggcgccg

SEQ ID NO: 326446 - RNA, 22 nt, Bordetella pertussis
cgaucauggcgugucuccgggc

SEQ ID NO: 326447 - RNA, 14 nt, Bordetella pertussis
cgauccacggccgg

SEQ ID NO: 326448 - RNA, 23 nt, Bordetella pertussis
cgauccacggccggcgcacgccg

SEQ ID NO: 326449 - RNA, 18 nt, Bordetella pertussis
cgaucccgucauggcggc

SEQ ID NO: 326450 - RNA, 16 nt, Bordetella pertussis
cgaucccuugugcgcg

SEQ ID NO: 326451 - RNA, 19 nt, Bordetella pertussis
cgaucccuugugcgcgcca

SEQ ID NO: 326452 - RNA, 18 nt, Bordetella pertussis
cgauccgaugaugcccag

SEQ ID NO: 326453 - RNA, 19 nt, Bordetella pertussis
cgauccgaugaugcccagg

SEQ ID NO: 326454 - RNA, 15 nt, Bordetella pertussis
cgauccgccgcggcc

SEQ ID NO: 326455 - RNA, 16 nt, Bordetella pertussis
cgauccgccgcggcca

SEQ ID NO: 326456 - RNA, 18 nt, Bordetella pertussis
cgauccgccgcggccagc

SEQ ID NO: 326457 - RNA, 21 nt, Bordetella pertussis
cgauccgcgacgcccuggccu

SEQ ID NO: 326458 - RNA, 15 nt, Bordetella pertussis
cgauccgcgccaggc

SEQ ID NO: 326459 - RNA, 19 nt, Bordetella pertussis
cgauccggcgaccgacggc

SEQ ID NO: 326460 - RNA, 20 nt, Bordetella pertussis
cgauccggcgaccgacggca

SEQ ID NO: 326461 - RNA, 13 nt, Bordetella pertussis
cgauccggcgcag

SEQ ID NO: 326462 - RNA, 15 nt, Bordetella pertussis
cgaucgacggccgca

SEQ ID NO: 326463 - RNA, 16 nt, Bordetella pertussis
cgaucgagcaggccgc

SEQ ID NO: 326464 - RNA, 18 nt, Bordetella pertussis
cgaucgagcaggccgccg

SEQ ID NO: 326465 - RNA, 19 nt, Bordetella pertussis
cgaucgagcaggccgccgg

SEQ ID NO: 326466 - RNA, 19 nt, Bordetella pertussis
cgaucgcaucgcggcagcc

SEQ ID NO: 326467 - RNA, 21 nt, Bordetella pertussis
cgaucgcaucgcggcagcccg

SEQ ID NO: 326468 - RNA, 22 nt, Bordetella pertussis
cgaucgcaucgcggcagcccgg

SEQ ID NO: 326469 - RNA, 17 nt, Bordetella pertussis
cgaucgucuugaccagc

SEQ ID NO: 326470 - RNA, 18 nt, Bordetella pertussis
cgaucgucuugaccagca

SEQ ID NO: 326471 - RNA, 19 nt, Bordetella pertussis
cgaucgucuugaccagcag

SEQ ID NO: 326472 - RNA, 16 nt, Bordetella pertussis
cgaucgugcacgcccg

SEQ ID NO: 326473 - RNA, 23 nt, Bordetella pertussis
cgaucgugcacgcccgcggcgcc

SEQ ID NO: 326474 - RNA, 13 nt, Bordetella pertussis
cgaucucgcgcag

SEQ ID NO: 326475 - RNA, 18 nt, Bordetella pertussis
cgaucucgcgcagggugg

SEQ ID NO: 326476 - RNA, 22 nt, Bordetella pertussis
cgaucugcgcggcggugccgcc

SEQ ID NO: 326477 - RNA, 12 nt, Bordetella pertussis
cgaucugcggcg

SEQ ID NO: 326478 - RNA, 15 nt, Bordetella pertussis
cgaucugcugggccg

SEQ ID NO: 326479 - RNA, 20 nt, Bordetella pertussis
cgaucuggccgauggccucg

SEQ ID NO: 326480 - RNA, 21 nt, Bordetella pertussis
cgaucuggccgauggccucgc

SEQ ID NO: 326481 - RNA, 14 nt, Bordetella pertussis
cgaucuggcgcgcg

SEQ ID NO: 326482 - RNA, 20 nt, Bordetella pertussis
cgaucuggcgcgcgaccagg

SEQ ID NO: 326483 - RNA, 16 nt, Bordetella pertussis
cgaucuggcucacgau

SEQ ID NO: 326484 - RNA, 19 nt, Bordetella pertussis
cgaucugggccucggccag

SEQ ID NO: 326485 - RNA, 21 nt, Bordetella pertussis
cgaucugguccugggccguca

SEQ ID NO: 326486 - RNA, 15 nt, Bordetella pertussis
cgaucuucagcacca

SEQ ID NO: 326487 - RNA, 19 nt, Bordetella pertussis
cgaucuucagcaccagcuc

SEQ ID NO: 326488 - RNA, 14 nt, Bordetella pertussis
cgaucugguuggcc

SEQ ID NO: 326489 - RNA, 18 nt, Bordetella pertussis
cgaugaccagcgccggcg

SEQ ID NO: 326490 - RNA, 21 nt, Bordetella pertussis
cgaugaccagcgccggcgcau

SEQ ID NO: 326491 - RNA, 21 nt, Bordetella pertussis
cgaugaccggcaagcgcucgc

SEQ ID NO: 326492 - RNA, 15 nt, Bordetella pertussis
cgaugaccggccagg

SEQ ID NO: 326493 - RNA, 17 nt, Bordetella pertussis
cgaugaccggccaggcg

SEQ ID NO: 326494 - RNA, 18 nt, Bordetella pertussis
cgaugaccggccaggcgc

SEQ ID NO: 326495 - RNA, 19 nt, Bordetella pertussis
cgaugaccggccaggcgcg

SEQ ID NO: 326496 - RNA, 16 nt, Bordetella pertussis
cgaugaccucgcgcug

SEQ ID NO: 326497 - RNA, 20 nt, Bordetella pertussis
cgaugaccucgcgcugcagc

SEQ ID NO: 326498 - RNA, 21 nt, Bordetella pertussis
cgaugaccucgcgcugcagca

SEQ ID NO: 326499 - RNA, 22 nt, Bordetella pertussis
cgaugaccuugagaugccagcg

SEQ ID NO: 326500 - RNA, 19 nt, Bordetella pertussis
cgaugcaauagcgcccgcc

SEQ ID NO: 326501 - RNA, 21 nt, Bordetella pertussis
cgaugcacggaacgugccguc

SEQ ID NO: 326502 - RNA, 17 nt, Bordetella pertussis
cgaugcacccaggcgcc

SEQ ID NO: 326503 - RNA, 22 nt, Bordetella pertussis
cgaugcaugaaccgcagcgcca

SEQ ID NO: 326504 - RNA, 23 nt, Bordetella pertussis
cgaugcaugaaccgcagcgccac

SEQ ID NO: 326505 - RNA, 15 nt, Bordetella pertussis
cgaugcauucggcgg

SEQ ID NO: 326506 - RNA, 16 nt, Bordetella pertussis
cgaugcauucggcggc

SEQ ID NO: 326507 - RNA, 18 nt, Bordetella pertussis
cgaugcauucggcggccg

SEQ ID NO: 326508 - RNA, 20 nt, Bordetella pertussis
cgaugcauucggcggccggc

SEQ ID NO: 326509 - RNA, 22 nt, Bordetella pertussis
cgaugcccaccagccgcccggc

SEQ ID NO: 326510 - RNA, 14 nt, Bordetella pertussis
cgaugccgaccagg

SEQ ID NO: 326511 - RNA, 15 nt, Bordetella pertussis
cgaugccgaccaggc

SEQ ID NO: 326512 - RNA, 16 nt, Bordetella pertussis
cgaugccgaccaggcu

SEQ ID NO: 326513 - RNA, 17 nt, Bordetella pertussis
cgaugccgaccaggcug

SEQ ID NO: 326514 - RNA, 18 nt, Bordetella pertussis
cgaugccgaccaggcugc

SEQ ID NO: 326515 - RNA, 18 nt, Bordetella pertussis
cgaugccgcagauggcca

SEQ ID NO: 326516 - RNA, 14 nt, Bordetella pertussis
cgaugccgccauca

SEQ ID NO: 326517 - RNA, 23 nt, Bordetella pertussis
cgaugccgccaucauccuggucg

SEQ ID NO: 326518 - RNA, 21 nt, Bordetella pertussis
cgaugccgccaugcgccagca

SEQ ID NO: 326519 - RNA, 23 nt, Bordetella pertussis
cgaugccgccaugcgccagcagg

SEQ ID NO: 326520 - RNA, 17 nt, Bordetella pertussis
cgaugccgcgcaccugg

SEQ ID NO: 326521 - RNA, 12 nt, Bordetella pertussis
cgaugccggcca

SEQ ID NO: 326522 - RNA, 14 nt, Bordetella pertussis
cgaugccggccagc

SEQ ID NO: 326523 - RNA, 14 nt, Bordetella pertussis
cgaugccggccucg

SEQ ID NO: 326524 - RNA, 13 nt, Bordetella pertussis
cgaugccggccag

SEQ ID NO: 326525 - RNA, 19 nt, Bordetella pertussis
cgaugccggcguggcgcgc

SEQ ID NO: 326526 - RNA, 20 nt, Bordetella pertussis
cgaugccggcguggcgcgca

SEQ ID NO: 326527 - RNA, 14 nt, Bordetella pertussis
cgaugccgggcacg

SEQ ID NO: 326528 - RNA, 14 nt, Bordetella pertussis
cgaugccgucgccg

SEQ ID NO: 326529 - RNA, 19 nt, Bordetella pertussis
cgaugccgucgccgcccac

SEQ ID NO: 326530 - RNA, 14 nt, Bordetella pertussis
cgaugcgcaccaug

SEQ ID NO: 326531 - RNA, 20 nt, Bordetella pertussis
cgaugcgcaccaugcgcagc

SEQ ID NO: 326532 - RNA, 20 nt, Bordetella pertussis
cgaugcgcagcagcagcgca

SEQ ID NO: 326533 - RNA, 15 nt, Bordetella pertussis
cgaugcgcacgccca

SEQ ID NO: 326534 - RNA, 14 nt, Bordetella pertussis
cgaugcgcaggcug

SEQ ID NO: 326535 - RNA, 23 nt, Bordetella pertussis
cgaugcgccaggccucggucgcc

SEQ ID NO: 326536 - RNA, 15 nt, Bordetella pertussis
cgaugcgccaggcgc

SEQ ID NO: 326537 - RNA, 16 nt, Bordetella pertussis
cgaugcgccaggcgcu

SEQ ID NO: 326538 - RNA, 23 nt, Bordetella pertussis
cgaugcgccaguccagcgcgccg

SEQ ID NO: 326539 - RNA, 20 nt, Bordetella pertussis
cgaugcgccgcaccagcgcc

SEQ ID NO: 326540 - RNA, 23 nt, Bordetella pertussis
cgaugcgccgcaccagcgccgac

SEQ ID NO: 326541 - RNA, 22 nt, Bordetella pertussis
cgaugcgccgcgcuucgucggc

SEQ ID NO: 326542 - RNA, 17 nt, Bordetella pertussis
cgaugcgcgaagcgccc

SEQ ID NO: 326543 - RNA, 15 nt, Bordetella pertussis
cgaugcgcgccacga

SEQ ID NO: 326544 - RNA, 15 nt, Bordetella pertussis
cgaugcgcgagcgcg

SEQ ID NO: 326545 - RNA, 17 nt, Bordetella pertussis
cgaugcgcggcccggcc

SEQ ID NO: 326546 - RNA, 22 nt, Bordetella pertussis
cgaugcgcucgguccagacggg

SEQ ID NO: 326547 - RNA, 21 nt, Bordetella pertussis
cgaugcgcugcuggaggccgg

SEQ ID NO: 326548 - RNA, 19 nt, Bordetella pertussis
cgaugcgggccacgccggc

SEQ ID NO: 326549 - RNA, 13 nt, Bordetella pertussis
cgaugcgggcggc

SEQ ID NO: 326550 - RNA, 20 nt, Bordetella pertussis
cgaugcggguacuggccgac

SEQ ID NO: 326551 - RNA, 19 nt, Bordetella pertussis
cgaugcgguaggcccagca

SEQ ID NO: 326552 - RNA, 20 nt, Bordetella pertussis
cgaugcgguaggcccagcaa

SEQ ID NO: 326553 - RNA, 17 nt, Bordetella pertussis
cgaugcggucggccgcg

SEQ ID NO: 326554 - RNA, 21 nt, Bordetella pertussis
cgaugcggucggccgcgccgc

SEQ ID NO: 326555 - RNA, 22 nt, Bordetella pertussis
cgaugcggugggucucggcguc

SEQ ID NO: 326556 - RNA, 16 nt, Bordetella pertussis
cgaugcuuagcgcagc

SEQ ID NO: 326557 - RNA, 20 nt, Bordetella pertussis
cgaugcgguuguugccgcgu

SEQ ID NO: 326558 - RNA, 15 nt, Bordetella pertussis
cgauggagucgguca

SEQ ID NO: 326559 - RNA, 16 nt, Bordetella pertussis
cgauggcaucgccccg

SEQ ID NO: 326560 - RNA, 17 nt, Bordetella pertussis
cgauggccucggcaugg

SEQ ID NO: 326561 - RNA, 18 nt, Bordetella pertussis
cgauggccucggcauggc

SEQ ID NO: 326562 - RNA, 22 nt, Bordetella pertussis
cgauggccgggagcggccagca

SEQ ID NO: 326563 - RNA, 22 nt, Bordetella pertussis
cgauggccugugcggcccaugu

SEQ ID NO: 326564 - RNA, 20 nt, Bordetella pertussis
cgauggcgauguaggccagg

SEQ ID NO: 326565 - RNA, 19 nt, Bordetella pertussis
cgauggcgcaauaggccgc

SEQ ID NO: 326566 - RNA, 16 nt, Bordetella pertussis
cgauggcgcaggcgcg

SEQ ID NO: 326567 - RNA, 20 nt, Bordetella pertussis
cgauggcgccaccuucgccg

SEQ ID NO: 326568 - RNA, 16 nt, Bordetella pertussis
cgauggcgccggccag

SEQ ID NO: 326569 - RNA, 22 nt, Bordetella pertussis
cgauggcgccggccagcgcgcc

SEQ ID NO: 326570 - RNA, 12 nt, Bordetella pertussis
cgauggcgcgcg

SEQ ID NO: 326571 - RNA, 14 nt, Bordetella pertussis
cgauggcgcgcgcc

SEQ ID NO: 326572 - RNA, 15 nt, Bordetella pertussis
cgauggcgcgcgcca

SEQ ID NO: 326573 - RNA, 17 nt, Bordetella pertussis
cgauggcgcgcggcugg

SEQ ID NO: 326574 - RNA, 18 nt, Bordetella pertussis
cgauggcgcggccggagg

SEQ ID NO: 326575 - RNA, 22 nt, Bordetella pertussis
cgauggcgcggccggaggccgc

SEQ ID NO: 326576 - RNA, 18 nt, Bordetella pertussis
cgauggcgcgucgccgcg

SEQ ID NO: 326577 - RNA, 21 nt, Bordetella pertussis
cgaugggauacgccgugcugu

SEQ ID NO: 326578 - RNA, 18 nt, Bordetella pertussis
cgauggcuuggcgcuuac

SEQ ID NO: 326579 - RNA, 14 nt, Bordetella pertussis
cgaugggccugccc

SEQ ID NO: 326580 - RNA, 18 nt, Bordetella pertussis
cgaugggccugcccaugg

SEQ ID NO: 326581 - RNA, 17 nt, Bordetella pertussis
cgaugggguagucggcc

SEQ ID NO: 326582 - RNA, 19 nt, Bordetella pertussis
cgaugggguagucggccac

SEQ ID NO: 326583 - RNA, 22 nt, Bordetella pertussis
cgauggggucgggccgcgcgcg

SEQ ID NO: 326584 - RNA, 21 nt, Bordetella pertussis
cgauguagagggucuggccgg

SEQ ID NO: 326585 - RNA, 18 nt, Bordetella pertussis
cgauguagaucuggcgcg

SEQ ID NO: 326586 - RNA, 18 nt, Bordetella pertussis
cgauguagggcagcucgc

SEQ ID NO: 326587 - RNA, 19 nt, Bordetella pertussis
cgauguccacgaaggcgcc

SEQ ID NO: 326588 - RNA, 14 nt, Bordetella pertussis
cgauguccagcgag

SEQ ID NO: 326589 - RNA, 17 nt, Bordetella pertussis
cgaugugcaugccgucg

SEQ ID NO: 326590 - RNA, 16 nt, Bordetella pertussis
cgauguggcgcgccau

SEQ ID NO: 326591 - RNA, 14 nt, Bordetella pertussis
cgauguggcgcugg

SEQ ID NO: 326592 - RNA, 18 nt, Bordetella pertussis
cgauguggcgcuggcggc

SEQ ID NO: 326593 - RNA, 20 nt, Bordetella pertussis
cgauguggcgcuggcggcug

SEQ ID NO: 326594 - RNA, 17 nt, Bordetella pertussis
cgauguugaacagcugg

SEQ ID NO: 326595 - RNA, 16 nt, Bordetella pertussis
cgauguugccgccggc

SEQ ID NO: 326596 - RNA, 18 nt, Bordetella pertussis
cgauguugccgccggcca

SEQ ID NO: 326597 - RNA, 18 nt, Bordetella pertussis
cgauguuguuggccgcca

SEQ ID NO: 326598 - RNA, 20 nt, Bordetella pertussis
cgauguuguuggccgccagc

SEQ ID NO: 326599 - RNA, 16 nt, Bordetella pertussis
cgauucauaucgaacu

SEQ ID NO: 326600 - RNA, 17 nt, Bordetella pertussis
cgauucuuuccuggccg

SEQ ID NO: 326601 - RNA, 13 nt, Bordetella pertussis
cgauugaccagca

SEQ ID NO: 326602 - RNA, 15 nt, Bordetella pertussis
cgauugcagguggcc

SEQ ID NO: 326603 - RNA, 18 nt, Bordetella pertussis
cgauuucacccagggugu

SEQ ID NO: 326604 - RNA, 22 nt, Bordetella pertussis
cgauuuccgcuaccaggcgcgc

SEQ ID NO: 326605 - RNA, 17 nt, Bordetella pertussis
cgauuucggccgccggc

SEQ ID NO: 326606 - RNA, 14 nt, Bordetella pertussis
cgauuucgcgcgcc

SEQ ID NO: 326607 - RNA, 15 nt, Bordetella pertussis
cgauuucggcggcca

SEQ ID NO: 326608 - RNA, 14 nt, Bordetella pertussis
cgauuugagcagcg

SEQ ID NO: 326609 - RNA, 18 nt, Bordetella pertussis
cgauuugccgcagcccgc

SEQ ID NO: 326610 - RNA, 13 nt, Bordetella pertussis
cgcaaagccggaa

SEQ ID NO: 326611 - RNA, 23 nt, Bordetella pertussis
cgcaacacgcgcgacgccguggu

SEQ ID NO: 326612 - RNA, 16 nt, Bordetella pertussis
cgcaacagacccgggc

SEQ ID NO: 326613 - RNA, 22 nt, Bordetella pertussis
cgcaacgcaggcgccgccccgu

SEQ ID NO: 326614 - RNA, 16 nt, Bordetella pertussis
cgcaacgccgccacca

SEQ ID NO: 326615 - RNA, 14 nt, Bordetella pertussis
cgcaacgccgccgg

SEQ ID NO: 326616 - RNA, 17 nt, Bordetella pertussis
cgcaacgccggccgcca

SEQ ID NO: 326617 - RNA, 12 nt, Bordetella pertussis
cgcaacgccagc

SEQ ID NO: 326618 - RNA, 13 nt, Bordetella pertussis
cgcaacgcgcgcg

SEQ ID NO: 326619 - RNA, 19 nt, Bordetella pertussis
cgcaacgcgcgcgcgcaca

SEQ ID NO: 326620 - RNA, 21 nt, Bordetella pertussis
cgcaagagcgugugucccggc

SEQ ID NO: 326621 - RNA, 18 nt, Bordetella pertussis
cgcaagauuucauggcgu

SEQ ID NO: 326622 - RNA, 22 nt, Bordetella pertussis
cgcaagauuucauggcgucugc

SEQ ID NO: 326623 - RNA, 21 nt, Bordetella pertussis
cgcaagcaagccccaggcagg

SEQ ID NO: 326624 - RNA, 18 nt, Bordetella pertussis
cgcaagcaccgccugcug

SEQ ID NO: 326625 - RNA, 18 nt, Bordetella pertussis
cgcaagacgcggcagggc

SEQ ID NO: 326626 - RNA, 15 nt, Bordetella pertussis
cgcaagcaggucacg

SEQ ID NO: 326627 - RNA, 20 nt, Bordetella pertussis
cgcaagcauuugcgcgacgg

SEQ ID NO: 326628 - RNA, 18 nt, Bordetella pertussis
cgcaagccgcccgcggcg

SEQ ID NO: 326629 - RNA, 14 nt, Bordetella pertussis
cgcaagccgcugga

SEQ ID NO: 326630 - RNA, 15 nt, Bordetella pertussis
cgcaagccggccgcg

SEQ ID NO: 326631 - RNA, 16 nt, Bordetella pertussis
cgcaagccggccgcgc

SEQ ID NO: 326632 - RNA, 19 nt, Bordetella pertussis
cgcaagcggccaugcgccg

SEQ ID NO: 326633 - RNA, 13 nt, Bordetella pertussis
cgcaagcuggcgg

SEQ ID NO: 326634 - RNA, 23 nt, Bordetella pertussis
cgcaagcuggcggcgcgcggcug

SEQ ID NO: 326635 - RNA, 22 nt, Bordetella pertussis
cgcaaggacgcguccucggcca

SEQ ID NO: 326636 - RNA, 17 nt, Bordetella pertussis
cgcaaggaaguggccga

SEQ ID NO: 326637 - RNA, 17 nt, Bordetella pertussis
cgcaccggcacgcgcca

SEQ ID NO: 326638 - RNA, 22 nt, Bordetella pertussis
cgcaccggcacgcgccagcuga

SEQ ID NO: 326639 - RNA, 12 nt, Bordetella pertussis
cgcaccggccgg

SEQ ID NO: 326640 - RNA, 13 nt, Bordetella pertussis
cgcaccggccggc

SEQ ID NO: 326641 - RNA, 15 nt, Bordetella pertussis
cgcaccggccggccg

SEQ ID NO: 326642 - RNA, 13 nt, Bordetella pertussis
cgcaccggcgugc

SEQ ID NO: 326643 - RNA, 16 nt, Bordetella pertussis
cgcaccggcgugcgcu

SEQ ID NO: 326644 - RNA, 22 nt, Bordetella pertussis
cgcaccggcuuggggcgcgccg

SEQ ID NO: 326645 - RNA, 13 nt, Bordetella pertussis
cgcaccgggcggc

SEQ ID NO: 326646 - RNA, 15 nt, Bordetella pertussis
cgcaccgggcggccc

SEQ ID NO: 326647 - RNA, 18 nt, Bordetella pertussis
cgcaccgggcggcccggc

SEQ ID NO: 326648 - RNA, 19 nt, Bordetella pertussis
cgcaccgggcggcccggcg

SEQ ID NO: 326649 - RNA, 21 nt, Bordetella pertussis
cgcaccgggcggcccggcgga

SEQ ID NO: 326650 - RNA, 21 nt, Bordetella pertussis
cgcaccgucacgcgcuccagc

SEQ ID NO: 326651 - RNA, 16 nt, Bordetella pertussis
cgcaccugcugcggca

SEQ ID NO: 326652 - RNA, 21 nt, Bordetella pertussis
cgcaccugcugcggcacggcc

SEQ ID NO: 326653 - RNA, 23 nt, Bordetella pertussis
cgcaccugggaggggccggcuuu

SEQ ID NO: 326654 - RNA, 13 nt, Bordetella pertussis
cgcaccuggucca

SEQ ID NO: 326655 - RNA, 16 nt, Bordetella pertussis
cgcaccugguccaugg

SEQ ID NO: 326656 - RNA, 22 nt, Bordetella pertussis
cgcaccuguucggcggcgccca

SEQ ID NO: 326657 - RNA, 15 nt, Bordetella pertussis
cgcaccuugucgcgc

SEQ ID NO: 326658 - RNA, 17 nt, Bordetella pertussis
cgcaccuugucgcgcag

SEQ ID NO: 326659 - RNA, 18 nt, Bordetella pertussis
cgcaccuugucgcgcagc

SEQ ID NO: 326660 - RNA, 18 nt, Bordetella pertussis
cgcaccuugcccacgcca

SEQ ID NO: 326661 - RNA, 19 nt, Bordetella pertussis
cgcaccuuucugcugcucg

SEQ ID NO: 326662 - RNA, 12 nt, Bordetella pertussis
cgcacgaagcgg

SEQ ID NO: 326663 - RNA, 14 nt, Bordetella pertussis
cgcacgacagcauc

SEQ ID NO: 326664 - RNA, 13 nt, Bordetella pertussis
cgcacgaccacca

SEQ ID NO: 326665 - RNA, 16 nt, Bordetella pertussis
cgcacgacgucgcgcg

SEQ ID NO: 326666 - RNA, 19 nt, Bordetella pertussis
cgcacgaucgcgccggccu

SEQ ID NO: 326667 - RNA, 16 nt, Bordetella pertussis
cgcacgauggcgcgcg

SEQ ID NO: 326668 - RNA, 15 nt, Bordetella pertussis
cgcacgauggggccg

SEQ ID NO: 326669 - RNA, 19 nt, Bordetella pertussis
cgcacgauggggccgucgc

SEQ ID NO: 326670 - RNA, 19 nt, Bordetella pertussis
cgcacgauggaaucgucga

SEQ ID NO: 326671 - RNA, 18 nt, Bordetella pertussis
cgcacgauugucgucgcg

SEQ ID NO: 326672 - RNA, 16 nt, Bordetella pertussis
cgcacgccccgacgcg

SEQ ID NO: 326673 - RNA, 16 nt, Bordetella pertussis
cgcacgcccgccugca

SEQ ID NO: 326674 - RNA, 24 nt, Bordetella pertussis
cgcacgcccgccugcagcagcgcc

SEQ ID NO: 326675 - RNA, 19 nt, Bordetella pertussis
cgcacgcccgcgacgcugg

SEQ ID NO: 326676 - RNA, 15 nt, Bordetella pertussis
cgcacgccgaccugg

SEQ ID NO: 326677 - RNA, 16 nt, Bordetella pertussis
cgcacgccgaccuggc

SEQ ID NO: 326678 - RNA, 14 nt, Bordetella pertussis
cgcacgccgcgccg

SEQ ID NO: 326679 - RNA, 15 nt, Bordetella pertussis
cgcacgccgcgccgg

SEQ ID NO: 326680 - RNA, 16 nt, Bordetella pertussis
cgcacgccggccugcg

SEQ ID NO: 326681 - RNA, 21 nt, Bordetella pertussis
cgcacgccggccugcgccagc

SEQ ID NO: 326682 - RNA, 14 nt, Bordetella pertussis
cgcacgccgggcgc

SEQ ID NO: 326683 - RNA, 15 nt, Bordetella pertussis
cgcacgccgggcgcg

SEQ ID NO: 326684 - RNA, 18 nt, Bordetella pertussis
cgcacgccgggcgcggcc

SEQ ID NO: 326685 - RNA, 14 nt, Bordetella pertussis
cgcacgcgcagcac

SEQ ID NO: 326686 - RNA, 13 nt, Bordetella pertussis
cgcacgcgcggca

SEQ ID NO: 326687 - RNA, 14 nt, Bordetella pertussis
cgcacgcgcggcag

SEQ ID NO: 326688 - RNA, 19 nt, Bordetella pertussis
cgcacgcgcucgggcagcu

SEQ ID NO: 326689 - RNA, 12 nt, Bordetella pertussis
cgcacgcggccg

SEQ ID NO: 326690 - RNA, 23 nt, Bordetella pertussis
cgcacgcggccgcgggccgcugg

SEQ ID NO: 326691 - RNA, 20 nt, Bordetella pertussis
cgcacgcggcuucgcccgga

SEQ ID NO: 326692 - RNA, 18 nt, Bordetella pertussis
cgcacgcguucgggcggc

SEQ ID NO: 326693 - RNA, 22 nt, Bordetella pertussis
cgcacgcguucgggcggcaggu

SEQ ID NO: 326694 - RNA, 19 nt, Bordetella pertussis
cgcacgcugggcgaggcgc

SEQ ID NO: 326695 - RNA, 22 nt, Bordetella pertussis
cgcacgcugggcgaggcgcugg

SEQ ID NO: 326696 - RNA, 19 nt, Bordetella pertussis
cgcacgcucuacacggccg

SEQ ID NO: 326697 - RNA, 15 nt, Bordetella pertussis
cgcacgcuggcgccc

SEQ ID NO: 326698 - RNA, 14 nt, Bordetella pertussis
cgcacggcgcccug

SEQ ID NO: 326699 - RNA, 21 nt, Bordetella pertussis
cgcacggcggcgaucacgccg

SEQ ID NO: 326700 - RNA, 18 nt, Bordetella pertussis
cgcacgggccgacggccu

SEQ ID NO: 326701 - RNA, 22 nt, Bordetella pertussis
cgcacgggccgacggccucggc

SEQ ID NO: 326702 - RNA, 15 nt, Bordetella pertussis
cgcacgggcgagggc

SEQ ID NO: 326703 - RNA, 15 nt, Bordetella pertussis
cgcacggggacaggc

SEQ ID NO: 326704 - RNA, 15 nt, Bordetella pertussis
cgcacggggacuggc

SEQ ID NO: 326705 - RNA, 17 nt, Bordetella pertussis
cgcacggggacuggcac

SEQ ID NO: 326706 - RNA, 21 nt, Bordetella pertussis
cgcacggggacuggcaccggc

SEQ ID NO: 326707 - RNA, 22 nt, Bordetella pertussis
cgcacggggacuggcaccggcc

SEQ ID NO: 326708 - RNA, 23 nt, Bordetella pertussis
cgcacggggacuggcaccggccg

SEQ ID NO: 326709 - RNA, 18 nt, Bordetella pertussis
cgcacgguccaggcggcc

SEQ ID NO: 326710 - RNA, 16 nt, Bordetella pertussis
cgcacggugcgcacga

SEQ ID NO: 326711 - RNA, 15 nt, Bordetella pertussis
cgcacgguggcgccg

SEQ ID NO: 326712 - RNA, 19 nt, Bordetella pertussis
cgcacguggaccagggacg

SEQ ID NO: 326713 - RNA, 24 nt, Bordetella pertussis
cgcacuccguaaagaugcgcgccg

SEQ ID NO: 326714 - RNA, 12 nt, Bordetella pertussis
cgcacucgaccg

SEQ ID NO: 326715 - RNA, 22 nt, Bordetella pertussis
cgcacugagaaaggccgccacg

SEQ ID NO: 326716 - RNA, 15 nt, Bordetella pertussis
cgcacugggugacgc

SEQ ID NO: 326717 - RNA, 18 nt, Bordetella pertussis
cgcacugggugacgcugg

SEQ ID NO: 326718 - RNA, 18 nt, Bordetella pertussis
cgcacuggguggccagcg

SEQ ID NO: 326719 - RNA, 20 nt, Bordetella pertussis
cgcacuggguggccagcgcc

SEQ ID NO: 326720 - RNA, 23 nt, Bordetella pertussis
cgcacuggguggccagcgccgcc

SEQ ID NO: 326721 - RNA, 23 nt, Bordetella pertussis
cgcagaaaccgccacagcgccgc

SEQ ID NO: 326722 - RNA, 16 nt, Bordetella pertussis
cgcagaacagcagcgu

SEQ ID NO: 326723 - RNA, 18 nt, Bordetella pertussis
cgcagcaauugccccagc

SEQ ID NO: 326724 - RNA, 20 nt, Bordetella pertussis
cgcagcaauugccccagcac

SEQ ID NO: 326725 - RNA, 15 nt, Bordetella pertussis
cgcagaagcagccgc

SEQ ID NO: 326726 - RNA, 18 nt, Bordetella pertussis
cgcagaagcagccgcgcg

SEQ ID NO: 326727 - RNA, 16 nt, Bordetella pertussis
cgcagcaccagcaugu

SEQ ID NO: 326728 - RNA, 22 nt, Bordetella pertussis
cgcagcaccaggcuuugcgcgc

SEQ ID NO: 326729 - RNA, 23 nt, Bordetella pertussis
cgcagcaccaggcuuugcgcgcc

SEQ ID NO: 326730 - RNA, 17 nt, Bordetella pertussis
cgcagcaccgccagcgc

SEQ ID NO: 326731 - RNA, 13 nt, Bordetella pertussis
cgcagcaccgcgc

SEQ ID NO: 326732 - RNA, 18 nt, Bordetella pertussis
cgcagcaccgcgcgcacg

SEQ ID NO: 326733 - RNA, 21 nt, Bordetella pertussis
cgcagcaccgcgcgcacgacc

SEQ ID NO: 326734 - RNA, 16 nt, Bordetella pertussis
cgcagcaccggcguga

SEQ ID NO: 326735 - RNA, 14 nt, Bordetella pertussis
cgcagcaccucggc

SEQ ID NO: 326736 - RNA, 18 nt, Bordetella pertussis
cgcagcaccucggggcgc

SEQ ID NO: 326737 - RNA, 13 nt, Bordetella pertussis
cgcagcacgccca

SEQ ID NO: 326738 - RNA, 15 nt, Bordetella pertussis
cgcagcacgcccaga

SEQ ID NO: 326739 - RNA, 12 nt, Bordetella pertussis
cgcagcacgccg

SEQ ID NO: 326740 - RNA, 15 nt, Bordetella pertussis
cgcagcacgccgcgc

SEQ ID NO: 326741 - RNA, 17 nt, Bordetella pertussis
cgcagcacgccgcgcca

SEQ ID NO: 326742 - RNA, 21 nt, Bordetella pertussis
cgcagcacgccgcgccaggca

SEQ ID NO: 326743 - RNA, 22 nt, Bordetella pertussis
cgcagcaccuugaccuggucgg

SEQ ID NO: 326744 - RNA, 20 nt, Bordetella pertussis
cgcagcacgcugcgcggcgg

SEQ ID NO: 326745 - RNA, 15 nt, Bordetella pertussis
cgcagcagacgcuuc

SEQ ID NO: 326746 - RNA, 20 nt, Bordetella pertussis
cgcagcagauugccgcgcgg

SEQ ID NO: 326747 - RNA, 14 nt, Bordetella pertussis
cgcagcagcagcgc

SEQ ID NO: 326748 - RNA, 15 nt, Bordetella pertussis
cgcagcagcagcgca

SEQ ID NO: 326749 - RNA, 16 nt, Bordetella pertussis
cgcagcagcgccggca

SEQ ID NO: 326750 - RNA, 22 nt, Bordetella pertussis
cgcagcagcgccggcaggcgcg

SEQ ID NO: 326751 - RNA, 20 nt, Bordetella pertussis
cgcagcagcgcgguggccag

SEQ ID NO: 326752 - RNA, 21 nt, Bordetella pertussis
cgcagcagcgcgguggccagc

SEQ ID NO: 326753 - RNA, 13 nt, Bordetella pertussis
cgcagcagccgcu

SEQ ID NO: 326754 - RNA, 15 nt, Bordetella pertussis
cgcagcagcuugccg

SEQ ID NO: 326755 - RNA, 14 nt, Bordetella pertussis
cgcagcaggccagg

SEQ ID NO: 326756 - RNA, 21 nt, Bordetella pertussis
cgcagcaggcccaugccgcgc

SEQ ID NO: 326757 - RNA, 12 nt, Bordetella pertussis
cgcagcaggccg

SEQ ID NO: 326758 - RNA, 13 nt, Bordetella pertussis
cgcagcaggccgc

SEQ ID NO: 326759 - RNA, 15 nt, Bordetella pertussis
cgcagcaggccgcgc

SEQ ID NO: 326760 - RNA, 22 nt, Bordetella pertussis
cgcagcaggccguugccgcugu

SEQ ID NO: 326761 - RNA, 18 nt, Bordetella pertussis
cgcagcauuucggcgccg

SEQ ID NO: 326762 - RNA, 21 nt, Bordetella pertussis
cgcagcauuucggcgccgccg

SEQ ID NO: 326763 - RNA, 12 nt, Bordetella pertussis
cgcagcaggcgc

SEQ ID NO: 326764 - RNA, 15 nt, Bordetella pertussis
cgcagccacgggaug

SEQ ID NO: 326765 - RNA, 12 nt, Bordetella pertussis
cgcagccgggcu

SEQ ID NO: 326766 - RNA, 16 nt, Bordetella pertussis
cgcagccgggcugccg

SEQ ID NO: 326767 - RNA, 18 nt, Bordetella pertussis
cgcagccgggcugccggc

SEQ ID NO: 326768 - RNA, 20 nt, Bordetella pertussis
cgcagccgggcugccggcag

SEQ ID NO: 326769 - RNA, 22 nt, Bordetella pertussis
cgcagccgggcugccggcagca

SEQ ID NO: 326770 - RNA, 16 nt, Bordetella pertussis
cgcagccgucgcgcug

SEQ ID NO: 326771 - RNA, 19 nt, Bordetella pertussis
cgcagcgaacggcccacgc

SEQ ID NO: 326772 - RNA, 12 nt, Bordetella pertussis
cgcagcgacucg

SEQ ID NO: 326773 - RNA, 16 nt, Bordetella pertussis
cgcagcgaggccucgu

SEQ ID NO: 326774 - RNA, 23 nt, Bordetella pertussis
cgcagcgaggccucgugcugcug

SEQ ID NO: 326775 - RNA, 21 nt, Bordetella pertussis
cgcagcgaguagacgcagccg

SEQ ID NO: 326776 - RNA, 18 nt, Bordetella pertussis
cgcagcgcagcgccacgc

SEQ ID NO: 326777 - RNA, 18 nt, Bordetella pertussis
cgcagcgcaccgacggca

SEQ ID NO: 326778 - RNA, 15 nt, Bordetella pertussis
cgcagcgcagcgcca

SEQ ID NO: 326779 - RNA, 13 nt, Bordetella pertussis
cgcagcgccaccg

SEQ ID NO: 326780 - RNA, 18 nt, Bordetella pertussis
cgcagcgccaccggcugg

SEQ ID NO: 326781 - RNA, 15 nt, Bordetella pertussis
cgcagcgccacgcug

SEQ ID NO: 326782 - RNA, 22 nt, Bordetella pertussis
cgcagcgcccaggcgaauccgc

SEQ ID NO: 326783 - RNA, 16 nt, Bordetella pertussis
cgcagcgccgccaccu

SEQ ID NO: 326784 - RNA, 22 nt, Bordetella pertussis
cgcagcgccgccaccucggcgu

SEQ ID NO: 326785 - RNA, 12 nt, Bordetella pertussis
cgcagcgccgcu

SEQ ID NO: 326786 - RNA, 15 nt, Bordetella pertussis
cgcagcgccgcuucc

SEQ ID NO: 326787 - RNA, 12 nt, Bordetella pertussis
cgcagcgccugg

SEQ ID NO: 326788 - RNA, 15 nt, Bordetella pertussis
cgcagcgccuggccg

SEQ ID NO: 326789 - RNA, 16 nt, Bordetella pertussis
cgcagcgccuggccga

SEQ ID NO: 326790 - RNA, 13 nt, Bordetella pertussis
cgcagcgcgaccg

SEQ ID NO: 326791 - RNA, 14 nt, Bordetella pertussis
cgcagcgcgaccgg

SEQ ID NO: 326792 - RNA, 19 nt, Bordetella pertussis
cgcagcgccugcaggcggu

SEQ ID NO: 326793 - RNA, 12 nt, Bordetella pertussis
cgcagcgcgccg

SEQ ID NO: 326794 - RNA, 17 nt, Bordetella pertussis
cgcagcgcgccggacau

SEQ ID NO: 326795 - RNA, 15 nt, Bordetella pertussis
cgcaggacggcgccg

SEQ ID NO: 326796 - RNA, 14 nt, Bordetella pertussis
cgcaggagcaugcc

SEQ ID NO: 326797 - RNA, 12 nt, Bordetella pertussis
cgcaggagucgc

SEQ ID NO: 326798 - RNA, 22 nt, Bordetella pertussis
cgcaggagucgcuccccgugcg

SEQ ID NO: 326799 - RNA, 19 nt, Bordetella pertussis
cgcaggauaccggagcggc

SEQ ID NO: 326800 - RNA, 23 nt, Bordetella pertussis
cgcaggaucagcuugaugccggc

SEQ ID NO: 326801 - RNA, 16 nt, Bordetella pertussis
cgcaggaugacguggc

SEQ ID NO: 326802 - RNA, 13 nt, Bordetella pertussis
cgcaggaugcgcu

SEQ ID NO: 326803 - RNA, 22 nt, Bordetella pertussis
cgcaggaugcgcuggccggccg

SEQ ID NO: 326804 - RNA, 19 nt, Bordetella pertussis
cgcaggcaagcugcuggcg

SEQ ID NO: 326805 - RNA, 22 nt, Bordetella pertussis
cgcaggcaagcugcuggcgcgc

SEQ ID NO: 326806 - RNA, 24 nt, Bordetella pertussis
cgcaggcaagcugcuggcgcgcca

SEQ ID NO: 326807 - RNA, 18 nt, Bordetella pertussis
cgcaggcaaagccugacg

SEQ ID NO: 326808 - RNA, 22 nt, Bordetella pertussis
cgcaggcaguuggcggcgcagc

SEQ ID NO: 326809 - RNA, 20 nt, Bordetella pertussis
cgcaggcauucgugaugccc

SEQ ID NO: 326810 - RNA, 19 nt, Bordetella pertussis
cgcaggcauugcgccagcc

SEQ ID NO: 326811 - RNA, 17 nt, Bordetella pertussis
cgcaggccagcccgcgc

SEQ ID NO: 326812 - RNA, 22 nt, Bordetella pertussis
cgcaggccagcccgcgcgcguu

SEQ ID NO: 326813 - RNA, 13 nt, Bordetella pertussis
cgcaggcccagcc

SEQ ID NO: 326814 - RNA, 21 nt, Bordetella pertussis
cgcaggcccaugacgaccuug

SEQ ID NO: 326815 - RNA, 15 nt, Bordetella pertussis
cgcaggccagcgccg

SEQ ID NO: 326816 - RNA, 16 nt, Bordetella pertussis
cgcaggcccgacagga

SEQ ID NO: 326817 - RNA, 22 nt, Bordetella pertussis
cgcaggcccgacaggaucgaag

SEQ ID NO: 326818 - RNA, 15 nt, Bordetella pertussis
cgcaggccgccacuu

SEQ ID NO: 326819 - RNA, 16 nt, Bordetella pertussis
cgcaggccgccacuug

SEQ ID NO: 326820 - RNA, 14 nt, Bordetella pertussis
cgcaggccgcgccg

SEQ ID NO: 326821 - RNA, 16 nt, Bordetella pertussis
cgcaggccgcgccggc

SEQ ID NO: 326822 - RNA, 15 nt, Bordetella pertussis
cgcaggccgcgcgca

SEQ ID NO: 326823 - RNA, 15 nt, Bordetella pertussis
cgcaggccgcggcca

SEQ ID NO: 326824 - RNA, 18 nt, Bordetella pertussis
cgcaggccgcggccaggc

SEQ ID NO: 326825 - RNA, 16 nt, Bordetella pertussis
cgcaggccggcggcca

SEQ ID NO: 326826 - RNA, 21 nt, Bordetella pertussis
cgcaggcggcggccuccagca

SEQ ID NO: 326827 - RNA, 23 nt, Bordetella pertussis
cgcaggcggcuggugccgacggc

SEQ ID NO: 326828 - RNA, 18 nt, Bordetella pertussis
cgcaggcgggcgccgcgc

SEQ ID NO: 326829 - RNA, 20 nt, Bordetella pertussis
cgcaggcgugcgcgggcgcc

SEQ ID NO: 326830 - RNA, 13 nt, Bordetella pertussis
cgcaggcugucga

SEQ ID NO: 326831 - RNA, 13 nt, Bordetella pertussis
cgcagggacaggc

SEQ ID NO: 326832 - RNA, 16 nt, Bordetella pertussis
cgcagguccaggccug

SEQ ID NO: 326833 - RNA, 17 nt, Bordetella pertussis
cgcagguccaggccugg

SEQ ID NO: 326834 - RNA, 16 nt, Bordetella pertussis
cgcagguagucgguca

SEQ ID NO: 326835 - RNA, 18 nt, Bordetella pertussis
cgcagguauuccgccguc

SEQ ID NO: 326836 - RNA, 15 nt, Bordetella pertussis
cgcaggucggccagg

SEQ ID NO: 326837 - RNA, 13 nt, Bordetella pertussis
cgcaggucggcga

SEQ ID NO: 326838 - RNA, 18 nt, Bordetella pertussis
cgcaggucggcgaugcgc

SEQ ID NO: 326839 - RNA, 14 nt, Bordetella pertussis
cgcaggugccuguc

SEQ ID NO: 326840 - RNA, 16 nt, Bordetella pertussis
cgcagguggggcagca

SEQ ID NO: 326841 - RNA, 19 nt, Bordetella pertussis
cgcagguggggcagcaggc

SEQ ID NO: 326842 - RNA, 17 nt, Bordetella pertussis
cgcaggugugccagccg

SEQ ID NO: 326843 - RNA, 20 nt, Bordetella pertussis
cgcagguucaucgagaacac

SEQ ID NO: 326844 - RNA, 20 nt, Bordetella pertussis
cgcaguacccggugcagcgu

SEQ ID NO: 326845 - RNA, 22 nt, Bordetella pertussis
cgcaguacccggugcagcgugg

SEQ ID NO: 326846 - RNA, 22 nt, Bordetella pertussis
cgcauccgguggugcugggcgg

SEQ ID NO: 326847 - RNA, 14 nt, Bordetella pertussis
cgcaucgacagcgc

SEQ ID NO: 326848 - RNA, 18 nt, Bordetella pertussis
cgcaucgacagcgcgccc

SEQ ID NO: 326849 - RNA, 16 nt, Bordetella pertussis
cgcaucgaucagcgcg

SEQ ID NO: 326850 - RNA, 21 nt, Bordetella pertussis
cgcaucgaucaggcugucgcg

SEQ ID NO: 326851 - RNA, 15 nt, Bordetella pertussis
cgcaucgaugcggcc

SEQ ID NO: 326852 - RNA, 19 nt, Bordetella pertussis
cgcaucgccgcaggcgugc

SEQ ID NO: 326853 - RNA, 17 nt, Bordetella pertussis
cgcaucgcgaugcgcag

SEQ ID NO: 326854 - RNA, 14 nt, Bordetella pertussis
cgcaucgcgcagcg

SEQ ID NO: 326855 - RNA, 22 nt, Bordetella pertussis
cgcaucgcgcagcgugcggacc

SEQ ID NO: 326856 - RNA, 16 nt, Bordetella pertussis
cgcaucgcgcgcgccg

SEQ ID NO: 326857 - RNA, 19 nt, Bordetella pertussis
cgcaucgcgcgcgccggca

SEQ ID NO: 326858 - RNA, 14 nt, Bordetella pertussis
cgcaucgcgcggca

SEQ ID NO: 326859 - RNA, 17 nt, Bordetella pertussis
cgcaucgcgcggcaugg

SEQ ID NO: 326860 - RNA, 17 nt, Bordetella pertussis
cgcaucgcggcagcccg

SEQ ID NO: 326861 - RNA, 18 nt, Bordetella pertussis
cgcaucgcggcagcccgg

SEQ ID NO: 326862 - RNA, 12 nt, Bordetella pertussis
cgcaucggccgg

SEQ ID NO: 326863 - RNA, 14 nt, Bordetella pertussis
cgcaucggccggau

SEQ ID NO: 326864 - RNA, 13 nt, Bordetella pertussis
cgcaucggcgccg

SEQ ID NO: 326865 - RNA, 13 nt, Bordetella pertussis
cgcaucggcggca

SEQ ID NO: 326866 - RNA, 14 nt, Bordetella pertussis
cgcaucggcgccga

SEQ ID NO: 326867 - RNA, 16 nt, Bordetella pertussis
cgcaucggcgccgagc

SEQ ID NO: 326868 - RNA, 14 nt, Bordetella pertussis
cgcaucucgucgag

SEQ ID NO: 326869 - RNA, 15 nt, Bordetella pertussis
cgcaucugcggggca

SEQ ID NO: 326870 - RNA, 14 nt, Bordetella pertussis
cgcaugaccugcag

SEQ ID NO: 326871 - RNA, 19 nt, Bordetella pertussis
cgcaugaccugcgacagca

SEQ ID NO: 326872 - RNA, 15 nt, Bordetella pertussis
cgcaugacgaggugc

SEQ ID NO: 326873 - RNA, 19 nt, Bordetella pertussis
cgcaugacgaggugccugu

SEQ ID NO: 326874 - RNA, 14 nt, Bordetella pertussis
cgcaugacggcguc

SEQ ID NO: 326875 - RNA, 23 nt, Bordetella pertussis
cgcaugacggcgucgagcacgcg

SEQ ID NO: 326876 - RNA, 14 nt, Bordetella pertussis
cgcaugagccggca

SEQ ID NO: 326877 - RNA, 22 nt, Bordetella pertussis
cgcaugcugcagcugcuugccc

SEQ ID NO: 326878 - RNA, 16 nt, Bordetella pertussis
cgcaugcugcgcgagg

SEQ ID NO: 326879 - RNA, 16 nt, Bordetella pertussis
cgcauggaccgccgcc

SEQ ID NO: 326880 - RNA, 14 nt, Bordetella pertussis
cgcauggacgccgc

SEQ ID NO: 326881 - RNA, 16 nt, Bordetella pertussis
cgcauggacgccgccg

SEQ ID NO: 326882 - RNA, 16 nt, Bordetella pertussis
cgcauggccagcgcgc

SEQ ID NO: 326883 - RNA, 22 nt, Bordetella pertussis
cgcauggcgaugaccucggcga

SEQ ID NO: 326884 - RNA, 16 nt, Bordetella pertussis
cgcauggcggcccugu

SEQ ID NO: 326885 - RNA, 19 nt, Bordetella pertussis
cgcaugggaaauccgccgg

SEQ ID NO: 326886 - RNA, 16 nt, Bordetella pertussis
cgcaugggccaggcgc

SEQ ID NO: 326887 - RNA, 18 nt, Bordetella pertussis
cgcaugggcgcaggccgc

SEQ ID NO: 326888 - RNA, 22 nt, Bordetella pertussis
cgcauggggacuggcgccugca

SEQ ID NO: 326889 - RNA, 23 nt, Bordetella pertussis
cgcauggggacuggcgccugcaa

SEQ ID NO: 326890 - RNA, 23 nt, Bordetella pertussis
cgcaugggggcuggcgcuugccc

SEQ ID NO: 326891 - RNA, 13 nt, Bordetella pertussis
cgcauggucgcga

SEQ ID NO: 326892 - RNA, 15 nt, Bordetella pertussis
cgcauggugagggcc

SEQ ID NO: 326893 - RNA, 20 nt, Bordetella pertussis
cgcauguagucgucgcuggc

SEQ ID NO: 326894 - RNA, 14 nt, Bordetella pertussis
cgcaugucccagcg

SEQ ID NO: 326895 - RNA, 16 nt, Bordetella pertussis
cgcaugucccagcgcu

SEQ ID NO: 326896 - RNA, 18 nt, Bordetella pertussis
cgcaugucccgcaugacc

SEQ ID NO: 326897 - RNA, 19 nt, Bordetella pertussis
cgcauugccgucggccgcg

SEQ ID NO: 326898 - RNA, 18 nt, Bordetella pertussis
cgcauuggcccugcuggg

SEQ ID NO: 326899 - RNA, 19 nt, Bordetella pertussis
cgcauugcgguccaggaag

SEQ ID NO: 326900 - RNA, 15 nt, Bordetella pertussis
cgcauuucgaccugc

SEQ ID NO: 326901 - RNA, 13 nt, Bordetella pertussis
cgcauuucucggc

SEQ ID NO: 326902 - RNA, 15 nt, Bordetella pertussis
cgcauuucucggccu

SEQ ID NO: 326903 - RNA, 17 nt, Bordetella pertussis
cgcauuucucggccugg

SEQ ID NO: 326904 - RNA, 17 nt, Bordetella pertussis
cgccaacucgcuccagc

SEQ ID NO: 326905 - RNA, 17 nt, Bordetella pertussis
cgccaagaccgcggccg

SEQ ID NO: 326906 - RNA, 21 nt, Bordetella pertussis
cgccaagaccgcggccgcgcu

SEQ ID NO: 326907 - RNA, 15 nt, Bordetella pertussis
cgccaagcggcaggc

SEQ ID NO: 326908 - RNA, 15 nt, Bordetella pertussis
cgccaagcugcuggc

SEQ ID NO: 326909 - RNA, 17 nt, Bordetella pertussis
cgccaagcugcuggccg

SEQ ID NO: 326910 - RNA, 19 nt, Bordetella pertussis
cgccaagcugcuggccggc

SEQ ID NO: 326911 - RNA, 16 nt, Bordetella pertussis
cgccaaucugccgcug

SEQ ID NO: 326912 - RNA, 21 nt, Bordetella pertussis
cgccaaucugccgcugaccgg

SEQ ID NO: 326913 - RNA, 18 nt, Bordetella pertussis
cgccaauugcuugccugu

SEQ ID NO: 326914 - RNA, 19 nt, Bordetella pertussis
cgccacagauuggccacca

SEQ ID NO: 326915 - RNA, 20 nt, Bordetella pertussis
cgccacagcgccaucgcgcg

SEQ ID NO: 326916 - RNA, 13 nt, Bordetella pertussis
cgccacagcgccg

SEQ ID NO: 326917 - RNA, 22 nt, Bordetella pertussis
cgccacaggcugacgcccggcu

SEQ ID NO: 326918 - RNA, 19 nt, Bordetella pertussis
cgccacauccugcacggcg

SEQ ID NO: 326919 - RNA, 17 nt, Bordetella pertussis
cgccaccacgcgcacca

SEQ ID NO: 326920 - RNA, 23 nt, Bordetella pertussis
cgccaccagcggcguggcggcca

SEQ ID NO: 326921 - RNA, 17 nt, Bordetella pertussis
cgccaccagcgucagca

SEQ ID NO: 326922 - RNA, 20 nt, Bordetella pertussis
cgccaccaggaacgccagca

SEQ ID NO: 326923 - RNA, 13 nt, Bordetella pertussis
cgccaccagcuug

SEQ ID NO: 326924 - RNA, 18 nt, Bordetella pertussis
cgccaccagcuugcgcgc

SEQ ID NO: 326925 - RNA, 17 nt, Bordetella pertussis
cgccaccagggcgcccg

SEQ ID NO: 326926 - RNA, 21 nt, Bordetella pertussis
cgccaccagugcgccggcggc

SEQ ID NO: 326927 - RNA, 23 nt, Bordetella pertussis
cgccaccaugccuugcgcgacag

SEQ ID NO: 326928 - RNA, 18 nt, Bordetella pertussis
cgccacccaggcggcagg

SEQ ID NO: 326929 - RNA, 13 nt, Bordetella pertussis
cgccaccccgccg

SEQ ID NO: 326930 - RNA, 15 nt, Bordetella pertussis
cgccaccccgccgcu

SEQ ID NO: 326931 - RNA, 16 nt, Bordetella pertussis
cgccacccguaccgcc

SEQ ID NO: 326932 - RNA, 14 nt, Bordetella pertussis
cgccaccgcccaga

SEQ ID NO: 326933 - RNA, 17 nt, Bordetella pertussis
cgccaccgcccccgccg

SEQ ID NO: 326934 - RNA, 13 nt, Bordetella pertussis
cgccaccgcgccg

SEQ ID NO: 326935 - RNA, 20 nt, Bordetella pertussis
cgccacgcaggcgggcgccg

SEQ ID NO: 326936 - RNA, 12 nt, Bordetella pertussis
cgccacgccagc

SEQ ID NO: 326937 - RNA, 15 nt, Bordetella pertussis
cgccacgccagcggc

SEQ ID NO: 326938 - RNA, 13 nt, Bordetella pertussis
cgccacgccauug

SEQ ID NO: 326939 - RNA, 12 nt, Bordetella pertussis
cgccacgcccac

SEQ ID NO: 326940 - RNA, 13 nt, Bordetella pertussis
cgccacgcccacu

SEQ ID NO: 326941 - RNA, 14 nt, Bordetella pertussis
cgccacgcccaggc

SEQ ID NO: 326942 - RNA, 19 nt, Bordetella pertussis
cgccacgcccaggccgcuu

SEQ ID NO: 326943 - RNA, 13 nt, Bordetella pertussis
cgccacgcccauc

SEQ ID NO: 326944 - RNA, 20 nt, Bordetella pertussis
cgccacgcccgucucgcgcg

SEQ ID NO: 326945 - RNA, 15 nt, Bordetella pertussis
cgccacgcccuggca

SEQ ID NO: 326946 - RNA, 13 nt, Bordetella pertussis
cgccacgccggcc

SEQ ID NO: 326947 - RNA, 23 nt, Bordetella pertussis
cgccacgccggccagcuugagca

SEQ ID NO: 326948 - RNA, 13 nt, Bordetella pertussis
cgccacggcgaug

SEQ ID NO: 326949 - RNA, 14 nt, Bordetella pertussis
cgccacggcgcccg

SEQ ID NO: 326950 - RNA, 15 nt, Bordetella pertussis
cgccacggcgcccga

SEQ ID NO: 326951 - RNA, 23 nt, Bordetella pertussis
cgccacggcggugaucugcucgc

SEQ ID NO: 326952 - RNA, 13 nt, Bordetella pertussis
cgccacggcggug

SEQ ID NO: 326953 - RNA, 22 nt, Bordetella pertussis
cgccacggcgucgccggccagg

SEQ ID NO: 326954 - RNA, 22 nt, Bordetella pertussis
cgccacgggcccgcgcagacgg

SEQ ID NO: 326955 - RNA, 19 nt, Bordetella pertussis
cgccacggucugcacgccg

SEQ ID NO: 326956 - RNA, 22 nt, Bordetella pertussis
cgccacggucugcacgccgggc

SEQ ID NO: 326957 - RNA, 13 nt, Bordetella pertussis
cgccacuggccuu

SEQ ID NO: 326958 - RNA, 21 nt, Bordetella pertussis
cgccacuggccuugugcgccg

SEQ ID NO: 326959 - RNA, 21 nt, Bordetella pertussis
cgccacuuccuugccauccag

SEQ ID NO: 326960 - RNA, 18 nt, Bordetella pertussis
cgccacuucgccucggcg

SEQ ID NO: 326961 - RNA, 14 nt, Bordetella pertussis
cgccacuugcaggc

SEQ ID NO: 326962 - RNA, 15 nt, Bordetella pertussis
cgccacuugcaggcc

SEQ ID NO: 326963 - RNA, 18 nt, Bordetella pertussis
cgccacuugcggcaggug

SEQ ID NO: 326964 - RNA, 16 nt, Bordetella pertussis
cgccagaaagcgcggc

SEQ ID NO: 326965 - RNA, 18 nt, Bordetella pertussis
cgccagaaagcgcggccg

SEQ ID NO: 326966 - RNA, 22 nt, Bordetella pertussis
cgccagaaagcgcggccgggcu

SEQ ID NO: 326967 - RNA, 14 nt, Bordetella pertussis
cgccagaugcgccg

SEQ ID NO: 326968 - RNA, 19 nt, Bordetella pertussis
cgccagcagcacgucguag

SEQ ID NO: 326969 - RNA, 14 nt, Bordetella pertussis
cgccagcagcaggc

SEQ ID NO: 326970 - RNA, 15 nt, Bordetella pertussis
cgccagcagcgccgg

SEQ ID NO: 326971 - RNA, 16 nt, Bordetella pertussis
cgccagcagcucggcg

SEQ ID NO: 326972 - RNA, 23 nt, Bordetella pertussis
cgccagcaggauguccacggucg

SEQ ID NO: 326973 - RNA, 22 nt, Bordetella pertussis
cgccagcaggcccugggccagc

SEQ ID NO: 326974 - RNA, 14 nt, Bordetella pertussis
cgccagcaggcgaa

SEQ ID NO: 326975 - RNA, 19 nt, Bordetella pertussis
cgccagcaggcgcucggcu

SEQ ID NO: 326976 - RNA, 17 nt, Bordetella pertussis
cgccagcagggucagcg

SEQ ID NO: 326977 - RNA, 19 nt, Bordetella pertussis
cgccagcagggucagcggc

SEQ ID NO: 326978 - RNA, 22 nt, Bordetella pertussis
cgccagcagggucagcggccgg

SEQ ID NO: 326979 - RNA, 16 nt, Bordetella pertussis
cgccagcccgacggcc

SEQ ID NO: 326980 - RNA, 19 nt, Bordetella pertussis
cgccagcccgacggccagc

SEQ ID NO: 326981 - RNA, 23 nt, Bordetella pertussis
cgccagcccgacggccagcgcga

SEQ ID NO: 326982 - RNA, 15 nt, Bordetella pertussis
cgccagcccgcccgc

SEQ ID NO: 326983 - RNA, 13 nt, Bordetella pertussis
cgccagcccgccg

SEQ ID NO: 326984 - RNA, 19 nt, Bordetella pertussis
cgccagcccuugcuugccg

SEQ ID NO: 326985 - RNA, 13 nt, Bordetella pertussis
cgccagcgccagc

SEQ ID NO: 326986 - RNA, 22 nt, Bordetella pertussis
cgccagcgccaugaugucgcgc

SEQ ID NO: 326987 - RNA, 13 nt, Bordetella pertussis
cgccagcgccccg

SEQ ID NO: 326988 - RNA, 15 nt, Bordetella pertussis
cgccagcgccgcgcg

SEQ ID NO: 326989 - RNA, 17 nt, Bordetella pertussis
cgccagcgccgcgcgcg

SEQ ID NO: 326990 - RNA, 15 nt, Bordetella pertussis
cgccagcgccggcgc

SEQ ID NO: 326991 - RNA, 14 nt, Bordetella pertussis
cgccagcggcagcg

SEQ ID NO: 326992 - RNA, 18 nt, Bordetella pertussis
cgccagcggcagcgcgca

SEQ ID NO: 326993 - RNA, 20 nt, Bordetella pertussis
cgccagcggcauugcccagg

SEQ ID NO: 326994 - RNA, 12 nt, Bordetella pertussis
cgccagcggccg

SEQ ID NO: 326995 - RNA, 14 nt, Bordetella pertussis
cgccagcggccguc

SEQ ID NO: 326996 - RNA, 18 nt, Bordetella pertussis
cgccagcggccgucgccu

SEQ ID NO: 326997 - RNA, 15 nt, Bordetella pertussis
cgccagcggcgagca

SEQ ID NO: 326998 - RNA, 22 nt, Bordetella pertussis
cgccagcggcgagcaauccguc

SEQ ID NO: 326999 - RNA, 11 nt, Bordetella pertussis
cgccagcggcu

SEQ ID NO: 327000 - RNA, 18 nt, Bordetella pertussis
cgccagcgggagccuguc

SEQ ID NO: 327001 - RNA, 19 nt, Bordetella pertussis
cgccagcgggagccugucc

SEQ ID NO: 327002 - RNA, 13 nt, Bordetella pertussis
cgccagcggcugg

SEQ ID NO: 327003 - RNA, 20 nt, Bordetella pertussis
cgccagcucggccugcggcu

SEQ ID NO: 327004 - RNA, 17 nt, Bordetella pertussis
cgccagcucuucgagcg

SEQ ID NO: 327005 - RNA, 19 nt, Bordetella pertussis
cgccagcucuucgagcgcg

SEQ ID NO: 327006 - RNA, 16 nt, Bordetella pertussis
cgccagcugaccucgc

SEQ ID NO: 327007 - RNA, 16 nt, Bordetella pertussis
cgccagcugcgcagcg

SEQ ID NO: 327008 - RNA, 18 nt, Bordetella pertussis
cgccagcugcgcagcgac

SEQ ID NO: 327009 - RNA, 20 nt, Bordetella pertussis
cgccagcuggaccgccuggc

SEQ ID NO: 327010 - RNA, 21 nt, Bordetella pertussis
cgccagcuggaccgccuggcc

SEQ ID NO: 327011 - RNA, 17 nt, Bordetella pertussis
cgccagcuugcgcgccu

SEQ ID NO: 327012 - RNA, 19 nt, Bordetella pertussis
cgccagcuugcgcgccuug

SEQ ID NO: 327013 - RNA, 17 nt, Bordetella pertussis
cgccagcuuggccaggc

SEQ ID NO: 327014 - RNA, 13 nt, Bordetella pertussis
cgccaggaacagc

SEQ ID NO: 327015 - RNA, 19 nt, Bordetella pertussis
cgccaggaacagcgccggc

SEQ ID NO: 327016 - RNA, 17 nt, Bordetella pertussis
cgccaggaagccgugcg

SEQ ID NO: 327017 - RNA, 17 nt, Bordetella pertussis
cgccaggaagcgcgccg

SEQ ID NO: 327018 - RNA, 20 nt, Bordetella pertussis
cgccaggaagcgcgccgcgc

SEQ ID NO: 327019 - RNA, 21 nt, Bordetella pertussis
cgccaggaagcgcgccgcgcg

SEQ ID NO: 327020 - RNA, 16 nt, Bordetella pertussis
cgccaggaagcgggcc

SEQ ID NO: 327021 - RNA, 23 nt, Bordetella pertussis
cgccaggaagcgggccugccgcg

SEQ ID NO: 327022 - RNA, 14 nt, Bordetella pertussis
cgccaggaccagga

SEQ ID NO: 327023 - RNA, 20 nt, Bordetella pertussis
cgccaggacgggaaagcggc

SEQ ID NO: 327024 - RNA, 21 nt, Bordetella pertussis
cgccaggacgggaaagcggcg

SEQ ID NO: 327025 - RNA, 17 nt, Bordetella pertussis
cgccaggacguccaggc

SEQ ID NO: 327026 - RNA, 20 nt, Bordetella pertussis
cgccaggacuucgucgauca

SEQ ID NO: 327027 - RNA, 19 nt, Bordetella pertussis
cgccaugcgaugcugcagg

SEQ ID NO: 327028 - RNA, 21 nt, Bordetella pertussis
cgccaugcgaugcugcagggc

SEQ ID NO: 327029 - RNA, 22 nt, Bordetella pertussis
cgccaugcgaugcugcagggcc

SEQ ID NO: 327030 - RNA, 14 nt, Bordetella pertussis
cgccaugcgcacca

SEQ ID NO: 327031 - RNA, 19 nt, Bordetella pertussis
cgccaugcgcaccaccgcc

SEQ ID NO: 327032 - RNA, 21 nt, Bordetella pertussis
cgccaugcgcaccaccgccga

SEQ ID NO: 327033 - RNA, 12 nt, Bordetella pertussis
cgccaugcgcag

SEQ ID NO: 327034 - RNA, 19 nt, Bordetella pertussis
cgccaugcgcauggccagc

SEQ ID NO: 327035 - RNA, 20 nt, Bordetella pertussis
cgccaugcgcauggccagcg

SEQ ID NO: 327036 - RNA, 22 nt, Bordetella pertussis
cgccaugcgcauggccagcgcg

SEQ ID NO: 327037 - RNA, 13 nt, Bordetella pertussis
cgccaugcgcccg

SEQ ID NO: 327038 - RNA, 18 nt, Bordetella pertussis
cgccaugcgcccggccac

SEQ ID NO: 327039 - RNA, 14 nt, Bordetella pertussis
cgccaugcggcugg

SEQ ID NO: 327040 - RNA, 17 nt, Bordetella pertussis
cgccaugcggcuggccg

SEQ ID NO: 327041 - RNA, 17 nt, Bordetella pertussis
cgccaugcucgcgcaca

SEQ ID NO: 327042 - RNA, 19 nt, Bordetella pertussis
cgccaugcucgcgcacagc

SEQ ID NO: 327043 - RNA, 21 nt, Bordetella pertussis
cgccaugcugccaaccgcgac

SEQ ID NO: 327044 - RNA, 14 nt, Bordetella pertussis
cgccaugcuggccg

SEQ ID NO: 327045 - RNA, 21 nt, Bordetella pertussis
cgccaugcuggccgccgcgcu

SEQ ID NO: 327046 - RNA, 14 nt, Bordetella pertussis
cgccauggacgccg

SEQ ID NO: 327047 - RNA, 17 nt, Bordetella pertussis
cgccauggacgccgaac

SEQ ID NO: 327048 - RNA, 18 nt, Bordetella pertussis
cgccauggaggcgcagcg

SEQ ID NO: 327049 - RNA, 22 nt, Bordetella pertussis
cgccauggaggcgcagcgcggc

SEQ ID NO: 327050 - RNA, 14 nt, Bordetella pertussis
cgccauggccacga

SEQ ID NO: 327051 - RNA, 15 nt, Bordetella pertussis
cgccauggcggccgc

SEQ ID NO: 327052 - RNA, 16 nt, Bordetella pertussis
cgccauggcggccgcc

SEQ ID NO: 327053 - RNA, 17 nt, Bordetella pertussis
cgccauggcggccgccg

SEQ ID NO: 327054 - RNA, 22 nt, Bordetella pertussis
cgccauggcggccgccgccagc

SEQ ID NO: 327055 - RNA, 13 nt, Bordetella pertussis
cgccauggcggcg

SEQ ID NO: 327056 - RNA, 15 nt, Bordetella pertussis
cgccauggcggcggc

SEQ ID NO: 327057 - RNA, 19 nt, Bordetella pertussis
cgccauggcggcggccacg

SEQ ID NO: 327058 - RNA, 12 nt, Bordetella pertussis
cgccauggcgcg

SEQ ID NO: 327059 - RNA, 14 nt, Bordetella pertussis
cgccauggcgcugg

SEQ ID NO: 327060 - RNA, 16 nt, Bordetella pertussis
cgccauggcgcuggca

SEQ ID NO: 327061 - RNA, 18 nt, Bordetella pertussis
cgccauggcgcuggcagg

SEQ ID NO: 327062 - RNA, 22 nt, Bordetella pertussis
cgccauggucgcgaccaccgug

SEQ ID NO: 327063 - RNA, 13 nt, Bordetella pertussis
cgccauggugccg

SEQ ID NO: 327064 - RNA, 16 nt, Bordetella pertussis
cgccauggugccgcgc

SEQ ID NO: 327065 - RNA, 19 nt, Bordetella pertussis
cgccauggugccgcgcagg

SEQ ID NO: 327066 - RNA, 21 nt, Bordetella pertussis
cgccaugucgacgaucucgcg

SEQ ID NO: 327067 - RNA, 19 nt, Bordetella pertussis
cgccaugugcgccgcgccg

SEQ ID NO: 327068 - RNA, 23 nt, Bordetella pertussis
cgccaugugcgccgcgccguaca

SEQ ID NO: 327069 - RNA, 22 nt, Bordetella pertussis
cgccaugugcguugccagccca

SEQ ID NO: 327070 - RNA, 17 nt, Bordetella pertussis
cgccauucauccagcgc

SEQ ID NO: 327071 - RNA, 18 nt, Bordetella pertussis
cgccauucauccagcgcg

SEQ ID NO: 327072 - RNA, 19 nt, Bordetella pertussis
cgccauucauccagcgcgc

SEQ ID NO: 327073 - RNA, 20 nt, Bordetella pertussis
cgccauucauccagcgcgcg

SEQ ID NO: 327074 - RNA, 13 nt, Bordetella pertussis
cgccauugcacgc

SEQ ID NO: 327075 - RNA, 21 nt, Bordetella pertussis
cgccauugccacggcgggccg

SEQ ID NO: 327076 - RNA, 22 nt, Bordetella pertussis
cgccauugccacggcgggccgg

SEQ ID NO: 327077 - RNA, 13 nt, Bordetella pertussis
cgccauugcgccg

SEQ ID NO: 327078 - RNA, 12 nt, Bordetella pertussis
cgccauugcggg

SEQ ID NO: 327079 - RNA, 22 nt, Bordetella pertussis
cgcccaacccggcgaggccgcc

SEQ ID NO: 327080 - RNA, 22 nt, Bordetella pertussis
cgcccaagucgaguucggcgcg

SEQ ID NO: 327081 - RNA, 23 nt, Bordetella pertussis
cgcccaagucgaguucggcgcgc

SEQ ID NO: 327082 - RNA, 21 nt, Bordetella pertussis
cgcccaauccgaucagcacga

SEQ ID NO: 327083 - RNA, 23 nt, Bordetella pertussis
cgcccaauccgaucagcacgaug

SEQ ID NO: 327084 - RNA, 17 nt, Bordetella pertussis
cgcccaaucgggcagca

SEQ ID NO: 327085 - RNA, 22 nt, Bordetella pertussis
cgcccaaucgggcagcacgcgc

SEQ ID NO: 327086 - RNA, 21 nt, Bordetella pertussis
cgcccacaggaacaggccggc

SEQ ID NO: 327087 - RNA, 22 nt, Bordetella pertussis
cgcccacaggaacaggccggcc

SEQ ID NO: 327088 - RNA, 23 nt, Bordetella pertussis
cgcccacaggaacaggccggccu

SEQ ID NO: 327089 - RNA, 19 nt, Bordetella pertussis
cgcccacauagcggccggc

SEQ ID NO: 327090 - RNA, 20 nt, Bordetella pertussis
cgcccacauagcggccggcg

SEQ ID NO: 327091 - RNA, 22 nt, Bordetella pertussis
cgcccacauagcggccggcgcg

SEQ ID NO: 327092 - RNA, 15 nt, Bordetella pertussis
cgcccaccacgccgc

SEQ ID NO: 327093 - RNA, 18 nt, Bordetella pertussis
cgcccaccagggugccgc

SEQ ID NO: 327094 - RNA, 19 nt, Bordetella pertussis
cgcccaccagggugccgcc

SEQ ID NO: 327095 - RNA, 20 nt, Bordetella pertussis
cgcccaccaugagcacgccc

SEQ ID NO: 327096 - RNA, 18 nt, Bordetella pertussis
cgcccacccccggcacca

SEQ ID NO: 327097 - RNA, 22 nt, Bordetella pertussis
cgcccacgcacaugaugcccag

SEQ ID NO: 327098 - RNA, 16 nt, Bordetella pertussis
cgcccacgccgccugg

SEQ ID NO: 327099 - RNA, 20 nt, Bordetella pertussis
cgcccacgccgccuggcccg

SEQ ID NO: 327100 - RNA, 19 nt, Bordetella pertussis
cgcccacggccuguccggc

SEQ ID NO: 327101 - RNA, 14 nt, Bordetella pertussis
cgcccacgggcgcc

SEQ ID NO: 327102 - RNA, 17 nt, Bordetella pertussis
cgcccacgggcgccugg

SEQ ID NO: 327103 - RNA, 18 nt, Bordetella pertussis
cgcccacuuccucggcgc

SEQ ID NO: 327104 - RNA, 23 nt, Bordetella pertussis
cgcccacuuccucggcgcgcgcg

SEQ ID NO: 327105 - RNA, 13 nt, Bordetella pertussis
cgcccagauggcc

SEQ ID NO: 327106 - RNA, 15 nt, Bordetella pertussis
cgcccagauggccga

SEQ ID NO: 327107 - RNA, 16 nt, Bordetella pertussis
cgcccagcagcgccac

SEQ ID NO: 327108 - RNA, 23 nt, Bordetella pertussis
cgcccagcaggcuuucgcacagc

SEQ ID NO: 327109 - RNA, 20 nt, Bordetella pertussis
cgcccagcauccgcgccagg

SEQ ID NO: 327110 - RNA, 21 nt, Bordetella pertussis
cgcccagcauccgcgccagga

SEQ ID NO: 327111 - RNA, 17 nt, Bordetella pertussis
cgcccagcaugcgcgcg

SEQ ID NO: 327112 - RNA, 18 nt, Bordetella pertussis
cgcccagcccugcccgca

SEQ ID NO: 327113 - RNA, 20 nt, Bordetella pertussis
cgcccagccaggcgccagcg

SEQ ID NO: 327114 - RNA, 22 nt, Bordetella pertussis
cgcccagccaggcgccagcggc

SEQ ID NO: 327115 - RNA, 14 nt, Bordetella pertussis
cgcccagccgcagc

SEQ ID NO: 327116 - RNA, 15 nt, Bordetella pertussis
cgcccagccgcagca

SEQ ID NO: 327117 - RNA, 14 nt, Bordetella pertussis
cgcccagccgcgcc

SEQ ID NO: 327118 - RNA, 15 nt, Bordetella pertussis
cgcccagccgcgcca

SEQ ID NO: 327119 - RNA, 20 nt, Bordetella pertussis
cgcccagccgcgccaucacg

SEQ ID NO: 327120 - RNA, 12 nt, Bordetella pertussis
cgcccagccggc

SEQ ID NO: 327121 - RNA, 15 nt, Bordetella pertussis
cgcccagccggccga

SEQ ID NO: 327122 - RNA, 17 nt, Bordetella pertussis
cgcccagcgacgagggc

SEQ ID NO: 327123 - RNA, 20 nt, Bordetella pertussis
cgcccagcgacgagggcgcc

SEQ ID NO: 327124 - RNA, 18 nt, Bordetella pertussis
cgcccagcgagccggcca

SEQ ID NO: 327125 - RNA, 20 nt, Bordetella pertussis
cgcccagcgagccggccagc

SEQ ID NO: 327126 - RNA, 21 nt, Bordetella pertussis
cgcccagcgagccggccagcg

SEQ ID NO: 327127 - RNA, 12 nt, Bordetella pertussis
cgcccagcgccg

SEQ ID NO: 327128 - RNA, 15 nt, Bordetella pertussis
cgcccagcgccggca

SEQ ID NO: 327129 - RNA, 16 nt, Bordetella pertussis
cgcccagcgccggcac

SEQ ID NO: 327130 - RNA, 22 nt, Bordetella pertussis
cgcccagcgccugcaaguccag

SEQ ID NO: 327131 - RNA, 14 nt, Bordetella pertussis
cgcccagcgcgucg

SEQ ID NO: 327132 - RNA, 20 nt, Bordetella pertussis
cgcccagcgcgugggccagc

SEQ ID NO: 327133 - RNA, 21 nt, Bordetella pertussis
cgcccagcgcgugggccagca

SEQ ID NO: 327134 - RNA, 20 nt, Bordetella pertussis
cgcccagcgcuugcacgcca

SEQ ID NO: 327135 - RNA, 16 nt, Bordetella pertussis
cgcccagcggcgccga

SEQ ID NO: 327136 - RNA, 13 nt, Bordetella pertussis
cgcccagcugcuu

SEQ ID NO: 327137 - RNA, 18 nt, Bordetella pertussis
cgcccagcugcuucaugc

SEQ ID NO: 327138 - RNA, 20 nt, Bordetella pertussis
cgcccagcuugaugccgccg

SEQ ID NO: 327139 - RNA, 12 nt, Bordetella pertussis
cgcccaggccca

SEQ ID NO: 327140 - RNA, 22 nt, Bordetella pertussis
cgcccaggcccaccgcaucgcg

SEQ ID NO: 327141 - RNA, 20 nt, Bordetella pertussis
cgcccaggcccagcgcgcca

SEQ ID NO: 327142 - RNA, 17 nt, Bordetella pertussis
cgcccaggaaggcgaaa

SEQ ID NO: 327143 - RNA, 13 nt, Bordetella pertussis
cgcccaggccggg

SEQ ID NO: 327144 - RNA, 20 nt, Bordetella pertussis
cgcccaggccgggcgagccg

SEQ ID NO: 327145 - RNA, 16 nt, Bordetella pertussis
cgcccaggccguggcg

SEQ ID NO: 327146 - RNA, 20 nt, Bordetella pertussis
cgcccaggccguggcgcacc

SEQ ID NO: 327147 - RNA, 21 nt, Bordetella pertussis
cgcccaggccguggcgcacca

SEQ ID NO: 327148 - RNA, 15 nt, Bordetella pertussis
cgcccaggcgaugcc

SEQ ID NO: 327149 - RNA, 16 nt, Bordetella pertussis
cgcccaggcgaugccc

SEQ ID NO: 327150 - RNA, 16 nt, Bordetella pertussis
cgcccaggcgcagccg

SEQ ID NO: 327151 - RNA, 21 nt, Bordetella pertussis
cgcccaggggccggcgcgccg

SEQ ID NO: 327152 - RNA, 16 nt, Bordetella pertussis
cgcccagguccugcgc

SEQ ID NO: 327153 - RNA, 19 nt, Bordetella pertussis
cgcccaggucggacgcgcc

SEQ ID NO: 327154 - RNA, 20 nt, Bordetella pertussis
cgcccaggucggacgcgccg

SEQ ID NO: 327155 - RNA, 21 nt, Bordetella pertussis
cgcccaggugcgggagccggc

SEQ ID NO: 327156 - RNA, 17 nt, Bordetella pertussis
cgcccagguugcggccg

SEQ ID NO: 327157 - RNA, 19 nt, Bordetella pertussis
cgcccagguugcggccgcc

SEQ ID NO: 327158 - RNA, 23 nt, Bordetella pertussis
cgcccagguugcggccgccaccc

SEQ ID NO: 327159 - RNA, 22 nt, Bordetella pertussis
cgcccaguauggugaccggcgu

SEQ ID NO: 327160 - RNA, 19 nt, Bordetella pertussis
cgcccagucccaggccgac

SEQ ID NO: 327161 - RNA, 20 nt, Bordetella pertussis
cgcccagucccaggccgacc

SEQ ID NO: 327162 - RNA, 17 nt, Bordetella pertussis
cgcccagucguccagca

SEQ ID NO: 327163 - RNA, 19 nt, Bordetella pertussis
cgcccaguuccacgcggcc

SEQ ID NO: 327164 - RNA, 20 nt, Bordetella pertussis
cgcccaucucggccgcggcg

SEQ ID NO: 327165 - RNA, 23 nt, Bordetella pertussis
cgcccaucucggccgcggcguug

SEQ ID NO: 327166 - RNA, 22 nt, Bordetella pertussis
cgcccaugaucagggccgugcc

SEQ ID NO: 327167 - RNA, 13 nt, Bordetella pertussis
cgcccaugauggu

SEQ ID NO: 327168 - RNA, 20 nt, Bordetella pertussis
cgcccaugauggugccggug

SEQ ID NO: 327169 - RNA, 16 nt, Bordetella pertussis
cgcccaugccgccggg

SEQ ID NO: 327170 - RNA, 12 nt, Bordetella pertussis
cgcccaugcgau

SEQ ID NO: 327171 - RNA, 16 nt, Bordetella pertussis
cgcccaugcgaucggc

SEQ ID NO: 327172 - RNA, 17 nt, Bordetella pertussis
cgcccaugcgaucggcc

SEQ ID NO: 327173 - RNA, 19 nt, Bordetella pertussis
cgcccaugcgcauggccag

SEQ ID NO: 327174 - RNA, 20 nt, Bordetella pertussis
cgcccaugcgcauggccagc

SEQ ID NO: 327175 - RNA, 17 nt, Bordetella pertussis
cgcccaugcgcuggcgc

SEQ ID NO: 327176 - RNA, 14 nt, Bordetella pertussis
cgcccaugcgggcg

SEQ ID NO: 327177 - RNA, 23 nt, Bordetella pertussis
cgcccaugcugaauugcgggccg

SEQ ID NO: 327178 - RNA, 12 nt, Bordetella pertussis
cgcccauggcgc

SEQ ID NO: 327179 - RNA, 13 nt, Bordetella pertussis
cgcccauggcgcg

SEQ ID NO: 327180 - RNA, 14 nt, Bordetella pertussis
cgcccauggcgcgc

SEQ ID NO: 327181 - RNA, 16 nt, Bordetella pertussis
cgcccauggcgcgcag

SEQ ID NO: 327182 - RNA, 20 nt, Bordetella pertussis
cgcccauguagaacgccagg

SEQ ID NO: 327183 - RNA, 21 nt, Bordetella pertussis
cgcccauguagaacgccaggg

SEQ ID NO: 327184 - RNA, 19 nt, Bordetella pertussis
cgcccauuccgagcgggcc

SEQ ID NO: 327185 - RNA, 21 nt, Bordetella pertussis
cgcccauuuccgcuucggaca

SEQ ID NO: 327186 - RNA, 15 nt, Bordetella pertussis
cgccccaacgcggcc

SEQ ID NO: 327187 - RNA, 19 nt, Bordetella pertussis
cgccccaacgcggccagcg

SEQ ID NO: 327188 - RNA, 20 nt, Bordetella pertussis
cgccccagagcaccgagacc

SEQ ID NO: 327189 - RNA, 16 nt, Bordetella pertussis
cgccccaggcguacga

SEQ ID NO: 327190 - RNA, 20 nt, Bordetella pertussis
cgccccaggcgucggcggcc

SEQ ID NO: 327191 - RNA, 18 nt, Bordetella pertussis
cgccccaucaccauggcc

SEQ ID NO: 327192 - RNA, 20 nt, Bordetella pertussis
cgccccauccacggcgccau

SEQ ID NO: 327193 - RNA, 15 nt, Bordetella pertussis
cgcccccagcgcgcc

SEQ ID NO: 327194 - RNA, 20 nt, Bordetella pertussis
cgcccccagcgcgccugccc

SEQ ID NO: 327195 - RNA, 18 nt, Bordetella pertussis
cgcccccgaaggccgcgc

SEQ ID NO: 327196 - RNA, 19 nt, Bordetella pertussis
cgcccccgaaggccgcgcc

SEQ ID NO: 327197 - RNA, 21 nt, Bordetella pertussis
cgcccccgauccccugcccgc

SEQ ID NO: 327198 - RNA, 14 nt, Bordetella pertussis
cgccccgucaucgg

SEQ ID NO: 327199 - RNA, 21 nt, Bordetella pertussis
cgccccgugccauggaccggc

SEQ ID NO: 327200 - RNA, 17 nt, Bordetella pertussis
cgccccuagcgccgcgc

SEQ ID NO: 327201 - RNA, 18 nt, Bordetella pertussis
cgccccuagcgccgcgcc

SEQ ID NO: 327202 - RNA, 21 nt, Bordetella pertussis
cgccccuagcgccgcgccagg

SEQ ID NO: 327203 - RNA, 17 nt, Bordetella pertussis
cgcccgaaagguccugg

SEQ ID NO: 327204 - RNA, 17 nt, Bordetella pertussis
cgcccgaaccggcaucc

SEQ ID NO: 327205 - RNA, 19 nt, Bordetella pertussis
cgccccuugcggggcgcgu

SEQ ID NO: 327206 - RNA, 18 nt, Bordetella pertussis
cgcccgacagcacgcccg

SEQ ID NO: 327207 - RNA, 21 nt, Bordetella pertussis
cgcccgacagcacgcccgcca

SEQ ID NO: 327208 - RNA, 21 nt, Bordetella pertussis
cgcccgcacgaagcggcaucg

SEQ ID NO: 327209 - RNA, 13 nt, Bordetella pertussis
cgcccgcacgaug

SEQ ID NO: 327210 - RNA, 18 nt, Bordetella pertussis
cgcccgcaggcggcggcc

SEQ ID NO: 327211 - RNA, 22 nt, Bordetella pertussis
cgcccgcaggcggcggccucca

SEQ ID NO: 327212 - RNA, 13 nt, Bordetella pertussis
cgcccgcaugucc

SEQ ID NO: 327213 - RNA, 22 nt, Bordetella pertussis
cgcccgcaugucccagcgcucg

SEQ ID NO: 327214 - RNA, 20 nt, Bordetella pertussis
cgcccgcauagacgccgacc

SEQ ID NO: 327215 - RNA, 20 nt, Bordetella pertussis
cgcccgcaucggcuggcgca

SEQ ID NO: 327216 - RNA, 12 nt, Bordetella pertussis
cgcccgccacca

SEQ ID NO: 327217 - RNA, 19 nt, Bordetella pertussis
cgcccgccaccaggaacgc

SEQ ID NO: 327218 - RNA, 15 nt, Bordetella pertussis
cgcccgccaggccag

SEQ ID NO: 327219 - RNA, 14 nt, Bordetella pertussis
cgcccgcccccuug

SEQ ID NO: 327220 - RNA, 13 nt, Bordetella pertussis
cgcccgccccgca

SEQ ID NO: 327221 - RNA, 16 nt, Bordetella pertussis
cgcccgccccggcgca

SEQ ID NO: 327222 - RNA, 15 nt, Bordetella pertussis
cgcccgccugcgcca

SEQ ID NO: 327223 - RNA, 16 nt, Bordetella pertussis
cgcccgccugcguggc

SEQ ID NO: 327224 - RNA, 17 nt, Bordetella pertussis
cgcccgccuucagcggg

SEQ ID NO: 327225 - RNA, 18 nt, Bordetella pertussis
cgcccgccuucagcgggc

SEQ ID NO: 327226 - RNA, 20 nt, Bordetella pertussis
cgcccgccuucagcgggccg

SEQ ID NO: 327227 - RNA, 22 nt, Bordetella pertussis
cgcccgccuucagcgggccggc

SEQ ID NO: 327228 - RNA, 23 nt, Bordetella pertussis
cgcccgccuucagcgggccggca

SEQ ID NO: 327229 - RNA, 14 nt, Bordetella pertussis
cgcccgcgacgcug

SEQ ID NO: 327230 - RNA, 15 nt, Bordetella pertussis
cgcccgcgacgcugg

SEQ ID NO: 327231 - RNA, 14 nt, Bordetella pertussis
cgcccgcgagcggc

SEQ ID NO: 327232 - RNA, 19 nt, Bordetella pertussis
cgcccgcgagcggccagcc

SEQ ID NO: 327233 - RNA, 20 nt, Bordetella pertussis
cgcccgcgccaucgcgucga

SEQ ID NO: 327234 - RNA, 12 nt, Bordetella pertussis
cgcccgcgcgcg

SEQ ID NO: 327235 - RNA, 14 nt, Bordetella pertussis
cgcccgcuccacca

SEQ ID NO: 327236 - RNA, 16 nt, Bordetella pertussis
cgcccgcuccaccagc

SEQ ID NO: 327237 - RNA, 18 nt, Bordetella pertussis
cgcccgcuccaccagcac

SEQ ID NO: 327238 - RNA, 20 nt, Bordetella pertussis
cgcccgcuccaccagcaccg

SEQ ID NO: 327239 - RNA, 14 nt, Bordetella pertussis
cgcccgcugaccgg

SEQ ID NO: 327240 - RNA, 15 nt, Bordetella pertussis
cgcccgcugaccggc

SEQ ID NO: 327241 - RNA, 18 nt, Bordetella pertussis
cgcccgcugaccggccug

SEQ ID NO: 327242 - RNA, 20 nt, Bordetella pertussis
cgcccgcugaccggccuggu

SEQ ID NO: 327243 - RNA, 14 nt, Bordetella pertussis
cgcccgcuuccuug

SEQ ID NO: 327244 - RNA, 19 nt, Bordetella pertussis
cgcccgcuucuuccuugcg

SEQ ID NO: 327245 - RNA, 20 nt, Bordetella pertussis
cgcccggcaggucgaugccc

SEQ ID NO: 327246 - RNA, 19 nt, Bordetella pertussis
cgcccggcaugggcgugcc

SEQ ID NO: 327247 - RNA, 13 nt, Bordetella pertussis
cgcccggcccagg

SEQ ID NO: 327248 - RNA, 17 nt, Bordetella pertussis
cgcccggcccaggccgg

SEQ ID NO: 327249 - RNA, 14 nt, Bordetella pertussis
cgcccggccggcac

SEQ ID NO: 327250 - RNA, 17 nt, Bordetella pertussis
cgcccggccggcacggc

SEQ ID NO: 327251 - RNA, 19 nt, Bordetella pertussis
cgcccggccggcacggccg

SEQ ID NO: 327252 - RNA, 22 nt, Bordetella pertussis
cgcccggccggcacggccggcc

SEQ ID NO: 327253 - RNA, 13 nt, Bordetella pertussis
cgcccggccggcc

SEQ ID NO: 327254 - RNA, 22 nt, Bordetella pertussis
cgcccggccggcccgcgcgccu

SEQ ID NO: 327255 - RNA, 13 nt, Bordetella pertussis
cgcccggccgccu

SEQ ID NO: 327256 - RNA, 19 nt, Bordetella pertussis
cgcccggccugcgggcgcc

SEQ ID NO: 327257 - RNA, 21 nt, Bordetella pertussis
cgcccggcgaaagcgucggcu

SEQ ID NO: 327258 - RNA, 19 nt, Bordetella pertussis
cgcccggcggccaggccgg

SEQ ID NO: 327259 - RNA, 16 nt, Bordetella pertussis
cgcccggcggcgcgcc

SEQ ID NO: 327260 - RNA, 15 nt, Bordetella pertussis
cgcccggcggcgcgg

SEQ ID NO: 327261 - RNA, 16 nt, Bordetella pertussis
cgcccggcggcgcggc

SEQ ID NO: 327262 - RNA, 17 nt, Bordetella pertussis
cgcccggcggcgcggcg

SEQ ID NO: 327263 - RNA, 17 nt, Bordetella pertussis
cgcccggcgugacgcug

SEQ ID NO: 327264 - RNA, 22 nt, Bordetella pertussis
cgcccggcuccaggccgcccag

SEQ ID NO: 327265 - RNA, 17 nt, Bordetella pertussis
cgcccggguuggcgucc

SEQ ID NO: 327266 - RNA, 20 nt, Bordetella pertussis
cgcccggguuggcguccagg

SEQ ID NO: 327267 - RNA, 14 nt, Bordetella pertussis
cgcccggugcgcgc

SEQ ID NO: 327268 - RNA, 17 nt, Bordetella pertussis
cgcccggugcgcgcagg

SEQ ID NO: 327269 - RNA, 22 nt, Bordetella pertussis
cgcccggugcgcgcagggcggc

SEQ ID NO: 327270 - RNA, 22 nt, Bordetella pertussis
cgcccggugcguaccagcccag

SEQ ID NO: 327271 - RNA, 14 nt, Bordetella pertussis
cgcccugcccggcg

SEQ ID NO: 327272 - RNA, 20 nt, Bordetella pertussis
cgcccugcccggcgagcaug

SEQ ID NO: 327273 - RNA, 22 nt, Bordetella pertussis
cgcccugccgccaagggcgcgc

SEQ ID NO: 327274 - RNA, 18 nt, Bordetella pertussis
cgcccugcgaacccgccg

SEQ ID NO: 327275 - RNA, 18 nt, Bordetella pertussis
cgcccgguucgccgucgu

SEQ ID NO: 327276 - RNA, 22 nt, Bordetella pertussis
cgcccugcgcguacguggcgcg

SEQ ID NO: 327277 - RNA, 13 nt, Bordetella pertussis
cgcccugcugccc

SEQ ID NO: 327278 - RNA, 16 nt, Bordetella pertussis
cgcccugcugcccgcc

SEQ ID NO: 327279 - RNA, 17 nt, Bordetella pertussis
cgcccugcugcccgccg

SEQ ID NO: 327280 - RNA, 15 nt, Bordetella pertussis
cgcccugcuggcgca

SEQ ID NO: 327281 - RNA, 15 nt, Bordetella pertussis
cgcccugcucgcgca

SEQ ID NO: 327282 - RNA, 19 nt, Bordetella pertussis
cgcccuggauggcggccgc

SEQ ID NO: 327283 - RNA, 18 nt, Bordetella pertussis
cgcccuggcagcuggcgc

SEQ ID NO: 327284 - RNA, 20 nt, Bordetella pertussis
cgcccuggcagcuggcgcgg

SEQ ID NO: 327285 - RNA, 14 nt, Bordetella pertussis
cgcccuucaggcca

SEQ ID NO: 327286 - RNA, 13 nt, Bordetella pertussis
cgcccuucaggua

SEQ ID NO: 327287 - RNA, 16 nt, Bordetella pertussis
cgcccuugaugccguc

SEQ ID NO: 327288 - RNA, 19 nt, Bordetella pertussis
cgcccuugauggccucggc

SEQ ID NO: 327289 - RNA, 22 nt, Bordetella pertussis
cgcccuugauggccucggcggc

SEQ ID NO: 327290 - RNA, 23 nt, Bordetella pertussis
cgcccuugauggccucggcggcc

SEQ ID NO: 327291 - RNA, 17 nt, Bordetella pertussis
cgcccuugcgccaguug

SEQ ID NO: 327292 - RNA, 16 nt, Bordetella pertussis
cgcccuugcggcgagg

SEQ ID NO: 327293 - RNA, 18 nt, Bordetella pertussis
cgcccuugggcucgucga

SEQ ID NO: 327294 - RNA, 20 nt, Bordetella pertussis
cgcccuugggcucgucgacg

SEQ ID NO: 327295 - RNA, 22 nt, Bordetella pertussis
cgcccuugggcucgucgacgcg

SEQ ID NO: 327296 - RNA, 24 nt, Bordetella pertussis
cgcccuugggcucgucgacgcggc

SEQ ID NO: 327297 - RNA, 15 nt, Bordetella pertussis
cgccgaaauuggcga

SEQ ID NO: 327298 - RNA, 22 nt, Bordetella pertussis
cgccgaacaccagcucggcggc

SEQ ID NO: 327299 - RNA, 21 nt, Bordetella pertussis
cgccgaagcaaugcagcgcga

SEQ ID NO: 327300 - RNA, 18 nt, Bordetella pertussis
cgccgaagccgccgccgu

SEQ ID NO: 327301 - RNA, 13 nt, Bordetella pertussis
cgccgaaggcggc

SEQ ID NO: 327302 - RNA, 20 nt, Bordetella pertussis
cgccgacccugcccggcagg

SEQ ID NO: 327303 - RNA, 17 nt, Bordetella pertussis
cgccgaccgcacgaugg

SEQ ID NO: 327304 - RNA, 15 nt, Bordetella pertussis
cgccgaccggcccca

SEQ ID NO: 327305 - RNA, 19 nt, Bordetella pertussis
cgccgacgaugccgcccac

SEQ ID NO: 327306 - RNA, 17 nt, Bordetella pertussis
cgccgacgaugucgccg

SEQ ID NO: 327307 - RNA, 20 nt, Bordetella pertussis
cgccgacgaugucgccgccg

SEQ ID NO: 327308 - RNA, 23 nt, Bordetella pertussis
cgccgacgaugucgccgccgcgc

SEQ ID NO: 327309 - RNA, 14 nt, Bordetella pertussis
cgccgaccgggccg

SEQ ID NO: 327310 - RNA, 21 nt, Bordetella pertussis
cgccgaccgggccgaccaggc

SEQ ID NO: 327311 - RNA, 14 nt, Bordetella pertussis
cgccgacgaugacc

SEQ ID NO: 327312 - RNA, 14 nt, Bordetella pertussis
cgccgacgccgcca

SEQ ID NO: 327313 - RNA, 16 nt, Bordetella pertussis
cgccgacgccgccacg

SEQ ID NO: 327314 - RNA, 19 nt, Bordetella pertussis
cgccgacgccgccacgcug

SEQ ID NO: 327315 - RNA, 14 nt, Bordetella pertussis
cgccgacgcgcugg

SEQ ID NO: 327316 - RNA, 20 nt, Bordetella pertussis
cgccgacggcauggcggcca

SEQ ID NO: 327317 - RNA, 22 nt, Bordetella pertussis
cgccgacggcauggcggccagc

SEQ ID NO: 327318 - RNA, 19 nt, Bordetella pertussis
cgccgacugggcuugccgg

SEQ ID NO: 327319 - RNA, 21 nt, Bordetella pertussis
cgccgacugggcuugccggug

SEQ ID NO: 327320 - RNA, 22 nt, Bordetella pertussis
cgccgacuuccugggugcgcca

SEQ ID NO: 327321 - RNA, 21 nt, Bordetella pertussis
cgccgagaaauccagcgcgcc

SEQ ID NO: 327322 - RNA, 19 nt, Bordetella pertussis
cgccgagcagaucgccaac

SEQ ID NO: 327323 - RNA, 12 nt, Bordetella pertussis
cgccgagcaggg

SEQ ID NO: 327324 - RNA, 21 nt, Bordetella pertussis
cgccgagcagggggucgauca

SEQ ID NO: 327325 - RNA, 14 nt, Bordetella pertussis
cgccgagccgcugu

SEQ ID NO: 327326 - RNA, 22 nt, Bordetella pertussis
cgccgaggaucuggccggcgcu

SEQ ID NO: 327327 - RNA, 18 nt, Bordetella pertussis
cgccgaggcgggcagcau

SEQ ID NO: 327328 - RNA, 16 nt, Bordetella pertussis
cgccgaggccugcugu

SEQ ID NO: 327329 - RNA, 21 nt, Bordetella pertussis
cgccgaucaccacgggcacga

SEQ ID NO: 327330 - RNA, 18 nt, Bordetella pertussis
cgccgaucagcaggucgg

SEQ ID NO: 327331 - RNA, 20 nt, Bordetella pertussis
cgccgauccacucggccagc

SEQ ID NO: 327332 - RNA, 21 nt, Bordetella pertussis
cgccgauccacucggccagcg

SEQ ID NO: 327333 - RNA, 14 nt, Bordetella pertussis
cgccgauccagccc

SEQ ID NO: 327334 - RNA, 15 nt, Bordetella pertussis
cgccgauccagccca

SEQ ID NO: 327335 - RNA, 15 nt, Bordetella pertussis
cgccgauccggcgca

SEQ ID NO: 327336 - RNA, 15 nt, Bordetella pertussis
cgccgaugaccagca

SEQ ID NO: 327337 - RNA, 19 nt, Bordetella pertussis
cgccgaugaccagcagcgc

SEQ ID NO: 327338 - RNA, 20 nt, Bordetella pertussis
cgccgaugaccagcagcgcc

SEQ ID NO: 327339 - RNA, 21 nt, Bordetella pertussis
cgccgaugaccagcagcgccg

SEQ ID NO: 327340 - RNA, 15 nt, Bordetella pertussis
cgccgaugaccaggg

SEQ ID NO: 327341 - RNA, 19 nt, Bordetella pertussis
cgccgaugaccagggcgcc

SEQ ID NO: 327342 - RNA, 19 nt, Bordetella pertussis
cgccgauccagggccgcag

SEQ ID NO: 327343 - RNA, 14 nt, Bordetella pertussis
cgccgaugcacagg

SEQ ID NO: 327344 - RNA, 17 nt, Bordetella pertussis
cgccgaugccgccauca

SEQ ID NO: 327345 - RNA, 18 nt, Bordetella pertussis
cgccgaugccgcgcaccu

SEQ ID NO: 327346 - RNA, 20 nt, Bordetella pertussis
cgccgaugccgcgcaccugg

SEQ ID NO: 327347 - RNA, 14 nt, Bordetella pertussis
cgccgaugccgcgc

SEQ ID NO: 327348 - RNA, 15 nt, Bordetella pertussis
cgccgaugcgccagg

SEQ ID NO: 327349 - RNA, 20 nt, Bordetella pertussis
cgccgaugcgcucgguccag

SEQ ID NO: 327350 - RNA, 22 nt, Bordetella pertussis
cgccgaugcggguacuggccga

SEQ ID NO: 327351 - RNA, 13 nt, Bordetella pertussis
cgccgauggcgcc

SEQ ID NO: 327352 - RNA, 15 nt, Bordetella pertussis
cgccgauggcgccac

SEQ ID NO: 327353 - RNA, 18 nt, Bordetella pertussis
cgccgauggcgccgcugu

SEQ ID NO: 327354 - RNA, 19 nt, Bordetella pertussis
cgccgauggcgcggccgcc

SEQ ID NO: 327355 - RNA, 16 nt, Bordetella pertussis
cgccgauggugcgggc

SEQ ID NO: 327356 - RNA, 17 nt, Bordetella pertussis
cgccgauguaugacuug

SEQ ID NO: 327357 - RNA, 22 nt, Bordetella pertussis
cgccgauguaugacuugaccgc

SEQ ID NO: 327358 - RNA, 23 nt, Bordetella pertussis
cgccgauguccacgaaggcgccg

SEQ ID NO: 327359 - RNA, 14 nt, Bordetella pertussis
cgccgaugugcggc

SEQ ID NO: 327360 - RNA, 17 nt, Bordetella pertussis
cgccgaugugcggcgug

SEQ ID NO: 327361 - RNA, 23 nt, Bordetella pertussis
cgccgauugaggccagcacgccg

SEQ ID NO: 327362 - RNA, 19 nt, Bordetella pertussis
cgccgauguugaacagcug

SEQ ID NO: 327363 - RNA, 20 nt, Bordetella pertussis
cgccgauguugaacagcugg

SEQ ID NO: 327364 - RNA, 17 nt, Bordetella pertussis
cgccgauuucgccgccg

SEQ ID NO: 327365 - RNA, 20 nt, Bordetella pertussis
cgccgauuucgccgccgcca

SEQ ID NO: 327366 - RNA, 18 nt, Bordetella pertussis
cgccgcaacaggcagcug

SEQ ID NO: 327367 - RNA, 22 nt, Bordetella pertussis
cgccgcaacaggcagcugcgcg

SEQ ID NO: 327368 - RNA, 15 nt, Bordetella pertussis
cgccgcaacgccggg

SEQ ID NO: 327369 - RNA, 17 nt, Bordetella pertussis
cgccgcaacgccgggcc

SEQ ID NO: 327370 - RNA, 20 nt, Bordetella pertussis
cgccgcaauagaucauccag

SEQ ID NO: 327371 - RNA, 11 nt, Bordetella pertussis
cgccgcaccag

SEQ ID NO: 327372 - RNA, 17 nt, Bordetella pertussis
cgccgcaccagccugau

SEQ ID NO: 327373 - RNA, 13 nt, Bordetella pertussis
cgccgcaccagcg

SEQ ID NO: 327374 - RNA, 20 nt, Bordetella pertussis
cgccgcaccagcgccgacgg

SEQ ID NO: 327375 - RNA, 16 nt, Bordetella pertussis
cgccgcaccagcggcg

SEQ ID NO: 327376 - RNA, 13 nt, Bordetella pertussis
cgccgcaccaggc

SEQ ID NO: 327377 - RNA, 15 nt, Bordetella pertussis
cgccgcaccaggccg

SEQ ID NO: 327378 - RNA, 16 nt, Bordetella pertussis
cgccgcaccaggccgc

SEQ ID NO: 327379 - RNA, 20 nt, Bordetella pertussis
cgccgcaccaggccgcggcg

SEQ ID NO: 327380 - RNA, 15 nt, Bordetella pertussis
cgccgcacagcgugg

SEQ ID NO: 327381 - RNA, 17 nt, Bordetella pertussis
cgccgcacccgaugacg

SEQ ID NO: 327382 - RNA, 12 nt, Bordetella pertussis
cgccgcacgccg

SEQ ID NO: 327383 - RNA, 19 nt, Bordetella pertussis
cgccgcacgccggucgcca

SEQ ID NO: 327384 - RNA, 13 nt, Bordetella pertussis
cgccgcacgccgg

SEQ ID NO: 327385 - RNA, 15 nt, Bordetella pertussis
cgccgcacgggcgcc

SEQ ID NO: 327386 - RNA, 17 nt, Bordetella pertussis
cgccgcacgucggucga

SEQ ID NO: 327387 - RNA, 18 nt, Bordetella pertussis
cgccgcagcaccucggcg

SEQ ID NO: 327388 - RNA, 20 nt, Bordetella pertussis
cgccgcagcaccucggcgug

SEQ ID NO: 327389 - RNA, 21 nt, Bordetella pertussis
cgccgcagcaccucggcgugg

SEQ ID NO: 327390 - RNA, 17 nt, Bordetella pertussis
cgccgccagcagcgccg

SEQ ID NO: 327391 - RNA, 14 nt, Bordetella pertussis
cgccgccagccgcu

SEQ ID NO: 327392 - RNA, 15 nt, Bordetella pertussis
cgccgccagccgcug

SEQ ID NO: 327393 - RNA, 17 nt, Bordetella pertussis
cgccgccagccgcuggc

SEQ ID NO: 327394 - RNA, 15 nt, Bordetella pertussis
cgccgccagccugcu

SEQ ID NO: 327395 - RNA, 14 nt, Bordetella pertussis
cgccgccagcgcgc

SEQ ID NO: 327396 - RNA, 15 nt, Bordetella pertussis
cgccgccagcgcgcg

SEQ ID NO: 327397 - RNA, 12 nt, Bordetella pertussis
cgccgccagcuu

SEQ ID NO: 327398 - RNA, 13 nt, Bordetella pertussis
cgccgccaggccg

SEQ ID NO: 327399 - RNA, 17 nt, Bordetella pertussis
cgccgccaggccgucga

SEQ ID NO: 327400 - RNA, 18 nt, Bordetella pertussis
cgccgcccacgccgccug

SEQ ID NO: 327401 - RNA, 23 nt, Bordetella pertussis
cgccgcccacgccgcugucgacc

SEQ ID NO: 327402 - RNA, 14 nt, Bordetella pertussis
cgccgcccacggcg

SEQ ID NO: 327403 - RNA, 17 nt, Bordetella pertussis
cgccgcccagccggccg

SEQ ID NO: 327404 - RNA, 20 nt, Bordetella pertussis
cgccgcccagccggccgaug

SEQ ID NO: 327405 - RNA, 12 nt, Bordetella pertussis
cgccgcccagcg

SEQ ID NO: 327406 - RNA, 17 nt, Bordetella pertussis
cgccgcccagcgcgugg

SEQ ID NO: 327407 - RNA, 18 nt, Bordetella pertussis
cgccgccccaguugcgcg

SEQ ID NO: 327408 - RNA, 16 nt, Bordetella pertussis
cgccgcccaugcgcau

SEQ ID NO: 327409 - RNA, 18 nt, Bordetella pertussis
cgccgcccccgcccagca

SEQ ID NO: 327410 - RNA, 19 nt, Bordetella pertussis
cgccgcccccgcccagcau

SEQ ID NO: 327411 - RNA, 20 nt, Bordetella pertussis
cgccgcccccgcccagcauc

SEQ ID NO: 327412 - RNA, 17 nt, Bordetella pertussis
cgccgcccuggccgcgc

SEQ ID NO: 327413 - RNA, 12 nt, Bordetella pertussis
cgccgccgaacg

SEQ ID NO: 327414 - RNA, 14 nt, Bordetella pertussis
cgccgccgacggca

SEQ ID NO: 327415 - RNA, 19 nt, Bordetella pertussis
cgccgccgacggcauggcg

SEQ ID NO: 327416 - RNA, 14 nt, Bordetella pertussis
cgccgccgauggcg

SEQ ID NO: 327417 - RNA, 15 nt, Bordetella pertussis
cgccgccgauggcgc

SEQ ID NO: 327418 - RNA, 16 nt, Bordetella pertussis
cgccgccgauggcgcg

SEQ ID NO: 327419 - RNA, 17 nt, Bordetella pertussis
cgccgccgauggcgcgc

SEQ ID NO: 327420 - RNA, 23 nt, Bordetella pertussis
cgccgccgauggcgcgcggcugg

SEQ ID NO: 327421 - RNA, 15 nt, Bordetella pertussis
cgccgccgcagccgc

SEQ ID NO: 327422 - RNA, 16 nt, Bordetella pertussis
cgccgccgcagccgcc

SEQ ID NO: 327423 - RNA, 14 nt, Bordetella pertussis
cgccgccgccacca

SEQ ID NO: 327424 - RNA, 14 nt, Bordetella pertussis
cgccgccgccagcc

SEQ ID NO: 327425 - RNA, 14 nt, Bordetella pertussis
cgccgccgccaugg

SEQ ID NO: 327426 - RNA, 15 nt, Bordetella pertussis
cgccgccgcccgcac

SEQ ID NO: 327427 - RNA, 14 nt, Bordetella pertussis
cgccgccgcccgcc

SEQ ID NO: 327428 - RNA, 16 nt, Bordetella pertussis
cgccgccgcccgcccg

SEQ ID NO: 327429 - RNA, 13 nt, Bordetella pertussis
cgccgccgcccgg

SEQ ID NO: 327430 - RNA, 14 nt, Bordetella pertussis
cgccgccgcccggc

SEQ ID NO: 327431 - RNA, 15 nt, Bordetella pertussis
cgccgccgccgcggc

SEQ ID NO: 327432 - RNA, 14 nt, Bordetella pertussis
cgccgccgccggca

SEQ ID NO: 327433 - RNA, 14 nt, Bordetella pertussis
cgccgccgcgcccu

SEQ ID NO: 327434 - RNA, 14 nt, Bordetella pertussis
cgccgccgcgccga

SEQ ID NO: 327435 - RNA, 15 nt, Bordetella pertussis
cgccgccgcgccgcu

SEQ ID NO: 327436 - RNA, 14 nt, Bordetella pertussis
cgccgccgcgcucg

SEQ ID NO: 327437 - RNA, 12 nt, Bordetella pertussis
cgccgccggcaa

SEQ ID NO: 327438 - RNA, 13 nt, Bordetella pertussis
cgccgccggcaag

SEQ ID NO: 327439 - RNA, 13 nt, Bordetella pertussis
cgccgccggcagg

SEQ ID NO: 327440 - RNA, 17 nt, Bordetella pertussis
cgccgccggcagggcca

SEQ ID NO: 327441 - RNA, 21 nt, Bordetella pertussis
cgccgccggcagggccagcgc

SEQ ID NO: 327442 - RNA, 13 nt, Bordetella pertussis
cgccgccggccag

SEQ ID NO: 327443 - RNA, 14 nt, Bordetella pertussis
cgccgccggccagc

SEQ ID NO: 327444 - RNA, 15 nt, Bordetella pertussis
cgccgccggccagcc

SEQ ID NO: 327445 - RNA, 12 nt, Bordetella pertussis
cgccgccggccc

SEQ ID NO: 327446 - RNA, 14 nt, Bordetella pertussis
cgccgccggcccag

SEQ ID NO: 327447 - RNA, 23 nt, Bordetella pertussis
cgccgccggcccaggauggcgcc

SEQ ID NO: 327448 - RNA, 15 nt, Bordetella pertussis
cgccgccggcccgcc

SEQ ID NO: 327449 - RNA, 15 nt, Bordetella pertussis
cgccgccggccugcu

SEQ ID NO: 327450 - RNA, 16 nt, Bordetella pertussis
cgccgccggccugcug

SEQ ID NO: 327451 - RNA, 17 nt, Bordetella pertussis
cgccgccggugcaccag

SEQ ID NO: 327452 - RNA, 17 nt, Bordetella pertussis
cgccgccguagccgcug

SEQ ID NO: 327453 - RNA, 14 nt, Bordetella pertussis
cgccgccgucaacg

SEQ ID NO: 327454 - RNA, 20 nt, Bordetella pertussis
cgccgccgucaacgcccagg

SEQ ID NO: 327455 - RNA, 16 nt, Bordetella pertussis
cgccgccgugacgcug

SEQ ID NO: 327456 - RNA, 17 nt, Bordetella pertussis
cgccgccgugacgcuga

SEQ ID NO: 327457 - RNA, 20 nt, Bordetella pertussis
cgccgccgugacgcugaugg

SEQ ID NO: 327458 - RNA, 20 nt, Bordetella pertussis
cgccgccgugcgcgggcgcg

SEQ ID NO: 327459 - RNA, 18 nt, Bordetella pertussis
cgccgccguuuucgcccg

SEQ ID NO: 327460 - RNA, 15 nt, Bordetella pertussis
cgccgccucaggccg

SEQ ID NO: 327461 - RNA, 17 nt, Bordetella pertussis
cgccgccucaggccggc

SEQ ID NO: 327462 - RNA, 19 nt, Bordetella pertussis
cgccgccucaggccggcgc

SEQ ID NO: 327463 - RNA, 14 nt, Bordetella pertussis
cgccgcgugcgccg

SEQ ID NO: 327464 - RNA, 17 nt, Bordetella pertussis
cgccgcguggcggcgca

SEQ ID NO: 327465 - RNA, 19 nt, Bordetella pertussis
cgccgcguggcggcgcagc

SEQ ID NO: 327466 - RNA, 14 nt, Bordetella pertussis
cgccgcgugguggc

SEQ ID NO: 327467 - RNA, 16 nt, Bordetella pertussis
cgccgcgugguggcgc

SEQ ID NO: 327468 - RNA, 16 nt, Bordetella pertussis
cgccgcuacagcguca

SEQ ID NO: 327469 - RNA, 14 nt, Bordetella pertussis
cgccgcuacgcggc

SEQ ID NO: 327470 - RNA, 15 nt, Bordetella pertussis
cgccgcuacgcggcg

SEQ ID NO: 327471 - RNA, 16 nt, Bordetella pertussis
cgccgcugauggcggu

SEQ ID NO: 327472 - RNA, 13 nt, Bordetella pertussis
cgccgcugcagcg

SEQ ID NO: 327473 - RNA, 14 nt, Bordetella pertussis
cgccgcugcagcgc

SEQ ID NO: 327474 - RNA, 13 nt, Bordetella pertussis
cgccgcugccggc

SEQ ID NO: 327475 - RNA, 15 nt, Bordetella pertussis
cgccgcugccggccg

SEQ ID NO: 327476 - RNA, 15 nt, Bordetella pertussis
cgccgcugccgggcu

SEQ ID NO: 327477 - RNA, 16 nt, Bordetella pertussis
cgccgcuuccaccguc

SEQ ID NO: 327478 - RNA, 17 nt, Bordetella pertussis
cgccgcuuccaccgucu

SEQ ID NO: 327479 - RNA, 16 nt, Bordetella pertussis
cgccgcuuccggccgg

SEQ ID NO: 327480 - RNA, 17 nt, Bordetella pertussis
cgccgcuuucgaccuug

SEQ ID NO: 327481 - RNA, 23 nt, Bordetella pertussis
cgccgcuuucgaccuugcugacg

SEQ ID NO: 327482 - RNA, 21 nt, Bordetella pertussis
cgccggaaagcuguccacgcc

SEQ ID NO: 327483 - RNA, 22 nt, Bordetella pertussis
cgccggaaagcuguccacgccg

SEQ ID NO: 327484 - RNA, 19 nt, Bordetella pertussis
cgccggacuugaaucccga

SEQ ID NO: 327485 - RNA, 17 nt, Bordetella pertussis
cgccggaggcgcgcagc

SEQ ID NO: 327486 - RNA, 15 nt, Bordetella pertussis
cgccggaucggccgg

SEQ ID NO: 327487 - RNA, 17 nt, Bordetella pertussis
cgccggaucggccggca

SEQ ID NO: 327488 - RNA, 14 nt, Bordetella pertussis
cgccggaugcgcgu

SEQ ID NO: 327489 - RNA, 20 nt, Bordetella pertussis
cgccggaugcgcguggcgcg

SEQ ID NO: 327490 - RNA, 15 nt, Bordetella pertussis
cgccggcauggucga

SEQ ID NO: 327491 - RNA, 18 nt, Bordetella pertussis
cgccggcauggucgauga

SEQ ID NO: 327492 - RNA, 19 nt, Bordetella pertussis
cgccggcauguugccgcug

SEQ ID NO: 327493 - RNA, 19 nt, Bordetella pertussis
cgccggccaccagcggcgc

SEQ ID NO: 327494 - RNA, 22 nt, Bordetella pertussis
cgccggccaccagcggcgccgg

SEQ ID NO: 327495 - RNA, 13 nt, Bordetella pertussis
cgccggccaccgc

SEQ ID NO: 327496 - RNA, 12 nt, Bordetella pertussis
cgccggccacga

SEQ ID NO: 327497 - RNA, 15 nt, Bordetella pertussis
cgccggccacgaacg

SEQ ID NO: 327498 - RNA, 16 nt, Bordetella pertussis
cgccggccacgaacgg

SEQ ID NO: 327499 - RNA, 12 nt, Bordetella pertussis
cgccggccagcc

SEQ ID NO: 327500 - RNA, 23 nt, Bordetella pertussis
cgccggccagccugugcgccaug

SEQ ID NO: 327501 - RNA, 14 nt, Bordetella pertussis
cgccggccagcgcg

SEQ ID NO: 327502 - RNA, 15 nt, Bordetella pertussis
cgccggccagcgcgc

SEQ ID NO: 327503 - RNA, 20 nt, Bordetella pertussis
cgccggccagcgcgccggcc

SEQ ID NO: 327504 - RNA, 18 nt, Bordetella pertussis
cgccggccagcgcggcau

SEQ ID NO: 327505 - RNA, 22 nt, Bordetella pertussis
cgccggccagcgcggcaucggc

SEQ ID NO: 327506 - RNA, 14 nt, Bordetella pertussis
cgccggccagcggc

SEQ ID NO: 327507 - RNA, 15 nt, Bordetella pertussis
cgccggccagcggca

SEQ ID NO: 327508 - RNA, 17 nt, Bordetella pertussis
cgccggccagcggcagg

SEQ ID NO: 327509 - RNA, 13 nt, Bordetella pertussis
cgccggccagcug

SEQ ID NO: 327510 - RNA, 21 nt, Bordetella pertussis
cgccggccagcugcaugcgca

SEQ ID NO: 327511 - RNA, 22 nt, Bordetella pertussis
cgccggccagcugcaugcgcac

SEQ ID NO: 327512 - RNA, 13 nt, Bordetella pertussis
cgccggccagcuu

SEQ ID NO: 327513 - RNA, 11 nt, Bordetella pertussis
cgccggccagg

SEQ ID NO: 327514 - RNA, 12 nt, Bordetella pertussis
cgccggccaggc

SEQ ID NO: 327515 - RNA, 16 nt, Bordetella pertussis
cgccggccagggccac

SEQ ID NO: 327516 - RNA, 18 nt, Bordetella pertussis
cgccggccagggccacca

SEQ ID NO: 327517 - RNA, 13 nt, Bordetella pertussis
cgccggccaucac

SEQ ID NO: 327518 - RNA, 14 nt, Bordetella pertussis
cgccggccaucacg

SEQ ID NO: 327519 - RNA, 21 nt, Bordetella pertussis
cgccggccaucacgccgaucu

SEQ ID NO: 327520 - RNA, 18 nt, Bordetella pertussis
cgccggccauggcggccg

SEQ ID NO: 327521 - RNA, 19 nt, Bordetella pertussis
cgccggccauggcggccgg

SEQ ID NO: 327522 - RNA, 19 nt, Bordetella pertussis
cgccggcccaaggccccgc

SEQ ID NO: 327523 - RNA, 22 nt, Bordetella pertussis
cgccggcccaaggccccgcgac

SEQ ID NO: 327524 - RNA, 17 nt, Bordetella pertussis
cgccggccaguggcgcg

SEQ ID NO: 327525 - RNA, 21 nt, Bordetella pertussis
cgccggcccaggauggcgcca

SEQ ID NO: 327526 - RNA, 23 nt, Bordetella pertussis
cgccggcccaggauggcgccagc

SEQ ID NO: 327527 - RNA, 14 nt, Bordetella pertussis
cgccggcccaggcg

SEQ ID NO: 327528 - RNA, 13 nt, Bordetella pertussis
cgccggcccgcca

SEQ ID NO: 327529 - RNA, 23 nt, Bordetella pertussis
cgccggcccgccacgcgggccgg

SEQ ID NO: 327530 - RNA, 16 nt, Bordetella pertussis
cgccggccgacggcgc

SEQ ID NO: 327531 - RNA, 20 nt, Bordetella pertussis
cgccggccgacggcgcuggc

SEQ ID NO: 327532 - RNA, 22 nt, Bordetella pertussis
cgccggccgacggcgcuggcga

SEQ ID NO: 327533 - RNA, 11 nt, Bordetella pertussis
cgccggccgcc

SEQ ID NO: 327534 - RNA, 14 nt, Bordetella pertussis
cgccggccgccagc

SEQ ID NO: 327535 - RNA, 19 nt, Bordetella pertussis
cgccggccgccauggccgg

SEQ ID NO: 327536 - RNA, 22 nt, Bordetella pertussis
cgccggccgccauggccggcgu

SEQ ID NO: 327537 - RNA, 14 nt, Bordetella pertussis
cgccggccgcccgc

SEQ ID NO: 327538 - RNA, 15 nt, Bordetella pertussis
cgccggccgccagca

SEQ ID NO: 327539 - RNA, 17 nt, Bordetella pertussis
cgccggccgccuggccc

SEQ ID NO: 327540 - RNA, 20 nt, Bordetella pertussis
cgccggccgcgcccagcgug

SEQ ID NO: 327541 - RNA, 13 nt, Bordetella pertussis
cgccggccgcgcg

SEQ ID NO: 327542 - RNA, 21 nt, Bordetella pertussis
cgccggccggggucuugccgc

SEQ ID NO: 327543 - RNA, 23 nt, Bordetella pertussis
cgccggccggggucuugccgcgc

SEQ ID NO: 327544 - RNA, 12 nt, Bordetella pertussis
cgccggccggug

SEQ ID NO: 327545 - RNA, 14 nt, Bordetella pertussis
cgccggccggugca

SEQ ID NO: 327546 - RNA, 15 nt, Bordetella pertussis
cgccggccuccagca

SEQ ID NO: 327547 - RNA, 17 nt, Bordetella pertussis
cgccggccuccagcauc

SEQ ID NO: 327548 - RNA, 19 nt, Bordetella pertussis
cgccggccuccagcaucgc

SEQ ID NO: 327549 - RNA, 12 nt, Bordetella pertussis
cgccggccugac

SEQ ID NO: 327550 - RNA, 14 nt, Bordetella pertussis
cgccggccugcgcc

SEQ ID NO: 327551 - RNA, 15 nt, Bordetella pertussis
cgccggccugcgcca

SEQ ID NO: 327552 - RNA, 16 nt, Bordetella pertussis
cgccggccugcgccgg

SEQ ID NO: 327553 - RNA, 22 nt, Bordetella pertussis
cgccggccugcucgccggccag

SEQ ID NO: 327554 - RNA, 18 nt, Bordetella pertussis
cgccggccugcugcagca

SEQ ID NO: 327555 - RNA, 16 nt, Bordetella pertussis
cgccggccuggcgcga

SEQ ID NO: 327556 - RNA, 16 nt, Bordetella pertussis
cgccggccuggcgcgc

SEQ ID NO: 327557 - RNA, 17 nt, Bordetella pertussis
cgccggccuggcgcgcg

SEQ ID NO: 327558 - RNA, 14 nt, Bordetella pertussis
cgccggccugggcg

SEQ ID NO: 327559 - RNA, 15 nt, Bordetella pertussis
cgccggccugggcgg

SEQ ID NO: 327560 - RNA, 15 nt, Bordetella pertussis
cgccggcgacgccgc

SEQ ID NO: 327561 - RNA, 14 nt, Bordetella pertussis
cgccggcgacgugg

SEQ ID NO: 327562 - RNA, 20 nt, Bordetella pertussis
cgccggcgauauggccaggg

SEQ ID NO: 327563 - RNA, 14 nt, Bordetella pertussis
cgccggcgaugacg

SEQ ID NO: 327564 - RNA, 17 nt, Bordetella pertussis
cgccggcgaugaucgcc

SEQ ID NO: 327565 - RNA, 16 nt, Bordetella pertussis
cgccggcgcaacgggc

SEQ ID NO: 327566 - RNA, 18 nt, Bordetella pertussis
cgccggcgcaacgggccg

SEQ ID NO: 327567 - RNA, 13 nt, Bordetella pertussis
cgccggcgcaccc

SEQ ID NO: 327568 - RNA, 17 nt, Bordetella pertussis
cgccggcgcccccagca

SEQ ID NO: 327569 - RNA, 16 nt, Bordetella pertussis
cgccggcgccggcgac

SEQ ID NO: 327570 - RNA, 22 nt, Bordetella pertussis
cgccggcgccuuggccugggcg

SEQ ID NO: 327571 - RNA, 12 nt, Bordetella pertussis
cgccggcgcgcc

SEQ ID NO: 327572 - RNA, 13 nt, Bordetella pertussis
cgccggcgcgccg

SEQ ID NO: 327573 - RNA, 15 nt, Bordetella pertussis
cgccggcgcgccgcc

SEQ ID NO: 327574 - RNA, 18 nt, Bordetella pertussis
cgccggcgcgccgcccgc

SEQ ID NO: 327575 - RNA, 17 nt, Bordetella pertussis
cgccggcgcgccggccg

SEQ ID NO: 327576 - RNA, 22 nt, Bordetella pertussis
cgccggcgcgcgaucucgggca

SEQ ID NO: 327577 - RNA, 21 nt, Bordetella pertussis
cgccggcgcgcgcgcgccgca

SEQ ID NO: 327578 - RNA, 16 nt, Bordetella pertussis
cgccggcgcggcgguc

SEQ ID NO: 327579 - RNA, 19 nt, Bordetella pertussis
cgccggcgcggcugcuggg

SEQ ID NO: 327580 - RNA, 22 nt, Bordetella pertussis
cgccggcgcguccacgccgugg

SEQ ID NO: 327581 - RNA, 22 nt, Bordetella pertussis
cgccggcgcuacagggugccgc

SEQ ID NO: 327582 - RNA, 17 nt, Bordetella pertussis
cgccggcgcugcggucg

SEQ ID NO: 327583 - RNA, 16 nt, Bordetella pertussis
cgccggcgcugcuguc

SEQ ID NO: 327584 - RNA, 14 nt, Bordetella pertussis
cgccggcggcaagg

SEQ ID NO: 327585 - RNA, 20 nt, Bordetella pertussis
cgccggcggcaauaucggca

SEQ ID NO: 327586 - RNA, 20 nt, Bordetella pertussis
cgccggcggcaccgcgcagc

SEQ ID NO: 327587 - RNA, 14 nt, Bordetella pertussis
cgccggcggccucc

SEQ ID NO: 327588 - RNA, 18 nt, Bordetella pertussis
cgccggcggccuccgcgc

SEQ ID NO: 327589 - RNA, 16 nt, Bordetella pertussis
cgccggcggccugcag

SEQ ID NO: 327590 - RNA, 18 nt, Bordetella pertussis
cgccggcggccugcaggc

SEQ ID NO: 327591 - RNA, 14 nt, Bordetella pertussis
cgccggcggccugg

SEQ ID NO: 327592 - RNA, 16 nt, Bordetella pertussis
cgccggcggccuggac

SEQ ID NO: 327593 - RNA, 15 nt, Bordetella pertussis
cgccggcggcgcacc

SEQ ID NO: 327594 - RNA, 16 nt, Bordetella pertussis
cgccggcggcgcacca

SEQ ID NO: 327595 - RNA, 17 nt, Bordetella pertussis
cgccggcggcgcaccaa

SEQ ID NO: 327596 - RNA, 14 nt, Bordetella pertussis
cgccggcggcgccg

SEQ ID NO: 327597 - RNA, 15 nt, Bordetella pertussis
cgccggcggcgcugg

SEQ ID NO: 327598 - RNA, 16 nt, Bordetella pertussis
cgccggcggcgcuggc

SEQ ID NO: 327599 - RNA, 18 nt, Bordetella pertussis
cgccggcggcgcuggcga

SEQ ID NO: 327600 - RNA, 23 nt, Bordetella pertussis
cgccggcggcgucggcgcccggc

SEQ ID NO: 327601 - RNA, 14 nt, Bordetella pertussis
cgccggcggcgugc

SEQ ID NO: 327602 - RNA, 22 nt, Bordetella pertussis
cgccggcggcgugcgccugcug

SEQ ID NO: 327603 - RNA, 16 nt, Bordetella pertussis
cgccggcggcguggcc

SEQ ID NO: 327604 - RNA, 15 nt, Bordetella pertussis
cgccggcgggcaggc

SEQ ID NO: 327605 - RNA, 18 nt, Bordetella pertussis
cgccggcgggcaggcggg

SEQ ID NO: 327606 - RNA, 15 nt, Bordetella pertussis
cgccggcggccuccg

SEQ ID NO: 327607 - RNA, 20 nt, Bordetella pertussis
cgccggcggcggucagcgaa

SEQ ID NO: 327608 - RNA, 14 nt, Bordetella pertussis
cgccggcggucacg

SEQ ID NO: 327609 - RNA, 21 nt, Bordetella pertussis
cgccggcggucacgccgauga

SEQ ID NO: 327610 - RNA, 15 nt, Bordetella pertussis
cgccggcgucacgcg

SEQ ID NO: 327611 - RNA, 19 nt, Bordetella pertussis
cgccggcgucacgcggccg

SEQ ID NO: 327612 - RNA, 20 nt, Bordetella pertussis
cgccggcgucacgcggccgg

SEQ ID NO: 327613 - RNA, 22 nt, Bordetella pertussis
cgccggcgucacgcggccgggc

SEQ ID NO: 327614 - RNA, 21 nt, Bordetella pertussis
cgccggcgguaagcguccgcg

SEQ ID NO: 327615 - RNA, 13 nt, Bordetella pertussis
cgccggcgugccc

SEQ ID NO: 327616 - RNA, 15 nt, Bordetella pertussis
cgccggcucaggcca

SEQ ID NO: 327617 - RNA, 16 nt, Bordetella pertussis
cgccggcucaggccag

SEQ ID NO: 327618 - RNA, 19 nt, Bordetella pertussis
cgccggcucaggccagcga

SEQ ID NO: 327619 - RNA, 21 nt, Bordetella pertussis
cgccggcuccgauagcggcgc

SEQ ID NO: 327620 - RNA, 15 nt, Bordetella pertussis
cgccggcucccgcgc

SEQ ID NO: 327621 - RNA, 16 nt, Bordetella pertussis
cgccggcucccgcgcu

SEQ ID NO: 327622 - RNA, 20 nt, Bordetella pertussis
cgccggcucccgcgcugccg

SEQ ID NO: 327623 - RNA, 21 nt, Bordetella pertussis
cgccggcucccgcgcugccgc

SEQ ID NO: 327624 - RNA, 20 nt, Bordetella pertussis
cgccggcucguacggcgucg

SEQ ID NO: 327625 - RNA, 18 nt, Bordetella pertussis
cgccggcuggcaugcggc

SEQ ID NO: 327626 - RNA, 15 nt, Bordetella pertussis
cgccggcuuccagca

SEQ ID NO: 327627 - RNA, 20 nt, Bordetella pertussis
cgccggcuuccagcagcaug

SEQ ID NO: 327628 - RNA, 20 nt, Bordetella pertussis
cgccggcuucgucauggucg

SEQ ID NO: 327629 - RNA, 13 nt, Bordetella pertussis
cgccggcuugcgc

SEQ ID NO: 327630 - RNA, 14 nt, Bordetella pertussis
cgccggcuugcgcc

SEQ ID NO: 327631 - RNA, 15 nt, Bordetella pertussis
cgccggcuugcgcca

SEQ ID NO: 327632 - RNA, 17 nt, Bordetella pertussis
cgccggcuugcgccagc

SEQ ID NO: 327633 - RNA, 18 nt, Bordetella pertussis
cgccggcuugcgccagcc

SEQ ID NO: 327634 - RNA, 18 nt, Bordetella pertussis
cgccggcuuucagcgccg

SEQ ID NO: 327635 - RNA, 21 nt, Bordetella pertussis
cgccggcuuucagcgccgagc

SEQ ID NO: 327636 - RNA, 15 nt, Bordetella pertussis
cgccgggacaggcac

SEQ ID NO: 327637 - RNA, 19 nt, Bordetella pertussis
cgccgggacaggcacccgc

SEQ ID NO: 327638 - RNA, 21 nt, Bordetella pertussis
cgccgggcgaaccgguggcca

SEQ ID NO: 327639 - RNA, 16 nt, Bordetella pertussis
cgccgggcgacggcgu

SEQ ID NO: 327640 - RNA, 17 nt, Bordetella pertussis
cgccgggcgacggcgug

SEQ ID NO: 327641 - RNA, 12 nt, Bordetella pertussis
cgccgggacgga

SEQ ID NO: 327642 - RNA, 15 nt, Bordetella pertussis
cgccgggcgccgcgc

SEQ ID NO: 327643 - RNA, 13 nt, Bordetella pertussis
cgccgggcgcgcu

SEQ ID NO: 327644 - RNA, 13 nt, Bordetella pertussis
cgccgggcgcggc

SEQ ID NO: 327645 - RNA, 17 nt, Bordetella pertussis
cgccgggcgcggccagg

SEQ ID NO: 327646 - RNA, 18 nt, Bordetella pertussis
cgccgggcgcggccaggc

SEQ ID NO: 327647 - RNA, 21 nt, Bordetella pertussis
cgccgggcgcggcccggcguc

SEQ ID NO: 327648 - RNA, 17 nt, Bordetella pertussis
cgccgggcgcggccgcc

SEQ ID NO: 327649 - RNA, 19 nt, Bordetella pertussis
cgccgggcgcggccgccgc

SEQ ID NO: 327650 - RNA, 17 nt, Bordetella pertussis
cgccgggcgcguggccc

SEQ ID NO: 327651 - RNA, 21 nt, Bordetella pertussis
cgccgggcgcguggcccgcgc

SEQ ID NO: 327652 - RNA, 12 nt, Bordetella pertussis
cgccgggcgcgc

SEQ ID NO: 327653 - RNA, 14 nt, Bordetella pertussis
cgccgggcgcgccg

SEQ ID NO: 327654 - RNA, 15 nt, Bordetella pertussis
cgccgggcgcgccgg

SEQ ID NO: 327655 - RNA, 18 nt, Bordetella pertussis
cgccgggcgcgccggcgg

SEQ ID NO: 327656 - RNA, 18 nt, Bordetella pertussis
cgccgggcggcgcgggcg

SEQ ID NO: 327657 - RNA, 22 nt, Bordetella pertussis
cgccgggcggcgcgggcggcua

SEQ ID NO: 327658 - RNA, 20 nt, Bordetella pertussis
cgccgggcgcgcgccggcgg

SEQ ID NO: 327659 - RNA, 19 nt, Bordetella pertussis
cgccgggcuggauccggcg

SEQ ID NO: 327660 - RNA, 16 nt, Bordetella pertussis
cgccgggcuguccgcc

SEQ ID NO: 327661 - RNA, 19 nt, Bordetella pertussis
cgccgggcuguccgccacc

SEQ ID NO: 327662 - RNA, 20 nt, Bordetella pertussis
cgccgggcuguccgccacca

SEQ ID NO: 327663 - RNA, 17 nt, Bordetella pertussis
cgccggggaggccucga

SEQ ID NO: 327664 - RNA, 21 nt, Bordetella pertussis
cgccggggaggccucgacgcu

SEQ ID NO: 327665 - RNA, 22 nt, Bordetella pertussis
cgccggggaggccucgacgcug

SEQ ID NO: 327666 - RNA, 17 nt, Bordetella pertussis
cgccggguccggccgcg

SEQ ID NO: 327667 - RNA, 19 nt, Bordetella pertussis
cgccggguccggccgcgca

SEQ ID NO: 327668 - RNA, 22 nt, Bordetella pertussis
cgccggguccggccgcgcaagg

SEQ ID NO: 327669 - RNA, 16 nt, Bordetella pertussis
cgccgggucgaggucg

SEQ ID NO: 327670 - RNA, 17 nt, Bordetella pertussis
cgccgggucgaggucga

SEQ ID NO: 327671 - RNA, 18 nt, Bordetella pertussis
cgccgguagcgcugggcg

SEQ ID NO: 327672 - RNA, 20 nt, Bordetella pertussis
cgccgguagcgcugggcgcc

SEQ ID NO: 327673 - RNA, 21 nt, Bordetella pertussis
cgccgguagcgcugggcgcca

SEQ ID NO: 327674 - RNA, 15 nt, Bordetella pertussis
cgccggucaccgccg

SEQ ID NO: 327675 - RNA, 15 nt, Bordetella pertussis
cgccggucacgcugg

SEQ ID NO: 327676 - RNA, 16 nt, Bordetella pertussis
cgccggucacgcuggu

SEQ ID NO: 327677 - RNA, 19 nt, Bordetella pertussis
cgccggucacgcugguggc

SEQ ID NO: 327678 - RNA, 21 nt, Bordetella pertussis
cgccggucacgcugguggcca

SEQ ID NO: 327679 - RNA, 23 nt, Bordetella pertussis
cgccggucacguacucgccgucg

SEQ ID NO: 327680 - RNA, 17 nt, Bordetella pertussis
cgccggucaugcaccug

SEQ ID NO: 327681 - RNA, 14 nt, Bordetella pertussis
cgccggugcgcggc

SEQ ID NO: 327682 - RNA, 17 nt, Bordetella pertussis
cgccggugcgcggcgcc

SEQ ID NO: 327683 - RNA, 14 nt, Bordetella pertussis
cgccgguggccagc

SEQ ID NO: 327684 - RNA, 15 nt, Bordetella pertussis
cgccgguggccagca

SEQ ID NO: 327685 - RNA, 16 nt, Bordetella pertussis
cgccgguggccagcag

SEQ ID NO: 327686 - RNA, 17 nt, Bordetella pertussis
cgccgguggccagcagc

SEQ ID NO: 327687 - RNA, 18 nt, Bordetella pertussis
cgccgguggccagcagcu

SEQ ID NO: 327688 - RNA, 20 nt, Bordetella pertussis
cgccgguggccagcagcugu

SEQ ID NO: 327689 - RNA, 19 nt, Bordetella pertussis
cgccgguguagcugcccgc

SEQ ID NO: 327690 - RNA, 13 nt, Bordetella pertussis
cgccggugucggc

SEQ ID NO: 327691 - RNA, 17 nt, Bordetella pertussis
cgccggugucggggccg

SEQ ID NO: 327692 - RNA, 18 nt, Bordetella pertussis
cgccggugucggggccgg

SEQ ID NO: 327693 - RNA, 20 nt, Bordetella pertussis
cgccggugucggggccgggc

SEQ ID NO: 327694 - RNA, 23 nt, Bordetella pertussis
cgccggugucggggccgggccgg

SEQ ID NO: 327695 - RNA, 18 nt, Bordetella pertussis
cgccgucgagcugcucga

SEQ ID NO: 327696 - RNA, 24 nt, Bordetella pertussis
cgccgucgagcugcucgagcaugc

SEQ ID NO: 327697 - RNA, 22 nt, Bordetella pertussis
cgccgucgagcaucccggcgcu

SEQ ID NO: 327698 - RNA, 18 nt, Bordetella pertussis
cgccgucgaucccaucgc

SEQ ID NO: 327699 - RNA, 17 nt, Bordetella pertussis
cgccgucgcccuggcgg

SEQ ID NO: 327700 - RNA, 18 nt, Bordetella pertussis
cgccgucgcccuggcggc

SEQ ID NO: 327701 - RNA, 19 nt, Bordetella pertussis
cgccgucgcccuggcggcg

SEQ ID NO: 327702 - RNA, 17 nt, Bordetella pertussis
cgccgucgggggccggc

SEQ ID NO: 327703 - RNA, 18 nt, Bordetella pertussis
cgccgucguugacgggga

SEQ ID NO: 327704 - RNA, 13 nt, Bordetella pertussis
cgccguggccaag

SEQ ID NO: 327705 - RNA, 20 nt, Bordetella pertussis
cgccguggccaagggcgccg

SEQ ID NO: 327706 - RNA, 19 nt, Bordetella pertussis
cgccguggcguugacggcc

SEQ ID NO: 327707 - RNA, 20 nt, Bordetella pertussis
cgccguggcguugacggccc

SEQ ID NO: 327708 - RNA, 19 nt, Bordetella pertussis
cgccguggugcugaccggc

SEQ ID NO: 327709 - RNA, 22 nt, Bordetella pertussis
cgccguggugcugaccggcuuc

SEQ ID NO: 327710 - RNA, 15 nt, Bordetella pertussis
cgccguugcggcccg

SEQ ID NO: 327711 - RNA, 19 nt, Bordetella pertussis
cgccguugcgggcugcgcg

SEQ ID NO: 327712 - RNA, 21 nt, Bordetella pertussis
cgccguugcgggcugcgcggg

SEQ ID NO: 327713 - RNA, 15 nt, Bordetella pertussis
cgccguugcucgcgc

SEQ ID NO: 327714 - RNA, 21 nt, Bordetella pertussis
cgccuccaucagcagcaccuu

SEQ ID NO: 327715 - RNA, 15 nt, Bordetella pertussis
cgccucccauugcgc

SEQ ID NO: 327716 - RNA, 18 nt, Bordetella pertussis
cgccucccauugcgcggc

SEQ ID NO: 327717 - RNA, 20 nt, Bordetella pertussis
cgccucccauugcgcggcca

SEQ ID NO: 327718 - RNA, 22 nt, Bordetella pertussis
cgccuccccaggccagcugcgc

SEQ ID NO: 327719 - RNA, 22 nt, Bordetella pertussis
cgccuccagcuccagcgcgccg

SEQ ID NO: 327720 - RNA, 13 nt, Bordetella pertussis
cgccucgcgcucg

SEQ ID NO: 327721 - RNA, 17 nt, Bordetella pertussis
cgccucgcgcucgagcg

SEQ ID NO: 327722 - RNA, 17 nt, Bordetella pertussis
cgccucggcggaugcga

SEQ ID NO: 327723 - RNA, 17 nt, Bordetella pertussis
cgccucggcggccagcg

SEQ ID NO: 327724 - RNA, 18 nt, Bordetella pertussis
cgccucggcggccagcgc

SEQ ID NO: 327725 - RNA, 22 nt, Bordetella pertussis
cgccucggcggccagcgcgccc

SEQ ID NO: 327726 - RNA, 17 nt, Bordetella pertussis
cgccucgggcacggcca

SEQ ID NO: 327727 - RNA, 15 nt, Bordetella pertussis
cgccucgguccagcg

SEQ ID NO: 327728 - RNA, 18 nt, Bordetella pertussis
cgccucguccugcaggcg

SEQ ID NO: 327729 - RNA, 23 nt, Bordetella pertussis
cgccucguccugcaggcggcgca

SEQ ID NO: 327730 - RNA, 16 nt, Bordetella pertussis
cgccugcaccgccgcg

SEQ ID NO: 327731 - RNA, 15 nt, Bordetella pertussis
cgccugcagcagcgg

SEQ ID NO: 327732 - RNA, 17 nt, Bordetella pertussis
cgccugcagcagcgugg

SEQ ID NO: 327733 - RNA, 15 nt, Bordetella pertussis
cgccugcagcgccgc

SEQ ID NO: 327734 - RNA, 23 nt, Bordetella pertussis
cgccugcaggaaauacucgagcc

SEQ ID NO: 327735 - RNA, 12 nt, Bordetella pertussis
cgccugccagaa

SEQ ID NO: 327736 - RNA, 21 nt, Bordetella pertussis
cgccugccagaacagccgcga

SEQ ID NO: 327737 - RNA, 15 nt, Bordetella pertussis
cgccugcgccaccug

SEQ ID NO: 327738 - RNA, 17 nt, Bordetella pertussis
cgccugcgccacgucca

SEQ ID NO: 327739 - RNA, 23 nt, Bordetella pertussis
cgccugcgccacguccagcacgg

SEQ ID NO: 327740 - RNA, 14 nt, Bordetella pertussis
cgccugcgccaggu

SEQ ID NO: 327741 - RNA, 17 nt, Bordetella pertussis
cgccugcauguccagcg

SEQ ID NO: 327742 - RNA, 19 nt, Bordetella pertussis
cgccugcgcggccucguag

SEQ ID NO: 327743 - RNA, 13 nt, Bordetella pertussis
cgccugcgcgccg

SEQ ID NO: 327744 - RNA, 17 nt, Bordetella pertussis
cgccugcggacggcggg

SEQ ID NO: 327745 - RNA, 20 nt, Bordetella pertussis
cgccugcggacggcgggcgc

SEQ ID NO: 327746 - RNA, 18 nt, Bordetella pertussis
cgccugcggcaggccgca

SEQ ID NO: 327747 - RNA, 21 nt, Bordetella pertussis
cgccugcggcaggccgcagcg

SEQ ID NO: 327748 - RNA, 17 nt, Bordetella pertussis
cgccugcggcauggugu

SEQ ID NO: 327749 - RNA, 14 nt, Bordetella pertussis
cgccugcggcgcgg

SEQ ID NO: 327750 - RNA, 17 nt, Bordetella pertussis
cgccugcggcgcggccg

SEQ ID NO: 327751 - RNA, 14 nt, Bordetella pertussis
cgccugcggggccg

SEQ ID NO: 327752 - RNA, 14 nt, Bordetella pertussis
cgccugcguggcgg

SEQ ID NO: 327753 - RNA, 19 nt, Bordetella pertussis
cgccuggcacgacguggcc

SEQ ID NO: 327754 - RNA, 14 nt, Bordetella pertussis
cgccuggccgagcg

SEQ ID NO: 327755 - RNA, 15 nt, Bordetella pertussis
cgccuggccgagcgc

SEQ ID NO: 327756 - RNA, 21 nt, Bordetella pertussis
cgccuggccgagcgcggcaug

SEQ ID NO: 327757 - RNA, 13 nt, Bordetella pertussis
cgccuggccgccc

SEQ ID NO: 327758 - RNA, 17 nt, Bordetella pertussis
cgccuggccgcccagcg

SEQ ID NO: 327759 - RNA, 13 nt, Bordetella pertussis
cgccuggccggcu

SEQ ID NO: 327760 - RNA, 14 nt, Bordetella pertussis
cgccuggccuucgc

SEQ ID NO: 327761 - RNA, 22 nt, Bordetella pertussis
cgccuggcgcaugacggcgucg

SEQ ID NO: 327762 - RNA, 13 nt, Bordetella pertussis
cgccuggcgcggc

SEQ ID NO: 327763 - RNA, 17 nt, Bordetella pertussis
cgccuggcgcggcccca

SEQ ID NO: 327764 - RNA, 19 nt, Bordetella pertussis
cgccuggcgcggccccaug

SEQ ID NO: 327765 - RNA, 14 nt, Bordetella pertussis
cgccuggcgcggcg

SEQ ID NO: 327766 - RNA, 15 nt, Bordetella pertussis
cgccuggcgcggcgc

SEQ ID NO: 327767 - RNA, 16 nt, Bordetella pertussis
cgccuggcgcggcgcc

SEQ ID NO: 327768 - RNA, 12 nt, Bordetella pertussis
cgccuggcgccg

SEQ ID NO: 327769 - RNA, 14 nt, Bordetella pertussis
cgccuggcggcugg

SEQ ID NO: 327770 - RNA, 23 nt, Bordetella pertussis
cgccuggcgggccugggcgucga

SEQ ID NO: 327771 - RNA, 12 nt, Bordetella pertussis
cgccugggcggc

SEQ ID NO: 327772 - RNA, 14 nt, Bordetella pertussis
cgccugggcggcca

SEQ ID NO: 327773 - RNA, 16 nt, Bordetella pertussis
cgccugggcggccacg

SEQ ID NO: 327774 - RNA, 16 nt, Bordetella pertussis
cgccuggggcgggcgc

SEQ ID NO: 327775 - RNA, 22 nt, Bordetella pertussis
cgccuggggcgggcgcugcgcg

SEQ ID NO: 327776 - RNA, 14 nt, Bordetella pertussis
cgccuggucgcgcg

SEQ ID NO: 327777 - RNA, 17 nt, Bordetella pertussis
cgccuggucgcgcgccu

SEQ ID NO: 327778 - RNA, 15 nt, Bordetella pertussis
cgccuggucgcuggc

SEQ ID NO: 327779 - RNA, 19 nt, Bordetella pertussis
cgccuggucgcuggcgccg

SEQ ID NO: 327780 - RNA, 14 nt, Bordetella pertussis
cgccuggucgacgc

SEQ ID NO: 327781 - RNA, 16 nt, Bordetella pertussis
cgccuggucgacgccg

SEQ ID NO: 327782 - RNA, 17 nt, Bordetella pertussis
cgccuggucgacgccgg

SEQ ID NO: 327783 - RNA, 18 nt, Bordetella pertussis
cgccuggucgacgccggc

SEQ ID NO: 327784 - RNA, 20 nt, Bordetella pertussis
cgccuggucgacgccggcga

SEQ ID NO: 327785 - RNA, 17 nt, Bordetella pertussis
cgccuguaucagcgccu

SEQ ID NO: 327786 - RNA, 17 nt, Bordetella pertussis
cgccuguaucugcgccg

SEQ ID NO: 327787 - RNA, 15 nt, Bordetella pertussis
cgccugucccgcugg

SEQ ID NO: 327788 - RNA, 20 nt, Bordetella pertussis
cgccugucccugaacguggc

SEQ ID NO: 327789 - RNA, 23 nt, Bordetella pertussis
cgccuguccccgcugcggcaagg

SEQ ID NO: 327790 - RNA, 16 nt, Bordetella pertussis
cgccugugccagcugg

SEQ ID NO: 327791 - RNA, 17 nt, Bordetella pertussis
cgccugugccagcuggc

SEQ ID NO: 327792 - RNA, 17 nt, Bordetella pertussis
cgccuguuuuggcgcac

SEQ ID NO: 327793 - RNA, 18 nt, Bordetella pertussis
cgccuguuuuggcgcacg

SEQ ID NO: 327794 - RNA, 22 nt, Bordetella pertussis
cgccuguuuuggcgcacgccgg

SEQ ID NO: 327795 - RNA, 19 nt, Bordetella pertussis
cgccuuacuucuugcgcau

SEQ ID NO: 327796 - RNA, 23 nt, Bordetella pertussis
cgccuuacuucuugcgcaucggc

SEQ ID NO: 327797 - RNA, 19 nt, Bordetella pertussis
cgccuucagcgggccggca

SEQ ID NO: 327798 - RNA, 22 nt, Bordetella pertussis
cgccuucagcgggccggcacca

SEQ ID NO: 327799 - RNA, 17 nt, Bordetella pertussis
cgccuucaccggcccca

SEQ ID NO: 327800 - RNA, 20 nt, Bordetella pertussis
cgccuuccggcagcggccag

SEQ ID NO: 327801 - RNA, 22 nt, Bordetella pertussis
cgccuuccggcagcggccagcg

SEQ ID NO: 327802 - RNA, 21 nt, Bordetella pertussis
cgccuuccugggcgccggcgg

SEQ ID NO: 327803 - RNA, 20 nt, Bordetella pertussis
cgccuuccuugaacugcgcg

SEQ ID NO: 327804 - RNA, 17 nt, Bordetella pertussis
cgccuucgaggccggcg

SEQ ID NO: 327805 - RNA, 19 nt, Bordetella pertussis
cgccuucgaggccggcguc

SEQ ID NO: 327806 - RNA, 22 nt, Bordetella pertussis
cgccuucgaucuucucgccgcg

SEQ ID NO: 327807 - RNA, 16 nt, Bordetella pertussis
cgccuucgcgauccag

SEQ ID NO: 327808 - RNA, 14 nt, Bordetella pertussis
cgccuucgccgugg

SEQ ID NO: 327809 - RNA, 13 nt, Bordetella pertussis
cgccuucggcagg

SEQ ID NO: 327810 - RNA, 17 nt, Bordetella pertussis
cgccuucggcaggcgcc

SEQ ID NO: 327811 - RNA, 20 nt, Bordetella pertussis
cgccuucggcaggcgccggc

SEQ ID NO: 327812 - RNA, 13 nt, Bordetella pertussis
cgccuucggcgac

SEQ ID NO: 327813 - RNA, 15 nt, Bordetella pertussis
cgccuucggcgcgca

SEQ ID NO: 327814 - RNA, 14 nt, Bordetella pertussis
cgccuucggcgcgg

SEQ ID NO: 327815 - RNA, 16 nt, Bordetella pertussis
cgccuucggcgcggcg

SEQ ID NO: 327816 - RNA, 13 nt, Bordetella pertussis
cgccuucggcggc

SEQ ID NO: 327817 - RNA, 18 nt, Bordetella pertussis
cgccuucggcggcgaugg

SEQ ID NO: 327818 - RNA, 16 nt, Bordetella pertussis
cgccuucggcggcggg

SEQ ID NO: 327819 - RNA, 23 nt, Bordetella pertussis
cgccuucgucgaggucagcggcu

SEQ ID NO: 327820 - RNA, 18 nt, Bordetella pertussis
cgccuucgucgcgcaccc

SEQ ID NO: 327821 - RNA, 21 nt, Bordetella pertussis
cgccuugacgaucucggcguu

SEQ ID NO: 327822 - RNA, 21 nt, Bordetella pertussis
cgccuugcccgggcuggccgc

SEQ ID NO: 327823 - RNA, 22 nt, Bordetella pertussis
cgccuugcccgggcuggccgcc

SEQ ID NO: 327824 - RNA, 13 nt, Bordetella pertussis
cgccuugccgccg

SEQ ID NO: 327825 - RNA, 17 nt, Bordetella pertussis
cgccuugccgccgugcg

SEQ ID NO: 327826 - RNA, 21 nt, Bordetella pertussis
cgccuugccuugcgcggccac

SEQ ID NO: 327827 - RNA, 14 nt, Bordetella pertussis
cgccuugcgcggcg

SEQ ID NO: 327828 - RNA, 19 nt, Bordetella pertussis
cgcgaacaacgggaucggc

SEQ ID NO: 327829 - RNA, 13 nt, Bordetella pertussis
cgcgaaccaggcc

SEQ ID NO: 327830 - RNA, 18 nt, Bordetella pertussis
cgcgaaccaggccugcgg

SEQ ID NO: 327831 - RNA, 16 nt, Bordetella pertussis
cgcgaagaucccgccg

SEQ ID NO: 327832 - RNA, 17 nt, Bordetella pertussis
cgcgaagcagccggcca

SEQ ID NO: 327833 - RNA, 17 nt, Bordetella pertussis
cgcgaagcgcgccagca

SEQ ID NO: 327834 - RNA, 19 nt, Bordetella pertussis
cgcgaagcgcgccagcagc

SEQ ID NO: 327835 - RNA, 13 nt, Bordetella pertussis
cgcgaagcgcccu

SEQ ID NO: 327836 - RNA, 13 nt, Bordetella pertussis
cgcgaagcgcugg

SEQ ID NO: 327837 - RNA, 22 nt, Bordetella pertussis
cgcgaaggcuucgucgaccagc

SEQ ID NO: 327838 - RNA, 22 nt, Bordetella pertussis
cgcgacaaauagccgaccgcgc

SEQ ID NO: 327839 - RNA, 20 nt, Bordetella pertussis
cgcgaccaccagcaccaugc

SEQ ID NO: 327840 - RNA, 16 nt, Bordetella pertussis
cgcgaccaccaggucg

SEQ ID NO: 327841 - RNA, 19 nt, Bordetella pertussis
cgcgaccacggucuggcgc

SEQ ID NO: 327842 - RNA, 21 nt, Bordetella pertussis
cgcgaccacggucuggcgcga

SEQ ID NO: 327843 - RNA, 19 nt, Bordetella pertussis
cgcgaccagcuucugcgcc

SEQ ID NO: 327844 - RNA, 14 nt, Bordetella pertussis
cgcgaccaggcugg

SEQ ID NO: 327845 - RNA, 15 nt, Bordetella pertussis
cgcgaccaggcugga

SEQ ID NO: 327846 - RNA, 23 nt, Bordetella pertussis
cgcgacccagaacccggccggcg

SEQ ID NO: 327847 - RNA, 16 nt, Bordetella pertussis
cgcgaccaugcggccg

SEQ ID NO: 327848 - RNA, 19 nt, Bordetella pertussis
cgcgacccgauagccgcgc

SEQ ID NO: 327849 - RNA, 23 nt, Bordetella pertussis
cgcgacccgauagccgcgcgccu

SEQ ID NO: 327850 - RNA, 14 nt, Bordetella pertussis
cgcgaccgccaagc

SEQ ID NO: 327851 - RNA, 15 nt, Bordetella pertussis
cgcgaccgcgcggcg

SEQ ID NO: 327852 - RNA, 17 nt, Bordetella pertussis
cgcgaccgcgcggcgcu

SEQ ID NO: 327853 - RNA, 12 nt, Bordetella pertussis
cgcgcaagccgc

SEQ ID NO: 327854 - RNA, 14 nt, Bordetella pertussis
cgcgcaagccgccg

SEQ ID NO: 327855 - RNA, 14 nt, Bordetella pertussis
cgcgcaagccgcug

SEQ ID NO: 327856 - RNA, 13 nt, Bordetella pertussis
cgcgcaaggcggc

SEQ ID NO: 327857 - RNA, 16 nt, Bordetella pertussis
cgcgcaaggcggcccg

SEQ ID NO: 327858 - RNA, 18 nt, Bordetella pertussis
cgcgcaaggcggcccggc

SEQ ID NO: 327859 - RNA, 19 nt, Bordetella pertussis
cgcgcaaggcggcccggcc

SEQ ID NO: 327860 - RNA, 15 nt, Bordetella pertussis
cgcgcaagggccagu

SEQ ID NO: 327861 - RNA, 14 nt, Bordetella pertussis
cgcgcaagguggcg

SEQ ID NO: 327862 - RNA, 17 nt, Bordetella pertussis
cgcgcaauacgccgccg

SEQ ID NO: 327863 - RNA, 18 nt, Bordetella pertussis
cgcgcaauacgccgccgg

SEQ ID NO: 327864 - RNA, 19 nt, Bordetella pertussis
cgcgcaauacgccgccggc

SEQ ID NO: 327865 - RNA, 21 nt, Bordetella pertussis
cgcgcaauacgccgccggcgc

SEQ ID NO: 327866 - RNA, 18 nt, Bordetella pertussis
cgcgcacaaacgcacgau

SEQ ID NO: 327867 - RNA, 20 nt, Bordetella pertussis
cgcgcacacuggccagcaag

SEQ ID NO: 327868 - RNA, 18 nt, Bordetella pertussis
cgcgcacagcauggccac

SEQ ID NO: 327869 - RNA, 22 nt, Bordetella pertussis
cgcgcacagcauggccaccagg

SEQ ID NO: 327870 - RNA, 12 nt, Bordetella pertussis
cgcgcacagcgc

SEQ ID NO: 327871 - RNA, 14 nt, Bordetella pertussis
cgcgcacagcgcgc

SEQ ID NO: 327872 - RNA, 22 nt, Bordetella pertussis
cgcgcacagcgcggcgaugccc

SEQ ID NO: 327873 - RNA, 14 nt, Bordetella pertussis
cgcgcacaagcgcg

SEQ ID NO: 327874 - RNA, 13 nt, Bordetella pertussis
cgcgcacauccag

SEQ ID NO: 327875 - RNA, 18 nt, Bordetella pertussis
cgcgcaccaccuggcuga

SEQ ID NO: 327876 - RNA, 12 nt, Bordetella pertussis
cgcgcaccagcc

SEQ ID NO: 327877 - RNA, 16 nt, Bordetella pertussis
cgcgcaccagcccgcc

SEQ ID NO: 327878 - RNA, 18 nt, Bordetella pertussis
cgcgcaccagcccgcccg

SEQ ID NO: 327879 - RNA, 18 nt, Bordetella pertussis
cgcgcaccaggccugccu

SEQ ID NO: 327880 - RNA, 15 nt, Bordetella pertussis
cgcgcaccaugggcg

SEQ ID NO: 327881 - RNA, 13 nt, Bordetella pertussis
cgcgcaccaccug

SEQ ID NO: 327882 - RNA, 16 nt, Bordetella pertussis
cgcgcaccgacaccaa

SEQ ID NO: 327883 - RNA, 20 nt, Bordetella pertussis
cgcgcaccgaggugccggcg

SEQ ID NO: 327884 - RNA, 22 nt, Bordetella pertussis
cgcgcaccgaggugccggcggu

SEQ ID NO: 327885 - RNA, 19 nt, Bordetella pertussis
cgcgcaccgcaugggccag

SEQ ID NO: 327886 - RNA, 15 nt, Bordetella pertussis
cgcgcaccgccugcg

SEQ ID NO: 327887 - RNA, 22 nt, Bordetella pertussis
cgcgcaccugggaggggccggc

SEQ ID NO: 327888 - RNA, 21 nt, Bordetella pertussis
cgcgcaccugggcgucgaucu

SEQ ID NO: 327889 - RNA, 23 nt, Bordetella pertussis
cgcgcaccuguucggcggcgccc

SEQ ID NO: 327890 - RNA, 22 nt, Bordetella pertussis
cgcgcacgaagccgaugcgccg

SEQ ID NO: 327891 - RNA, 18 nt, Bordetella pertussis
cgcgcacgaccaccagcg

SEQ ID NO: 327892 - RNA, 20 nt, Bordetella pertussis
cgcgcacgauggggcagcca

SEQ ID NO: 327893 - RNA, 13 nt, Bordetella pertussis
cgcgcacgcccgc

SEQ ID NO: 327894 - RNA, 14 nt, Bordetella pertussis
cgcgcacgcccgcg

SEQ ID NO: 327895 - RNA, 15 nt, Bordetella pertussis
cgcgcacgcccgcga

SEQ ID NO: 327896 - RNA, 17 nt, Bordetella pertussis
cgcgcacgcccgcgacg

SEQ ID NO: 327897 - RNA, 18 nt, Bordetella pertussis
cgcgcacgcgcucgggca

SEQ ID NO: 327898 - RNA, 17 nt, Bordetella pertussis
cgcgcacgcuggcaucg

SEQ ID NO: 327899 - RNA, 15 nt, Bordetella pertussis
cgcgcacggccagca

SEQ ID NO: 327900 - RNA, 18 nt, Bordetella pertussis
cgcgcacggccagcaucg

SEQ ID NO: 327901 - RNA, 17 nt, Bordetella pertussis
cgcgcacggcgcccugc

SEQ ID NO: 327902 - RNA, 12 nt, Bordetella pertussis
cgcgcacgggcg

SEQ ID NO: 327903 - RNA, 18 nt, Bordetella pertussis
cgcgcacguggaccaggg

SEQ ID NO: 327904 - RNA, 13 nt, Bordetella pertussis
cgcgcagacgcgc

SEQ ID NO: 327905 - RNA, 19 nt, Bordetella pertussis
cgcgcagacgcgcucaggc

SEQ ID NO: 327906 - RNA, 23 nt, Bordetella pertussis
cgcgcagacgcgcucaggcggug

SEQ ID NO: 327907 - RNA, 16 nt, Bordetella pertussis
cgcgcagaucccaggc

SEQ ID NO: 327908 - RNA, 16 nt, Bordetella pertussis
cgcgcagcaacccgcc

SEQ ID NO: 327909 - RNA, 18 nt, Bordetella pertussis
cgcgcagcaacccgcccg

SEQ ID NO: 327910 - RNA, 20 nt, Bordetella pertussis
cgcgcagcaacccgcccggg

SEQ ID NO: 327911 - RNA, 19 nt, Bordetella pertussis
cgcgcagcaagucagcccg

SEQ ID NO: 327912 - RNA, 22 nt, Bordetella pertussis
cgcgcagcaauucaagccgcac

SEQ ID NO: 327913 - RNA, 14 nt, Bordetella pertussis
cgcgcagcaccgcc

SEQ ID NO: 327914 - RNA, 20 nt, Bordetella pertussis
cgcgcagcaccgccagcgcg

SEQ ID NO: 327915 - RNA, 16 nt, Bordetella pertussis
cgcgcagcaccggcgu

SEQ ID NO: 327916 - RNA, 15 nt, Bordetella pertussis
cgcgcagcacgcccg

SEQ ID NO: 327917 - RNA, 16 nt, Bordetella pertussis
cgcgcagcacgcccgc

SEQ ID NO: 327918 - RNA, 15 nt, Bordetella pertussis
cgcgcagcacgcugc

SEQ ID NO: 327919 - RNA, 22 nt, Bordetella pertussis
cgcgcagcagacgcuucaggcc

SEQ ID NO: 327920 - RNA, 14 nt, Bordetella pertussis
cgcgcagcagcgca

SEQ ID NO: 327921 - RNA, 16 nt, Bordetella pertussis
cgcgcagcagcgcaac

SEQ ID NO: 327922 - RNA, 12 nt, Bordetella pertussis
cgcgcagcagcu

SEQ ID NO: 327923 - RNA, 13 nt, Bordetella pertussis
cgcgcagcaggcc

SEQ ID NO: 327924 - RNA, 14 nt, Bordetella pertussis
cgcgcagcaggccc

SEQ ID NO: 327925 - RNA, 15 nt, Bordetella pertussis
cgcgcagcaggccca

SEQ ID NO: 327926 - RNA, 21 nt, Bordetella pertussis
cgcgcagcaggcccaugccgc

SEQ ID NO: 327927 - RNA, 15 nt, Bordetella pertussis
cgcgcagcaggccgc

SEQ ID NO: 327928 - RNA, 17 nt, Bordetella pertussis
cgcgcagcaggccgcgc

SEQ ID NO: 327929 - RNA, 15 nt, Bordetella pertussis
cgcgcagcaggccgu

SEQ ID NO: 327930 - RNA, 13 nt, Bordetella pertussis
cgcgcagcagggu

SEQ ID NO: 327931 - RNA, 20 nt, Bordetella pertussis
cgcgcagcaggguggccacg

SEQ ID NO: 327932 - RNA, 21 nt, Bordetella pertussis
cgcgcagcaggguggccacgc

SEQ ID NO: 327933 - RNA, 13 nt, Bordetella pertussis
cgcgcagcacgau

SEQ ID NO: 327934 - RNA, 14 nt, Bordetella pertussis
cgcgcagcacgaug

SEQ ID NO: 327935 - RNA, 16 nt, Bordetella pertussis
cgcgcagccacagcgc

SEQ ID NO: 327936 - RNA, 14 nt, Bordetella pertussis
cgcgcagccaggua

SEQ ID NO: 327937 - RNA, 23 nt, Bordetella pertussis
cgcgcagccagguaagcuggcgc

SEQ ID NO: 327938 - RNA, 16 nt, Bordetella pertussis
cgcgcagcccggcgug

SEQ ID NO: 327939 - RNA, 14 nt, Bordetella pertussis
cgcgcagccgacag

SEQ ID NO: 327940 - RNA, 18 nt, Bordetella pertussis
cgcgcagccgacaggcgc

SEQ ID NO: 327941 - RNA, 14 nt, Bordetella pertussis
cgcgcagccgcgcc

SEQ ID NO: 327942 - RNA, 15 nt, Bordetella pertussis
cgcgcagcgaacggc

SEQ ID NO: 327943 - RNA, 14 nt, Bordetella pertussis
cgcgcagcgaggcc

SEQ ID NO: 327944 - RNA, 12 nt, Bordetella pertussis
cgcgcagcgccu

SEQ ID NO: 327945 - RNA, 19 nt, Bordetella pertussis
cgcgcagcgccuggccgag

SEQ ID NO: 327946 - RNA, 17 nt, Bordetella pertussis
cgcgcagcgcgaccggg

SEQ ID NO: 327947 - RNA, 14 nt, Bordetella pertussis
cgcgcagcgcgccg

SEQ ID NO: 327948 - RNA, 12 nt, Bordetella pertussis
cgcgcagcggcg

SEQ ID NO: 327949 - RNA, 13 nt, Bordetella pertussis
cgcgcagcgucug

SEQ ID NO: 327950 - RNA, 18 nt, Bordetella pertussis
cgcgcagcugccugagca

SEQ ID NO: 327951 - RNA, 18 nt, Bordetella pertussis
cgcgcagcuugcccgcgc

SEQ ID NO: 327952 - RNA, 18 nt, Bordetella pertussis
cgcgcaggacaaggcgcg

SEQ ID NO: 327953 - RNA, 21 nt, Bordetella pertussis
cgcgcaggacaaggcgcgcgc

SEQ ID NO: 327954 - RNA, 23 nt, Bordetella pertussis
cgcgcaggaucagcuugaugccg

SEQ ID NO: 327955 - RNA, 14 nt, Bordetella pertussis
cgcgcaggccauug

SEQ ID NO: 327956 - RNA, 20 nt, Bordetella pertussis
cgcgcaggccauugcuggcg

SEQ ID NO: 327957 - RNA, 17 nt, Bordetella pertussis
cgcgcaggccucgcccg

SEQ ID NO: 327958 - RNA, 19 nt, Bordetella pertussis
cgcgcaggccucgcccgau

SEQ ID NO: 327959 - RNA, 12 nt, Bordetella pertussis
cgcgcaggcggg

SEQ ID NO: 327960 - RNA, 15 nt, Bordetella pertussis
cgcgcaggcgggccu

SEQ ID NO: 327961 - RNA, 13 nt, Bordetella pertussis
cgcgcagggcggc

SEQ ID NO: 327962 - RNA, 18 nt, Bordetella pertussis
cgcgcagggcggccggca

SEQ ID NO: 327963 - RNA, 17 nt, Bordetella pertussis
cgcgcaggguggcaucg

SEQ ID NO: 327964 - RNA, 14 nt, Bordetella pertussis
cgcgcaggugugcc

SEQ ID NO: 327965 - RNA, 15 nt, Bordetella pertussis
cgcgcaucacgcugg

SEQ ID NO: 327966 - RNA, 20 nt, Bordetella pertussis
cgcgcauccgguggugcugg

SEQ ID NO: 327967 - RNA, 16 nt, Bordetella pertussis
cgcgcaucgcgcggca

SEQ ID NO: 327968 - RNA, 13 nt, Bordetella pertussis
cgcgcaucggccg

SEQ ID NO: 327969 - RNA, 15 nt, Bordetella pertussis
cgcgcaucggcgccg

SEQ ID NO: 327970 - RNA, 22 nt, Bordetella pertussis
cgcgcaucgggauccgugcggc

SEQ ID NO: 327971 - RNA, 23 nt, Bordetella pertussis
cgcgcaucgucaggcaggcgcgc

SEQ ID NO: 327972 - RNA, 24 nt, Bordetella pertussis
cgcgcaucgucaggcaggcgcgcc

SEQ ID NO: 327973 - RNA, 13 nt, Bordetella pertussis
cgcgcaugcagcg

SEQ ID NO: 327974 - RNA, 16 nt, Bordetella pertussis
cgcgcauggacgccgc

SEQ ID NO: 327975 - RNA, 18 nt, Bordetella pertussis
cgcgcauggacugcaggc

SEQ ID NO: 327976 - RNA, 21 nt, Bordetella pertussis
cgcgcauggacugcaggcgcu

SEQ ID NO: 327977 - RNA, 13 nt, Bordetella pertussis
cgcgcaugcgcac

SEQ ID NO: 327978 - RNA, 17 nt, Bordetella pertussis
cgcgcauggcgaugacc

SEQ ID NO: 327979 - RNA, 19 nt, Bordetella pertussis
cgcgcauucgucgcugccg

SEQ ID NO: 327980 - RNA, 20 nt, Bordetella pertussis
cgcgcauuucgaacaaggcg

SEQ ID NO: 327981 - RNA, 19 nt, Bordetella pertussis
cgcgcauuucgaccugcgc

SEQ ID NO: 327982 - RNA, 16 nt, Bordetella pertussis
cgcgccaacccggccu

SEQ ID NO: 327983 - RNA, 18 nt, Bordetella pertussis
cgcgccaacgcacaaggg

SEQ ID NO: 327984 - RNA, 17 nt, Bordetella pertussis
cgcgccaagggcgugcg

SEQ ID NO: 327985 - RNA, 15 nt, Bordetella pertussis
cgcgccacacgggcg

SEQ ID NO: 327986 - RNA, 17 nt, Bordetella pertussis
cgcgccacacgggcgcc

SEQ ID NO: 327987 - RNA, 18 nt, Bordetella pertussis
cgcgccacacgggcgccu

SEQ ID NO: 327988 - RNA, 12 nt, Bordetella pertussis
cgcgccaccacc

SEQ ID NO: 327989 - RNA, 15 nt, Bordetella pertussis
cgcgccaccaccguc

SEQ ID NO: 327990 - RNA, 14 nt, Bordetella pertussis
cgcgccaccaugcc

SEQ ID NO: 327991 - RNA, 24 nt, Bordetella pertussis
cgcgccaccggucgccguccaggc

SEQ ID NO: 327992 - RNA, 12 nt, Bordetella pertussis
cgcgccacggcu

SEQ ID NO: 327993 - RNA, 21 nt, Bordetella pertussis
cgcgccacggcuucgcccagc

SEQ ID NO: 327994 - RNA, 13 nt, Bordetella pertussis
cgcgccagcacgg

SEQ ID NO: 327995 - RNA, 18 nt, Bordetella pertussis
cgcgccagcacgguggcg

SEQ ID NO: 327996 - RNA, 14 nt, Bordetella pertussis
cgcgccagcagcgc

SEQ ID NO: 327997 - RNA, 17 nt, Bordetella pertussis
cgcgccagcagcgccgg

SEQ ID NO: 327998 - RNA, 14 nt, Bordetella pertussis
cgcgccagccgcgc

SEQ ID NO: 327999 - RNA, 18 nt, Bordetella pertussis
cgcgccagccgcgcgacc

SEQ ID NO: 328000 - RNA, 14 nt, Bordetella pertussis
cgcgccagccgcug

SEQ ID NO: 328001 - RNA, 21 nt, Bordetella pertussis
cgcgccagccgcugcagcgac

SEQ ID NO: 328002 - RNA, 13 nt, Bordetella pertussis
cgcgccagcgccg

SEQ ID NO: 328003 - RNA, 13 nt, Bordetella pertussis
cgcgccagcgcgc

SEQ ID NO: 328004 - RNA, 15 nt, Bordetella pertussis
cgcgccagcgcgcga

SEQ ID NO: 328005 - RNA, 14 nt, Bordetella pertussis
cgcgccagcgcggc

SEQ ID NO: 328006 - RNA, 16 nt, Bordetella pertussis
cgcgccagcgcggcca

SEQ ID NO: 328007 - RNA, 16 nt, Bordetella pertussis
cgcgccagcgcggcgg

SEQ ID NO: 328008 - RNA, 19 nt, Bordetella pertussis
cgcgccagcgcggcgggcc

SEQ ID NO: 328009 - RNA, 16 nt, Bordetella pertussis
cgcgccagcgccgcgc

SEQ ID NO: 328010 - RNA, 14 nt, Bordetella pertussis
cgcgccagcgccgg

SEQ ID NO: 328011 - RNA, 17 nt, Bordetella pertussis
cgcgccagcgccggcgc

SEQ ID NO: 328012 - RNA, 13 nt, Bordetella pertussis
cgcgccagcgccu

SEQ ID NO: 328013 - RNA, 15 nt, Bordetella pertussis
cgcgccagcgccugg

SEQ ID NO: 328014 - RNA, 12 nt, Bordetella pertussis
cgcgccagcgcg

SEQ ID NO: 328015 - RNA, 13 nt, Bordetella pertussis
cgcgccagcggcc

SEQ ID NO: 328016 - RNA, 14 nt, Bordetella pertussis
cgcgccagcggccg

SEQ ID NO: 328017 - RNA, 18 nt, Bordetella pertussis
cgcgccagcggccgucgc

SEQ ID NO: 328018 - RNA, 19 nt, Bordetella pertussis
cgcgccagcggcugcuuga

SEQ ID NO: 328019 - RNA, 11 nt, Bordetella pertussis
cgcgccagcuc

SEQ ID NO: 328020 - RNA, 13 nt, Bordetella pertussis
cgcgccagcucgc

SEQ ID NO: 328021 - RNA, 15 nt, Bordetella pertussis
cgcgccagcucgcgc

SEQ ID NO: 328022 - RNA, 20 nt, Bordetella pertussis
cgcgccagcucuucgagcgc

SEQ ID NO: 328023 - RNA, 14 nt, Bordetella pertussis
cgcgccagcugcgc

SEQ ID NO: 328024 - RNA, 19 nt, Bordetella pertussis
cgcgccaggaagcgcgccg

SEQ ID NO: 328025 - RNA, 22 nt, Bordetella pertussis
cgcgccaggaagcgcgccgcgc

SEQ ID NO: 328026 - RNA, 17 nt, Bordetella pertussis
cgcgccaggauggccac

SEQ ID NO: 328027 - RNA, 21 nt, Bordetella pertussis
cgcgccaggauggccacgacc

SEQ ID NO: 328028 - RNA, 18 nt, Bordetella pertussis
cgcgccaggcauucucgg

SEQ ID NO: 328029 - RNA, 13 nt, Bordetella pertussis
cgcgccaggccca

SEQ ID NO: 328030 - RNA, 13 nt, Bordetella pertussis
cgcgccaggccgg

SEQ ID NO: 328031 - RNA, 15 nt, Bordetella pertussis
cgcgccaggcgcaug

SEQ ID NO: 328032 - RNA, 15 nt, Bordetella pertussis
cgcgccaggcgcgca

SEQ ID NO: 328033 - RNA, 22 nt, Bordetella pertussis
cgcgccaggcgguacaggccgg

SEQ ID NO: 328034 - RNA, 16 nt, Bordetella pertussis
cgcgccaggcguagac

SEQ ID NO: 328035 - RNA, 19 nt, Bordetella pertussis
cgcgccaggcguagaccac

SEQ ID NO: 328036 - RNA, 22 nt, Bordetella pertussis
cgcgccaggcguagaccaccug

SEQ ID NO: 328037 - RNA, 16 nt, Bordetella pertussis
cgcgccaggcccaggg

SEQ ID NO: 328038 - RNA, 20 nt, Bordetella pertussis
cgcgccaggcccagggccag

SEQ ID NO: 328039 - RNA, 15 nt, Bordetella pertussis
cgcgccaggccccgc

SEQ ID NO: 328040 - RNA, 17 nt, Bordetella pertussis
cgcgccagggcgccgcg

SEQ ID NO: 328041 - RNA, 18 nt, Bordetella pertussis
cgcgccagguaggccggc

SEQ ID NO: 328042 - RNA, 19 nt, Bordetella pertussis
cgcgccagguaggccggcg

SEQ ID NO: 328043 - RNA, 13 nt, Bordetella pertussis
cgcgccaggucgc

SEQ ID NO: 328044 - RNA, 15 nt, Bordetella pertussis
cgcgccaggucgcgc

SEQ ID NO: 328045 - RNA, 20 nt, Bordetella pertussis
cgcgccaggucgcgcaccag

SEQ ID NO: 328046 - RNA, 18 nt, Bordetella pertussis
cgcgccaggugcacggug

SEQ ID NO: 328047 - RNA, 18 nt, Bordetella pertussis
cgcgccaguucaaggcgc

SEQ ID NO: 328048 - RNA, 18 nt, Bordetella pertussis
cgcgccaucacggugucg

SEQ ID NO: 328049 - RNA, 16 nt, Bordetella pertussis
cgcgccauccggcgca

SEQ ID NO: 328050 - RNA, 22 nt, Bordetella pertussis
cgcgccauccugaacgccgcgc

SEQ ID NO: 328051 - RNA, 19 nt, Bordetella pertussis
cgcgccaucgacgggcggc

SEQ ID NO: 328052 - RNA, 22 nt, Bordetella pertussis
cgcgccaucgcgucgacggugc

SEQ ID NO: 328053 - RNA, 15 nt, Bordetella pertussis
cgcgccaugaaagcg

SEQ ID NO: 328054 - RNA, 22 nt, Bordetella pertussis
cgcgccaugaaagcgaacaggg

SEQ ID NO: 328055 - RNA, 20 nt, Bordetella pertussis
cgcgccaugcaacacgacca

SEQ ID NO: 328056 - RNA, 17 nt, Bordetella pertussis
cgcgccaugcucgcgca

SEQ ID NO: 328057 - RNA, 20 nt, Bordetella pertussis
cgcgccaugcucgcgcacag

SEQ ID NO: 328058 - RNA, 13 nt, Bordetella pertussis
cgcgccauggucu

SEQ ID NO: 328059 - RNA, 23 nt, Bordetella pertussis
cgcgccauggugaacggccccgc

SEQ ID NO: 328060 - RNA, 15 nt, Bordetella pertussis
cgcgccaugucgacg

SEQ ID NO: 328061 - RNA, 17 nt, Bordetella pertussis
cgcgccaugucggggcu

SEQ ID NO: 328062 - RNA, 15 nt, Bordetella pertussis
cgcgccauggccggc

SEQ ID NO: 328063 - RNA, 21 nt, Bordetella pertussis
cgcgccauggccggccgccgg

SEQ ID NO: 328064 - RNA, 22 nt, Bordetella pertussis
cgcgccauugccacggcgggcc

SEQ ID NO: 328065 - RNA, 21 nt, Bordetella pertussis
cgcgcccacaggaacaggccg

SEQ ID NO: 328066 - RNA, 13 nt, Bordetella pertussis
cgcgcccaccagg

SEQ ID NO: 328067 - RNA, 13 nt, Bordetella pertussis
cgcgcccagcagc

SEQ ID NO: 328068 - RNA, 17 nt, Bordetella pertussis
cgcgcccagcagcgcca

SEQ ID NO: 328069 - RNA, 15 nt, Bordetella pertussis
cgcgcccagccccgc

SEQ ID NO: 328070 - RNA, 19 nt, Bordetella pertussis
cgcgcccagccccgcggcc

SEQ ID NO: 328071 - RNA, 15 nt, Bordetella pertussis
cgcgcccagccgcgc

SEQ ID NO: 328072 - RNA, 16 nt, Bordetella pertussis
cgcgcccagcugucca

SEQ ID NO: 328073 - RNA, 21 nt, Bordetella pertussis
cgcgcccagcuugaugccgcc

SEQ ID NO: 328074 - RNA, 14 nt, Bordetella pertussis
cgcgcccaggggcc

SEQ ID NO: 328075 - RNA, 22 nt, Bordetella pertussis
cgcgcccaggggccggcgcgcc

SEQ ID NO: 328076 - RNA, 17 nt, Bordetella pertussis
cgcgcccggcggccagg

SEQ ID NO: 328077 - RNA, 21 nt, Bordetella pertussis
cgcgcccggcggccaggccgg

SEQ ID NO: 328078 - RNA, 21 nt, Bordetella pertussis
cgcgcccggucugccacacgc

SEQ ID NO: 328079 - RNA, 21 nt, Bordetella pertussis
cgcgcccguccacggccugcg

SEQ ID NO: 328080 - RNA, 20 nt, Bordetella pertussis
cgcgcccuggcgccgcggcc

SEQ ID NO: 328081 - RNA, 17 nt, Bordetella pertussis
cgcgcccuggcgcggcg

SEQ ID NO: 328082 - RNA, 18 nt, Bordetella pertussis
cgcgcccuggcgcggcgg

SEQ ID NO: 328083 - RNA, 13 nt, Bordetella pertussis
cgcgcccuggggc

SEQ ID NO: 328084 - RNA, 12 nt, Bordetella pertussis
cgcgccgaaaug

SEQ ID NO: 328085 - RNA, 23 nt, Bordetella pertussis
cgcgccgaaaugcacgacgucgu

SEQ ID NO: 328086 - RNA, 16 nt, Bordetella pertussis
cgcgccgaacaccagc

SEQ ID NO: 328087 - RNA, 23 nt, Bordetella pertussis
cgcgccgaacgacuuggcgcaaa

SEQ ID NO: 328088 - RNA, 17 nt, Bordetella pertussis
cgcgccgaagcgcaggc

SEQ ID NO: 328089 - RNA, 14 nt, Bordetella pertussis
cgcgccgaugcgcc

SEQ ID NO: 328090 - RNA, 16 nt, Bordetella pertussis
cgcgccgaugcgccag

SEQ ID NO: 328091 - RNA, 14 nt, Bordetella pertussis
cgcgccgcaggccg

SEQ ID NO: 328092 - RNA, 22 nt, Bordetella pertussis
cgcgccgccagcgcgcgcgagg

SEQ ID NO: 328093 - RNA, 13 nt, Bordetella pertussis
cgcgccgccaggc

SEQ ID NO: 328094 - RNA, 17 nt, Bordetella pertussis
cgcgccgccaggcgcga

SEQ ID NO: 328095 - RNA, 13 nt, Bordetella pertussis
cgcgccgccagcg

SEQ ID NO: 328096 - RNA, 14 nt, Bordetella pertussis
cgcgccgcccacca

SEQ ID NO: 328097 - RNA, 14 nt, Bordetella pertussis
cgcgccgcccacgc

SEQ ID NO: 328098 - RNA, 14 nt, Bordetella pertussis
cgcgccgcccccgc

SEQ ID NO: 328099 - RNA, 17 nt, Bordetella pertussis
cgcgccgcccccgccca

SEQ ID NO: 328100 - RNA, 20 nt, Bordetella pertussis
cgcgccgcccccgcccagca

SEQ ID NO: 328101 - RNA, 14 nt, Bordetella pertussis
cgcgccgcccgcgg

SEQ ID NO: 328102 - RNA, 14 nt, Bordetella pertussis
cgcgccgcgcgcgg

SEQ ID NO: 328103 - RNA, 15 nt, Bordetella pertussis
cgcgccgcgcgcggc

SEQ ID NO: 328104 - RNA, 16 nt, Bordetella pertussis
cgcgccgcgcgcggcg

SEQ ID NO: 328105 - RNA, 14 nt, Bordetella pertussis
cgcgccgcggcaag

SEQ ID NO: 328106 - RNA, 19 nt, Bordetella pertussis
cgcgccgcggcacggggca

SEQ ID NO: 328107 - RNA, 14 nt, Bordetella pertussis
cgcgccgcggcggg

SEQ ID NO: 328108 - RNA, 22 nt, Bordetella pertussis
cgcgccgcgucgguggccagcc

SEQ ID NO: 328109 - RNA, 18 nt, Bordetella pertussis
cgcgccgcuacagcguca

SEQ ID NO: 328110 - RNA, 15 nt, Bordetella pertussis
cgcgccgcugcagcg

SEQ ID NO: 328111 - RNA, 16 nt, Bordetella pertussis
cgcgccgcuggcggcc

SEQ ID NO: 328112 - RNA, 16 nt, Bordetella pertussis
cgcgccgcuggcgucg
